United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 171

SEQ ID NO: 7146865 - DNA, 22 bp, Homo sapiens
cctgctttgagatgggcagcag

SEQ ID NO: 7146866 - DNA, 22 bp, Homo sapiens
cctgctttgagatgggcagcag

SEQ ID NO: 7146867 - DNA, 22 bp, Homo sapiens
cctgctttgctggtaccatcag

SEQ ID NO: 7146868 - DNA, 22 bp, Homo sapiens
cctgctttggcaggcagctcct

SEQ ID NO: 7146869 - DNA, 22 bp, Homo sapiens
cctgctttggcaggcagctcct

SEQ ID NO: 7146870 - DNA, 22 bp, Homo sapiens
cctgctttgctggtaccatcag

SEQ ID NO: 7146871 - DNA, 22 bp, Homo sapiens
tgtaaagacagataaaacagca

SEQ ID NO: 7146872 - DNA, 22 bp, Homo sapiens
tgtaaagacgcttatagcttgc

SEQ ID NO: 7146873 - DNA, 22 bp, Homo sapiens
cctgctgtgtccctggctttct

SEQ ID NO: 7146874 - DNA, 22 bp, Homo sapiens
cctgctgtgtgacgggatgtta

SEQ ID NO: 7146875 - DNA, 20 bp, Homo sapiens
cctgctgtgctttccatgga

SEQ ID NO: 7146876 - DNA, 22 bp, Homo sapiens
cctgctgttttcttcacttcag

SEQ ID NO: 7146877 - DNA, 20 bp, Homo sapiens
cctgctgtttccatggggcc

SEQ ID NO: 7146878 - DNA, 22 bp, Homo sapiens
cctgctgttttcttcacttcag

SEQ ID NO: 7146879 - DNA, 22 bp, Homo sapiens
tgtaatataagcattaatagtt

SEQ ID NO: 7146880 - DNA, 22 bp, Homo sapiens
tgtaatataagcattaatagtt

SEQ ID NO: 7146881 - DNA, 22 bp, Homo sapiens
tgtaagtagtaatggaaggaca

SEQ ID NO: 7146882 - DNA, 21 bp, Homo sapiens
tgtaagtttcatctgaattgg

SEQ ID NO: 7146883 - DNA, 21 bp, Homo sapiens
tgtaagtttcatctgaattgg

SEQ ID NO: 7146884 - DNA, 22 bp, Homo sapiens
tgtaatcattacagtacatgga

SEQ ID NO: 7146885 - DNA, 22 bp, Homo sapiens
tgtaatcatgcatcagttagtt

SEQ ID NO: 7146886 - DNA, 22 bp, Homo sapiens
tgtaatatatataactgtgtgc

SEQ ID NO: 7146887 - DNA, 22 bp, Homo sapiens
tgtaatattgtagtgacagtac

SEQ ID NO: 7146888 - DNA, 22 bp, Homo sapiens
tgtaatgatgtacttagaagga

SEQ ID NO: 7146889 - DNA, 22 bp, Homo sapiens
tgtaatgagtcacttaccttaa

SEQ ID NO: 7146890 - DNA, 22 bp, Homo sapiens
tgtaatggaagtgggattgcat

SEQ ID NO: 7146891 - DNA, 22 bp, Homo sapiens
tgtaatgagaaagagagtgaat

SEQ ID NO: 7146892 - DNA, 22 bp, Homo sapiens
tgtaatgaaatggtacaactgt

SEQ ID NO: 7146893 - DNA, 21 bp, Homo sapiens
tgtaatctaaagaagctcttt

SEQ ID NO: 7146894 - DNA, 22 bp, Homo sapiens
tgtacatagaaaggatacagct

SEQ ID NO: 7146895 - DNA, 22 bp, Homo sapiens
tgtacatagaaaggatacagct

SEQ ID NO: 7146896 - DNA, 19 bp, Homo sapiens
tgtacatatagagctcagt

SEQ ID NO: 7146897 - DNA, 19 bp, Homo sapiens
tgtacatatagagctcagt

SEQ ID NO: 7146898 - DNA, 22 bp, Homo sapiens
tgtacatattcaagcacttcta

SEQ ID NO: 7146899 - DNA, 22 bp, Homo sapiens
tgtacatgaataaaagatcttg

SEQ ID NO: 7146900 - DNA, 22 bp, Homo sapiens
cctggagctcactgggagccgg

SEQ ID NO: 7146901 - DNA, 22 bp, Homo sapiens
cctggagcactctccctggctg

SEQ ID NO: 7146902 - DNA, 22 bp, Homo sapiens
tgtaccaaaaatgtgtcagact

SEQ ID NO: 7146903 - DNA, 22 bp, Homo sapiens
tgtacattgtcactcatcaagt

SEQ ID NO: 7146904 - DNA, 22 bp, Homo sapiens
tgtacatttagagctcaataga

SEQ ID NO: 7146905 - DNA, 22 bp, Homo sapiens
tgtacattttctcagagtttat

SEQ ID NO: 7146906 - DNA, 22 bp, Homo sapiens
tgtacattttctcagagtttat

SEQ ID NO: 7146907 - DNA, 22 bp, Homo sapiens
tgtaatttgcatggctgaatgc

SEQ ID NO: 7146908 - DNA, 22 bp, Homo sapiens
tgtaatttgcatggctgaatgc

SEQ ID NO: 7146909 - DNA, 22 bp, Homo sapiens
tgtaatttcctgatgttagaac

SEQ ID NO: 7146910 - DNA, 22 bp, Homo sapiens
tgtaatgttagaaacaattgct

SEQ ID NO: 7146911 - DNA, 22 bp, Homo sapiens
tgtaattttacgtgacacagtt

SEQ ID NO: 7146912 - DNA, 22 bp, Homo sapiens
tgtacagtggaaaatggattcg

SEQ ID NO: 7146913 - DNA, 22 bp, Homo sapiens
tgtacagtgtagtcatgaggtt

SEQ ID NO: 7146914 - DNA, 22 bp, Homo sapiens
tgtacagttaatcttaagccat

SEQ ID NO: 7146915 - DNA, 18 bp, Homo sapiens
tgtacagttatgagcatt

SEQ ID NO: 7146916 - DNA, 23 bp, Homo sapiens
tgtacagttgtttgactcagctc

SEQ ID NO: 7146917 - DNA, 23 bp, Homo sapiens
tgtacagttgtttgactcagctc

SEQ ID NO: 7146918 - DNA, 22 bp, Homo sapiens
tgtacagttttaactctgaggg

SEQ ID NO: 7146919 - DNA, 22 bp, Homo sapiens
tgtacatacatagatatacaca

SEQ ID NO: 7146920 - DNA, 22 bp, Homo sapiens
tgtacatacatagatatacaca

SEQ ID NO: 7146921 - DNA, 23 bp, Homo sapiens
cctgcctgttctaactccatttc

SEQ ID NO: 7146922 - DNA, 22 bp, Homo sapiens
cctgcctgtctttatcccctgt

SEQ ID NO: 7146923 - DNA, 20 bp, Homo sapiens
cctgcctgtgtttgtgatga

SEQ ID NO: 7146924 - DNA, 22 bp, Homo sapiens
cctgcctgtctttatcccctgt

SEQ ID NO: 7146925 - DNA, 22 bp, Homo sapiens
cctgcctgtctttatcccctgt

SEQ ID NO: 7146926 - DNA, 22 bp, Homo sapiens
cctgcctgtccctcagtccaca

SEQ ID NO: 7146927 - DNA, 22 bp, Homo sapiens
cctgcctgtccctcagtccaca

SEQ ID NO: 7146928 - DNA, 22 bp, Homo sapiens
cctgcctggtgtaagtctaagg

SEQ ID NO: 7146929 - DNA, 22 bp, Homo sapiens
cctgcctgtaagatgggtacaa

SEQ ID NO: 7146930 - DNA, 22 bp, Homo sapiens
cctgcctgtactagagacccag

SEQ ID NO: 7146931 - DNA, 22 bp, Homo sapiens
cctgcctgtactagagacccag

SEQ ID NO: 7146932 - DNA, 22 bp, Homo sapiens
cctgcctgtccctcagtccaca

SEQ ID NO: 7146933 - DNA, 22 bp, Homo sapiens
cctgcctggggacaaaggaggg

SEQ ID NO: 7146934 - DNA, 22 bp, Homo sapiens
cctgcctggggacaaaggaggg

SEQ ID NO: 7146935 - DNA, 22 bp, Homo sapiens
cctgcctgggttcaaatcccag

SEQ ID NO: 7146936 - DNA, 22 bp, Homo sapiens
cctgcctgggctcacttgccag

SEQ ID NO: 7146937 - DNA, 22 bp, Homo sapiens
tgggtcagattgagcccctggt

SEQ ID NO: 7146938 - DNA, 23 bp, Homo sapiens
tgggtcagctgcctccaggacaa

SEQ ID NO: 7146939 - DNA, 23 bp, Homo sapiens
tgggtcagctgcctccaggacaa

SEQ ID NO: 7146940 - DNA, 22 bp, Homo sapiens
tgggtcaggctgggagtcctga

SEQ ID NO: 7146941 - DNA, 22 bp, Homo sapiens
tgggtcagattgagcccctggt

SEQ ID NO: 7146942 - DNA, 22 bp, Homo sapiens
tgggtcagaggacctcgtggcc

SEQ ID NO: 7146943 - DNA, 22 bp, Homo sapiens
tgggtcagaggacctcgtggcc

SEQ ID NO: 7146944 - DNA, 21 bp, Homo sapiens
tgggtcagagggaaagtgtat

SEQ ID NO: 7146945 - DNA, 22 bp, Homo sapiens
tgggtcaggctgggagtcctga

SEQ ID NO: 7146946 - DNA, 22 bp, Homo sapiens
tgggtcagtttgggggccagcc

SEQ ID NO: 7146947 - DNA, 22 bp, Homo sapiens
tgggtcagtttgggggccagcc

SEQ ID NO: 7146948 - DNA, 22 bp, Homo sapiens
tgggtcagtttgggggccagcc

SEQ ID NO: 7146949 - DNA, 22 bp, Homo sapiens
tgggtcagagctgtgctgccca

SEQ ID NO: 7146950 - DNA, 22 bp, Homo sapiens
tgggtcagaggacctcgtggcc

SEQ ID NO: 7146951 - DNA, 22 bp, Homo sapiens
tgggtcagacagccagtgggcc

SEQ ID NO: 7146952 - DNA, 22 bp, Homo sapiens
tgggtcagacagccagtgggcc

SEQ ID NO: 7146953 - DNA, 22 bp, Homo sapiens
tgggtcagagcagacctctgga

SEQ ID NO: 7146954 - DNA, 22 bp, Homo sapiens
tgggtcagagcagacctctgga

SEQ ID NO: 7146955 - DNA, 22 bp, Homo sapiens
tgggtcagagctgtgctgccca

SEQ ID NO: 7146956 - DNA, 22 bp, Homo sapiens
tgggtcactctatcctgcttag

SEQ ID NO: 7146957 - DNA, 22 bp, Homo sapiens
tgggtcagaatcagagagttgc

SEQ ID NO: 7146958 - DNA, 22 bp, Homo sapiens
tgggtcagacagccagtgggcc

SEQ ID NO: 7146959 - DNA, 22 bp, Homo sapiens
tgggtcagacagccagtgggcc

SEQ ID NO: 7146960 - DNA, 22 bp, Homo sapiens
tgggtaggtgctggggattcag

SEQ ID NO: 7146961 - DNA, 22 bp, Homo sapiens
tgggtaggtgctggggattcag

SEQ ID NO: 7146962 - DNA, 22 bp, Homo sapiens
tgggtaggtgctggggattcag

SEQ ID NO: 7146963 - DNA, 22 bp, Homo sapiens
tgggtaggtgctggggattcag

SEQ ID NO: 7146964 - DNA, 22 bp, Homo sapiens
tgggtaggtgtggcctgaatgt

SEQ ID NO: 7146965 - DNA, 22 bp, Homo sapiens
tgggtaggtgtggcctgaatgt

SEQ ID NO: 7146966 - DNA, 22 bp, Homo sapiens
tgggtcacaaaggccagatgat

SEQ ID NO: 7146967 - DNA, 22 bp, Homo sapiens
tgggtcaccacttcagaggaga

SEQ ID NO: 7146968 - DNA, 22 bp, Homo sapiens
tgggtcactatttgcagagacg

SEQ ID NO: 7146969 - DNA, 18 bp, Homo sapiens
cctgccagtctggagcag

SEQ ID NO: 7146970 - DNA, 18 bp, Homo sapiens
cctgccagtctggagcag

SEQ ID NO: 7146971 - DNA, 18 bp, Homo sapiens
cctgccagtctggagcag

SEQ ID NO: 7146972 - DNA, 22 bp, Homo sapiens
cctgccagggccagaggccagc

SEQ ID NO: 7146973 - DNA, 22 bp, Homo sapiens
cctgccagggccagaggccagc

SEQ ID NO: 7146974 - DNA, 22 bp, Homo sapiens
cctgccagggccttggaagaaa

SEQ ID NO: 7146975 - DNA, 22 bp, Homo sapiens
cctgccaggctttgggcttctg

SEQ ID NO: 7146976 - DNA, 22 bp, Homo sapiens
cctgccaggctttcaggtttgg

SEQ ID NO: 7146977 - DNA, 22 bp, Homo sapiens
cctgccaggctttgggcttctg

SEQ ID NO: 7146978 - DNA, 22 bp, Homo sapiens
cctgccagggccagaggccagc

SEQ ID NO: 7146979 - DNA, 22 bp, Homo sapiens
cctgccaggcgagtctaggcca

SEQ ID NO: 7146980 - DNA, 22 bp, Homo sapiens
cctgccaggcgagtctaggcca

SEQ ID NO: 7146981 - DNA, 22 bp, Homo sapiens
cctgccaggcgagtctaggcca

SEQ ID NO: 7146982 - DNA, 22 bp, Homo sapiens
cctgctggacgtggaggagggg

SEQ ID NO: 7146983 - DNA, 22 bp, Homo sapiens
cctgctggacgtggaggagggg

SEQ ID NO: 7146984 - DNA, 22 bp, Homo sapiens
cctgctggacctcaacacattt

SEQ ID NO: 7146985 - DNA, 22 bp, Homo sapiens
cctgctggacgtggaggagggg

SEQ ID NO: 7146986 - DNA, 22 bp, Homo sapiens
cctgctggacgtggaggagggg

SEQ ID NO: 7146987 - DNA, 22 bp, Homo sapiens
cctgctggacaggggtgttcat

SEQ ID NO: 7146988 - DNA, 22 bp, Homo sapiens
cctgctctaaatctcatggaac

SEQ ID NO: 7146989 - DNA, 22 bp, Homo sapiens
cctgctctaaatctcatggaac

SEQ ID NO: 7146990 - DNA, 22 bp, Homo sapiens
tggtctgttcaaggtggctgat

SEQ ID NO: 7146991 - DNA, 22 bp, Homo sapiens
tggtctgttcaaggtggctgat

SEQ ID NO: 7146992 - DNA, 22 bp, Homo sapiens
tggtctgcctggatcacagccc

SEQ ID NO: 7146993 - DNA, 22 bp, Homo sapiens
tggtctgctgaacagccgtatc

SEQ ID NO: 7146994 - DNA, 22 bp, Homo sapiens
tggtctggaactcctggcttca

SEQ ID NO: 7146995 - DNA, 22 bp, Homo sapiens
tggtctggaactcctggcttca

SEQ ID NO: 7146996 - DNA, 20 bp, Homo sapiens
tggtctggagccagtgagga

SEQ ID NO: 7146997 - DNA, 20 bp, Homo sapiens
tggtctggagccagtgagga

SEQ ID NO: 7146998 - DNA, 20 bp, Homo sapiens
tggtctggagccagtgagga

SEQ ID NO: 7146999 - DNA, 22 bp, Homo sapiens
tggtctgggcaaatccttctga

SEQ ID NO: 7147000 - DNA, 22 bp, Homo sapiens
tggtctggggaccgagggttac

SEQ ID NO: 7147001 - DNA, 22 bp, Homo sapiens
tggtctgcattatctgtaatgg

SEQ ID NO: 7147002 - DNA, 22 bp, Homo sapiens
tggtctgcctggatcacagccc

SEQ ID NO: 7147003 - DNA, 22 bp, Homo sapiens
tggtctgaaggtggatttgaga

SEQ ID NO: 7147004 - DNA, 22 bp, Homo sapiens
tggtctgaatgacttgttagtt

SEQ ID NO: 7147005 - DNA, 23 bp, Homo sapiens
cctgcctgttctaactccatttc

SEQ ID NO: 7147006 - DNA, 22 bp, Homo sapiens
cctgccttcagccctgaagtct

SEQ ID NO: 7147007 - DNA, 22 bp, Homo sapiens
cctgccttcagccctgaagtct

SEQ ID NO: 7147008 - DNA, 22 bp, Homo sapiens
cctgccttccagccttgggctc

SEQ ID NO: 7147009 - DNA, 22 bp, Homo sapiens
cctgccttccagccttgggctc

SEQ ID NO: 7147010 - DNA, 22 bp, Homo sapiens
cctgccttcccagcttggcttt

SEQ ID NO: 7147011 - DNA, 22 bp, Homo sapiens
tggtctcttcttccaagatggc

SEQ ID NO: 7147012 - DNA, 22 bp, Homo sapiens
tggtctcttttcagcctgggga

SEQ ID NO: 7147013 - DNA, 22 bp, Homo sapiens
cctgctgtcagtggggcaggca

SEQ ID NO: 7147014 - DNA, 22 bp, Homo sapiens
cctgctgtagggcccctggggc

SEQ ID NO: 7147015 - DNA, 22 bp, Homo sapiens
cctgctgtagggcccctggggc

SEQ ID NO: 7147016 - DNA, 22 bp, Homo sapiens
cctgctgtaatgtgtctttatt

SEQ ID NO: 7147017 - DNA, 22 bp, Homo sapiens
cctgctggtgtccaggctttgg

SEQ ID NO: 7147018 - DNA, 22 bp, Homo sapiens
cctgctggtttttacaaagatg

SEQ ID NO: 7147019 - DNA, 22 bp, Homo sapiens
cctgctggtttttacaaagatg

SEQ ID NO: 7147020 - DNA, 22 bp, Homo sapiens
cctgctgtgaccggggagcagg

SEQ ID NO: 7147021 - DNA, 22 bp, Homo sapiens
cctgctgtgaagccaggcctgt

SEQ ID NO: 7147022 - DNA, 22 bp, Homo sapiens
cctgctgtctctgggcaggcag

SEQ ID NO: 7147023 - DNA, 22 bp, Homo sapiens
cctgctgtctctgggcaggcag

SEQ ID NO: 7147024 - DNA, 20 bp, Homo sapiens
cctgctgggaaccctctgaa

SEQ ID NO: 7147025 - DNA, 22 bp, Homo sapiens
cctgctggctggtagagttccg

SEQ ID NO: 7147026 - DNA, 22 bp, Homo sapiens
cctgctggcgtggctggcgccc

SEQ ID NO: 7147027 - DNA, 22 bp, Homo sapiens
cctgctggcgtggctggcgccc

SEQ ID NO: 7147028 - DNA, 22 bp, Homo sapiens
cctgctggcgtggctggcgccc

SEQ ID NO: 7147029 - DNA, 22 bp, Homo sapiens
cctgctggcgtggctggcgccc

SEQ ID NO: 7147030 - DNA, 22 bp, Homo sapiens
cctgctggctctgttgctcggc

SEQ ID NO: 7147031 - DNA, 22 bp, Homo sapiens
cctgctgggacgtgtggttgcc

SEQ ID NO: 7147032 - DNA, 22 bp, Homo sapiens
cctgctggcattcttgctccct

SEQ ID NO: 7147033 - DNA, 22 bp, Homo sapiens
cctgctggcattcttgctccct

SEQ ID NO: 7147034 - DNA, 22 bp, Homo sapiens
cctgctggacgtggaggagggg

SEQ ID NO: 7147035 - DNA, 22 bp, Homo sapiens
cctgctggacgtggaggagggg

SEQ ID NO: 7147036 - DNA, 22 bp, Homo sapiens
cctgctggcattcttgctccct

SEQ ID NO: 7147037 - DNA, 22 bp, Homo sapiens
cctgctggccactgctccacct

SEQ ID NO: 7147038 - DNA, 22 bp, Homo sapiens
cctgctggccactgctccacct

SEQ ID NO: 7147039 - DNA, 22 bp, Homo sapiens
cctgctggccactgctccacct

SEQ ID NO: 7147040 - DNA, 22 bp, Homo sapiens
cctgctggccagtggagggctg

SEQ ID NO: 7147041 - DNA, 22 bp, Homo sapiens
cctgctggccagtggagggctg

SEQ ID NO: 7147042 - DNA, 22 bp, Homo sapiens
cctgctggcgcttgtctgggag

SEQ ID NO: 7147043 - DNA, 22 bp, Homo sapiens
cctgctggcggggacccagtga

SEQ ID NO: 7147044 - DNA, 22 bp, Homo sapiens
ccctactccatagtcaattcat

SEQ ID NO: 7147045 - DNA, 22 bp, Homo sapiens
ccctactctgccactttttctg

SEQ ID NO: 7147046 - DNA, 22 bp, Homo sapiens
ccctactctgccactttttctg

SEQ ID NO: 7147047 - DNA, 21 bp, Homo sapiens
ccctaactctaaaggatccat

SEQ ID NO: 7147048 - DNA, 23 bp, Homo sapiens
ccctaactaattctagggcctaa

SEQ ID NO: 7147049 - DNA, 22 bp, Homo sapiens
cccgtcccttttgcccgctggt

SEQ ID NO: 7147050 - DNA, 22 bp, Homo sapiens
cccgggttgtccgcgcgtccgg

SEQ ID NO: 7147051 - DNA, 22 bp, Homo sapiens
cccgggaggtggagactgcagt

SEQ ID NO: 7147052 - DNA, 22 bp, Homo sapiens
tggaagaataggatagaagaac

SEQ ID NO: 7147053 - DNA, 22 bp, Homo sapiens
tggaagaataggatagaagaac

SEQ ID NO: 7147054 - DNA, 22 bp, Homo sapiens
tggaagaataggatagaagaac

SEQ ID NO: 7147055 - DNA, 22 bp, Homo sapiens
tggaagaataggatagaagaac

SEQ ID NO: 7147056 - DNA, 22 bp, Homo sapiens
tggaagaaggcagagaggcatt

SEQ ID NO: 7147057 - DNA, 22 bp, Homo sapiens
tggaagaaggcagagaggcatt

SEQ ID NO: 7147058 - DNA, 22 bp, Homo sapiens
tggaagaaggcagagaggcatt

SEQ ID NO: 7147059 - DNA, 22 bp, Homo sapiens
tggaaagagaaactcttgctaa

SEQ ID NO: 7147060 - DNA, 22 bp, Homo sapiens
ccctagaacacgcagacactga

SEQ ID NO: 7147061 - DNA, 22 bp, Homo sapiens
ccctagagagatcagatgggga

SEQ ID NO: 7147062 - DNA, 20 bp, Homo sapiens
ccctaggaacgcagcaggag

SEQ ID NO: 7147063 - DNA, 22 bp, Homo sapiens
tggaagggaacaggtgggtgtt

SEQ ID NO: 7147064 - DNA, 22 bp, Homo sapiens
tggaagggaacaggtgggtgtt

SEQ ID NO: 7147065 - DNA, 22 bp, Homo sapiens
tggaagggaaagtttggggtcc

SEQ ID NO: 7147066 - DNA, 22 bp, Homo sapiens
tggaagggaaagtttggggtcc

SEQ ID NO: 7147067 - DNA, 22 bp, Homo sapiens
tggaaggctttgctgtccttgc

SEQ ID NO: 7147068 - DNA, 22 bp, Homo sapiens
tggaagggaaagtttggggtcc

SEQ ID NO: 7147069 - DNA, 22 bp, Homo sapiens
tggaagggaaagtttggggtcc

SEQ ID NO: 7147070 - DNA, 22 bp, Homo sapiens
tggaagggaaagtttggggtcc

SEQ ID NO: 7147071 - DNA, 21 bp, Homo sapiens
tggaaggctgctctgccaggg

SEQ ID NO: 7147072 - DNA, 21 bp, Homo sapiens
tggaaggctgctctgccaggg

SEQ ID NO: 7147073 - DNA, 22 bp, Homo sapiens
tggaaggctgagagtcctgggg

SEQ ID NO: 7147074 - DNA, 21 bp, Homo sapiens
tggaaggctgctctgccaggg

SEQ ID NO: 7147075 - DNA, 22 bp, Homo sapiens
tggaaggcatttcacacaggat

SEQ ID NO: 7147076 - DNA, 22 bp, Homo sapiens
tggaaggcctgttgtgtcctag

SEQ ID NO: 7147077 - DNA, 22 bp, Homo sapiens
tggaaggcgtctcgaaggccta

SEQ ID NO: 7147078 - DNA, 22 bp, Homo sapiens
tggaaggcgtctcgaaggccta

SEQ ID NO: 7147079 - DNA, 19 bp, Homo sapiens
tggaaggctaagacacttg

SEQ ID NO: 7147080 - DNA, 22 bp, Homo sapiens
tggaaggctaggtgctaggccc

SEQ ID NO: 7147081 - DNA, 22 bp, Homo sapiens
tggaaggctaggtgctaggccc

SEQ ID NO: 7147082 - DNA, 22 bp, Homo sapiens
tggaaggcaggacctgccttgg

SEQ ID NO: 7147083 - DNA, 22 bp, Homo sapiens
tggaagacaggagatgtgtgta

SEQ ID NO: 7147084 - DNA, 22 bp, Homo sapiens
tggaagacaggcatggaagtgg

SEQ ID NO: 7147085 - DNA, 22 bp, Homo sapiens
tggaagacagttgatgggagtt

SEQ ID NO: 7147086 - DNA, 22 bp, Homo sapiens
tggaaggcaacggagtgagctg

SEQ ID NO: 7147087 - DNA, 20 bp, Homo sapiens
tggaagacactgaagggcca

SEQ ID NO: 7147088 - DNA, 22 bp, Homo sapiens
tggaagacactatttaccaggt

SEQ ID NO: 7147089 - DNA, 22 bp, Homo sapiens
tggaagaatgtttgccttataa

SEQ ID NO: 7147090 - DNA, 22 bp, Homo sapiens
tggaagaatttggggataaatt

SEQ ID NO: 7147091 - DNA, 22 bp, Homo sapiens
tggaagacaaagattcaatatt

SEQ ID NO: 7147092 - DNA, 22 bp, Homo sapiens
tgcctcagtttcatctgcagaa

SEQ ID NO: 7147093 - DNA, 22 bp, Homo sapiens
tgcctcagtttcatctgcagaa

SEQ ID NO: 7147094 - DNA, 22 bp, Homo sapiens
tgcctcagtttcatctgcagaa

SEQ ID NO: 7147095 - DNA, 22 bp, Homo sapiens
tgcctcagtttctccatatgaa

SEQ ID NO: 7147096 - DNA, 22 bp, Homo sapiens
tgcctcagtttctccatatgaa

SEQ ID NO: 7147097 - DNA, 22 bp, Homo sapiens
tgcctcagtttctccatatgaa

SEQ ID NO: 7147098 - DNA, 22 bp, Homo sapiens
tgcctcatttttaagtgttata

SEQ ID NO: 7147099 - DNA, 22 bp, Homo sapiens
tgcctccaacagcccatcctag

SEQ ID NO: 7147100 - DNA, 22 bp, Homo sapiens
tgcctccaacagcccatcctag

SEQ ID NO: 7147101 - DNA, 22 bp, Homo sapiens
tgcctccaccattgctcacttt

SEQ ID NO: 7147102 - DNA, 22 bp, Homo sapiens
tgcctccaccattgctcacttt

SEQ ID NO: 7147103 - DNA, 22 bp, Homo sapiens
tgcctccaccattgctcacttt

SEQ ID NO: 7147104 - DNA, 23 bp, Homo sapiens
tgcctccaccgagggccaggcat

SEQ ID NO: 7147105 - DNA, 23 bp, Homo sapiens
tgcctccaccgagggccaggcat

SEQ ID NO: 7147106 - DNA, 23 bp, Homo sapiens
tgcctccaccgagggccaggcat

SEQ ID NO: 7147107 - DNA, 23 bp, Homo sapiens
tgcctccaccgagggccaggcat

SEQ ID NO: 7147108 - DNA, 17 bp, Homo sapiens
tgcctccagcagggtga

SEQ ID NO: 7147109 - DNA, 22 bp, Homo sapiens
tgcctccaggaggggcagctct

SEQ ID NO: 7147110 - DNA, 22 bp, Homo sapiens
tgcctccaggaggggcagctct

SEQ ID NO: 7147111 - DNA, 17 bp, Homo sapiens
tgcctccagcagggtga

SEQ ID NO: 7147112 - DNA, 22 bp, Homo sapiens
tgcctccaggaggggcagctct

SEQ ID NO: 7147113 - DNA, 22 bp, Homo sapiens
tgcctccatgtttcagcatcta

SEQ ID NO: 7147114 - DNA, 22 bp, Homo sapiens
tgcctccatgtttcagcatcta

SEQ ID NO: 7147115 - DNA, 22 bp, Homo sapiens
tgcctccatgtttcagcatcta

SEQ ID NO: 7147116 - DNA, 22 bp, Homo sapiens
tgcctccatgtttcagcatcta

SEQ ID NO: 7147117 - DNA, 22 bp, Homo sapiens
tgcctgcctaggaagctgtgaa

SEQ ID NO: 7147118 - DNA, 22 bp, Homo sapiens
tgcctgccctgaaaactgccca

SEQ ID NO: 7147119 - DNA, 22 bp, Homo sapiens
tgcctccatgtttcagcatcta

SEQ ID NO: 7147120 - DNA, 22 bp, Homo sapiens
tgcctccattcctgggtcattg

SEQ ID NO: 7147121 - DNA, 22 bp, Homo sapiens
tgcctgccttgctgctggacag

SEQ ID NO: 7147122 - DNA, 22 bp, Homo sapiens
tgcctgcgaggcatgggtgaga

SEQ ID NO: 7147123 - DNA, 22 bp, Homo sapiens
tgcctgctagatatccaggtga

SEQ ID NO: 7147124 - DNA, 22 bp, Homo sapiens
tgcctgcctctggcagccctgc

SEQ ID NO: 7147125 - DNA, 22 bp, Homo sapiens
tgctttattgcatcagtgtggg

SEQ ID NO: 7147126 - DNA, 22 bp, Homo sapiens
tgctttattggaacctcatcct

SEQ ID NO: 7147127 - DNA, 22 bp, Homo sapiens
tgctttattggaacctcatcct

SEQ ID NO: 7147128 - DNA, 22 bp, Homo sapiens
tgctttatttataaaatagcaa

SEQ ID NO: 7147129 - DNA, 22 bp, Homo sapiens
tgctttatttataaaatagcaa

SEQ ID NO: 7147130 - DNA, 22 bp, Homo sapiens
tgctttattttaaatatgccat

SEQ ID NO: 7147131 - DNA, 22 bp, Homo sapiens
tgctttatttataaaatagcaa

SEQ ID NO: 7147132 - DNA, 19 bp, Homo sapiens
tgcctgctcctggcttcca

SEQ ID NO: 7147133 - DNA, 22 bp, Homo sapiens
tgcttgtctcagataaaactat

SEQ ID NO: 7147134 - DNA, 22 bp, Homo sapiens
tgcttgtctctctgtgcccact

SEQ ID NO: 7147135 - DNA, 22 bp, Homo sapiens
tgcctgctaggccctgctgggt

SEQ ID NO: 7147136 - DNA, 22 bp, Homo sapiens
tgcctgctatttgcctaaagtg

SEQ ID NO: 7147137 - DNA, 22 bp, Homo sapiens
tgcctgctccagtcctgtccac

SEQ ID NO: 7147138 - DNA, 22 bp, Homo sapiens
tgcctgctccagtcctgtccac

SEQ ID NO: 7147139 - DNA, 22 bp, Homo sapiens
tgctttcaatgaattgtatact

SEQ ID NO: 7147140 - DNA, 22 bp, Homo sapiens
tgctttcaatgaattgtatact

SEQ ID NO: 7147141 - DNA, 22 bp, Homo sapiens
tgctttcaatgaattgtatact

SEQ ID NO: 7147142 - DNA, 22 bp, Homo sapiens
tgctttcaaaggctttctagat

SEQ ID NO: 7147143 - DNA, 22 bp, Homo sapiens
tgctttcaaaggctttctagat

SEQ ID NO: 7147144 - DNA, 22 bp, Homo sapiens
tgctttcaatgaattgtatact

SEQ ID NO: 7147145 - DNA, 22 bp, Homo sapiens
tgctttcacaccatgcctataa

SEQ ID NO: 7147146 - DNA, 22 bp, Homo sapiens
tgctttcacaccatgcctataa

SEQ ID NO: 7147147 - DNA, 22 bp, Homo sapiens
tgctttcacatgtatgcacaaa

SEQ ID NO: 7147148 - DNA, 22 bp, Homo sapiens
tgctttcacatgtatgcacaaa

SEQ ID NO: 7147149 - DNA, 22 bp, Homo sapiens
tgctttcacatgtatgcacaaa

SEQ ID NO: 7147150 - DNA, 22 bp, Homo sapiens
tgctttcacctgtttgcaccca

SEQ ID NO: 7147151 - DNA, 22 bp, Homo sapiens
tgctttcacctgtttgcaccca

SEQ ID NO: 7147152 - DNA, 22 bp, Homo sapiens
tgctttcactgatgtatcattt

SEQ ID NO: 7147153 - DNA, 22 bp, Homo sapiens
tgctttcactgatgtatcattt

SEQ ID NO: 7147154 - DNA, 22 bp, Homo sapiens
tgctttcactgatgtatcattt

SEQ ID NO: 7147155 - DNA, 22 bp, Homo sapiens
tgctttcactgatgtatcattt

SEQ ID NO: 7147156 - DNA, 22 bp, Homo sapiens
tgctttcacttctctgcagcca

SEQ ID NO: 7147157 - DNA, 21 bp, Homo sapiens
tgctttcagactcttacagaa

SEQ ID NO: 7147158 - DNA, 21 bp, Homo sapiens
tgctttcagactcttacagaa

SEQ ID NO: 7147159 - DNA, 22 bp, Homo sapiens
tgctttcagatatctgtttcaa

SEQ ID NO: 7147160 - DNA, 21 bp, Homo sapiens
tgctttcagactcttacagaa

SEQ ID NO: 7147161 - DNA, 22 bp, Homo sapiens
tgctttcagctggtaaagaaac

SEQ ID NO: 7147162 - DNA, 22 bp, Homo sapiens
tgctttcagggatgtctgtgag

SEQ ID NO: 7147163 - DNA, 22 bp, Homo sapiens
tgctttcagggatgtctgtgag

SEQ ID NO: 7147164 - DNA, 22 bp, Homo sapiens
tgctttcagggatgtctgtgag

SEQ ID NO: 7147165 - DNA, 22 bp, Homo sapiens
tgctttcagtttacatcagaac

SEQ ID NO: 7147166 - DNA, 22 bp, Homo sapiens
tgctttcagtttacatcagaac

SEQ ID NO: 7147167 - DNA, 22 bp, Homo sapiens
tgctttcagtttacatcagaac

SEQ ID NO: 7147168 - DNA, 22 bp, Homo sapiens
tgctttcatattgcctatgact

SEQ ID NO: 7147169 - DNA, 22 bp, Homo sapiens
tgctttcatattgcctatgact

SEQ ID NO: 7147170 - DNA, 22 bp, Homo sapiens
tgctttcatgaagtctatagag

SEQ ID NO: 7147171 - DNA, 22 bp, Homo sapiens
tgctttcatgaagtctatagag

SEQ ID NO: 7147172 - DNA, 22 bp, Homo sapiens
tgctttcattcacaaaatagca

SEQ ID NO: 7147173 - DNA, 22 bp, Homo sapiens
tgctttcattcacaaaatagca

SEQ ID NO: 7147174 - DNA, 22 bp, Homo sapiens
tgctttcattcacaaaatagca

SEQ ID NO: 7147175 - DNA, 22 bp, Homo sapiens
tgctttcattgtgataggaagc

SEQ ID NO: 7147176 - DNA, 22 bp, Homo sapiens
tgctttcattgtgataggaagc

SEQ ID NO: 7147177 - DNA, 22 bp, Homo sapiens
tgctttcattgtgataggaagc

SEQ ID NO: 7147178 - DNA, 22 bp, Homo sapiens
tgctttcattgtgataggaagc

SEQ ID NO: 7147179 - DNA, 22 bp, Homo sapiens
tggaggtcgcgcgggtgctgca

SEQ ID NO: 7147180 - DNA, 22 bp, Homo sapiens
tggaggtactcaggcacagagt

SEQ ID NO: 7147181 - DNA, 22 bp, Homo sapiens
tggaggtactcaggcacagagt

SEQ ID NO: 7147182 - DNA, 22 bp, Homo sapiens
tggaggtcttacccagggctat

SEQ ID NO: 7147183 - DNA, 22 bp, Homo sapiens
tggaggtgaaatgagattttgt

SEQ ID NO: 7147184 - DNA, 22 bp, Homo sapiens
tggaggggcaatggagcgcgga

SEQ ID NO: 7147185 - DNA, 22 bp, Homo sapiens
tggaggggcaatggagcgcgga

SEQ ID NO: 7147186 - DNA, 22 bp, Homo sapiens
tggaggggcaatggagcgcgga

SEQ ID NO: 7147187 - DNA, 22 bp, Homo sapiens
tggaggggcaatggagcgcgga

SEQ ID NO: 7147188 - DNA, 22 bp, Homo sapiens
tggaggggcaatggagcgcgga

SEQ ID NO: 7147189 - DNA, 19 bp, Homo sapiens
tggaggggtttgaatgtgg

SEQ ID NO: 7147190 - DNA, 19 bp, Homo sapiens
tggaggggtttgaatgtgg

SEQ ID NO: 7147191 - DNA, 19 bp, Homo sapiens
tggaggggtttgaatgtgg

SEQ ID NO: 7147192 - DNA, 19 bp, Homo sapiens
tggaggggtttgaatgtgg

SEQ ID NO: 7147193 - DNA, 19 bp, Homo sapiens
tggaggggtttgaatgtgg

SEQ ID NO: 7147194 - DNA, 22 bp, Homo sapiens
tggagggtcaccccttgctgag

SEQ ID NO: 7147195 - DNA, 22 bp, Homo sapiens
tggaggtacataatgagagggt

SEQ ID NO: 7147196 - DNA, 22 bp, Homo sapiens
ccctggagctagtctgagcaga

SEQ ID NO: 7147197 - DNA, 23 bp, Homo sapiens
ccctggagctagtctgagcagag

SEQ ID NO: 7147198 - DNA, 23 bp, Homo sapiens
ccctggagctagtctgagcagag

SEQ ID NO: 7147199 - DNA, 23 bp, Homo sapiens
ccctggagctagtctgagcagag

SEQ ID NO: 7147200 - DNA, 23 bp, Homo sapiens
ccctggagctagtctgagcgggg

SEQ ID NO: 7147201 - DNA, 23 bp, Homo sapiens
ccctggagctagtctgagcgggg

SEQ ID NO: 7147202 - DNA, 23 bp, Homo sapiens
ccctggagctagtctgagcgggg

SEQ ID NO: 7147203 - DNA, 22 bp, Homo sapiens
ccctggagctgcttgcatgttg

SEQ ID NO: 7147204 - DNA, 22 bp, Homo sapiens
ccctggagctgcttgcatgttg

SEQ ID NO: 7147205 - DNA, 22 bp, Homo sapiens
tggaggtgagtgtggtacagca

SEQ ID NO: 7147206 - DNA, 22 bp, Homo sapiens
tggaggtgacggggcctcgttg

SEQ ID NO: 7147207 - DNA, 22 bp, Homo sapiens
tggaggtgacggggcctcgttg

SEQ ID NO: 7147208 - DNA, 22 bp, Homo sapiens
tggaggtgacggggcctcgttg

SEQ ID NO: 7147209 - DNA, 22 bp, Homo sapiens
tggaggtgaaatgagattttgt

SEQ ID NO: 7147210 - DNA, 22 bp, Homo sapiens
tggaggtgacggggcctcgttg

SEQ ID NO: 7147211 - DNA, 22 bp, Homo sapiens
tggaggtgacggggcctcgttg

SEQ ID NO: 7147212 - DNA, 22 bp, Homo sapiens
tggaggtgagtgtggtacagca

SEQ ID NO: 7147213 - DNA, 22 bp, Homo sapiens
tggaggtgagtgtggtacagca

SEQ ID NO: 7147214 - DNA, 22 bp, Homo sapiens
ccctgctgaagaacgttcatac

SEQ ID NO: 7147215 - DNA, 22 bp, Homo sapiens
ccctgctcttctgactcaagct

SEQ ID NO: 7147216 - DNA, 22 bp, Homo sapiens
ccctgctcttctgactcaagct

SEQ ID NO: 7147217 - DNA, 22 bp, Homo sapiens
ccctgctcttagtgcctgtgtg

SEQ ID NO: 7147218 - DNA, 22 bp, Homo sapiens
ccctgctcttagtgcctgtgtg

SEQ ID NO: 7147219 - DNA, 22 bp, Homo sapiens
tggaggggcaatggagcgcgga

SEQ ID NO: 7147220 - DNA, 19 bp, Homo sapiens
tggaggccaggacacaggt

SEQ ID NO: 7147221 - DNA, 22 bp, Homo sapiens
tggaggccaggaaggcagcgag

SEQ ID NO: 7147222 - DNA, 22 bp, Homo sapiens
tggaggccaggaaggcagcgag

SEQ ID NO: 7147223 - DNA, 22 bp, Homo sapiens
tggaggggcaatggagcgcgga

SEQ ID NO: 7147224 - DNA, 22 bp, Homo sapiens
ccctgctgaatcccatggagtc

SEQ ID NO: 7147225 - DNA, 22 bp, Homo sapiens
ccctgctgacaacttgattttg

SEQ ID NO: 7147226 - DNA, 22 bp, Homo sapiens
tggaggccagaggtactgggac

SEQ ID NO: 7147227 - DNA, 22 bp, Homo sapiens
tggaggccaggaaggcagcgag

SEQ ID NO: 7147228 - DNA, 22 bp, Homo sapiens
tggaggccaggaaggcagcgag

SEQ ID NO: 7147229 - DNA, 22 bp, Homo sapiens
ccctgccttgttggagcctatg

SEQ ID NO: 7147230 - DNA, 22 bp, Homo sapiens
ccctgccttgtctgggctaggt

SEQ ID NO: 7147231 - DNA, 22 bp, Homo sapiens
ccctgccttgttggagcctatg

SEQ ID NO: 7147232 - DNA, 22 bp, Homo sapiens
ccctgccttgttggagcctatg

SEQ ID NO: 7147233 - DNA, 22 bp, Homo sapiens
ccctgccttggggtccacaccg

SEQ ID NO: 7147234 - DNA, 22 bp, Homo sapiens
ccctgccttggggtccacaccg

SEQ ID NO: 7147235 - DNA, 22 bp, Homo sapiens
ccctgccttggggtccacaccg

SEQ ID NO: 7147236 - DNA, 22 bp, Homo sapiens
ccctgccttggggtccacaccg

SEQ ID NO: 7147237 - DNA, 22 bp, Homo sapiens
ccctgcctctgaagctgctcag

SEQ ID NO: 7147238 - DNA, 22 bp, Homo sapiens
ccctgcctctgaagctgctcag

SEQ ID NO: 7147239 - DNA, 19 bp, Homo sapiens
ccctgccctggtgactggg

SEQ ID NO: 7147240 - DNA, 22 bp, Homo sapiens
ccctgcctacagggttttcttt

SEQ ID NO: 7147241 - DNA, 19 bp, Homo sapiens
ccctgccctggtgactggg

SEQ ID NO: 7147242 - DNA, 23 bp, Homo sapiens
ccctgcagtcagggtgagatggt

SEQ ID NO: 7147243 - DNA, 22 bp, Homo sapiens
ccctgcagtcctttcttggctc

SEQ ID NO: 7147244 - DNA, 22 bp, Homo sapiens
ccctgcctgtgggcatcaacat

SEQ ID NO: 7147245 - DNA, 22 bp, Homo sapiens
ccctgccttcttggcctttaaa

SEQ ID NO: 7147246 - DNA, 22 bp, Homo sapiens
ccctgcctgtgggcatcaacat

SEQ ID NO: 7147247 - DNA, 22 bp, Homo sapiens
ccctgcctgtgggcatcaacat

SEQ ID NO: 7147248 - DNA, 22 bp, Homo sapiens
ccctgcctctgaagctgctcag

SEQ ID NO: 7147249 - DNA, 22 bp, Homo sapiens
tggacaggtttgggtgcctgtt

SEQ ID NO: 7147250 - DNA, 22 bp, Homo sapiens
tggacaggtttgggtgcctgtt

SEQ ID NO: 7147251 - DNA, 22 bp, Homo sapiens
tggacaggttgagtaggaggag

SEQ ID NO: 7147252 - DNA, 22 bp, Homo sapiens
tggacaggtttgggtgcctgtt

SEQ ID NO: 7147253 - DNA, 22 bp, Homo sapiens
tggacaggtttgggtgcctgtt

SEQ ID NO: 7147254 - DNA, 22 bp, Homo sapiens
tggacaggtttgggtgcctgtt

SEQ ID NO: 7147255 - DNA, 22 bp, Homo sapiens
tggacagtaagagaagatgtag

SEQ ID NO: 7147256 - DNA, 22 bp, Homo sapiens
tggacagtaggaagagtgtggg

SEQ ID NO: 7147257 - DNA, 22 bp, Homo sapiens
tggacagtaggaagagtgtggg

SEQ ID NO: 7147258 - DNA, 22 bp, Homo sapiens
tggacaggtgcacacagcagcc

SEQ ID NO: 7147259 - DNA, 22 bp, Homo sapiens
tggacaggttgagtaggaggag

SEQ ID NO: 7147260 - DNA, 22 bp, Homo sapiens
tggacaggttgagtaggaggag

SEQ ID NO: 7147261 - DNA, 22 bp, Homo sapiens
tggacaggttgagtaggaggag

SEQ ID NO: 7147262 - DNA, 22 bp, Homo sapiens
tggacaggttgagtaggaggag

SEQ ID NO: 7147263 - DNA, 22 bp, Homo sapiens
tggacaggttgagtaggaggag

SEQ ID NO: 7147264 - DNA, 23 bp, Homo sapiens
tggacagtagggtagacagtgcc

SEQ ID NO: 7147265 - DNA, 22 bp, Homo sapiens
tggacagtatctcttattcctc

SEQ ID NO: 7147266 - DNA, 22 bp, Homo sapiens
tggacagtgcagatacagaatg

SEQ ID NO: 7147267 - DNA, 20 bp, Homo sapiens
tggacagttactttatctct

SEQ ID NO: 7147268 - DNA, 23 bp, Homo sapiens
tggacagttatctcattgtcctg

SEQ ID NO: 7147269 - DNA, 22 bp, Homo sapiens
tggacagttgtcttgtagctaa

SEQ ID NO: 7147270 - DNA, 22 bp, Homo sapiens
tggacatcttagtcatgtcaat

SEQ ID NO: 7147271 - DNA, 22 bp, Homo sapiens
tggacatgacctcgagcgagat

SEQ ID NO: 7147272 - DNA, 22 bp, Homo sapiens
tggacatgagctgagtgggtgt

SEQ ID NO: 7147273 - DNA, 22 bp, Homo sapiens
tggacatgtaaaggctcaaggt

SEQ ID NO: 7147274 - DNA, 22 bp, Homo sapiens
ccctgcagacgtcttgatgcct

SEQ ID NO: 7147275 - DNA, 22 bp, Homo sapiens
ccctgcagacgtcttgatgcct

SEQ ID NO: 7147276 - DNA, 22 bp, Homo sapiens
ccctgcagaccaatgccataga

SEQ ID NO: 7147277 - DNA, 22 bp, Homo sapiens
ccctgcagaaccacagacaaac

SEQ ID NO: 7147278 - DNA, 22 bp, Homo sapiens
ccctgcagaaccacagacaaac

SEQ ID NO: 7147279 - DNA, 22 bp, Homo sapiens
ccctgcagaccaatgccataga

SEQ ID NO: 7147280 - DNA, 22 bp, Homo sapiens
ccctgcagacgtcttgatgcct

SEQ ID NO: 7147281 - DNA, 22 bp, Homo sapiens
ccctgcagagaccactgacctt

SEQ ID NO: 7147282 - DNA, 22 bp, Homo sapiens
ccctgcagagaccactgacctt

SEQ ID NO: 7147283 - DNA, 22 bp, Homo sapiens
ccctgcagagagtgcttttgtg

SEQ ID NO: 7147284 - DNA, 22 bp, Homo sapiens
ccctgcagagccagccctgacc

SEQ ID NO: 7147285 - DNA, 22 bp, Homo sapiens
ccctgaggaccaggaaggaggg

SEQ ID NO: 7147286 - DNA, 22 bp, Homo sapiens
ccctgaggagagcgcttcccga

SEQ ID NO: 7147287 - DNA, 22 bp, Homo sapiens
tggaagggaacaggtgggtgtt

SEQ ID NO: 7147288 - DNA, 22 bp, Homo sapiens
tggaagggaacaggtgggtgtt

SEQ ID NO: 7147289 - DNA, 22 bp, Homo sapiens
tggaagggaacaggtgggtgtt

SEQ ID NO: 7147290 - DNA, 21 bp, Homo sapiens
tggaagggaagtcttggttgt

SEQ ID NO: 7147291 - DNA, 22 bp, Homo sapiens
ccctgcagagggatgggggcag

SEQ ID NO: 7147292 - DNA, 22 bp, Homo sapiens
ccctgcagagggatgggggcag

SEQ ID NO: 7147293 - DNA, 22 bp, Homo sapiens
ccctgcagagggatgggggcag

SEQ ID NO: 7147294 - DNA, 22 bp, Homo sapiens
ccctgcagatcagtgagaactt

SEQ ID NO: 7147295 - DNA, 22 bp, Homo sapiens
ccctgcagatcagtgagaactt

SEQ ID NO: 7147296 - DNA, 22 bp, Homo sapiens
ccctgcagagccagccctgacc

SEQ ID NO: 7147297 - DNA, 22 bp, Homo sapiens
ccctgcagagggatgggggcag

SEQ ID NO: 7147298 - DNA, 22 bp, Homo sapiens
ccctgcagatcagtgagaactt

SEQ ID NO: 7147299 - DNA, 22 bp, Homo sapiens
ccctgcagatctagggtccttc

SEQ ID NO: 7147300 - DNA, 22 bp, Homo sapiens
ccctgcagatctagggtccttc

SEQ ID NO: 7147301 - DNA, 20 bp, Homo sapiens
ccctgcagccatgggagtgg

SEQ ID NO: 7147302 - DNA, 20 bp, Homo sapiens
ccctgcagccatgggagtgg

SEQ ID NO: 7147303 - DNA, 22 bp, Homo sapiens
tggacaggttgagtaggaggag

SEQ ID NO: 7147304 - DNA, 22 bp, Homo sapiens
tggacaggttgagtaggaggag

SEQ ID NO: 7147305 - DNA, 22 bp, Homo sapiens
tggacaggtgcacacagcagcc

SEQ ID NO: 7147306 - DNA, 22 bp, Homo sapiens
tggacaggtgcacacagcagcc

SEQ ID NO: 7147307 - DNA, 22 bp, Homo sapiens
tggacaggtgcacacagcagcc

SEQ ID NO: 7147308 - DNA, 22 bp, Homo sapiens
ccctgcagccggccagctcatt

SEQ ID NO: 7147309 - DNA, 22 bp, Homo sapiens
tggacaggtgcacacagcagcc

SEQ ID NO: 7147310 - DNA, 20 bp, Homo sapiens
ccctgcagccatgggagtgg

SEQ ID NO: 7147311 - DNA, 20 bp, Homo sapiens
ccctgcagccatgggagtgg

SEQ ID NO: 7147312 - DNA, 22 bp, Homo sapiens
ccctgcagccggccagctcatt

SEQ ID NO: 7147313 - DNA, 22 bp, Homo sapiens
cctcagctcttccctgtgcaca

SEQ ID NO: 7147314 - DNA, 22 bp, Homo sapiens
cctcagctcttccctgtgcaca

SEQ ID NO: 7147315 - DNA, 22 bp, Homo sapiens
cctcagctcccatgagatctgc

SEQ ID NO: 7147316 - DNA, 22 bp, Homo sapiens
cctcagccttggccccaggcag

SEQ ID NO: 7147317 - DNA, 22 bp, Homo sapiens
cctcagccttggccccaggcag

SEQ ID NO: 7147318 - DNA, 22 bp, Homo sapiens
cctcagccttggccccaggcag

SEQ ID NO: 7147319 - DNA, 22 bp, Homo sapiens
cctcagctgctgcacagctttt

SEQ ID NO: 7147320 - DNA, 22 bp, Homo sapiens
cctcagctgctgcacagctttt

SEQ ID NO: 7147321 - DNA, 22 bp, Homo sapiens
cctcagctgcttccctggagcc

SEQ ID NO: 7147322 - DNA, 22 bp, Homo sapiens
cctcagctgcttccctggagcc

SEQ ID NO: 7147323 - DNA, 22 bp, Homo sapiens
cctcagctgcttccctggagcc

SEQ ID NO: 7147324 - DNA, 22 bp, Homo sapiens
cctcagctgcttccctggagcc

SEQ ID NO: 7147325 - DNA, 22 bp, Homo sapiens
cctcagctgtcttttccgaggt

SEQ ID NO: 7147326 - DNA, 22 bp, Homo sapiens
tggcctgggtcacaccagggtc

SEQ ID NO: 7147327 - DNA, 22 bp, Homo sapiens
tggcctgggtcacaccagggtc

SEQ ID NO: 7147328 - DNA, 22 bp, Homo sapiens
tggctaacaaggtgaaaccccg

SEQ ID NO: 7147329 - DNA, 22 bp, Homo sapiens
cctcagcccctgaatggagaga

SEQ ID NO: 7147330 - DNA, 22 bp, Homo sapiens
cctcagccttggccccaggcag

SEQ ID NO: 7147331 - DNA, 23 bp, Homo sapiens
cctcagcatggcaggagcccagc

SEQ ID NO: 7147332 - DNA, 22 bp, Homo sapiens
cctcagcccctgaatggagaga

SEQ ID NO: 7147333 - DNA, 22 bp, Homo sapiens
tggcctctcctggcagcatcca

SEQ ID NO: 7147334 - DNA, 22 bp, Homo sapiens
tggcctcctcgggctgaccctg

SEQ ID NO: 7147335 - DNA, 22 bp, Homo sapiens
tggcctcggcatccagcaagag

SEQ ID NO: 7147336 - DNA, 22 bp, Homo sapiens
tggcctcggcatccagcaagag

SEQ ID NO: 7147337 - DNA, 22 bp, Homo sapiens
tggcctcggcatccagcaagag

SEQ ID NO: 7147338 - DNA, 22 bp, Homo sapiens
cctcactcttgtcctggcaggt

SEQ ID NO: 7147339 - DNA, 22 bp, Homo sapiens
cctcactcttgtcctggcaggt

SEQ ID NO: 7147340 - DNA, 22 bp, Homo sapiens
cctcactctgcaccctgcagca

SEQ ID NO: 7147341 - DNA, 22 bp, Homo sapiens
cctcactgaagaggtgacattt

SEQ ID NO: 7147342 - DNA, 22 bp, Homo sapiens
cctcactgaagaggtgacattt

SEQ ID NO: 7147343 - DNA, 19 bp, Homo sapiens
cctcaccctgcagaggagg

SEQ ID NO: 7147344 - DNA, 19 bp, Homo sapiens
cctcaccctgcagaggagg

SEQ ID NO: 7147345 - DNA, 19 bp, Homo sapiens
cctcaccctgcagaggagg

SEQ ID NO: 7147346 - DNA, 19 bp, Homo sapiens
cctcaccctgcagaggagg

SEQ ID NO: 7147347 - DNA, 22 bp, Homo sapiens
cctcactctgcaccctgcagca

SEQ ID NO: 7147348 - DNA, 22 bp, Homo sapiens
cctcagaagactttagggaaga

SEQ ID NO: 7147349 - DNA, 22 bp, Homo sapiens
cctcagaagctcaaggacattg

SEQ ID NO: 7147350 - DNA, 22 bp, Homo sapiens
cctcactttcctttctcctggg

SEQ ID NO: 7147351 - DNA, 22 bp, Homo sapiens
cctcactgtcatcagtagttat

SEQ ID NO: 7147352 - DNA, 22 bp, Homo sapiens
cctcactgtcacttatagtggt

SEQ ID NO: 7147353 - DNA, 22 bp, Homo sapiens
cctcactggccagccaggggtg

SEQ ID NO: 7147354 - DNA, 22 bp, Homo sapiens
cctcactgctatgtgtttgctc

SEQ ID NO: 7147355 - DNA, 22 bp, Homo sapiens
cctcactgaagaggtgacattt

SEQ ID NO: 7147356 - DNA, 22 bp, Homo sapiens
tggccctgcttatgtctctctt

SEQ ID NO: 7147357 - DNA, 21 bp, Homo sapiens
tggccctggccacggctgcca

SEQ ID NO: 7147358 - DNA, 21 bp, Homo sapiens
tggccctggccacggctgcca

SEQ ID NO: 7147359 - DNA, 21 bp, Homo sapiens
tggccctggccacggctgcca

SEQ ID NO: 7147360 - DNA, 22 bp, Homo sapiens
tggcctcaagtctgagggcctt

SEQ ID NO: 7147361 - DNA, 22 bp, Homo sapiens
tggcctcaagtctgagggcctt

SEQ ID NO: 7147362 - DNA, 22 bp, Homo sapiens
tggcctcaagtctgagggcctt

SEQ ID NO: 7147363 - DNA, 22 bp, Homo sapiens
tggcctcagatttcaggggtgg

SEQ ID NO: 7147364 - DNA, 22 bp, Homo sapiens
tggcctcaccactagctgggtg

SEQ ID NO: 7147365 - DNA, 22 bp, Homo sapiens
tggcctcaccactagctgggtg

SEQ ID NO: 7147366 - DNA, 22 bp, Homo sapiens
tggcctcccctaacagcctctt

SEQ ID NO: 7147367 - DNA, 22 bp, Homo sapiens
tggcctcccctaacagcctctt

SEQ ID NO: 7147368 - DNA, 21 bp, Homo sapiens
tggcctcccacacttccatgg

SEQ ID NO: 7147369 - DNA, 19 bp, Homo sapiens
cctccccttggaccagcaa

SEQ ID NO: 7147370 - DNA, 19 bp, Homo sapiens
cctccccttggaccagcaa

SEQ ID NO: 7147371 - DNA, 23 bp, Homo sapiens
cctccccttcccacagctgggtg

SEQ ID NO: 7147372 - DNA, 19 bp, Homo sapiens
cctccccttggaccagcaa

SEQ ID NO: 7147373 - DNA, 22 bp, Homo sapiens
cctcccgtatatgtcctgggct

SEQ ID NO: 7147374 - DNA, 22 bp, Homo sapiens
cctcccgtatatgtcctgggct

SEQ ID NO: 7147375 - DNA, 22 bp, Homo sapiens
cctccctctttcagtcccacag

SEQ ID NO: 7147376 - DNA, 22 bp, Homo sapiens
cctccctccctcttatggttta

SEQ ID NO: 7147377 - DNA, 22 bp, Homo sapiens
cctccctccctgcagaagccac

SEQ ID NO: 7147378 - DNA, 22 bp, Homo sapiens
cctccctccattgccatcgtct

SEQ ID NO: 7147379 - DNA, 22 bp, Homo sapiens
cctccctccattgccatcgtct

SEQ ID NO: 7147380 - DNA, 22 bp, Homo sapiens
cctcccctcagacagagactgg

SEQ ID NO: 7147381 - DNA, 22 bp, Homo sapiens
cctcccctcagacagagactgg

SEQ ID NO: 7147382 - DNA, 22 bp, Homo sapiens
cctccccatgacccggtgctgg

SEQ ID NO: 7147383 - DNA, 22 bp, Homo sapiens
cctccccatgacccggtgctgg

SEQ ID NO: 7147384 - DNA, 22 bp, Homo sapiens
cctccccatgacccggtgctgg

SEQ ID NO: 7147385 - DNA, 22 bp, Homo sapiens
tggctcagctgactcggcttct

SEQ ID NO: 7147386 - DNA, 22 bp, Homo sapiens
cctcccagatgtgcccaatgga

SEQ ID NO: 7147387 - DNA, 22 bp, Homo sapiens
tggctcagctgactcggcttct

SEQ ID NO: 7147388 - DNA, 22 bp, Homo sapiens
cctcccagatgtgcccaatgga

SEQ ID NO: 7147389 - DNA, 22 bp, Homo sapiens
cctcccaggcattgccattttc

SEQ ID NO: 7147390 - DNA, 22 bp, Homo sapiens
tggctcagcggtggcagcagac

SEQ ID NO: 7147391 - DNA, 22 bp, Homo sapiens
tggctcagcggtggcagcagac

SEQ ID NO: 7147392 - DNA, 22 bp, Homo sapiens
tggctcagcgcggcctggtctt

SEQ ID NO: 7147393 - DNA, 22 bp, Homo sapiens
tggctcagcgcggcctggtctt

SEQ ID NO: 7147394 - DNA, 22 bp, Homo sapiens
tggctcagcggtggcagcagac

SEQ ID NO: 7147395 - DNA, 22 bp, Homo sapiens
tggctcagcggtggcagcagac

SEQ ID NO: 7147396 - DNA, 22 bp, Homo sapiens
tggctcagcggtggcagcagac

SEQ ID NO: 7147397 - DNA, 22 bp, Homo sapiens
tggctcagcggtggcagcagac

SEQ ID NO: 7147398 - DNA, 22 bp, Homo sapiens
tggctcagcggtggcagcagac

SEQ ID NO: 7147399 - DNA, 23 bp, Homo sapiens
tggctcagctagttttccatttc

SEQ ID NO: 7147400 - DNA, 23 bp, Homo sapiens
tggctcagctagttttccatttc

SEQ ID NO: 7147401 - DNA, 23 bp, Homo sapiens
tggctcagctagttttccatttc

SEQ ID NO: 7147402 - DNA, 22 bp, Homo sapiens
tggctcagcgcggcctggtctt

SEQ ID NO: 7147403 - DNA, 22 bp, Homo sapiens
tggctcagcgcggcctggtctt

SEQ ID NO: 7147404 - DNA, 22 bp, Homo sapiens
tggctcagcctggccctttcat

SEQ ID NO: 7147405 - DNA, 22 bp, Homo sapiens
tggctcagcgcggcctggtctt

SEQ ID NO: 7147406 - DNA, 22 bp, Homo sapiens
tggctcagcgcggcctggtctt

SEQ ID NO: 7147407 - DNA, 22 bp, Homo sapiens
tggctcagcgcggcctggtctt

SEQ ID NO: 7147408 - DNA, 22 bp, Homo sapiens
tggctcagccattcgtgttgcc

SEQ ID NO: 7147409 - DNA, 22 bp, Homo sapiens
tggctcagcctggccctttcat

SEQ ID NO: 7147410 - DNA, 22 bp, Homo sapiens
tggctcagcctggccctttcat

SEQ ID NO: 7147411 - DNA, 22 bp, Homo sapiens
tggctcagcctggccctttcat

SEQ ID NO: 7147412 - DNA, 22 bp, Homo sapiens
tggctcagccagccctaggaac

SEQ ID NO: 7147413 - DNA, 22 bp, Homo sapiens
tggctcagccattcgtgttgcc

SEQ ID NO: 7147414 - DNA, 22 bp, Homo sapiens
tggctcagccattcgtgttgcc

SEQ ID NO: 7147415 - DNA, 22 bp, Homo sapiens
tggctcagccattcgtgttgcc

SEQ ID NO: 7147416 - DNA, 22 bp, Homo sapiens
tggctcagccattcgtgttgcc

SEQ ID NO: 7147417 - DNA, 22 bp, Homo sapiens
tggctaggctccaagagctgga

SEQ ID NO: 7147418 - DNA, 22 bp, Homo sapiens
tggctaggacctctgcggagca

SEQ ID NO: 7147419 - DNA, 22 bp, Homo sapiens
tggctagataactagaatttca

SEQ ID NO: 7147420 - DNA, 22 bp, Homo sapiens
tggctaacaaggtgaaaccccg

SEQ ID NO: 7147421 - DNA, 22 bp, Homo sapiens
tggctaacaaggtgaaaccccg

SEQ ID NO: 7147422 - DNA, 19 bp, Homo sapiens
tggctaaggccagcggaaa

SEQ ID NO: 7147423 - DNA, 19 bp, Homo sapiens
tggctaaggccagcggaaa

SEQ ID NO: 7147424 - DNA, 22 bp, Homo sapiens
tggctacagatttgctgacaat

SEQ ID NO: 7147425 - DNA, 22 bp, Homo sapiens
tggctacagcaagaggaaagaa

SEQ ID NO: 7147426 - DNA, 22 bp, Homo sapiens
tggctacatttgttgatcactt

SEQ ID NO: 7147427 - DNA, 22 bp, Homo sapiens
tggctacctgatttcttttcag

SEQ ID NO: 7147428 - DNA, 22 bp, Homo sapiens
tggctactcaacatgtactcat

SEQ ID NO: 7147429 - DNA, 22 bp, Homo sapiens
ccgccgtgtcgacaggccctgg

SEQ ID NO: 7147430 - DNA, 22 bp, Homo sapiens
ccgcgccacccattcccactga

SEQ ID NO: 7147431 - DNA, 22 bp, Homo sapiens
ccctttcatattttataaatgg

SEQ ID NO: 7147432 - DNA, 22 bp, Homo sapiens
ccctttcattggcagagctctc

SEQ ID NO: 7147433 - DNA, 22 bp, Homo sapiens
ccctttcattggcagagctctc

SEQ ID NO: 7147434 - DNA, 22 bp, Homo sapiens
ccctttcattggcagagctctc

SEQ ID NO: 7147435 - DNA, 22 bp, Homo sapiens
ccggagtgtctggcctgctggg

SEQ ID NO: 7147436 - DNA, 22 bp, Homo sapiens
ccggcctataggtgcaaacatc

SEQ ID NO: 7147437 - DNA, 22 bp, Homo sapiens
ccggcctttgttgtggagggtc

SEQ ID NO: 7147438 - DNA, 22 bp, Homo sapiens
ccggctactcgggaggctgacg

SEQ ID NO: 7147439 - DNA, 22 bp, Homo sapiens
ccggctactcgggaggctgacg

SEQ ID NO: 7147440 - DNA, 22 bp, Homo sapiens
ccggctactcgggaggctgacg

SEQ ID NO: 7147441 - DNA, 22 bp, Homo sapiens
ccgcggggtcatggctgggccg

SEQ ID NO: 7147442 - DNA, 22 bp, Homo sapiens
ccctttccatggctctcctagg

SEQ ID NO: 7147443 - DNA, 22 bp, Homo sapiens
ccgcttggatggggggtccaga

SEQ ID NO: 7147444 - DNA, 22 bp, Homo sapiens
ccggaaggcggaacgtgcagtg

SEQ ID NO: 7147445 - DNA, 22 bp, Homo sapiens
ccggaatgccggctgaccgcgg

SEQ ID NO: 7147446 - DNA, 20 bp, Homo sapiens
ccctgtgattggcaagtgtc

SEQ ID NO: 7147447 - DNA, 20 bp, Homo sapiens
ccctgtgattggcaagtgtc

SEQ ID NO: 7147448 - DNA, 20 bp, Homo sapiens
ccctgtgattggcaagtgtc

SEQ ID NO: 7147449 - DNA, 22 bp, Homo sapiens
ccctgtgcacacacttcactct

SEQ ID NO: 7147450 - DNA, 22 bp, Homo sapiens
ccctgtgcagatggcagctggg

SEQ ID NO: 7147451 - DNA, 22 bp, Homo sapiens
ccctgtgcattggagggtgttt

SEQ ID NO: 7147452 - DNA, 22 bp, Homo sapiens
ccctgtgcctagttggcctaaa

SEQ ID NO: 7147453 - DNA, 22 bp, Homo sapiens
ccctgtggaggaggagagcagt

SEQ ID NO: 7147454 - DNA, 22 bp, Homo sapiens
ccctgtggaggaggagagcagt

SEQ ID NO: 7147455 - DNA, 22 bp, Homo sapiens
ccctggaggaaaatctgaggct

SEQ ID NO: 7147456 - DNA, 22 bp, Homo sapiens
ccctggaggaagaaacaatggc

SEQ ID NO: 7147457 - DNA, 22 bp, Homo sapiens
ccctggaggaagaaacaatggc

SEQ ID NO: 7147458 - DNA, 22 bp, Homo sapiens
ccctggaggaagaaacaatggc

SEQ ID NO: 7147459 - DNA, 22 bp, Homo sapiens
ccctggaggaagaaacaatggc

SEQ ID NO: 7147460 - DNA, 22 bp, Homo sapiens
ccctgggataccagacaccaga

SEQ ID NO: 7147461 - DNA, 22 bp, Homo sapiens
ccctgggataccagacaccaga

SEQ ID NO: 7147462 - DNA, 22 bp, Homo sapiens
ccctggagctgcttgcatgttg

SEQ ID NO: 7147463 - DNA, 22 bp, Homo sapiens
ccctggaggaaaatctgaggct

SEQ ID NO: 7147464 - DNA, 22 bp, Homo sapiens
ccctggaggaaaatctgaggct

SEQ ID NO: 7147465 - DNA, 22 bp, Homo sapiens
ccctggaggaaaatctgaggct

SEQ ID NO: 7147466 - DNA, 22 bp, Homo sapiens
ccctgggttctggctgggctgc

SEQ ID NO: 7147467 - DNA, 22 bp, Homo sapiens
ccctgggataccagacaccaga

SEQ ID NO: 7147468 - DNA, 22 bp, Homo sapiens
ccctgggatggattggcaggaa

SEQ ID NO: 7147469 - DNA, 22 bp, Homo sapiens
ccctgggatggattggcaggaa

SEQ ID NO: 7147470 - DNA, 22 bp, Homo sapiens
ccctggtgccctgggtcagcct

SEQ ID NO: 7147471 - DNA, 22 bp, Homo sapiens
ccctggtggggccagacttgct

SEQ ID NO: 7147472 - DNA, 22 bp, Homo sapiens
ccctgtctcattgatcacttgt

SEQ ID NO: 7147473 - DNA, 22 bp, Homo sapiens
ccctgtctgtaccgtgatgagc

SEQ ID NO: 7147474 - DNA, 22 bp, Homo sapiens
ccctgtctgtaccgtgatgagc

SEQ ID NO: 7147475 - DNA, 22 bp, Homo sapiens
ccctgtcctgctaggccctggt

SEQ ID NO: 7147476 - DNA, 22 bp, Homo sapiens
ccctgtcctgctaggccctggt

SEQ ID NO: 7147477 - DNA, 23 bp, Homo sapiens
ccctgtagcccaggacaggcttt

SEQ ID NO: 7147478 - DNA, 22 bp, Homo sapiens
ccctggtggtacggcactggca

SEQ ID NO: 7147479 - DNA, 22 bp, Homo sapiens
ccctggtggtacggcactggca

SEQ ID NO: 7147480 - DNA, 22 bp, Homo sapiens
ccctggtggtacggcactggca

SEQ ID NO: 7147481 - DNA, 22 bp, Homo sapiens
ccctggtggtacggcactggca

SEQ ID NO: 7147482 - DNA, 22 bp, Homo sapiens
ccctggtgtccactggaggaag

SEQ ID NO: 7147483 - DNA, 22 bp, Homo sapiens
ccctggttcaggtttctctgaa

SEQ ID NO: 7147484 - DNA, 21 bp, Homo sapiens
ccctggttccactgtcaccgc

SEQ ID NO: 7147485 - DNA, 22 bp, Homo sapiens
ccgtggtcacctgagctccttg

SEQ ID NO: 7147486 - DNA, 22 bp, Homo sapiens
ccgtggagttgtgctgagtatg

SEQ ID NO: 7147487 - DNA, 22 bp, Homo sapiens
ccgtggcttcccaggcggatgt

SEQ ID NO: 7147488 - DNA, 22 bp, Homo sapiens
ccgtccccagccacctgctgat

SEQ ID NO: 7147489 - DNA, 22 bp, Homo sapiens
ccgtcccctctgaccttgctga

SEQ ID NO: 7147490 - DNA, 22 bp, Homo sapiens
ccgtctgcagcctccaggagtt

SEQ ID NO: 7147491 - DNA, 21 bp, Homo sapiens
ccgtgctcggctatggaccac

SEQ ID NO: 7147492 - DNA, 21 bp, Homo sapiens
ccgtgctcggctatggaccac

SEQ ID NO: 7147493 - DNA, 22 bp, Homo sapiens
ccgtattataagtttttccttc

SEQ ID NO: 7147494 - DNA, 22 bp, Homo sapiens
ccggtcccaggtgccccggtga

SEQ ID NO: 7147495 - DNA, 18 bp, Homo sapiens
ccgggctttggtgacaca

SEQ ID NO: 7147496 - DNA, 22 bp, Homo sapiens
ccggggacttaaagtgaaggaa

SEQ ID NO: 7147497 - DNA, 22 bp, Homo sapiens
ccgggtggggactccaggtttc

SEQ ID NO: 7147498 - DNA, 22 bp, Homo sapiens
ccgggcctcgggacaccgggta

SEQ ID NO: 7147499 - DNA, 22 bp, Homo sapiens
ccgggccccacggtgacctcag

SEQ ID NO: 7147500 - DNA, 22 bp, Homo sapiens
ccgggccgccccgcgtttctta

SEQ ID NO: 7147501 - DNA, 22 bp, Homo sapiens
ccgggagcaggcgccaccgcca

SEQ ID NO: 7147502 - DNA, 22 bp, Homo sapiens
ccgggcctcgggacaccgggta

SEQ ID NO: 7147503 - DNA, 22 bp, Homo sapiens
ccgggcctcgggacaccgggta

SEQ ID NO: 7147504 - DNA, 22 bp, Homo sapiens
ccgggcgggggctctcgtcacc

SEQ ID NO: 7147505 - DNA, 22 bp, Homo sapiens
ccgggcgggggctctcgtcacc

SEQ ID NO: 7147506 - DNA, 22 bp, Homo sapiens
ccggctactcgggaggctgacg

SEQ ID NO: 7147507 - DNA, 22 bp, Homo sapiens
ccggctactcgggaggctgacg

SEQ ID NO: 7147508 - DNA, 22 bp, Homo sapiens
ccggctcggcgaccaggctgaa

SEQ ID NO: 7147509 - DNA, 22 bp, Homo sapiens
ccgggagcaggcgccaccgcca

SEQ ID NO: 7147510 - DNA, 22 bp, Homo sapiens
ccggctactcgggaggctgacg

SEQ ID NO: 7147511 - DNA, 22 bp, Homo sapiens
ccggctactcgggaggctgacg

SEQ ID NO: 7147512 - DNA, 22 bp, Homo sapiens
ccggctactcgggaggctgacg

SEQ ID NO: 7147513 - DNA, 22 bp, Homo sapiens
cctatttgtaggctgggccagt

SEQ ID NO: 7147514 - DNA, 23 bp, Homo sapiens
ccgtgtgtatactctgtaataga

SEQ ID NO: 7147515 - DNA, 22 bp, Homo sapiens
ccgtgtacataaagccctggta

SEQ ID NO: 7147516 - DNA, 22 bp, Homo sapiens
ccgtgtgtatggtggaactgct

SEQ ID NO: 7147517 - DNA, 22 bp, Homo sapiens
cctcacagagcccagatgtcta

SEQ ID NO: 7147518 - DNA, 22 bp, Homo sapiens
cctcacagagcccagatgtcta

SEQ ID NO: 7147519 - DNA, 22 bp, Homo sapiens
cctcacagaggggcagccatct

SEQ ID NO: 7147520 - DNA, 22 bp, Homo sapiens
cctcacagaggggcagccatct

SEQ ID NO: 7147521 - DNA, 22 bp, Homo sapiens
cctcacagaggggcagccatct

SEQ ID NO: 7147522 - DNA, 22 bp, Homo sapiens
cctcacagaggggcagccatct

SEQ ID NO: 7147523 - DNA, 22 bp, Homo sapiens
cctcacagcaaggatttcagtg

SEQ ID NO: 7147524 - DNA, 22 bp, Homo sapiens
cctcacagccctcctctagcac

SEQ ID NO: 7147525 - DNA, 22 bp, Homo sapiens
cctcacagccctcctctagcac

SEQ ID NO: 7147526 - DNA, 22 bp, Homo sapiens
cctcacagcccttggcccagga

SEQ ID NO: 7147527 - DNA, 22 bp, Homo sapiens
cctcacagcctcatgcccagcc

SEQ ID NO: 7147528 - DNA, 22 bp, Homo sapiens
cctcacagcctcatgcccagcc

SEQ ID NO: 7147529 - DNA, 22 bp, Homo sapiens
cctcacagcttgggcaaacggc

SEQ ID NO: 7147530 - DNA, 17 bp, Homo sapiens
cctcacagggaccagac

SEQ ID NO: 7147531 - DNA, 17 bp, Homo sapiens
cctcacagggaccagac

SEQ ID NO: 7147532 - DNA, 17 bp, Homo sapiens
cctcacagggaccagac

SEQ ID NO: 7147533 - DNA, 17 bp, Homo sapiens
cctcacagggaccagac

SEQ ID NO: 7147534 - DNA, 20 bp, Homo sapiens
cctcacagggcagagagggg

SEQ ID NO: 7147535 - DNA, 17 bp, Homo sapiens
cctcacagggaccagac

SEQ ID NO: 7147536 - DNA, 20 bp, Homo sapiens
cctcacagggcagagagggg

SEQ ID NO: 7147537 - DNA, 20 bp, Homo sapiens
cctcacagggcagagagggg

SEQ ID NO: 7147538 - DNA, 22 bp, Homo sapiens
cctcacagggccaggcccctca

SEQ ID NO: 7147539 - DNA, 22 bp, Homo sapiens
cctcacagtgttcgtgtcagat

SEQ ID NO: 7147540 - DNA, 22 bp, Homo sapiens
cctcacagtgttcgtgtcagat

SEQ ID NO: 7147541 - DNA, 22 bp, Homo sapiens
cctcacagtgttcgtgtcagat

SEQ ID NO: 7147542 - DNA, 22 bp, Homo sapiens
cctcacagtttggctaactgtg

SEQ ID NO: 7147543 - DNA, 22 bp, Homo sapiens
cctcacccactacactcaaggg

SEQ ID NO: 7147544 - DNA, 22 bp, Homo sapiens
cctcacccactacactcaaggg

SEQ ID NO: 7147545 - DNA, 22 bp, Homo sapiens
cctcacccactacactcaaggg

SEQ ID NO: 7147546 - DNA, 22 bp, Homo sapiens
cctcacccactacactcaaggg

SEQ ID NO: 7147547 - DNA, 22 bp, Homo sapiens
cctcacccagtcacctaggtgg

SEQ ID NO: 7147548 - DNA, 22 bp, Homo sapiens
cctcacccagtcacctaggtgg

SEQ ID NO: 7147549 - DNA, 22 bp, Homo sapiens
cctcacccagtcacctaggtgg

SEQ ID NO: 7147550 - DNA, 22 bp, Homo sapiens
cctcacccagtcacctaggtgg

SEQ ID NO: 7147551 - DNA, 22 bp, Homo sapiens
cccaagagatcgcatgtagttg

SEQ ID NO: 7147552 - DNA, 19 bp, Homo sapiens
cccaacttgactattttct

SEQ ID NO: 7147553 - DNA, 22 bp, Homo sapiens
cccaagcagggtgcagaggcat

SEQ ID NO: 7147554 - DNA, 22 bp, Homo sapiens
cccaagcagggtgcagaggcat

SEQ ID NO: 7147555 - DNA, 22 bp, Homo sapiens
cccaagccagaccctgaccctg

SEQ ID NO: 7147556 - DNA, 22 bp, Homo sapiens
tgattacacaccacagtgctcc

SEQ ID NO: 7147557 - DNA, 22 bp, Homo sapiens
cccaactactctcaggcagctt

SEQ ID NO: 7147558 - DNA, 22 bp, Homo sapiens
cccaactgaaatctccacctgc

SEQ ID NO: 7147559 - DNA, 21 bp, Homo sapiens
cccaacccatttccagttcat

SEQ ID NO: 7147560 - DNA, 22 bp, Homo sapiens
cccaaccccaacttcctatgtt

SEQ ID NO: 7147561 - DNA, 22 bp, Homo sapiens
cccaaccccaacttcctatgtt

SEQ ID NO: 7147562 - DNA, 22 bp, Homo sapiens
cccaaccagaaattgacagaca

SEQ ID NO: 7147563 - DNA, 22 bp, Homo sapiens
cccaaccagaaattgacagaga

SEQ ID NO: 7147564 - DNA, 21 bp, Homo sapiens
cccaacccatttccagttcat

SEQ ID NO: 7147565 - DNA, 22 bp, Homo sapiens
cccaaagggtgtcagcagcaag

SEQ ID NO: 7147566 - DNA, 22 bp, Homo sapiens
cccaaagggtgtcagcagcaag

SEQ ID NO: 7147567 - DNA, 22 bp, Homo sapiens
cccaaaggttgaggctgcagtg

SEQ ID NO: 7147568 - DNA, 22 bp, Homo sapiens
cccaaaggtttggtagatatga

SEQ ID NO: 7147569 - DNA, 22 bp, Homo sapiens
cccaaagtacaagtaaacatgt

SEQ ID NO: 7147570 - DNA, 22 bp, Homo sapiens
tgattacacagcagtaatttca

SEQ ID NO: 7147571 - DNA, 22 bp, Homo sapiens
tgattacactatttgggaatag

SEQ ID NO: 7147572 - DNA, 23 bp, Homo sapiens
tgattacaggaagttcaagtgtt

SEQ ID NO: 7147573 - DNA, 22 bp, Homo sapiens
tgattacactatttgggaatag

SEQ ID NO: 7147574 - DNA, 22 bp, Homo sapiens
tgattacagtatttgagatcca

SEQ ID NO: 7147575 - DNA, 22 bp, Homo sapiens
tgattacagtatttgagatcca

SEQ ID NO: 7147576 - DNA, 22 bp, Homo sapiens
tgattacagtctgacagatgtt

SEQ ID NO: 7147577 - DNA, 22 bp, Homo sapiens
tgattacattggtaatgtttat

SEQ ID NO: 7147578 - DNA, 22 bp, Homo sapiens
tgattacattggtaatgtttat

SEQ ID NO: 7147579 - DNA, 22 bp, Homo sapiens
tgattcaactttcataacaaaa

SEQ ID NO: 7147580 - DNA, 22 bp, Homo sapiens
tgattcaactttcataacaaaa

SEQ ID NO: 7147581 - DNA, 17 bp, Homo sapiens
tgattcaactagaaact

SEQ ID NO: 7147582 - DNA, 17 bp, Homo sapiens
tgattcaactagaaact

SEQ ID NO: 7147583 - DNA, 22 bp, Homo sapiens
tgattatattaactatgttcct

SEQ ID NO: 7147584 - DNA, 22 bp, Homo sapiens
tgattatattctaacttcataa

SEQ ID NO: 7147585 - DNA, 22 bp, Homo sapiens
ccatggcattttatgtgtctta

SEQ ID NO: 7147586 - DNA, 23 bp, Homo sapiens
ccatggccaatgtcaagctacta

SEQ ID NO: 7147587 - DNA, 22 bp, Homo sapiens
ccatggcagccatgggagccac

SEQ ID NO: 7147588 - DNA, 22 bp, Homo sapiens
ccatggcagcctggcctggctt

SEQ ID NO: 7147589 - DNA, 22 bp, Homo sapiens
ccatggcagcctggcctggctt

SEQ ID NO: 7147590 - DNA, 22 bp, Homo sapiens
ccatggcattttatgtgtctta

SEQ ID NO: 7147591 - DNA, 22 bp, Homo sapiens
ccatggccgccgctgctcagga

SEQ ID NO: 7147592 - DNA, 20 bp, Homo sapiens
ccatggccacatctgtgctg

SEQ ID NO: 7147593 - DNA, 22 bp, Homo sapiens
ccatggccaggaaagccaaggt

SEQ ID NO: 7147594 - DNA, 22 bp, Homo sapiens
ccatggccaggaaagccaaggt

SEQ ID NO: 7147595 - DNA, 22 bp, Homo sapiens
ccatggccaattgcaccttgct

SEQ ID NO: 7147596 - DNA, 20 bp, Homo sapiens
ccatggccacatctgtgctg

SEQ ID NO: 7147597 - DNA, 20 bp, Homo sapiens
ccatggccacatctgtgctg

SEQ ID NO: 7147598 - DNA, 22 bp, Homo sapiens
ccatggagcgggtgagtgagtg

SEQ ID NO: 7147599 - DNA, 22 bp, Homo sapiens
ccatggagcgggtgagtgagtg

SEQ ID NO: 7147600 - DNA, 22 bp, Homo sapiens
ccatggagttcctctggtctat

SEQ ID NO: 7147601 - DNA, 22 bp, Homo sapiens
ccatggatctggatctatcttt

SEQ ID NO: 7147602 - DNA, 22 bp, Homo sapiens
ccatggcaaaggagatgttttc

SEQ ID NO: 7147603 - DNA, 22 bp, Homo sapiens
ccatggcaactggcgtccaggg

SEQ ID NO: 7147604 - DNA, 22 bp, Homo sapiens
ccatggcaactggcgtccaggg

SEQ ID NO: 7147605 - DNA, 19 bp, Homo sapiens
ccatggcaatgatctgatg

SEQ ID NO: 7147606 - DNA, 19 bp, Homo sapiens
ccatggcaatgatctgatg

SEQ ID NO: 7147607 - DNA, 22 bp, Homo sapiens
ccatggcaatggtaaactgaca

SEQ ID NO: 7147608 - DNA, 22 bp, Homo sapiens
ccatggcaatggtcagtctatt

SEQ ID NO: 7147609 - DNA, 22 bp, Homo sapiens
ccatggcaatggtcagtctatt

SEQ ID NO: 7147610 - DNA, 22 bp, Homo sapiens
ccatggcaatggtcagtctatt

SEQ ID NO: 7147611 - DNA, 22 bp, Homo sapiens
ccatggccgccgctgctcagga

SEQ ID NO: 7147612 - DNA, 22 bp, Homo sapiens
ccatggccgccgctgctcagga

SEQ ID NO: 7147613 - DNA, 22 bp, Homo sapiens
ccatggcctcgctctacgtggg

SEQ ID NO: 7147614 - DNA, 22 bp, Homo sapiens
ccatggcctcgctctacgtggg

SEQ ID NO: 7147615 - DNA, 22 bp, Homo sapiens
ccatggcctcgctctacgtggg

SEQ ID NO: 7147616 - DNA, 22 bp, Homo sapiens
ccattgtagtatctgttttagt

SEQ ID NO: 7147617 - DNA, 22 bp, Homo sapiens
ccattgtttatttagacttaat

SEQ ID NO: 7147618 - DNA, 19 bp, Homo sapiens
ccattgtttgttgcccaag

SEQ ID NO: 7147619 - DNA, 22 bp, Homo sapiens
cccaaagcagggtcattgggcc

SEQ ID NO: 7147620 - DNA, 22 bp, Homo sapiens
cccaaaggaaggacaaggcaga

SEQ ID NO: 7147621 - DNA, 22 bp, Homo sapiens
cccaaaggcattttgctgacca

SEQ ID NO: 7147622 - DNA, 22 bp, Homo sapiens
cccaaaggcattttgctgacca

SEQ ID NO: 7147623 - DNA, 22 bp, Homo sapiens
cccaaaggataaggtaagaatg

SEQ ID NO: 7147624 - DNA, 22 bp, Homo sapiens
cccaaaggctctggagatttga

SEQ ID NO: 7147625 - DNA, 22 bp, Homo sapiens
cccaaaggctctggagatttga

SEQ ID NO: 7147626 - DNA, 22 bp, Homo sapiens
cccaaaggctgtacttgtaacc

SEQ ID NO: 7147627 - DNA, 22 bp, Homo sapiens
cccaaagggcttcctgttctca

SEQ ID NO: 7147628 - DNA, 22 bp, Homo sapiens
cccaaagggcttcctgttctca

SEQ ID NO: 7147629 - DNA, 22 bp, Homo sapiens
tgatgagggggaacagagattt

SEQ ID NO: 7147630 - DNA, 22 bp, Homo sapiens
tgatgagggcagttcttgttgc

SEQ ID NO: 7147631 - DNA, 22 bp, Homo sapiens
tgatgaggggctcagaggtcag

SEQ ID NO: 7147632 - DNA, 22 bp, Homo sapiens
tgatgaggggctcagaggtcag

SEQ ID NO: 7147633 - DNA, 23 bp, Homo sapiens
ccatggagcatggctcactaggc

SEQ ID NO: 7147634 - DNA, 22 bp, Homo sapiens
ccatggagcacctcacagaggc

SEQ ID NO: 7147635 - DNA, 22 bp, Homo sapiens
ccatggaagaactgatgtgcca

SEQ ID NO: 7147636 - DNA, 19 bp, Homo sapiens
ccatggagagagatgcatt

SEQ ID NO: 7147637 - DNA, 22 bp, Homo sapiens
tgatgaggcatatgctacacat

SEQ ID NO: 7147638 - DNA, 22 bp, Homo sapiens
tgatgaggagactgtggcttgg

SEQ ID NO: 7147639 - DNA, 22 bp, Homo sapiens
tgatgaccgccaacgtttaggt

SEQ ID NO: 7147640 - DNA, 22 bp, Homo sapiens
tgatgaccgccaacgtttaggt

SEQ ID NO: 7147641 - DNA, 22 bp, Homo sapiens
tgatgaccgccaacgtttaggt

SEQ ID NO: 7147642 - DNA, 22 bp, Homo sapiens
tgatgacccaaggtgtcctctg

SEQ ID NO: 7147643 - DNA, 22 bp, Homo sapiens
tgaggcagtgctgggaagcctg

SEQ ID NO: 7147644 - DNA, 22 bp, Homo sapiens
tgaggcagtgctgggaagcctg

SEQ ID NO: 7147645 - DNA, 22 bp, Homo sapiens
tgaggcagtgatgtttaagcac

SEQ ID NO: 7147646 - DNA, 22 bp, Homo sapiens
tgaggcagtgatgtttaagcac

SEQ ID NO: 7147647 - DNA, 18 bp, Homo sapiens
tgaggcagtcagtgatgg

SEQ ID NO: 7147648 - DNA, 18 bp, Homo sapiens
tgaggcagtcagtgatgg

SEQ ID NO: 7147649 - DNA, 18 bp, Homo sapiens
tgaggcagtcagtgatgg

SEQ ID NO: 7147650 - DNA, 22 bp, Homo sapiens
tgatgacaaactttcctgatgc

SEQ ID NO: 7147651 - DNA, 22 bp, Homo sapiens
tgatgacaaactttcctgatgc

SEQ ID NO: 7147652 - DNA, 22 bp, Homo sapiens
tgatgacaatgttgctgcaata

SEQ ID NO: 7147653 - DNA, 22 bp, Homo sapiens
tgatgaattagtaacaaatgag

SEQ ID NO: 7147654 - DNA, 22 bp, Homo sapiens
tgatgaattagtaacaaatgag

SEQ ID NO: 7147655 - DNA, 22 bp, Homo sapiens
tgatgaattggaaattctgatt

SEQ ID NO: 7147656 - DNA, 22 bp, Homo sapiens
tgatgaattagtaacaaatgag

SEQ ID NO: 7147657 - DNA, 16 bp, Homo sapiens
tgatgacagatatggc

SEQ ID NO: 7147658 - DNA, 22 bp, Homo sapiens
tgatgacagcatggaccccagg

SEQ ID NO: 7147659 - DNA, 22 bp, Homo sapiens
tgatgacaggcagggttaagtg

SEQ ID NO: 7147660 - DNA, 22 bp, Homo sapiens
tgatgacagtgttacagctcca

SEQ ID NO: 7147661 - DNA, 22 bp, Homo sapiens
tgatgacagtgttacagctcca

SEQ ID NO: 7147662 - DNA, 18 bp, Homo sapiens
tgaggcagtcagtgatgg

SEQ ID NO: 7147663 - DNA, 22 bp, Homo sapiens
tgaggcagtcaccccctcctgc

SEQ ID NO: 7147664 - DNA, 22 bp, Homo sapiens
tgaggcagtcaccccctcctgc

SEQ ID NO: 7147665 - DNA, 22 bp, Homo sapiens
tgaggcagtattttagtgactt

SEQ ID NO: 7147666 - DNA, 22 bp, Homo sapiens
tgaggcagtattttagtgactt

SEQ ID NO: 7147667 - DNA, 22 bp, Homo sapiens
tgaggcagtcaccccctcctgc

SEQ ID NO: 7147668 - DNA, 22 bp, Homo sapiens
tgaggcagtattttagtgactt

SEQ ID NO: 7147669 - DNA, 22 bp, Homo sapiens
tgaggcagtattttagtgactt

SEQ ID NO: 7147670 - DNA, 22 bp, Homo sapiens
tgaggcagtattttagtgactt

SEQ ID NO: 7147671 - DNA, 22 bp, Homo sapiens
tgaggcaggtggattacaaggt

SEQ ID NO: 7147672 - DNA, 22 bp, Homo sapiens
tgaggcaggtggattacaaggt

SEQ ID NO: 7147673 - DNA, 22 bp, Homo sapiens
tgaggcagtattctccattcca

SEQ ID NO: 7147674 - DNA, 22 bp, Homo sapiens
tgaggcagtattctccattcca

SEQ ID NO: 7147675 - DNA, 22 bp, Homo sapiens
tgaggcaggtggattacaaggt

SEQ ID NO: 7147676 - DNA, 22 bp, Homo sapiens
tgaggcaggtaagcaagttttg

SEQ ID NO: 7147677 - DNA, 21 bp, Homo sapiens
tgaggcaggggtgcttttgtc

SEQ ID NO: 7147678 - DNA, 21 bp, Homo sapiens
tgaggcaggggtgcttttgtc

SEQ ID NO: 7147679 - DNA, 22 bp, Homo sapiens
tgaggcaggtaagcaagttttg

SEQ ID NO: 7147680 - DNA, 22 bp, Homo sapiens
ccagtgtggccaggtgctggta

SEQ ID NO: 7147681 - DNA, 22 bp, Homo sapiens
ccagtgtgggcccggcctcctc

SEQ ID NO: 7147682 - DNA, 22 bp, Homo sapiens
ccagtgtgttccctgcctcact

SEQ ID NO: 7147683 - DNA, 19 bp, Homo sapiens
cccagagagatctcttgcc

SEQ ID NO: 7147684 - DNA, 22 bp, Homo sapiens
cccagagaattccacatagagg

SEQ ID NO: 7147685 - DNA, 22 bp, Homo sapiens
cccagagactttgtccgacgac

SEQ ID NO: 7147686 - DNA, 22 bp, Homo sapiens
cccagagagcatttggacaaag

SEQ ID NO: 7147687 - DNA, 22 bp, Homo sapiens
cccagagagcatttggacaaag

SEQ ID NO: 7147688 - DNA, 22 bp, Homo sapiens
cccagagatcttgtcctttcca

SEQ ID NO: 7147689 - DNA, 22 bp, Homo sapiens
cccagagggtggaggttgcagt

SEQ ID NO: 7147690 - DNA, 22 bp, Homo sapiens
cccagaggtgaaggaggtggga

SEQ ID NO: 7147691 - DNA, 22 bp, Homo sapiens
cccagaggtctgaaaaggttga

SEQ ID NO: 7147692 - DNA, 22 bp, Homo sapiens
cccagaggtgaaggaggtggga

SEQ ID NO: 7147693 - DNA, 22 bp, Homo sapiens
cccagcactcagcaggctcata

SEQ ID NO: 7147694 - DNA, 22 bp, Homo sapiens
cccagagaattccacatagagg

SEQ ID NO: 7147695 - DNA, 22 bp, Homo sapiens
cccagagaatctttcagaaagg

SEQ ID NO: 7147696 - DNA, 22 bp, Homo sapiens
cccagagaagtgaagtgacttg

SEQ ID NO: 7147697 - DNA, 22 bp, Homo sapiens
cccagagaagtgaagtgacttg

SEQ ID NO: 7147698 - DNA, 22 bp, Homo sapiens
cccagagaaccttctgtgccac

SEQ ID NO: 7147699 - DNA, 22 bp, Homo sapiens
tgcagaggtttccaggcaagtt

SEQ ID NO: 7147700 - DNA, 22 bp, Homo sapiens
tgcagaggtttccaggcaagtt

SEQ ID NO: 7147701 - DNA, 22 bp, Homo sapiens
tgcagaggtttccaggcaagtt

SEQ ID NO: 7147702 - DNA, 22 bp, Homo sapiens
tgcagaggtttgtggtgttgct

SEQ ID NO: 7147703 - DNA, 22 bp, Homo sapiens
tgcagaggtttgtggtgttgct

SEQ ID NO: 7147704 - DNA, 22 bp, Homo sapiens
tgcagaggtttgtggtgttgct

SEQ ID NO: 7147705 - DNA, 22 bp, Homo sapiens
tgcagaggtttgtggtgttgct

SEQ ID NO: 7147706 - DNA, 22 bp, Homo sapiens
tgcagaggtttttaatacattt

SEQ ID NO: 7147707 - DNA, 22 bp, Homo sapiens
tgcagaggtttttaatacattt

SEQ ID NO: 7147708 - DNA, 22 bp, Homo sapiens
tgcagaggtttttaatacattt

SEQ ID NO: 7147709 - DNA, 22 bp, Homo sapiens
tgcagagtaaaagcagatgcta

SEQ ID NO: 7147710 - DNA, 22 bp, Homo sapiens
tgcagagtaaaagcagatgcta

SEQ ID NO: 7147711 - DNA, 22 bp, Homo sapiens
cccagcagatggctatgtgcta

SEQ ID NO: 7147712 - DNA, 22 bp, Homo sapiens
cccagcagatggctatgtgcta

SEQ ID NO: 7147713 - DNA, 23 bp, Homo sapiens
cccagcagagatgaggaggggtc

SEQ ID NO: 7147714 - DNA, 23 bp, Homo sapiens
cccagcagagatgaggaggggtc

SEQ ID NO: 7147715 - DNA, 23 bp, Homo sapiens
cccagcagagatgaggaggggtc

SEQ ID NO: 7147716 - DNA, 22 bp, Homo sapiens
cccagcagaccgctgtgatggc

SEQ ID NO: 7147717 - DNA, 22 bp, Homo sapiens
cccagcagaccgctgtgatggc

SEQ ID NO: 7147718 - DNA, 23 bp, Homo sapiens
cccagcagagatgaggaggggtc

SEQ ID NO: 7147719 - DNA, 23 bp, Homo sapiens
cccagcagagatgaggaggggtc

SEQ ID NO: 7147720 - DNA, 22 bp, Homo sapiens
cccagcagaatctgatgagggc

SEQ ID NO: 7147721 - DNA, 22 bp, Homo sapiens
cccagcagaccgctgtgatggc

SEQ ID NO: 7147722 - DNA, 18 bp, Homo sapiens
cccagcactttgggagcc

SEQ ID NO: 7147723 - DNA, 22 bp, Homo sapiens
cccagcactttgaatatgtcac

SEQ ID NO: 7147724 - DNA, 22 bp, Homo sapiens
cccagcactttgaatatgtcac

SEQ ID NO: 7147725 - DNA, 22 bp, Homo sapiens
cccagcactttgaatatgtcac

SEQ ID NO: 7147726 - DNA, 18 bp, Homo sapiens
cccagcactttgggagcc

SEQ ID NO: 7147727 - DNA, 18 bp, Homo sapiens
cccagcactttgggagcc

SEQ ID NO: 7147728 - DNA, 18 bp, Homo sapiens
cccagcactttgggagcc

SEQ ID NO: 7147729 - DNA, 22 bp, Homo sapiens
cccagcagaatctgatgagggc

SEQ ID NO: 7147730 - DNA, 22 bp, Homo sapiens
cccagcagaatctgatgagggc

SEQ ID NO: 7147731 - DNA, 22 bp, Homo sapiens
cccagcagccagaatgaggagc

SEQ ID NO: 7147732 - DNA, 22 bp, Homo sapiens
cccagcagccagaatgaggagc

SEQ ID NO: 7147733 - DNA, 22 bp, Homo sapiens
tgcagcaggtatggcaagctcc

SEQ ID NO: 7147734 - DNA, 22 bp, Homo sapiens
tgcagcaggtatggcaagctcc

SEQ ID NO: 7147735 - DNA, 22 bp, Homo sapiens
tgcagcaggtatggcaagctcc

SEQ ID NO: 7147736 - DNA, 22 bp, Homo sapiens
tgcagcaggttccaaagggtta

SEQ ID NO: 7147737 - DNA, 22 bp, Homo sapiens
tgcagcaggttccaaagggtta

SEQ ID NO: 7147738 - DNA, 22 bp, Homo sapiens
tgcagcagtcagtcaggcctgg

SEQ ID NO: 7147739 - DNA, 22 bp, Homo sapiens
tgcagcagtcagtcaggcctgg

SEQ ID NO: 7147740 - DNA, 22 bp, Homo sapiens
tgcagcagtgttccttggcttg

SEQ ID NO: 7147741 - DNA, 22 bp, Homo sapiens
cccacaggctaggggtagggca

SEQ ID NO: 7147742 - DNA, 22 bp, Homo sapiens
cccacaggctaggggtagggca

SEQ ID NO: 7147743 - DNA, 22 bp, Homo sapiens
cccacagggctgctgatggcag

SEQ ID NO: 7147744 - DNA, 22 bp, Homo sapiens
cccacagggctgctgatggcag

SEQ ID NO: 7147745 - DNA, 22 bp, Homo sapiens
cccacaggtccccatgaactcg

SEQ ID NO: 7147746 - DNA, 22 bp, Homo sapiens
cccacaggtccccatgaactcg

SEQ ID NO: 7147747 - DNA, 22 bp, Homo sapiens
cccacaggtggaagcctcggaa

SEQ ID NO: 7147748 - DNA, 22 bp, Homo sapiens
cccacaggtggaagcctcggaa

SEQ ID NO: 7147749 - DNA, 22 bp, Homo sapiens
cccacaggtggaagcctcggaa

SEQ ID NO: 7147750 - DNA, 22 bp, Homo sapiens
cccacaggtgtgagcttgctgg

SEQ ID NO: 7147751 - DNA, 22 bp, Homo sapiens
cccacaggtgtgagcttgctgg

SEQ ID NO: 7147752 - DNA, 22 bp, Homo sapiens
cccacagttaaccaaaggaatt

SEQ ID NO: 7147753 - DNA, 22 bp, Homo sapiens
cccacaggccctgctgccttga

SEQ ID NO: 7147754 - DNA, 22 bp, Homo sapiens
cccacaggcaggggcagagaca

SEQ ID NO: 7147755 - DNA, 22 bp, Homo sapiens
cccacaggcaggtgcatgggct

SEQ ID NO: 7147756 - DNA, 22 bp, Homo sapiens
cccacaggcaggtgcatgggct

SEQ ID NO: 7147757 - DNA, 22 bp, Homo sapiens
cccacaggcaggggcagagaca

SEQ ID NO: 7147758 - DNA, 22 bp, Homo sapiens
cccacaggcaggtgcatgggct

SEQ ID NO: 7147759 - DNA, 22 bp, Homo sapiens
cccacaggcaggtgcatgggct

SEQ ID NO: 7147760 - DNA, 22 bp, Homo sapiens
cccacaggcaggtgcatgggct

SEQ ID NO: 7147761 - DNA, 22 bp, Homo sapiens
cccaagggtgcccagcagagga

SEQ ID NO: 7147762 - DNA, 22 bp, Homo sapiens
cccacactctgagaaatgctga

SEQ ID NO: 7147763 - DNA, 22 bp, Homo sapiens
cccacaggacgggctaaagagt

SEQ ID NO: 7147764 - DNA, 19 bp, Homo sapiens
cccacaggaggacatatgg

SEQ ID NO: 7147765 - DNA, 19 bp, Homo sapiens
cccacaggaggacatatgg

SEQ ID NO: 7147766 - DNA, 22 bp, Homo sapiens
cccacaggcaggggcagagaca

SEQ ID NO: 7147767 - DNA, 19 bp, Homo sapiens
cccacaggaggacatatgg

SEQ ID NO: 7147768 - DNA, 22 bp, Homo sapiens
tgcagagatagaactactttct

SEQ ID NO: 7147769 - DNA, 22 bp, Homo sapiens
tgcagagatagaactactttct

SEQ ID NO: 7147770 - DNA, 22 bp, Homo sapiens
cccacccctggacaggtgagtg

SEQ ID NO: 7147771 - DNA, 22 bp, Homo sapiens
cccacccctggacaggtgagtg

SEQ ID NO: 7147772 - DNA, 22 bp, Homo sapiens
cccacccctggacaggtgagtg

SEQ ID NO: 7147773 - DNA, 22 bp, Homo sapiens
cccacccagcctggctgagggg

SEQ ID NO: 7147774 - DNA, 22 bp, Homo sapiens
cccacccagcctggctgagggg

SEQ ID NO: 7147775 - DNA, 22 bp, Homo sapiens
cccacccagcctggctgagggg

SEQ ID NO: 7147776 - DNA, 22 bp, Homo sapiens
cccacccagcctggctgagggg

SEQ ID NO: 7147777 - DNA, 22 bp, Homo sapiens
cccacccagctgagccgctcac

SEQ ID NO: 7147778 - DNA, 22 bp, Homo sapiens
cccacccagctgagccgctcac

SEQ ID NO: 7147779 - DNA, 22 bp, Homo sapiens
cccacccagctgagccgctcac

SEQ ID NO: 7147780 - DNA, 22 bp, Homo sapiens
cccacccagctgagccgctcac

SEQ ID NO: 7147781 - DNA, 21 bp, Homo sapiens
cccaccccataaggcagaacc

SEQ ID NO: 7147782 - DNA, 23 bp, Homo sapiens
cccacatgtctgagtcagtgcca

SEQ ID NO: 7147783 - DNA, 23 bp, Homo sapiens
cccacatgtctgagtcagtgcca

SEQ ID NO: 7147784 - DNA, 22 bp, Homo sapiens
cccaccacgtgctttgctggag

SEQ ID NO: 7147785 - DNA, 22 bp, Homo sapiens
cccaccacgtgctttgctggag

SEQ ID NO: 7147786 - DNA, 22 bp, Homo sapiens
cccaccagattctcaaatatct

SEQ ID NO: 7147787 - DNA, 22 bp, Homo sapiens
cccaccagccatctgagagtgt

SEQ ID NO: 7147788 - DNA, 22 bp, Homo sapiens
cccacccactctgaccagaagc

SEQ ID NO: 7147789 - DNA, 22 bp, Homo sapiens
cccacccagcctggctgagggg

SEQ ID NO: 7147790 - DNA, 22 bp, Homo sapiens
tgcagaggtttccaggcaagtt

SEQ ID NO: 7147791 - DNA, 22 bp, Homo sapiens
tgcagaggtttccaggcaagtt

SEQ ID NO: 7147792 - DNA, 22 bp, Homo sapiens
tgcagaggtgttgctgagataa

SEQ ID NO: 7147793 - DNA, 22 bp, Homo sapiens
tgcagaggtgttgctgagataa

SEQ ID NO: 7147794 - DNA, 22 bp, Homo sapiens
tgcagaggtgttgctgagataa

SEQ ID NO: 7147795 - DNA, 22 bp, Homo sapiens
tgcagaggtgttgctgagataa

SEQ ID NO: 7147796 - DNA, 21 bp, Homo sapiens
tgcagagatatctgaagcaga

SEQ ID NO: 7147797 - DNA, 15 bp, Homo sapiens
tgcagaggtacctgg

SEQ ID NO: 7147798 - DNA, 22 bp, Homo sapiens
tgcagaggtgaaagactagcaa

SEQ ID NO: 7147799 - DNA, 22 bp, Homo sapiens
tgcagaggtgtgcattcttaag

SEQ ID NO: 7147800 - DNA, 22 bp, Homo sapiens
tgcagaggtgaaagactagcaa

SEQ ID NO: 7147801 - DNA, 22 bp, Homo sapiens
tgcagaggtgaaagactagcaa

SEQ ID NO: 7147802 - DNA, 22 bp, Homo sapiens
tgccctcctcctgagcccatgt

SEQ ID NO: 7147803 - DNA, 22 bp, Homo sapiens
tgccctcctcctgagcccatgt

SEQ ID NO: 7147804 - DNA, 22 bp, Homo sapiens
tgccctcctcctgagcccatgt

SEQ ID NO: 7147805 - DNA, 22 bp, Homo sapiens
tgccctctgcaggccgccatgg

SEQ ID NO: 7147806 - DNA, 22 bp, Homo sapiens
tgccctccctgtactgtcagga

SEQ ID NO: 7147807 - DNA, 22 bp, Homo sapiens
tgccctcccacattatggctgt

SEQ ID NO: 7147808 - DNA, 22 bp, Homo sapiens
tgccctccacagtggctccacc

SEQ ID NO: 7147809 - DNA, 23 bp, Homo sapiens
tgccctcccaatgcttcggtcac

SEQ ID NO: 7147810 - DNA, 22 bp, Homo sapiens
tgccctcattataagaggctca

SEQ ID NO: 7147811 - DNA, 22 bp, Homo sapiens
tgccctcattataagaggctca

SEQ ID NO: 7147812 - DNA, 22 bp, Homo sapiens
tgccctcagccacctccaagtt

SEQ ID NO: 7147813 - DNA, 22 bp, Homo sapiens
tgccctcagccacctccaagtt

SEQ ID NO: 7147814 - DNA, 22 bp, Homo sapiens
tgccctcagcagcagctcctgc

SEQ ID NO: 7147815 - DNA, 22 bp, Homo sapiens
tgccctcagcagcagctcctgc

SEQ ID NO: 7147816 - DNA, 21 bp, Homo sapiens
cccaggaggctgagaagagca

SEQ ID NO: 7147817 - DNA, 22 bp, Homo sapiens
tgcccaggatctggcgatgctc

SEQ ID NO: 7147818 - DNA, 22 bp, Homo sapiens
tgcccaggatctggcgatgctc

SEQ ID NO: 7147819 - DNA, 22 bp, Homo sapiens
tgcccaggatctggcgatgctc

SEQ ID NO: 7147820 - DNA, 22 bp, Homo sapiens
cccaggaggcggaggttgcagt

SEQ ID NO: 7147821 - DNA, 22 bp, Homo sapiens
cccaggaggcggaggttgcagt

SEQ ID NO: 7147822 - DNA, 22 bp, Homo sapiens
cccaggaggcggaggttgcagt

SEQ ID NO: 7147823 - DNA, 19 bp, Homo sapiens
cccaggaggcggaggttgc

SEQ ID NO: 7147824 - DNA, 22 bp, Homo sapiens
cccaggaggcggaggttgcagt

SEQ ID NO: 7147825 - DNA, 21 bp, Homo sapiens
cccaggaggctgagaagagca

SEQ ID NO: 7147826 - DNA, 21 bp, Homo sapiens
cccaggaggctgagaagagca

SEQ ID NO: 7147827 - DNA, 22 bp, Homo sapiens
cccaggaggcggaggttgtggt

SEQ ID NO: 7147828 - DNA, 22 bp, Homo sapiens
cccaggaggcggaggttgtggt

SEQ ID NO: 7147829 - DNA, 21 bp, Homo sapiens
cccaggaggctgagaagagca

SEQ ID NO: 7147830 - DNA, 21 bp, Homo sapiens
cccaggaggctgagaagagca

SEQ ID NO: 7147831 - DNA, 22 bp, Homo sapiens
tgccctgaagcaccctcaccct

SEQ ID NO: 7147832 - DNA, 19 bp, Homo sapiens
tgccctgcacgctgtcctg

SEQ ID NO: 7147833 - DNA, 22 bp, Homo sapiens
cccaggaggttgaggctgcagt

SEQ ID NO: 7147834 - DNA, 22 bp, Homo sapiens
cccaggaggttgaggctgcagt

SEQ ID NO: 7147835 - DNA, 22 bp, Homo sapiens
cccaggaggttgaggctgcagt

SEQ ID NO: 7147836 - DNA, 22 bp, Homo sapiens
cccaggaggttggggctacagt

SEQ ID NO: 7147837 - DNA, 22 bp, Homo sapiens
cccaggaggttggggctacagt

SEQ ID NO: 7147838 - DNA, 22 bp, Homo sapiens
cccaggagtaagtgacattgtt

SEQ ID NO: 7147839 - DNA, 22 bp, Homo sapiens
cccaggagtaagtgacattgtt

SEQ ID NO: 7147840 - DNA, 22 bp, Homo sapiens
cccaggagtaagtgacattgtt

SEQ ID NO: 7147841 - DNA, 21 bp, Homo sapiens
cccaggagtcctatttaaatg

SEQ ID NO: 7147842 - DNA, 19 bp, Homo sapiens
cccaggagtctggctggtt

SEQ ID NO: 7147843 - DNA, 19 bp, Homo sapiens
cccaggagtctggctggtt

SEQ ID NO: 7147844 - DNA, 19 bp, Homo sapiens
cccaggagtctggctggtt

SEQ ID NO: 7147845 - DNA, 19 bp, Homo sapiens
cccaggagtctggctggtt

SEQ ID NO: 7147846 - DNA, 20 bp, Homo sapiens
cccaggagtgagcagcttta

SEQ ID NO: 7147847 - DNA, 20 bp, Homo sapiens
cccaggagtgagcagcttta

SEQ ID NO: 7147848 - DNA, 20 bp, Homo sapiens
cccaggagtgagcagcttta

SEQ ID NO: 7147849 - DNA, 19 bp, Homo sapiens
cccaggagtctggctggtt

SEQ ID NO: 7147850 - DNA, 20 bp, Homo sapiens
cccaggagtgagcagcttta

SEQ ID NO: 7147851 - DNA, 23 bp, Homo sapiens
tgcctcagtggaatgtgagggtg

SEQ ID NO: 7147852 - DNA, 23 bp, Homo sapiens
tgcctcagtggaatgtgagggtg

SEQ ID NO: 7147853 - DNA, 22 bp, Homo sapiens
tgcctcagtttcatctgcagaa

SEQ ID NO: 7147854 - DNA, 22 bp, Homo sapiens
tgcctcagtttcatctgcagaa

SEQ ID NO: 7147855 - DNA, 22 bp, Homo sapiens
tgcctcagtctaaagtctctca

SEQ ID NO: 7147856 - DNA, 22 bp, Homo sapiens
tgccctggttctgtgggtgagc

SEQ ID NO: 7147857 - DNA, 22 bp, Homo sapiens
tgccctggttctgtgggtgagc

SEQ ID NO: 7147858 - DNA, 22 bp, Homo sapiens
tgccctggttctgtgggtgagc

SEQ ID NO: 7147859 - DNA, 22 bp, Homo sapiens
tgcatattctcctttattttgt

SEQ ID NO: 7147860 - DNA, 22 bp, Homo sapiens
tgcatattctcctttattttgt

SEQ ID NO: 7147861 - DNA, 22 bp, Homo sapiens
tgcatattatgtgtatctgtct

SEQ ID NO: 7147862 - DNA, 22 bp, Homo sapiens
tgcatattataaagagaattag

SEQ ID NO: 7147863 - DNA, 22 bp, Homo sapiens
tgcatatcttcaatgctgttgc

SEQ ID NO: 7147864 - DNA, 22 bp, Homo sapiens
tgcatatatcttatttttctgt

SEQ ID NO: 7147865 - DNA, 22 bp, Homo sapiens
tgcatatcactttgaatgggga

SEQ ID NO: 7147866 - DNA, 23 bp, Homo sapiens
tgcatatcagaaatttcatatgg

SEQ ID NO: 7147867 - DNA, 22 bp, Homo sapiens
tgcatatcagaattcaagagtg

SEQ ID NO: 7147868 - DNA, 22 bp, Homo sapiens
tgcatatccacaccttatctct

SEQ ID NO: 7147869 - DNA, 22 bp, Homo sapiens
tgcatatctggggatagggatg

SEQ ID NO: 7147870 - DNA, 22 bp, Homo sapiens
cccaggagaatatttttgggtc

SEQ ID NO: 7147871 - DNA, 22 bp, Homo sapiens
cccaggagaatatttttgggtc

SEQ ID NO: 7147872 - DNA, 22 bp, Homo sapiens
cccaggagacagaaacagaggt

SEQ ID NO: 7147873 - DNA, 22 bp, Homo sapiens
cccaggagacagaaacagaggt

SEQ ID NO: 7147874 - DNA, 22 bp, Homo sapiens
cccaggagacagaaacagaggt

SEQ ID NO: 7147875 - DNA, 22 bp, Homo sapiens
cccaggagacagaaacagaggt

SEQ ID NO: 7147876 - DNA, 22 bp, Homo sapiens
cccaggagacatatagaaggac

SEQ ID NO: 7147877 - DNA, 22 bp, Homo sapiens
cccaggagacatatagaaggac

SEQ ID NO: 7147878 - DNA, 22 bp, Homo sapiens
cccaggagacatatagaaggac

SEQ ID NO: 7147879 - DNA, 19 bp, Homo sapiens
tgcatatatctatgaaaga

SEQ ID NO: 7147880 - DNA, 21 bp, Homo sapiens
tgcatatataagtgcatacac

SEQ ID NO: 7147881 - DNA, 22 bp, Homo sapiens
tgcatattttataaagatggaa

SEQ ID NO: 7147882 - DNA, 22 bp, Homo sapiens
tgcatatttgtatgatgtttag

SEQ ID NO: 7147883 - DNA, 22 bp, Homo sapiens
tgcatatttgattgagatacct

SEQ ID NO: 7147884 - DNA, 22 bp, Homo sapiens
tgcatattgtgaaaatgtagat

SEQ ID NO: 7147885 - DNA, 22 bp, Homo sapiens
tgcatattgtccttgatattat

SEQ ID NO: 7147886 - DNA, 22 bp, Homo sapiens
tgcatattgtccttgatattat

SEQ ID NO: 7147887 - DNA, 21 bp, Homo sapiens
tgcatattcttctggtggctg

SEQ ID NO: 7147888 - DNA, 22 bp, Homo sapiens
tgcatattttctgattcagaag

SEQ ID NO: 7147889 - DNA, 22 bp, Homo sapiens
cccaggagataacgttcccaag

SEQ ID NO: 7147890 - DNA, 22 bp, Homo sapiens
cccaggagatctggatctcgtc

SEQ ID NO: 7147891 - DNA, 22 bp, Homo sapiens
cccaggagatctggatctcgtc

SEQ ID NO: 7147892 - DNA, 22 bp, Homo sapiens
cccaggagatctggatctcgtc

SEQ ID NO: 7147893 - DNA, 22 bp, Homo sapiens
cccaggagatctggatctcgtc

SEQ ID NO: 7147894 - DNA, 22 bp, Homo sapiens
cccaggagatctggatctcgtc

SEQ ID NO: 7147895 - DNA, 22 bp, Homo sapiens
cccaggagatctggatctcgtc

SEQ ID NO: 7147896 - DNA, 22 bp, Homo sapiens
cccaggaggacattccataccc

SEQ ID NO: 7147897 - DNA, 22 bp, Homo sapiens
cccaggaggacattccataccc

SEQ ID NO: 7147898 - DNA, 22 bp, Homo sapiens
cccaggaggcagaagttgcagt

SEQ ID NO: 7147899 - DNA, 22 bp, Homo sapiens
cccaggaggcagaagttgcagt

SEQ ID NO: 7147900 - DNA, 22 bp, Homo sapiens
cccaggaggcagaagttgcagt

SEQ ID NO: 7147901 - DNA, 22 bp, Homo sapiens
cccaggaggcagaagttgcagt

SEQ ID NO: 7147902 - DNA, 22 bp, Homo sapiens
cccaggaggcagaagttgcagt

SEQ ID NO: 7147903 - DNA, 22 bp, Homo sapiens
cccaggaggaggaaaaagctcg

SEQ ID NO: 7147904 - DNA, 22 bp, Homo sapiens
cccaggaggcagaagttgcagt

SEQ ID NO: 7147905 - DNA, 21 bp, Homo sapiens
cccaggaggagctccggctcc

SEQ ID NO: 7147906 - DNA, 22 bp, Homo sapiens
cccaggaggcagaggttgcagt

SEQ ID NO: 7147907 - DNA, 22 bp, Homo sapiens
cccaggaggcagagcttgcagt

SEQ ID NO: 7147908 - DNA, 22 bp, Homo sapiens
cccaggaggcagagcttgcagt

SEQ ID NO: 7147909 - DNA, 22 bp, Homo sapiens
cccaggaggcagagcttgcagt

SEQ ID NO: 7147910 - DNA, 22 bp, Homo sapiens
cccaggaggcagagcttgcagt

SEQ ID NO: 7147911 - DNA, 22 bp, Homo sapiens
cccaggaggcagagatagcagt

SEQ ID NO: 7147912 - DNA, 22 bp, Homo sapiens
cccaggaggcagagatagcagt

SEQ ID NO: 7147913 - DNA, 22 bp, Homo sapiens
cccaggaggcagagatagcagt

SEQ ID NO: 7147914 - DNA, 22 bp, Homo sapiens
cccaggaggcagagatagcagt

SEQ ID NO: 7147915 - DNA, 22 bp, Homo sapiens
cccaggaggcagagatagcagt

SEQ ID NO: 7147916 - DNA, 22 bp, Homo sapiens
cccaggaggcagagatagcagt

SEQ ID NO: 7147917 - DNA, 22 bp, Homo sapiens
cccaggaggcagagcttgcagt

SEQ ID NO: 7147918 - DNA, 22 bp, Homo sapiens
cccaggaggcagagcttgcagt

SEQ ID NO: 7147919 - DNA, 22 bp, Homo sapiens
cccaggaggcagagcttgcagt

SEQ ID NO: 7147920 - DNA, 22 bp, Homo sapiens
cccaggaggcagaggttgcagt

SEQ ID NO: 7147921 - DNA, 22 bp, Homo sapiens
cccaggaggcagaggttgcagt

SEQ ID NO: 7147922 - DNA, 22 bp, Homo sapiens
cccaggaggcagaggttgcagt

SEQ ID NO: 7147923 - DNA, 22 bp, Homo sapiens
cccaggaggcagaggttggagc

SEQ ID NO: 7147924 - DNA, 22 bp, Homo sapiens
cccaggaggcagatgttgcagt

SEQ ID NO: 7147925 - DNA, 22 bp, Homo sapiens
cccaggaggcagatgttgcagt

SEQ ID NO: 7147926 - DNA, 22 bp, Homo sapiens
cccaggaggccaaggttgcagt

SEQ ID NO: 7147927 - DNA, 22 bp, Homo sapiens
cccaggaggcagatgttgcagt

SEQ ID NO: 7147928 - DNA, 22 bp, Homo sapiens
cccaggaggcagaggttggagc

SEQ ID NO: 7147929 - DNA, 22 bp, Homo sapiens
cccaggaggcagaggttggagc

SEQ ID NO: 7147930 - DNA, 22 bp, Homo sapiens
cccaggaggccaaggttgcagt

SEQ ID NO: 7147931 - DNA, 22 bp, Homo sapiens
cccaggaggccaaggttgcagt

SEQ ID NO: 7147932 - DNA, 22 bp, Homo sapiens
cccaggaggccaaggttgcagt

SEQ ID NO: 7147933 - DNA, 22 bp, Homo sapiens
cccaggaggcctgcctggccgg

SEQ ID NO: 7147934 - DNA, 22 bp, Homo sapiens
cccaggaggcctgcctggccgg

SEQ ID NO: 7147935 - DNA, 22 bp, Homo sapiens
cccaggaggcgcaggttgcggt

SEQ ID NO: 7147936 - DNA, 22 bp, Homo sapiens
cccaggaggcgcaggttgcggt

SEQ ID NO: 7147937 - DNA, 22 bp, Homo sapiens
cccaggaggcctgcctggccgg

SEQ ID NO: 7147938 - DNA, 22 bp, Homo sapiens
cccaggaggcctgcctggccgg

SEQ ID NO: 7147939 - DNA, 22 bp, Homo sapiens
cccagcaggtgccatcactctg

SEQ ID NO: 7147940 - DNA, 22 bp, Homo sapiens
cccagcagtaaccagtggaaat

SEQ ID NO: 7147941 - DNA, 22 bp, Homo sapiens
cccagcatctccaggcatggcc

SEQ ID NO: 7147942 - DNA, 22 bp, Homo sapiens
cccagcatttctgggctgcact

SEQ ID NO: 7147943 - DNA, 22 bp, Homo sapiens
cccagcatttctgggctgcact

SEQ ID NO: 7147944 - DNA, 22 bp, Homo sapiens
cccagcatttctgggctgcact

SEQ ID NO: 7147945 - DNA, 22 bp, Homo sapiens
cccagccaaaagcaagtttacc

SEQ ID NO: 7147946 - DNA, 22 bp, Homo sapiens
cccagccaaaagcaagtttacc

SEQ ID NO: 7147947 - DNA, 22 bp, Homo sapiens
cccagccaaggtgctggtgttg

SEQ ID NO: 7147948 - DNA, 22 bp, Homo sapiens
cccagccaaggtgctggtgttg

SEQ ID NO: 7147949 - DNA, 22 bp, Homo sapiens
cccagccaaggtgctggtgttg

SEQ ID NO: 7147950 - DNA, 22 bp, Homo sapiens
cccagccaagtgatctgaccgc

SEQ ID NO: 7147951 - DNA, 22 bp, Homo sapiens
cccagccaagtgatctgaccgc

SEQ ID NO: 7147952 - DNA, 22 bp, Homo sapiens
cccagccagcctcttcccatat

SEQ ID NO: 7147953 - DNA, 22 bp, Homo sapiens
cccagccagcctcttcccatat

SEQ ID NO: 7147954 - DNA, 22 bp, Homo sapiens
cccagcaggtcggtgctgcctg

SEQ ID NO: 7147955 - DNA, 22 bp, Homo sapiens
tgcagcattttataccatcatt

SEQ ID NO: 7147956 - DNA, 22 bp, Homo sapiens
tgcagcattttataccatcatt

SEQ ID NO: 7147957 - DNA, 22 bp, Homo sapiens
tgcagcattttataccatcatt

SEQ ID NO: 7147958 - DNA, 22 bp, Homo sapiens
cccagcaggtgccatcactctg

SEQ ID NO: 7147959 - DNA, 22 bp, Homo sapiens
tgcagcattgcaaagcagtctt

SEQ ID NO: 7147960 - DNA, 22 bp, Homo sapiens
tgcagcattgcaaagcagtctt

SEQ ID NO: 7147961 - DNA, 22 bp, Homo sapiens
tgcagcatttgctgaagcagga

SEQ ID NO: 7147962 - DNA, 22 bp, Homo sapiens
tgcagcattagtacaagtctca

SEQ ID NO: 7147963 - DNA, 22 bp, Homo sapiens
tgcagcattagtacaagtctca

SEQ ID NO: 7147964 - DNA, 18 bp, Homo sapiens
tgcagcatgttcccataa

SEQ ID NO: 7147965 - DNA, 22 bp, Homo sapiens
tgcagcattatgtagctgtttt

SEQ ID NO: 7147966 - DNA, 22 bp, Homo sapiens
tgcagcattctggtaaaaggca

SEQ ID NO: 7147967 - DNA, 22 bp, Homo sapiens
tgcagcattcttggccactact

SEQ ID NO: 7147968 - DNA, 22 bp, Homo sapiens
tgcagcagtttaatgcagggtt

SEQ ID NO: 7147969 - DNA, 22 bp, Homo sapiens
tgcagcagtttaatgcagggtt

SEQ ID NO: 7147970 - DNA, 22 bp, Homo sapiens
tgcagcagtttaatgcagggtt

SEQ ID NO: 7147971 - DNA, 22 bp, Homo sapiens
tgcagcatccatatattattag

SEQ ID NO: 7147972 - DNA, 22 bp, Homo sapiens
tgcagcatctccttgtgccatg

SEQ ID NO: 7147973 - DNA, 22 bp, Homo sapiens
tgcagcatgcaggagaggctct

SEQ ID NO: 7147974 - DNA, 22 bp, Homo sapiens
tgcagcatgcaggagaggctct

SEQ ID NO: 7147975 - DNA, 20 bp, Homo sapiens
cccagcccgggccgcgctcg

SEQ ID NO: 7147976 - DNA, 20 bp, Homo sapiens
cccagcccctacctgttgcc

SEQ ID NO: 7147977 - DNA, 20 bp, Homo sapiens
cccagcccctacctgttgcc

SEQ ID NO: 7147978 - DNA, 20 bp, Homo sapiens
cccagcccgggccgcgctcg

SEQ ID NO: 7147979 - DNA, 22 bp, Homo sapiens
cccagccctgacctattggaaa

SEQ ID NO: 7147980 - DNA, 22 bp, Homo sapiens
cccagccctgacctattggaaa

SEQ ID NO: 7147981 - DNA, 22 bp, Homo sapiens
cccagccctgacctattggaaa

SEQ ID NO: 7147982 - DNA, 22 bp, Homo sapiens
cccagcccatctcaaaggtcta

SEQ ID NO: 7147983 - DNA, 22 bp, Homo sapiens
cccagcccagcgttcgaggggt

SEQ ID NO: 7147984 - DNA, 22 bp, Homo sapiens
cccagcccatctcaaaggtcta

SEQ ID NO: 7147985 - DNA, 22 bp, Homo sapiens
cccagcccccgagtgtctggaa

SEQ ID NO: 7147986 - DNA, 22 bp, Homo sapiens
cccagcccccgagtgtctggaa

SEQ ID NO: 7147987 - DNA, 22 bp, Homo sapiens
cccagcccccgagtgtctggaa

SEQ ID NO: 7147988 - DNA, 22 bp, Homo sapiens
cccagcccccgagtgtctggaa

SEQ ID NO: 7147989 - DNA, 22 bp, Homo sapiens
cccagcccccgagtgtctggaa

SEQ ID NO: 7147990 - DNA, 22 bp, Homo sapiens
cccagcccccgagtgtctggaa

SEQ ID NO: 7147991 - DNA, 20 bp, Homo sapiens
cccagcccctacctgttgcc

SEQ ID NO: 7147992 - DNA, 22 bp, Homo sapiens
cccagcccagcgttcgaggggt

SEQ ID NO: 7147993 - DNA, 22 bp, Homo sapiens
cccagcccagcgttcgaggggt

SEQ ID NO: 7147994 - DNA, 22 bp, Homo sapiens
cccagcccagcgttcgaggggt

SEQ ID NO: 7147995 - DNA, 22 bp, Homo sapiens
cccagcccacggtcctgggtgg

SEQ ID NO: 7147996 - DNA, 22 bp, Homo sapiens
cccagcccacggtcctgggtgg

SEQ ID NO: 7147997 - DNA, 22 bp, Homo sapiens
cccagcccagcgttcgaggggt

SEQ ID NO: 7147998 - DNA, 22 bp, Homo sapiens
cccagcccagcgttcgaggggt

SEQ ID NO: 7147999 - DNA, 22 bp, Homo sapiens
cccagcccagcgttcgaggggt

SEQ ID NO: 7148000 - DNA, 18 bp, Homo sapiens
cccagcccaccatttctc

SEQ ID NO: 7148001 - DNA, 22 bp, Homo sapiens
cccagcccacggtcctgggtgg

SEQ ID NO: 7148002 - DNA, 18 bp, Homo sapiens
cccagcccaccatttctc

SEQ ID NO: 7148003 - DNA, 22 bp, Homo sapiens
cccagccagcctcttcccatat

SEQ ID NO: 7148004 - DNA, 22 bp, Homo sapiens
cccagccagcctcttcccatat

SEQ ID NO: 7148005 - DNA, 19 bp, Homo sapiens
cccagccaggtcttgcatc

SEQ ID NO: 7148006 - DNA, 19 bp, Homo sapiens
cccagccaggtcttgcatc

SEQ ID NO: 7148007 - DNA, 19 bp, Homo sapiens
cccagccaggtcttgcatc

SEQ ID NO: 7148008 - DNA, 18 bp, Homo sapiens
cccagcccaccatttctc

SEQ ID NO: 7148009 - DNA, 18 bp, Homo sapiens
cccagcccaccatttctc

SEQ ID NO: 7148010 - DNA, 19 bp, Homo sapiens
cccagccaggtcttgcatc

SEQ ID NO: 7148011 - DNA, 18 bp, Homo sapiens
cccagcccaccatttctc

SEQ ID NO: 7148012 - DNA, 22 bp, Homo sapiens
tgcagtggaagaggtggagatc

SEQ ID NO: 7148013 - DNA, 22 bp, Homo sapiens
tgcagtggaaagactcagactt

SEQ ID NO: 7148014 - DNA, 22 bp, Homo sapiens
tgcagtggaacaatttcaacag

SEQ ID NO: 7148015 - DNA, 22 bp, Homo sapiens
tgcagtggaacaatttcaacag

SEQ ID NO: 7148016 - DNA, 22 bp, Homo sapiens
tgcagtggaaagactcagactt

SEQ ID NO: 7148017 - DNA, 22 bp, Homo sapiens
tgcagtgcagctggaatatctt

SEQ ID NO: 7148018 - DNA, 22 bp, Homo sapiens
tgcagtcttccagctgcacaaa

SEQ ID NO: 7148019 - DNA, 22 bp, Homo sapiens
tgcaggtggacacgggagacgg

SEQ ID NO: 7148020 - DNA, 22 bp, Homo sapiens
tgcagtctggatgtcctcagat

SEQ ID NO: 7148021 - DNA, 22 bp, Homo sapiens
tgcagtctctagtttctgaatg

SEQ ID NO: 7148022 - DNA, 22 bp, Homo sapiens
tgcagtctggatgtcctcagat

SEQ ID NO: 7148023 - DNA, 22 bp, Homo sapiens
tgcaggtggacacgggagacgg

SEQ ID NO: 7148024 - DNA, 22 bp, Homo sapiens
cccagcctactctgccatagca

SEQ ID NO: 7148025 - DNA, 22 bp, Homo sapiens
cccagcctactctgccatagca

SEQ ID NO: 7148026 - DNA, 22 bp, Homo sapiens
cccagcctactctgccatagca

SEQ ID NO: 7148027 - DNA, 22 bp, Homo sapiens
tgcagtggaggccgtgagacag

SEQ ID NO: 7148028 - DNA, 22 bp, Homo sapiens
tgcagtggaatctggagagcag

SEQ ID NO: 7148029 - DNA, 22 bp, Homo sapiens
tgcagtggaatctggagagcag

SEQ ID NO: 7148030 - DNA, 22 bp, Homo sapiens
tgcagtggaggccgtgagacag

SEQ ID NO: 7148031 - DNA, 22 bp, Homo sapiens
tgcagtggaggccgtgagacag

SEQ ID NO: 7148032 - DNA, 22 bp, Homo sapiens
tgcagtggcgccatctcagctc

SEQ ID NO: 7148033 - DNA, 22 bp, Homo sapiens
tgcagtggcgccatctcagctc

SEQ ID NO: 7148034 - DNA, 22 bp, Homo sapiens
tgcagtggaatctggagagcag

SEQ ID NO: 7148035 - DNA, 22 bp, Homo sapiens
tgcagtggaagaggtggagatc

SEQ ID NO: 7148036 - DNA, 22 bp, Homo sapiens
tgcagtggaagaggtggagatc

SEQ ID NO: 7148037 - DNA, 22 bp, Homo sapiens
cccagctccaagggacagcgaa

SEQ ID NO: 7148038 - DNA, 22 bp, Homo sapiens
cccagctccaagggacagcgaa

SEQ ID NO: 7148039 - DNA, 18 bp, Homo sapiens
cccagctccacttccctc

SEQ ID NO: 7148040 - DNA, 18 bp, Homo sapiens
cccagctccacttccctc

SEQ ID NO: 7148041 - DNA, 18 bp, Homo sapiens
cccagctccacttccctc

SEQ ID NO: 7148042 - DNA, 22 bp, Homo sapiens
cccagctccaagggacagcgaa

SEQ ID NO: 7148043 - DNA, 22 bp, Homo sapiens
cccagctccaagggacagcgaa

SEQ ID NO: 7148044 - DNA, 22 bp, Homo sapiens
cccagctcatcaggagccgccc

SEQ ID NO: 7148045 - DNA, 22 bp, Homo sapiens
cccagctcatcaggagccgccc

SEQ ID NO: 7148046 - DNA, 22 bp, Homo sapiens
cccagctcatcaggagccgccc

SEQ ID NO: 7148047 - DNA, 22 bp, Homo sapiens
tgcagtggcgccatctcagctc

SEQ ID NO: 7148048 - DNA, 22 bp, Homo sapiens
cccagctcaagcagagagctaa

SEQ ID NO: 7148049 - DNA, 22 bp, Homo sapiens
cccaggacccttcaatggctcc

SEQ ID NO: 7148050 - DNA, 22 bp, Homo sapiens
cccaggacccttcaatggctcc

SEQ ID NO: 7148051 - DNA, 22 bp, Homo sapiens
cccaggaccgcgcggctgagcg

SEQ ID NO: 7148052 - DNA, 22 bp, Homo sapiens
cccaggaattggaggctgcagt

SEQ ID NO: 7148053 - DNA, 22 bp, Homo sapiens
cccaggaattggaggctgcagt

SEQ ID NO: 7148054 - DNA, 22 bp, Homo sapiens
cccaggaccgcgcggctgagcg

SEQ ID NO: 7148055 - DNA, 22 bp, Homo sapiens
cccaggaccgcgcggctgagcg

SEQ ID NO: 7148056 - DNA, 22 bp, Homo sapiens
cccaggactaatgagctctacg

SEQ ID NO: 7148057 - DNA, 22 bp, Homo sapiens
cccaggactctgacacccccaa

SEQ ID NO: 7148058 - DNA, 22 bp, Homo sapiens
cccaggactcttcactgcagcc

SEQ ID NO: 7148059 - DNA, 22 bp, Homo sapiens
cccaggactcttcactgcagcc

SEQ ID NO: 7148060 - DNA, 21 bp, Homo sapiens
cccaggagaagaaaagatgca

SEQ ID NO: 7148061 - DNA, 22 bp, Homo sapiens
cccaggagaatataatgttctt

SEQ ID NO: 7148062 - DNA, 21 bp, Homo sapiens
cccaggagaagaaaagatgca

SEQ ID NO: 7148063 - DNA, 22 bp, Homo sapiens
cccaggagaatataatgttctt

SEQ ID NO: 7148064 - DNA, 22 bp, Homo sapiens
cccagctccgagctccgagccg

SEQ ID NO: 7148065 - DNA, 22 bp, Homo sapiens
cccagctccgagctccgagccg

SEQ ID NO: 7148066 - DNA, 22 bp, Homo sapiens
cccagctccctggtatttgtgc

SEQ ID NO: 7148067 - DNA, 22 bp, Homo sapiens
cccagctccctggtatttgtgc

SEQ ID NO: 7148068 - DNA, 22 bp, Homo sapiens
cccagctccctggtatttgtgc

SEQ ID NO: 7148069 - DNA, 22 bp, Homo sapiens
cccagctccgagctccgagccg

SEQ ID NO: 7148070 - DNA, 22 bp, Homo sapiens
cccagctccgagctccgagccg

SEQ ID NO: 7148071 - DNA, 22 bp, Homo sapiens
cccaggaaagtggaggcggctg

SEQ ID NO: 7148072 - DNA, 22 bp, Homo sapiens
cccaggaaatagccaggaggtg

SEQ ID NO: 7148073 - DNA, 22 bp, Homo sapiens
cccaggaaatagccaggaggtg

SEQ ID NO: 7148074 - DNA, 22 bp, Homo sapiens
cccaggaaatagccaggaggtg

SEQ ID NO: 7148075 - DNA, 22 bp, Homo sapiens
cccaggaattggaggctgcagt

SEQ ID NO: 7148076 - DNA, 22 bp, Homo sapiens
cccagctcccatgttctccaat

SEQ ID NO: 7148077 - DNA, 22 bp, Homo sapiens
cccagctcccatgttctccaat

SEQ ID NO: 7148078 - DNA, 22 bp, Homo sapiens
cccagctcccatgttctccaat

SEQ ID NO: 7148079 - DNA, 22 bp, Homo sapiens
cccagctcccatgttctccaat

SEQ ID NO: 7148080 - DNA, 22 bp, Homo sapiens
cccagctcccaagttgctatgg

SEQ ID NO: 7148081 - DNA, 22 bp, Homo sapiens
cccagctcccaagttgctatgg

SEQ ID NO: 7148082 - DNA, 22 bp, Homo sapiens
cccagctcccatgttctccaat

SEQ ID NO: 7148083 - DNA, 22 bp, Homo sapiens
cccagctcccatgttctccaat

SEQ ID NO: 7148084 - DNA, 22 bp, Homo sapiens
cccagctcccatgttctccaat

SEQ ID NO: 7148085 - DNA, 22 bp, Homo sapiens
cccagctccagagccagaaaca

SEQ ID NO: 7148086 - DNA, 18 bp, Homo sapiens
cccagctccacttccctc

SEQ ID NO: 7148087 - DNA, 18 bp, Homo sapiens
cccagctccacttccctc

SEQ ID NO: 7148088 - DNA, 18 bp, Homo sapiens
cccagctccacttccctc

SEQ ID NO: 7148089 - DNA, 22 bp, Homo sapiens
cccagctccagagccagaaaca

SEQ ID NO: 7148090 - DNA, 22 bp, Homo sapiens
tctttattttatgcttgtgcaa

SEQ ID NO: 7148091 - DNA, 22 bp, Homo sapiens
tctttattttatgcttgtgcaa

SEQ ID NO: 7148092 - DNA, 22 bp, Homo sapiens
tctttattttatgcttgtgcaa

SEQ ID NO: 7148093 - DNA, 22 bp, Homo sapiens
tctttcaaagctgtagtagatt

SEQ ID NO: 7148094 - DNA, 22 bp, Homo sapiens
tctttcaaagtaacaaccacga

SEQ ID NO: 7148095 - DNA, 19 bp, Homo sapiens
ccaggcctggcgtctccgc

SEQ ID NO: 7148096 - DNA, 19 bp, Homo sapiens
ccaggcctggcgtctccgc

SEQ ID NO: 7148097 - DNA, 22 bp, Homo sapiens
ccaggctagaaactgaggcaca

SEQ ID NO: 7148098 - DNA, 22 bp, Homo sapiens
tctttatttctgaatcccccat

SEQ ID NO: 7148099 - DNA, 22 bp, Homo sapiens
tctttattttatgcttgtgcaa

SEQ ID NO: 7148100 - DNA, 22 bp, Homo sapiens
tctttattttatgcttgtgcaa

SEQ ID NO: 7148101 - DNA, 22 bp, Homo sapiens
tctttatttctgaatcccccat

SEQ ID NO: 7148102 - DNA, 22 bp, Homo sapiens
tctttatttctgaatcccccat

SEQ ID NO: 7148103 - DNA, 22 bp, Homo sapiens
tctttatttctgaatcccccat

SEQ ID NO: 7148104 - DNA, 22 bp, Homo sapiens
tctttatttctgaatcccccat

SEQ ID NO: 7148105 - DNA, 22 bp, Homo sapiens
tctttaatatctgccccagagc

SEQ ID NO: 7148106 - DNA, 22 bp, Homo sapiens
tctttaagagttcatttgcatg

SEQ ID NO: 7148107 - DNA, 22 bp, Homo sapiens
tctttaagccaagatatattta

SEQ ID NO: 7148108 - DNA, 22 bp, Homo sapiens
ccaggctcagcgcgcacgtctg

SEQ ID NO: 7148109 - DNA, 22 bp, Homo sapiens
ccaggctcagcgcgcacgtctg

SEQ ID NO: 7148110 - DNA, 22 bp, Homo sapiens
ccaggctcactgactaccacat

SEQ ID NO: 7148111 - DNA, 22 bp, Homo sapiens
ccaggctcactgactaccacat

SEQ ID NO: 7148112 - DNA, 22 bp, Homo sapiens
ccaggctcactgactaccacat

SEQ ID NO: 7148113 - DNA, 22 bp, Homo sapiens
ccaggctcacctggagcccctg

SEQ ID NO: 7148114 - DNA, 22 bp, Homo sapiens
ccaggctcacagcatcccagga

SEQ ID NO: 7148115 - DNA, 22 bp, Homo sapiens
ccaggctcacctggagcccctg

SEQ ID NO: 7148116 - DNA, 22 bp, Homo sapiens
ccaggctcacctggagcccctg

SEQ ID NO: 7148117 - DNA, 22 bp, Homo sapiens
ccaggctcacctggagcccctg

SEQ ID NO: 7148118 - DNA, 22 bp, Homo sapiens
ccaggctcacagcatcccagga

SEQ ID NO: 7148119 - DNA, 22 bp, Homo sapiens
ccaggctcacagcatcccagga

SEQ ID NO: 7148120 - DNA, 22 bp, Homo sapiens
ccaggctcacagcatcccagga

SEQ ID NO: 7148121 - DNA, 22 bp, Homo sapiens
ccaggctcacagcatcccagga

SEQ ID NO: 7148122 - DNA, 22 bp, Homo sapiens
ccaggctcacagcatcccagga

SEQ ID NO: 7148123 - DNA, 22 bp, Homo sapiens
ccaggctcaggcctgctcgttg

SEQ ID NO: 7148124 - DNA, 22 bp, Homo sapiens
ccaggctcaggcctgctcgttg

SEQ ID NO: 7148125 - DNA, 22 bp, Homo sapiens
ccaggctcaggcctgctcgttg

SEQ ID NO: 7148126 - DNA, 22 bp, Homo sapiens
ccaggctcaggcctgctcgttg

SEQ ID NO: 7148127 - DNA, 22 bp, Homo sapiens
ccaggctcaggcctgctcgttg

SEQ ID NO: 7148128 - DNA, 22 bp, Homo sapiens
ccaggctcaggcctgctcgttg

SEQ ID NO: 7148129 - DNA, 22 bp, Homo sapiens
ccaggctcagggcagactttca

SEQ ID NO: 7148130 - DNA, 22 bp, Homo sapiens
ccaggctcagcgcgcacgtctg

SEQ ID NO: 7148131 - DNA, 22 bp, Homo sapiens
ccaggctcagcgcgcacgtctg

SEQ ID NO: 7148132 - DNA, 22 bp, Homo sapiens
ccaggctcagcgcgcacgtctg

SEQ ID NO: 7148133 - DNA, 22 bp, Homo sapiens
ccaggctcagcgcgcacgtctg

SEQ ID NO: 7148134 - DNA, 22 bp, Homo sapiens
ccaggctcagcgcgcacgtctg

SEQ ID NO: 7148135 - DNA, 22 bp, Homo sapiens
ccaggctcagctattaagaaac

SEQ ID NO: 7148136 - DNA, 22 bp, Homo sapiens
ccaggctcagctattaagaaac

SEQ ID NO: 7148137 - DNA, 22 bp, Homo sapiens
ccaggctcagctattaagaaac

SEQ ID NO: 7148138 - DNA, 22 bp, Homo sapiens
ccaggctcagctattaagaaac

SEQ ID NO: 7148139 - DNA, 22 bp, Homo sapiens
ccaggctcagggcagactttca

SEQ ID NO: 7148140 - DNA, 22 bp, Homo sapiens
ccaggctcaggtgcgagagaca

SEQ ID NO: 7148141 - DNA, 22 bp, Homo sapiens
ccaggctcaggtgcgagagaca

SEQ ID NO: 7148142 - DNA, 22 bp, Homo sapiens
ccaggctcaggtgcgagagaca

SEQ ID NO: 7148143 - DNA, 22 bp, Homo sapiens
ccaggctcaggtgcgagagaca

SEQ ID NO: 7148144 - DNA, 17 bp, Homo sapiens
ccaggctccatcactgt

SEQ ID NO: 7148145 - DNA, 17 bp, Homo sapiens
ccaggctccatcactgt

SEQ ID NO: 7148146 - DNA, 17 bp, Homo sapiens
ccaggctccatcactgt

SEQ ID NO: 7148147 - DNA, 17 bp, Homo sapiens
ccaggctccatcactgt

SEQ ID NO: 7148148 - DNA, 17 bp, Homo sapiens
ccaggctccatcactgt

SEQ ID NO: 7148149 - DNA, 17 bp, Homo sapiens
ccaggctccatcactgt

SEQ ID NO: 7148150 - DNA, 17 bp, Homo sapiens
ccaggctccatcactgt

SEQ ID NO: 7148151 - DNA, 17 bp, Homo sapiens
ccaggctccatcactgt

SEQ ID NO: 7148152 - DNA, 22 bp, Homo sapiens
ccaggctccccaggaggccctt

SEQ ID NO: 7148153 - DNA, 22 bp, Homo sapiens
ccaggctccccaggaggccctt

SEQ ID NO: 7148154 - DNA, 22 bp, Homo sapiens
tctgcagagattctgggctgag

SEQ ID NO: 7148155 - DNA, 22 bp, Homo sapiens
tctgcagagcattatagcaaaa

SEQ ID NO: 7148156 - DNA, 22 bp, Homo sapiens
tctgcagagcattatagcaaaa

SEQ ID NO: 7148157 - DNA, 22 bp, Homo sapiens
tctgcagacttgcctaagtgtg

SEQ ID NO: 7148158 - DNA, 22 bp, Homo sapiens
tctgcagacttgataaccactg

SEQ ID NO: 7148159 - DNA, 22 bp, Homo sapiens
tctgcagacttgcctaagtgtg

SEQ ID NO: 7148160 - DNA, 22 bp, Homo sapiens
tctgcagagacaaagtgttatt

SEQ ID NO: 7148161 - DNA, 22 bp, Homo sapiens
tctgcagagcctcaggagaaca

SEQ ID NO: 7148162 - DNA, 19 bp, Homo sapiens
tctgcagaggaattcttca

SEQ ID NO: 7148163 - DNA, 19 bp, Homo sapiens
tctgcagaggaattcttca

SEQ ID NO: 7148164 - DNA, 17 bp, Homo sapiens
tctgcagaggcaaacct

SEQ ID NO: 7148165 - DNA, 22 bp, Homo sapiens
tctgcagagggagtgctgggtc

SEQ ID NO: 7148166 - DNA, 22 bp, Homo sapiens
tctgcagagggagtgctgggtc

SEQ ID NO: 7148167 - DNA, 22 bp, Homo sapiens
tctgcagaggtaatttacagat

SEQ ID NO: 7148168 - DNA, 22 bp, Homo sapiens
tctgcagacaggaagctgaggc

SEQ ID NO: 7148169 - DNA, 22 bp, Homo sapiens
tctgcagacactggggtctgga

SEQ ID NO: 7148170 - DNA, 22 bp, Homo sapiens
tctgcagaattgtctcaagcta

SEQ ID NO: 7148171 - DNA, 23 bp, Homo sapiens
tctgcagacgctgttctattgtc

SEQ ID NO: 7148172 - DNA, 23 bp, Homo sapiens
tctgcagacgctgttctattgtc

SEQ ID NO: 7148173 - DNA, 19 bp, Homo sapiens
tctgcagactatattgtga

SEQ ID NO: 7148174 - DNA, 22 bp, Homo sapiens
tctgcagacttgataaccactg

SEQ ID NO: 7148175 - DNA, 22 bp, Homo sapiens
tctgcagaggtaatttacagat

SEQ ID NO: 7148176 - DNA, 20 bp, Homo sapiens
tctgcagataagggaaagac

SEQ ID NO: 7148177 - DNA, 20 bp, Homo sapiens
tctgcagataagggaaagac

SEQ ID NO: 7148178 - DNA, 22 bp, Homo sapiens
tctgcagatccctttagtgagg

SEQ ID NO: 7148179 - DNA, 22 bp, Homo sapiens
tctgcagatttatcagcagctg

SEQ ID NO: 7148180 - DNA, 22 bp, Homo sapiens
ccagcccttgagatggaaggga

SEQ ID NO: 7148181 - DNA, 22 bp, Homo sapiens
ccagcccttgagatggaaggga

SEQ ID NO: 7148182 - DNA, 22 bp, Homo sapiens
ccagcccttgagatggaaggga

SEQ ID NO: 7148183 - DNA, 22 bp, Homo sapiens
ccagcccttgagatggaaggga

SEQ ID NO: 7148184 - DNA, 22 bp, Homo sapiens
ccagcccttgaggtctgtccat

SEQ ID NO: 7148185 - DNA, 22 bp, Homo sapiens
ccagcccttgctgaagggtggc

SEQ ID NO: 7148186 - DNA, 22 bp, Homo sapiens
ccagccgcggtgagggtggctg

SEQ ID NO: 7148187 - DNA, 22 bp, Homo sapiens
ccagccggactccacttcccgt

SEQ ID NO: 7148188 - DNA, 22 bp, Homo sapiens
ccagcctcactggcatcaccta

SEQ ID NO: 7148189 - DNA, 22 bp, Homo sapiens
ccagcctcactggcatcaccta

SEQ ID NO: 7148190 - DNA, 22 bp, Homo sapiens
ccagcctcactggcatcaccta

SEQ ID NO: 7148191 - DNA, 21 bp, Homo sapiens
tcttgtccttgctctcccact

SEQ ID NO: 7148192 - DNA, 23 bp, Homo sapiens
tcttgtttcctttgcgctatcca

SEQ ID NO: 7148193 - DNA, 22 bp, Homo sapiens
tcttgtttctgtatataatgac

SEQ ID NO: 7148194 - DNA, 22 bp, Homo sapiens
tcttgtttctgtatataatgac

SEQ ID NO: 7148195 - DNA, 22 bp, Homo sapiens
tcttgtttcttctaagcagcag

SEQ ID NO: 7148196 - DNA, 22 bp, Homo sapiens
tcttgtttggattttgggcagt

SEQ ID NO: 7148197 - DNA, 22 bp, Homo sapiens
tcttgttttgaactcatcagga

SEQ ID NO: 7148198 - DNA, 22 bp, Homo sapiens
tcttgttttgaactcatcagga

SEQ ID NO: 7148199 - DNA, 22 bp, Homo sapiens
tcttgttttgaactcatcagga

SEQ ID NO: 7148200 - DNA, 22 bp, Homo sapiens
tcttgttttgaactcatcagga

SEQ ID NO: 7148201 - DNA, 22 bp, Homo sapiens
tcttgttttgaactcatcagga

SEQ ID NO: 7148202 - DNA, 22 bp, Homo sapiens
tctttaaagttggagcttgcaa

SEQ ID NO: 7148203 - DNA, 22 bp, Homo sapiens
tctttaaagttggagcttgcaa

SEQ ID NO: 7148204 - DNA, 22 bp, Homo sapiens
tctttaaagttggagcttgcaa

SEQ ID NO: 7148205 - DNA, 22 bp, Homo sapiens
tctttaagagttcatttgcatg

SEQ ID NO: 7148206 - DNA, 22 bp, Homo sapiens
tcttgtaattaactagaaagat

SEQ ID NO: 7148207 - DNA, 22 bp, Homo sapiens
tcttggtgcctcagaccttgtg

SEQ ID NO: 7148208 - DNA, 21 bp, Homo sapiens
tcttggttccgtgtgtttgat

SEQ ID NO: 7148209 - DNA, 22 bp, Homo sapiens
tcttggtttttccagggctgat

SEQ ID NO: 7148210 - DNA, 22 bp, Homo sapiens
tcttgccttatgccatgaagca

SEQ ID NO: 7148211 - DNA, 18 bp, Homo sapiens
tcttgcctgcaccctctc

SEQ ID NO: 7148212 - DNA, 21 bp, Homo sapiens
tcttggggaggagggctgcac

SEQ ID NO: 7148213 - DNA, 22 bp, Homo sapiens
tcttgggggactttggcatgga

SEQ ID NO: 7148214 - DNA, 22 bp, Homo sapiens
tcttgggggactttggcatgga

SEQ ID NO: 7148215 - DNA, 22 bp, Homo sapiens
tcttggggtagacctgagaatt

SEQ ID NO: 7148216 - DNA, 22 bp, Homo sapiens
tcttggtatacgcatggcattg

SEQ ID NO: 7148217 - DNA, 18 bp, Homo sapiens
tcttgcctgcaccctctc

SEQ ID NO: 7148218 - DNA, 18 bp, Homo sapiens
tcttgcctgcaccctctc

SEQ ID NO: 7148219 - DNA, 22 bp, Homo sapiens
tcttgccgcgcaggcgcagttc

SEQ ID NO: 7148220 - DNA, 22 bp, Homo sapiens
tcttgcctcttcccctttccat

SEQ ID NO: 7148221 - DNA, 21 bp, Homo sapiens
ccagcctcagatcagggagct

SEQ ID NO: 7148222 - DNA, 21 bp, Homo sapiens
ccagcctcagatcagggagct

SEQ ID NO: 7148223 - DNA, 22 bp, Homo sapiens
ccagcctcactggcatcaccta

SEQ ID NO: 7148224 - DNA, 22 bp, Homo sapiens
ccagcctcactggcatcaccta

SEQ ID NO: 7148225 - DNA, 21 bp, Homo sapiens
ccagcctcagatcagggagct

SEQ ID NO: 7148226 - DNA, 21 bp, Homo sapiens
ccagcctcagatcagggagct

SEQ ID NO: 7148227 - DNA, 21 bp, Homo sapiens
ccagcctcagatcagggagct

SEQ ID NO: 7148228 - DNA, 21 bp, Homo sapiens
ccagcctcagatcagggagct

SEQ ID NO: 7148229 - DNA, 21 bp, Homo sapiens
ccagcctcagatcagggagct

SEQ ID NO: 7148230 - DNA, 22 bp, Homo sapiens
tgaaggagaaatggaaagtggg

SEQ ID NO: 7148231 - DNA, 22 bp, Homo sapiens
tgaaggaatgagggagtgggtc

SEQ ID NO: 7148232 - DNA, 22 bp, Homo sapiens
tgaaggaatgagtatactgttt

SEQ ID NO: 7148233 - DNA, 22 bp, Homo sapiens
tgaaggaatggaggatcagagc

SEQ ID NO: 7148234 - DNA, 17 bp, Homo sapiens
tgaaggaaggatgatgt

SEQ ID NO: 7148235 - DNA, 22 bp, Homo sapiens
tgaaggaatgagggagtgggtc

SEQ ID NO: 7148236 - DNA, 22 bp, Homo sapiens
tgaaggaagaataggcagtgtt

SEQ ID NO: 7148237 - DNA, 22 bp, Homo sapiens
tgaaggaaatgacggcagaaga

SEQ ID NO: 7148238 - DNA, 22 bp, Homo sapiens
tgaaggaaatgacggcagaaga

SEQ ID NO: 7148239 - DNA, 22 bp, Homo sapiens
tgaaggaagaataggcagtgtt

SEQ ID NO: 7148240 - DNA, 22 bp, Homo sapiens
tgaaggaagaataggcagtgtt

SEQ ID NO: 7148241 - DNA, 17 bp, Homo sapiens
tgaaggaaggatgatgt

SEQ ID NO: 7148242 - DNA, 22 bp, Homo sapiens
tgaagatttaagcatctcaatt

SEQ ID NO: 7148243 - DNA, 22 bp, Homo sapiens
tgaagatttccaccaaatcaca

SEQ ID NO: 7148244 - DNA, 22 bp, Homo sapiens
tgaagctttaggatgggttcat

SEQ ID NO: 7148245 - DNA, 22 bp, Homo sapiens
tgaaggaaagagggaacatccc

SEQ ID NO: 7148246 - DNA, 22 bp, Homo sapiens
tgaaggaaatgacggcagaaga

SEQ ID NO: 7148247 - DNA, 22 bp, Homo sapiens
tgaaggaaatgacggcagaaga

SEQ ID NO: 7148248 - DNA, 17 bp, Homo sapiens
tgaagatgcatggcagc

SEQ ID NO: 7148249 - DNA, 22 bp, Homo sapiens
tgaagagtgtgactgcacctag

SEQ ID NO: 7148250 - DNA, 22 bp, Homo sapiens
tgaagagttaattatgaggtgc

SEQ ID NO: 7148251 - DNA, 22 bp, Homo sapiens
tgaagagttaattatgaggtgc

SEQ ID NO: 7148252 - DNA, 22 bp, Homo sapiens
tgaagagtttccagcctgcttg

SEQ ID NO: 7148253 - DNA, 22 bp, Homo sapiens
tgaagagtttccagcctgcttg

SEQ ID NO: 7148254 - DNA, 17 bp, Homo sapiens
tgaagatgcatggcagc

SEQ ID NO: 7148255 - DNA, 17 bp, Homo sapiens
tgaagatgcatggcagc

SEQ ID NO: 7148256 - DNA, 22 bp, Homo sapiens
tgaagatgtcagcaggggtggt

SEQ ID NO: 7148257 - DNA, 22 bp, Homo sapiens
tgaagattgagaaattatccaa

SEQ ID NO: 7148258 - DNA, 22 bp, Homo sapiens
tgaagattgagaaattatccaa

SEQ ID NO: 7148259 - DNA, 22 bp, Homo sapiens
tgaagaggccaaactatcattg

SEQ ID NO: 7148260 - DNA, 22 bp, Homo sapiens
tgaagaggccaaactatcattg

SEQ ID NO: 7148261 - DNA, 22 bp, Homo sapiens
tgaagaggccgtgtgcaggtga

SEQ ID NO: 7148262 - DNA, 20 bp, Homo sapiens
tgaagaggaagaggacggcc

SEQ ID NO: 7148263 - DNA, 22 bp, Homo sapiens
tgaagagtattaggttatttga

SEQ ID NO: 7148264 - DNA, 22 bp, Homo sapiens
tgaagagtattaggttatttga

SEQ ID NO: 7148265 - DNA, 22 bp, Homo sapiens
tgaagagtcatttcattcccag

SEQ ID NO: 7148266 - DNA, 22 bp, Homo sapiens
tgaagagtcatttcattcccag

SEQ ID NO: 7148267 - DNA, 22 bp, Homo sapiens
tgaagagtgattcatgcagtca

SEQ ID NO: 7148268 - DNA, 22 bp, Homo sapiens
tgaagagtgattcatgcagtca

SEQ ID NO: 7148269 - DNA, 22 bp, Homo sapiens
tgaagagtgattcatgcagtca

SEQ ID NO: 7148270 - DNA, 20 bp, Homo sapiens
tgaagagtgcgcacattgcc

SEQ ID NO: 7148271 - DNA, 20 bp, Homo sapiens
tgaagagtgcgcacattgcc

SEQ ID NO: 7148272 - DNA, 22 bp, Homo sapiens
tgaagagtgcttgagattttaa

SEQ ID NO: 7148273 - DNA, 22 bp, Homo sapiens
tgaagagtgcttgagattttaa

SEQ ID NO: 7148274 - DNA, 22 bp, Homo sapiens
tgaagagtgcttgagattttaa

SEQ ID NO: 7148275 - DNA, 22 bp, Homo sapiens
tgaagagtgtgactgcacctag

SEQ ID NO: 7148276 - DNA, 22 bp, Homo sapiens
tgaagagttaattatgaggtgc

SEQ ID NO: 7148277 - DNA, 22 bp, Homo sapiens
tgaagagatagaagtacatgct

SEQ ID NO: 7148278 - DNA, 22 bp, Homo sapiens
tgaagagatagaagtacatgct

SEQ ID NO: 7148279 - DNA, 22 bp, Homo sapiens
tgaagagattaagttggttttg

SEQ ID NO: 7148280 - DNA, 22 bp, Homo sapiens
tgaagagattaagttggttttg

SEQ ID NO: 7148281 - DNA, 22 bp, Homo sapiens
tgaacaggcattatcagggatc

SEQ ID NO: 7148282 - DNA, 22 bp, Homo sapiens
tgaacaggctgtactcatgagg

SEQ ID NO: 7148283 - DNA, 22 bp, Homo sapiens
tgaacaggtatttattgaacat

SEQ ID NO: 7148284 - DNA, 22 bp, Homo sapiens
tgaacaggtatttattgaacat

SEQ ID NO: 7148285 - DNA, 22 bp, Homo sapiens
tgaacaggtcttagtaggttct

SEQ ID NO: 7148286 - DNA, 22 bp, Homo sapiens
tgaacaggtgccttcagggagt

SEQ ID NO: 7148287 - DNA, 23 bp, Homo sapiens
tgaacagtatgtgggacattgag

SEQ ID NO: 7148288 - DNA, 22 bp, Homo sapiens
tgaacagtcaaaaagtgaccat

SEQ ID NO: 7148289 - DNA, 22 bp, Homo sapiens
tgaacaggtgccttcagggagt

SEQ ID NO: 7148290 - DNA, 22 bp, Homo sapiens
tgaacagtcatttagaatgtgc

SEQ ID NO: 7148291 - DNA, 22 bp, Homo sapiens
tgaacagatggcccagcagagg

SEQ ID NO: 7148292 - DNA, 22 bp, Homo sapiens
tgaacagatggcccagcagagg

SEQ ID NO: 7148293 - DNA, 22 bp, Homo sapiens
tgaacagatgtggaggtacctt

SEQ ID NO: 7148294 - DNA, 22 bp, Homo sapiens
tgaacagctatcttgtcagtgt

SEQ ID NO: 7148295 - DNA, 22 bp, Homo sapiens
tgaacaggagaaaggtttcttt

SEQ ID NO: 7148296 - DNA, 22 bp, Homo sapiens
tgaacaggcattatcagggatc

SEQ ID NO: 7148297 - DNA, 22 bp, Homo sapiens
tgaacagatcaatagaactgac

SEQ ID NO: 7148298 - DNA, 22 bp, Homo sapiens
tgaacagatgccttctcccatg

SEQ ID NO: 7148299 - DNA, 22 bp, Homo sapiens
tgaacacatttctggccaattt

SEQ ID NO: 7148300 - DNA, 22 bp, Homo sapiens
tgaacacattttcttcagtaga

SEQ ID NO: 7148301 - DNA, 20 bp, Homo sapiens
tgaacactggggtgtttcag

SEQ ID NO: 7148302 - DNA, 20 bp, Homo sapiens
tgaacactggggtgtttcag

SEQ ID NO: 7148303 - DNA, 22 bp, Homo sapiens
tgaacactgtatattcttcttg

SEQ ID NO: 7148304 - DNA, 22 bp, Homo sapiens
tgaacagactgacctctgacct

SEQ ID NO: 7148305 - DNA, 22 bp, Homo sapiens
tgaacagactgacctctgacct

SEQ ID NO: 7148306 - DNA, 22 bp, Homo sapiens
tgaacagagctgattcagctca

SEQ ID NO: 7148307 - DNA, 22 bp, Homo sapiens
tgaacacataaggctttcctgt

SEQ ID NO: 7148308 - DNA, 22 bp, Homo sapiens
tgaacacataaggctttcctgt

SEQ ID NO: 7148309 - DNA, 22 bp, Homo sapiens
tgaacacagttctgatgagctt

SEQ ID NO: 7148310 - DNA, 22 bp, Homo sapiens
tgaacacataaaagcaaagggt

SEQ ID NO: 7148311 - DNA, 22 bp, Homo sapiens
tgaacacagcatattttgttac

SEQ ID NO: 7148312 - DNA, 22 bp, Homo sapiens
tgaacacagggccaaacttgag

SEQ ID NO: 7148313 - DNA, 18 bp, Homo sapiens
tgaacacagtacaattcc

SEQ ID NO: 7148314 - DNA, 22 bp, Homo sapiens
tgaaatgcaacagttatttttg

SEQ ID NO: 7148315 - DNA, 22 bp, Homo sapiens
ccaggctgctcacaagctgccc

SEQ ID NO: 7148316 - DNA, 22 bp, Homo sapiens
ccaggctgctgttggtgtccgc

SEQ ID NO: 7148317 - DNA, 22 bp, Homo sapiens
ccaggctgctgttggtgtccgc

SEQ ID NO: 7148318 - DNA, 22 bp, Homo sapiens
ccaggctgctcacaagctgccc

SEQ ID NO: 7148319 - DNA, 22 bp, Homo sapiens
ccaggctgccgaggaaagaaag

SEQ ID NO: 7148320 - DNA, 22 bp, Homo sapiens
ccaggctgctcacaagctgccc

SEQ ID NO: 7148321 - DNA, 22 bp, Homo sapiens
ccaggctgcagtcaaggggcat

SEQ ID NO: 7148322 - DNA, 22 bp, Homo sapiens
ccaggctgcagtcaaggggcat

SEQ ID NO: 7148323 - DNA, 22 bp, Homo sapiens
ccaggctgcagtcaaggggcat

SEQ ID NO: 7148324 - DNA, 22 bp, Homo sapiens
ccaggctgcagtcaaggggcat

SEQ ID NO: 7148325 - DNA, 22 bp, Homo sapiens
ccaggctgagcatgattggagc

SEQ ID NO: 7148326 - DNA, 22 bp, Homo sapiens
tgaaaggggttgagttacagct

SEQ ID NO: 7148327 - DNA, 22 bp, Homo sapiens
tgaaagggaacctgctggactg

SEQ ID NO: 7148328 - DNA, 22 bp, Homo sapiens
tgaaaggaagagggctactcct

SEQ ID NO: 7148329 - DNA, 22 bp, Homo sapiens
tgaaaggcagttagaggtgttt

SEQ ID NO: 7148330 - DNA, 22 bp, Homo sapiens
tgaaaggcagttagaggtgttt

SEQ ID NO: 7148331 - DNA, 22 bp, Homo sapiens
tgaaagctgggcacaagattct

SEQ ID NO: 7148332 - DNA, 22 bp, Homo sapiens
tgaaagctgtacatgtggtaca

SEQ ID NO: 7148333 - DNA, 22 bp, Homo sapiens
tgaaagcttgttggaaatgtag

SEQ ID NO: 7148334 - DNA, 22 bp, Homo sapiens
tgaaagctttgggacagtgtga

SEQ ID NO: 7148335 - DNA, 22 bp, Homo sapiens
tgaaagctttgggacagtgtga

SEQ ID NO: 7148336 - DNA, 22 bp, Homo sapiens
tgaaaggaaagtacagtgatgc

SEQ ID NO: 7148337 - DNA, 22 bp, Homo sapiens
tgaaaggaaagtacagtgatgc

SEQ ID NO: 7148338 - DNA, 22 bp, Homo sapiens
tgaaaggaaagtacagtgatgc

SEQ ID NO: 7148339 - DNA, 22 bp, Homo sapiens
tgaaagctgaggacaggagggt

SEQ ID NO: 7148340 - DNA, 22 bp, Homo sapiens
tgaaagctgcccagtggaatta

SEQ ID NO: 7148341 - DNA, 22 bp, Homo sapiens
tgaaagcatgcttgccaagctt

SEQ ID NO: 7148342 - DNA, 20 bp, Homo sapiens
tgaaagcatgtggtatttgg

SEQ ID NO: 7148343 - DNA, 22 bp, Homo sapiens
tgaaagcattagtctaaggtag

SEQ ID NO: 7148344 - DNA, 22 bp, Homo sapiens
tgaaagcaggcgggctacttta

SEQ ID NO: 7148345 - DNA, 22 bp, Homo sapiens
tgaaagcagtgccatgattatg

SEQ ID NO: 7148346 - DNA, 22 bp, Homo sapiens
tgaaagcagtgccatgattatg

SEQ ID NO: 7148347 - DNA, 22 bp, Homo sapiens
tgaaagcagtgccatgattatg

SEQ ID NO: 7148348 - DNA, 22 bp, Homo sapiens
tgaaagcagtgccatgattatg

SEQ ID NO: 7148349 - DNA, 22 bp, Homo sapiens
tgaaagcagtgccatgattatg

SEQ ID NO: 7148350 - DNA, 22 bp, Homo sapiens
tgaaagcatatgctaaagacca

SEQ ID NO: 7148351 - DNA, 22 bp, Homo sapiens
tgaaagcatatgctaaagacca

SEQ ID NO: 7148352 - DNA, 22 bp, Homo sapiens
tgaaagcatatgctaaagacca

SEQ ID NO: 7148353 - DNA, 22 bp, Homo sapiens
tgaaagcatgcttgccaagctt

SEQ ID NO: 7148354 - DNA, 22 bp, Homo sapiens
tgaaagcagcaccaataccatt

SEQ ID NO: 7148355 - DNA, 22 bp, Homo sapiens
tgaaagcagcaccaataccatt

SEQ ID NO: 7148356 - DNA, 22 bp, Homo sapiens
tgaaagcactgattctcaactc

SEQ ID NO: 7148357 - DNA, 21 bp, Homo sapiens
ccaggctcctgaggctggtca

SEQ ID NO: 7148358 - DNA, 22 bp, Homo sapiens
tgaaacagattgatggtttcta

SEQ ID NO: 7148359 - DNA, 22 bp, Homo sapiens
ccaggctccccaggaggccctt

SEQ ID NO: 7148360 - DNA, 22 bp, Homo sapiens
ccaggctccccaggaggccctt

SEQ ID NO: 7148361 - DNA, 22 bp, Homo sapiens
ccaggctccccaggaggccctt

SEQ ID NO: 7148362 - DNA, 22 bp, Homo sapiens
ccaggctccccaggaggccctt

SEQ ID NO: 7148363 - DNA, 22 bp, Homo sapiens
ccaggctccgcatagaccccac

SEQ ID NO: 7148364 - DNA, 22 bp, Homo sapiens
ccaggctccgcatagaccccac

SEQ ID NO: 7148365 - DNA, 22 bp, Homo sapiens
ccaggctccgcatagaccccac

SEQ ID NO: 7148366 - DNA, 22 bp, Homo sapiens
ccaggctcctcatgatcttgtt

SEQ ID NO: 7148367 - DNA, 22 bp, Homo sapiens
ccaggctcctcatgatcttgtt

SEQ ID NO: 7148368 - DNA, 22 bp, Homo sapiens
ccaggctcctcatgatcttgtt

SEQ ID NO: 7148369 - DNA, 22 bp, Homo sapiens
ccaggctcctcatgatcttgtt

SEQ ID NO: 7148370 - DNA, 21 bp, Homo sapiens
ccaggctcctgaggctggtca

SEQ ID NO: 7148371 - DNA, 22 bp, Homo sapiens
ccagggaaaggaggttgacttg

SEQ ID NO: 7148372 - DNA, 22 bp, Homo sapiens
ccagggaaattaatgagttaat

SEQ ID NO: 7148373 - DNA, 22 bp, Homo sapiens
ccagggaagaaagatgaagtgc

SEQ ID NO: 7148374 - DNA, 21 bp, Homo sapiens
ccagggaagaaatgagggcag

SEQ ID NO: 7148375 - DNA, 21 bp, Homo sapiens
ccagggaagaaatgagggcag

SEQ ID NO: 7148376 - DNA, 21 bp, Homo sapiens
ccagggaagaaatgagggcag

SEQ ID NO: 7148377 - DNA, 22 bp, Homo sapiens
ccagggaagaataggtgtggtt

SEQ ID NO: 7148378 - DNA, 22 bp, Homo sapiens
ccagggaagaccacttcctgga

SEQ ID NO: 7148379 - DNA, 22 bp, Homo sapiens
tgacaattgtgggcagtttgtg

SEQ ID NO: 7148380 - DNA, 22 bp, Homo sapiens
tgacaattgcagacacagaagt

SEQ ID NO: 7148381 - DNA, 22 bp, Homo sapiens
tgacaattgcagacacagaagt

SEQ ID NO: 7148382 - DNA, 22 bp, Homo sapiens
ccagggaagattagaagccact

SEQ ID NO: 7148383 - DNA, 22 bp, Homo sapiens
tgacaatggggcacatggaaag

SEQ ID NO: 7148384 - DNA, 22 bp, Homo sapiens
tgacaatgggtggacaagatag

SEQ ID NO: 7148385 - DNA, 22 bp, Homo sapiens
tgacaatgggtggacaagatag

SEQ ID NO: 7148386 - DNA, 22 bp, Homo sapiens
tgacaatgggtggacaagatag

SEQ ID NO: 7148387 - DNA, 22 bp, Homo sapiens
tgacagactttacttctcctat

SEQ ID NO: 7148388 - DNA, 22 bp, Homo sapiens
tgacagagacagattgaagctt

SEQ ID NO: 7148389 - DNA, 22 bp, Homo sapiens
tgacagagacttcagagccaaa

SEQ ID NO: 7148390 - DNA, 22 bp, Homo sapiens
tgacagagacttcagagccaaa

SEQ ID NO: 7148391 - DNA, 22 bp, Homo sapiens
ccagggaaaatcaacttctact

SEQ ID NO: 7148392 - DNA, 22 bp, Homo sapiens
ccaggcttttctcatggagtca

SEQ ID NO: 7148393 - DNA, 22 bp, Homo sapiens
ccaggcttttagctgcatggca

SEQ ID NO: 7148394 - DNA, 22 bp, Homo sapiens
ccaggcttttctcatggagtca

SEQ ID NO: 7148395 - DNA, 22 bp, Homo sapiens
ccagggaaaatcaacttctact

SEQ ID NO: 7148396 - DNA, 22 bp, Homo sapiens
ccagggaaacagcccagtgtga

SEQ ID NO: 7148397 - DNA, 22 bp, Homo sapiens
ccagggaaactttggagtggag

SEQ ID NO: 7148398 - DNA, 22 bp, Homo sapiens
ccaggctttcccagcctctcca

SEQ ID NO: 7148399 - DNA, 22 bp, Homo sapiens
ccaggctttctcctgactcaca

SEQ ID NO: 7148400 - DNA, 22 bp, Homo sapiens
ccaggctttctcctgactcaca

SEQ ID NO: 7148401 - DNA, 22 bp, Homo sapiens
ccaggcttttagctgcatggca

SEQ ID NO: 7148402 - DNA, 21 bp, Homo sapiens
tgaaggagaggaccgagtgct

SEQ ID NO: 7148403 - DNA, 21 bp, Homo sapiens
tgaaggagaggaccgagtgct

SEQ ID NO: 7148404 - DNA, 22 bp, Homo sapiens
tgaaggagaattaataggcatt

SEQ ID NO: 7148405 - DNA, 22 bp, Homo sapiens
tgaaggagaattaataggcatt

SEQ ID NO: 7148406 - DNA, 22 bp, Homo sapiens
ccaggcttggtgtgtggtcagg

SEQ ID NO: 7148407 - DNA, 22 bp, Homo sapiens
ccaggcttggtgtgtggtcagg

SEQ ID NO: 7148408 - DNA, 22 bp, Homo sapiens
ccaggcttggtgtgtggtcagg

SEQ ID NO: 7148409 - DNA, 22 bp, Homo sapiens
ccaggctttaagaggtggaaac

SEQ ID NO: 7148410 - DNA, 22 bp, Homo sapiens
ccaggctttaagaggtggaaac

SEQ ID NO: 7148411 - DNA, 19 bp, Homo sapiens
ccaggctttatgcaaatac

SEQ ID NO: 7148412 - DNA, 22 bp, Homo sapiens
ccagggcatgtccaagacttag

SEQ ID NO: 7148413 - DNA, 22 bp, Homo sapiens
ccagggcatgtccaagacttag

SEQ ID NO: 7148414 - DNA, 22 bp, Homo sapiens
ccagggccaagagacctcgagg

SEQ ID NO: 7148415 - DNA, 22 bp, Homo sapiens
ccagggccaagagacctcgagg

SEQ ID NO: 7148416 - DNA, 22 bp, Homo sapiens
ccagggcatgtaactaatggtg

SEQ ID NO: 7148417 - DNA, 22 bp, Homo sapiens
ccagggcatgtaactaatggtg

SEQ ID NO: 7148418 - DNA, 22 bp, Homo sapiens
ccagggcatgtaactaatggtg

SEQ ID NO: 7148419 - DNA, 22 bp, Homo sapiens
ccagggcatgtccaagacttag

SEQ ID NO: 7148420 - DNA, 22 bp, Homo sapiens
ccagggcatgggaagaactgaa

SEQ ID NO: 7148421 - DNA, 22 bp, Homo sapiens
ccagggcatgggaagaactgaa

SEQ ID NO: 7148422 - DNA, 22 bp, Homo sapiens
tgacagagttcggattgagttt

SEQ ID NO: 7148423 - DNA, 22 bp, Homo sapiens
tgacagagttcggattgagttt

SEQ ID NO: 7148424 - DNA, 22 bp, Homo sapiens
tgacagagttcggattgagttt

SEQ ID NO: 7148425 - DNA, 22 bp, Homo sapiens
ccagggcatgggaagaactgaa

SEQ ID NO: 7148426 - DNA, 22 bp, Homo sapiens
tgacagaggctgagttagtctg

SEQ ID NO: 7148427 - DNA, 22 bp, Homo sapiens
tgacagagtccagaagtagtgt

SEQ ID NO: 7148428 - DNA, 22 bp, Homo sapiens
tgacagagtccagaagtagtgt

SEQ ID NO: 7148429 - DNA, 22 bp, Homo sapiens
tgacagagtccagaagtagtgt

SEQ ID NO: 7148430 - DNA, 22 bp, Homo sapiens
tgacagagtccagaagtagtgt

SEQ ID NO: 7148431 - DNA, 22 bp, Homo sapiens
tgacagagtccagaagtagtgt

SEQ ID NO: 7148432 - DNA, 22 bp, Homo sapiens
tgacagagtcggggcaagctgt

SEQ ID NO: 7148433 - DNA, 22 bp, Homo sapiens
tgacagagtgacactcttgtct

SEQ ID NO: 7148434 - DNA, 23 bp, Homo sapiens
tgacagagcacagtgggggagat

SEQ ID NO: 7148435 - DNA, 22 bp, Homo sapiens
tgacagagcatgtagtgacagc

SEQ ID NO: 7148436 - DNA, 22 bp, Homo sapiens
tgacagagcatgtagtgacagc

SEQ ID NO: 7148437 - DNA, 22 bp, Homo sapiens
tgacagagcatgtagtgacagc

SEQ ID NO: 7148438 - DNA, 22 bp, Homo sapiens
tgacagagcatgtagtgacagc

SEQ ID NO: 7148439 - DNA, 22 bp, Homo sapiens
tgacagagcatgtagtgacagc

SEQ ID NO: 7148440 - DNA, 22 bp, Homo sapiens
tgacagagccaagatcagtact

SEQ ID NO: 7148441 - DNA, 22 bp, Homo sapiens
tgacagagctggagaataattt

SEQ ID NO: 7148442 - DNA, 22 bp, Homo sapiens
tgacagaggagctggaatgatt

SEQ ID NO: 7148443 - DNA, 22 bp, Homo sapiens
tgacagaggcacccacaactat

SEQ ID NO: 7148444 - DNA, 19 bp, Homo sapiens
tgacagagagcagggtggt

SEQ ID NO: 7148445 - DNA, 19 bp, Homo sapiens
tgacagagagcagggtggt

SEQ ID NO: 7148446 - DNA, 22 bp, Homo sapiens
tgacagagagcttttgactgtc

SEQ ID NO: 7148447 - DNA, 22 bp, Homo sapiens
tgacagagagcttttgactgtc

SEQ ID NO: 7148448 - DNA, 23 bp, Homo sapiens
tgacagagcaagacttggtctca

SEQ ID NO: 7148449 - DNA, 22 bp, Homo sapiens
tgacagagcaagatctagataa

SEQ ID NO: 7148450 - DNA, 22 bp, Homo sapiens
tgacagagcaagatctagataa

SEQ ID NO: 7148451 - DNA, 22 bp, Homo sapiens
tgacagagcaagatcttatctc

SEQ ID NO: 7148452 - DNA, 23 bp, Homo sapiens
tgacagagcacagtgggggagat

SEQ ID NO: 7148453 - DNA, 22 bp, Homo sapiens
ccagggtggcgtagatgctggg

SEQ ID NO: 7148454 - DNA, 22 bp, Homo sapiens
ccagggtcttcgaggcagcaat

SEQ ID NO: 7148455 - DNA, 22 bp, Homo sapiens
tgagaaaactcaaagacagatc

SEQ ID NO: 7148456 - DNA, 22 bp, Homo sapiens
tgagaaaactcaaagacagatc

SEQ ID NO: 7148457 - DNA, 22 bp, Homo sapiens
tgagaaaaggttgagatgataa

SEQ ID NO: 7148458 - DNA, 22 bp, Homo sapiens
tgagaaaaggttgagatgataa

SEQ ID NO: 7148459 - DNA, 22 bp, Homo sapiens
tgagaaaaggttgagatgataa

SEQ ID NO: 7148460 - DNA, 22 bp, Homo sapiens
tgagaaaaggttgagatgataa

SEQ ID NO: 7148461 - DNA, 22 bp, Homo sapiens
ccagggtctctgctgcctgaga

SEQ ID NO: 7148462 - DNA, 22 bp, Homo sapiens
tgacttttggacctcactgtcc

SEQ ID NO: 7148463 - DNA, 18 bp, Homo sapiens
tgactttctttttcaacc

SEQ ID NO: 7148464 - DNA, 22 bp, Homo sapiens
tgacttttggacctcactgtcc

SEQ ID NO: 7148465 - DNA, 22 bp, Homo sapiens
tgagaaaacagtttgtaataat

SEQ ID NO: 7148466 - DNA, 22 bp, Homo sapiens
tgagaaaacagtttgtaataat

SEQ ID NO: 7148467 - DNA, 22 bp, Homo sapiens
tgagaaaacagtttgtaataat

SEQ ID NO: 7148468 - DNA, 22 bp, Homo sapiens
tgagaaaacagtttgtaataat

SEQ ID NO: 7148469 - DNA, 22 bp, Homo sapiens
tgagaaaacagtttgtaataat

SEQ ID NO: 7148470 - DNA, 22 bp, Homo sapiens
tgagaaaactcaaagacagatc

SEQ ID NO: 7148471 - DNA, 22 bp, Homo sapiens
tgagaaaactcaaagacagatc

SEQ ID NO: 7148472 - DNA, 22 bp, Homo sapiens
tgacccatttgcttttcctgta

SEQ ID NO: 7148473 - DNA, 22 bp, Homo sapiens
tgaccccactgtgctcagaggt

SEQ ID NO: 7148474 - DNA, 22 bp, Homo sapiens
tgaccctgcttcttggtgcagg

SEQ ID NO: 7148475 - DNA, 22 bp, Homo sapiens
tgactttagacttagtcaagtt

SEQ ID NO: 7148476 - DNA, 21 bp, Homo sapiens
tgactttatttgacagcccag

SEQ ID NO: 7148477 - DNA, 22 bp, Homo sapiens
tgactttccattctcacacagt

SEQ ID NO: 7148478 - DNA, 22 bp, Homo sapiens
tgactttcttaactagctgttc

SEQ ID NO: 7148479 - DNA, 22 bp, Homo sapiens
tgactttggactagtgatttaa

SEQ ID NO: 7148480 - DNA, 22 bp, Homo sapiens
tgaccaaaggtggtttatttgg

SEQ ID NO: 7148481 - DNA, 22 bp, Homo sapiens
tgaccacacgtctggaattgtg

SEQ ID NO: 7148482 - DNA, 22 bp, Homo sapiens
tgacatttttgtacaaagtcag

SEQ ID NO: 7148483 - DNA, 22 bp, Homo sapiens
tgaccacagacccaatgactac

SEQ ID NO: 7148484 - DNA, 22 bp, Homo sapiens
tgaccacacttgatcactctga

SEQ ID NO: 7148485 - DNA, 22 bp, Homo sapiens
tgaccacacttgatcactctga

SEQ ID NO: 7148486 - DNA, 22 bp, Homo sapiens
tgaccacagacccaatgactac

SEQ ID NO: 7148487 - DNA, 22 bp, Homo sapiens
tgaccacattgatttctcatcc

SEQ ID NO: 7148488 - DNA, 22 bp, Homo sapiens
tgaccaggatactgcagggatg

SEQ ID NO: 7148489 - DNA, 22 bp, Homo sapiens
tgaccaggatactgcagggatg

SEQ ID NO: 7148490 - DNA, 22 bp, Homo sapiens
tgaccagtgacccgaggcaagt

SEQ ID NO: 7148491 - DNA, 22 bp, Homo sapiens
tgaccagtgagcacagcatggt

SEQ ID NO: 7148492 - DNA, 22 bp, Homo sapiens
tgaccagtgatctactgggatt

SEQ ID NO: 7148493 - DNA, 22 bp, Homo sapiens
tgaccagtgcagggggagttag

SEQ ID NO: 7148494 - DNA, 21 bp, Homo sapiens
tgaccagtgccccatcctgtc

SEQ ID NO: 7148495 - DNA, 22 bp, Homo sapiens
tgaccagtggcgctgggtgcaa

SEQ ID NO: 7148496 - DNA, 22 bp, Homo sapiens
tgaccagttaagtcatcctgtc

SEQ ID NO: 7148497 - DNA, 22 bp, Homo sapiens
tgaccatttgatctacattcca

SEQ ID NO: 7148498 - DNA, 22 bp, Homo sapiens
tgacccatcaggccacatgagg

SEQ ID NO: 7148499 - DNA, 22 bp, Homo sapiens
tgacccatcaggccacatgagg

SEQ ID NO: 7148500 - DNA, 22 bp, Homo sapiens
tgacccatggtctgatcatagg

SEQ ID NO: 7148501 - DNA, 22 bp, Homo sapiens
tgacccattaaccactttccct

SEQ ID NO: 7148502 - DNA, 22 bp, Homo sapiens
tgacccattggtccctagatcc

SEQ ID NO: 7148503 - DNA, 22 bp, Homo sapiens
ccagggccagtaagattggcat

SEQ ID NO: 7148504 - DNA, 22 bp, Homo sapiens
ccagggccagtaagattggcat

SEQ ID NO: 7148505 - DNA, 22 bp, Homo sapiens
ccagggccaagagacctcgagg

SEQ ID NO: 7148506 - DNA, 22 bp, Homo sapiens
ccagggccagtaagattggcat

SEQ ID NO: 7148507 - DNA, 22 bp, Homo sapiens
ccagggccagtaagattggcat

SEQ ID NO: 7148508 - DNA, 23 bp, Homo sapiens
ccagggcccctacaccactgtcc

SEQ ID NO: 7148509 - DNA, 22 bp, Homo sapiens
ccagggcccacggccagaatag

SEQ ID NO: 7148510 - DNA, 22 bp, Homo sapiens
ccagggccagtaagattggcat

SEQ ID NO: 7148511 - DNA, 22 bp, Homo sapiens
ccagggcccacggccagaatag

SEQ ID NO: 7148512 - DNA, 22 bp, Homo sapiens
ccagggcccacggccagaatag

SEQ ID NO: 7148513 - DNA, 22 bp, Homo sapiens
tgacatctcattttgttgttgt

SEQ ID NO: 7148514 - DNA, 22 bp, Homo sapiens
tgacatctcattttgttgttgt

SEQ ID NO: 7148515 - DNA, 22 bp, Homo sapiens
tgacatctctgtgggttcaggt

SEQ ID NO: 7148516 - DNA, 22 bp, Homo sapiens
tgacatctgaccacacgtattc

SEQ ID NO: 7148517 - DNA, 22 bp, Homo sapiens
tgacatctgccagtttggtcgt

SEQ ID NO: 7148518 - DNA, 22 bp, Homo sapiens
tgacatctggagtctgggctgt

SEQ ID NO: 7148519 - DNA, 22 bp, Homo sapiens
tgacatctggcttgtgccctgc

SEQ ID NO: 7148520 - DNA, 22 bp, Homo sapiens
tgacatctttgatctcatttag

SEQ ID NO: 7148521 - DNA, 20 bp, Homo sapiens
tgacatctgttgaggaggaa

SEQ ID NO: 7148522 - DNA, 22 bp, Homo sapiens
tgacatgaaactgtgttgctac

SEQ ID NO: 7148523 - DNA, 22 bp, Homo sapiens
tgacatgctaagattatgttat

SEQ ID NO: 7148524 - DNA, 22 bp, Homo sapiens
tgacatgcttgttttccttgaa

SEQ ID NO: 7148525 - DNA, 22 bp, Homo sapiens
tgacatgctaagattatgttat

SEQ ID NO: 7148526 - DNA, 22 bp, Homo sapiens
tgacatttttgtacaaagtcag

SEQ ID NO: 7148527 - DNA, 22 bp, Homo sapiens
tgagcacctccctgacagtggg

SEQ ID NO: 7148528 - DNA, 22 bp, Homo sapiens
tgagcacctggaccagattctg

SEQ ID NO: 7148529 - DNA, 20 bp, Homo sapiens
tgagcacctgggtgttctgg

SEQ ID NO: 7148530 - DNA, 19 bp, Homo sapiens
tgagcaccttctcacgtaa

SEQ ID NO: 7148531 - DNA, 22 bp, Homo sapiens
tgagcaccttctctcatttccc

SEQ ID NO: 7148532 - DNA, 22 bp, Homo sapiens
tgagcacctaccttgtccagtg

SEQ ID NO: 7148533 - DNA, 22 bp, Homo sapiens
tgagcacctactagaatgctaa

SEQ ID NO: 7148534 - DNA, 21 bp, Homo sapiens
tgagcacctactatgtgtcag

SEQ ID NO: 7148535 - DNA, 22 bp, Homo sapiens
tgagcacctactgtattccagg

SEQ ID NO: 7148536 - DNA, 23 bp, Homo sapiens
tgagcacctacctggagccaagc

SEQ ID NO: 7148537 - DNA, 23 bp, Homo sapiens
tgagcacctaatgctgggcactg

SEQ ID NO: 7148538 - DNA, 22 bp, Homo sapiens
tgagcaccgccgcatttccaag

SEQ ID NO: 7148539 - DNA, 22 bp, Homo sapiens
tgagcaccctctggaaaatggg

SEQ ID NO: 7148540 - DNA, 22 bp, Homo sapiens
tgagataaggatgttatactcg

SEQ ID NO: 7148541 - DNA, 22 bp, Homo sapiens
tgagataaggaagtaattagga

SEQ ID NO: 7148542 - DNA, 22 bp, Homo sapiens
tgagataacatggaagagtagc

SEQ ID NO: 7148543 - DNA, 22 bp, Homo sapiens
tgagataacatggaagagtagc

SEQ ID NO: 7148544 - DNA, 22 bp, Homo sapiens
tgagataagcaaggataaaggt

SEQ ID NO: 7148545 - DNA, 22 bp, Homo sapiens
tgagataagcaaggataaaggt

SEQ ID NO: 7148546 - DNA, 22 bp, Homo sapiens
tgagagttctctcttcaggtgg

SEQ ID NO: 7148547 - DNA, 22 bp, Homo sapiens
tgagagttttgacgcttgtaac

SEQ ID NO: 7148548 - DNA, 22 bp, Homo sapiens
tgagataacaaaattatcttca

SEQ ID NO: 7148549 - DNA, 22 bp, Homo sapiens
tgagataacaaaattatcttca

SEQ ID NO: 7148550 - DNA, 19 bp, Homo sapiens
tgagagtgaggaaggcttc

SEQ ID NO: 7148551 - DNA, 19 bp, Homo sapiens
tgagagtgaggaaggcttc

SEQ ID NO: 7148552 - DNA, 19 bp, Homo sapiens
tgagagtgaggaaggcttc

SEQ ID NO: 7148553 - DNA, 22 bp, Homo sapiens
tgagagttattctgaatttagc

SEQ ID NO: 7148554 - DNA, 22 bp, Homo sapiens
tgagagtgaaatgtcacatgtc

SEQ ID NO: 7148555 - DNA, 22 bp, Homo sapiens
tgagagtattttggcattatca

SEQ ID NO: 7148556 - DNA, 22 bp, Homo sapiens
tgagagtattttggcattatca

SEQ ID NO: 7148557 - DNA, 22 bp, Homo sapiens
tgagaggtgaggcatgaggcat

SEQ ID NO: 7148558 - DNA, 22 bp, Homo sapiens
tgagagtagagtcttcatctgt

SEQ ID NO: 7148559 - DNA, 22 bp, Homo sapiens
ccaggtcctgttttcaccacag

SEQ ID NO: 7148560 - DNA, 22 bp, Homo sapiens
ccaggtcctgttttcaccacag

SEQ ID NO: 7148561 - DNA, 22 bp, Homo sapiens
ccaggtctatcaagttgggctc

SEQ ID NO: 7148562 - DNA, 22 bp, Homo sapiens
ccaggtaaattacctactgaat

SEQ ID NO: 7148563 - DNA, 22 bp, Homo sapiens
ccagggttggtctctctgaggt

SEQ ID NO: 7148564 - DNA, 22 bp, Homo sapiens
ccagggttggtctctctgaggt

SEQ ID NO: 7148565 - DNA, 22 bp, Homo sapiens
ccaggtagccaaggggtctggg

SEQ ID NO: 7148566 - DNA, 22 bp, Homo sapiens
ccaggtcaagctcccctgtggt

SEQ ID NO: 7148567 - DNA, 22 bp, Homo sapiens
ccaggtccctggaatttatgag

SEQ ID NO: 7148568 - DNA, 22 bp, Homo sapiens
ccagggttgctttagattctga

SEQ ID NO: 7148569 - DNA, 22 bp, Homo sapiens
ccagggttataaatgcatctgt

SEQ ID NO: 7148570 - DNA, 22 bp, Homo sapiens
ccagggtgtgggcgtcggcacg

SEQ ID NO: 7148571 - DNA, 22 bp, Homo sapiens
ccagggttataaatgcatctgt

SEQ ID NO: 7148572 - DNA, 22 bp, Homo sapiens
ccagggtgggaggctgaaggcg

SEQ ID NO: 7148573 - DNA, 22 bp, Homo sapiens
ccagggtgggaggctgaaggcg

SEQ ID NO: 7148574 - DNA, 22 bp, Homo sapiens
ccagggtgggaggctgaaggcg

SEQ ID NO: 7148575 - DNA, 22 bp, Homo sapiens
ccagggtgtgagaaggaagtag

SEQ ID NO: 7148576 - DNA, 22 bp, Homo sapiens
ccagggtgtgagaaggaagtag

SEQ ID NO: 7148577 - DNA, 22 bp, Homo sapiens
ccagggtgtgagaaggaagtag

SEQ ID NO: 7148578 - DNA, 22 bp, Homo sapiens
ccagggtgtgagaaggaagtag

SEQ ID NO: 7148579 - DNA, 22 bp, Homo sapiens
ccagggtgtgagaaggaagtag

SEQ ID NO: 7148580 - DNA, 22 bp, Homo sapiens
ccagggtgtgagaaggaagtag

SEQ ID NO: 7148581 - DNA, 22 bp, Homo sapiens
ccagggtggggtccaggaacca

SEQ ID NO: 7148582 - DNA, 22 bp, Homo sapiens
ccagggtgtagggattccagat

SEQ ID NO: 7148583 - DNA, 22 bp, Homo sapiens
ccagggtgtagggattccagat

SEQ ID NO: 7148584 - DNA, 22 bp, Homo sapiens
ccagggtggggtccaggaacca

SEQ ID NO: 7148585 - DNA, 22 bp, Homo sapiens
ccagggtggggtccaggaacca

SEQ ID NO: 7148586 - DNA, 22 bp, Homo sapiens
ccagggtggggtccaggaacca

SEQ ID NO: 7148587 - DNA, 22 bp, Homo sapiens
ccagggtggggtccaggaacca

SEQ ID NO: 7148588 - DNA, 22 bp, Homo sapiens
ccagggtggggtccaggaacca

SEQ ID NO: 7148589 - DNA, 22 bp, Homo sapiens
tgagctgggctgggctgagctg

SEQ ID NO: 7148590 - DNA, 23 bp, Homo sapiens
tgagctgggcctgcaggggtctc

SEQ ID NO: 7148591 - DNA, 23 bp, Homo sapiens
tgagctgggcctgcaggggtctc

SEQ ID NO: 7148592 - DNA, 23 bp, Homo sapiens
tgagctgggcctgcaggggtctc

SEQ ID NO: 7148593 - DNA, 22 bp, Homo sapiens
tgagctgggctgggctgagctg

SEQ ID NO: 7148594 - DNA, 22 bp, Homo sapiens
tgagctggggtcagctcccctg

SEQ ID NO: 7148595 - DNA, 22 bp, Homo sapiens
tgagctggggtcagctcccctg

SEQ ID NO: 7148596 - DNA, 23 bp, Homo sapiens
tgagctggtattgtccatctcca

SEQ ID NO: 7148597 - DNA, 23 bp, Homo sapiens
tgagctggtattgtccatctcca

SEQ ID NO: 7148598 - DNA, 22 bp, Homo sapiens
tgagctgggctgggctgagctg

SEQ ID NO: 7148599 - DNA, 22 bp, Homo sapiens
tgaggaatgctgagcagaggaa

SEQ ID NO: 7148600 - DNA, 22 bp, Homo sapiens
tgaggaagttgtttctcttcta

SEQ ID NO: 7148601 - DNA, 22 bp, Homo sapiens
tgagctggtcactccttctgaa

SEQ ID NO: 7148602 - DNA, 22 bp, Homo sapiens
tgagctggtcactccttctgaa

SEQ ID NO: 7148603 - DNA, 22 bp, Homo sapiens
tgaggaatttctttatgaatga

SEQ ID NO: 7148604 - DNA, 22 bp, Homo sapiens
tgaggacaatccctaactcaga

SEQ ID NO: 7148605 - DNA, 22 bp, Homo sapiens
tgaggacaatccctaactcaga

SEQ ID NO: 7148606 - DNA, 22 bp, Homo sapiens
tgaggacaatccctaactcaga

SEQ ID NO: 7148607 - DNA, 22 bp, Homo sapiens
tgaggacatgagtgggacagag

SEQ ID NO: 7148608 - DNA, 23 bp, Homo sapiens
ccagtggcgtaaactagaggata

SEQ ID NO: 7148609 - DNA, 22 bp, Homo sapiens
ccagtgggaacactggcattgc

SEQ ID NO: 7148610 - DNA, 23 bp, Homo sapiens
ccagtggcgtaaactagaggata

SEQ ID NO: 7148611 - DNA, 22 bp, Homo sapiens
tgaggacatttatcttggcgca

SEQ ID NO: 7148612 - DNA, 22 bp, Homo sapiens
tgaggacattggtcaggacatg

SEQ ID NO: 7148613 - DNA, 22 bp, Homo sapiens
tgaggacattggtcaggacatg

SEQ ID NO: 7148614 - DNA, 22 bp, Homo sapiens
tgaggacattgagactggagac

SEQ ID NO: 7148615 - DNA, 22 bp, Homo sapiens
tgaggacattgagactggagac

SEQ ID NO: 7148616 - DNA, 22 bp, Homo sapiens
tgaggacattgagactggagac

SEQ ID NO: 7148617 - DNA, 22 bp, Homo sapiens
tgaggacattgagactggagac

SEQ ID NO: 7148618 - DNA, 22 bp, Homo sapiens
tgaggacattgagactggagac

SEQ ID NO: 7148619 - DNA, 22 bp, Homo sapiens
tgaggacattaggaagtgaagg

SEQ ID NO: 7148620 - DNA, 22 bp, Homo sapiens
tgaggacatgagtgggacagag

SEQ ID NO: 7148621 - DNA, 22 bp, Homo sapiens
tgaggacatgagtgggacagag

SEQ ID NO: 7148622 - DNA, 22 bp, Homo sapiens
tgaggacatgagtgggacagag

SEQ ID NO: 7148623 - DNA, 22 bp, Homo sapiens
tgagctgggagtggtgatgagg

SEQ ID NO: 7148624 - DNA, 22 bp, Homo sapiens
tgagctgggagtggtgatgagg

SEQ ID NO: 7148625 - DNA, 21 bp, Homo sapiens
tgagctgggagttctgaaaag

SEQ ID NO: 7148626 - DNA, 22 bp, Homo sapiens
tgagctgggaagagcagccaga

SEQ ID NO: 7148627 - DNA, 22 bp, Homo sapiens
tgagctgggaagagcagccaga

SEQ ID NO: 7148628 - DNA, 22 bp, Homo sapiens
tgagctggcttgtcaaccaggg

SEQ ID NO: 7148629 - DNA, 22 bp, Homo sapiens
tgagctggcttgtcaaccaggg

SEQ ID NO: 7148630 - DNA, 19 bp, Homo sapiens
tgagctggctgagcctctc

SEQ ID NO: 7148631 - DNA, 22 bp, Homo sapiens
tgagctggcaggggctcaggga

SEQ ID NO: 7148632 - DNA, 22 bp, Homo sapiens
tgagctggcaggggctcaggga

SEQ ID NO: 7148633 - DNA, 22 bp, Homo sapiens
tgagctggcaggggctcaggga

SEQ ID NO: 7148634 - DNA, 22 bp, Homo sapiens
tgagctggcacttttcctggga

SEQ ID NO: 7148635 - DNA, 22 bp, Homo sapiens
tgagcccaggagttggaggctg

SEQ ID NO: 7148636 - DNA, 19 bp, Homo sapiens
tgagctggctgagcctctc

SEQ ID NO: 7148637 - DNA, 22 bp, Homo sapiens
tgagctggcaggggctcaggga

SEQ ID NO: 7148638 - DNA, 22 bp, Homo sapiens
tgagcccaggagttggaggctg

SEQ ID NO: 7148639 - DNA, 22 bp, Homo sapiens
tgagcagacttgatgaggcagc

SEQ ID NO: 7148640 - DNA, 22 bp, Homo sapiens
tgagcagaagttataaataaga

SEQ ID NO: 7148641 - DNA, 22 bp, Homo sapiens
tgagcagaatgttcagataaat

SEQ ID NO: 7148642 - DNA, 22 bp, Homo sapiens
tgagcagaatgttcagataaat

SEQ ID NO: 7148643 - DNA, 22 bp, Homo sapiens
tgagcagactctgcagagccac

SEQ ID NO: 7148644 - DNA, 22 bp, Homo sapiens
tgagcagacttgatgaggcagc

SEQ ID NO: 7148645 - DNA, 22 bp, Homo sapiens
tgagcagaagccctcctggact

SEQ ID NO: 7148646 - DNA, 22 bp, Homo sapiens
tgagcagaagccctcctggact

SEQ ID NO: 7148647 - DNA, 22 bp, Homo sapiens
tgagcagaacacgggatccatg

SEQ ID NO: 7148648 - DNA, 22 bp, Homo sapiens
tgagcagaagattggaacttac

SEQ ID NO: 7148649 - DNA, 22 bp, Homo sapiens
tgagcaccttgtgactggctgc

SEQ ID NO: 7148650 - DNA, 21 bp, Homo sapiens
tgagcaccttcttatattttg

SEQ ID NO: 7148651 - DNA, 22 bp, Homo sapiens
tgagcacggaataaacgtctat

SEQ ID NO: 7148652 - DNA, 22 bp, Homo sapiens
tgagcactttaaaatattccca

SEQ ID NO: 7148653 - DNA, 22 bp, Homo sapiens
tgagcacttttcaaagagagct

SEQ ID NO: 7148654 - DNA, 22 bp, Homo sapiens
tgagcagaaaagaatgctgagc

SEQ ID NO: 7148655 - DNA, 22 bp, Homo sapiens
tgagcagaaaagaatgctgagc

SEQ ID NO: 7148656 - DNA, 22 bp, Homo sapiens
tttgattgcaatagttttatga

SEQ ID NO: 7148657 - DNA, 18 bp, Homo sapiens
tttgattgctgtcatcca

SEQ ID NO: 7148658 - DNA, 22 bp, Homo sapiens
tttgatttactggatattctca

SEQ ID NO: 7148659 - DNA, 22 bp, Homo sapiens
tttgatttactggatattctca

SEQ ID NO: 7148660 - DNA, 22 bp, Homo sapiens
tttgatttactggatattctca

SEQ ID NO: 7148661 - DNA, 22 bp, Homo sapiens
tttgatttactataagcagcac

SEQ ID NO: 7148662 - DNA, 22 bp, Homo sapiens
tttgattgtcacctaccttgca

SEQ ID NO: 7148663 - DNA, 22 bp, Homo sapiens
tttgatgatgatgataaagttt

SEQ ID NO: 7148664 - DNA, 22 bp, Homo sapiens
tttgatgatgatgataaagttt

SEQ ID NO: 7148665 - DNA, 22 bp, Homo sapiens
tttgatgatgatgataaagttt

SEQ ID NO: 7148666 - DNA, 22 bp, Homo sapiens
tttgatgagtttaataacagcc

SEQ ID NO: 7148667 - DNA, 22 bp, Homo sapiens
tttgatgagtttaataacagcc

SEQ ID NO: 7148668 - DNA, 22 bp, Homo sapiens
tttgatgagtttaataacagcc

SEQ ID NO: 7148669 - DNA, 22 bp, Homo sapiens
tttgatgatgatgataaagttt

SEQ ID NO: 7148670 - DNA, 22 bp, Homo sapiens
tttgatgatgatgataaagttt

SEQ ID NO: 7148671 - DNA, 22 bp, Homo sapiens
tttgatgatgatgataaagttt

SEQ ID NO: 7148672 - DNA, 22 bp, Homo sapiens
tttgatgtcaaaatatcctgtt

SEQ ID NO: 7148673 - DNA, 22 bp, Homo sapiens
tttgatgtcaaaatatcctgtt

SEQ ID NO: 7148674 - DNA, 22 bp, Homo sapiens
tttgatgaacctatataatttg

SEQ ID NO: 7148675 - DNA, 22 bp, Homo sapiens
tttgatgaaagctactatttac

SEQ ID NO: 7148676 - DNA, 22 bp, Homo sapiens
tttgatgaacctatataatttg

SEQ ID NO: 7148677 - DNA, 22 bp, Homo sapiens
tttgatgaacctatataatttg

SEQ ID NO: 7148678 - DNA, 22 bp, Homo sapiens
tttgatgacctgtatctttttc

SEQ ID NO: 7148679 - DNA, 22 bp, Homo sapiens
tttgatgacctgtatctttttc

SEQ ID NO: 7148680 - DNA, 19 bp, Homo sapiens
tttgatgagaatttaagca

SEQ ID NO: 7148681 - DNA, 22 bp, Homo sapiens
tttgatgacttcagatctttgt

SEQ ID NO: 7148682 - DNA, 22 bp, Homo sapiens
tttgctttcccttgtagaaagt

SEQ ID NO: 7148683 - DNA, 22 bp, Homo sapiens
tttgatttactggatattctca

SEQ ID NO: 7148684 - DNA, 18 bp, Homo sapiens
tttgctttccttcttcag

SEQ ID NO: 7148685 - DNA, 18 bp, Homo sapiens
tttgctttccttcttcag

SEQ ID NO: 7148686 - DNA, 18 bp, Homo sapiens
tttgctttccttcttcag

SEQ ID NO: 7148687 - DNA, 18 bp, Homo sapiens
tttgctttccttcttcag

SEQ ID NO: 7148688 - DNA, 22 bp, Homo sapiens
tttgctttctgttgaacagagt

SEQ ID NO: 7148689 - DNA, 22 bp, Homo sapiens
tttgctttcttgattcagatta

SEQ ID NO: 7148690 - DNA, 22 bp, Homo sapiens
tttgctttgggaggttgtctgg

SEQ ID NO: 7148691 - DNA, 22 bp, Homo sapiens
tttgctttgggaggttgtctgg

SEQ ID NO: 7148692 - DNA, 22 bp, Homo sapiens
tttgctttgggaggttgtctgg

SEQ ID NO: 7148693 - DNA, 19 bp, Homo sapiens
tttgatagggcataatata

SEQ ID NO: 7148694 - DNA, 22 bp, Homo sapiens
tttgatatcctatacaagtaaa

SEQ ID NO: 7148695 - DNA, 22 bp, Homo sapiens
tttgatatcctatacaagtaaa

SEQ ID NO: 7148696 - DNA, 22 bp, Homo sapiens
tttgatatcctatacaagtaaa

SEQ ID NO: 7148697 - DNA, 22 bp, Homo sapiens
tttgataattaaaaattgtagt

SEQ ID NO: 7148698 - DNA, 22 bp, Homo sapiens
tttgatgaaagctactatttac

SEQ ID NO: 7148699 - DNA, 22 bp, Homo sapiens
tttgatgaaagctactatttac

SEQ ID NO: 7148700 - DNA, 22 bp, Homo sapiens
tttgatctatgcgtggtttccc

SEQ ID NO: 7148701 - DNA, 22 bp, Homo sapiens
tttgatccagggcttacacata

SEQ ID NO: 7148702 - DNA, 22 bp, Homo sapiens
tttgatcctttagccatttgac

SEQ ID NO: 7148703 - DNA, 22 bp, Homo sapiens
tttgatatcttggtatacagat

SEQ ID NO: 7148704 - DNA, 22 bp, Homo sapiens
tttgatatcttggtatacagat

SEQ ID NO: 7148705 - DNA, 19 bp, Homo sapiens
tttgatatctgaattatgc

SEQ ID NO: 7148706 - DNA, 22 bp, Homo sapiens
tttgatcagcaagataaataga

SEQ ID NO: 7148707 - DNA, 22 bp, Homo sapiens
tttgatcatgaagaggataaac

SEQ ID NO: 7148708 - DNA, 22 bp, Homo sapiens
tttgagttgcttatttaatagg

SEQ ID NO: 7148709 - DNA, 22 bp, Homo sapiens
tttgagtctgcttccattttca

SEQ ID NO: 7148710 - DNA, 22 bp, Homo sapiens
tttgataacagtgaatatcatg

SEQ ID NO: 7148711 - DNA, 22 bp, Homo sapiens
tttgataacagtgaatatcatg

SEQ ID NO: 7148712 - DNA, 22 bp, Homo sapiens
tttgataagagctgctgaaact

SEQ ID NO: 7148713 - DNA, 22 bp, Homo sapiens
tttgataagagctgctgaaact

SEQ ID NO: 7148714 - DNA, 22 bp, Homo sapiens
tttgataatacacaagagaaag

SEQ ID NO: 7148715 - DNA, 22 bp, Homo sapiens
tttgacagatccttaactcagc

SEQ ID NO: 7148716 - DNA, 22 bp, Homo sapiens
tttgacagatccttaactcagc

SEQ ID NO: 7148717 - DNA, 22 bp, Homo sapiens
tttgacagatctcagagcattt

SEQ ID NO: 7148718 - DNA, 22 bp, Homo sapiens
tttgacagatctcagagcattt

SEQ ID NO: 7148719 - DNA, 22 bp, Homo sapiens
tttgacagcagataaaataaaa

SEQ ID NO: 7148720 - DNA, 22 bp, Homo sapiens
tttgacagcagataaaataaaa

SEQ ID NO: 7148721 - DNA, 22 bp, Homo sapiens
tttgaggacattttagaaagtt

SEQ ID NO: 7148722 - DNA, 22 bp, Homo sapiens
tttgaggacattttagaaagtt

SEQ ID NO: 7148723 - DNA, 22 bp, Homo sapiens
tttgaggacattttagaaagtt

SEQ ID NO: 7148724 - DNA, 22 bp, Homo sapiens
tttgaggttagctagcagatca

SEQ ID NO: 7148725 - DNA, 22 bp, Homo sapiens
tttgaggttagctagcagatca

SEQ ID NO: 7148726 - DNA, 22 bp, Homo sapiens
tttgaggttagctagcagatca

SEQ ID NO: 7148727 - DNA, 22 bp, Homo sapiens
tttgaggttagctagcagatca

SEQ ID NO: 7148728 - DNA, 22 bp, Homo sapiens
tttgaggttagctagcagatca

SEQ ID NO: 7148729 - DNA, 22 bp, Homo sapiens
tttgtaaaagcccaagctgtag

SEQ ID NO: 7148730 - DNA, 22 bp, Homo sapiens
tttgtaaaagcccaagctgtag

SEQ ID NO: 7148731 - DNA, 22 bp, Homo sapiens
tttgtaaaagcccaagctgtag

SEQ ID NO: 7148732 - DNA, 22 bp, Homo sapiens
tttggtttattaaattgtaggc

SEQ ID NO: 7148733 - DNA, 22 bp, Homo sapiens
tttggtttgaatgagcataaga

SEQ ID NO: 7148734 - DNA, 22 bp, Homo sapiens
tttggtttgaatgagcataaga

SEQ ID NO: 7148735 - DNA, 22 bp, Homo sapiens
tttggtttttaatacaaagtac

SEQ ID NO: 7148736 - DNA, 22 bp, Homo sapiens
tttggtttttaatacaaagtac

SEQ ID NO: 7148737 - DNA, 22 bp, Homo sapiens
tttggtgtgcaccttgcggtgc

SEQ ID NO: 7148738 - DNA, 22 bp, Homo sapiens
tttggttgtatcattctatgaa

SEQ ID NO: 7148739 - DNA, 22 bp, Homo sapiens
tttggtttagggtcatttaaca

SEQ ID NO: 7148740 - DNA, 22 bp, Homo sapiens
tttggtctggaatcttcagggt

SEQ ID NO: 7148741 - DNA, 22 bp, Homo sapiens
tttggtcttttgtaagttatct

SEQ ID NO: 7148742 - DNA, 21 bp, Homo sapiens
tttggtgctggaaatgccatt

SEQ ID NO: 7148743 - DNA, 22 bp, Homo sapiens
tttggtcatgtcgtcatttggg

SEQ ID NO: 7148744 - DNA, 22 bp, Homo sapiens
tttggtccaagttttactcttt

SEQ ID NO: 7148745 - DNA, 22 bp, Homo sapiens
tttggtccagcagtcccacttc

SEQ ID NO: 7148746 - DNA, 22 bp, Homo sapiens
tttggtccattatatgctgtca

SEQ ID NO: 7148747 - DNA, 22 bp, Homo sapiens
tttggtccatttgctcttacat

SEQ ID NO: 7148748 - DNA, 22 bp, Homo sapiens
tttggtcccagttctgtcatgg

SEQ ID NO: 7148749 - DNA, 21 bp, Homo sapiens
tttggtcccctcacctcctgg

SEQ ID NO: 7148750 - DNA, 22 bp, Homo sapiens
tttggtccctccctgcagctca

SEQ ID NO: 7148751 - DNA, 22 bp, Homo sapiens
tttggtcctaagctgctctcta

SEQ ID NO: 7148752 - DNA, 22 bp, Homo sapiens
tttggtcctatgagcaagtttc

SEQ ID NO: 7148753 - DNA, 22 bp, Homo sapiens
tttggtcctctctctgtgtgtg

SEQ ID NO: 7148754 - DNA, 22 bp, Homo sapiens
tttggtcctgagcaaaactatg

SEQ ID NO: 7148755 - DNA, 22 bp, Homo sapiens
tttggtccttcatacttccttt

SEQ ID NO: 7148756 - DNA, 18 bp, Homo sapiens
tttggtcctttataaaca

SEQ ID NO: 7148757 - DNA, 22 bp, Homo sapiens
tttggtctctgtgcatcctcct

SEQ ID NO: 7148758 - DNA, 22 bp, Homo sapiens
tttggaaattttcatccagaca

SEQ ID NO: 7148759 - DNA, 22 bp, Homo sapiens
tttggaaattttcatccagaca

SEQ ID NO: 7148760 - DNA, 22 bp, Homo sapiens
tttggaaatttcatcaatagcc

SEQ ID NO: 7148761 - DNA, 22 bp, Homo sapiens
tttggaaattttcatccagaca

SEQ ID NO: 7148762 - DNA, 22 bp, Homo sapiens
tttggaaatgagaagccacctt

SEQ ID NO: 7148763 - DNA, 22 bp, Homo sapiens
tttggaaattactcattgtcct

SEQ ID NO: 7148764 - DNA, 22 bp, Homo sapiens
tttggaaatttcatcaatagcc

SEQ ID NO: 7148765 - DNA, 22 bp, Homo sapiens
tttggaaataattccatctcat

SEQ ID NO: 7148766 - DNA, 22 bp, Homo sapiens
tttggaaatacgcgtaggcaga

SEQ ID NO: 7148767 - DNA, 22 bp, Homo sapiens
tttggaaatgaccccgtctaag

SEQ ID NO: 7148768 - DNA, 22 bp, Homo sapiens
tttggaaagtgtgatttcaagg

SEQ ID NO: 7148769 - DNA, 22 bp, Homo sapiens
tttggaaagtgtgatttcaagg

SEQ ID NO: 7148770 - DNA, 22 bp, Homo sapiens
tttggaaagtgtgatttcaagg

SEQ ID NO: 7148771 - DNA, 22 bp, Homo sapiens
tttggaaagtgtgatttcaagg

SEQ ID NO: 7148772 - DNA, 22 bp, Homo sapiens
tttggaaagttgtcactttaga

SEQ ID NO: 7148773 - DNA, 22 bp, Homo sapiens
tttggaaagacacacagtttta

SEQ ID NO: 7148774 - DNA, 22 bp, Homo sapiens
tttggaaagacacacagtttta

SEQ ID NO: 7148775 - DNA, 22 bp, Homo sapiens
tttggaaaggtttggccattat

SEQ ID NO: 7148776 - DNA, 22 bp, Homo sapiens
tttggaaaggtttggccattat

SEQ ID NO: 7148777 - DNA, 17 bp, Homo sapiens
tttggaaagtgatcatt

SEQ ID NO: 7148778 - DNA, 17 bp, Homo sapiens
tttggaaagtgatcatt

SEQ ID NO: 7148779 - DNA, 22 bp, Homo sapiens
tttggaaagtgtacaaatttga

SEQ ID NO: 7148780 - DNA, 22 bp, Homo sapiens
tttggaaagtgtacaaatttga

SEQ ID NO: 7148781 - DNA, 22 bp, Homo sapiens
tttggaaagtgtacaaatttga

SEQ ID NO: 7148782 - DNA, 22 bp, Homo sapiens
tttggaaacatctcagaaaata

SEQ ID NO: 7148783 - DNA, 22 bp, Homo sapiens
tttggaaactgatggtacattc

SEQ ID NO: 7148784 - DNA, 22 bp, Homo sapiens
tttggaaactgatggtacattc

SEQ ID NO: 7148785 - DNA, 22 bp, Homo sapiens
tttggaaactgatggtacattc

SEQ ID NO: 7148786 - DNA, 22 bp, Homo sapiens
tttggaaacatctcagaaaata

SEQ ID NO: 7148787 - DNA, 22 bp, Homo sapiens
tttggaaactgcctcagctctt

SEQ ID NO: 7148788 - DNA, 22 bp, Homo sapiens
tttggaaacacggtcatcttcc

SEQ ID NO: 7148789 - DNA, 22 bp, Homo sapiens
tttggaaacacggtcatcttcc

SEQ ID NO: 7148790 - DNA, 22 bp, Homo sapiens
tttggaaaatattgaactggtt

SEQ ID NO: 7148791 - DNA, 22 bp, Homo sapiens
tttggaaaattttctaagtctg

SEQ ID NO: 7148792 - DNA, 22 bp, Homo sapiens
tttggaaaattttctaagtctg

SEQ ID NO: 7148793 - DNA, 22 bp, Homo sapiens
tttggaaaaagcctgaacatag

SEQ ID NO: 7148794 - DNA, 22 bp, Homo sapiens
tttggaaaaagacagcttatga

SEQ ID NO: 7148795 - DNA, 22 bp, Homo sapiens
tttggaaaaagcctgaacatag

SEQ ID NO: 7148796 - DNA, 22 bp, Homo sapiens
tttgcttttgtgctctagtggt

SEQ ID NO: 7148797 - DNA, 22 bp, Homo sapiens
tttgcttttgtgctctagtggt

SEQ ID NO: 7148798 - DNA, 22 bp, Homo sapiens
tttggaaaaagacagcttatga

SEQ ID NO: 7148799 - DNA, 22 bp, Homo sapiens
tttcctcctagcctccagccgc

SEQ ID NO: 7148800 - DNA, 22 bp, Homo sapiens
tttcctctaaacgcatttgctt

SEQ ID NO: 7148801 - DNA, 22 bp, Homo sapiens
tttcctcatttatctgctggga

SEQ ID NO: 7148802 - DNA, 22 bp, Homo sapiens
tttcctcagaagtgtctactat

SEQ ID NO: 7148803 - DNA, 22 bp, Homo sapiens
tttcctaacacaatgcatgaga

SEQ ID NO: 7148804 - DNA, 19 bp, Homo sapiens
tttcctaaaaagctgtgct

SEQ ID NO: 7148805 - DNA, 22 bp, Homo sapiens
tttccctttgcactctacaatt

SEQ ID NO: 7148806 - DNA, 22 bp, Homo sapiens
tttccctctgtgccagcttctc

SEQ ID NO: 7148807 - DNA, 22 bp, Homo sapiens
tttccctgaggcctggacatta

SEQ ID NO: 7148808 - DNA, 21 bp, Homo sapiens
tttccctcattgtgttggcac

SEQ ID NO: 7148809 - DNA, 17 bp, Homo sapiens
tttccctccttccactc

SEQ ID NO: 7148810 - DNA, 17 bp, Homo sapiens
tttccctccttccactc

SEQ ID NO: 7148811 - DNA, 18 bp, Homo sapiens
tttctttctgcctggggc

SEQ ID NO: 7148812 - DNA, 21 bp, Homo sapiens
tttctttctggctctcacagt

SEQ ID NO: 7148813 - DNA, 21 bp, Homo sapiens
tttctttctggctctcacagt

SEQ ID NO: 7148814 - DNA, 21 bp, Homo sapiens
tttctttctggctctcacagt

SEQ ID NO: 7148815 - DNA, 21 bp, Homo sapiens
tttctttctggctctcacagt

SEQ ID NO: 7148816 - DNA, 22 bp, Homo sapiens
tttctttgagtctcagtttgct

SEQ ID NO: 7148817 - DNA, 22 bp, Homo sapiens
tttctttgagtctcagtttgct

SEQ ID NO: 7148818 - DNA, 22 bp, Homo sapiens
tttcttttacagtgtggctatt

SEQ ID NO: 7148819 - DNA, 22 bp, Homo sapiens
tttctttgttgttatcacatca

SEQ ID NO: 7148820 - DNA, 22 bp, Homo sapiens
tttcttttacagtgtggctatt

SEQ ID NO: 7148821 - DNA, 22 bp, Homo sapiens
tttcttttacagtgtggctatt

SEQ ID NO: 7148822 - DNA, 22 bp, Homo sapiens
tttcttttacagtgtggctatt

SEQ ID NO: 7148823 - DNA, 22 bp, Homo sapiens
tttctttgtagtagcataatca

SEQ ID NO: 7148824 - DNA, 22 bp, Homo sapiens
tttctttgttgttatcacatca

SEQ ID NO: 7148825 - DNA, 22 bp, Homo sapiens
tttctttgttgttatcacatca

SEQ ID NO: 7148826 - DNA, 22 bp, Homo sapiens
tttctttgttgttatcacatca

SEQ ID NO: 7148827 - DNA, 22 bp, Homo sapiens
tttcttttgccctgtgggttag

SEQ ID NO: 7148828 - DNA, 22 bp, Homo sapiens
tttcttttgccctgtgggttag

SEQ ID NO: 7148829 - DNA, 22 bp, Homo sapiens
tttcttttgaatagtgtgtggt

SEQ ID NO: 7148830 - DNA, 22 bp, Homo sapiens
tttcttttgccctgtgggttag

SEQ ID NO: 7148831 - DNA, 22 bp, Homo sapiens
tttcttttgccctgtgggttag

SEQ ID NO: 7148832 - DNA, 22 bp, Homo sapiens
tttcttttgctgagaggggcac

SEQ ID NO: 7148833 - DNA, 22 bp, Homo sapiens
tttcttttgctgagaggggcac

SEQ ID NO: 7148834 - DNA, 22 bp, Homo sapiens
tttcttttgctgagaggggcac

SEQ ID NO: 7148835 - DNA, 22 bp, Homo sapiens
tttgaaaaaggcctttggtatg

SEQ ID NO: 7148836 - DNA, 19 bp, Homo sapiens
tttcttttcccctcagcac

SEQ ID NO: 7148837 - DNA, 19 bp, Homo sapiens
tttcttttcccctcagcac

SEQ ID NO: 7148838 - DNA, 19 bp, Homo sapiens
tttcttttcccctcagcac

SEQ ID NO: 7148839 - DNA, 22 bp, Homo sapiens
tttcttttccaatatccctact

SEQ ID NO: 7148840 - DNA, 22 bp, Homo sapiens
tttcttttccaatatccctact

SEQ ID NO: 7148841 - DNA, 22 bp, Homo sapiens
tttcttttccaatatccctact

SEQ ID NO: 7148842 - DNA, 22 bp, Homo sapiens
tttcttttccaatatccctact

SEQ ID NO: 7148843 - DNA, 19 bp, Homo sapiens
tttcttttcccctcagcac

SEQ ID NO: 7148844 - DNA, 19 bp, Homo sapiens
tttcttttcccctcagcac

SEQ ID NO: 7148845 - DNA, 22 bp, Homo sapiens
tttcttttgaatagtgtgtggt

SEQ ID NO: 7148846 - DNA, 22 bp, Homo sapiens
tttcttttgaatagtgtgtggt

SEQ ID NO: 7148847 - DNA, 22 bp, Homo sapiens
tttcttttgaatagtgtgtggt

SEQ ID NO: 7148848 - DNA, 22 bp, Homo sapiens
tttcttttgaatagtgtgtggt

SEQ ID NO: 7148849 - DNA, 22 bp, Homo sapiens
tttgaatatgtgcttgttaaat

SEQ ID NO: 7148850 - DNA, 22 bp, Homo sapiens
tttgaatgagaattattgtcat

SEQ ID NO: 7148851 - DNA, 22 bp, Homo sapiens
tttgaatgagaattattgtcat

SEQ ID NO: 7148852 - DNA, 22 bp, Homo sapiens
tttgaatatacttcaaacaaag

SEQ ID NO: 7148853 - DNA, 22 bp, Homo sapiens
tttgaatatacttcaaacaaag

SEQ ID NO: 7148854 - DNA, 22 bp, Homo sapiens
tttgaatatacttcaaacaaag

SEQ ID NO: 7148855 - DNA, 22 bp, Homo sapiens
tttgaatatcacaaactttcaa

SEQ ID NO: 7148856 - DNA, 22 bp, Homo sapiens
tttgaatagggctttgcaggga

SEQ ID NO: 7148857 - DNA, 22 bp, Homo sapiens
tttgaagagccacagtgaaatt

SEQ ID NO: 7148858 - DNA, 19 bp, Homo sapiens
tttgaaaggattgttattt

SEQ ID NO: 7148859 - DNA, 19 bp, Homo sapiens
tttgaaaggattgttattt

SEQ ID NO: 7148860 - DNA, 22 bp, Homo sapiens
tttgaaagggttatgagactga

SEQ ID NO: 7148861 - DNA, 22 bp, Homo sapiens
tttgaaaggagctttatccaga

SEQ ID NO: 7148862 - DNA, 22 bp, Homo sapiens
tttgaaaggaattaggatgaca

SEQ ID NO: 7148863 - DNA, 22 bp, Homo sapiens
tttgaaagcctggcttttctct

SEQ ID NO: 7148864 - DNA, 21 bp, Homo sapiens
tttgaaagccctatgttttca

SEQ ID NO: 7148865 - DNA, 22 bp, Homo sapiens
tttgaaagcctggcttttctct

SEQ ID NO: 7148866 - DNA, 21 bp, Homo sapiens
tttgaaagccctatgttttca

SEQ ID NO: 7148867 - DNA, 22 bp, Homo sapiens
tttgacaaatccttcagcaatg

SEQ ID NO: 7148868 - DNA, 22 bp, Homo sapiens
tttgacaaatatttattggcac

SEQ ID NO: 7148869 - DNA, 22 bp, Homo sapiens
tttgacaaaggaaaaatgcaca

SEQ ID NO: 7148870 - DNA, 22 bp, Homo sapiens
tttgaatgttttaggtacttaa

SEQ ID NO: 7148871 - DNA, 20 bp, Homo sapiens
tttgaatgtaaagcatgtca

SEQ ID NO: 7148872 - DNA, 20 bp, Homo sapiens
tttgaatgtaaagcatgtca

SEQ ID NO: 7148873 - DNA, 22 bp, Homo sapiens
tttgaatgtaaatgctgcagct

SEQ ID NO: 7148874 - DNA, 22 bp, Homo sapiens
tttgaatgagaattattgtcat

SEQ ID NO: 7148875 - DNA, 22 bp, Homo sapiens
tttgaatgagggaaccacagtt

SEQ ID NO: 7148876 - DNA, 22 bp, Homo sapiens
tttgaatgcaggacatacagaa

SEQ ID NO: 7148877 - DNA, 23 bp, Homo sapiens
tttgaatgggtctatttttctta

SEQ ID NO: 7148878 - DNA, 22 bp, Homo sapiens
tttgacaattaggtagaaaaag

SEQ ID NO: 7148879 - DNA, 22 bp, Homo sapiens
tttgacaattaggtagaaaaag

SEQ ID NO: 7148880 - DNA, 22 bp, Homo sapiens
tttgacaattaggtagaaaaag

SEQ ID NO: 7148881 - DNA, 22 bp, Homo sapiens
tttgacaacagcaaatgtcaca

SEQ ID NO: 7148882 - DNA, 22 bp, Homo sapiens
tttgacaaccaggcaggtaaga

SEQ ID NO: 7148883 - DNA, 22 bp, Homo sapiens
tttgacaacgttgttgtgagga

SEQ ID NO: 7148884 - DNA, 22 bp, Homo sapiens
tttgacaacgttgttgtgagga

SEQ ID NO: 7148885 - DNA, 22 bp, Homo sapiens
tttgacaactgtgcagtttgta

SEQ ID NO: 7148886 - DNA, 22 bp, Homo sapiens
tttgacagaaagttattatttt

SEQ ID NO: 7148887 - DNA, 22 bp, Homo sapiens
tttgacagaaagttattatttt

SEQ ID NO: 7148888 - DNA, 22 bp, Homo sapiens
tttgacagacagtgctgggaca

SEQ ID NO: 7148889 - DNA, 22 bp, Homo sapiens
tttgacagacatttactacatt

SEQ ID NO: 7148890 - DNA, 22 bp, Homo sapiens
tttgacagacatttactacatt

SEQ ID NO: 7148891 - DNA, 22 bp, Homo sapiens
tttgacagacatttactacatt

SEQ ID NO: 7148892 - DNA, 22 bp, Homo sapiens
tttgacagagctcttagtctct

SEQ ID NO: 7148893 - DNA, 22 bp, Homo sapiens
tttgacagaggttgtggtgtat

SEQ ID NO: 7148894 - DNA, 22 bp, Homo sapiens
tttgacagagttgtgaggattt

SEQ ID NO: 7148895 - DNA, 22 bp, Homo sapiens
tttgacagagttgtgaggattt

SEQ ID NO: 7148896 - DNA, 19 bp, Homo sapiens
tttgacagagtttgagcat

SEQ ID NO: 7148897 - DNA, 19 bp, Homo sapiens
tttgacagagtttgagcat

SEQ ID NO: 7148898 - DNA, 22 bp, Homo sapiens
tttgacagatagatgttatgtt

SEQ ID NO: 7148899 - DNA, 22 bp, Homo sapiens
tttgacagatccttaactcagc

SEQ ID NO: 7148900 - DNA, 19 bp, Homo sapiens
ttttcacatactggatcct

SEQ ID NO: 7148901 - DNA, 19 bp, Homo sapiens
ttttcacatactggatcct

SEQ ID NO: 7148902 - DNA, 19 bp, Homo sapiens
ttttcacatactggatcct

SEQ ID NO: 7148903 - DNA, 22 bp, Homo sapiens
ttttcacattgtcccagcacta

SEQ ID NO: 7148904 - DNA, 22 bp, Homo sapiens
ttttcacacaaggtgataagtt

SEQ ID NO: 7148905 - DNA, 22 bp, Homo sapiens
ttttcacacaaggtgataagtt

SEQ ID NO: 7148906 - DNA, 22 bp, Homo sapiens
ttttattggagtgataccaagc

SEQ ID NO: 7148907 - DNA, 22 bp, Homo sapiens
ttttattgggagtcctctactg

SEQ ID NO: 7148908 - DNA, 22 bp, Homo sapiens
ttttcatgtcatgtccttgagg

SEQ ID NO: 7148909 - DNA, 22 bp, Homo sapiens
ttttcatgtgatgtgacatttc

SEQ ID NO: 7148910 - DNA, 22 bp, Homo sapiens
ttttcatggccaccgcaagtga

SEQ ID NO: 7148911 - DNA, 22 bp, Homo sapiens
ttttcatctctgctttgtacct

SEQ ID NO: 7148912 - DNA, 22 bp, Homo sapiens
ttttcatctctgctttgtacct

SEQ ID NO: 7148913 - DNA, 22 bp, Homo sapiens
ttttcatagtaatggtgcatgt

SEQ ID NO: 7148914 - DNA, 22 bp, Homo sapiens
ttttcatctctgctttgtacct

SEQ ID NO: 7148915 - DNA, 22 bp, Homo sapiens
ttttcatgttccttgttaagtg

SEQ ID NO: 7148916 - DNA, 22 bp, Homo sapiens
ttttcattgtaaatcaggaaac

SEQ ID NO: 7148917 - DNA, 22 bp, Homo sapiens
ttttcattgtaaatcaggaaac

SEQ ID NO: 7148918 - DNA, 22 bp, Homo sapiens
ttttcattgtaaatcaggaaac

SEQ ID NO: 7148919 - DNA, 22 bp, Homo sapiens
ttttcattgttactatgagcta

SEQ ID NO: 7148920 - DNA, 22 bp, Homo sapiens
ttttcattgttactatgagcta

SEQ ID NO: 7148921 - DNA, 22 bp, Homo sapiens
ttttattagtggctagatgggg

SEQ ID NO: 7148922 - DNA, 22 bp, Homo sapiens
ttttattagtggctagatgggg

SEQ ID NO: 7148923 - DNA, 22 bp, Homo sapiens
ttttattagtggctagatgggg

SEQ ID NO: 7148924 - DNA, 22 bp, Homo sapiens
ttttattagtggctagatgggg

SEQ ID NO: 7148925 - DNA, 22 bp, Homo sapiens
ttttattagtggctagatgggg

SEQ ID NO: 7148926 - DNA, 22 bp, Homo sapiens
ttttatgttgctataataggta

SEQ ID NO: 7148927 - DNA, 22 bp, Homo sapiens
ttttatgttcctgaagctatct

SEQ ID NO: 7148928 - DNA, 22 bp, Homo sapiens
ttttatgttgctataataggta

SEQ ID NO: 7148929 - DNA, 22 bp, Homo sapiens
ttttatgttcctctttatgcga

SEQ ID NO: 7148930 - DNA, 22 bp, Homo sapiens
ttttatgttcctctttatgcga

SEQ ID NO: 7148931 - DNA, 22 bp, Homo sapiens
ttttatgttcctctttatgcga

SEQ ID NO: 7148932 - DNA, 22 bp, Homo sapiens
ttttatgttcctgaagctatct

SEQ ID NO: 7148933 - DNA, 22 bp, Homo sapiens
ttttatgtgtgaaatgctgtct

SEQ ID NO: 7148934 - DNA, 22 bp, Homo sapiens
ttttatgtgtcaaagcagtggt

SEQ ID NO: 7148935 - DNA, 22 bp, Homo sapiens
ttttattatctttgaatgggac

SEQ ID NO: 7148936 - DNA, 22 bp, Homo sapiens
ttttattatctttgaatgggac

SEQ ID NO: 7148937 - DNA, 21 bp, Homo sapiens
ttttattgatgaatggccact

SEQ ID NO: 7148938 - DNA, 22 bp, Homo sapiens
ttttattgcaataaagtgtgta

SEQ ID NO: 7148939 - DNA, 22 bp, Homo sapiens
ttttattgcaataaagtgtgta

SEQ ID NO: 7148940 - DNA, 22 bp, Homo sapiens
ttttattgcaataaagtgtgta

SEQ ID NO: 7148941 - DNA, 22 bp, Homo sapiens
ttttattgcaataaagtgtgta

SEQ ID NO: 7148942 - DNA, 22 bp, Homo sapiens
ttttattgcaataaagtgtgta

SEQ ID NO: 7148943 - DNA, 22 bp, Homo sapiens
ttttattgcaataaagtgtgta

SEQ ID NO: 7148944 - DNA, 22 bp, Homo sapiens
ttttattgcaataaagtgtgta

SEQ ID NO: 7148945 - DNA, 22 bp, Homo sapiens
ttttattggagtgataccaagc

SEQ ID NO: 7148946 - DNA, 22 bp, Homo sapiens
ttttattggagtgataccaagc

SEQ ID NO: 7148947 - DNA, 22 bp, Homo sapiens
ttttattggagtgataccaagc

SEQ ID NO: 7148948 - DNA, 22 bp, Homo sapiens
ttttattggagtgataccaagc

SEQ ID NO: 7148949 - DNA, 22 bp, Homo sapiens
ttttattggagtgataccaagc

SEQ ID NO: 7148950 - DNA, 22 bp, Homo sapiens
ttttattggagtgataccaagc

SEQ ID NO: 7148951 - DNA, 22 bp, Homo sapiens
ttttattggagtgataccaagc

SEQ ID NO: 7148952 - DNA, 22 bp, Homo sapiens
ttttattggagtgataccaagc

SEQ ID NO: 7148953 - DNA, 22 bp, Homo sapiens
ttttctgaagtttaagacattt

SEQ ID NO: 7148954 - DNA, 22 bp, Homo sapiens
ttttctgaagtttaagacattt

SEQ ID NO: 7148955 - DNA, 22 bp, Homo sapiens
ttttctgacctatctacattta

SEQ ID NO: 7148956 - DNA, 22 bp, Homo sapiens
ttttctgacctatctacattta

SEQ ID NO: 7148957 - DNA, 22 bp, Homo sapiens
ttttctgacctatctacattta

SEQ ID NO: 7148958 - DNA, 22 bp, Homo sapiens
ttttctgaagtttaagacattt

SEQ ID NO: 7148959 - DNA, 22 bp, Homo sapiens
ttttctgaagtttaagacattt

SEQ ID NO: 7148960 - DNA, 22 bp, Homo sapiens
ttttctgaagtttaagacattt

SEQ ID NO: 7148961 - DNA, 22 bp, Homo sapiens
ttttctcttgttaatgtactga

SEQ ID NO: 7148962 - DNA, 22 bp, Homo sapiens
ttttctgaagtttaagacattt

SEQ ID NO: 7148963 - DNA, 22 bp, Homo sapiens
ttttctcttgttaatgtactga

SEQ ID NO: 7148964 - DNA, 22 bp, Homo sapiens
ttttctcttgttaatgtactga

SEQ ID NO: 7148965 - DNA, 22 bp, Homo sapiens
ttttctcttgttaatgtactga

SEQ ID NO: 7148966 - DNA, 22 bp, Homo sapiens
ttttctcttccctctggacctg

SEQ ID NO: 7148967 - DNA, 22 bp, Homo sapiens
ttttctcttgttaatgtactga

SEQ ID NO: 7148968 - DNA, 22 bp, Homo sapiens
ttttctcttgttaatgtactga

SEQ ID NO: 7148969 - DNA, 22 bp, Homo sapiens
ttttctcaggtgcttatctaag

SEQ ID NO: 7148970 - DNA, 19 bp, Homo sapiens
ttttctcagcttctagcgg

SEQ ID NO: 7148971 - DNA, 22 bp, Homo sapiens
ttttctcagctgcactgtatta

SEQ ID NO: 7148972 - DNA, 22 bp, Homo sapiens
ttttctcagctgcactgtatta

SEQ ID NO: 7148973 - DNA, 22 bp, Homo sapiens
ttttctcagctgcactgtatta

SEQ ID NO: 7148974 - DNA, 22 bp, Homo sapiens
ttttctcagctgcactgtatta

SEQ ID NO: 7148975 - DNA, 22 bp, Homo sapiens
ttttctcaagatccaatgcact

SEQ ID NO: 7148976 - DNA, 22 bp, Homo sapiens
ttttcatttttgtagatgcaag

SEQ ID NO: 7148977 - DNA, 22 bp, Homo sapiens
ttttcatttacattagggaaga

SEQ ID NO: 7148978 - DNA, 22 bp, Homo sapiens
ttttcatttacattagggaaga

SEQ ID NO: 7148979 - DNA, 22 bp, Homo sapiens
ttttccaaattagaagtagaga

SEQ ID NO: 7148980 - DNA, 19 bp, Homo sapiens
ttttccacagaaatatgtt

SEQ ID NO: 7148981 - DNA, 22 bp, Homo sapiens
ttttccacagcaccataagatt

SEQ ID NO: 7148982 - DNA, 22 bp, Homo sapiens
ttttccacagcaccataagatt

SEQ ID NO: 7148983 - DNA, 22 bp, Homo sapiens
ttttccacctggttccagggct

SEQ ID NO: 7148984 - DNA, 22 bp, Homo sapiens
ttttccaccttctagagattgt

SEQ ID NO: 7148985 - DNA, 22 bp, Homo sapiens
ttttccaccttctagagattgt

SEQ ID NO: 7148986 - DNA, 22 bp, Homo sapiens
ttttctattaactcattttgca

SEQ ID NO: 7148987 - DNA, 22 bp, Homo sapiens
ttttctattcattgtctatggt

SEQ ID NO: 7148988 - DNA, 22 bp, Homo sapiens
ttttctattcattgtctatggt

SEQ ID NO: 7148989 - DNA, 22 bp, Homo sapiens
ttttctattcattgtctatggt

SEQ ID NO: 7148990 - DNA, 22 bp, Homo sapiens
ttttctgtttacagagggacct

SEQ ID NO: 7148991 - DNA, 22 bp, Homo sapiens
ttttctgtttgcttcaagacat

SEQ ID NO: 7148992 - DNA, 22 bp, Homo sapiens
ttttctgtgtatccaggcttcc

SEQ ID NO: 7148993 - DNA, 22 bp, Homo sapiens
ttttctgtgtatccaggcttcc

SEQ ID NO: 7148994 - DNA, 22 bp, Homo sapiens
ttttctgttacaaagtacagcg

SEQ ID NO: 7148995 - DNA, 22 bp, Homo sapiens
ttttctgtgattctgaggttgg

SEQ ID NO: 7148996 - DNA, 20 bp, Homo sapiens
ttttctgtgccaagaaaact

SEQ ID NO: 7148997 - DNA, 20 bp, Homo sapiens
ttttctgtgccaagaaaact

SEQ ID NO: 7148998 - DNA, 20 bp, Homo sapiens
ttttctgtgccaagaaaact

SEQ ID NO: 7148999 - DNA, 22 bp, Homo sapiens
ttttctgtgccctgctagctgg

SEQ ID NO: 7149000 - DNA, 22 bp, Homo sapiens
ttttctgtggtcagagcttgag

SEQ ID NO: 7149001 - DNA, 22 bp, Homo sapiens
ttttctgactctattgaggtat

SEQ ID NO: 7149002 - DNA, 22 bp, Homo sapiens
ttttctgcctgcgtgtttagga

SEQ ID NO: 7149003 - DNA, 22 bp, Homo sapiens
ttttctgagctcagtgacttac

SEQ ID NO: 7149004 - DNA, 22 bp, Homo sapiens
ttttctgtattattgtgcttca

SEQ ID NO: 7149005 - DNA, 22 bp, Homo sapiens
ttttctgtattattgtgcttca

SEQ ID NO: 7149006 - DNA, 22 bp, Homo sapiens
ttttctgtattattgtgcttca

SEQ ID NO: 7149007 - DNA, 22 bp, Homo sapiens
ttttctgtttgcttcaagacat

SEQ ID NO: 7149008 - DNA, 22 bp, Homo sapiens
ttttctgtttgcttcaagacat

SEQ ID NO: 7149009 - DNA, 22 bp, Homo sapiens
ttttcttatggtgaagcacaaa

SEQ ID NO: 7149010 - DNA, 22 bp, Homo sapiens
ttttcttatggtgaagcacaaa

SEQ ID NO: 7149011 - DNA, 22 bp, Homo sapiens
ttttcttatggtgaagcacaaa

SEQ ID NO: 7149012 - DNA, 22 bp, Homo sapiens
ttttcttatggtgaagcacaaa

SEQ ID NO: 7149013 - DNA, 22 bp, Homo sapiens
ttttcttatgtgcagctatatg

SEQ ID NO: 7149014 - DNA, 22 bp, Homo sapiens
ttttcttatggtgaagcacaaa

SEQ ID NO: 7149015 - DNA, 22 bp, Homo sapiens
ttttatgattgagctggctaca

SEQ ID NO: 7149016 - DNA, 22 bp, Homo sapiens
ttttatgattgagctggctaca

SEQ ID NO: 7149017 - DNA, 22 bp, Homo sapiens
ttttatgagtgtccctctgtgg

SEQ ID NO: 7149018 - DNA, 22 bp, Homo sapiens
ttttatgagtgtccctctgtgg

SEQ ID NO: 7149019 - DNA, 22 bp, Homo sapiens
ttttatgattgagctggctaca

SEQ ID NO: 7149020 - DNA, 22 bp, Homo sapiens
ttttatgcaagttatgattaaa

SEQ ID NO: 7149021 - DNA, 21 bp, Homo sapiens
ttttatgcataggaaatatat

SEQ ID NO: 7149022 - DNA, 23 bp, Homo sapiens
ttttaatttggacataagaagat

SEQ ID NO: 7149023 - DNA, 18 bp, Homo sapiens
ttttaatttcaggggtgg

SEQ ID NO: 7149024 - DNA, 18 bp, Homo sapiens
ttttaatttcaggggtgg

SEQ ID NO: 7149025 - DNA, 22 bp, Homo sapiens
ttttaattgcaattatggtccc

SEQ ID NO: 7149026 - DNA, 22 bp, Homo sapiens
ttttaattgcaattatggtccc

SEQ ID NO: 7149027 - DNA, 22 bp, Homo sapiens
ttttatgtaatccttactgtcg

SEQ ID NO: 7149028 - DNA, 22 bp, Homo sapiens
ttttatgtaatccttactgtcg

SEQ ID NO: 7149029 - DNA, 22 bp, Homo sapiens
ttttatgtaatccttactgtcg

SEQ ID NO: 7149030 - DNA, 22 bp, Homo sapiens
ttttatgtaataaactgtacac

SEQ ID NO: 7149031 - DNA, 22 bp, Homo sapiens
ttttatgtaatccttactgtcg

SEQ ID NO: 7149032 - DNA, 22 bp, Homo sapiens
ttttatgtaatccttactgtcg

SEQ ID NO: 7149033 - DNA, 22 bp, Homo sapiens
ttttatgtgctggactggcagt

SEQ ID NO: 7149034 - DNA, 22 bp, Homo sapiens
ttttatgtgtcaaagcagtggt

SEQ ID NO: 7149035 - DNA, 22 bp, Homo sapiens
ttttaatgggcgactattatgg

SEQ ID NO: 7149036 - DNA, 22 bp, Homo sapiens
ttttaatgggcgactattatgg

SEQ ID NO: 7149037 - DNA, 22 bp, Homo sapiens
ttttaatgggcgactattatgg

SEQ ID NO: 7149038 - DNA, 22 bp, Homo sapiens
ttttaatgggcgactattatgg

SEQ ID NO: 7149039 - DNA, 22 bp, Homo sapiens
ttttaatcctcttggtatctta

SEQ ID NO: 7149040 - DNA, 22 bp, Homo sapiens
ttttaatgtgctctgcaatgat

SEQ ID NO: 7149041 - DNA, 22 bp, Homo sapiens
ttttaatgtgctctgcaatgat

SEQ ID NO: 7149042 - DNA, 22 bp, Homo sapiens
ttttaattcaaagtgaatagtg

SEQ ID NO: 7149043 - DNA, 22 bp, Homo sapiens
ttttaattcaaagtgaatagtg

SEQ ID NO: 7149044 - DNA, 22 bp, Homo sapiens
ttttaatgtgctctgcaatgat

SEQ ID NO: 7149045 - DNA, 22 bp, Homo sapiens
ttttaattcaaagtgaatagtg

SEQ ID NO: 7149046 - DNA, 22 bp, Homo sapiens
ttttaattcaaagtgaatagtg

SEQ ID NO: 7149047 - DNA, 22 bp, Homo sapiens
ttttaaagagatgctgtgcata

SEQ ID NO: 7149048 - DNA, 22 bp, Homo sapiens
ttttaaagagatgctgtgcata

SEQ ID NO: 7149049 - DNA, 22 bp, Homo sapiens
ttttaaaggatagctctggttg

SEQ ID NO: 7149050 - DNA, 22 bp, Homo sapiens
ttttaaaggatactcttgtcta

SEQ ID NO: 7149051 - DNA, 22 bp, Homo sapiens
ttttaaaggatagctctggttg

SEQ ID NO: 7149052 - DNA, 22 bp, Homo sapiens
ttttaaaggatagctctggttg

SEQ ID NO: 7149053 - DNA, 22 bp, Homo sapiens
ttttaaaggcagattatggctt

SEQ ID NO: 7149054 - DNA, 22 bp, Homo sapiens
ttttaaaggcagattatggctt

SEQ ID NO: 7149055 - DNA, 22 bp, Homo sapiens
ttttaaaggctgtatgaccaag

SEQ ID NO: 7149056 - DNA, 22 bp, Homo sapiens
ttttaaaggatactcttgtcta

SEQ ID NO: 7149057 - DNA, 22 bp, Homo sapiens
ttttaaagagatgctgtgcata

SEQ ID NO: 7149058 - DNA, 21 bp, Homo sapiens
ttttaacaaggatttccctag

SEQ ID NO: 7149059 - DNA, 22 bp, Homo sapiens
ttttaaaggctgtatgaccaag

SEQ ID NO: 7149060 - DNA, 22 bp, Homo sapiens
ttttaaatctccagttgacccc

SEQ ID NO: 7149061 - DNA, 22 bp, Homo sapiens
ttttaaatctccagttgacccc

SEQ ID NO: 7149062 - DNA, 22 bp, Homo sapiens
ttttaagaaatgtatgactgtc

SEQ ID NO: 7149063 - DNA, 22 bp, Homo sapiens
ttttaacttaaaatacatagat

SEQ ID NO: 7149064 - DNA, 22 bp, Homo sapiens
ttttaacactcagcactatctc

SEQ ID NO: 7149065 - DNA, 22 bp, Homo sapiens
ttttaacactcagcactatctc

SEQ ID NO: 7149066 - DNA, 21 bp, Homo sapiens
ttttaacaaggatttccctag

SEQ ID NO: 7149067 - DNA, 22 bp, Homo sapiens
ttttaacactcagcactatctc

SEQ ID NO: 7149068 - DNA, 22 bp, Homo sapiens
ttttaacactcagcactatctc

SEQ ID NO: 7149069 - DNA, 22 bp, Homo sapiens
ttttaacactcagcactatctc

SEQ ID NO: 7149070 - DNA, 22 bp, Homo sapiens
tttgtaaaaggaggaagcatgg

SEQ ID NO: 7149071 - DNA, 22 bp, Homo sapiens
tttgtaaaaggaggaagcatgg

SEQ ID NO: 7149072 - DNA, 22 bp, Homo sapiens
tttgtaaaaggaggaagcatgg

SEQ ID NO: 7149073 - DNA, 22 bp, Homo sapiens
tttgtaaaattagggaattcaa

SEQ ID NO: 7149074 - DNA, 22 bp, Homo sapiens
tttgtaaaattagggaattcaa

SEQ ID NO: 7149075 - DNA, 22 bp, Homo sapiens
tttgtaaaggcctgaatttcag

SEQ ID NO: 7149076 - DNA, 22 bp, Homo sapiens
tttgtaaaggcctgaatttcag

SEQ ID NO: 7149077 - DNA, 22 bp, Homo sapiens
tttgtaaatagcagtactcatg

SEQ ID NO: 7149078 - DNA, 22 bp, Homo sapiens
tttgtaaatagcagtactcatg

SEQ ID NO: 7149079 - DNA, 22 bp, Homo sapiens
tttgtaaatagcagtactcatg

SEQ ID NO: 7149080 - DNA, 22 bp, Homo sapiens
tttgtaaatagcagtactcatg

SEQ ID NO: 7149081 - DNA, 22 bp, Homo sapiens
tttgtaaagtctgttctgagtt

SEQ ID NO: 7149082 - DNA, 22 bp, Homo sapiens
tttgtaagagcatatgtaaagg

SEQ ID NO: 7149083 - DNA, 22 bp, Homo sapiens
tttgtaagcaaaaagtccattc

SEQ ID NO: 7149084 - DNA, 22 bp, Homo sapiens
tttgtaagcaaaaagtccattc

SEQ ID NO: 7149085 - DNA, 22 bp, Homo sapiens
tttgtaagtggtagatctaaga

SEQ ID NO: 7149086 - DNA, 22 bp, Homo sapiens
tttgtgtgaaaatatttaagtt

SEQ ID NO: 7149087 - DNA, 22 bp, Homo sapiens
tttgtgtgcaacgcatggagtc

SEQ ID NO: 7149088 - DNA, 22 bp, Homo sapiens
tttgtgtgcttggtattgaaga

SEQ ID NO: 7149089 - DNA, 22 bp, Homo sapiens
tttgtgtgcttggtattgaaga

SEQ ID NO: 7149090 - DNA, 22 bp, Homo sapiens
tttgtgtggatggaaggcagta

SEQ ID NO: 7149091 - DNA, 22 bp, Homo sapiens
tttgtgtgggggaaacaaggta

SEQ ID NO: 7149092 - DNA, 22 bp, Homo sapiens
tttgtgtggtggatactgggta

SEQ ID NO: 7149093 - DNA, 22 bp, Homo sapiens
tttgtgtgtatatccttccaga

SEQ ID NO: 7149094 - DNA, 22 bp, Homo sapiens
tttgtgtgtatatgtatataga

SEQ ID NO: 7149095 - DNA, 22 bp, Homo sapiens
tttgtgtgtatatgtatataga

SEQ ID NO: 7149096 - DNA, 21 bp, Homo sapiens
tttgtgtgtcacgtgcacagg

SEQ ID NO: 7149097 - DNA, 21 bp, Homo sapiens
tttgtgtgtcacgtgcacagg

SEQ ID NO: 7149098 - DNA, 21 bp, Homo sapiens
tttgtgtgtcacgtgcacagg

SEQ ID NO: 7149099 - DNA, 22 bp, Homo sapiens
tttgtgtgtgctcacatagatg

SEQ ID NO: 7149100 - DNA, 22 bp, Homo sapiens
tttgtgtgtgctcacatagatg

SEQ ID NO: 7149101 - DNA, 22 bp, Homo sapiens
tttgtgtgtgctcacatagatg

SEQ ID NO: 7149102 - DNA, 22 bp, Homo sapiens
tttgtgtgtgctcacatagatg

SEQ ID NO: 7149103 - DNA, 22 bp, Homo sapiens
tttgtgttggaagaaatgctac

SEQ ID NO: 7149104 - DNA, 22 bp, Homo sapiens
tttgtgttaaatgttaaattca

SEQ ID NO: 7149105 - DNA, 22 bp, Homo sapiens
tttgtgttaaatgttaaattca

SEQ ID NO: 7149106 - DNA, 22 bp, Homo sapiens
tttgtgttaaatgttaaattca

SEQ ID NO: 7149107 - DNA, 22 bp, Homo sapiens
tttgtgttaaatgttaaattca

SEQ ID NO: 7149108 - DNA, 22 bp, Homo sapiens
tttgtgttaaatgttaaattca

SEQ ID NO: 7149109 - DNA, 22 bp, Homo sapiens
tttgtgttggaagaaatgctac

SEQ ID NO: 7149110 - DNA, 22 bp, Homo sapiens
tttgtgttggaagaaatgctac

SEQ ID NO: 7149111 - DNA, 22 bp, Homo sapiens
tttgtgttgtacttctgtgcat

SEQ ID NO: 7149112 - DNA, 22 bp, Homo sapiens
tttgtgtttatgaagttattct

SEQ ID NO: 7149113 - DNA, 22 bp, Homo sapiens
tttgtgtttatgaagttattct

SEQ ID NO: 7149114 - DNA, 22 bp, Homo sapiens
tttgtgttttcccatactattg

SEQ ID NO: 7149115 - DNA, 22 bp, Homo sapiens
tttgtgttttcactagcagtgt

SEQ ID NO: 7149116 - DNA, 22 bp, Homo sapiens
tttgtgttttcccatactattg

SEQ ID NO: 7149117 - DNA, 22 bp, Homo sapiens
tttgttaaaatgcagattctgt

SEQ ID NO: 7149118 - DNA, 22 bp, Homo sapiens
tttgtgttttcactagcagtgt

SEQ ID NO: 7149119 - DNA, 22 bp, Homo sapiens
tttgttaaaatgcagattctgt

SEQ ID NO: 7149120 - DNA, 22 bp, Homo sapiens
tttgttaaatatttattgagtg

SEQ ID NO: 7149121 - DNA, 22 bp, Homo sapiens
tttgttaaaatgcagattctgt

SEQ ID NO: 7149122 - DNA, 22 bp, Homo sapiens
tttgttaaaatgcagattctgt

SEQ ID NO: 7149123 - DNA, 22 bp, Homo sapiens
tttgttaattcttatgttagag

SEQ ID NO: 7149124 - DNA, 22 bp, Homo sapiens
tttgttaaggagtattgcttct

SEQ ID NO: 7149125 - DNA, 22 bp, Homo sapiens
tttgttaaggagtattgcttct

SEQ ID NO: 7149126 - DNA, 22 bp, Homo sapiens
tttgttataacaataaaaagtc

SEQ ID NO: 7149127 - DNA, 22 bp, Homo sapiens
tttgttcaaaaattataagata

SEQ ID NO: 7149128 - DNA, 22 bp, Homo sapiens
tttgttcaaattttcctatctg

SEQ ID NO: 7149129 - DNA, 22 bp, Homo sapiens
tttgttcaaggaatagtaaatg

SEQ ID NO: 7149130 - DNA, 22 bp, Homo sapiens
tttttacacttagcattgagcg

SEQ ID NO: 7149131 - DNA, 22 bp, Homo sapiens
tttttacacttagcattgagcg

SEQ ID NO: 7149132 - DNA, 22 bp, Homo sapiens
tttttacagtcatggtcactca

SEQ ID NO: 7149133 - DNA, 22 bp, Homo sapiens
tttttacagtcatggtcactca

SEQ ID NO: 7149134 - DNA, 22 bp, Homo sapiens
tttttacagtcatggtcactca

SEQ ID NO: 7149135 - DNA, 22 bp, Homo sapiens
tttttacacttagcattgagcg

SEQ ID NO: 7149136 - DNA, 22 bp, Homo sapiens
tttttacacttagcattgagcg

SEQ ID NO: 7149137 - DNA, 22 bp, Homo sapiens
ttttgtttgtgtccactgcagt

SEQ ID NO: 7149138 - DNA, 22 bp, Homo sapiens
ttttgtttaaaatcctggatgg

SEQ ID NO: 7149139 - DNA, 22 bp, Homo sapiens
ttttgtttgtgtccactgcagt

SEQ ID NO: 7149140 - DNA, 22 bp, Homo sapiens
ttttgtttgtgtccactgcagt

SEQ ID NO: 7149141 - DNA, 22 bp, Homo sapiens
ttttgtttaaaatcctggatgg

SEQ ID NO: 7149142 - DNA, 22 bp, Homo sapiens
ttttgtttgtgtccactgcagt

SEQ ID NO: 7149143 - DNA, 22 bp, Homo sapiens
ttttgtttaaaatcctggatgg

SEQ ID NO: 7149144 - DNA, 22 bp, Homo sapiens
ttttgtttaaaatcctggatgg

SEQ ID NO: 7149145 - DNA, 22 bp, Homo sapiens
ttttcttcctggattttggcat

SEQ ID NO: 7149146 - DNA, 22 bp, Homo sapiens
ttttcttcctggattttggcat

SEQ ID NO: 7149147 - DNA, 19 bp, Homo sapiens
tttttagcagggtacacct

SEQ ID NO: 7149148 - DNA, 22 bp, Homo sapiens
tttttagtagaggtgggtttca

SEQ ID NO: 7149149 - DNA, 23 bp, Homo sapiens
tttttagttacacctctgccacc

SEQ ID NO: 7149150 - DNA, 22 bp, Homo sapiens
tttttagattactcagccacca

SEQ ID NO: 7149151 - DNA, 22 bp, Homo sapiens
tttttagattactcagccacca

SEQ ID NO: 7149152 - DNA, 22 bp, Homo sapiens
tttttagagtgttaccagtata

SEQ ID NO: 7149153 - DNA, 22 bp, Homo sapiens
tttttagagtgttaccagtata

SEQ ID NO: 7149154 - DNA, 22 bp, Homo sapiens
tttttagaattggctgagaatt

SEQ ID NO: 7149155 - DNA, 22 bp, Homo sapiens
tttttagaattggctgagaatt

SEQ ID NO: 7149156 - DNA, 22 bp, Homo sapiens
tttttagaattggctgagaatt

SEQ ID NO: 7149157 - DNA, 22 bp, Homo sapiens
tttttacagtcatggtcactca

SEQ ID NO: 7149158 - DNA, 23 bp, Homo sapiens
tttttagttacacctctgccacc

SEQ ID NO: 7149159 - DNA, 23 bp, Homo sapiens
tttttagttacacctctgccacc

SEQ ID NO: 7149160 - DNA, 22 bp, Homo sapiens
tttttataactcttttgtgaca

SEQ ID NO: 7149161 - DNA, 22 bp, Homo sapiens
tttttataactcttttgtgaca

SEQ ID NO: 7149162 - DNA, 22 bp, Homo sapiens
tttttataactcttttgtgaca

SEQ ID NO: 7149163 - DNA, 22 bp, Homo sapiens
tttttataactcttttgtgaca

SEQ ID NO: 7149164 - DNA, 22 bp, Homo sapiens
tttttataactcttttgtgaca

SEQ ID NO: 7149165 - DNA, 22 bp, Homo sapiens
tttttataccacctctcactta

SEQ ID NO: 7149166 - DNA, 22 bp, Homo sapiens
tttttataccacctctcactta

SEQ ID NO: 7149167 - DNA, 22 bp, Homo sapiens
tttttataccacctctcactta

SEQ ID NO: 7149168 - DNA, 22 bp, Homo sapiens
tttttataccacctctcactta

SEQ ID NO: 7149169 - DNA, 22 bp, Homo sapiens
tttttataccacctctcactta

SEQ ID NO: 7149170 - DNA, 22 bp, Homo sapiens
tttttataccacctctcactta

SEQ ID NO: 7149171 - DNA, 22 bp, Homo sapiens
tttttatctacagattctcagc

SEQ ID NO: 7149172 - DNA, 22 bp, Homo sapiens
tttttatctacagattctcagc

SEQ ID NO: 7149173 - DNA, 22 bp, Homo sapiens
tttttatctacagattctcagc

SEQ ID NO: 7149174 - DNA, 22 bp, Homo sapiens
tttttatctacagattctcagc

SEQ ID NO: 7149175 - DNA, 22 bp, Homo sapiens
tttttatcttgtatgtgtctct

SEQ ID NO: 7149176 - DNA, 22 bp, Homo sapiens
tttttatcttgtatgtgtctct

SEQ ID NO: 7149177 - DNA, 22 bp, Homo sapiens
tttttatgcctacgctgaaaag

SEQ ID NO: 7149178 - DNA, 22 bp, Homo sapiens
tttttatgcctacgctgaaaag

SEQ ID NO: 7149179 - DNA, 22 bp, Homo sapiens
tttttatcttgtatgtgtctct

SEQ ID NO: 7149180 - DNA, 22 bp, Homo sapiens
tttttataggtcagggcaagtc

SEQ ID NO: 7149181 - DNA, 22 bp, Homo sapiens
tttttataggtcagggcaagtc

SEQ ID NO: 7149182 - DNA, 22 bp, Homo sapiens
tttttatatgaaggatagtgcg

SEQ ID NO: 7149183 - DNA, 22 bp, Homo sapiens
tttttatatgaaggatagtgcg

SEQ ID NO: 7149184 - DNA, 22 bp, Homo sapiens
tttttatatgaaggatagtgcg

SEQ ID NO: 7149185 - DNA, 22 bp, Homo sapiens
tttttatatgaaggatagtgcg

SEQ ID NO: 7149186 - DNA, 22 bp, Homo sapiens
tttttatactttgctcaagatt

SEQ ID NO: 7149187 - DNA, 22 bp, Homo sapiens
tttttatactttgctcaagatt

SEQ ID NO: 7149188 - DNA, 22 bp, Homo sapiens
tttttatactttgctcaagatt

SEQ ID NO: 7149189 - DNA, 22 bp, Homo sapiens
tttttataccacctctcactta

SEQ ID NO: 7149190 - DNA, 22 bp, Homo sapiens
tttttatactttgctcaagatt

SEQ ID NO: 7149191 - DNA, 22 bp, Homo sapiens
tttttcagccatgaattacact

SEQ ID NO: 7149192 - DNA, 22 bp, Homo sapiens
tttttcagccatgaattacact

SEQ ID NO: 7149193 - DNA, 22 bp, Homo sapiens
tttttcatattcccctctctgg

SEQ ID NO: 7149194 - DNA, 22 bp, Homo sapiens
tttttcatattcccctctctgg

SEQ ID NO: 7149195 - DNA, 22 bp, Homo sapiens
tttttcatattcccctctctgg

SEQ ID NO: 7149196 - DNA, 22 bp, Homo sapiens
tttttcatattcccctctctgg

SEQ ID NO: 7149197 - DNA, 22 bp, Homo sapiens
tttttcatctgattgataactc

SEQ ID NO: 7149198 - DNA, 22 bp, Homo sapiens
tttttcatctgattgataactc

SEQ ID NO: 7149199 - DNA, 22 bp, Homo sapiens
tttttcatctgattgataactc

SEQ ID NO: 7149200 - DNA, 22 bp, Homo sapiens
tttatctgaaaaaactcttgga

SEQ ID NO: 7149201 - DNA, 22 bp, Homo sapiens
tttatctgagctgatagatagt

SEQ ID NO: 7149202 - DNA, 22 bp, Homo sapiens
tttatctgagctgatagatagt

SEQ ID NO: 7149203 - DNA, 22 bp, Homo sapiens
tttatctgagctgatagatagt

SEQ ID NO: 7149204 - DNA, 22 bp, Homo sapiens
tttattcaagatgaggttcatg

SEQ ID NO: 7149205 - DNA, 22 bp, Homo sapiens
tttatctgaggaaagcagacaa

SEQ ID NO: 7149206 - DNA, 22 bp, Homo sapiens
tttatctgagctgatagatagt

SEQ ID NO: 7149207 - DNA, 22 bp, Homo sapiens
tttatctgaggaaagcagacaa

SEQ ID NO: 7149208 - DNA, 22 bp, Homo sapiens
tttatccatcatctgctgaagg

SEQ ID NO: 7149209 - DNA, 22 bp, Homo sapiens
tttatccagcagctattcaaaa

SEQ ID NO: 7149210 - DNA, 22 bp, Homo sapiens
tttatccatatcattaaaatct

SEQ ID NO: 7149211 - DNA, 22 bp, Homo sapiens
tttatctattgtattgttgatg

SEQ ID NO: 7149212 - DNA, 22 bp, Homo sapiens
tttatctattgtattgttgatg

SEQ ID NO: 7149213 - DNA, 22 bp, Homo sapiens
tttatccactcatccatgcctc

SEQ ID NO: 7149214 - DNA, 22 bp, Homo sapiens
tttatccagcagctattcaaaa

SEQ ID NO: 7149215 - DNA, 23 bp, Homo sapiens
tttatccaactctgtaatctctc

SEQ ID NO: 7149216 - DNA, 22 bp, Homo sapiens
tttatccaagcacaatttctaa

SEQ ID NO: 7149217 - DNA, 21 bp, Homo sapiens
tttatcatcacgagcttgagc

SEQ ID NO: 7149218 - DNA, 22 bp, Homo sapiens
tttatcatcttgtttttaaagc

SEQ ID NO: 7149219 - DNA, 22 bp, Homo sapiens
tttatcatcttgtttttaaagc

SEQ ID NO: 7149220 - DNA, 22 bp, Homo sapiens
tttatcatcttgtttttaaagc

SEQ ID NO: 7149221 - DNA, 22 bp, Homo sapiens
tttatcaaacaaattatccagc

SEQ ID NO: 7149222 - DNA, 22 bp, Homo sapiens
tttatcaaacaaattatccagc

SEQ ID NO: 7149223 - DNA, 22 bp, Homo sapiens
tttatcagaggctatgtttcat

SEQ ID NO: 7149224 - DNA, 20 bp, Homo sapiens
tttatcaggcacttactatt

SEQ ID NO: 7149225 - DNA, 20 bp, Homo sapiens
tttatcaggcacttactatt

SEQ ID NO: 7149226 - DNA, 22 bp, Homo sapiens
tttatcagtagcaaagttttaa

SEQ ID NO: 7149227 - DNA, 22 bp, Homo sapiens
tttatattgtaaaaatggttct

SEQ ID NO: 7149228 - DNA, 22 bp, Homo sapiens
tttatattgtaaaaatggttct

SEQ ID NO: 7149229 - DNA, 22 bp, Homo sapiens
tttatattgtaaaaatggttct

SEQ ID NO: 7149230 - DNA, 22 bp, Homo sapiens
tttatattgtaaaaatggttct

SEQ ID NO: 7149231 - DNA, 22 bp, Homo sapiens
tttatattgtaaaaatggttct

SEQ ID NO: 7149232 - DNA, 22 bp, Homo sapiens
tttatatttcccaggattggcc

SEQ ID NO: 7149233 - DNA, 22 bp, Homo sapiens
tttatatatggctggtctggat

SEQ ID NO: 7149234 - DNA, 22 bp, Homo sapiens
tttatatatggctggtctggat

SEQ ID NO: 7149235 - DNA, 22 bp, Homo sapiens
tttatatagagatttgtgcatg

SEQ ID NO: 7149236 - DNA, 22 bp, Homo sapiens
tttatattgggagtcgttttga

SEQ ID NO: 7149237 - DNA, 22 bp, Homo sapiens
tttatattgggagtcgttttga

SEQ ID NO: 7149238 - DNA, 22 bp, Homo sapiens
tttatattgggagtcgttttga

SEQ ID NO: 7149239 - DNA, 22 bp, Homo sapiens
tttatattgggagtcgttttga

SEQ ID NO: 7149240 - DNA, 22 bp, Homo sapiens
tttatattgggagtcgttttga

SEQ ID NO: 7149241 - DNA, 22 bp, Homo sapiens
tttatattgggagtcgttttga

SEQ ID NO: 7149242 - DNA, 22 bp, Homo sapiens
tttagcaatatcataaggaaga

SEQ ID NO: 7149243 - DNA, 22 bp, Homo sapiens
tttagcaataaagggatattaa

SEQ ID NO: 7149244 - DNA, 22 bp, Homo sapiens
tttagcaatatcataaggaaga

SEQ ID NO: 7149245 - DNA, 22 bp, Homo sapiens
tttagcacggtaacacataaag

SEQ ID NO: 7149246 - DNA, 22 bp, Homo sapiens
tttagcaccttcactttctctg

SEQ ID NO: 7149247 - DNA, 22 bp, Homo sapiens
tttagcagaatttctctagaag

SEQ ID NO: 7149248 - DNA, 22 bp, Homo sapiens
tttagcagagcatatgatatcc

SEQ ID NO: 7149249 - DNA, 22 bp, Homo sapiens
tttagcagagttatatggaagt

SEQ ID NO: 7149250 - DNA, 22 bp, Homo sapiens
tttagcagtgaagtgaagtgaa

SEQ ID NO: 7149251 - DNA, 22 bp, Homo sapiens
tttagcatatcctataaaacta

SEQ ID NO: 7149252 - DNA, 22 bp, Homo sapiens
tttagcatatttaaggaatgat

SEQ ID NO: 7149253 - DNA, 22 bp, Homo sapiens
tttatatagagatttgtgcatg

SEQ ID NO: 7149254 - DNA, 22 bp, Homo sapiens
tttatatagagatttgtgcatg

SEQ ID NO: 7149255 - DNA, 22 bp, Homo sapiens
tttaccaagctttaattacata

SEQ ID NO: 7149256 - DNA, 22 bp, Homo sapiens
tttaccaagatagcatctggtt

SEQ ID NO: 7149257 - DNA, 22 bp, Homo sapiens
tttaccaagagttgtcactgtt

SEQ ID NO: 7149258 - DNA, 22 bp, Homo sapiens
tttaccaactgtagatctgcta

SEQ ID NO: 7149259 - DNA, 22 bp, Homo sapiens
tttaccaagctttaattacata

SEQ ID NO: 7149260 - DNA, 22 bp, Homo sapiens
tttaccaaggcatagtaatctc

SEQ ID NO: 7149261 - DNA, 22 bp, Homo sapiens
tttaccacaataatcatcacaa

SEQ ID NO: 7149262 - DNA, 22 bp, Homo sapiens
tttaccacaataatcatcacaa

SEQ ID NO: 7149263 - DNA, 23 bp, Homo sapiens
tttaccagaatagcaggggagag

SEQ ID NO: 7149264 - DNA, 23 bp, Homo sapiens
tttaccagaatagcaggggagag

SEQ ID NO: 7149265 - DNA, 22 bp, Homo sapiens
tttagaagacagatgcacagcc

SEQ ID NO: 7149266 - DNA, 22 bp, Homo sapiens
tttagaagacagatgcacagcc

SEQ ID NO: 7149267 - DNA, 22 bp, Homo sapiens
tttagaagggctggtcagaaat

SEQ ID NO: 7149268 - DNA, 22 bp, Homo sapiens
tttagaagggctggtcagaaat

SEQ ID NO: 7149269 - DNA, 22 bp, Homo sapiens
tttagaagttcacacatttaaa

SEQ ID NO: 7149270 - DNA, 22 bp, Homo sapiens
tttagaagttcacacatttaaa

SEQ ID NO: 7149271 - DNA, 17 bp, Homo sapiens
tttagaatacaatgttt

SEQ ID NO: 7149272 - DNA, 22 bp, Homo sapiens
tttacagtgtcttgttgactgt

SEQ ID NO: 7149273 - DNA, 22 bp, Homo sapiens
tttacagtgtcttgttgactgt

SEQ ID NO: 7149274 - DNA, 22 bp, Homo sapiens
tttacagtgagagcttagtgag

SEQ ID NO: 7149275 - DNA, 22 bp, Homo sapiens
tttacagtctgtctagcaatgt

SEQ ID NO: 7149276 - DNA, 22 bp, Homo sapiens
tttacagtctgtctagcaatgt

SEQ ID NO: 7149277 - DNA, 22 bp, Homo sapiens
tttacagtctgtctagcaatgt

SEQ ID NO: 7149278 - DNA, 22 bp, Homo sapiens
tttacagtgagagcttagtgag

SEQ ID NO: 7149279 - DNA, 22 bp, Homo sapiens
tttaccaaagtactctgaggca

SEQ ID NO: 7149280 - DNA, 20 bp, Homo sapiens
tttacattttgaaacagtga

SEQ ID NO: 7149281 - DNA, 20 bp, Homo sapiens
tttacattttgaaacagtga

SEQ ID NO: 7149282 - DNA, 20 bp, Homo sapiens
tttacattttgaaacagtga

SEQ ID NO: 7149283 - DNA, 20 bp, Homo sapiens
tttacattttgaaacagtga

SEQ ID NO: 7149284 - DNA, 20 bp, Homo sapiens
tttacattttgaaacagtga

SEQ ID NO: 7149285 - DNA, 20 bp, Homo sapiens
tttacattttgaaacagtga

SEQ ID NO: 7149286 - DNA, 17 bp, Homo sapiens
tttagaatacaatgttt

SEQ ID NO: 7149287 - DNA, 21 bp, Homo sapiens
tttagagaatactcactattt

SEQ ID NO: 7149288 - DNA, 22 bp, Homo sapiens
tttagagaattagaacagtact

SEQ ID NO: 7149289 - DNA, 22 bp, Homo sapiens
tttagagaattagaacagtact

SEQ ID NO: 7149290 - DNA, 22 bp, Homo sapiens
tttagagacacactggcatttg

SEQ ID NO: 7149291 - DNA, 22 bp, Homo sapiens
tttagagaccctctgctatttt

SEQ ID NO: 7149292 - DNA, 22 bp, Homo sapiens
tttagagagaaataaatgagat

SEQ ID NO: 7149293 - DNA, 22 bp, Homo sapiens
tttagagagcactgtagacact

SEQ ID NO: 7149294 - DNA, 22 bp, Homo sapiens
tttagagaggctctgtaaaatg

SEQ ID NO: 7149295 - DNA, 22 bp, Homo sapiens
tttagagagtgtaaaaatatat

SEQ ID NO: 7149296 - DNA, 22 bp, Homo sapiens
tttagagagtgtaaaaatatat

SEQ ID NO: 7149297 - DNA, 22 bp, Homo sapiens
tttagaggcatcttgcttttct

SEQ ID NO: 7149298 - DNA, 22 bp, Homo sapiens
tttagaggctgcctatcacaac

SEQ ID NO: 7149299 - DNA, 22 bp, Homo sapiens
tttagaggtaggtagagtccaa

SEQ ID NO: 7149300 - DNA, 22 bp, Homo sapiens
tttagagatgggagacaggaaa

SEQ ID NO: 7149301 - DNA, 21 bp, Homo sapiens
tttagaggacacagggaggca

SEQ ID NO: 7149302 - DNA, 21 bp, Homo sapiens
tttagaggacacagggaggca

SEQ ID NO: 7149303 - DNA, 22 bp, Homo sapiens
tttagaggaggaagaaattttg

SEQ ID NO: 7149304 - DNA, 22 bp, Homo sapiens
tttagataatgctcaagcaatt

SEQ ID NO: 7149305 - DNA, 22 bp, Homo sapiens
tttagcaaaacattatgtctgt

SEQ ID NO: 7149306 - DNA, 22 bp, Homo sapiens
tttagcaagtatttactgacta

SEQ ID NO: 7149307 - DNA, 22 bp, Homo sapiens
tttagcaagtatttactgacta

SEQ ID NO: 7149308 - DNA, 22 bp, Homo sapiens
tttagcaaatatttctgttgat

SEQ ID NO: 7149309 - DNA, 22 bp, Homo sapiens
tttagcaaactttggagtttgt

SEQ ID NO: 7149310 - DNA, 20 bp, Homo sapiens
tttagcaaaagggactgctc

SEQ ID NO: 7149311 - DNA, 19 bp, Homo sapiens
tttaaagtgactggtattt

SEQ ID NO: 7149312 - DNA, 22 bp, Homo sapiens
tttaaagagaatgtgaaggagt

SEQ ID NO: 7149313 - DNA, 22 bp, Homo sapiens
tttaaagagaatgtgaaggagt

SEQ ID NO: 7149314 - DNA, 22 bp, Homo sapiens
tttaaagagaatgtgaaggagt

SEQ ID NO: 7149315 - DNA, 22 bp, Homo sapiens
tttaaagagaatgtgaaggagt

SEQ ID NO: 7149316 - DNA, 22 bp, Homo sapiens
tttaaagaaattcctcatcttt

SEQ ID NO: 7149317 - DNA, 21 bp, Homo sapiens
tttaaagaataggaagggagg

SEQ ID NO: 7149318 - DNA, 21 bp, Homo sapiens
tttaaagaataggaagggagg

SEQ ID NO: 7149319 - DNA, 21 bp, Homo sapiens
tttaaagaataggaagggagg

SEQ ID NO: 7149320 - DNA, 22 bp, Homo sapiens
tttaaactgttgattttatgaa

SEQ ID NO: 7149321 - DNA, 22 bp, Homo sapiens
tttaaagaaattcctcatcttt

SEQ ID NO: 7149322 - DNA, 22 bp, Homo sapiens
tttaaagaaattcctcatcttt

SEQ ID NO: 7149323 - DNA, 22 bp, Homo sapiens
tttaaagaaattcctcatcttt

SEQ ID NO: 7149324 - DNA, 22 bp, Homo sapiens
tttaaagaaattcctcatcttt

SEQ ID NO: 7149325 - DNA, 22 bp, Homo sapiens
tttaaactgttgattttatgaa

SEQ ID NO: 7149326 - DNA, 22 bp, Homo sapiens
tttaaactgttgattttatgaa

SEQ ID NO: 7149327 - DNA, 22 bp, Homo sapiens
tttaaactaacagtacacgttg

SEQ ID NO: 7149328 - DNA, 22 bp, Homo sapiens
tttaaacctatctaagaaatag

SEQ ID NO: 7149329 - DNA, 22 bp, Homo sapiens
tttaaacctcctgattcagcta

SEQ ID NO: 7149330 - DNA, 22 bp, Homo sapiens
tttaaactaacagtacacgttg

SEQ ID NO: 7149331 - DNA, 17 bp, Homo sapiens
tttaaactactacaagg

SEQ ID NO: 7149332 - DNA, 17 bp, Homo sapiens
tttaaactactacaagg

SEQ ID NO: 7149333 - DNA, 17 bp, Homo sapiens
ttgtgtgtagttctgat

SEQ ID NO: 7149334 - DNA, 17 bp, Homo sapiens
ttgtgtgtagttctgat

SEQ ID NO: 7149335 - DNA, 19 bp, Homo sapiens
ttgtgtgtcagtcagagtt

SEQ ID NO: 7149336 - DNA, 19 bp, Homo sapiens
ttgtgtgtcagtcagagtt

SEQ ID NO: 7149337 - DNA, 22 bp, Homo sapiens
tttaaacatcttgttgccttaa

SEQ ID NO: 7149338 - DNA, 22 bp, Homo sapiens
tttaaacatcttgttgccttaa

SEQ ID NO: 7149339 - DNA, 22 bp, Homo sapiens
ttgtgtgtagactcagccattg

SEQ ID NO: 7149340 - DNA, 17 bp, Homo sapiens
ttgtgtgtagttctgat

SEQ ID NO: 7149341 - DNA, 22 bp, Homo sapiens
ttgtgtgtagactcagccattg

SEQ ID NO: 7149342 - DNA, 17 bp, Homo sapiens
ttgtgtgtagttctgat

SEQ ID NO: 7149343 - DNA, 17 bp, Homo sapiens
ttgtgtgtagttctgat

SEQ ID NO: 7149344 - DNA, 17 bp, Homo sapiens
ttgtgtgtagttctgat

SEQ ID NO: 7149345 - DNA, 22 bp, Homo sapiens
ttgtgtgtactggttatgggca

SEQ ID NO: 7149346 - DNA, 22 bp, Homo sapiens
ttgtgtgtactggttatgggca

SEQ ID NO: 7149347 - DNA, 22 bp, Homo sapiens
ttgtgtgtactggttatgggca

SEQ ID NO: 7149348 - DNA, 22 bp, Homo sapiens
ttgtgtgtactggttatgggca

SEQ ID NO: 7149349 - DNA, 22 bp, Homo sapiens
ttgtgtgtactggttatgggca

SEQ ID NO: 7149350 - DNA, 22 bp, Homo sapiens
ttgtgtgtagactcagccattg

SEQ ID NO: 7149351 - DNA, 22 bp, Homo sapiens
ttgtgtgtagactcagccattg

SEQ ID NO: 7149352 - DNA, 22 bp, Homo sapiens
ttgtgtgtagactcagccattg

SEQ ID NO: 7149353 - DNA, 22 bp, Homo sapiens
ttgtgtgataagtctcttgtgc

SEQ ID NO: 7149354 - DNA, 22 bp, Homo sapiens
ttgtgtgcataaattctgatgt

SEQ ID NO: 7149355 - DNA, 22 bp, Homo sapiens
ttgtgtgcataaattctgatgt

SEQ ID NO: 7149356 - DNA, 22 bp, Homo sapiens
ttgtgtgctgagggcctgctgt

SEQ ID NO: 7149357 - DNA, 22 bp, Homo sapiens
ttgtgtgctgagggcctgctgt

SEQ ID NO: 7149358 - DNA, 22 bp, Homo sapiens
ttgtgtgcataaattctgatgt

SEQ ID NO: 7149359 - DNA, 22 bp, Homo sapiens
ttgtgtgtactggttatgggca

SEQ ID NO: 7149360 - DNA, 22 bp, Homo sapiens
tttaaagtttttgcacattctg

SEQ ID NO: 7149361 - DNA, 22 bp, Homo sapiens
tttaaagtggtccatttcagaa

SEQ ID NO: 7149362 - DNA, 22 bp, Homo sapiens
tttaaagtggtccatttcagaa

SEQ ID NO: 7149363 - DNA, 22 bp, Homo sapiens
tttaaagtttttgcacattctg

SEQ ID NO: 7149364 - DNA, 22 bp, Homo sapiens
tttaaataggactcctgggggt

SEQ ID NO: 7149365 - DNA, 22 bp, Homo sapiens
tttaaataggactcctgggggt

SEQ ID NO: 7149366 - DNA, 22 bp, Homo sapiens
tttaaataggactcctgggggt

SEQ ID NO: 7149367 - DNA, 22 bp, Homo sapiens
tttaaagtggtccatttcagaa

SEQ ID NO: 7149368 - DNA, 22 bp, Homo sapiens
tttaaagtggtccatttcagaa

SEQ ID NO: 7149369 - DNA, 22 bp, Homo sapiens
tttaaagtggtccatttcagaa

SEQ ID NO: 7149370 - DNA, 22 bp, Homo sapiens
tttaaagtgctgctcctatcct

SEQ ID NO: 7149371 - DNA, 22 bp, Homo sapiens
tttaaagtgctgctcctatcct

SEQ ID NO: 7149372 - DNA, 19 bp, Homo sapiens
tttaaagtgactggtattt

SEQ ID NO: 7149373 - DNA, 22 bp, Homo sapiens
tttaaatgctttaagcaagggt

SEQ ID NO: 7149374 - DNA, 22 bp, Homo sapiens
tttaaatgctttaagcaagggt

SEQ ID NO: 7149375 - DNA, 22 bp, Homo sapiens
tttaaatgctttaagcaagggt

SEQ ID NO: 7149376 - DNA, 22 bp, Homo sapiens
tttaaatgcagacgttgattca

SEQ ID NO: 7149377 - DNA, 22 bp, Homo sapiens
tttaaatgcagacgttgattca

SEQ ID NO: 7149378 - DNA, 22 bp, Homo sapiens
tttaaatgcagacgttgattca

SEQ ID NO: 7149379 - DNA, 22 bp, Homo sapiens
tttaaataggactcctgggggt

SEQ ID NO: 7149380 - DNA, 22 bp, Homo sapiens
tttaaataggactcctgggggt

SEQ ID NO: 7149381 - DNA, 22 bp, Homo sapiens
tttaaatgcagacgttgattca

SEQ ID NO: 7149382 - DNA, 22 bp, Homo sapiens
tttaaatgttcatgatactgaa

SEQ ID NO: 7149383 - DNA, 22 bp, Homo sapiens
tttaaatgttcatgatactgaa

SEQ ID NO: 7149384 - DNA, 22 bp, Homo sapiens
tttaaatgtgttcttagtagct

SEQ ID NO: 7149385 - DNA, 22 bp, Homo sapiens
tttaaatgtgttcttagtagct

SEQ ID NO: 7149386 - DNA, 22 bp, Homo sapiens
tttaaatgtgttcttagtagct

SEQ ID NO: 7149387 - DNA, 22 bp, Homo sapiens
tttaaatggcattttcccagat

SEQ ID NO: 7149388 - DNA, 22 bp, Homo sapiens
tttaaatggcattttcccagat

SEQ ID NO: 7149389 - DNA, 22 bp, Homo sapiens
tttaaatggcattttcccagat

SEQ ID NO: 7149390 - DNA, 22 bp, Homo sapiens
tttaaatggcattttcccagat

SEQ ID NO: 7149391 - DNA, 22 bp, Homo sapiens
tttaaatgtgttcttagtagct

SEQ ID NO: 7149392 - DNA, 22 bp, Homo sapiens
tttaaatgtgttcttagtagct

SEQ ID NO: 7149393 - DNA, 22 bp, Homo sapiens
tttaaatgtttatagagagtac

SEQ ID NO: 7149394 - DNA, 22 bp, Homo sapiens
tttaaatgtttatagagagtac

SEQ ID NO: 7149395 - DNA, 22 bp, Homo sapiens
tttaaatgtttatagagagtac

SEQ ID NO: 7149396 - DNA, 22 bp, Homo sapiens
tttaagatggtattttataaag

SEQ ID NO: 7149397 - DNA, 22 bp, Homo sapiens
tttaaatgtttaaaactcgtga

SEQ ID NO: 7149398 - DNA, 22 bp, Homo sapiens
tttaaatgtttaaaactcgtga

SEQ ID NO: 7149399 - DNA, 22 bp, Homo sapiens
tttaagattcagtaaggcaaac

SEQ ID NO: 7149400 - DNA, 22 bp, Homo sapiens
tttaagattcagtaaggcaaac

SEQ ID NO: 7149401 - DNA, 22 bp, Homo sapiens
tttaagcacagggataaagtta

SEQ ID NO: 7149402 - DNA, 19 bp, Homo sapiens
tttaagcatagaggccaga

SEQ ID NO: 7149403 - DNA, 22 bp, Homo sapiens
tttaagcagagaaatgatgtat

SEQ ID NO: 7149404 - DNA, 22 bp, Homo sapiens
tttaaggcagtgaaactattct

SEQ ID NO: 7149405 - DNA, 22 bp, Homo sapiens
tttaaggtacagctagcagcat

SEQ ID NO: 7149406 - DNA, 22 bp, Homo sapiens
tttaaggtggacatctaagtca

SEQ ID NO: 7149407 - DNA, 22 bp, Homo sapiens
tttaatgaataattcaaatctg

SEQ ID NO: 7149408 - DNA, 22 bp, Homo sapiens
tttaatcttcaaaatagtctta

SEQ ID NO: 7149409 - DNA, 22 bp, Homo sapiens
tttaatcttcaaaatagtctta

SEQ ID NO: 7149410 - DNA, 22 bp, Homo sapiens
tttaatcttcaaaatagtctta

SEQ ID NO: 7149411 - DNA, 22 bp, Homo sapiens
tttaatcttcaaaatagtctta

SEQ ID NO: 7149412 - DNA, 22 bp, Homo sapiens
tttaagtcatggagaattgtgg

SEQ ID NO: 7149413 - DNA, 22 bp, Homo sapiens
tttaagtgaaatgtaatacagt

SEQ ID NO: 7149414 - DNA, 22 bp, Homo sapiens
tttaagttccttttcaacaact

SEQ ID NO: 7149415 - DNA, 22 bp, Homo sapiens
tttaatgatagtcttacgaaaa

SEQ ID NO: 7149416 - DNA, 22 bp, Homo sapiens
tttaatgatagctgtttcacat

SEQ ID NO: 7149417 - DNA, 22 bp, Homo sapiens
tttaatgatagtcttacgaaaa

SEQ ID NO: 7149418 - DNA, 23 bp, Homo sapiens
tttaatgaccaatagaaggaaca

SEQ ID NO: 7149419 - DNA, 23 bp, Homo sapiens
tttaatgaccaatagaaggaaca

SEQ ID NO: 7149420 - DNA, 22 bp, Homo sapiens
tttaatgaggtctctcgctggc

SEQ ID NO: 7149421 - DNA, 22 bp, Homo sapiens
tttaatgaggtctctcgctggc

SEQ ID NO: 7149422 - DNA, 22 bp, Homo sapiens
tttaatgtagcgtgaaatgatt

SEQ ID NO: 7149423 - DNA, 22 bp, Homo sapiens
tttaatggcaagaaggctgcag

SEQ ID NO: 7149424 - DNA, 22 bp, Homo sapiens
tttaatgggatccatctggtta

SEQ ID NO: 7149425 - DNA, 19 bp, Homo sapiens
tttacagggaatggagacc

SEQ ID NO: 7149426 - DNA, 23 bp, Homo sapiens
tttacagggcactcttatgcagc

SEQ ID NO: 7149427 - DNA, 22 bp, Homo sapiens
tttacagggaatattttggctt

SEQ ID NO: 7149428 - DNA, 22 bp, Homo sapiens
tttacagggaatattttggctt

SEQ ID NO: 7149429 - DNA, 22 bp, Homo sapiens
tttacaggaagctgaaaaacat

SEQ ID NO: 7149430 - DNA, 22 bp, Homo sapiens
tttacaggaagctgaaaaacat

SEQ ID NO: 7149431 - DNA, 22 bp, Homo sapiens
tttacaggattaccctggctgc

SEQ ID NO: 7149432 - DNA, 22 bp, Homo sapiens
tttacaggattaccctggctgc

SEQ ID NO: 7149433 - DNA, 22 bp, Homo sapiens
tttacaggattaccctggctgc

SEQ ID NO: 7149434 - DNA, 22 bp, Homo sapiens
tttaatgtgacatcttttagag

SEQ ID NO: 7149435 - DNA, 22 bp, Homo sapiens
tttaatgtgacatcttttagag

SEQ ID NO: 7149436 - DNA, 22 bp, Homo sapiens
tttaatgcccaaggctttgatg

SEQ ID NO: 7149437 - DNA, 22 bp, Homo sapiens
tttaatgtgagtccctttcaag

SEQ ID NO: 7149438 - DNA, 22 bp, Homo sapiens
tttacagtctgtctagcaatgt

SEQ ID NO: 7149439 - DNA, 22 bp, Homo sapiens
tttacagtctctatagtcaaaa

SEQ ID NO: 7149440 - DNA, 22 bp, Homo sapiens
tttacagtctctatagtcaaaa

SEQ ID NO: 7149441 - DNA, 22 bp, Homo sapiens
tttacagtctctatagtcaaaa

SEQ ID NO: 7149442 - DNA, 22 bp, Homo sapiens
tttacagtctatgttgaattaa

SEQ ID NO: 7149443 - DNA, 22 bp, Homo sapiens
tttacagtccccaggtgaggat

SEQ ID NO: 7149444 - DNA, 22 bp, Homo sapiens
tttacagtccccaggtgaggat

SEQ ID NO: 7149445 - DNA, 22 bp, Homo sapiens
tttacagtctatgttgaattaa

SEQ ID NO: 7149446 - DNA, 22 bp, Homo sapiens
tttacagtctatgttgaattaa

SEQ ID NO: 7149447 - DNA, 22 bp, Homo sapiens
tttacagtctctatagtcaaaa

SEQ ID NO: 7149448 - DNA, 23 bp, Homo sapiens
tttacagggcactcttatgcagc

SEQ ID NO: 7149449 - DNA, 22 bp, Homo sapiens
tttacagggttcaagaatgaaa

SEQ ID NO: 7149450 - DNA, 22 bp, Homo sapiens
tttacagggttcaagaatgaaa

SEQ ID NO: 7149451 - DNA, 22 bp, Homo sapiens
tttacagtaaggtggatggtac

SEQ ID NO: 7149452 - DNA, 22 bp, Homo sapiens
tttacagtaaggtggatggtac

SEQ ID NO: 7149453 - DNA, 22 bp, Homo sapiens
tttacagtatagtaggactcat

SEQ ID NO: 7149454 - DNA, 22 bp, Homo sapiens
tttacagtatagtaggactcat

SEQ ID NO: 7149455 - DNA, 22 bp, Homo sapiens
tttacagtcaccaaactttgct

SEQ ID NO: 7149456 - DNA, 22 bp, Homo sapiens
tttacagtcaccaaactttgct

SEQ ID NO: 7149457 - DNA, 22 bp, Homo sapiens
tttacagtcaccaaactttgct

SEQ ID NO: 7149458 - DNA, 22 bp, Homo sapiens
tttacagtcaccaaactttgct

SEQ ID NO: 7149459 - DNA, 22 bp, Homo sapiens
tttacagtccccaggtgaggat

SEQ ID NO: 7149460 - DNA, 19 bp, Homo sapiens
tttcaaagggcataagcct

SEQ ID NO: 7149461 - DNA, 22 bp, Homo sapiens
tttattgcatacacaaatgtca

SEQ ID NO: 7149462 - DNA, 22 bp, Homo sapiens
tttattgcatacacaaatgtca

SEQ ID NO: 7149463 - DNA, 20 bp, Homo sapiens
tttattgagcacgtactgtg

SEQ ID NO: 7149464 - DNA, 22 bp, Homo sapiens
tttattgagtatctactatgtg

SEQ ID NO: 7149465 - DNA, 22 bp, Homo sapiens
tttattgagtatctactatgtg

SEQ ID NO: 7149466 - DNA, 22 bp, Homo sapiens
tttattgagtatctactatgtg

SEQ ID NO: 7149467 - DNA, 22 bp, Homo sapiens
tttattgacccaaagcgagagt

SEQ ID NO: 7149468 - DNA, 22 bp, Homo sapiens
tttattgacccaaagcgagagt

SEQ ID NO: 7149469 - DNA, 22 bp, Homo sapiens
tttattgacccaaagcgagagt

SEQ ID NO: 7149470 - DNA, 22 bp, Homo sapiens
tttattgacccaaagcgagagt

SEQ ID NO: 7149471 - DNA, 22 bp, Homo sapiens
tttattgacttcagtgagtctt

SEQ ID NO: 7149472 - DNA, 22 bp, Homo sapiens
tttattgacttcagtgagtctt

SEQ ID NO: 7149473 - DNA, 22 bp, Homo sapiens
tttattgagcacccgttgtgcg

SEQ ID NO: 7149474 - DNA, 22 bp, Homo sapiens
tttattgagcacccgttgtgcg

SEQ ID NO: 7149475 - DNA, 20 bp, Homo sapiens
tttattgagcacgtactgtg

SEQ ID NO: 7149476 - DNA, 22 bp, Homo sapiens
tttcaaaggtggaagagtgaat

SEQ ID NO: 7149477 - DNA, 22 bp, Homo sapiens
tttcaaaggttttgtcatgtct

SEQ ID NO: 7149478 - DNA, 22 bp, Homo sapiens
tttcaaaggttttgtcatgtct

SEQ ID NO: 7149479 - DNA, 22 bp, Homo sapiens
tttcaaagtaaggattttcatc

SEQ ID NO: 7149480 - DNA, 23 bp, Homo sapiens
tttcaaattactctgcagatgac

SEQ ID NO: 7149481 - DNA, 23 bp, Homo sapiens
tttcaacaatgcttagagaaaac

SEQ ID NO: 7149482 - DNA, 22 bp, Homo sapiens
tttcaacaccagagaccatgcg

SEQ ID NO: 7149483 - DNA, 22 bp, Homo sapiens
tttcaacagaatatgatcagag

SEQ ID NO: 7149484 - DNA, 20 bp, Homo sapiens
tttattcacagagaagagtt

SEQ ID NO: 7149485 - DNA, 22 bp, Homo sapiens
tttattcaagatgaggttcatg

SEQ ID NO: 7149486 - DNA, 20 bp, Homo sapiens
tttattcacagagaagagtt

SEQ ID NO: 7149487 - DNA, 22 bp, Homo sapiens
tttattctagctcagaatagtt

SEQ ID NO: 7149488 - DNA, 19 bp, Homo sapiens
tttattcacctttaccttg

SEQ ID NO: 7149489 - DNA, 22 bp, Homo sapiens
tttattctagctcagaatagtt

SEQ ID NO: 7149490 - DNA, 21 bp, Homo sapiens
tttattctcagatacagggag

SEQ ID NO: 7149491 - DNA, 22 bp, Homo sapiens
tttattctataggcattaagca

SEQ ID NO: 7149492 - DNA, 22 bp, Homo sapiens
tttattctataggcattaagca

SEQ ID NO: 7149493 - DNA, 22 bp, Homo sapiens
tttattctataggcattaagca

SEQ ID NO: 7149494 - DNA, 22 bp, Homo sapiens
tttattctataggcattaagca

SEQ ID NO: 7149495 - DNA, 22 bp, Homo sapiens
tttattctagctcagaatagtt

SEQ ID NO: 7149496 - DNA, 22 bp, Homo sapiens
tttattctagctcagaatagtt

SEQ ID NO: 7149497 - DNA, 22 bp, Homo sapiens
tttattctagctcagaatagtt

SEQ ID NO: 7149498 - DNA, 22 bp, Homo sapiens
tttattgaacacttgcactggc

SEQ ID NO: 7149499 - DNA, 22 bp, Homo sapiens
tttattgaacacttgcactggc

SEQ ID NO: 7149500 - DNA, 22 bp, Homo sapiens
tttattgaacacttgcactggc

SEQ ID NO: 7149501 - DNA, 22 bp, Homo sapiens
tttattgaattgtaaccctatt

SEQ ID NO: 7149502 - DNA, 22 bp, Homo sapiens
tttattgaattgtaaccctatt

SEQ ID NO: 7149503 - DNA, 22 bp, Homo sapiens
tttattgaattgtaaccctatt

SEQ ID NO: 7149504 - DNA, 22 bp, Homo sapiens
tttattcttgagagtgagaaga

SEQ ID NO: 7149505 - DNA, 22 bp, Homo sapiens
tttattcttgagagtgagaaga

SEQ ID NO: 7149506 - DNA, 22 bp, Homo sapiens
tttattcttgagagtgagaaga

SEQ ID NO: 7149507 - DNA, 22 bp, Homo sapiens
tttattcttgagagtgagaaga

SEQ ID NO: 7149508 - DNA, 22 bp, Homo sapiens
tttattgaacacttgcactggc

SEQ ID NO: 7149509 - DNA, 22 bp, Homo sapiens
tttattctgtgctacatgaaga

SEQ ID NO: 7149510 - DNA, 22 bp, Homo sapiens
tttattctgtgctacatgaaga

SEQ ID NO: 7149511 - DNA, 22 bp, Homo sapiens
tttattctctagttggtcagat

SEQ ID NO: 7149512 - DNA, 23 bp, Homo sapiens
tttattctcagatacataggtct

SEQ ID NO: 7149513 - DNA, 22 bp, Homo sapiens
tttattctgtgctacatgaaga

SEQ ID NO: 7149514 - DNA, 22 bp, Homo sapiens
tttattctgtgctacatgaaga

SEQ ID NO: 7149515 - DNA, 22 bp, Homo sapiens
tttattctgtgctacatgaaga

SEQ ID NO: 7149516 - DNA, 22 bp, Homo sapiens
tttattctgtgctacatgaaga

SEQ ID NO: 7149517 - DNA, 22 bp, Homo sapiens
tttcacactagtcagaatacca

SEQ ID NO: 7149518 - DNA, 22 bp, Homo sapiens
tttcacactagtcagaatacca

SEQ ID NO: 7149519 - DNA, 22 bp, Homo sapiens
tttcacactgcagcatcagaga

SEQ ID NO: 7149520 - DNA, 22 bp, Homo sapiens
tttcacaattttaaggagcaaa

SEQ ID NO: 7149521 - DNA, 22 bp, Homo sapiens
tttcacaattttaaggagcaaa

SEQ ID NO: 7149522 - DNA, 23 bp, Homo sapiens
tttcacaatgagcattacagaat

SEQ ID NO: 7149523 - DNA, 23 bp, Homo sapiens
tttcacaatgagcattacagaat

SEQ ID NO: 7149524 - DNA, 23 bp, Homo sapiens
tttcacaatgagcattacagaat

SEQ ID NO: 7149525 - DNA, 23 bp, Homo sapiens
tttcacaatgagcattacagaat

SEQ ID NO: 7149526 - DNA, 23 bp, Homo sapiens
tttcacaatgagcattacagaat

SEQ ID NO: 7149527 - DNA, 22 bp, Homo sapiens
tttcacaatgcaatcctacttc

SEQ ID NO: 7149528 - DNA, 22 bp, Homo sapiens
tttcacaatgcaatcctacttc

SEQ ID NO: 7149529 - DNA, 20 bp, Homo sapiens
tttcacaatgaacatgtctc

SEQ ID NO: 7149530 - DNA, 23 bp, Homo sapiens
tttcacaatgagcattacagaat

SEQ ID NO: 7149531 - DNA, 22 bp, Homo sapiens
tttcaagcaggatcaaagcaaa

SEQ ID NO: 7149532 - DNA, 22 bp, Homo sapiens
tttcaagcaggatcaaagcaaa

SEQ ID NO: 7149533 - DNA, 22 bp, Homo sapiens
tttcacagagaaatataacagg

SEQ ID NO: 7149534 - DNA, 22 bp, Homo sapiens
tttcacagagaaatataacagg

SEQ ID NO: 7149535 - DNA, 22 bp, Homo sapiens
tttcacagagaaatataacagg

SEQ ID NO: 7149536 - DNA, 22 bp, Homo sapiens
tttcacagatataagatttcac

SEQ ID NO: 7149537 - DNA, 22 bp, Homo sapiens
tttcacagatataagatttcac

SEQ ID NO: 7149538 - DNA, 22 bp, Homo sapiens
tttcacagatataagatttcac

SEQ ID NO: 7149539 - DNA, 22 bp, Homo sapiens
tttcacagatcctacagcttgt

SEQ ID NO: 7149540 - DNA, 22 bp, Homo sapiens
tttcacagatgttttggagtct

SEQ ID NO: 7149541 - DNA, 22 bp, Homo sapiens
tttcacagaaagaagctagttt

SEQ ID NO: 7149542 - DNA, 22 bp, Homo sapiens
tttcacagaaagaagctagttt

SEQ ID NO: 7149543 - DNA, 22 bp, Homo sapiens
tttcacagaaaggataacatta

SEQ ID NO: 7149544 - DNA, 22 bp, Homo sapiens
tttcacagaaaggataacatta

SEQ ID NO: 7149545 - DNA, 22 bp, Homo sapiens
tttcacagaactcactaaggag

SEQ ID NO: 7149546 - DNA, 22 bp, Homo sapiens
tttcacagaactcactaaggag

SEQ ID NO: 7149547 - DNA, 23 bp, Homo sapiens
tttcacagaaggattgtagggcc

SEQ ID NO: 7149548 - DNA, 23 bp, Homo sapiens
tttcacagaaggattgtagggcc

SEQ ID NO: 7149549 - DNA, 22 bp, Homo sapiens
tttcacagagaaatataacagg

SEQ ID NO: 7149550 - DNA, 22 bp, Homo sapiens
tttcaagaattgaagaggattt

SEQ ID NO: 7149551 - DNA, 22 bp, Homo sapiens
tttcaagactcattgagtattg

SEQ ID NO: 7149552 - DNA, 22 bp, Homo sapiens
tttcaagagaaaactaacctat

SEQ ID NO: 7149553 - DNA, 22 bp, Homo sapiens
tttcaagagaaaactaacctat

SEQ ID NO: 7149554 - DNA, 22 bp, Homo sapiens
tttcaagagcaggaaaaaggtc

SEQ ID NO: 7149555 - DNA, 22 bp, Homo sapiens
tttcaagagggaactgaacaca

SEQ ID NO: 7149556 - DNA, 22 bp, Homo sapiens
tttcaagagggaactgaacaca

SEQ ID NO: 7149557 - DNA, 22 bp, Homo sapiens
tttcaagaagcaaattaaagtc

SEQ ID NO: 7149558 - DNA, 23 bp, Homo sapiens
tttcaactcctgccattatttct

SEQ ID NO: 7149559 - DNA, 22 bp, Homo sapiens
tttcaacttgaagaattgatac

SEQ ID NO: 7149560 - DNA, 22 bp, Homo sapiens
tttcaactcatgctaaaggaag

SEQ ID NO: 7149561 - DNA, 22 bp, Homo sapiens
tttcaacagctctcaaatgatc

SEQ ID NO: 7149562 - DNA, 22 bp, Homo sapiens
tttcaacaggatgataataggc

SEQ ID NO: 7149563 - DNA, 23 bp, Homo sapiens
tttcaacaggcagagaagactta

SEQ ID NO: 7149564 - DNA, 22 bp, Homo sapiens
tttcatgattaacttagtgaat

SEQ ID NO: 7149565 - DNA, 22 bp, Homo sapiens
tttcatgattaacttagtgaat

SEQ ID NO: 7149566 - DNA, 22 bp, Homo sapiens
tttcatgattaacttagtgaat

SEQ ID NO: 7149567 - DNA, 22 bp, Homo sapiens
tttcatgatccatttacaaaat

SEQ ID NO: 7149568 - DNA, 22 bp, Homo sapiens
tttcatgatccatttacaaaat

SEQ ID NO: 7149569 - DNA, 22 bp, Homo sapiens
tttcatgctcatggaacacagc

SEQ ID NO: 7149570 - DNA, 22 bp, Homo sapiens
tttcagagctcagcagctagag

SEQ ID NO: 7149571 - DNA, 22 bp, Homo sapiens
tttcatgaggggcaaaatctca

SEQ ID NO: 7149572 - DNA, 22 bp, Homo sapiens
tttcatcttgattctatatggc

SEQ ID NO: 7149573 - DNA, 22 bp, Homo sapiens
tttcatcttgattctatatggc

SEQ ID NO: 7149574 - DNA, 22 bp, Homo sapiens
tttcatgagattcctccacatc

SEQ ID NO: 7149575 - DNA, 22 bp, Homo sapiens
tttcatgttacagtgtaaaagt

SEQ ID NO: 7149576 - DNA, 22 bp, Homo sapiens
tttcatgttacagtgtaaaagt

SEQ ID NO: 7149577 - DNA, 22 bp, Homo sapiens
tttcatgtgcaattagcaatat

SEQ ID NO: 7149578 - DNA, 22 bp, Homo sapiens
tttcatgtcattccatttcaga

SEQ ID NO: 7149579 - DNA, 22 bp, Homo sapiens
tttcatgtacttttttgataga

SEQ ID NO: 7149580 - DNA, 22 bp, Homo sapiens
tttcatgtacttttttgataga

SEQ ID NO: 7149581 - DNA, 22 bp, Homo sapiens
tttcatgtatttcccaaagctt

SEQ ID NO: 7149582 - DNA, 19 bp, Homo sapiens
tttcccagcccttgctgtg

SEQ ID NO: 7149583 - DNA, 21 bp, Homo sapiens
tttcccagcagagatagctgg

SEQ ID NO: 7149584 - DNA, 22 bp, Homo sapiens
tttcattgatgggtgatagaaa

SEQ ID NO: 7149585 - DNA, 22 bp, Homo sapiens
tttcattgcagagtctgtgtgc

SEQ ID NO: 7149586 - DNA, 22 bp, Homo sapiens
tttcccagcctcctttgcagct

SEQ ID NO: 7149587 - DNA, 22 bp, Homo sapiens
tttcccaggccctcagggctgc

SEQ ID NO: 7149588 - DNA, 22 bp, Homo sapiens
tttcccaggccctcagggctgc

SEQ ID NO: 7149589 - DNA, 19 bp, Homo sapiens
tttcccagtcccaggagtg

SEQ ID NO: 7149590 - DNA, 19 bp, Homo sapiens
tttcccagtcccaggagtg

SEQ ID NO: 7149591 - DNA, 22 bp, Homo sapiens
tttcccaggctggaatgcagtg

SEQ ID NO: 7149592 - DNA, 22 bp, Homo sapiens
tttcccagttagtgaagacatg

SEQ ID NO: 7149593 - DNA, 22 bp, Homo sapiens
tttcccagttagtgaagacatg

SEQ ID NO: 7149594 - DNA, 22 bp, Homo sapiens
tttcccagttccctgctctata

SEQ ID NO: 7149595 - DNA, 22 bp, Homo sapiens
tttcccagttccctgctctata

SEQ ID NO: 7149596 - DNA, 22 bp, Homo sapiens
tttcccagttccctgctctata

SEQ ID NO: 7149597 - DNA, 22 bp, Homo sapiens
tttcccattctaattactcatt

SEQ ID NO: 7149598 - DNA, 22 bp, Homo sapiens
tttcccctcagtactaaacata

SEQ ID NO: 7149599 - DNA, 22 bp, Homo sapiens
tttcattcattatacagtagag

SEQ ID NO: 7149600 - DNA, 22 bp, Homo sapiens
tttcattcattatacagtagag

SEQ ID NO: 7149601 - DNA, 22 bp, Homo sapiens
tttcattcagcaccctgaggtg

SEQ ID NO: 7149602 - DNA, 22 bp, Homo sapiens
tttcattgaactaaagaatctg

SEQ ID NO: 7149603 - DNA, 21 bp, Homo sapiens
tttcattgaatgagataaggt

SEQ ID NO: 7149604 - DNA, 22 bp, Homo sapiens
tttcattcagcaccctgaggtg

SEQ ID NO: 7149605 - DNA, 22 bp, Homo sapiens
tttcattcatgtgttaaaggtg

SEQ ID NO: 7149606 - DNA, 22 bp, Homo sapiens
tttcattatgttcctggaagag

SEQ ID NO: 7149607 - DNA, 22 bp, Homo sapiens
tttcattatacagcttcataaa

SEQ ID NO: 7149608 - DNA, 22 bp, Homo sapiens
tttcattattcatgctagttat

SEQ ID NO: 7149609 - DNA, 22 bp, Homo sapiens
tttcattgagactatagacatc

SEQ ID NO: 7149610 - DNA, 22 bp, Homo sapiens
tttcattgacagttgggggaaa

SEQ ID NO: 7149611 - DNA, 22 bp, Homo sapiens
tttcattgacagttgggggaaa

SEQ ID NO: 7149612 - DNA, 22 bp, Homo sapiens
tttcattgagaatataagattt

SEQ ID NO: 7149613 - DNA, 22 bp, Homo sapiens
tttcacagctgggtggcagagt

SEQ ID NO: 7149614 - DNA, 22 bp, Homo sapiens
tttcacagctgggtggcagagt

SEQ ID NO: 7149615 - DNA, 22 bp, Homo sapiens
tttcacagctgggtggcagagt

SEQ ID NO: 7149616 - DNA, 22 bp, Homo sapiens
tttcacagctgggtggcagagt

SEQ ID NO: 7149617 - DNA, 22 bp, Homo sapiens
tttcacagctgtcttccgtctc

SEQ ID NO: 7149618 - DNA, 22 bp, Homo sapiens
tttcacagcgtctttctcttgc

SEQ ID NO: 7149619 - DNA, 22 bp, Homo sapiens
tttcacagctagtgagcttcta

SEQ ID NO: 7149620 - DNA, 22 bp, Homo sapiens
tttcacagctgggaagagatat

SEQ ID NO: 7149621 - DNA, 22 bp, Homo sapiens
tttcacagctgggaagagatat

SEQ ID NO: 7149622 - DNA, 22 bp, Homo sapiens
tttcacagcatataggtgtact

SEQ ID NO: 7149623 - DNA, 22 bp, Homo sapiens
tttcacagcatataggtgtact

SEQ ID NO: 7149624 - DNA, 22 bp, Homo sapiens
tttcacagcgtctttctcttgc

SEQ ID NO: 7149625 - DNA, 22 bp, Homo sapiens
tttcacagcagtgtgctgcttt

SEQ ID NO: 7149626 - DNA, 22 bp, Homo sapiens
tttcacagcagaatttctgagg

SEQ ID NO: 7149627 - DNA, 22 bp, Homo sapiens
tttcacagcagaatttctgagg

SEQ ID NO: 7149628 - DNA, 18 bp, Homo sapiens
tttcacagattcatgact

SEQ ID NO: 7149629 - DNA, 23 bp, Homo sapiens
tttcacagcttttattctgcatc

SEQ ID NO: 7149630 - DNA, 23 bp, Homo sapiens
tttcacagcttttattctgcatc

SEQ ID NO: 7149631 - DNA, 22 bp, Homo sapiens
tttcacatttgttttaagaagt

SEQ ID NO: 7149632 - DNA, 22 bp, Homo sapiens
tttcacatttgttttaagaagt

SEQ ID NO: 7149633 - DNA, 22 bp, Homo sapiens
tttcacattttatacttaagcc

SEQ ID NO: 7149634 - DNA, 22 bp, Homo sapiens
tttcaccaaggtaacctttgat

SEQ ID NO: 7149635 - DNA, 22 bp, Homo sapiens
tttcaccacagaggcaagacaa

SEQ ID NO: 7149636 - DNA, 20 bp, Homo sapiens
tttcaccatcttggccaggc

SEQ ID NO: 7149637 - DNA, 22 bp, Homo sapiens
tttcaccatcttggccaggctg

SEQ ID NO: 7149638 - DNA, 22 bp, Homo sapiens
tttcagaaaacttatcatcagt

SEQ ID NO: 7149639 - DNA, 22 bp, Homo sapiens
tttcactgttaggagtatgcta

SEQ ID NO: 7149640 - DNA, 22 bp, Homo sapiens
tttcactgttaggagtatgcta

SEQ ID NO: 7149641 - DNA, 22 bp, Homo sapiens
tttcactgttaggagtatgcta

SEQ ID NO: 7149642 - DNA, 20 bp, Homo sapiens
tttcactgtggtgctggaga

SEQ ID NO: 7149643 - DNA, 22 bp, Homo sapiens
tttcactagaacgttcttgttt

SEQ ID NO: 7149644 - DNA, 20 bp, Homo sapiens
tttcactggcttgataaggt

SEQ ID NO: 7149645 - DNA, 20 bp, Homo sapiens
tttcactggcttgataaggt

SEQ ID NO: 7149646 - DNA, 22 bp, Homo sapiens
tttcactgggcttgcagaaatc

SEQ ID NO: 7149647 - DNA, 22 bp, Homo sapiens
tttcagaaatggcactgaaatc

SEQ ID NO: 7149648 - DNA, 22 bp, Homo sapiens
tttcagaatatcgattcagtga

SEQ ID NO: 7149649 - DNA, 22 bp, Homo sapiens
tttcagaaatcaaaaccagggt

SEQ ID NO: 7149650 - DNA, 22 bp, Homo sapiens
tttcagaaagctgaacatatga

SEQ ID NO: 7149651 - DNA, 22 bp, Homo sapiens
tttcagaaagctgaacatatga

SEQ ID NO: 7149652 - DNA, 22 bp, Homo sapiens
tttcagaaagcatcatcaaagt

SEQ ID NO: 7149653 - DNA, 22 bp, Homo sapiens
tttcagaaagcatcatcaaagt

SEQ ID NO: 7149654 - DNA, 22 bp, Homo sapiens
tttcagactcatctcaagcttt

SEQ ID NO: 7149655 - DNA, 22 bp, Homo sapiens
tttcagagaattagaagctgat

SEQ ID NO: 7149656 - DNA, 22 bp, Homo sapiens
tttcagagagatcaacatagct

SEQ ID NO: 7149657 - DNA, 22 bp, Homo sapiens
ttgtcctgttacttgtttggat

SEQ ID NO: 7149658 - DNA, 22 bp, Homo sapiens
ttgtcctgtttagggataagga

SEQ ID NO: 7149659 - DNA, 22 bp, Homo sapiens
ttgtcctgtgtctgtttggatt

SEQ ID NO: 7149660 - DNA, 22 bp, Homo sapiens
ttgtcctgtgatttcagggcct

SEQ ID NO: 7149661 - DNA, 22 bp, Homo sapiens
ttgtggctgtcgagaattgagg

SEQ ID NO: 7149662 - DNA, 22 bp, Homo sapiens
ttgtggctcgtgagatgttagg

SEQ ID NO: 7149663 - DNA, 22 bp, Homo sapiens
ttgtgggatctccctgttgctc

SEQ ID NO: 7149664 - DNA, 22 bp, Homo sapiens
ttgtgggatggctcttcccaaa

SEQ ID NO: 7149665 - DNA, 20 bp, Homo sapiens
ttgtgtaggtctaatgcata

SEQ ID NO: 7149666 - DNA, 22 bp, Homo sapiens
ttgtgtattttttgatactaac

SEQ ID NO: 7149667 - DNA, 22 bp, Homo sapiens
ttgtgtccaaggctatggtgat

SEQ ID NO: 7149668 - DNA, 22 bp, Homo sapiens
ttgtgtccatttgagtcatgtg

SEQ ID NO: 7149669 - DNA, 22 bp, Homo sapiens
ttgtgtccatttgagtcatgtg

SEQ ID NO: 7149670 - DNA, 22 bp, Homo sapiens
ttgtgtccatttgagtcatgtg

SEQ ID NO: 7149671 - DNA, 22 bp, Homo sapiens
ttgtgtccccctttgagagcca

SEQ ID NO: 7149672 - DNA, 22 bp, Homo sapiens
ttgtgtccccctttgagagcca

SEQ ID NO: 7149673 - DNA, 22 bp, Homo sapiens
ttgtgtcccctgttctacctgt

SEQ ID NO: 7149674 - DNA, 22 bp, Homo sapiens
ttgtgtccctgcggctgaggag

SEQ ID NO: 7149675 - DNA, 22 bp, Homo sapiens
ttgtgtccctggagcttctgtg

SEQ ID NO: 7149676 - DNA, 22 bp, Homo sapiens
ttgtgtccctgtaagacaaagc

SEQ ID NO: 7149677 - DNA, 22 bp, Homo sapiens
ttgtgtcctaacatctagttaa

SEQ ID NO: 7149678 - DNA, 22 bp, Homo sapiens
ttgtgtcctaagcaccagatgg

SEQ ID NO: 7149679 - DNA, 22 bp, Homo sapiens
ttgtgtcctatatgcatgttct

SEQ ID NO: 7149680 - DNA, 22 bp, Homo sapiens
ttgtgtcctatatgcatgttct

SEQ ID NO: 7149681 - DNA, 22 bp, Homo sapiens
ttgtgtcctctaatctcaccac

SEQ ID NO: 7149682 - DNA, 22 bp, Homo sapiens
ttgtgtcctgatttgacacaat

SEQ ID NO: 7149683 - DNA, 21 bp, Homo sapiens
ttgtgtccttctaaagggcca

SEQ ID NO: 7149684 - DNA, 21 bp, Homo sapiens
ttgtgtccttctaaagggcca

SEQ ID NO: 7149685 - DNA, 22 bp, Homo sapiens
ttgtgtctaaataaggagacct

SEQ ID NO: 7149686 - DNA, 22 bp, Homo sapiens
ttgtgtctaaataaggagacct

SEQ ID NO: 7149687 - DNA, 23 bp, Homo sapiens
ttgtgtctacttcctatctaggg

SEQ ID NO: 7149688 - DNA, 23 bp, Homo sapiens
ttgtgtctacttcctatctaggg

SEQ ID NO: 7149689 - DNA, 22 bp, Homo sapiens
ttgtgtctatggtttgagcatc

SEQ ID NO: 7149690 - DNA, 22 bp, Homo sapiens
ttgtgtctatggtttgagcatc

SEQ ID NO: 7149691 - DNA, 22 bp, Homo sapiens
ttgtgtctggaatgcgtggagc

SEQ ID NO: 7149692 - DNA, 22 bp, Homo sapiens
ttgtgtctggaatgcgtggagc

SEQ ID NO: 7149693 - DNA, 22 bp, Homo sapiens
ttgtgtctggatttcagctttc

SEQ ID NO: 7149694 - DNA, 22 bp, Homo sapiens
ttgtgtctggatttcagctttc

SEQ ID NO: 7149695 - DNA, 22 bp, Homo sapiens
ttgtgtctgggggagtgacatc

SEQ ID NO: 7149696 - DNA, 22 bp, Homo sapiens
ttgtgtctgggggagtgacatc

SEQ ID NO: 7149697 - DNA, 22 bp, Homo sapiens
ttgtgtctgggggagtgacatc

SEQ ID NO: 7149698 - DNA, 22 bp, Homo sapiens
ttgtgtctgggggagtgacatc

SEQ ID NO: 7149699 - DNA, 22 bp, Homo sapiens
ttgtgtctgggggagtgacatc

SEQ ID NO: 7149700 - DNA, 22 bp, Homo sapiens
ttgtgtctgggggagtgacatc

SEQ ID NO: 7149701 - DNA, 22 bp, Homo sapiens
ttgtgtcttaaagattaaatgg

SEQ ID NO: 7149702 - DNA, 22 bp, Homo sapiens
ttgtgtcttaaagattaaatgg

SEQ ID NO: 7149703 - DNA, 22 bp, Homo sapiens
ttgtcctgtcaggctgggggct

SEQ ID NO: 7149704 - DNA, 16 bp, Homo sapiens
ttgtcctgtctcactg

SEQ ID NO: 7149705 - DNA, 22 bp, Homo sapiens
ttgtcctggaggttaatagagt

SEQ ID NO: 7149706 - DNA, 22 bp, Homo sapiens
ttgtcctggcccaaatgtcaac

SEQ ID NO: 7149707 - DNA, 23 bp, Homo sapiens
ttgtcctgccgatctctgagaat

SEQ ID NO: 7149708 - DNA, 22 bp, Homo sapiens
ttgtcctgcaggtggctgggag

SEQ ID NO: 7149709 - DNA, 23 bp, Homo sapiens
ttgtcctgccgatctctgagaat

SEQ ID NO: 7149710 - DNA, 23 bp, Homo sapiens
ttgtcctgccgatctctgagaat

SEQ ID NO: 7149711 - DNA, 22 bp, Homo sapiens
ttgtcctgcaacctcacatggc

SEQ ID NO: 7149712 - DNA, 22 bp, Homo sapiens
ttgtcctgattttgcaacttct

SEQ ID NO: 7149713 - DNA, 22 bp, Homo sapiens
ttgtcctgaggactgttatcag

SEQ ID NO: 7149714 - DNA, 22 bp, Homo sapiens
ttgtcctgatttataaaatgaa

SEQ ID NO: 7149715 - DNA, 22 bp, Homo sapiens
ttgtcctgatttataaaatgaa

SEQ ID NO: 7149716 - DNA, 22 bp, Homo sapiens
ttgtccctgcccctgcttgctt

SEQ ID NO: 7149717 - DNA, 22 bp, Homo sapiens
ttgtcccttcagtaagagtgga

SEQ ID NO: 7149718 - DNA, 23 bp, Homo sapiens
ttgtcctctggatcggtttggtt

SEQ ID NO: 7149719 - DNA, 22 bp, Homo sapiens
ttgtcctgagataaggaacaga

SEQ ID NO: 7149720 - DNA, 22 bp, Homo sapiens
ttgtcagccagctcgcactctt

SEQ ID NO: 7149721 - DNA, 20 bp, Homo sapiens
ttgtcacagctttccatcag

SEQ ID NO: 7149722 - DNA, 22 bp, Homo sapiens
ttgtcacaggaaagggtgcaag

SEQ ID NO: 7149723 - DNA, 17 bp, Homo sapiens
ttgtcacaggtggtggt

SEQ ID NO: 7149724 - DNA, 17 bp, Homo sapiens
ttgtcacaggtggtggt

SEQ ID NO: 7149725 - DNA, 22 bp, Homo sapiens
ttgtcacatgtagttcattctc

SEQ ID NO: 7149726 - DNA, 22 bp, Homo sapiens
ttgtcacatgtagttcattctc

SEQ ID NO: 7149727 - DNA, 22 bp, Homo sapiens
ttgtcacatgtagttcattctc

SEQ ID NO: 7149728 - DNA, 22 bp, Homo sapiens
ttgtcacattcaagttttatat

SEQ ID NO: 7149729 - DNA, 19 bp, Homo sapiens
ttgtcacaattcatcaggt

SEQ ID NO: 7149730 - DNA, 19 bp, Homo sapiens
ttgtcacaattcatcaggt

SEQ ID NO: 7149731 - DNA, 22 bp, Homo sapiens
ttgtcacacccttttttatacc

SEQ ID NO: 7149732 - DNA, 22 bp, Homo sapiens
ttgtcacagacatcccaggtga

SEQ ID NO: 7149733 - DNA, 22 bp, Homo sapiens
ttgtcacagcagcaaaggctct

SEQ ID NO: 7149734 - DNA, 20 bp, Homo sapiens
ttgtcacagctttccatcag

SEQ ID NO: 7149735 - DNA, 22 bp, Homo sapiens
ttgtcatggatggaagggatat

SEQ ID NO: 7149736 - DNA, 22 bp, Homo sapiens
ttgtcatgatccttctgttagg

SEQ ID NO: 7149737 - DNA, 22 bp, Homo sapiens
ttgtcatgagtcacaaaaataa

SEQ ID NO: 7149738 - DNA, 22 bp, Homo sapiens
ttgtcaggaactatgattatgc

SEQ ID NO: 7149739 - DNA, 22 bp, Homo sapiens
ttgtcagggactggaaaagaaa

SEQ ID NO: 7149740 - DNA, 22 bp, Homo sapiens
ttgtaaatagtagtaagatgcc

SEQ ID NO: 7149741 - DNA, 22 bp, Homo sapiens
ttgtaaatagtagtaagatgcc

SEQ ID NO: 7149742 - DNA, 22 bp, Homo sapiens
ttgtaaagaggggggatggtag

SEQ ID NO: 7149743 - DNA, 22 bp, Homo sapiens
ttgtaaagatgcttcccattct

SEQ ID NO: 7149744 - DNA, 22 bp, Homo sapiens
ttgtaaagatgcttcccattct

SEQ ID NO: 7149745 - DNA, 22 bp, Homo sapiens
ttgtaaagctgattagaaagcc

SEQ ID NO: 7149746 - DNA, 22 bp, Homo sapiens
ttgtaaagctttgagactacat

SEQ ID NO: 7149747 - DNA, 22 bp, Homo sapiens
ttgtaaaggctgttattgactt

SEQ ID NO: 7149748 - DNA, 22 bp, Homo sapiens
ttgtaaaggctgttattgactt

SEQ ID NO: 7149749 - DNA, 22 bp, Homo sapiens
ttgtaaagggcatttgcacagt

SEQ ID NO: 7149750 - DNA, 21 bp, Homo sapiens
ttgtaaaggtttagaagaatg

SEQ ID NO: 7149751 - DNA, 22 bp, Homo sapiens
ttgtaaagtacttagcacagca

SEQ ID NO: 7149752 - DNA, 22 bp, Homo sapiens
ttgtaaagttcttaggaagctc

SEQ ID NO: 7149753 - DNA, 22 bp, Homo sapiens
ttgggccctgctctgagttgct

SEQ ID NO: 7149754 - DNA, 22 bp, Homo sapiens
ttgggcctcactctagaaggca

SEQ ID NO: 7149755 - DNA, 22 bp, Homo sapiens
ttgggcctcactctagaaggca

SEQ ID NO: 7149756 - DNA, 22 bp, Homo sapiens
ttgggcctcggccaaggacggg

SEQ ID NO: 7149757 - DNA, 22 bp, Homo sapiens
ttgggcctctcaaagtgctggg

SEQ ID NO: 7149758 - DNA, 22 bp, Homo sapiens
ttgggcctgatcggaataagga

SEQ ID NO: 7149759 - DNA, 22 bp, Homo sapiens
ttgtaaacttgtttgaaggtat

SEQ ID NO: 7149760 - DNA, 22 bp, Homo sapiens
ttgtaacagctgcttaatagag

SEQ ID NO: 7149761 - DNA, 22 bp, Homo sapiens
ttgtaacaaagacactccaaaa

SEQ ID NO: 7149762 - DNA, 22 bp, Homo sapiens
ttgtaacactcccactcttctt

SEQ ID NO: 7149763 - DNA, 22 bp, Homo sapiens
ttgtaacaggtactaaataact

SEQ ID NO: 7149764 - DNA, 22 bp, Homo sapiens
ttgtaactctgaatacatccta

SEQ ID NO: 7149765 - DNA, 22 bp, Homo sapiens
ttgtaacatcaccatcaaaatc

SEQ ID NO: 7149766 - DNA, 22 bp, Homo sapiens
ttgtaactttgcatactcctgt

SEQ ID NO: 7149767 - DNA, 22 bp, Homo sapiens
ttgtaagactgtagaatgcaaa

SEQ ID NO: 7149768 - DNA, 22 bp, Homo sapiens
ttgtattttttcctggcggtgg

SEQ ID NO: 7149769 - DNA, 22 bp, Homo sapiens
ttgtattttttcctggcggtgg

SEQ ID NO: 7149770 - DNA, 23 bp, Homo sapiens
ttgtatttttagtagagacaggg

SEQ ID NO: 7149771 - DNA, 22 bp, Homo sapiens
ttgtactatgtctaagtcactg

SEQ ID NO: 7149772 - DNA, 22 bp, Homo sapiens
ttgtatttcctataacctttct

SEQ ID NO: 7149773 - DNA, 22 bp, Homo sapiens
ttgtatttcgatgcacgtgtag

SEQ ID NO: 7149774 - DNA, 22 bp, Homo sapiens
ttgtatttcgatgcacgtgtag

SEQ ID NO: 7149775 - DNA, 22 bp, Homo sapiens
ttgtatttcgatgcacgtgtag

SEQ ID NO: 7149776 - DNA, 22 bp, Homo sapiens
ttgtatttctccactttctgtt

SEQ ID NO: 7149777 - DNA, 22 bp, Homo sapiens
ttgtatttctccactttctgtt

SEQ ID NO: 7149778 - DNA, 23 bp, Homo sapiens
ttgtacagcccagattcctcttc

SEQ ID NO: 7149779 - DNA, 22 bp, Homo sapiens
ttgtacagggaagtaatacaag

SEQ ID NO: 7149780 - DNA, 22 bp, Homo sapiens
ttgtacaggttcctagggtgga

SEQ ID NO: 7149781 - DNA, 22 bp, Homo sapiens
ttgtacagtttaagtgggtgaa

SEQ ID NO: 7149782 - DNA, 22 bp, Homo sapiens
ttgtacattctgaatctgtcct

SEQ ID NO: 7149783 - DNA, 22 bp, Homo sapiens
ttgtacattctgaatctgtcct

SEQ ID NO: 7149784 - DNA, 22 bp, Homo sapiens
ttgtacatttgttcagttctga

SEQ ID NO: 7149785 - DNA, 22 bp, Homo sapiens
ttgtacactgttgatgggaatg

SEQ ID NO: 7149786 - DNA, 22 bp, Homo sapiens
ttgtacagaaaaaattcttggt

SEQ ID NO: 7149787 - DNA, 22 bp, Homo sapiens
ttgtacagaccctgaaaagctc

SEQ ID NO: 7149788 - DNA, 22 bp, Homo sapiens
ttgtacagaccctgaaaagctc

SEQ ID NO: 7149789 - DNA, 19 bp, Homo sapiens
ttgtacagcaaccaaccct

SEQ ID NO: 7149790 - DNA, 21 bp, Homo sapiens
ttgtacacccacagatcagcc

SEQ ID NO: 7149791 - DNA, 22 bp, Homo sapiens
ttgtacactctttttattccgt

SEQ ID NO: 7149792 - DNA, 22 bp, Homo sapiens
ttgtaagatggataggaacagc

SEQ ID NO: 7149793 - DNA, 22 bp, Homo sapiens
ttgtaagggttacaagaaaaca

SEQ ID NO: 7149794 - DNA, 22 bp, Homo sapiens
ttgtaatgagtggatcttaggg

SEQ ID NO: 7149795 - DNA, 22 bp, Homo sapiens
ttgtaatgagtggatcttaggg

SEQ ID NO: 7149796 - DNA, 22 bp, Homo sapiens
ttgtacaagtattatgtgaaca

SEQ ID NO: 7149797 - DNA, 22 bp, Homo sapiens
ttgtacaagttttgagcttaag

SEQ ID NO: 7149798 - DNA, 22 bp, Homo sapiens
ttgggacagaaaaggagaagat

SEQ ID NO: 7149799 - DNA, 22 bp, Homo sapiens
ttgggacagaaaaggagaagat

SEQ ID NO: 7149800 - DNA, 22 bp, Homo sapiens
ttgggaagtttaatgacagact

SEQ ID NO: 7149801 - DNA, 22 bp, Homo sapiens
ttgggaagtttaatgacagact

SEQ ID NO: 7149802 - DNA, 22 bp, Homo sapiens
ttgggacaaagactccttgaat

SEQ ID NO: 7149803 - DNA, 22 bp, Homo sapiens
ttgggacaaagactccttgaat

SEQ ID NO: 7149804 - DNA, 22 bp, Homo sapiens
ttgggacagagctggggctgga

SEQ ID NO: 7149805 - DNA, 22 bp, Homo sapiens
ttgggacagctgtggtagtgag

SEQ ID NO: 7149806 - DNA, 22 bp, Homo sapiens
ttgggacagctgtggtagtgag

SEQ ID NO: 7149807 - DNA, 22 bp, Homo sapiens
ttggccatctaagcccagccac

SEQ ID NO: 7149808 - DNA, 22 bp, Homo sapiens
ttggccatgacaggacaggaag

SEQ ID NO: 7149809 - DNA, 22 bp, Homo sapiens
ttggcccacagtaccatgctgt

SEQ ID NO: 7149810 - DNA, 22 bp, Homo sapiens
ttgggaagaatggaggtggtta

SEQ ID NO: 7149811 - DNA, 22 bp, Homo sapiens
ttgggaagaggcccctggattc

SEQ ID NO: 7149812 - DNA, 22 bp, Homo sapiens
ttgggaaggcgtggaagcagaa

SEQ ID NO: 7149813 - DNA, 22 bp, Homo sapiens
ttgggaaggcgtggaagcagaa

SEQ ID NO: 7149814 - DNA, 22 bp, Homo sapiens
ttgggaagtaatatggtggtct

SEQ ID NO: 7149815 - DNA, 22 bp, Homo sapiens
ttgggaagtaatatggtggtct

SEQ ID NO: 7149816 - DNA, 22 bp, Homo sapiens
ttgggaagtaatatggtggtct

SEQ ID NO: 7149817 - DNA, 22 bp, Homo sapiens
ttgggaagtttaatgacagact

SEQ ID NO: 7149818 - DNA, 22 bp, Homo sapiens
ttggccagtggaaagaggagga

SEQ ID NO: 7149819 - DNA, 22 bp, Homo sapiens
ttggccatctaagcccagccac

SEQ ID NO: 7149820 - DNA, 22 bp, Homo sapiens
ttggccatctaagcccagccac

SEQ ID NO: 7149821 - DNA, 22 bp, Homo sapiens
ttggccatctaagcccagccac

SEQ ID NO: 7149822 - DNA, 22 bp, Homo sapiens
ttggccaggtgtccagcccagg

SEQ ID NO: 7149823 - DNA, 22 bp, Homo sapiens
ttggccaggtgtccagcccagg

SEQ ID NO: 7149824 - DNA, 22 bp, Homo sapiens
ttggccagtgaaccaggcctgg

SEQ ID NO: 7149825 - DNA, 22 bp, Homo sapiens
ttggccagtgaaccaggcctgg

SEQ ID NO: 7149826 - DNA, 22 bp, Homo sapiens
ttggcatcagtgtaggacctgt

SEQ ID NO: 7149827 - DNA, 22 bp, Homo sapiens
ttggcataccttagtggtggag

SEQ ID NO: 7149828 - DNA, 22 bp, Homo sapiens
ttggcataccttagtggtggag

SEQ ID NO: 7149829 - DNA, 22 bp, Homo sapiens
ttggcataaaactcttcaaaat

SEQ ID NO: 7149830 - DNA, 22 bp, Homo sapiens
ttggcataccttagtggtggag

SEQ ID NO: 7149831 - DNA, 22 bp, Homo sapiens
ttggccagcgacgaccttctta

SEQ ID NO: 7149832 - DNA, 22 bp, Homo sapiens
ttggccaggtccatttctccat

SEQ ID NO: 7149833 - DNA, 22 bp, Homo sapiens
ttggccaggtgtaggtcacacc

SEQ ID NO: 7149834 - DNA, 22 bp, Homo sapiens
ttgggcaggtgaagagagggct

SEQ ID NO: 7149835 - DNA, 22 bp, Homo sapiens
ttgggcaggtgaagagagggct

SEQ ID NO: 7149836 - DNA, 22 bp, Homo sapiens
ttgggcaggtgaagagagggct

SEQ ID NO: 7149837 - DNA, 22 bp, Homo sapiens
ttgggcaggtgtggctctcctt

SEQ ID NO: 7149838 - DNA, 22 bp, Homo sapiens
ttgggcaggtgtggctctcctt

SEQ ID NO: 7149839 - DNA, 22 bp, Homo sapiens
ttgggcagtagcctcttggtgt

SEQ ID NO: 7149840 - DNA, 22 bp, Homo sapiens
ttgggcaggtgaagagagggct

SEQ ID NO: 7149841 - DNA, 22 bp, Homo sapiens
ttgggcaggtgaagagagggct

SEQ ID NO: 7149842 - DNA, 22 bp, Homo sapiens
ttgggcagggaaaggacaggca

SEQ ID NO: 7149843 - DNA, 22 bp, Homo sapiens
ttgggcagggaaaggacaggca

SEQ ID NO: 7149844 - DNA, 22 bp, Homo sapiens
ttgggcagggaaaggacaggca

SEQ ID NO: 7149845 - DNA, 22 bp, Homo sapiens
ttgggagcttggacttagtgtg

SEQ ID NO: 7149846 - DNA, 22 bp, Homo sapiens
ttgggaggtaatggagccaagt

SEQ ID NO: 7149847 - DNA, 22 bp, Homo sapiens
ttgggaggtaatggagccaagt

SEQ ID NO: 7149848 - DNA, 22 bp, Homo sapiens
ttgggcagtctggctgcagagt

SEQ ID NO: 7149849 - DNA, 22 bp, Homo sapiens
ttgggcagtctggctgcagagt

SEQ ID NO: 7149850 - DNA, 22 bp, Homo sapiens
ttgggcagtctggctgcagagt

SEQ ID NO: 7149851 - DNA, 22 bp, Homo sapiens
ttgggcagtagcctcttggtgt

SEQ ID NO: 7149852 - DNA, 22 bp, Homo sapiens
ttgggcagtctggctgcagagt

SEQ ID NO: 7149853 - DNA, 22 bp, Homo sapiens
ttgggcagtgattagttcatga

SEQ ID NO: 7149854 - DNA, 22 bp, Homo sapiens
ttgggcagtgattagttcatga

SEQ ID NO: 7149855 - DNA, 22 bp, Homo sapiens
ttgggcagtgattagttcatga

SEQ ID NO: 7149856 - DNA, 22 bp, Homo sapiens
ttgggcagtgattagttcatga

SEQ ID NO: 7149857 - DNA, 22 bp, Homo sapiens
ttgggccaaagatgtccttgtt

SEQ ID NO: 7149858 - DNA, 22 bp, Homo sapiens
ttgggcccatggggctaagcta

SEQ ID NO: 7149859 - DNA, 22 bp, Homo sapiens
ttgggacatctggcatacagtt

SEQ ID NO: 7149860 - DNA, 22 bp, Homo sapiens
ttgggacattatcagtctgcag

SEQ ID NO: 7149861 - DNA, 22 bp, Homo sapiens
ttgggacattatcagtctgcag

SEQ ID NO: 7149862 - DNA, 22 bp, Homo sapiens
ttgggacattatcagtctgcag

SEQ ID NO: 7149863 - DNA, 22 bp, Homo sapiens
ttgggagacaaaggctctgtct

SEQ ID NO: 7149864 - DNA, 17 bp, Homo sapiens
ttgggagagaaaggtat

SEQ ID NO: 7149865 - DNA, 22 bp, Homo sapiens
ttgggagatggggagataatat

SEQ ID NO: 7149866 - DNA, 22 bp, Homo sapiens
ttgggagattcattgagccaag

SEQ ID NO: 7149867 - DNA, 22 bp, Homo sapiens
ttggcagggccaggctctctct

SEQ ID NO: 7149868 - DNA, 22 bp, Homo sapiens
ttggcagggctgcttgtctagg

SEQ ID NO: 7149869 - DNA, 22 bp, Homo sapiens
ttggcagggctgcttgtctagg

SEQ ID NO: 7149870 - DNA, 22 bp, Homo sapiens
ttggcagggcatcagacacgtg

SEQ ID NO: 7149871 - DNA, 22 bp, Homo sapiens
ttggcagggcatcagacacgtg

SEQ ID NO: 7149872 - DNA, 22 bp, Homo sapiens
ttggcaggaatattgcagaggt

SEQ ID NO: 7149873 - DNA, 22 bp, Homo sapiens
ttggcaggatgatagctttgtg

SEQ ID NO: 7149874 - DNA, 22 bp, Homo sapiens
ttggcaggaatattgcagaggt

SEQ ID NO: 7149875 - DNA, 22 bp, Homo sapiens
ttggcaggaatattgcagaggt

SEQ ID NO: 7149876 - DNA, 22 bp, Homo sapiens
ttggcagctcttgatggcaccc

SEQ ID NO: 7149877 - DNA, 22 bp, Homo sapiens
ttggcagcattccagccaagca

SEQ ID NO: 7149878 - DNA, 22 bp, Homo sapiens
ttggaggactagttaagagacc

SEQ ID NO: 7149879 - DNA, 22 bp, Homo sapiens
ttggaggaagctcatgggggat

SEQ ID NO: 7149880 - DNA, 22 bp, Homo sapiens
ttggaggaagctcatgggggat

SEQ ID NO: 7149881 - DNA, 22 bp, Homo sapiens
ttggaggactagttaagagacc

SEQ ID NO: 7149882 - DNA, 22 bp, Homo sapiens
ttggaggactagttaagagacc

SEQ ID NO: 7149883 - DNA, 22 bp, Homo sapiens
ttggagctaccaggaagggctg

SEQ ID NO: 7149884 - DNA, 22 bp, Homo sapiens
ttggaggaaagaaggttgatat

SEQ ID NO: 7149885 - DNA, 22 bp, Homo sapiens
ttggaggaaattgcttttgtgg

SEQ ID NO: 7149886 - DNA, 22 bp, Homo sapiens
ttggaggaaattgcttttgtgg

SEQ ID NO: 7149887 - DNA, 22 bp, Homo sapiens
ttggaggaagctcatgggggat

SEQ ID NO: 7149888 - DNA, 22 bp, Homo sapiens
ttggaggaagctcatgggggat

SEQ ID NO: 7149889 - DNA, 22 bp, Homo sapiens
ttggaggaggcattggaggatt

SEQ ID NO: 7149890 - DNA, 22 bp, Homo sapiens
ttggaggaggcattggaggatt

SEQ ID NO: 7149891 - DNA, 22 bp, Homo sapiens
ttggaggaggcattggaggatt

SEQ ID NO: 7149892 - DNA, 22 bp, Homo sapiens
ttggcagcagggagttggccgc

SEQ ID NO: 7149893 - DNA, 22 bp, Homo sapiens
ttggagatatcacaccttcaca

SEQ ID NO: 7149894 - DNA, 22 bp, Homo sapiens
ttggagatatcacaccttcaca

SEQ ID NO: 7149895 - DNA, 22 bp, Homo sapiens
ttggagatatcacaccttcaca

SEQ ID NO: 7149896 - DNA, 22 bp, Homo sapiens
ttggagatatgtgaaaaaaaca

SEQ ID NO: 7149897 - DNA, 22 bp, Homo sapiens
ttggagatatgtgaaaaaaaca

SEQ ID NO: 7149898 - DNA, 22 bp, Homo sapiens
ttggagccatgcccagctctct

SEQ ID NO: 7149899 - DNA, 22 bp, Homo sapiens
ttggagccctgaggatctggat

SEQ ID NO: 7149900 - DNA, 22 bp, Homo sapiens
ttggagagtgatattcagatgc

SEQ ID NO: 7149901 - DNA, 22 bp, Homo sapiens
ttggagagtgatattcagatgc

SEQ ID NO: 7149902 - DNA, 22 bp, Homo sapiens
ttggagagggcttggatcacac

SEQ ID NO: 7149903 - DNA, 22 bp, Homo sapiens
ttggagagatttaggtctcagt

SEQ ID NO: 7149904 - DNA, 22 bp, Homo sapiens
ttggagaggcagtcttgctctg

SEQ ID NO: 7149905 - DNA, 22 bp, Homo sapiens
ttggacagtactttaaagcaga

SEQ ID NO: 7149906 - DNA, 22 bp, Homo sapiens
ttggacagtgcagatctacacg

SEQ ID NO: 7149907 - DNA, 22 bp, Homo sapiens
ttggacatttattgagtgtggt

SEQ ID NO: 7149908 - DNA, 22 bp, Homo sapiens
ttggaccaaattaaaagttggc

SEQ ID NO: 7149909 - DNA, 22 bp, Homo sapiens
ttggaccaaggtctgctctttc

SEQ ID NO: 7149910 - DNA, 22 bp, Homo sapiens
ttggaccaattcctgatatttt

SEQ ID NO: 7149911 - DNA, 23 bp, Homo sapiens
ttggaccactactgttttctctt

SEQ ID NO: 7149912 - DNA, 17 bp, Homo sapiens
ttggaccagattctaaa

SEQ ID NO: 7149913 - DNA, 22 bp, Homo sapiens
ttggaccagtggattatggtgg

SEQ ID NO: 7149914 - DNA, 21 bp, Homo sapiens
ttggaccatacaagttatgca

SEQ ID NO: 7149915 - DNA, 22 bp, Homo sapiens
ttggaccatcagctcctcctgg

SEQ ID NO: 7149916 - DNA, 22 bp, Homo sapiens
ttggaccatggtagggaacttg

SEQ ID NO: 7149917 - DNA, 18 bp, Homo sapiens
ttggacctgtgtcagggc

SEQ ID NO: 7149918 - DNA, 22 bp, Homo sapiens
ttggaccattgacctgatctac

SEQ ID NO: 7149919 - DNA, 22 bp, Homo sapiens
ttggacgctcctaagaccaagc

SEQ ID NO: 7149920 - DNA, 22 bp, Homo sapiens
ttggactcaaaaggagatttac

SEQ ID NO: 7149921 - DNA, 22 bp, Homo sapiens
ttggactcatgatcacttcggg

SEQ ID NO: 7149922 - DNA, 22 bp, Homo sapiens
ttggactcctctttcctcttgg

SEQ ID NO: 7149923 - DNA, 22 bp, Homo sapiens
ttggactcctctttcctcttgg

SEQ ID NO: 7149924 - DNA, 22 bp, Homo sapiens
ttggactctgggattctggatt

SEQ ID NO: 7149925 - DNA, 22 bp, Homo sapiens
ttggactctgggattctggatt

SEQ ID NO: 7149926 - DNA, 22 bp, Homo sapiens
ttggactgaatctttctcacac

SEQ ID NO: 7149927 - DNA, 22 bp, Homo sapiens
ttggactgagagttccaccatt

SEQ ID NO: 7149928 - DNA, 22 bp, Homo sapiens
ttggactggtttacatttcaag

SEQ ID NO: 7149929 - DNA, 22 bp, Homo sapiens
ttggacttaacaaagggtgatg

SEQ ID NO: 7149930 - DNA, 22 bp, Homo sapiens
ttggagagaggctgctcaggct

SEQ ID NO: 7149931 - DNA, 22 bp, Homo sapiens
ttgcagagtggttgtgaggatt

SEQ ID NO: 7149932 - DNA, 22 bp, Homo sapiens
ttgcagagtggttgtgaggatt

SEQ ID NO: 7149933 - DNA, 22 bp, Homo sapiens
ttgcagatatatggagtgcatt

SEQ ID NO: 7149934 - DNA, 22 bp, Homo sapiens
ttgcagaggcaaaaatgaactc

SEQ ID NO: 7149935 - DNA, 22 bp, Homo sapiens
ttgcagaggcaaaaatgaactc

SEQ ID NO: 7149936 - DNA, 22 bp, Homo sapiens
ttgcagagccatgaggctggct

SEQ ID NO: 7149937 - DNA, 22 bp, Homo sapiens
ttgcagagccatgaggctggct

SEQ ID NO: 7149938 - DNA, 22 bp, Homo sapiens
ttgcagagccatgaggctggct

SEQ ID NO: 7149939 - DNA, 22 bp, Homo sapiens
ttgcagagcagtaggaatatag

SEQ ID NO: 7149940 - DNA, 22 bp, Homo sapiens
ttgcagagcagtaggaatatag

SEQ ID NO: 7149941 - DNA, 22 bp, Homo sapiens
ttgcagagaggttaggaactca

SEQ ID NO: 7149942 - DNA, 22 bp, Homo sapiens
ttgcagacttacttcgagaaat

SEQ ID NO: 7149943 - DNA, 22 bp, Homo sapiens
ttgcagacccttactgctagag

SEQ ID NO: 7149944 - DNA, 22 bp, Homo sapiens
ttgcagaatacttattctgtat

SEQ ID NO: 7149945 - DNA, 22 bp, Homo sapiens
ttgcagaatctcaggaaggaga

SEQ ID NO: 7149946 - DNA, 22 bp, Homo sapiens
ttgcagaattaagcagagagcc

SEQ ID NO: 7149947 - DNA, 22 bp, Homo sapiens
ttgcagaacttaaagacagagt

SEQ ID NO: 7149948 - DNA, 22 bp, Homo sapiens
ttgcagaagggcacagtgatca

SEQ ID NO: 7149949 - DNA, 22 bp, Homo sapiens
ttgcagaagggcacagtgatca

SEQ ID NO: 7149950 - DNA, 22 bp, Homo sapiens
ttgcagaatacttattctgtat

SEQ ID NO: 7149951 - DNA, 22 bp, Homo sapiens
ttgacagaatgttacatataga

SEQ ID NO: 7149952 - DNA, 22 bp, Homo sapiens
ttgacagagaaaagtgtgactt

SEQ ID NO: 7149953 - DNA, 22 bp, Homo sapiens
ttgacagagctaggtcaactct

SEQ ID NO: 7149954 - DNA, 22 bp, Homo sapiens
ttgacagatgtgaaagtgagca

SEQ ID NO: 7149955 - DNA, 22 bp, Homo sapiens
ttgacagcaaagattgtgccta

SEQ ID NO: 7149956 - DNA, 22 bp, Homo sapiens
ttgacagctacctacatggtgg

SEQ ID NO: 7149957 - DNA, 22 bp, Homo sapiens
ttgacagctacggagcagctgt

SEQ ID NO: 7149958 - DNA, 22 bp, Homo sapiens
ttgacacagttttctcattaag

SEQ ID NO: 7149959 - DNA, 22 bp, Homo sapiens
ttgacactaagatttccaaaca

SEQ ID NO: 7149960 - DNA, 22 bp, Homo sapiens
ttgacagaaatgtatttgcatg

SEQ ID NO: 7149961 - DNA, 22 bp, Homo sapiens
ttgacagaaatgtatttgcatg

SEQ ID NO: 7149962 - DNA, 22 bp, Homo sapiens
ttgacagaaatgtatttgcatg

SEQ ID NO: 7149963 - DNA, 22 bp, Homo sapiens
ttgacagaatgttacatataga

SEQ ID NO: 7149964 - DNA, 21 bp, Homo sapiens
ttgacaggaaagaggggagat

SEQ ID NO: 7149965 - DNA, 22 bp, Homo sapiens
ttgacagctattttgctttgat

SEQ ID NO: 7149966 - DNA, 22 bp, Homo sapiens
ttgacaggatataaagacataa

SEQ ID NO: 7149967 - DNA, 23 bp, Homo sapiens
ttgacagtaggtggttttcattg

SEQ ID NO: 7149968 - DNA, 22 bp, Homo sapiens
ttgcaattgctatggagagcgt

SEQ ID NO: 7149969 - DNA, 22 bp, Homo sapiens
ttgcaattgctatggagagcgt

SEQ ID NO: 7149970 - DNA, 22 bp, Homo sapiens
ttgcaattgctatggagagcgt

SEQ ID NO: 7149971 - DNA, 21 bp, Homo sapiens
ttgcacagaaaaccatagaga

SEQ ID NO: 7149972 - DNA, 22 bp, Homo sapiens
ttgacacaatgtatattttcaa

SEQ ID NO: 7149973 - DNA, 22 bp, Homo sapiens
ttgacacaaacagtgatgtagt

SEQ ID NO: 7149974 - DNA, 22 bp, Homo sapiens
ttgacacaaacagtgatgtagt

SEQ ID NO: 7149975 - DNA, 22 bp, Homo sapiens
ttgacacaaacagtgatgtagt

SEQ ID NO: 7149976 - DNA, 22 bp, Homo sapiens
ttgacacaatcatggcagacat

SEQ ID NO: 7149977 - DNA, 22 bp, Homo sapiens
ttgacacagatcaatattcaac

SEQ ID NO: 7149978 - DNA, 22 bp, Homo sapiens
ttgacacagatcaatattcaac

SEQ ID NO: 7149979 - DNA, 22 bp, Homo sapiens
ttgacacagatcaatattcaac

SEQ ID NO: 7149980 - DNA, 22 bp, Homo sapiens
ttgacaatgtcctttgaatttc

SEQ ID NO: 7149981 - DNA, 22 bp, Homo sapiens
ttgacaattgggagatataaag

SEQ ID NO: 7149982 - DNA, 22 bp, Homo sapiens
ttgacaattgggagatataaag

SEQ ID NO: 7149983 - DNA, 22 bp, Homo sapiens
ttgacaatgcactgtgctaagt

SEQ ID NO: 7149984 - DNA, 22 bp, Homo sapiens
ttgacaatgtcctttgaatttc

SEQ ID NO: 7149985 - DNA, 22 bp, Homo sapiens
ttgacaatgtcctttgaatttc

SEQ ID NO: 7149986 - DNA, 22 bp, Homo sapiens
ttgacaatgtcctttgaatttc

SEQ ID NO: 7149987 - DNA, 22 bp, Homo sapiens
ttgacaagtggagatatttaag

SEQ ID NO: 7149988 - DNA, 22 bp, Homo sapiens
ttgacaatccctgttagaagtg

SEQ ID NO: 7149989 - DNA, 22 bp, Homo sapiens
ttgacaatccctgttagaagtg

SEQ ID NO: 7149990 - DNA, 22 bp, Homo sapiens
ttgacaagaatcgttgccttgg

SEQ ID NO: 7149991 - DNA, 22 bp, Homo sapiens
ttgacaagcgaagtaccataat

SEQ ID NO: 7149992 - DNA, 22 bp, Homo sapiens
ttgacaagcgaagtaccataat

SEQ ID NO: 7149993 - DNA, 22 bp, Homo sapiens
ttgacaaagtttagtaataatc

SEQ ID NO: 7149994 - DNA, 22 bp, Homo sapiens
ttgacaaagtttagtaataatc

SEQ ID NO: 7149995 - DNA, 22 bp, Homo sapiens
ttgacaaatacccattagacca

SEQ ID NO: 7149996 - DNA, 22 bp, Homo sapiens
ttgacaaatacccattagacca

SEQ ID NO: 7149997 - DNA, 22 bp, Homo sapiens
ttgacaaatacccattagacca

SEQ ID NO: 7149998 - DNA, 22 bp, Homo sapiens
ttgacaaaaacctcatttcacc

SEQ ID NO: 7149999 - DNA, 22 bp, Homo sapiens
ttgacaaaaacctcatttcacc

SEQ ID NO: 7150000 - DNA, 22 bp, Homo sapiens
ttgacaaaaacctcatttcacc

SEQ ID NO: 7150001 - DNA, 22 bp, Homo sapiens
ttgacaaaaataacacagcata

SEQ ID NO: 7150002 - DNA, 22 bp, Homo sapiens
ttgacaaaaataacacagcata

SEQ ID NO: 7150003 - DNA, 22 bp, Homo sapiens
ttgacaaaaataacacagcata

SEQ ID NO: 7150004 - DNA, 22 bp, Homo sapiens
ttgacaaaacaacacagatttc

SEQ ID NO: 7150005 - DNA, 22 bp, Homo sapiens
ttgacaaaacaacacagatttc

SEQ ID NO: 7150006 - DNA, 22 bp, Homo sapiens
ttgacaaaacaacacagatttc

SEQ ID NO: 7150007 - DNA, 22 bp, Homo sapiens
ttgacaaaacaacacagatttc

SEQ ID NO: 7150008 - DNA, 22 bp, Homo sapiens
ttgacaaagatatattcatgct

SEQ ID NO: 7150009 - DNA, 22 bp, Homo sapiens
ttgacaaagatatattcatgct

SEQ ID NO: 7150010 - DNA, 22 bp, Homo sapiens
ttgacaaagatatattcatgct

SEQ ID NO: 7150011 - DNA, 22 bp, Homo sapiens
ttgacaaaggaattgaatctct

SEQ ID NO: 7150012 - DNA, 22 bp, Homo sapiens
ttgacaaaggaattgaatctct

SEQ ID NO: 7150013 - DNA, 22 bp, Homo sapiens
ttgacaaaggaattgaatctct

SEQ ID NO: 7150014 - DNA, 22 bp, Homo sapiens
ttgacaaaggaattgaatctct

SEQ ID NO: 7150015 - DNA, 22 bp, Homo sapiens
ttgacaaaggaccttgctattt

SEQ ID NO: 7150016 - DNA, 22 bp, Homo sapiens
ttgacaaaggaccttgctattt

SEQ ID NO: 7150017 - DNA, 22 bp, Homo sapiens
ttgacaaaggctgagaggaaaa

SEQ ID NO: 7150018 - DNA, 22 bp, Homo sapiens
ttgacaaaggctgagaggaaaa

SEQ ID NO: 7150019 - DNA, 22 bp, Homo sapiens
ttgacaaaggctgagaggaaaa

SEQ ID NO: 7150020 - DNA, 22 bp, Homo sapiens
ttgacaaagtttagtaataatc

SEQ ID NO: 7150021 - DNA, 22 bp, Homo sapiens
ttgacaaagtttagtaataatc

SEQ ID NO: 7150022 - DNA, 22 bp, Homo sapiens
ttgcaggattttagagatgaca

SEQ ID NO: 7150023 - DNA, 22 bp, Homo sapiens
ttgcagggaaacagtttaggaa

SEQ ID NO: 7150024 - DNA, 22 bp, Homo sapiens
ttgcagggaaacagtttaggaa

SEQ ID NO: 7150025 - DNA, 22 bp, Homo sapiens
ttgcagggaaatagaaataaac

SEQ ID NO: 7150026 - DNA, 23 bp, Homo sapiens
ttgcagggatggagttcaaaatg

SEQ ID NO: 7150027 - DNA, 22 bp, Homo sapiens
ttgcagggattaccttattttt

SEQ ID NO: 7150028 - DNA, 22 bp, Homo sapiens
ttgcagggattaccttattttt

SEQ ID NO: 7150029 - DNA, 22 bp, Homo sapiens
ttgcagggataaaacaagtgaa

SEQ ID NO: 7150030 - DNA, 22 bp, Homo sapiens
ttgcagggataaaacaagtgaa

SEQ ID NO: 7150031 - DNA, 23 bp, Homo sapiens
ttgcagggatggagttcaaaatg

SEQ ID NO: 7150032 - DNA, 22 bp, Homo sapiens
ttgcagggacctgcagaaagct

SEQ ID NO: 7150033 - DNA, 22 bp, Homo sapiens
ttgcagggacctgcagaaagct

SEQ ID NO: 7150034 - DNA, 22 bp, Homo sapiens
ttgcagggaaatagaaataaac

SEQ ID NO: 7150035 - DNA, 22 bp, Homo sapiens
ttgcagggaaatcagtgaggat

SEQ ID NO: 7150036 - DNA, 22 bp, Homo sapiens
ttgcagggaaatcagtgaggat

SEQ ID NO: 7150037 - DNA, 22 bp, Homo sapiens
ttgcagcaaggtcatgaaatgt

SEQ ID NO: 7150038 - DNA, 22 bp, Homo sapiens
ttgcagcatattgatctcctgt

SEQ ID NO: 7150039 - DNA, 22 bp, Homo sapiens
ttgcagcatgcatagacactgc

SEQ ID NO: 7150040 - DNA, 22 bp, Homo sapiens
ttgcagcatgcatagacactgc

SEQ ID NO: 7150041 - DNA, 22 bp, Homo sapiens
ttgcaggggaaggagcagagct

SEQ ID NO: 7150042 - DNA, 22 bp, Homo sapiens
ttgcaggggaaggagcagagct

SEQ ID NO: 7150043 - DNA, 22 bp, Homo sapiens
ttgcaggggagaggaacaaaca

SEQ ID NO: 7150044 - DNA, 22 bp, Homo sapiens
ttgcaggggagaggaacaaaca

SEQ ID NO: 7150045 - DNA, 22 bp, Homo sapiens
ttgcagggtcccagaggcctgg

SEQ ID NO: 7150046 - DNA, 22 bp, Homo sapiens
ttgcagggtcctgtggctctcc

SEQ ID NO: 7150047 - DNA, 22 bp, Homo sapiens
ttgcagggtcctgtggctctcc

SEQ ID NO: 7150048 - DNA, 22 bp, Homo sapiens
ttgcagggtcctgtggctctcc

SEQ ID NO: 7150049 - DNA, 22 bp, Homo sapiens
ttgcagggtacattcttagaat

SEQ ID NO: 7150050 - DNA, 22 bp, Homo sapiens
ttgcagggtacattcttagaat

SEQ ID NO: 7150051 - DNA, 22 bp, Homo sapiens
ttgcagggtcccagaggcctgg

SEQ ID NO: 7150052 - DNA, 22 bp, Homo sapiens
ttgcagggcaaatggtcagata

SEQ ID NO: 7150053 - DNA, 22 bp, Homo sapiens
ttgcagggcaaatggtcagata

SEQ ID NO: 7150054 - DNA, 22 bp, Homo sapiens
ttgcagggcaggaccatggaca

SEQ ID NO: 7150055 - DNA, 22 bp, Homo sapiens
ttgcagggcaggaccatggaca

SEQ ID NO: 7150056 - DNA, 22 bp, Homo sapiens
ttgcagggcatcgcgtacttct

SEQ ID NO: 7150057 - DNA, 22 bp, Homo sapiens
ttgcagggcatcgcgtacttct

SEQ ID NO: 7150058 - DNA, 22 bp, Homo sapiens
ttgcagggcatctatgtctggt

SEQ ID NO: 7150059 - DNA, 22 bp, Homo sapiens
ttgcagggcatctatgtctggt

SEQ ID NO: 7150060 - DNA, 22 bp, Homo sapiens
ttgcagggccttggcttcttcc

SEQ ID NO: 7150061 - DNA, 22 bp, Homo sapiens
ttgcagggccttggcttcttcc

SEQ ID NO: 7150062 - DNA, 22 bp, Homo sapiens
ttgcagggctggaacatggaat

SEQ ID NO: 7150063 - DNA, 22 bp, Homo sapiens
ttgcagggctggaacatggaat

SEQ ID NO: 7150064 - DNA, 22 bp, Homo sapiens
ttgcagggcttggggattacag

SEQ ID NO: 7150065 - DNA, 22 bp, Homo sapiens
ttgcagggcttggggattacag

SEQ ID NO: 7150066 - DNA, 18 bp, Homo sapiens
ttgcaggtacctctatct

SEQ ID NO: 7150067 - DNA, 22 bp, Homo sapiens
ttgcagggttaaagtaaggtag

SEQ ID NO: 7150068 - DNA, 22 bp, Homo sapiens
ttgcagggttaaagtaaggtag

SEQ ID NO: 7150069 - DNA, 22 bp, Homo sapiens
ttgcagggttgacactgcctgc

SEQ ID NO: 7150070 - DNA, 22 bp, Homo sapiens
ttgcagggttgacactgcctgc

SEQ ID NO: 7150071 - DNA, 22 bp, Homo sapiens
ttgcagggttgaccaataggct

SEQ ID NO: 7150072 - DNA, 22 bp, Homo sapiens
ttgcagggttgaccaataggct

SEQ ID NO: 7150073 - DNA, 22 bp, Homo sapiens
ttgcagtcacactctaaagtag

SEQ ID NO: 7150074 - DNA, 22 bp, Homo sapiens
ttgcagttaaaaatcattagtt

SEQ ID NO: 7150075 - DNA, 22 bp, Homo sapiens
ttgcagttgctgtatttaagga

SEQ ID NO: 7150076 - DNA, 22 bp, Homo sapiens
ttgcagttgcatatgcccctac

SEQ ID NO: 7150077 - DNA, 22 bp, Homo sapiens
ttgcagttgcatatgcccctac

SEQ ID NO: 7150078 - DNA, 22 bp, Homo sapiens
ttgcagttgctgtatttaagga

SEQ ID NO: 7150079 - DNA, 22 bp, Homo sapiens
ttgcatggaggaacatggccca

SEQ ID NO: 7150080 - DNA, 22 bp, Homo sapiens
ttgcatggatggatggttcgat

SEQ ID NO: 7150081 - DNA, 22 bp, Homo sapiens
ttgcatgggcaacaggaggtgg

SEQ ID NO: 7150082 - DNA, 22 bp, Homo sapiens
ttgcatggggattggagcacag

SEQ ID NO: 7150083 - DNA, 22 bp, Homo sapiens
ttgcatggggattggagcacag

SEQ ID NO: 7150084 - DNA, 22 bp, Homo sapiens
ttgcatggtgtgctctgaatca

SEQ ID NO: 7150085 - DNA, 23 bp, Homo sapiens
ttgcatgtagcccatgagtaact

SEQ ID NO: 7150086 - DNA, 22 bp, Homo sapiens
ttgcttatttgattaaatgtct

SEQ ID NO: 7150087 - DNA, 22 bp, Homo sapiens
ttgcttatgcctcttgacaaag

SEQ ID NO: 7150088 - DNA, 22 bp, Homo sapiens
ttgcttatagagagtttcatac

SEQ ID NO: 7150089 - DNA, 21 bp, Homo sapiens
ttgctgttttcccaatgcagt

SEQ ID NO: 7150090 - DNA, 22 bp, Homo sapiens
ttgctgttttacatctggtggg

SEQ ID NO: 7150091 - DNA, 22 bp, Homo sapiens
ttgctgtttctctgtgtctggt

SEQ ID NO: 7150092 - DNA, 20 bp, Homo sapiens
ttgctgttgccaagattttg

SEQ ID NO: 7150093 - DNA, 22 bp, Homo sapiens
ttgctgtttaatgatgtcttat

SEQ ID NO: 7150094 - DNA, 22 bp, Homo sapiens
ttgctgtgtctgatggctgaga

SEQ ID NO: 7150095 - DNA, 22 bp, Homo sapiens
ttgctgtgtcatttgtttaatc

SEQ ID NO: 7150096 - DNA, 22 bp, Homo sapiens
ttgctgtgtaactcctggcctg

SEQ ID NO: 7150097 - DNA, 22 bp, Homo sapiens
ttgctgtgaaaccatgggaagt

SEQ ID NO: 7150098 - DNA, 23 bp, Homo sapiens
ttgctgagataaagaatgcaggg

SEQ ID NO: 7150099 - DNA, 22 bp, Homo sapiens
ttgctgaattgaatcctttggt

SEQ ID NO: 7150100 - DNA, 22 bp, Homo sapiens
ttgctgaattgaatcctttggt

SEQ ID NO: 7150101 - DNA, 22 bp, Homo sapiens
ttgctgaagtgaaggtatgttt

SEQ ID NO: 7150102 - DNA, 22 bp, Homo sapiens
ttgctgaagtgaaggtatgttt

SEQ ID NO: 7150103 - DNA, 22 bp, Homo sapiens
ttgctgaagttaatgcttgcaa

SEQ ID NO: 7150104 - DNA, 22 bp, Homo sapiens
ttgctgaagttaatgcttgcaa

SEQ ID NO: 7150105 - DNA, 22 bp, Homo sapiens
ttgctgaagttgctcagctcca

SEQ ID NO: 7150106 - DNA, 22 bp, Homo sapiens
ttgctgaagttgctcagctcca

SEQ ID NO: 7150107 - DNA, 22 bp, Homo sapiens
ttgctgaatgcaagttggatag

SEQ ID NO: 7150108 - DNA, 22 bp, Homo sapiens
ttgctgaatgcaagttggatag

SEQ ID NO: 7150109 - DNA, 22 bp, Homo sapiens
ttgctgaagaaaaaatatgtta

SEQ ID NO: 7150110 - DNA, 22 bp, Homo sapiens
ttgctgaagctgccaaaccagt

SEQ ID NO: 7150111 - DNA, 22 bp, Homo sapiens
ttgctgaagctgccaaaccagt

SEQ ID NO: 7150112 - DNA, 22 bp, Homo sapiens
ttgctgaagctgccaaaccagt

SEQ ID NO: 7150113 - DNA, 19 bp, Homo sapiens
ttgctgaaggaagcctctg

SEQ ID NO: 7150114 - DNA, 19 bp, Homo sapiens
ttgctgaaggaagcctctg

SEQ ID NO: 7150115 - DNA, 22 bp, Homo sapiens
ttgctgaaggcctcttggggtt

SEQ ID NO: 7150116 - DNA, 22 bp, Homo sapiens
ttgctgaaggcctcttggggtt

SEQ ID NO: 7150117 - DNA, 22 bp, Homo sapiens
ttgctgaagtatgaaaaagaca

SEQ ID NO: 7150118 - DNA, 22 bp, Homo sapiens
ttgctgaagtatgaaaaagaca

SEQ ID NO: 7150119 - DNA, 22 bp, Homo sapiens
ttgctgaagtattgtgaatcct

SEQ ID NO: 7150120 - DNA, 22 bp, Homo sapiens
ttgctgaagtattgtgaatcct

SEQ ID NO: 7150121 - DNA, 22 bp, Homo sapiens
ttgctgaaatctatgacatcct

SEQ ID NO: 7150122 - DNA, 22 bp, Homo sapiens
ttgctgaaatctatgacatcct

SEQ ID NO: 7150123 - DNA, 22 bp, Homo sapiens
ttgctgaaatctatgacatcct

SEQ ID NO: 7150124 - DNA, 22 bp, Homo sapiens
ttgctgaaccctgccctctaat

SEQ ID NO: 7150125 - DNA, 22 bp, Homo sapiens
ttgctgaaccctgccctctaat

SEQ ID NO: 7150126 - DNA, 22 bp, Homo sapiens
ttgctgaagaaaaaatatgtta

SEQ ID NO: 7150127 - DNA, 22 bp, Homo sapiens
ttgctgaaaggtagctgtgtgg

SEQ ID NO: 7150128 - DNA, 22 bp, Homo sapiens
ttgctgaaaggtagctgtgtgg

SEQ ID NO: 7150129 - DNA, 22 bp, Homo sapiens
ttgctgaaagtggcaagaagta

SEQ ID NO: 7150130 - DNA, 22 bp, Homo sapiens
ttgctgaaagtggcaagaagta

SEQ ID NO: 7150131 - DNA, 22 bp, Homo sapiens
ttgctgaaaacaggtcatcagg

SEQ ID NO: 7150132 - DNA, 22 bp, Homo sapiens
ttgctgaaaacaggtcatcagg

SEQ ID NO: 7150133 - DNA, 22 bp, Homo sapiens
ttgctgaaaacagtgggtattg

SEQ ID NO: 7150134 - DNA, 22 bp, Homo sapiens
ttgctgaaaacagtgggtattg

SEQ ID NO: 7150135 - DNA, 22 bp, Homo sapiens
ttgctgaaaagctggcctttgt

SEQ ID NO: 7150136 - DNA, 22 bp, Homo sapiens
ttgctgaaaagctggcctttgt

SEQ ID NO: 7150137 - DNA, 22 bp, Homo sapiens
ttgctctgtccagccagcaggt

SEQ ID NO: 7150138 - DNA, 22 bp, Homo sapiens
ttgctcttgaaaattgatgctg

SEQ ID NO: 7150139 - DNA, 22 bp, Homo sapiens
ttgctctgtcagggcctcagtc

SEQ ID NO: 7150140 - DNA, 22 bp, Homo sapiens
ttgctctgtcagggcctcagtc

SEQ ID NO: 7150141 - DNA, 22 bp, Homo sapiens
ttgctctgattaggtggaaaca

SEQ ID NO: 7150142 - DNA, 22 bp, Homo sapiens
ttgctctgaacccagggcacca

SEQ ID NO: 7150143 - DNA, 22 bp, Homo sapiens
ttgctctgactggagtgcagtg

SEQ ID NO: 7150144 - DNA, 22 bp, Homo sapiens
ttgcatttactgcaccgtgagt

SEQ ID NO: 7150145 - DNA, 22 bp, Homo sapiens
ttgcatttactgcaccgtgagt

SEQ ID NO: 7150146 - DNA, 22 bp, Homo sapiens
ttgcatttatagactgccattt

SEQ ID NO: 7150147 - DNA, 22 bp, Homo sapiens
ttgcatttatagactgccattt

SEQ ID NO: 7150148 - DNA, 22 bp, Homo sapiens
ttgcatttcaattgctcaggaa

SEQ ID NO: 7150149 - DNA, 22 bp, Homo sapiens
ttgcatttcactttcagtaggc

SEQ ID NO: 7150150 - DNA, 22 bp, Homo sapiens
ttgctccaggctgcagactctg

SEQ ID NO: 7150151 - DNA, 19 bp, Homo sapiens
ttgctcccaccccagtttt

SEQ ID NO: 7150152 - DNA, 22 bp, Homo sapiens
ttgctctccagaggctcacagc

SEQ ID NO: 7150153 - DNA, 22 bp, Homo sapiens
ttgctctcggggaggctgcagg

SEQ ID NO: 7150154 - DNA, 22 bp, Homo sapiens
ttgctctgaacccagggcacca

SEQ ID NO: 7150155 - DNA, 22 bp, Homo sapiens
ttgcatttaagtagatgttaca

SEQ ID NO: 7150156 - DNA, 22 bp, Homo sapiens
ttgcatttaagtagatgttaca

SEQ ID NO: 7150157 - DNA, 20 bp, Homo sapiens
ttgcattggatgtgcaggtg

SEQ ID NO: 7150158 - DNA, 19 bp, Homo sapiens
ttgcattgtagttggactg

SEQ ID NO: 7150159 - DNA, 21 bp, Homo sapiens
ttgcattcctgttagtataag

SEQ ID NO: 7150160 - DNA, 22 bp, Homo sapiens
ttgcattgaatgcacattttta

SEQ ID NO: 7150161 - DNA, 22 bp, Homo sapiens
ttgcatgtgtataaaagttgga

SEQ ID NO: 7150162 - DNA, 22 bp, Homo sapiens
ttgcatgtgtaatttttctaaa

SEQ ID NO: 7150163 - DNA, 22 bp, Homo sapiens
ttgcattagtgtcataaggtgg

SEQ ID NO: 7150164 - DNA, 22 bp, Homo sapiens
ttgcattccatggttttccttc

SEQ ID NO: 7150165 - DNA, 22 bp, Homo sapiens
ttgcattcccagccaagttagt

SEQ ID NO: 7150166 - DNA, 23 bp, Homo sapiens
ttgctttcatcatgagatgctcc

SEQ ID NO: 7150167 - DNA, 22 bp, Homo sapiens
ttgctttattgggtttactgcc

SEQ ID NO: 7150168 - DNA, 22 bp, Homo sapiens
ttgctttattgggtttactgcc

SEQ ID NO: 7150169 - DNA, 22 bp, Homo sapiens
ttgcttatttgattaaatgtct

SEQ ID NO: 7150170 - DNA, 22 bp, Homo sapiens
ttgcttatttgattaaatgtct

SEQ ID NO: 7150171 - DNA, 22 bp, Homo sapiens
ttgctttccgtcatgtgctaat

SEQ ID NO: 7150172 - DNA, 22 bp, Homo sapiens
ttgctttccgtcatgtgctaat

SEQ ID NO: 7150173 - DNA, 22 bp, Homo sapiens
ttggaaaatgtatttctagaag

SEQ ID NO: 7150174 - DNA, 22 bp, Homo sapiens
ttggaaacgtcaccttttcctt

SEQ ID NO: 7150175 - DNA, 22 bp, Homo sapiens
ttggaaacgtcaccttttcctt

SEQ ID NO: 7150176 - DNA, 22 bp, Homo sapiens
ttggaaacgtcaccttttcctt

SEQ ID NO: 7150177 - DNA, 22 bp, Homo sapiens
ttggaaagattattattatgaa

SEQ ID NO: 7150178 - DNA, 22 bp, Homo sapiens
ttggaaagcaacttttgagagt

SEQ ID NO: 7150179 - DNA, 22 bp, Homo sapiens
ttggaaagcaacttttgagagt

SEQ ID NO: 7150180 - DNA, 22 bp, Homo sapiens
ttggaaagcaagctggacatac

SEQ ID NO: 7150181 - DNA, 22 bp, Homo sapiens
ttggaaagcaagctggacatac

SEQ ID NO: 7150182 - DNA, 22 bp, Homo sapiens
ttggaaagattattattatgaa

SEQ ID NO: 7150183 - DNA, 22 bp, Homo sapiens
ttggaaagattattattatgaa

SEQ ID NO: 7150184 - DNA, 22 bp, Homo sapiens
ttggaaagaccgaattcctgtt

SEQ ID NO: 7150185 - DNA, 22 bp, Homo sapiens
ttggaaacgtcaccttttcctt

SEQ ID NO: 7150186 - DNA, 22 bp, Homo sapiens
ttggaaactttcaagcataatg

SEQ ID NO: 7150187 - DNA, 22 bp, Homo sapiens
ttggaaagaagggctgagcaag

SEQ ID NO: 7150188 - DNA, 22 bp, Homo sapiens
ttggaaaggagtttttagctat

SEQ ID NO: 7150189 - DNA, 22 bp, Homo sapiens
ttggaaaggagtttttagctat

SEQ ID NO: 7150190 - DNA, 22 bp, Homo sapiens
ttggaaagggaggaatgtagac

SEQ ID NO: 7150191 - DNA, 22 bp, Homo sapiens
ttggaaagcagccgcagccaat

SEQ ID NO: 7150192 - DNA, 22 bp, Homo sapiens
ttggaaagcccattatttggac

SEQ ID NO: 7150193 - DNA, 22 bp, Homo sapiens
ttggaaagcccattatttggac

SEQ ID NO: 7150194 - DNA, 22 bp, Homo sapiens
ttggaaaggagattctattgtg

SEQ ID NO: 7150195 - DNA, 22 bp, Homo sapiens
ttggaaagtttttactgaagac

SEQ ID NO: 7150196 - DNA, 22 bp, Homo sapiens
ttggaaagtctcacccagttga

SEQ ID NO: 7150197 - DNA, 22 bp, Homo sapiens
ttggaaagtgacgttcaactgt

SEQ ID NO: 7150198 - DNA, 22 bp, Homo sapiens
ttggaaaggtgcttttgtctgt

SEQ ID NO: 7150199 - DNA, 22 bp, Homo sapiens
ttggaaaggtgcttttgtctgt

SEQ ID NO: 7150200 - DNA, 22 bp, Homo sapiens
ttggaaagggatatctgtactt

SEQ ID NO: 7150201 - DNA, 22 bp, Homo sapiens
ttggaaatacagcagttacttt

SEQ ID NO: 7150202 - DNA, 22 bp, Homo sapiens
ttggaaatacgagtagtatcat

SEQ ID NO: 7150203 - DNA, 22 bp, Homo sapiens
ttggaaatacagcagttacttt

SEQ ID NO: 7150204 - DNA, 22 bp, Homo sapiens
ttggaaagtttttactgaagac

SEQ ID NO: 7150205 - DNA, 22 bp, Homo sapiens
ttggaaatacagcagttacttt

SEQ ID NO: 7150206 - DNA, 22 bp, Homo sapiens
ttggaaatgatttctattatta

SEQ ID NO: 7150207 - DNA, 22 bp, Homo sapiens
ttggaaatgcaaatatattgaa

SEQ ID NO: 7150208 - DNA, 22 bp, Homo sapiens
ttggaaatggctgtagttatga

SEQ ID NO: 7150209 - DNA, 23 bp, Homo sapiens
ttggaaatggggagaacagattc

SEQ ID NO: 7150210 - DNA, 22 bp, Homo sapiens
ttggaaatgtagaaaagcagat

SEQ ID NO: 7150211 - DNA, 22 bp, Homo sapiens
ttggaaatggctgtagttatga

SEQ ID NO: 7150212 - DNA, 22 bp, Homo sapiens
ttggaaattgcaagtgatttgc

SEQ ID NO: 7150213 - DNA, 21 bp, Homo sapiens
ttggaacaagcagcagtttgc

SEQ ID NO: 7150214 - DNA, 22 bp, Homo sapiens
ttggaaattgcaagtgatttgc

SEQ ID NO: 7150215 - DNA, 21 bp, Homo sapiens
ttggaacaagcagcagtttgc

SEQ ID NO: 7150216 - DNA, 22 bp, Homo sapiens
ttggaacaatcacatccttgct

SEQ ID NO: 7150217 - DNA, 22 bp, Homo sapiens
ttggacagtaaattgtgcttaa

SEQ ID NO: 7150218 - DNA, 20 bp, Homo sapiens
ttggacagacgcattgacac

SEQ ID NO: 7150219 - DNA, 22 bp, Homo sapiens
ttggacagcacagacatagaat

SEQ ID NO: 7150220 - DNA, 22 bp, Homo sapiens
ttggacactgagactagcaagc

SEQ ID NO: 7150221 - DNA, 22 bp, Homo sapiens
ttggacacactgattggccagg

SEQ ID NO: 7150222 - DNA, 22 bp, Homo sapiens
ttggacagaattttgtgtgtgt

SEQ ID NO: 7150223 - DNA, 20 bp, Homo sapiens
ttggacagacgcattgacac

SEQ ID NO: 7150224 - DNA, 22 bp, Homo sapiens
ttggaattggacatgttgaagg

SEQ ID NO: 7150225 - DNA, 22 bp, Homo sapiens
ttcaaacactgttggcactggg

SEQ ID NO: 7150226 - DNA, 22 bp, Homo sapiens
ttcaaacactgttggcactggg

SEQ ID NO: 7150227 - DNA, 22 bp, Homo sapiens
ttcaaacactggcttagccaat

SEQ ID NO: 7150228 - DNA, 22 bp, Homo sapiens
ttcaaacactgctttgagaggg

SEQ ID NO: 7150229 - DNA, 22 bp, Homo sapiens
ttcaaacactggcttagccaat

SEQ ID NO: 7150230 - DNA, 22 bp, Homo sapiens
ttcaaacaggggtcagggagat

SEQ ID NO: 7150231 - DNA, 22 bp, Homo sapiens
ttcaaacaggggtcagggagat

SEQ ID NO: 7150232 - DNA, 23 bp, Homo sapiens
ttcaaacagctacaagggggtgg

SEQ ID NO: 7150233 - DNA, 22 bp, Homo sapiens
ttcaaacagatgactctgctct

SEQ ID NO: 7150234 - DNA, 22 bp, Homo sapiens
ttcaaacagatgactctgctct

SEQ ID NO: 7150235 - DNA, 22 bp, Homo sapiens
ttattgtgaggaataagtgaga

SEQ ID NO: 7150236 - DNA, 22 bp, Homo sapiens
ttattgtgaggaataagtgaga

SEQ ID NO: 7150237 - DNA, 22 bp, Homo sapiens
ttattgtggactactgttctgg

SEQ ID NO: 7150238 - DNA, 22 bp, Homo sapiens
ttattgtggcagaggtatggtt

SEQ ID NO: 7150239 - DNA, 22 bp, Homo sapiens
ttcaaactcttgctctgctagt

SEQ ID NO: 7150240 - DNA, 22 bp, Homo sapiens
ttcaaactcttgctctgctagt

SEQ ID NO: 7150241 - DNA, 22 bp, Homo sapiens
ttcaaactatgacttcagctac

SEQ ID NO: 7150242 - DNA, 22 bp, Homo sapiens
ttcaaactatgacttcagctac

SEQ ID NO: 7150243 - DNA, 22 bp, Homo sapiens
ttcaaaccttcacttgcagagt

SEQ ID NO: 7150244 - DNA, 22 bp, Homo sapiens
ttcaaacagtgtagaatatatg

SEQ ID NO: 7150245 - DNA, 22 bp, Homo sapiens
ttcaaacagtgtagaatatatg

SEQ ID NO: 7150246 - DNA, 22 bp, Homo sapiens
ttcaaacagttgcacaacttat

SEQ ID NO: 7150247 - DNA, 22 bp, Homo sapiens
ttcaaacagttgcacaacttat

SEQ ID NO: 7150248 - DNA, 22 bp, Homo sapiens
ttcaaacagttgcacaacttat

SEQ ID NO: 7150249 - DNA, 22 bp, Homo sapiens
ttcaaacattcaaataaaccgg

SEQ ID NO: 7150250 - DNA, 22 bp, Homo sapiens
ttcaaacattcaaataaaccgg

SEQ ID NO: 7150251 - DNA, 22 bp, Homo sapiens
ttattgtcaaaaacaggacact

SEQ ID NO: 7150252 - DNA, 17 bp, Homo sapiens
ttattgtcaaggttcca

SEQ ID NO: 7150253 - DNA, 22 bp, Homo sapiens
ttattgtaggcctattgtagaa

SEQ ID NO: 7150254 - DNA, 22 bp, Homo sapiens
ttattggattcttgccccaggt

SEQ ID NO: 7150255 - DNA, 22 bp, Homo sapiens
ttattgggtcccaacaagttgc

SEQ ID NO: 7150256 - DNA, 18 bp, Homo sapiens
ttattggtgctgctgttc

SEQ ID NO: 7150257 - DNA, 22 bp, Homo sapiens
ttattgtagcactttggcagtg

SEQ ID NO: 7150258 - DNA, 22 bp, Homo sapiens
ttattgtaggcctattgtagaa

SEQ ID NO: 7150259 - DNA, 22 bp, Homo sapiens
ttattgtaggcctattgtagaa

SEQ ID NO: 7150260 - DNA, 22 bp, Homo sapiens
ttattgagcacatagtatgtgg

SEQ ID NO: 7150261 - DNA, 22 bp, Homo sapiens
ttattgagcacctactatgtgt

SEQ ID NO: 7150262 - DNA, 22 bp, Homo sapiens
ttattgagcacctactatgtgt

SEQ ID NO: 7150263 - DNA, 22 bp, Homo sapiens
ttattgagcacctactatgtgt

SEQ ID NO: 7150264 - DNA, 16 bp, Homo sapiens
ttattgaggccaagga

SEQ ID NO: 7150265 - DNA, 22 bp, Homo sapiens
ttattgctgctaacattttatg

SEQ ID NO: 7150266 - DNA, 22 bp, Homo sapiens
ttattgctgctaacattttatg

SEQ ID NO: 7150267 - DNA, 22 bp, Homo sapiens
ttattgcttttgtgcaggtgag

SEQ ID NO: 7150268 - DNA, 22 bp, Homo sapiens
ttattggaaaagggctgtaatt

SEQ ID NO: 7150269 - DNA, 22 bp, Homo sapiens
ttattggagtctgctgtccttt

SEQ ID NO: 7150270 - DNA, 22 bp, Homo sapiens
ttattgaagcaagcttttctga

SEQ ID NO: 7150271 - DNA, 22 bp, Homo sapiens
ttattgaaggaactgaaataaa

SEQ ID NO: 7150272 - DNA, 22 bp, Homo sapiens
ttattgaaggaactgaaataaa

SEQ ID NO: 7150273 - DNA, 22 bp, Homo sapiens
ttattgaagcaagcttttctga

SEQ ID NO: 7150274 - DNA, 22 bp, Homo sapiens
ttattgactcccagcttttcca

SEQ ID NO: 7150275 - DNA, 22 bp, Homo sapiens
ttattgactgaaatgagagtga

SEQ ID NO: 7150276 - DNA, 22 bp, Homo sapiens
ttattgactgatcagagaggga

SEQ ID NO: 7150277 - DNA, 22 bp, Homo sapiens
ttattgacttgtttgtcctggt

SEQ ID NO: 7150278 - DNA, 21 bp, Homo sapiens
ttattgagacatttgtggaaa

SEQ ID NO: 7150279 - DNA, 21 bp, Homo sapiens
ttattgagacatttgtggaaa

SEQ ID NO: 7150280 - DNA, 21 bp, Homo sapiens
ttattgagacatttgtggaaa

SEQ ID NO: 7150281 - DNA, 22 bp, Homo sapiens
ttattgagaccgtaagtcaggt

SEQ ID NO: 7150282 - DNA, 22 bp, Homo sapiens
ttattgagaccgtaagtcaggt

SEQ ID NO: 7150283 - DNA, 22 bp, Homo sapiens
ttattgagaccgtaagtcaggt

SEQ ID NO: 7150284 - DNA, 22 bp, Homo sapiens
ttattgagagctgttttatggc

SEQ ID NO: 7150285 - DNA, 22 bp, Homo sapiens
ttattgagagctgttttatggc

SEQ ID NO: 7150286 - DNA, 22 bp, Homo sapiens
ttattgagagctgttttatggc

SEQ ID NO: 7150287 - DNA, 22 bp, Homo sapiens
ttattgagcaactctggggctc

SEQ ID NO: 7150288 - DNA, 22 bp, Homo sapiens
ttattgagcaactctggggctc

SEQ ID NO: 7150289 - DNA, 22 bp, Homo sapiens
ttattgagcacatagtatgtgg

SEQ ID NO: 7150290 - DNA, 22 bp, Homo sapiens
ttattgagcacatagtatgtgg

SEQ ID NO: 7150291 - DNA, 22 bp, Homo sapiens
ttattagggtggtttatgttct

SEQ ID NO: 7150292 - DNA, 22 bp, Homo sapiens
ttattagggtggtttatgttct

SEQ ID NO: 7150293 - DNA, 22 bp, Homo sapiens
ttattaggttattctctgtact

SEQ ID NO: 7150294 - DNA, 22 bp, Homo sapiens
ttattaggttattctctgtact

SEQ ID NO: 7150295 - DNA, 22 bp, Homo sapiens
ttattaggtttacataaaggtt

SEQ ID NO: 7150296 - DNA, 22 bp, Homo sapiens
ttattagtgttgatattaggat

SEQ ID NO: 7150297 - DNA, 22 bp, Homo sapiens
ttattataatgagggataaaaa

SEQ ID NO: 7150298 - DNA, 22 bp, Homo sapiens
ttattagatctgttagggatcc

SEQ ID NO: 7150299 - DNA, 22 bp, Homo sapiens
ttattagctgggcttcagggtg

SEQ ID NO: 7150300 - DNA, 22 bp, Homo sapiens
ttattagagtgctttgagaaag

SEQ ID NO: 7150301 - DNA, 22 bp, Homo sapiens
ttattagagtgctttgagaaag

SEQ ID NO: 7150302 - DNA, 22 bp, Homo sapiens
ttattagctgggcttcagggtg

SEQ ID NO: 7150303 - DNA, 22 bp, Homo sapiens
ttattaggaaaaggtcagatgt

SEQ ID NO: 7150304 - DNA, 22 bp, Homo sapiens
ttattaggaaaaggtcagatgt

SEQ ID NO: 7150305 - DNA, 22 bp, Homo sapiens
ttattaggaactcaggattttt

SEQ ID NO: 7150306 - DNA, 22 bp, Homo sapiens
ttattacagtcccagggagtag

SEQ ID NO: 7150307 - DNA, 22 bp, Homo sapiens
ttattactgtattaatccagag

SEQ ID NO: 7150308 - DNA, 22 bp, Homo sapiens
ttattagagtgctttgagaaag

SEQ ID NO: 7150309 - DNA, 22 bp, Homo sapiens
ttattagagatatttggttagg

SEQ ID NO: 7150310 - DNA, 22 bp, Homo sapiens
ttattagagatatttggttagg

SEQ ID NO: 7150311 - DNA, 22 bp, Homo sapiens
ttattacactgaaagaattgcg

SEQ ID NO: 7150312 - DNA, 22 bp, Homo sapiens
ttattacactgaaagaattgcg

SEQ ID NO: 7150313 - DNA, 22 bp, Homo sapiens
ttattacactgaaagaattgcg

SEQ ID NO: 7150314 - DNA, 22 bp, Homo sapiens
ttattatggtatttctttgcag

SEQ ID NO: 7150315 - DNA, 22 bp, Homo sapiens
ttattatgtgctagagaatgta

SEQ ID NO: 7150316 - DNA, 22 bp, Homo sapiens
ttattatgtgctagagaatgta

SEQ ID NO: 7150317 - DNA, 22 bp, Homo sapiens
ttattatggtatttctttgcag

SEQ ID NO: 7150318 - DNA, 22 bp, Homo sapiens
ttattatggcagttttctaggt

SEQ ID NO: 7150319 - DNA, 22 bp, Homo sapiens
ttattatggcagttttctaggt

SEQ ID NO: 7150320 - DNA, 22 bp, Homo sapiens
ttattatgccattacctccctg

SEQ ID NO: 7150321 - DNA, 22 bp, Homo sapiens
ttattataatgagggataaaaa

SEQ ID NO: 7150322 - DNA, 22 bp, Homo sapiens
ttattatagattatgcaagatt

SEQ ID NO: 7150323 - DNA, 22 bp, Homo sapiens
ttattatagattatgcaagatt

SEQ ID NO: 7150324 - DNA, 22 bp, Homo sapiens
ttattataatgagggataaaaa

SEQ ID NO: 7150325 - DNA, 22 bp, Homo sapiens
ttattatagattatgcaagatt

SEQ ID NO: 7150326 - DNA, 22 bp, Homo sapiens
ttattatagattatgcaagatt

SEQ ID NO: 7150327 - DNA, 22 bp, Homo sapiens
ttattatagattatgcaagatt

SEQ ID NO: 7150328 - DNA, 22 bp, Homo sapiens
ttattatgtggatgaaagatgt

SEQ ID NO: 7150329 - DNA, 22 bp, Homo sapiens
ttattctttaaacatatatgtt

SEQ ID NO: 7150330 - DNA, 22 bp, Homo sapiens
ttattctttaaacatatatgtt

SEQ ID NO: 7150331 - DNA, 22 bp, Homo sapiens
ttattatgtggatgaaagatgt

SEQ ID NO: 7150332 - DNA, 22 bp, Homo sapiens
ttattatgtgctagagaatgta

SEQ ID NO: 7150333 - DNA, 22 bp, Homo sapiens
ttattatgtggatgaaagatgt

SEQ ID NO: 7150334 - DNA, 22 bp, Homo sapiens
ttattctttaaacatatatgtt

SEQ ID NO: 7150335 - DNA, 22 bp, Homo sapiens
ttattctttaaacatatatgtt

SEQ ID NO: 7150336 - DNA, 22 bp, Homo sapiens
ttattctttaaacatatatgtt

SEQ ID NO: 7150337 - DNA, 22 bp, Homo sapiens
ttattcttttctccagaatccc

SEQ ID NO: 7150338 - DNA, 22 bp, Homo sapiens
ttattcttttctccagaatccc

SEQ ID NO: 7150339 - DNA, 22 bp, Homo sapiens
ttattcttttctccagaatccc

SEQ ID NO: 7150340 - DNA, 22 bp, Homo sapiens
ttattcttttctccagaatccc

SEQ ID NO: 7150341 - DNA, 22 bp, Homo sapiens
ttatatcagaaggtgagattga

SEQ ID NO: 7150342 - DNA, 22 bp, Homo sapiens
ttatatatcttgatttgttcca

SEQ ID NO: 7150343 - DNA, 22 bp, Homo sapiens
ttatatatatgtagaggtcacg

SEQ ID NO: 7150344 - DNA, 22 bp, Homo sapiens
ttatatatatgtagaggtcacg

SEQ ID NO: 7150345 - DNA, 19 bp, Homo sapiens
ttatatacttggtttctct

SEQ ID NO: 7150346 - DNA, 22 bp, Homo sapiens
ttatatgattgaagtgcataag

SEQ ID NO: 7150347 - DNA, 22 bp, Homo sapiens
ttatatgattgagcatcttggt

SEQ ID NO: 7150348 - DNA, 22 bp, Homo sapiens
ttatatgaactggactttagga

SEQ ID NO: 7150349 - DNA, 22 bp, Homo sapiens
ttatatgagtatcatatcactt

SEQ ID NO: 7150350 - DNA, 22 bp, Homo sapiens
ttatatgagtatcatatcactt

SEQ ID NO: 7150351 - DNA, 22 bp, Homo sapiens
ttatatgagtatcatatcactt

SEQ ID NO: 7150352 - DNA, 22 bp, Homo sapiens
ttattacaatgcagaaaataga

SEQ ID NO: 7150353 - DNA, 22 bp, Homo sapiens
ttattacaatgcagaaaataga

SEQ ID NO: 7150354 - DNA, 22 bp, Homo sapiens
ttattacaatgcagaaaataga

SEQ ID NO: 7150355 - DNA, 22 bp, Homo sapiens
ttattacaatgcagaaaataga

SEQ ID NO: 7150356 - DNA, 22 bp, Homo sapiens
ttattacaatgcagaaaataga

SEQ ID NO: 7150357 - DNA, 22 bp, Homo sapiens
ttattaatgagtacaagttatt

SEQ ID NO: 7150358 - DNA, 22 bp, Homo sapiens
ttattaatcttatctttggaaa

SEQ ID NO: 7150359 - DNA, 22 bp, Homo sapiens
ttattaatgagtacaagttatt

SEQ ID NO: 7150360 - DNA, 22 bp, Homo sapiens
ttattaatcttatctttggaaa

SEQ ID NO: 7150361 - DNA, 22 bp, Homo sapiens
ttattaataaagtggcatagcc

SEQ ID NO: 7150362 - DNA, 22 bp, Homo sapiens
ttattaatacatgcacctgcat

SEQ ID NO: 7150363 - DNA, 22 bp, Homo sapiens
ttattaagtgcgtactgtatgc

SEQ ID NO: 7150364 - DNA, 22 bp, Homo sapiens
ttagctttcagcctttctcacc

SEQ ID NO: 7150365 - DNA, 22 bp, Homo sapiens
ttagcttaattaaataatcagt

SEQ ID NO: 7150366 - DNA, 22 bp, Homo sapiens
ttagctgaaaaaattcatgcaa

SEQ ID NO: 7150367 - DNA, 22 bp, Homo sapiens
ttagctgactgtgtgatttggc

SEQ ID NO: 7150368 - DNA, 22 bp, Homo sapiens
ttagctgagattaagtgaactt

SEQ ID NO: 7150369 - DNA, 22 bp, Homo sapiens
ttagctgctgattaaatatgtt

SEQ ID NO: 7150370 - DNA, 22 bp, Homo sapiens
ttagctgtggaagcttcagcca

SEQ ID NO: 7150371 - DNA, 22 bp, Homo sapiens
ttagctctggattaagcagaaa

SEQ ID NO: 7150372 - DNA, 22 bp, Homo sapiens
ttagctctggattaagcagaaa

SEQ ID NO: 7150373 - DNA, 22 bp, Homo sapiens
ttagctatagtatgtctgcttt

SEQ ID NO: 7150374 - DNA, 22 bp, Homo sapiens
ttagctatggctattactagtt

SEQ ID NO: 7150375 - DNA, 22 bp, Homo sapiens
ttagctatggctattactagtt

SEQ ID NO: 7150376 - DNA, 22 bp, Homo sapiens
ttagctcagaaaatttaaactt

SEQ ID NO: 7150377 - DNA, 22 bp, Homo sapiens
ttagccattttatacaagtgta

SEQ ID NO: 7150378 - DNA, 22 bp, Homo sapiens
ttagccattgtcagcacatggc

SEQ ID NO: 7150379 - DNA, 22 bp, Homo sapiens
ttagccatttgaggtcttcatt

SEQ ID NO: 7150380 - DNA, 22 bp, Homo sapiens
ttagccatttgaggtcttcatt

SEQ ID NO: 7150381 - DNA, 22 bp, Homo sapiens
ttagccattttattcagcaggt

SEQ ID NO: 7150382 - DNA, 22 bp, Homo sapiens
ttagccttagaagcttagcaaa

SEQ ID NO: 7150383 - DNA, 22 bp, Homo sapiens
ttagcgcacatcacagggggaa

SEQ ID NO: 7150384 - DNA, 22 bp, Homo sapiens
ttagccattttattcagcaggt

SEQ ID NO: 7150385 - DNA, 22 bp, Homo sapiens
ttagccatgttgaagatttaga

SEQ ID NO: 7150386 - DNA, 22 bp, Homo sapiens
ttagccattaaattacaaggtg

SEQ ID NO: 7150387 - DNA, 22 bp, Homo sapiens
ttagccattaatgtcctgtgca

SEQ ID NO: 7150388 - DNA, 23 bp, Homo sapiens
ttagccattccactgacatttga

SEQ ID NO: 7150389 - DNA, 22 bp, Homo sapiens
ttagccattctgataggtatgt

SEQ ID NO: 7150390 - DNA, 21 bp, Homo sapiens
ttagccattgggacattcagc

SEQ ID NO: 7150391 - DNA, 22 bp, Homo sapiens
ttagccatgttgaagatttaga

SEQ ID NO: 7150392 - DNA, 22 bp, Homo sapiens
ttagccatgtgggaaaaacagc

SEQ ID NO: 7150393 - DNA, 22 bp, Homo sapiens
ttagccatggactgaattgact

SEQ ID NO: 7150394 - DNA, 16 bp, Homo sapiens
ttagccatggcattct

SEQ ID NO: 7150395 - DNA, 22 bp, Homo sapiens
ttagccatgccctagaagagga

SEQ ID NO: 7150396 - DNA, 22 bp, Homo sapiens
ttagccatgcttcttgggtcta

SEQ ID NO: 7150397 - DNA, 22 bp, Homo sapiens
ttagccatgatgagtatatttg

SEQ ID NO: 7150398 - DNA, 22 bp, Homo sapiens
ttagccatatagaaaaagagct

SEQ ID NO: 7150399 - DNA, 22 bp, Homo sapiens
ttagccatatagtgctcttgta

SEQ ID NO: 7150400 - DNA, 19 bp, Homo sapiens
ttagccatccacagtgaaa

SEQ ID NO: 7150401 - DNA, 22 bp, Homo sapiens
ttagccatgagctgggcgactc

SEQ ID NO: 7150402 - DNA, 22 bp, Homo sapiens
ttagccataattgtttttccca

SEQ ID NO: 7150403 - DNA, 22 bp, Homo sapiens
ttagccagtgaaatggagaaat

SEQ ID NO: 7150404 - DNA, 22 bp, Homo sapiens
ttagccaggggagcagcttgtc

SEQ ID NO: 7150405 - DNA, 22 bp, Homo sapiens
tcctgctggactctgagtacaa

SEQ ID NO: 7150406 - DNA, 22 bp, Homo sapiens
tcctgctggaaacttcctcttg

SEQ ID NO: 7150407 - DNA, 22 bp, Homo sapiens
tcctgctggaaacttcctcttg

SEQ ID NO: 7150408 - DNA, 21 bp, Homo sapiens
tcctgctgctcctgtcgtgtt

SEQ ID NO: 7150409 - DNA, 21 bp, Homo sapiens
tcctgctgctcctgtcgtgtt

SEQ ID NO: 7150410 - DNA, 22 bp, Homo sapiens
tcctgcctgtttacctgtactt

SEQ ID NO: 7150411 - DNA, 22 bp, Homo sapiens
tcctgcctgtttacctgtactt

SEQ ID NO: 7150412 - DNA, 23 bp, Homo sapiens
tcctgctgaaagctccagctggc

SEQ ID NO: 7150413 - DNA, 22 bp, Homo sapiens
tcctgcctgtttacctgtactt

SEQ ID NO: 7150414 - DNA, 22 bp, Homo sapiens
tcctgctgacaaggaaagcatg

SEQ ID NO: 7150415 - DNA, 20 bp, Homo sapiens
tcctgctgaccttcacaagc

SEQ ID NO: 7150416 - DNA, 21 bp, Homo sapiens
tcctgctgagaaacagatggt

SEQ ID NO: 7150417 - DNA, 22 bp, Homo sapiens
tcctgctgagcatgttctgccc

SEQ ID NO: 7150418 - DNA, 22 bp, Homo sapiens
tcctgctgagcatgttctgccc

SEQ ID NO: 7150419 - DNA, 22 bp, Homo sapiens
tcctgctgagcgtctgtcattt

SEQ ID NO: 7150420 - DNA, 20 bp, Homo sapiens
tcctgctgccacctcttctt

SEQ ID NO: 7150421 - DNA, 22 bp, Homo sapiens
tcctgctgctacctggcccacg

SEQ ID NO: 7150422 - DNA, 22 bp, Homo sapiens
tcctgctgctacctggcccacg

SEQ ID NO: 7150423 - DNA, 22 bp, Homo sapiens
tcctgctgctcacctttttgtc

SEQ ID NO: 7150424 - DNA, 22 bp, Homo sapiens
tcctgctgctcacctttttgtc

SEQ ID NO: 7150425 - DNA, 22 bp, Homo sapiens
tcctgctgctcacctttttgtc

SEQ ID NO: 7150426 - DNA, 18 bp, Homo sapiens
tcctgcctgtgccccagg

SEQ ID NO: 7150427 - DNA, 18 bp, Homo sapiens
tcctgcctgtgccccagg

SEQ ID NO: 7150428 - DNA, 19 bp, Homo sapiens
tcctgcctggggccgcctg

SEQ ID NO: 7150429 - DNA, 18 bp, Homo sapiens
tcctgcctgcgggctccc

SEQ ID NO: 7150430 - DNA, 18 bp, Homo sapiens
tcctgcctgcgggctccc

SEQ ID NO: 7150431 - DNA, 18 bp, Homo sapiens
tcctgcctgcgggctccc

SEQ ID NO: 7150432 - DNA, 22 bp, Homo sapiens
tcctgcctgcaatcccagcact

SEQ ID NO: 7150433 - DNA, 22 bp, Homo sapiens
ttatacatgtttataaggttga

SEQ ID NO: 7150434 - DNA, 22 bp, Homo sapiens
ttaggaaacgctgctattgact

SEQ ID NO: 7150435 - DNA, 22 bp, Homo sapiens
ttaggaaagaagcagctaggag

SEQ ID NO: 7150436 - DNA, 22 bp, Homo sapiens
ttaggaaagggttttctaacag

SEQ ID NO: 7150437 - DNA, 22 bp, Homo sapiens
ttaggaaagttcttcagacatg

SEQ ID NO: 7150438 - DNA, 22 bp, Homo sapiens
ttagcttttgagaatgatttct

SEQ ID NO: 7150439 - DNA, 22 bp, Homo sapiens
ttagcttttcacttgcattatc

SEQ ID NO: 7150440 - DNA, 22 bp, Homo sapiens
ttagcttttctctatgttggct

SEQ ID NO: 7150441 - DNA, 22 bp, Homo sapiens
ttagcttttaagtgtgctacat

SEQ ID NO: 7150442 - DNA, 20 bp, Homo sapiens
ttagctttggcaatagtgac

SEQ ID NO: 7150443 - DNA, 22 bp, Homo sapiens
ttagctttggattgcatttagt

SEQ ID NO: 7150444 - DNA, 22 bp, Homo sapiens
ttagctttggattgcatttagt

SEQ ID NO: 7150445 - DNA, 22 bp, Homo sapiens
ttagctttctttggcagacgtg

SEQ ID NO: 7150446 - DNA, 22 bp, Homo sapiens
ttagctttcttggagaattaca

SEQ ID NO: 7150447 - DNA, 22 bp, Homo sapiens
ttagctttcatgaacctggtcg

SEQ ID NO: 7150448 - DNA, 21 bp, Homo sapiens
ttagctttctagaatctttgt

SEQ ID NO: 7150449 - DNA, 22 bp, Homo sapiens
ttagctttcttggagaattaca

SEQ ID NO: 7150450 - DNA, 22 bp, Homo sapiens
ttaggaaaagaagacatttcta

SEQ ID NO: 7150451 - DNA, 22 bp, Homo sapiens
ttaggaaaagaagacatttcta

SEQ ID NO: 7150452 - DNA, 22 bp, Homo sapiens
ttaggaaaatggagtcctttta

SEQ ID NO: 7150453 - DNA, 22 bp, Homo sapiens
ttaggaaacagtagcctttgct

SEQ ID NO: 7150454 - DNA, 19 bp, Homo sapiens
ttaggaaaccactttcctt

SEQ ID NO: 7150455 - DNA, 22 bp, Homo sapiens
ttatatactgtggtagtactgt

SEQ ID NO: 7150456 - DNA, 22 bp, Homo sapiens
ttatataactcaggtgggctca

SEQ ID NO: 7150457 - DNA, 22 bp, Homo sapiens
ttatataactcaggtgggctca

SEQ ID NO: 7150458 - DNA, 22 bp, Homo sapiens
ttatataactcaggtgggctca

SEQ ID NO: 7150459 - DNA, 22 bp, Homo sapiens
ttatataactcaggtgggctca

SEQ ID NO: 7150460 - DNA, 22 bp, Homo sapiens
ttatataaagataacttttctt

SEQ ID NO: 7150461 - DNA, 22 bp, Homo sapiens
ttatataaagataacttttctt

SEQ ID NO: 7150462 - DNA, 22 bp, Homo sapiens
ttatataaagataacttttctt

SEQ ID NO: 7150463 - DNA, 22 bp, Homo sapiens
ttatataaagataacttttctt

SEQ ID NO: 7150464 - DNA, 22 bp, Homo sapiens
ttataggaaatagttcatgcga

SEQ ID NO: 7150465 - DNA, 22 bp, Homo sapiens
ttatagggtttctgggagtggg

SEQ ID NO: 7150466 - DNA, 22 bp, Homo sapiens
ttatagtatgtgcatatgtgtg

SEQ ID NO: 7150467 - DNA, 22 bp, Homo sapiens
ttataggtccactgcaatttgc

SEQ ID NO: 7150468 - DNA, 22 bp, Homo sapiens
ttatagtattaggtactcaaca

SEQ ID NO: 7150469 - DNA, 22 bp, Homo sapiens
ttatagtattaggtactcaaca

SEQ ID NO: 7150470 - DNA, 22 bp, Homo sapiens
ttatagtattaggtactcaaca

SEQ ID NO: 7150471 - DNA, 22 bp, Homo sapiens
ttatagtattaggtactcaaca

SEQ ID NO: 7150472 - DNA, 22 bp, Homo sapiens
ttatagtgcataattaacatgg

SEQ ID NO: 7150473 - DNA, 22 bp, Homo sapiens
ttatagttagtaggtcattaaa

SEQ ID NO: 7150474 - DNA, 22 bp, Homo sapiens
ttatagatgccttgagtaaatg

SEQ ID NO: 7150475 - DNA, 22 bp, Homo sapiens
ttatagatttttatgaagtctg

SEQ ID NO: 7150476 - DNA, 22 bp, Homo sapiens
ttatagaatggtggattttctg

SEQ ID NO: 7150477 - DNA, 22 bp, Homo sapiens
ttatagaatggtggattttctg

SEQ ID NO: 7150478 - DNA, 22 bp, Homo sapiens
ttatagatctaaatgtgaaggg

SEQ ID NO: 7150479 - DNA, 22 bp, Homo sapiens
ttatagatctaaatgtgaaggg

SEQ ID NO: 7150480 - DNA, 22 bp, Homo sapiens
ttatagatgccttgagtaaatg

SEQ ID NO: 7150481 - DNA, 22 bp, Homo sapiens
ttatagatgccttgagtaaatg

SEQ ID NO: 7150482 - DNA, 22 bp, Homo sapiens
ttatagaaggagcattcactta

SEQ ID NO: 7150483 - DNA, 22 bp, Homo sapiens
ttatagaaggagcattcactta

SEQ ID NO: 7150484 - DNA, 22 bp, Homo sapiens
ttatactttatactacatcatt

SEQ ID NO: 7150485 - DNA, 22 bp, Homo sapiens
ttatactttatactacatcatt

SEQ ID NO: 7150486 - DNA, 22 bp, Homo sapiens
ttatactttatactacatcatt

SEQ ID NO: 7150487 - DNA, 22 bp, Homo sapiens
ttcacagataacacaggcaaat

SEQ ID NO: 7150488 - DNA, 22 bp, Homo sapiens
ttcacagatgagaaaattgagg

SEQ ID NO: 7150489 - DNA, 18 bp, Homo sapiens
ttcacagatccacaggaa

SEQ ID NO: 7150490 - DNA, 18 bp, Homo sapiens
ttcacagatccacaggaa

SEQ ID NO: 7150491 - DNA, 22 bp, Homo sapiens
ttcacagatgagaaaattgagg

SEQ ID NO: 7150492 - DNA, 21 bp, Homo sapiens
ttcacagatgggaaaactgag

SEQ ID NO: 7150493 - DNA, 22 bp, Homo sapiens
ttcacagatgcctgatgtgtgg

SEQ ID NO: 7150494 - DNA, 22 bp, Homo sapiens
ttcacagatgagaaaattgagg

SEQ ID NO: 7150495 - DNA, 21 bp, Homo sapiens
ttcacagatgggaaaactgag

SEQ ID NO: 7150496 - DNA, 21 bp, Homo sapiens
ttcacagatgggaaaactgag

SEQ ID NO: 7150497 - DNA, 20 bp, Homo sapiens
ttcacagaggactcaggtca

SEQ ID NO: 7150498 - DNA, 22 bp, Homo sapiens
ttcacagagcgggatgctggga

SEQ ID NO: 7150499 - DNA, 22 bp, Homo sapiens
ttcacagagcttgttcatggcc

SEQ ID NO: 7150500 - DNA, 20 bp, Homo sapiens
ttcacagaggactcaggtca

SEQ ID NO: 7150501 - DNA, 22 bp, Homo sapiens
ttcacagagttatttttatgct

SEQ ID NO: 7150502 - DNA, 22 bp, Homo sapiens
ttcacagagttatttttatgct

SEQ ID NO: 7150503 - DNA, 22 bp, Homo sapiens
ttcacagagagaactcaaacca

SEQ ID NO: 7150504 - DNA, 22 bp, Homo sapiens
ttcacagagagtatgcagagaa

SEQ ID NO: 7150505 - DNA, 22 bp, Homo sapiens
ttcacagagagtatgcagagaa

SEQ ID NO: 7150506 - DNA, 22 bp, Homo sapiens
ttcacagagcactgccaagtac

SEQ ID NO: 7150507 - DNA, 22 bp, Homo sapiens
ttcacagagcactgccaagtac

SEQ ID NO: 7150508 - DNA, 22 bp, Homo sapiens
ttcacagatgtattggaactcc

SEQ ID NO: 7150509 - DNA, 21 bp, Homo sapiens
ttcacagatgggaaaactgag

SEQ ID NO: 7150510 - DNA, 22 bp, Homo sapiens
ttcacagatgtattggaactcc

SEQ ID NO: 7150511 - DNA, 22 bp, Homo sapiens
ttcacagatgtattggaactcc

SEQ ID NO: 7150512 - DNA, 23 bp, Homo sapiens
ttcacagattaaatatttcttct

SEQ ID NO: 7150513 - DNA, 23 bp, Homo sapiens
ttcacagattaaatatttcttct

SEQ ID NO: 7150514 - DNA, 22 bp, Homo sapiens
ttcacagattgactggattcct

SEQ ID NO: 7150515 - DNA, 22 bp, Homo sapiens
ttcacagattgactggattcct

SEQ ID NO: 7150516 - DNA, 22 bp, Homo sapiens
ttcacagatttccctgcacatg

SEQ ID NO: 7150517 - DNA, 22 bp, Homo sapiens
ttcacagcctctgccccaggca

SEQ ID NO: 7150518 - DNA, 22 bp, Homo sapiens
ttcacagcctctgccccaggca

SEQ ID NO: 7150519 - DNA, 22 bp, Homo sapiens
ttcacagctaagagctaagtaa

SEQ ID NO: 7150520 - DNA, 22 bp, Homo sapiens
ttcacagctaagagctaagtaa

SEQ ID NO: 7150521 - DNA, 22 bp, Homo sapiens
ttcacagctcatactgttctca

SEQ ID NO: 7150522 - DNA, 22 bp, Homo sapiens
ttcacagctccttttactcaac

SEQ ID NO: 7150523 - DNA, 22 bp, Homo sapiens
ttcacagctccttttactcaac

SEQ ID NO: 7150524 - DNA, 22 bp, Homo sapiens
ttcacagctccttttactcaac

SEQ ID NO: 7150525 - DNA, 22 bp, Homo sapiens
ttcacagctccttttactcaac

SEQ ID NO: 7150526 - DNA, 19 bp, Homo sapiens
ttcacagctctgtgtcagt

SEQ ID NO: 7150527 - DNA, 19 bp, Homo sapiens
ttcacagctctgtgtcagt

SEQ ID NO: 7150528 - DNA, 19 bp, Homo sapiens
ttcacagctctgtgtcagt

SEQ ID NO: 7150529 - DNA, 22 bp, Homo sapiens
ttcacagcttaataaggctcag

SEQ ID NO: 7150530 - DNA, 22 bp, Homo sapiens
ttcacagcttaataaggctcag

SEQ ID NO: 7150531 - DNA, 22 bp, Homo sapiens
ttcaaagataatgtagcatttt

SEQ ID NO: 7150532 - DNA, 22 bp, Homo sapiens
ttcaaagataatgtagcatttt

SEQ ID NO: 7150533 - DNA, 22 bp, Homo sapiens
ttcaaagataatgtagcatttt

SEQ ID NO: 7150534 - DNA, 22 bp, Homo sapiens
ttcaaagagaaattgtattttc

SEQ ID NO: 7150535 - DNA, 22 bp, Homo sapiens
ttcaaagagaaattgtattttc

SEQ ID NO: 7150536 - DNA, 21 bp, Homo sapiens
ttcaaagacttgatgctgacc

SEQ ID NO: 7150537 - DNA, 22 bp, Homo sapiens
ttcaaagaccttacttggcaaa

SEQ ID NO: 7150538 - DNA, 22 bp, Homo sapiens
ttcaaagctgcagactcctggg

SEQ ID NO: 7150539 - DNA, 22 bp, Homo sapiens
ttcaaagatggagggatagatt

SEQ ID NO: 7150540 - DNA, 22 bp, Homo sapiens
ttcaaagataattaccaaacat

SEQ ID NO: 7150541 - DNA, 22 bp, Homo sapiens
ttcacaatggcaaaccattaaa

SEQ ID NO: 7150542 - DNA, 22 bp, Homo sapiens
ttcacaattaactttatactta

SEQ ID NO: 7150543 - DNA, 22 bp, Homo sapiens
ttcacagactttccatagattg

SEQ ID NO: 7150544 - DNA, 22 bp, Homo sapiens
ttcacagagagaactcaaacca

SEQ ID NO: 7150545 - DNA, 22 bp, Homo sapiens
ttcacaataggagcatgcaaat

SEQ ID NO: 7150546 - DNA, 22 bp, Homo sapiens
ttcacaatgccttgttgatggt

SEQ ID NO: 7150547 - DNA, 22 bp, Homo sapiens
ttcagagcatctctaaagccag

SEQ ID NO: 7150548 - DNA, 22 bp, Homo sapiens
ttcagagatggaaggcagaatg

SEQ ID NO: 7150549 - DNA, 22 bp, Homo sapiens
ttcagagatggaaggcagaatg

SEQ ID NO: 7150550 - DNA, 22 bp, Homo sapiens
ttcagagatggaaggcagaatg

SEQ ID NO: 7150551 - DNA, 20 bp, Homo sapiens
ttcagagatagggtctttaa

SEQ ID NO: 7150552 - DNA, 22 bp, Homo sapiens
ttcagagagtttgtgagtcctt

SEQ ID NO: 7150553 - DNA, 22 bp, Homo sapiens
ttcagagacatgttctagatca

SEQ ID NO: 7150554 - DNA, 22 bp, Homo sapiens
ttcagagagtccagtatgcagt

SEQ ID NO: 7150555 - DNA, 22 bp, Homo sapiens
ttcagagagtccagtatgcagt

SEQ ID NO: 7150556 - DNA, 22 bp, Homo sapiens
ttcagagaagtgcacaaaatca

SEQ ID NO: 7150557 - DNA, 22 bp, Homo sapiens
ttcagagaattggataattcgt

SEQ ID NO: 7150558 - DNA, 22 bp, Homo sapiens
ttcagagacagcaaccaggaca

SEQ ID NO: 7150559 - DNA, 22 bp, Homo sapiens
ttcagagaacttcatggaagag

SEQ ID NO: 7150560 - DNA, 22 bp, Homo sapiens
ttcagagaagcaaaggcagatt

SEQ ID NO: 7150561 - DNA, 22 bp, Homo sapiens
ttcagagaagcaaaggcagatt

SEQ ID NO: 7150562 - DNA, 22 bp, Homo sapiens
ttcagagaagcaaaggcagatt

SEQ ID NO: 7150563 - DNA, 22 bp, Homo sapiens
ttcagagaagcaaaggcagatt

SEQ ID NO: 7150564 - DNA, 22 bp, Homo sapiens
ttcagagaagcaaaggcagatt

SEQ ID NO: 7150565 - DNA, 22 bp, Homo sapiens
ttcagactgctggtgcttccct

SEQ ID NO: 7150566 - DNA, 22 bp, Homo sapiens
ttcagagaaactgaggtttaga

SEQ ID NO: 7150567 - DNA, 22 bp, Homo sapiens
ttcagagaaactgaggtttaga

SEQ ID NO: 7150568 - DNA, 22 bp, Homo sapiens
ttcacaggcttggaggtggggg

SEQ ID NO: 7150569 - DNA, 22 bp, Homo sapiens
ttcacaggatatatgtgcaggg

SEQ ID NO: 7150570 - DNA, 22 bp, Homo sapiens
ttcacaggagggtggatgcatg

SEQ ID NO: 7150571 - DNA, 22 bp, Homo sapiens
ttcacagggcagcagctgagcc

SEQ ID NO: 7150572 - DNA, 22 bp, Homo sapiens
ttcacagggcagatcatttctg

SEQ ID NO: 7150573 - DNA, 22 bp, Homo sapiens
ttcacagggccactggcaggag

SEQ ID NO: 7150574 - DNA, 22 bp, Homo sapiens
ttcagagctggtgtctacagct

SEQ ID NO: 7150575 - DNA, 16 bp, Homo sapiens
ttcagagcggctcata

SEQ ID NO: 7150576 - DNA, 22 bp, Homo sapiens
ttcagaggacaaccagccatct

SEQ ID NO: 7150577 - DNA, 22 bp, Homo sapiens
ttcagcaaatggactgttcagg

SEQ ID NO: 7150578 - DNA, 22 bp, Homo sapiens
ttcagcaaatggcttgagataa

SEQ ID NO: 7150579 - DNA, 22 bp, Homo sapiens
ttcagcaacatttgttgagtgc

SEQ ID NO: 7150580 - DNA, 22 bp, Homo sapiens
ttcagcaaccagaaaggctggg

SEQ ID NO: 7150581 - DNA, 22 bp, Homo sapiens
ttcagcaaggcatgtgcaggag

SEQ ID NO: 7150582 - DNA, 21 bp, Homo sapiens
ttcagcaagcactctggacac

SEQ ID NO: 7150583 - DNA, 22 bp, Homo sapiens
ttcagcaagtgtctctactgtc

SEQ ID NO: 7150584 - DNA, 22 bp, Homo sapiens
ttcagcaatgacagcctatata

SEQ ID NO: 7150585 - DNA, 22 bp, Homo sapiens
ttcagcaatgggatggtgcagg

SEQ ID NO: 7150586 - DNA, 22 bp, Homo sapiens
ttcagcaagaccaccatgtacc

SEQ ID NO: 7150587 - DNA, 22 bp, Homo sapiens
ttcagcaactgagtgtctttta

SEQ ID NO: 7150588 - DNA, 22 bp, Homo sapiens
ttcagcaagaatttactgagct

SEQ ID NO: 7150589 - DNA, 22 bp, Homo sapiens
ttcagcaacctataaatcccag

SEQ ID NO: 7150590 - DNA, 22 bp, Homo sapiens
ttcagcaactcaaacctattag

SEQ ID NO: 7150591 - DNA, 19 bp, Homo sapiens
ttcagtgtgctggctcctg

SEQ ID NO: 7150592 - DNA, 22 bp, Homo sapiens
ttcagtgtgcttcaggacgtta

SEQ ID NO: 7150593 - DNA, 22 bp, Homo sapiens
ttcagtgtgcctaagtcagttg

SEQ ID NO: 7150594 - DNA, 22 bp, Homo sapiens
ttcagtgtgaagcttctgaaag

SEQ ID NO: 7150595 - DNA, 18 bp, Homo sapiens
ttcagcagcagacacact

SEQ ID NO: 7150596 - DNA, 22 bp, Homo sapiens
ttcagtgtccctagtagaagtt

SEQ ID NO: 7150597 - DNA, 22 bp, Homo sapiens
ttcagcaattttttaagctaat

SEQ ID NO: 7150598 - DNA, 22 bp, Homo sapiens
ttcagcacaagactagacaggt

SEQ ID NO: 7150599 - DNA, 22 bp, Homo sapiens
ttcagcacaagactagacaggt

SEQ ID NO: 7150600 - DNA, 22 bp, Homo sapiens
ttcagcacagttcaagatggta

SEQ ID NO: 7150601 - DNA, 22 bp, Homo sapiens
ttcagcacagttcaagatggta

SEQ ID NO: 7150602 - DNA, 22 bp, Homo sapiens
ttcagcacagttcaagatggta

SEQ ID NO: 7150603 - DNA, 22 bp, Homo sapiens
ttcagcaccacttccagagaag

SEQ ID NO: 7150604 - DNA, 22 bp, Homo sapiens
ttcagcaccacttccagagaag

SEQ ID NO: 7150605 - DNA, 22 bp, Homo sapiens
ttcagcaccctctgaggcatcc

SEQ ID NO: 7150606 - DNA, 22 bp, Homo sapiens
ttcagcaccctctgaggcatcc

SEQ ID NO: 7150607 - DNA, 22 bp, Homo sapiens
ttcagcacctggaatagcacct

SEQ ID NO: 7150608 - DNA, 22 bp, Homo sapiens
ttcagcacctggaatagcacct

SEQ ID NO: 7150609 - DNA, 22 bp, Homo sapiens
ttcagcaccctctgaggcatcc

SEQ ID NO: 7150610 - DNA, 22 bp, Homo sapiens
ttcagcacctggaatagcacct

SEQ ID NO: 7150611 - DNA, 22 bp, Homo sapiens
ttcagcactgactgagtggtta

SEQ ID NO: 7150612 - DNA, 22 bp, Homo sapiens
ttcagcactgactgagtggtta

SEQ ID NO: 7150613 - DNA, 22 bp, Homo sapiens
ttcagcactggacagcgagtct

SEQ ID NO: 7150614 - DNA, 22 bp, Homo sapiens
ttcagcactggacagcgagtct

SEQ ID NO: 7150615 - DNA, 22 bp, Homo sapiens
ttcagcactggacagcgagtct

SEQ ID NO: 7150616 - DNA, 22 bp, Homo sapiens
ttcagcactgttatggatttgc

SEQ ID NO: 7150617 - DNA, 22 bp, Homo sapiens
ttcagcactgttatggatttgc

SEQ ID NO: 7150618 - DNA, 22 bp, Homo sapiens
ttcagcactttgttttgctcat

SEQ ID NO: 7150619 - DNA, 22 bp, Homo sapiens
ttcagcactttgttttgctcat

SEQ ID NO: 7150620 - DNA, 22 bp, Homo sapiens
ttcagcactttgttttgctcat

SEQ ID NO: 7150621 - DNA, 18 bp, Homo sapiens
ttcagcagcagacacact

SEQ ID NO: 7150622 - DNA, 22 bp, Homo sapiens
ttcatttgtctgctatagatcc

SEQ ID NO: 7150623 - DNA, 22 bp, Homo sapiens
ttcatttgtggttatttacaat

SEQ ID NO: 7150624 - DNA, 22 bp, Homo sapiens
ttcatttgtctgctatagatcc

SEQ ID NO: 7150625 - DNA, 22 bp, Homo sapiens
ttcatttgtctgctatagatcc

SEQ ID NO: 7150626 - DNA, 22 bp, Homo sapiens
ttcatttgtccaaatactatgt

SEQ ID NO: 7150627 - DNA, 19 bp, Homo sapiens
ttcatttgtatctgctcac

SEQ ID NO: 7150628 - DNA, 22 bp, Homo sapiens
ttcatttgggatgagtcagaag

SEQ ID NO: 7150629 - DNA, 20 bp, Homo sapiens
ttcatttgggaaaatctgcg

SEQ ID NO: 7150630 - DNA, 20 bp, Homo sapiens
ttcatttgggaaaatctgcg

SEQ ID NO: 7150631 - DNA, 20 bp, Homo sapiens
ttcatttgggaaaatctgcg

SEQ ID NO: 7150632 - DNA, 22 bp, Homo sapiens
ttcatttggcctctgcttaaaa

SEQ ID NO: 7150633 - DNA, 22 bp, Homo sapiens
ttcatttttaccgcgtgtcaaa

SEQ ID NO: 7150634 - DNA, 22 bp, Homo sapiens
ttcatttttaccgcgtgtcaaa

SEQ ID NO: 7150635 - DNA, 22 bp, Homo sapiens
ttcatttttaccgcgtgtcaaa

SEQ ID NO: 7150636 - DNA, 22 bp, Homo sapiens
ttcattttctttcacgctgctg

SEQ ID NO: 7150637 - DNA, 22 bp, Homo sapiens
ttcattttctttcacgctgctg

SEQ ID NO: 7150638 - DNA, 22 bp, Homo sapiens
ttcattttataaaccctgctga

SEQ ID NO: 7150639 - DNA, 22 bp, Homo sapiens
ttcatttgtggttatttacaat

SEQ ID NO: 7150640 - DNA, 21 bp, Homo sapiens
ttcatttgttatagacaaagt

SEQ ID NO: 7150641 - DNA, 22 bp, Homo sapiens
ttcatttgttgacagagacatg

SEQ ID NO: 7150642 - DNA, 22 bp, Homo sapiens
ttcatttgttgacagagacatg

SEQ ID NO: 7150643 - DNA, 22 bp, Homo sapiens
ttccaggaattcagctctcagt

SEQ ID NO: 7150644 - DNA, 22 bp, Homo sapiens
ttccaggcagaacaatcatgct

SEQ ID NO: 7150645 - DNA, 23 bp, Homo sapiens
ttccaggcagagcagggattaga

SEQ ID NO: 7150646 - DNA, 22 bp, Homo sapiens
ttccaggcatgtcagacatagg

SEQ ID NO: 7150647 - DNA, 22 bp, Homo sapiens
ttccaggaagacatctcaggaa

SEQ ID NO: 7150648 - DNA, 22 bp, Homo sapiens
ttccagtctagtacctggatgc

SEQ ID NO: 7150649 - DNA, 22 bp, Homo sapiens
ttccagtctggcctgtgcttag

SEQ ID NO: 7150650 - DNA, 22 bp, Homo sapiens
ttccagtctggcctgtgcttag

SEQ ID NO: 7150651 - DNA, 22 bp, Homo sapiens
ttccagtacccagcgaaggcac

SEQ ID NO: 7150652 - DNA, 18 bp, Homo sapiens
ttccagtagctgtatcac

SEQ ID NO: 7150653 - DNA, 22 bp, Homo sapiens
ttccagtgaccatagagtatgg

SEQ ID NO: 7150654 - DNA, 22 bp, Homo sapiens
ttccagtgactaagcttctgct

SEQ ID NO: 7150655 - DNA, 23 bp, Homo sapiens
ttccagtgagactgagaggtctt

SEQ ID NO: 7150656 - DNA, 22 bp, Homo sapiens
ttccagtgggaaagcatagcca

SEQ ID NO: 7150657 - DNA, 22 bp, Homo sapiens
ttccagttcaaattggccaata

SEQ ID NO: 7150658 - DNA, 22 bp, Homo sapiens
ttccagttcactccatttctgg

SEQ ID NO: 7150659 - DNA, 19 bp, Homo sapiens
ttccagttctaatctcttc

SEQ ID NO: 7150660 - DNA, 19 bp, Homo sapiens
ttccagttctaatctcttc

SEQ ID NO: 7150661 - DNA, 22 bp, Homo sapiens
ttccagggttaatttatatggt

SEQ ID NO: 7150662 - DNA, 22 bp, Homo sapiens
ttccagggctaggtaatgggta

SEQ ID NO: 7150663 - DNA, 22 bp, Homo sapiens
ttccaggctgcacagttgggac

SEQ ID NO: 7150664 - DNA, 22 bp, Homo sapiens
ttccaggctgcagttgtagtta

SEQ ID NO: 7150665 - DNA, 22 bp, Homo sapiens
ttccaggctgcagttgtagtta

SEQ ID NO: 7150666 - DNA, 22 bp, Homo sapiens
ttccaggctgcagttttctagt

SEQ ID NO: 7150667 - DNA, 22 bp, Homo sapiens
ttccaggcttctctggggcgtc

SEQ ID NO: 7150668 - DNA, 22 bp, Homo sapiens
ttccagggctaattcctgtgga

SEQ ID NO: 7150669 - DNA, 22 bp, Homo sapiens
ttccaggctattccctttggag

SEQ ID NO: 7150670 - DNA, 22 bp, Homo sapiens
ttccaggctcccttggaggtgt

SEQ ID NO: 7150671 - DNA, 22 bp, Homo sapiens
ttccaggctcctgcagtttcta

SEQ ID NO: 7150672 - DNA, 22 bp, Homo sapiens
ttccaggctcttccaggctgtc

SEQ ID NO: 7150673 - DNA, 22 bp, Homo sapiens
ttccaggctgatgggccacagg

SEQ ID NO: 7150674 - DNA, 22 bp, Homo sapiens
ttccaggcattaaagtttctcc

SEQ ID NO: 7150675 - DNA, 22 bp, Homo sapiens
ttccaggcattacagggtttgc

SEQ ID NO: 7150676 - DNA, 22 bp, Homo sapiens
ttccaggccagaatggtcacat

SEQ ID NO: 7150677 - DNA, 22 bp, Homo sapiens
ttccaggcgcacgtcggcctta

SEQ ID NO: 7150678 - DNA, 22 bp, Homo sapiens
ttccaggctatccggtgaaggg

SEQ ID NO: 7150679 - DNA, 22 bp, Homo sapiens
ttcagttccttgtgcgaattcc

SEQ ID NO: 7150680 - DNA, 22 bp, Homo sapiens
ttcagttccatttcaggtgggt

SEQ ID NO: 7150681 - DNA, 22 bp, Homo sapiens
ttcagtgtttgtagagataact

SEQ ID NO: 7150682 - DNA, 22 bp, Homo sapiens
ttcagtgtttgtagagataact

SEQ ID NO: 7150683 - DNA, 22 bp, Homo sapiens
ttcagtgttaatcttgggagaa

SEQ ID NO: 7150684 - DNA, 22 bp, Homo sapiens
ttcagtgttactcaaggggcag

SEQ ID NO: 7150685 - DNA, 22 bp, Homo sapiens
ttcagtgttcttttctgttagc

SEQ ID NO: 7150686 - DNA, 22 bp, Homo sapiens
ttcagtgtggaatgtgaactgc

SEQ ID NO: 7150687 - DNA, 22 bp, Homo sapiens
ttcagtgtggcccatgaagagg

SEQ ID NO: 7150688 - DNA, 22 bp, Homo sapiens
ttcagtgtggtgcacagttttg

SEQ ID NO: 7150689 - DNA, 22 bp, Homo sapiens
ttcagtgtgtcagtttcagcag

SEQ ID NO: 7150690 - DNA, 22 bp, Homo sapiens
ttcagtgtgtgatacctgctgt

SEQ ID NO: 7150691 - DNA, 22 bp, Homo sapiens
ttcagtgttaaattcaaagagt

SEQ ID NO: 7150692 - DNA, 22 bp, Homo sapiens
ttcagttttctttagaatgtag

SEQ ID NO: 7150693 - DNA, 21 bp, Homo sapiens
ttcataaaccattctcatgca

SEQ ID NO: 7150694 - DNA, 21 bp, Homo sapiens
ttcataaaccattctcatgca

SEQ ID NO: 7150695 - DNA, 19 bp, Homo sapiens
ttcataacttttatatcct

SEQ ID NO: 7150696 - DNA, 22 bp, Homo sapiens
ttcataaacaactgatggtaat

SEQ ID NO: 7150697 - DNA, 22 bp, Homo sapiens
ttcagttttgcttttaatcatg

SEQ ID NO: 7150698 - DNA, 22 bp, Homo sapiens
ttcatttgcactggattactgg

SEQ ID NO: 7150699 - DNA, 22 bp, Homo sapiens
ttcatttgccatcagtgtaatg

SEQ ID NO: 7150700 - DNA, 22 bp, Homo sapiens
ttcatttgagtttatagttgct

SEQ ID NO: 7150701 - DNA, 23 bp, Homo sapiens
ttcatttaggagttcataagagc

SEQ ID NO: 7150702 - DNA, 23 bp, Homo sapiens
ttcatttaggagttcataagagc

SEQ ID NO: 7150703 - DNA, 22 bp, Homo sapiens
ttcatttattcagcaggtattt

SEQ ID NO: 7150704 - DNA, 22 bp, Homo sapiens
ttcatttattcagcaggtattt

SEQ ID NO: 7150705 - DNA, 22 bp, Homo sapiens
ttcatttattcagcaggtattt

SEQ ID NO: 7150706 - DNA, 22 bp, Homo sapiens
ttcatttaatcagaatctctaa

SEQ ID NO: 7150707 - DNA, 22 bp, Homo sapiens
ttcatttaatttgtgtattaac

SEQ ID NO: 7150708 - DNA, 22 bp, Homo sapiens
ttcatttaatttgtgtattaac

SEQ ID NO: 7150709 - DNA, 22 bp, Homo sapiens
ttcatttaatttgtgtattaac

SEQ ID NO: 7150710 - DNA, 22 bp, Homo sapiens
ttcatttaatttgtgtattaac

SEQ ID NO: 7150711 - DNA, 22 bp, Homo sapiens
ttcatttaatttgtgtattaac

SEQ ID NO: 7150712 - DNA, 22 bp, Homo sapiens
ttcatttagcatgctaaacctg

SEQ ID NO: 7150713 - DNA, 22 bp, Homo sapiens
ttcatttagcatgctaaacctg

SEQ ID NO: 7150714 - DNA, 23 bp, Homo sapiens
ttcatttaggagttcataagagc

SEQ ID NO: 7150715 - DNA, 23 bp, Homo sapiens
ttcatttaggagttcataagagc

SEQ ID NO: 7150716 - DNA, 23 bp, Homo sapiens
ttcatttaggagttcataagagc

SEQ ID NO: 7150717 - DNA, 22 bp, Homo sapiens
ttcattgatttccttggaataa

SEQ ID NO: 7150718 - DNA, 22 bp, Homo sapiens
ttcatacaatgggatattatga

SEQ ID NO: 7150719 - DNA, 22 bp, Homo sapiens
ttcattgatttccttggaataa

SEQ ID NO: 7150720 - DNA, 22 bp, Homo sapiens
ttcattgcattccagcctgggt

SEQ ID NO: 7150721 - DNA, 22 bp, Homo sapiens
ttcattggcacaggggcaggtt

SEQ ID NO: 7150722 - DNA, 22 bp, Homo sapiens
ttcattggctaaagacctggga

SEQ ID NO: 7150723 - DNA, 22 bp, Homo sapiens
ttcattggtactaggacaggac

SEQ ID NO: 7150724 - DNA, 22 bp, Homo sapiens
ttcataagttggtgttgacttt

SEQ ID NO: 7150725 - DNA, 19 bp, Homo sapiens
ttcataagtttagtgaggg

SEQ ID NO: 7150726 - DNA, 22 bp, Homo sapiens
ttcataatcaccaaaaactgga

SEQ ID NO: 7150727 - DNA, 22 bp, Homo sapiens
ttcattgtgaacacattctgcc

SEQ ID NO: 7150728 - DNA, 22 bp, Homo sapiens
ttcatttaatcagaatctctaa

SEQ ID NO: 7150729 - DNA, 22 bp, Homo sapiens
ttcatttaatcagaatctctaa

SEQ ID NO: 7150730 - DNA, 22 bp, Homo sapiens
ttcatttaatcagaatctctaa

SEQ ID NO: 7150731 - DNA, 22 bp, Homo sapiens
ttcattgtactttaagagatgc

SEQ ID NO: 7150732 - DNA, 22 bp, Homo sapiens
ttcattggtcctgctcctggac

SEQ ID NO: 7150733 - DNA, 22 bp, Homo sapiens
ttcattgtactttaagagatgc

SEQ ID NO: 7150734 - DNA, 22 bp, Homo sapiens
ttcattgtactttaagagatgc

SEQ ID NO: 7150735 - DNA, 22 bp, Homo sapiens
ttcttcaaatgctgaaagtcta

SEQ ID NO: 7150736 - DNA, 22 bp, Homo sapiens
ttcttcaaagtccttattcctt

SEQ ID NO: 7150737 - DNA, 22 bp, Homo sapiens
ttcttcaacaaggacactgtta

SEQ ID NO: 7150738 - DNA, 22 bp, Homo sapiens
ttcttcaacaaggacactgtta

SEQ ID NO: 7150739 - DNA, 22 bp, Homo sapiens
ttcttcaaccatctacataaac

SEQ ID NO: 7150740 - DNA, 22 bp, Homo sapiens
ttcttcaaccatctacataaac

SEQ ID NO: 7150741 - DNA, 22 bp, Homo sapiens
ttcttcaaccatctacataaac

SEQ ID NO: 7150742 - DNA, 22 bp, Homo sapiens
ttcttcaaccatctacataaac

SEQ ID NO: 7150743 - DNA, 22 bp, Homo sapiens
ttcttcaatgtgccctgttttc

SEQ ID NO: 7150744 - DNA, 22 bp, Homo sapiens
ttcttcaattttccatatactg

SEQ ID NO: 7150745 - DNA, 22 bp, Homo sapiens
ttcttcaattttccatatactg

SEQ ID NO: 7150746 - DNA, 22 bp, Homo sapiens
ttcttcaagggtaaaggcaacg

SEQ ID NO: 7150747 - DNA, 22 bp, Homo sapiens
ttcttcaagggtaaaggcaacg

SEQ ID NO: 7150748 - DNA, 22 bp, Homo sapiens
ttcttcaataaattcccataag

SEQ ID NO: 7150749 - DNA, 22 bp, Homo sapiens
ttcttcagactactgatgattg

SEQ ID NO: 7150750 - DNA, 22 bp, Homo sapiens
ttcttatttcccccttcatcat

SEQ ID NO: 7150751 - DNA, 23 bp, Homo sapiens
ttcttatttactttggaatctcc

SEQ ID NO: 7150752 - DNA, 22 bp, Homo sapiens
ttcttattatgtgctctgtgaa

SEQ ID NO: 7150753 - DNA, 22 bp, Homo sapiens
ttcttattatgtgctctgtgaa

SEQ ID NO: 7150754 - DNA, 22 bp, Homo sapiens
ttcttatgttcacataattcca

SEQ ID NO: 7150755 - DNA, 22 bp, Homo sapiens
ttcttattcttgaaatgtggga

SEQ ID NO: 7150756 - DNA, 22 bp, Homo sapiens
ttcttattcttgaaatgtggga

SEQ ID NO: 7150757 - DNA, 22 bp, Homo sapiens
ttcttattgggagaccttttct

SEQ ID NO: 7150758 - DNA, 22 bp, Homo sapiens
ttcttattgggagaccttttct

SEQ ID NO: 7150759 - DNA, 22 bp, Homo sapiens
ttcttcaaaatccagcatgatt

SEQ ID NO: 7150760 - DNA, 22 bp, Homo sapiens
ttcttcaaaatccagcatgatt

SEQ ID NO: 7150761 - DNA, 22 bp, Homo sapiens
ttcttcaaaatccagcatgatt

SEQ ID NO: 7150762 - DNA, 22 bp, Homo sapiens
ttcttcaaaatccagcatgatt

SEQ ID NO: 7150763 - DNA, 22 bp, Homo sapiens
ttcttcaaaatccagcatgatt

SEQ ID NO: 7150764 - DNA, 22 bp, Homo sapiens
ttcttcaaaatccagcatgatt

SEQ ID NO: 7150765 - DNA, 22 bp, Homo sapiens
ttcttcaaacaaaagtggcatg

SEQ ID NO: 7150766 - DNA, 22 bp, Homo sapiens
ttcttcaaacaaaagtggcatg

SEQ ID NO: 7150767 - DNA, 22 bp, Homo sapiens
ttcttcaaagatgtctgttgga

SEQ ID NO: 7150768 - DNA, 22 bp, Homo sapiens
ttcttcaaagtaatagagacta

SEQ ID NO: 7150769 - DNA, 22 bp, Homo sapiens
ttcttcaaagtaatagagacta

SEQ ID NO: 7150770 - DNA, 22 bp, Homo sapiens
ttcttttcttggcaggagtaga

SEQ ID NO: 7150771 - DNA, 22 bp, Homo sapiens
ttcttttcttggcaggagtaga

SEQ ID NO: 7150772 - DNA, 22 bp, Homo sapiens
ttcttttctgcagctggtattt

SEQ ID NO: 7150773 - DNA, 22 bp, Homo sapiens
ttcttttctgcagctggtattt

SEQ ID NO: 7150774 - DNA, 22 bp, Homo sapiens
ttcttttaatgttctgaagttt

SEQ ID NO: 7150775 - DNA, 17 bp, Homo sapiens
ttcttttctgagccttg

SEQ ID NO: 7150776 - DNA, 17 bp, Homo sapiens
ttcttttctgagccttg

SEQ ID NO: 7150777 - DNA, 22 bp, Homo sapiens
ttcttttaatgtctggctttca

SEQ ID NO: 7150778 - DNA, 22 bp, Homo sapiens
ttcttttaatgttctgaagttt

SEQ ID NO: 7150779 - DNA, 22 bp, Homo sapiens
ttcttttaatagagatcctgtg

SEQ ID NO: 7150780 - DNA, 22 bp, Homo sapiens
ttcttttaatagagatcctgtg

SEQ ID NO: 7150781 - DNA, 22 bp, Homo sapiens
ttcttttaatgtctggctttca

SEQ ID NO: 7150782 - DNA, 22 bp, Homo sapiens
ttcttttaatgtctggctttca

SEQ ID NO: 7150783 - DNA, 22 bp, Homo sapiens
ttctttgtagcaaaacgtgtat

SEQ ID NO: 7150784 - DNA, 22 bp, Homo sapiens
ttctttgtgcatccaattttct

SEQ ID NO: 7150785 - DNA, 23 bp, Homo sapiens
ttctttgtggataatctccagtg

SEQ ID NO: 7150786 - DNA, 23 bp, Homo sapiens
ttctttgtggataatctccagtg

SEQ ID NO: 7150787 - DNA, 23 bp, Homo sapiens
ttctttgtggataatctccagtg

SEQ ID NO: 7150788 - DNA, 22 bp, Homo sapiens
ttctttgtggcagtgagctggg

SEQ ID NO: 7150789 - DNA, 22 bp, Homo sapiens
ttctttgtaacctttgggaact

SEQ ID NO: 7150790 - DNA, 22 bp, Homo sapiens
ttctttgtaaagccacagtcct

SEQ ID NO: 7150791 - DNA, 22 bp, Homo sapiens
ttctttgtaaagccacagtcct

SEQ ID NO: 7150792 - DNA, 22 bp, Homo sapiens
ttctttgtaaagccacagtcct

SEQ ID NO: 7150793 - DNA, 20 bp, Homo sapiens
ttctttgttccttacatttg

SEQ ID NO: 7150794 - DNA, 20 bp, Homo sapiens
ttctttgttccttacatttg

SEQ ID NO: 7150795 - DNA, 20 bp, Homo sapiens
ttctttgttccttacatttg

SEQ ID NO: 7150796 - DNA, 20 bp, Homo sapiens
ttctttgttccttacatttg

SEQ ID NO: 7150797 - DNA, 22 bp, Homo sapiens
ttctttgttgagcaagtaggac

SEQ ID NO: 7150798 - DNA, 22 bp, Homo sapiens
ttctttgttgtactttcctaca

SEQ ID NO: 7150799 - DNA, 22 bp, Homo sapiens
ttctttgttgtactttcctaca

SEQ ID NO: 7150800 - DNA, 22 bp, Homo sapiens
ttctttgttgtactttcctaca

SEQ ID NO: 7150801 - DNA, 22 bp, Homo sapiens
ttctttgttgtactttcctaca

SEQ ID NO: 7150802 - DNA, 22 bp, Homo sapiens
ttctttgtttgataagtatgct

SEQ ID NO: 7150803 - DNA, 22 bp, Homo sapiens
ttctttgtttgataagtatgct

SEQ ID NO: 7150804 - DNA, 22 bp, Homo sapiens
ttgaaatggaagtgaaaattct

SEQ ID NO: 7150805 - DNA, 22 bp, Homo sapiens
ttgaaatggaagtgaaaattct

SEQ ID NO: 7150806 - DNA, 22 bp, Homo sapiens
ttgaaatgcagattccaatcca

SEQ ID NO: 7150807 - DNA, 22 bp, Homo sapiens
ttgaaatgcatcatcatttaga

SEQ ID NO: 7150808 - DNA, 22 bp, Homo sapiens
ttgaaatgcatcatcatttaga

SEQ ID NO: 7150809 - DNA, 22 bp, Homo sapiens
ttgaaatgcatcatcatttaga

SEQ ID NO: 7150810 - DNA, 22 bp, Homo sapiens
ttgaaatgagactaattgattg

SEQ ID NO: 7150811 - DNA, 22 bp, Homo sapiens
ttgaaatgatctatttcagtag

SEQ ID NO: 7150812 - DNA, 22 bp, Homo sapiens
ttgaaagggttaaagtggtaaa

SEQ ID NO: 7150813 - DNA, 22 bp, Homo sapiens
ttgaaagggatatatctttctg

SEQ ID NO: 7150814 - DNA, 22 bp, Homo sapiens
ttgaaatcaccactagcatttg

SEQ ID NO: 7150815 - DNA, 22 bp, Homo sapiens
ttcttttctttaggcattgtgt

SEQ ID NO: 7150816 - DNA, 22 bp, Homo sapiens
ttcttttctttaggcattgtgt

SEQ ID NO: 7150817 - DNA, 22 bp, Homo sapiens
ttgaaaggcctgtttatccagc

SEQ ID NO: 7150818 - DNA, 22 bp, Homo sapiens
ttgaaaggcacaggcacctggg

SEQ ID NO: 7150819 - DNA, 22 bp, Homo sapiens
ttgaaaggaatacagaggccta

SEQ ID NO: 7150820 - DNA, 22 bp, Homo sapiens
ttctttttaaagtgtgtatgca

SEQ ID NO: 7150821 - DNA, 22 bp, Homo sapiens
ttctttttaaagtgtgtatgca

SEQ ID NO: 7150822 - DNA, 22 bp, Homo sapiens
ttctttttaaagtgtgtatgca

SEQ ID NO: 7150823 - DNA, 22 bp, Homo sapiens
ttctttttaaagtgtgtatgca

SEQ ID NO: 7150824 - DNA, 22 bp, Homo sapiens
ttctttttaaagtgtgtatgca

SEQ ID NO: 7150825 - DNA, 22 bp, Homo sapiens
ttgaacactaagtttccaggct

SEQ ID NO: 7150826 - DNA, 22 bp, Homo sapiens
ttgaacactaagtttccaggct

SEQ ID NO: 7150827 - DNA, 19 bp, Homo sapiens
ttgaacactttcttcaagg

SEQ ID NO: 7150828 - DNA, 22 bp, Homo sapiens
ttgaacattaacttcagtctat

SEQ ID NO: 7150829 - DNA, 19 bp, Homo sapiens
ttgaaattgtttgatatgg

SEQ ID NO: 7150830 - DNA, 22 bp, Homo sapiens
ttgaaattttaggccttgcaat

SEQ ID NO: 7150831 - DNA, 22 bp, Homo sapiens
ttgaacaatttggtatacaaac

SEQ ID NO: 7150832 - DNA, 22 bp, Homo sapiens
ttgaaatggcagcagctgacct

SEQ ID NO: 7150833 - DNA, 22 bp, Homo sapiens
ttgaaatgtagtcctgccttca

SEQ ID NO: 7150834 - DNA, 20 bp, Homo sapiens
ttgaaattggatggtagcta

SEQ ID NO: 7150835 - DNA, 20 bp, Homo sapiens
ttgaaattggatggtagcta

SEQ ID NO: 7150836 - DNA, 22 bp, Homo sapiens
ttgaaattgggtgtggctgtca

SEQ ID NO: 7150837 - DNA, 19 bp, Homo sapiens
ttgaaattgtttgatatgg

SEQ ID NO: 7150838 - DNA, 22 bp, Homo sapiens
ttgaaattgggtgtggctgtca

SEQ ID NO: 7150839 - DNA, 22 bp, Homo sapiens
ttgaattcatttctcattgagt

SEQ ID NO: 7150840 - DNA, 18 bp, Homo sapiens
ttgaattcttctacatgt

SEQ ID NO: 7150841 - DNA, 22 bp, Homo sapiens
ttgaacattagaataagtaatt

SEQ ID NO: 7150842 - DNA, 22 bp, Homo sapiens
ttgaacattggcaatttcatat

SEQ ID NO: 7150843 - DNA, 22 bp, Homo sapiens
ttgaacattttctatgttatag

SEQ ID NO: 7150844 - DNA, 22 bp, Homo sapiens
ttgaactaataggtatcttgta

SEQ ID NO: 7150845 - DNA, 22 bp, Homo sapiens
ttgaactaataggtatcttgta

SEQ ID NO: 7150846 - DNA, 22 bp, Homo sapiens
ttgaactaataggtatcttgta

SEQ ID NO: 7150847 - DNA, 22 bp, Homo sapiens
ttgaactagaagctttggaact

SEQ ID NO: 7150848 - DNA, 22 bp, Homo sapiens
ttgaactagaagctttggaact

SEQ ID NO: 7150849 - DNA, 22 bp, Homo sapiens
ttgaactctggacccatgccag

SEQ ID NO: 7150850 - DNA, 22 bp, Homo sapiens
ttgaactttcagaaaatggcag

SEQ ID NO: 7150851 - DNA, 22 bp, Homo sapiens
ttgaactttgaaccattcctat

SEQ ID NO: 7150852 - DNA, 22 bp, Homo sapiens
ttgaactttgaaccattcctat

SEQ ID NO: 7150853 - DNA, 22 bp, Homo sapiens
ttgaacttttccagacaaggaa

SEQ ID NO: 7150854 - DNA, 22 bp, Homo sapiens
ttgaagaaagtcatatataatg

SEQ ID NO: 7150855 - DNA, 22 bp, Homo sapiens
ttctctggggttcagtatctct

SEQ ID NO: 7150856 - DNA, 22 bp, Homo sapiens
ttctctgggttaggggaactat

SEQ ID NO: 7150857 - DNA, 22 bp, Homo sapiens
ttctctgggttaggggaactat

SEQ ID NO: 7150858 - DNA, 22 bp, Homo sapiens
ttctctggtaaacacatgcgta

SEQ ID NO: 7150859 - DNA, 22 bp, Homo sapiens
ttctctggtaaacacatgcgta

SEQ ID NO: 7150860 - DNA, 22 bp, Homo sapiens
ttctctggggactgtctctatt

SEQ ID NO: 7150861 - DNA, 22 bp, Homo sapiens
ttctctggggactgtctctatt

SEQ ID NO: 7150862 - DNA, 22 bp, Homo sapiens
ttctctggggacttggttggag

SEQ ID NO: 7150863 - DNA, 22 bp, Homo sapiens
ttctctggggttcagtatctct

SEQ ID NO: 7150864 - DNA, 22 bp, Homo sapiens
ttctctggggttcagtatctct

SEQ ID NO: 7150865 - DNA, 19 bp, Homo sapiens
ttctctggactagatgctg

SEQ ID NO: 7150866 - DNA, 22 bp, Homo sapiens
ttctctgggacaggaacagttt

SEQ ID NO: 7150867 - DNA, 22 bp, Homo sapiens
ttctctgggacaggaacagttt

SEQ ID NO: 7150868 - DNA, 22 bp, Homo sapiens
ttctctgggatctggcaaaagg

SEQ ID NO: 7150869 - DNA, 22 bp, Homo sapiens
ttctctgggatctggcaaaagg

SEQ ID NO: 7150870 - DNA, 22 bp, Homo sapiens
ttctctgggcttttcggatccg

SEQ ID NO: 7150871 - DNA, 22 bp, Homo sapiens
ttctctggggactgtctctatt

SEQ ID NO: 7150872 - DNA, 22 bp, Homo sapiens
ttctctgggacaggaacagttt

SEQ ID NO: 7150873 - DNA, 22 bp, Homo sapiens
ttctctgggacaggaacagttt

SEQ ID NO: 7150874 - DNA, 22 bp, Homo sapiens
ttctctggacagtgaagagagg

SEQ ID NO: 7150875 - DNA, 22 bp, Homo sapiens
ttctctggacagtgaagagagg

SEQ ID NO: 7150876 - DNA, 22 bp, Homo sapiens
ttctggaacatagcaagaagtt

SEQ ID NO: 7150877 - DNA, 22 bp, Homo sapiens
ttctggaaatgttgctgaggcc

SEQ ID NO: 7150878 - DNA, 22 bp, Homo sapiens
ttctggaaatgttgctgaggcc

SEQ ID NO: 7150879 - DNA, 22 bp, Homo sapiens
ttctggaaatgttgctgaggcc

SEQ ID NO: 7150880 - DNA, 22 bp, Homo sapiens
ttctggaaatgggtatagagca

SEQ ID NO: 7150881 - DNA, 22 bp, Homo sapiens
ttctggaaatgggtatagagca

SEQ ID NO: 7150882 - DNA, 22 bp, Homo sapiens
ttctggaaatgggtatagagca

SEQ ID NO: 7150883 - DNA, 21 bp, Homo sapiens
ttctctggtcaagcacacata

SEQ ID NO: 7150884 - DNA, 21 bp, Homo sapiens
ttctctggtcaagcacacata

SEQ ID NO: 7150885 - DNA, 21 bp, Homo sapiens
ttctctggtcaagcacacata

SEQ ID NO: 7150886 - DNA, 21 bp, Homo sapiens
ttctctggtcaagcacacata

SEQ ID NO: 7150887 - DNA, 22 bp, Homo sapiens
ttctggaaatgaatgctaggaa

SEQ ID NO: 7150888 - DNA, 22 bp, Homo sapiens
ttctggaaatgcacaactaatt

SEQ ID NO: 7150889 - DNA, 22 bp, Homo sapiens
ttctggaaatgcacaactaatt

SEQ ID NO: 7150890 - DNA, 22 bp, Homo sapiens
ttctggaatatttgacacaatt

SEQ ID NO: 7150891 - DNA, 22 bp, Homo sapiens
ttctggaatatttgacacaatt

SEQ ID NO: 7150892 - DNA, 22 bp, Homo sapiens
ttctggaatactaagttccttt

SEQ ID NO: 7150893 - DNA, 22 bp, Homo sapiens
ttctggaatactaagttccttt

SEQ ID NO: 7150894 - DNA, 22 bp, Homo sapiens
ttctggaagttttctcctgtgg

SEQ ID NO: 7150895 - DNA, 22 bp, Homo sapiens
ttctggaagttggaaatagcag

SEQ ID NO: 7150896 - DNA, 22 bp, Homo sapiens
ttctggaagttttctcctgtgg

SEQ ID NO: 7150897 - DNA, 22 bp, Homo sapiens
ttctggaagtgttagaatctgg

SEQ ID NO: 7150898 - DNA, 22 bp, Homo sapiens
ttctggaagtggaatttttgta

SEQ ID NO: 7150899 - DNA, 22 bp, Homo sapiens
ttctggaagggtggagtagctt

SEQ ID NO: 7150900 - DNA, 22 bp, Homo sapiens
ttctggaagtggaatttttgta

SEQ ID NO: 7150901 - DNA, 22 bp, Homo sapiens
ttctggaagttggaaatagcag

SEQ ID NO: 7150902 - DNA, 22 bp, Homo sapiens
ttctggaagtgttagaatctgg

SEQ ID NO: 7150903 - DNA, 22 bp, Homo sapiens
ttctggagaataatcagcattg

SEQ ID NO: 7150904 - DNA, 22 bp, Homo sapiens
ttctggagaatcaccaccaggc

SEQ ID NO: 7150905 - DNA, 22 bp, Homo sapiens
ttctggagaataatcagcattg

SEQ ID NO: 7150906 - DNA, 22 bp, Homo sapiens
ttctggagaaaattctgtcatt

SEQ ID NO: 7150907 - DNA, 23 bp, Homo sapiens
ttctggagaaaggaccatagctt

SEQ ID NO: 7150908 - DNA, 22 bp, Homo sapiens
ttctggagacccagcaacaggg

SEQ ID NO: 7150909 - DNA, 22 bp, Homo sapiens
ttctggagacccagcaacaggg

SEQ ID NO: 7150910 - DNA, 22 bp, Homo sapiens
ttctggagagaaaccttacaaa

SEQ ID NO: 7150911 - DNA, 22 bp, Homo sapiens
ttctggagagaagaccagtgtg

SEQ ID NO: 7150912 - DNA, 22 bp, Homo sapiens
ttctggaattcttgcagccact

SEQ ID NO: 7150913 - DNA, 22 bp, Homo sapiens
ttctggaattctggctatggta

SEQ ID NO: 7150914 - DNA, 22 bp, Homo sapiens
ttctggaatgcctgttctaatt

SEQ ID NO: 7150915 - DNA, 22 bp, Homo sapiens
ttctggaatatttgacacaatt

SEQ ID NO: 7150916 - DNA, 22 bp, Homo sapiens
ttctggaatcctcaaaacatga

SEQ ID NO: 7150917 - DNA, 22 bp, Homo sapiens
ttctggaatgcctgttctaatt

SEQ ID NO: 7150918 - DNA, 22 bp, Homo sapiens
ttctggaattcttgcagccact

SEQ ID NO: 7150919 - DNA, 19 bp, Homo sapiens
ttctggacagcagaaacca

SEQ ID NO: 7150920 - DNA, 22 bp, Homo sapiens
ttctggacttgccttgctgatg

SEQ ID NO: 7150921 - DNA, 22 bp, Homo sapiens
ttctggagccccaagatctgta

SEQ ID NO: 7150922 - DNA, 22 bp, Homo sapiens
ttctggagccgggcctgggcag

SEQ ID NO: 7150923 - DNA, 22 bp, Homo sapiens
ttctggagctaaagtccactct

SEQ ID NO: 7150924 - DNA, 22 bp, Homo sapiens
ttctggagctaaagtccactct

SEQ ID NO: 7150925 - DNA, 22 bp, Homo sapiens
ttctgtaagctaccaagtttgt

SEQ ID NO: 7150926 - DNA, 19 bp, Homo sapiens
ttctgtaaggacattaatc

SEQ ID NO: 7150927 - DNA, 22 bp, Homo sapiens
ttctgtaagctaccaagtttgt

SEQ ID NO: 7150928 - DNA, 22 bp, Homo sapiens
ttctgtaaacatcaagtgcctg

SEQ ID NO: 7150929 - DNA, 22 bp, Homo sapiens
ttctggagctaaagtccactct

SEQ ID NO: 7150930 - DNA, 22 bp, Homo sapiens
ttctggagctctcgaccccact

SEQ ID NO: 7150931 - DNA, 22 bp, Homo sapiens
ttctggttttactgaggaaatc

SEQ ID NO: 7150932 - DNA, 22 bp, Homo sapiens
ttctggttttactgaggaaatc

SEQ ID NO: 7150933 - DNA, 22 bp, Homo sapiens
ttctggagaggaacagaaaggt

SEQ ID NO: 7150934 - DNA, 22 bp, Homo sapiens
ttctggagatagtcaggcatta

SEQ ID NO: 7150935 - DNA, 22 bp, Homo sapiens
ttctggagatctgcctatggga

SEQ ID NO: 7150936 - DNA, 22 bp, Homo sapiens
ttctggagatgacttttagaaa

SEQ ID NO: 7150937 - DNA, 22 bp, Homo sapiens
ttctggagattgagaaggcatt

SEQ ID NO: 7150938 - DNA, 22 bp, Homo sapiens
ttctggagattgagaaggcatt

SEQ ID NO: 7150939 - DNA, 22 bp, Homo sapiens
ttctgtgaatcttttttcccac

SEQ ID NO: 7150940 - DNA, 22 bp, Homo sapiens
ttctgtggcagtttgggaggtg

SEQ ID NO: 7150941 - DNA, 22 bp, Homo sapiens
ttctgtggcagtttgggaggtg

SEQ ID NO: 7150942 - DNA, 22 bp, Homo sapiens
ttctgtgtcttcttgttctgtg

SEQ ID NO: 7150943 - DNA, 22 bp, Homo sapiens
ttctgtgtcttcttgttctgtg

SEQ ID NO: 7150944 - DNA, 22 bp, Homo sapiens
ttctgtgtgccagagttgtgct

SEQ ID NO: 7150945 - DNA, 22 bp, Homo sapiens
ttctgtctctgtgtttacatta

SEQ ID NO: 7150946 - DNA, 22 bp, Homo sapiens
ttctgtctgatggtgccagaac

SEQ ID NO: 7150947 - DNA, 22 bp, Homo sapiens
ttctgtctggaaaaggacatag

SEQ ID NO: 7150948 - DNA, 22 bp, Homo sapiens
ttctgtaattctgttagtttca

SEQ ID NO: 7150949 - DNA, 22 bp, Homo sapiens
ttctgtacaagttgtggctgct

SEQ ID NO: 7150950 - DNA, 22 bp, Homo sapiens
ttctgtaagggatttattctga

SEQ ID NO: 7150951 - DNA, 22 bp, Homo sapiens
ttctgtaagggatttattctga

SEQ ID NO: 7150952 - DNA, 22 bp, Homo sapiens
ttctgtctgtaaacttctcaat

SEQ ID NO: 7150953 - DNA, 22 bp, Homo sapiens
ttctgtctgtaaacttctcaat

SEQ ID NO: 7150954 - DNA, 22 bp, Homo sapiens
ttctgtctgtaaacttctcaat

SEQ ID NO: 7150955 - DNA, 22 bp, Homo sapiens
ttctgtctgtaaacttctcaat

SEQ ID NO: 7150956 - DNA, 22 bp, Homo sapiens
ttctgtcttcccactgaggagc

SEQ ID NO: 7150957 - DNA, 23 bp, Homo sapiens
ttctgtcttgctgtcagctttct

SEQ ID NO: 7150958 - DNA, 22 bp, Homo sapiens
ttcttacattactttacatgtg

SEQ ID NO: 7150959 - DNA, 22 bp, Homo sapiens
ttcttacattagtctgtgcttt

SEQ ID NO: 7150960 - DNA, 22 bp, Homo sapiens
ttctgtgttctgtgcaatgagc

SEQ ID NO: 7150961 - DNA, 22 bp, Homo sapiens
ttctgtgttgtgacattctaga

SEQ ID NO: 7150962 - DNA, 22 bp, Homo sapiens
ttctgtgttgtgacattctaga

SEQ ID NO: 7150963 - DNA, 19 bp, Homo sapiens
ttctgtgttaattccttta

SEQ ID NO: 7150964 - DNA, 22 bp, Homo sapiens
ttctgtgtgtctcagcaagctg

SEQ ID NO: 7150965 - DNA, 22 bp, Homo sapiens
ttctgtgtgggtagctcctgtt

SEQ ID NO: 7150966 - DNA, 22 bp, Homo sapiens
ttctgtgtgtctcagcaagctg

SEQ ID NO: 7150967 - DNA, 22 bp, Homo sapiens
ttctgtgtgccagagttgtgct

SEQ ID NO: 7150968 - DNA, 22 bp, Homo sapiens
ttctgtgtgctgtcttggcttt

SEQ ID NO: 7150969 - DNA, 22 bp, Homo sapiens
ttctgtgtgcttactggtgttc

SEQ ID NO: 7150970 - DNA, 22 bp, Homo sapiens
ttcttagtggtagtcatctttg

SEQ ID NO: 7150971 - DNA, 19 bp, Homo sapiens
ttcttagtctcatgcatga

SEQ ID NO: 7150972 - DNA, 22 bp, Homo sapiens
ttcttagtcatctgagccagcc

SEQ ID NO: 7150973 - DNA, 20 bp, Homo sapiens
ttcttagtagagcatgtatt

SEQ ID NO: 7150974 - DNA, 20 bp, Homo sapiens
ttcttagtagagcatgtatt

SEQ ID NO: 7150975 - DNA, 22 bp, Homo sapiens
ttcttagtagcatagctatatt

SEQ ID NO: 7150976 - DNA, 22 bp, Homo sapiens
ttcttagggctggacaaggggc

SEQ ID NO: 7150977 - DNA, 22 bp, Homo sapiens
ttcttagaagaaacatctaaaa

SEQ ID NO: 7150978 - DNA, 22 bp, Homo sapiens
ttcttagaagaaacatctaaaa

SEQ ID NO: 7150979 - DNA, 22 bp, Homo sapiens
ttcttagagatggttaaaaata

SEQ ID NO: 7150980 - DNA, 22 bp, Homo sapiens
ttcttatgttcacataattcca

SEQ ID NO: 7150981 - DNA, 22 bp, Homo sapiens
ttcttatattgggtcatggata

SEQ ID NO: 7150982 - DNA, 22 bp, Homo sapiens
ttcttatagaagcaaccattgt

SEQ ID NO: 7150983 - DNA, 19 bp, Homo sapiens
ttcttagtctcatgcatga

SEQ ID NO: 7150984 - DNA, 22 bp, Homo sapiens
ttcttagtggtagtcatctttg

SEQ ID NO: 7150985 - DNA, 22 bp, Homo sapiens
ttcttagttcaactaaaattta

SEQ ID NO: 7150986 - DNA, 22 bp, Homo sapiens
ttcttataagttaatatttcca

SEQ ID NO: 7150987 - DNA, 22 bp, Homo sapiens
ttccttcttttacaccataaat

SEQ ID NO: 7150988 - DNA, 22 bp, Homo sapiens
ttccttgaatgagtcatggaaa

SEQ ID NO: 7150989 - DNA, 22 bp, Homo sapiens
ttccttggccccatgcccaggg

SEQ ID NO: 7150990 - DNA, 22 bp, Homo sapiens
ttccttggccacactggtgctt

SEQ ID NO: 7150991 - DNA, 22 bp, Homo sapiens
ttccttggatacaagtaacttt

SEQ ID NO: 7150992 - DNA, 20 bp, Homo sapiens
ttccttggattgtgtcttga

SEQ ID NO: 7150993 - DNA, 22 bp, Homo sapiens
ttccttggagttaagaccctgg

SEQ ID NO: 7150994 - DNA, 22 bp, Homo sapiens
ttccttggagtcaaacagggag

SEQ ID NO: 7150995 - DNA, 22 bp, Homo sapiens
ttccttggagttaagaccctgg

SEQ ID NO: 7150996 - DNA, 22 bp, Homo sapiens
ttccttggagcgctaaagctct

SEQ ID NO: 7150997 - DNA, 22 bp, Homo sapiens
ttccttggaagggtaattgcaa

SEQ ID NO: 7150998 - DNA, 22 bp, Homo sapiens
ttccttcttccagaggctgccc

SEQ ID NO: 7150999 - DNA, 22 bp, Homo sapiens
ttccttcttgtaatgatctgcc

SEQ ID NO: 7151000 - DNA, 22 bp, Homo sapiens
ttccttcttccaaacccatcat

SEQ ID NO: 7151001 - DNA, 22 bp, Homo sapiens
ttccttcttccaaacccatcat

SEQ ID NO: 7151002 - DNA, 20 bp, Homo sapiens
ttcctgtatacaaagagttc

SEQ ID NO: 7151003 - DNA, 22 bp, Homo sapiens
ttcctgtatgtcagtgaagagc

SEQ ID NO: 7151004 - DNA, 22 bp, Homo sapiens
ttccttctggaagcttcagggg

SEQ ID NO: 7151005 - DNA, 22 bp, Homo sapiens
ttcctgggtggtcctggtagag

SEQ ID NO: 7151006 - DNA, 19 bp, Homo sapiens
ttcctggggttccattgtg

SEQ ID NO: 7151007 - DNA, 22 bp, Homo sapiens
ttcctgggtggtcctggtagag

SEQ ID NO: 7151008 - DNA, 22 bp, Homo sapiens
ttcctgggtttacgtattgggt

SEQ ID NO: 7151009 - DNA, 22 bp, Homo sapiens
ttcctgggggcagcagtcttga

SEQ ID NO: 7151010 - DNA, 22 bp, Homo sapiens
ttcctggggcttagcaatggag

SEQ ID NO: 7151011 - DNA, 22 bp, Homo sapiens
ttcctggggctccagctaccag

SEQ ID NO: 7151012 - DNA, 22 bp, Homo sapiens
ttcctggtaacaatctcaaagt

SEQ ID NO: 7151013 - DNA, 22 bp, Homo sapiens
ttcctggtaacaatctcaaagt

SEQ ID NO: 7151014 - DNA, 22 bp, Homo sapiens
ttcctggtaaattatgtccagg

SEQ ID NO: 7151015 - DNA, 22 bp, Homo sapiens
ttcctggtaaattatgtccagg

SEQ ID NO: 7151016 - DNA, 22 bp, Homo sapiens
ttcctggtagtaagacatctgg

SEQ ID NO: 7151017 - DNA, 22 bp, Homo sapiens
ttcctggtagtaagacatctgg

SEQ ID NO: 7151018 - DNA, 22 bp, Homo sapiens
ttcctggtcccgttcttcactg

SEQ ID NO: 7151019 - DNA, 22 bp, Homo sapiens
ttcctggtagtaagacatctgg

SEQ ID NO: 7151020 - DNA, 22 bp, Homo sapiens
ttcctggtcccgttcttcactg

SEQ ID NO: 7151021 - DNA, 22 bp, Homo sapiens
ttcctggtcctattatatacac

SEQ ID NO: 7151022 - DNA, 22 bp, Homo sapiens
ttcctggtctatttagaattgc

SEQ ID NO: 7151023 - DNA, 22 bp, Homo sapiens
ttcctggtctgtgccattcaga

SEQ ID NO: 7151024 - DNA, 22 bp, Homo sapiens
ttcctggtgacctcactggtag

SEQ ID NO: 7151025 - DNA, 22 bp, Homo sapiens
ttcctggtgacctcactggtag

SEQ ID NO: 7151026 - DNA, 22 bp, Homo sapiens
ttcctggtgacctcactggtag

SEQ ID NO: 7151027 - DNA, 22 bp, Homo sapiens
ttcctggtgagatttcgttctg

SEQ ID NO: 7151028 - DNA, 22 bp, Homo sapiens
ttcctggtctgtgccattcaga

SEQ ID NO: 7151029 - DNA, 22 bp, Homo sapiens
ttcctggtggctttgccaactg

SEQ ID NO: 7151030 - DNA, 22 bp, Homo sapiens
ttcctggtggtggtgacagcac

SEQ ID NO: 7151031 - DNA, 22 bp, Homo sapiens
ttcctggttggattctgattaa

SEQ ID NO: 7151032 - DNA, 22 bp, Homo sapiens
ttcctggttggattctgattaa

SEQ ID NO: 7151033 - DNA, 22 bp, Homo sapiens
ttcctggtttatacctgtatca

SEQ ID NO: 7151034 - DNA, 22 bp, Homo sapiens
ttcctggtttatacctgtatca

SEQ ID NO: 7151035 - DNA, 22 bp, Homo sapiens
ttcctggtttatggaaagcatg

SEQ ID NO: 7151036 - DNA, 22 bp, Homo sapiens
ttcctggtttatggaaagcatg

SEQ ID NO: 7151037 - DNA, 22 bp, Homo sapiens
ttcctggtttgcctggaatcca

SEQ ID NO: 7151038 - DNA, 22 bp, Homo sapiens
ttcctgtagttgtgcaatgtac

SEQ ID NO: 7151039 - DNA, 22 bp, Homo sapiens
ttcctggtttgcctggaatcca

SEQ ID NO: 7151040 - DNA, 22 bp, Homo sapiens
ttcctgtagttgtgcaatgtac

SEQ ID NO: 7151041 - DNA, 20 bp, Homo sapiens
ttcctgtatacaaagagttc

SEQ ID NO: 7151042 - DNA, 22 bp, Homo sapiens
ttcctgctccatttgctgagct

SEQ ID NO: 7151043 - DNA, 22 bp, Homo sapiens
ttcctgcctacatgccttatgc

SEQ ID NO: 7151044 - DNA, 22 bp, Homo sapiens
ttcctgcttcctggcctcacaa

SEQ ID NO: 7151045 - DNA, 22 bp, Homo sapiens
ttcctggaaattatgctcacct

SEQ ID NO: 7151046 - DNA, 22 bp, Homo sapiens
ttcctgcaggccatagagcctg

SEQ ID NO: 7151047 - DNA, 22 bp, Homo sapiens
ttcctgcaggccccagttcaca

SEQ ID NO: 7151048 - DNA, 22 bp, Homo sapiens
ttcctgcatggattgaggctat

SEQ ID NO: 7151049 - DNA, 22 bp, Homo sapiens
ttcctgcccctgagagctccca

SEQ ID NO: 7151050 - DNA, 22 bp, Homo sapiens
ttcctgcccctgagagctccca

SEQ ID NO: 7151051 - DNA, 22 bp, Homo sapiens
ttcctgccctgcctgtgccact

SEQ ID NO: 7151052 - DNA, 22 bp, Homo sapiens
ttcctgcctacatgccttatgc

SEQ ID NO: 7151053 - DNA, 22 bp, Homo sapiens
ttcctggcaccaccacttctag

SEQ ID NO: 7151054 - DNA, 22 bp, Homo sapiens
ttcctggcacccttgttagcct

SEQ ID NO: 7151055 - DNA, 22 bp, Homo sapiens
ttcctggcaaagtgagcatcac

SEQ ID NO: 7151056 - DNA, 17 bp, Homo sapiens
ttcctggaagtcattcc

SEQ ID NO: 7151057 - DNA, 17 bp, Homo sapiens
ttcctggaagtcattcc

SEQ ID NO: 7151058 - DNA, 22 bp, Homo sapiens
ttcctggagagttttcccaaag

SEQ ID NO: 7151059 - DNA, 21 bp, Homo sapiens
ttcctggggacttccgtggga

SEQ ID NO: 7151060 - DNA, 22 bp, Homo sapiens
ttcctggctcacagcagtgggg

SEQ ID NO: 7151061 - DNA, 22 bp, Homo sapiens
ttcctggcctctctctgagcag

SEQ ID NO: 7151062 - DNA, 22 bp, Homo sapiens
ttcctggcactgcagtggttga

SEQ ID NO: 7151063 - DNA, 23 bp, Homo sapiens
ttcctgagtgctggagagagtgc

SEQ ID NO: 7151064 - DNA, 23 bp, Homo sapiens
ttcctgagtgctggagagagtgc

SEQ ID NO: 7151065 - DNA, 22 bp, Homo sapiens
ttcctgagtcgccgagtctatg

SEQ ID NO: 7151066 - DNA, 23 bp, Homo sapiens
ttcctgagtgctggagagagtgc

SEQ ID NO: 7151067 - DNA, 22 bp, Homo sapiens
ttcctgatcccccaggacaaag

SEQ ID NO: 7151068 - DNA, 22 bp, Homo sapiens
ttcctgatcccccaggacaaag

SEQ ID NO: 7151069 - DNA, 22 bp, Homo sapiens
ttcctgatgcacacagtcattt

SEQ ID NO: 7151070 - DNA, 22 bp, Homo sapiens
ttcctgatgcacacagtcattt

SEQ ID NO: 7151071 - DNA, 22 bp, Homo sapiens
ttcctgatgcacacagtcattt

SEQ ID NO: 7151072 - DNA, 20 bp, Homo sapiens
ttcctgattgtcatttctgc

SEQ ID NO: 7151073 - DNA, 22 bp, Homo sapiens
ttcctgcaaaactactagtagc

SEQ ID NO: 7151074 - DNA, 22 bp, Homo sapiens
ttcctgcacagcccttcctgag

SEQ ID NO: 7151075 - DNA, 22 bp, Homo sapiens
ttcctgcagcaaggagaagctg

SEQ ID NO: 7151076 - DNA, 22 bp, Homo sapiens
ttcctgaggtgattctaatgtg

SEQ ID NO: 7151077 - DNA, 22 bp, Homo sapiens
ttcctgagtcccgggtaaagat

SEQ ID NO: 7151078 - DNA, 22 bp, Homo sapiens
ttcctgagggccccagaggagg

SEQ ID NO: 7151079 - DNA, 22 bp, Homo sapiens
ttcctgagggccccagaggagg

SEQ ID NO: 7151080 - DNA, 22 bp, Homo sapiens
ttcctgagcaccagacactgca

SEQ ID NO: 7151081 - DNA, 22 bp, Homo sapiens
ttcctgagcaccagacactgca

SEQ ID NO: 7151082 - DNA, 22 bp, Homo sapiens
ttcctgagcaccagacactgca

SEQ ID NO: 7151083 - DNA, 22 bp, Homo sapiens
ttcctgagcaccagacactgca

SEQ ID NO: 7151084 - DNA, 22 bp, Homo sapiens
ttcctgagcaccagacactgca

SEQ ID NO: 7151085 - DNA, 22 bp, Homo sapiens
ttcctgagcttttaacctagtc

SEQ ID NO: 7151086 - DNA, 22 bp, Homo sapiens
ttcctgagcttttaacctagtc

SEQ ID NO: 7151087 - DNA, 22 bp, Homo sapiens
ttcctgaggaggaccaggacca

SEQ ID NO: 7151088 - DNA, 22 bp, Homo sapiens
ttcctgaggaggaccaggacca

SEQ ID NO: 7151089 - DNA, 22 bp, Homo sapiens
ttcctgagaccctcacagtgat

SEQ ID NO: 7151090 - DNA, 22 bp, Homo sapiens
ttcctgagaccctcacagtgat

SEQ ID NO: 7151091 - DNA, 22 bp, Homo sapiens
ttcctgagaacatggcagctta

SEQ ID NO: 7151092 - DNA, 17 bp, Homo sapiens
ttccagtttagtattgt

SEQ ID NO: 7151093 - DNA, 22 bp, Homo sapiens
ttccagttggtagaatgtaagg

SEQ ID NO: 7151094 - DNA, 22 bp, Homo sapiens
ttccagttggtagaatgtaagg

SEQ ID NO: 7151095 - DNA, 22 bp, Homo sapiens
ttctctcttccagttcccactt

SEQ ID NO: 7151096 - DNA, 22 bp, Homo sapiens
ttctctcttccagttcccactt

SEQ ID NO: 7151097 - DNA, 22 bp, Homo sapiens
ttctctcttttgggtaggaggt

SEQ ID NO: 7151098 - DNA, 22 bp, Homo sapiens
ttctctcttccagttcccactt

SEQ ID NO: 7151099 - DNA, 22 bp, Homo sapiens
ttctctcttactgccatgctgt

SEQ ID NO: 7151100 - DNA, 22 bp, Homo sapiens
ttctctcttactgccatgctgt

SEQ ID NO: 7151101 - DNA, 22 bp, Homo sapiens
ttctctcttactgccatgctgt

SEQ ID NO: 7151102 - DNA, 22 bp, Homo sapiens
ttctctctgttatggattttac

SEQ ID NO: 7151103 - DNA, 22 bp, Homo sapiens
ttctctctgtggtcccattttg

SEQ ID NO: 7151104 - DNA, 22 bp, Homo sapiens
ttctctctgtgtcattatggac

SEQ ID NO: 7151105 - DNA, 22 bp, Homo sapiens
ttctctctgtggtcccattttg

SEQ ID NO: 7151106 - DNA, 22 bp, Homo sapiens
ttctctggaactgaaacaagat

SEQ ID NO: 7151107 - DNA, 22 bp, Homo sapiens
ttctctggaactgaaacaagat

SEQ ID NO: 7151108 - DNA, 22 bp, Homo sapiens
ttctctggacagtgaagagagg

SEQ ID NO: 7151109 - DNA, 22 bp, Homo sapiens
ttctctggaaggctctacggga

SEQ ID NO: 7151110 - DNA, 22 bp, Homo sapiens
ttctctggaactgaaacaagat

SEQ ID NO: 7151111 - DNA, 22 bp, Homo sapiens
ttctctgctacatactagggct

SEQ ID NO: 7151112 - DNA, 22 bp, Homo sapiens
ttctctgctacatactagggct

SEQ ID NO: 7151113 - DNA, 19 bp, Homo sapiens
ttctctgctacattctcag

SEQ ID NO: 7151114 - DNA, 22 bp, Homo sapiens
ttctctgagatagactaagtgg

SEQ ID NO: 7151115 - DNA, 22 bp, Homo sapiens
ttctctgagtacgtttcagtgt

SEQ ID NO: 7151116 - DNA, 22 bp, Homo sapiens
ttctctgacccccttaaatatt

SEQ ID NO: 7151117 - DNA, 22 bp, Homo sapiens
ttctctgcagctcctggctggg

SEQ ID NO: 7151118 - DNA, 22 bp, Homo sapiens
ttctctctggacctgggatgcg

SEQ ID NO: 7151119 - DNA, 22 bp, Homo sapiens
ttctctcctcctagaggctttt

SEQ ID NO: 7151120 - DNA, 22 bp, Homo sapiens
ttctctcctcctagaggctttt

SEQ ID NO: 7151121 - DNA, 22 bp, Homo sapiens
ttctctcctcctagaggctttt

SEQ ID NO: 7151122 - DNA, 22 bp, Homo sapiens
ttctctctgagagcatctggaa

SEQ ID NO: 7151123 - DNA, 22 bp, Homo sapiens
ttctctcctacccagtatccat

SEQ ID NO: 7151124 - DNA, 22 bp, Homo sapiens
ttctctcctacccagtatccat

SEQ ID NO: 7151125 - DNA, 22 bp, Homo sapiens
ttctctcccatgaagcttctat

SEQ ID NO: 7151126 - DNA, 22 bp, Homo sapiens
ttctctcccatgaagcttctat

SEQ ID NO: 7151127 - DNA, 21 bp, Homo sapiens
ttctctccatatgcccagccc

SEQ ID NO: 7151128 - DNA, 22 bp, Homo sapiens
ttctctccagactgcagtgggt

SEQ ID NO: 7151129 - DNA, 22 bp, Homo sapiens
ttctctccagtcctggattctg

SEQ ID NO: 7151130 - DNA, 22 bp, Homo sapiens
ttctctccagtcctggattctg

SEQ ID NO: 7151131 - DNA, 21 bp, Homo sapiens
ttctctccatatgcccagccc

SEQ ID NO: 7151132 - DNA, 21 bp, Homo sapiens
ttctctccatatgcccagccc

SEQ ID NO: 7151133 - DNA, 21 bp, Homo sapiens
ttctctccatatgcccagccc

SEQ ID NO: 7151134 - DNA, 22 bp, Homo sapiens
ttctctcccatgaagcttctat

SEQ ID NO: 7151135 - DNA, 22 bp, Homo sapiens
ttctctccagactgcagtgggt

SEQ ID NO: 7151136 - DNA, 22 bp, Homo sapiens
ttctctccagactgcagtgggt

SEQ ID NO: 7151137 - DNA, 22 bp, Homo sapiens
ttctctccagactgcagtgggt

SEQ ID NO: 7151138 - DNA, 22 bp, Homo sapiens
ttctctcagttaaactttgtga

SEQ ID NO: 7151139 - DNA, 22 bp, Homo sapiens
ttctctcagttaaactttgtga

SEQ ID NO: 7151140 - DNA, 22 bp, Homo sapiens
ttctctcattcaaattaaagtg

SEQ ID NO: 7151141 - DNA, 22 bp, Homo sapiens
ttctctcattcaaattaaagtg

SEQ ID NO: 7151142 - DNA, 22 bp, Homo sapiens
ttctctcattcaaattaaagtg

SEQ ID NO: 7151143 - DNA, 22 bp, Homo sapiens
ttctctaatggtgatgattaga

SEQ ID NO: 7151144 - DNA, 22 bp, Homo sapiens
ttctctaatggtgatgattaga

SEQ ID NO: 7151145 - DNA, 21 bp, Homo sapiens
ttctctacctctagtgctgta

SEQ ID NO: 7151146 - DNA, 22 bp, Homo sapiens
ttctctacttcacaagggatgg

SEQ ID NO: 7151147 - DNA, 22 bp, Homo sapiens
ttctctaagccttagtttcttc

SEQ ID NO: 7151148 - DNA, 22 bp, Homo sapiens
ttctctaagctggctgaggtct

SEQ ID NO: 7151149 - DNA, 22 bp, Homo sapiens
ttctctaagccttagtttcttc

SEQ ID NO: 7151150 - DNA, 22 bp, Homo sapiens
ttctctaaggcttggcttccct

SEQ ID NO: 7151151 - DNA, 22 bp, Homo sapiens
ttctctaaggtcccgttctgga

SEQ ID NO: 7151152 - DNA, 22 bp, Homo sapiens
ttctctaaggtcccgttctgga

SEQ ID NO: 7151153 - DNA, 22 bp, Homo sapiens
ttctctaatacattttgacaaa

SEQ ID NO: 7151154 - DNA, 22 bp, Homo sapiens
ttctctaggttttagatgaaga

SEQ ID NO: 7151155 - DNA, 23 bp, Homo sapiens
ttctctagatgaggtgaagatgg

SEQ ID NO: 7151156 - DNA, 22 bp, Homo sapiens
ttctctagcagatcataatgaa

SEQ ID NO: 7151157 - DNA, 22 bp, Homo sapiens
ttctctatcttgaatgcgtcaa

SEQ ID NO: 7151158 - DNA, 19 bp, Homo sapiens
ttctctattatgtcttctc

SEQ ID NO: 7151159 - DNA, 19 bp, Homo sapiens
ttctctattatgtcttctc

SEQ ID NO: 7151160 - DNA, 22 bp, Homo sapiens
ttctctaagagttatatgaatt

SEQ ID NO: 7151161 - DNA, 22 bp, Homo sapiens
ttctctaagagttatatgaatt

SEQ ID NO: 7151162 - DNA, 23 bp, Homo sapiens
ttctcctgaggaagcagggactg

SEQ ID NO: 7151163 - DNA, 22 bp, Homo sapiens
ttctcctgagttcccaggtcta

SEQ ID NO: 7151164 - DNA, 22 bp, Homo sapiens
ttctcctctgttggccttccct

SEQ ID NO: 7151165 - DNA, 22 bp, Homo sapiens
ttctcctctgttggccttccct

SEQ ID NO: 7151166 - DNA, 22 bp, Homo sapiens
ttctccagagggctctgcagga

SEQ ID NO: 7151167 - DNA, 22 bp, Homo sapiens
ttctccagaccctcctgcagac

SEQ ID NO: 7151168 - DNA, 22 bp, Homo sapiens
ttctccagacaggcagagggaa

SEQ ID NO: 7151169 - DNA, 22 bp, Homo sapiens
ttctccagaccactgcctctgt

SEQ ID NO: 7151170 - DNA, 22 bp, Homo sapiens
ttctccaagggatttctgcctt

SEQ ID NO: 7151171 - DNA, 22 bp, Homo sapiens
ttctccaaggttcatatttatc

SEQ ID NO: 7151172 - DNA, 22 bp, Homo sapiens
ttctccacccactcttttgttg

SEQ ID NO: 7151173 - DNA, 22 bp, Homo sapiens
ttctccacccactcttttgttg

SEQ ID NO: 7151174 - DNA, 22 bp, Homo sapiens
ttctccaagatgaagctgtgta

SEQ ID NO: 7151175 - DNA, 22 bp, Homo sapiens
ttctccaacacaagcatgatgt

SEQ ID NO: 7151176 - DNA, 22 bp, Homo sapiens
ttctcagggtttgtgcaggctt

SEQ ID NO: 7151177 - DNA, 22 bp, Homo sapiens
ttctcagctttccttgcagtta

SEQ ID NO: 7151178 - DNA, 22 bp, Homo sapiens
ttctcaggaactcagtgtcagc

SEQ ID NO: 7151179 - DNA, 22 bp, Homo sapiens
ttctcaggaactcagtgtcagc

SEQ ID NO: 7151180 - DNA, 22 bp, Homo sapiens
ttctcaggcacttcttccccgc

SEQ ID NO: 7151181 - DNA, 22 bp, Homo sapiens
ttctcaggcacttcttccccgc

SEQ ID NO: 7151182 - DNA, 22 bp, Homo sapiens
ttctcagatgattcagataaac

SEQ ID NO: 7151183 - DNA, 22 bp, Homo sapiens
ttctcagatgattcagataaac

SEQ ID NO: 7151184 - DNA, 22 bp, Homo sapiens
ttctcaggcctttgggatggga

SEQ ID NO: 7151185 - DNA, 22 bp, Homo sapiens
ttctcagggtctggatggcctg

SEQ ID NO: 7151186 - DNA, 22 bp, Homo sapiens
ttctcagggtctggatggcctg

SEQ ID NO: 7151187 - DNA, 22 bp, Homo sapiens
ttccttgttctacatccctgcc

SEQ ID NO: 7151188 - DNA, 22 bp, Homo sapiens
ttccttgtgagggctctcttcc

SEQ ID NO: 7151189 - DNA, 22 bp, Homo sapiens
ttccttgtgtaaactctccatc

SEQ ID NO: 7151190 - DNA, 22 bp, Homo sapiens
ttccttgtgtaaactctccatc

SEQ ID NO: 7151191 - DNA, 22 bp, Homo sapiens
ttccttgttaatagtgtctgga

SEQ ID NO: 7151192 - DNA, 22 bp, Homo sapiens
ttccttgttcctaggagatcaa

SEQ ID NO: 7151193 - DNA, 22 bp, Homo sapiens
ttccttgttcctaggagatcaa

SEQ ID NO: 7151194 - DNA, 22 bp, Homo sapiens
ttccttggtgtaactgctccta

SEQ ID NO: 7151195 - DNA, 22 bp, Homo sapiens
ttccttggtacagagtagcttt

SEQ ID NO: 7151196 - DNA, 22 bp, Homo sapiens
ttccttggtagagagaatattt

SEQ ID NO: 7151197 - DNA, 22 bp, Homo sapiens
ttccttggtacagagtagcttt

SEQ ID NO: 7151198 - DNA, 22 bp, Homo sapiens
ttccttgggtgcctacttagag

SEQ ID NO: 7151199 - DNA, 17 bp, Homo sapiens
ttccttgggtgctgggt

SEQ ID NO: 7151200 - DNA, 22 bp, Homo sapiens
gggggaggtgaatgcaataagg

SEQ ID NO: 7151201 - DNA, 22 bp, Homo sapiens
gggggaggtgaatgcaataagg

SEQ ID NO: 7151202 - DNA, 22 bp, Homo sapiens
gggggaggtgaatgcaataagg

SEQ ID NO: 7151203 - DNA, 22 bp, Homo sapiens
gggggagctagtccagctgagg

SEQ ID NO: 7151204 - DNA, 22 bp, Homo sapiens
gggggaggtgaatgcaataagg

SEQ ID NO: 7151205 - DNA, 22 bp, Homo sapiens
gggggaggtgaatgcaataagg

SEQ ID NO: 7151206 - DNA, 22 bp, Homo sapiens
gggggaggtgaatgcaataagg

SEQ ID NO: 7151207 - DNA, 22 bp, Homo sapiens
gggggaggtgaatgcaataagg

SEQ ID NO: 7151208 - DNA, 22 bp, Homo sapiens
gggggaggtgaatgcaataagg

SEQ ID NO: 7151209 - DNA, 22 bp, Homo sapiens
cagaggaccagaaaggggccca

SEQ ID NO: 7151210 - DNA, 22 bp, Homo sapiens
cagaggaccagaaaggggccca

SEQ ID NO: 7151211 - DNA, 22 bp, Homo sapiens
cagaggacctgtgtggccagag

SEQ ID NO: 7151212 - DNA, 22 bp, Homo sapiens
cagaggacctgtgtggccagag

SEQ ID NO: 7151213 - DNA, 22 bp, Homo sapiens
ggggcgccccgagggtgcgcac

SEQ ID NO: 7151214 - DNA, 22 bp, Homo sapiens
ggggcgctcggagggatcccct

SEQ ID NO: 7151215 - DNA, 22 bp, Homo sapiens
ggggcgctcggagggatcccct

SEQ ID NO: 7151216 - DNA, 22 bp, Homo sapiens
ggggcggggctctgagaagcat

SEQ ID NO: 7151217 - DNA, 22 bp, Homo sapiens
ggggcggggctctgagaagcat

SEQ ID NO: 7151218 - DNA, 22 bp, Homo sapiens
cagaggacaatagaatggaaag

SEQ ID NO: 7151219 - DNA, 22 bp, Homo sapiens
cagaggacaactggggcaagga

SEQ ID NO: 7151220 - DNA, 22 bp, Homo sapiens
cagaggacaactggggcaagga

SEQ ID NO: 7151221 - DNA, 22 bp, Homo sapiens
cagaggaagttccttgatgaga

SEQ ID NO: 7151222 - DNA, 22 bp, Homo sapiens
cagaggaagttccttgatgaga

SEQ ID NO: 7151223 - DNA, 22 bp, Homo sapiens
cagaggaagggtgctgcgaaag

SEQ ID NO: 7151224 - DNA, 22 bp, Homo sapiens
cagaggaagggtgctgcgaaag

SEQ ID NO: 7151225 - DNA, 22 bp, Homo sapiens
cagaggaaggctctgggaatgt

SEQ ID NO: 7151226 - DNA, 22 bp, Homo sapiens
cagaggaagggtgctgcgaaag

SEQ ID NO: 7151227 - DNA, 22 bp, Homo sapiens
cagaggaaggctctgggaatgt

SEQ ID NO: 7151228 - DNA, 22 bp, Homo sapiens
cagaggaaggctctgggaatgt

SEQ ID NO: 7151229 - DNA, 22 bp, Homo sapiens
cagaggaaggctctgggaatgt

SEQ ID NO: 7151230 - DNA, 22 bp, Homo sapiens
cagaggaagctgggtgtggagt

SEQ ID NO: 7151231 - DNA, 22 bp, Homo sapiens
cagaggaagctgggtgtggagt

SEQ ID NO: 7151232 - DNA, 22 bp, Homo sapiens
cagaggaagcagacacatcttg

SEQ ID NO: 7151233 - DNA, 22 bp, Homo sapiens
cagaggaagcagacacatcttg

SEQ ID NO: 7151234 - DNA, 22 bp, Homo sapiens
cagaggaagcagacacatcttg

SEQ ID NO: 7151235 - DNA, 22 bp, Homo sapiens
cagaggaagctgggtgtggagt

SEQ ID NO: 7151236 - DNA, 22 bp, Homo sapiens
gggggatgctcaggaggctgct

SEQ ID NO: 7151237 - DNA, 22 bp, Homo sapiens
gggggatgctcaggaggctgct

SEQ ID NO: 7151238 - DNA, 22 bp, Homo sapiens
gggggatgctcaggaggctgct

SEQ ID NO: 7151239 - DNA, 22 bp, Homo sapiens
gggggaggtgaatgcaataagg

SEQ ID NO: 7151240 - DNA, 22 bp, Homo sapiens
gggggaggtgaatgcaataagg

SEQ ID NO: 7151241 - DNA, 22 bp, Homo sapiens
gggggatgctcaggaggctgct

SEQ ID NO: 7151242 - DNA, 22 bp, Homo sapiens
gggggatgctcaggaggctgct

SEQ ID NO: 7151243 - DNA, 22 bp, Homo sapiens
gggggatgctcaggaggctgct

SEQ ID NO: 7151244 - DNA, 22 bp, Homo sapiens
gggggatgctcaggaggctgct

SEQ ID NO: 7151245 - DNA, 22 bp, Homo sapiens
gggggcagaatgtactcttgtc

SEQ ID NO: 7151246 - DNA, 22 bp, Homo sapiens
gggggcagaatgtactcttgtc

SEQ ID NO: 7151247 - DNA, 22 bp, Homo sapiens
gggggcagaatgtactcttgtc

SEQ ID NO: 7151248 - DNA, 19 bp, Homo sapiens
cagaggcactttctcttag

SEQ ID NO: 7151249 - DNA, 22 bp, Homo sapiens
gggggcagtaacctcaaagtgt

SEQ ID NO: 7151250 - DNA, 22 bp, Homo sapiens
gggggcagtaaggatatggaaa

SEQ ID NO: 7151251 - DNA, 22 bp, Homo sapiens
gggggcaggtctggaactttga

SEQ ID NO: 7151252 - DNA, 22 bp, Homo sapiens
gggggcaggtctggaactttga

SEQ ID NO: 7151253 - DNA, 22 bp, Homo sapiens
gggggcaggtctggaactttga

SEQ ID NO: 7151254 - DNA, 22 bp, Homo sapiens
gggggcagtaacctcaaagtgt

SEQ ID NO: 7151255 - DNA, 22 bp, Homo sapiens
gggggcagtaacctcaaagtgt

SEQ ID NO: 7151256 - DNA, 22 bp, Homo sapiens
cagaggcagaggtcatctctgg

SEQ ID NO: 7151257 - DNA, 22 bp, Homo sapiens
cagaggcagaggtcatctctgg

SEQ ID NO: 7151258 - DNA, 22 bp, Homo sapiens
cagaggcagccgggggagaacg

SEQ ID NO: 7151259 - DNA, 22 bp, Homo sapiens
cagaggcaggaagatgggcagt

SEQ ID NO: 7151260 - DNA, 22 bp, Homo sapiens
cagaggcaggaagatgggcagt

SEQ ID NO: 7151261 - DNA, 22 bp, Homo sapiens
cagaggcaggaagatgggcagt

SEQ ID NO: 7151262 - DNA, 22 bp, Homo sapiens
cagaggcaggaagatgggcagt

SEQ ID NO: 7151263 - DNA, 22 bp, Homo sapiens
cagaggcaggaagatgggcagt

SEQ ID NO: 7151264 - DNA, 22 bp, Homo sapiens
cagaggcagaggtcatctctgg

SEQ ID NO: 7151265 - DNA, 22 bp, Homo sapiens
cagaggcagaggtcatctctgg

SEQ ID NO: 7151266 - DNA, 22 bp, Homo sapiens
cagaggcagaggtcatctctgg

SEQ ID NO: 7151267 - DNA, 22 bp, Homo sapiens
cagaggcagaatggagatttgg

SEQ ID NO: 7151268 - DNA, 22 bp, Homo sapiens
cagaggcagaatggagatttgg

SEQ ID NO: 7151269 - DNA, 22 bp, Homo sapiens
cagaggcagaccctccagggcg

SEQ ID NO: 7151270 - DNA, 22 bp, Homo sapiens
cagaggcagaccctccagggcg

SEQ ID NO: 7151271 - DNA, 22 bp, Homo sapiens
cagaggcagaccctccagggcg

SEQ ID NO: 7151272 - DNA, 22 bp, Homo sapiens
cagaggcagaccctccagggcg

SEQ ID NO: 7151273 - DNA, 22 bp, Homo sapiens
cagagctttctgtcacattagt

SEQ ID NO: 7151274 - DNA, 22 bp, Homo sapiens
cagaggaaatgggaaggagata

SEQ ID NO: 7151275 - DNA, 22 bp, Homo sapiens
cagaggaaagtatttctggaag

SEQ ID NO: 7151276 - DNA, 22 bp, Homo sapiens
cagaggaagagatacaagccct

SEQ ID NO: 7151277 - DNA, 22 bp, Homo sapiens
cagaggaagagatacaagccct

SEQ ID NO: 7151278 - DNA, 22 bp, Homo sapiens
cagaggaaatgggaaggagata

SEQ ID NO: 7151279 - DNA, 22 bp, Homo sapiens
cagaggaaatgggaaggagata

SEQ ID NO: 7151280 - DNA, 22 bp, Homo sapiens
cagagctgtcatttgccagtga

SEQ ID NO: 7151281 - DNA, 22 bp, Homo sapiens
cagagctgtcatttgccagtga

SEQ ID NO: 7151282 - DNA, 22 bp, Homo sapiens
cagagcttgaatccaacaaaga

SEQ ID NO: 7151283 - DNA, 22 bp, Homo sapiens
gggctctgcgctcagctccagc

SEQ ID NO: 7151284 - DNA, 22 bp, Homo sapiens
gggctctgcgctcagctccagc

SEQ ID NO: 7151285 - DNA, 22 bp, Homo sapiens
gggctctgcctggctgggagta

SEQ ID NO: 7151286 - DNA, 22 bp, Homo sapiens
gggctctgcgctcagctccagc

SEQ ID NO: 7151287 - DNA, 22 bp, Homo sapiens
gggctctgcgctcagctccagc

SEQ ID NO: 7151288 - DNA, 22 bp, Homo sapiens
gggctctgcagtgacttgaggg

SEQ ID NO: 7151289 - DNA, 22 bp, Homo sapiens
gggctctgcagtgacttgaggg

SEQ ID NO: 7151290 - DNA, 20 bp, Homo sapiens
gggctctgcatccatcagcc

SEQ ID NO: 7151291 - DNA, 20 bp, Homo sapiens
gggctctgcatccatcagcc

SEQ ID NO: 7151292 - DNA, 20 bp, Homo sapiens
gggctctgcatccatcagcc

SEQ ID NO: 7151293 - DNA, 20 bp, Homo sapiens
gggctctgcatccatcagcc

SEQ ID NO: 7151294 - DNA, 21 bp, Homo sapiens
gggctctgccctcctggagct

SEQ ID NO: 7151295 - DNA, 21 bp, Homo sapiens
gggctctgccctcctggagct

SEQ ID NO: 7151296 - DNA, 21 bp, Homo sapiens
gggctctgccctcctggagct

SEQ ID NO: 7151297 - DNA, 21 bp, Homo sapiens
gggctctgccctcctggagct

SEQ ID NO: 7151298 - DNA, 22 bp, Homo sapiens
gggctctgcctggctgggagta

SEQ ID NO: 7151299 - DNA, 22 bp, Homo sapiens
gggctctgcctggctgggagta

SEQ ID NO: 7151300 - DNA, 22 bp, Homo sapiens
gggctcaggtcagggcatcagc

SEQ ID NO: 7151301 - DNA, 22 bp, Homo sapiens
gggctcaggtcagggcatcagc

SEQ ID NO: 7151302 - DNA, 22 bp, Homo sapiens
gggctcaggtcagggcatcagc

SEQ ID NO: 7151303 - DNA, 22 bp, Homo sapiens
gggctcaggtcagggcatcagc

SEQ ID NO: 7151304 - DNA, 22 bp, Homo sapiens
gggctcagggacacatgtgtgt

SEQ ID NO: 7151305 - DNA, 22 bp, Homo sapiens
gggctcagggacacatgtgtgt

SEQ ID NO: 7151306 - DNA, 22 bp, Homo sapiens
gggctcagggacacatgtgtgt

SEQ ID NO: 7151307 - DNA, 22 bp, Homo sapiens
gggctcagggacacatgtgtgt

SEQ ID NO: 7151308 - DNA, 22 bp, Homo sapiens
gggctcagggacacatgtgtgt

SEQ ID NO: 7151309 - DNA, 22 bp, Homo sapiens
gggctcagggacacatgtgtgt

SEQ ID NO: 7151310 - DNA, 22 bp, Homo sapiens
gggctcagggacacatgtgtgt

SEQ ID NO: 7151311 - DNA, 22 bp, Homo sapiens
gggctcagggacacatgtgtgt

SEQ ID NO: 7151312 - DNA, 22 bp, Homo sapiens
gggctcaggtcagggcatcagc

SEQ ID NO: 7151313 - DNA, 22 bp, Homo sapiens
gggctcaggtcagggcatcagc

SEQ ID NO: 7151314 - DNA, 22 bp, Homo sapiens
gggctcagtcctggttctaccc

SEQ ID NO: 7151315 - DNA, 22 bp, Homo sapiens
gggctcagtcctggttctaccc

SEQ ID NO: 7151316 - DNA, 22 bp, Homo sapiens
gggctcagtcctggttctaccc

SEQ ID NO: 7151317 - DNA, 22 bp, Homo sapiens
gggctcagtcctggttctaccc

SEQ ID NO: 7151318 - DNA, 22 bp, Homo sapiens
gggctcagtcctggttctaccc

SEQ ID NO: 7151319 - DNA, 22 bp, Homo sapiens
gggctcaggcctggcctctcac

SEQ ID NO: 7151320 - DNA, 22 bp, Homo sapiens
gggctcaggcctggcctctcac

SEQ ID NO: 7151321 - DNA, 22 bp, Homo sapiens
gggctcaggcctggcctctcac

SEQ ID NO: 7151322 - DNA, 22 bp, Homo sapiens
gggctcaggcctggcctctcac

SEQ ID NO: 7151323 - DNA, 22 bp, Homo sapiens
gggctcaggagtttgaggctgc

SEQ ID NO: 7151324 - DNA, 22 bp, Homo sapiens
gggctcaggagtttgaggctgc

SEQ ID NO: 7151325 - DNA, 22 bp, Homo sapiens
gggctcaggagtttgaggctgc

SEQ ID NO: 7151326 - DNA, 22 bp, Homo sapiens
gggctcaggagtttgaggctgc

SEQ ID NO: 7151327 - DNA, 22 bp, Homo sapiens
gggctcaggagtttgaggctgc

SEQ ID NO: 7151328 - DNA, 22 bp, Homo sapiens
gggctcaggagtttgaggctgc

SEQ ID NO: 7151329 - DNA, 22 bp, Homo sapiens
gggctcaggcctggcctctcac

SEQ ID NO: 7151330 - DNA, 22 bp, Homo sapiens
gggctcaggcctggcctctcac

SEQ ID NO: 7151331 - DNA, 22 bp, Homo sapiens
gggctcagtctggcgtggaatg

SEQ ID NO: 7151332 - DNA, 22 bp, Homo sapiens
gggctcagtctgcggcgcgcgg

SEQ ID NO: 7151333 - DNA, 22 bp, Homo sapiens
gggctcagtctgcggcgcgcgg

SEQ ID NO: 7151334 - DNA, 22 bp, Homo sapiens
gggctcagtctggcgtggaatg

SEQ ID NO: 7151335 - DNA, 22 bp, Homo sapiens
gggctcagtctggcgtggaatg

SEQ ID NO: 7151336 - DNA, 22 bp, Homo sapiens
gggctcagtctggcgtggaatg

SEQ ID NO: 7151337 - DNA, 21 bp, Homo sapiens
gggctcagtggaaaagagtgt

SEQ ID NO: 7151338 - DNA, 21 bp, Homo sapiens
gggctcagtggaaaagagtgt

SEQ ID NO: 7151339 - DNA, 21 bp, Homo sapiens
gggctcagtggaaaagagtgt

SEQ ID NO: 7151340 - DNA, 22 bp, Homo sapiens
gggctcagtctgcggcgcgcgg

SEQ ID NO: 7151341 - DNA, 22 bp, Homo sapiens
gggctcagtctgcggcgcgcgg

SEQ ID NO: 7151342 - DNA, 22 bp, Homo sapiens
gggctcagtcggcaagcccctt

SEQ ID NO: 7151343 - DNA, 22 bp, Homo sapiens
gggctcagtcggcaagcccctt

SEQ ID NO: 7151344 - DNA, 22 bp, Homo sapiens
gggctcagtctgcggcgcgcgg

SEQ ID NO: 7151345 - DNA, 22 bp, Homo sapiens
gggctcagtctgcggcgcgcgg

SEQ ID NO: 7151346 - DNA, 22 bp, Homo sapiens
gggctcagtcctggttctaccc

SEQ ID NO: 7151347 - DNA, 22 bp, Homo sapiens
gggctcagtcggcaagcccctt

SEQ ID NO: 7151348 - DNA, 22 bp, Homo sapiens
gggctcagtcggcaagcccctt

SEQ ID NO: 7151349 - DNA, 22 bp, Homo sapiens
gggctcagtcggcaagcccctt

SEQ ID NO: 7151350 - DNA, 22 bp, Homo sapiens
gggctcagtcggcaagcccctt

SEQ ID NO: 7151351 - DNA, 21 bp, Homo sapiens
gggctcagtggaaaagagtgt

SEQ ID NO: 7151352 - DNA, 22 bp, Homo sapiens
gggctctgatagagattattgc

SEQ ID NO: 7151353 - DNA, 18 bp, Homo sapiens
gggctctgatccttcacc

SEQ ID NO: 7151354 - DNA, 18 bp, Homo sapiens
gggctctgatccttcacc

SEQ ID NO: 7151355 - DNA, 22 bp, Homo sapiens
gggctctgcacgttctggcgtc

SEQ ID NO: 7151356 - DNA, 22 bp, Homo sapiens
gggctctgcacgttctggcgtc

SEQ ID NO: 7151357 - DNA, 22 bp, Homo sapiens
gggctctgcacgttctggcgtc

SEQ ID NO: 7151358 - DNA, 22 bp, Homo sapiens
gggctctgcagagaactggctc

SEQ ID NO: 7151359 - DNA, 22 bp, Homo sapiens
gggctctgcagagaactggctc

SEQ ID NO: 7151360 - DNA, 22 bp, Homo sapiens
gggctctgcagagaactggctc

SEQ ID NO: 7151361 - DNA, 22 bp, Homo sapiens
gggctctgcagtgacttgaggg

SEQ ID NO: 7151362 - DNA, 22 bp, Homo sapiens
gggctctgcagtgacttgaggg

SEQ ID NO: 7151363 - DNA, 22 bp, Homo sapiens
cagaagcaagtagtgattcttt

SEQ ID NO: 7151364 - DNA, 22 bp, Homo sapiens
cagaagcaagggccaaagtctt

SEQ ID NO: 7151365 - DNA, 22 bp, Homo sapiens
cagaagcaagggccaaagtctt

SEQ ID NO: 7151366 - DNA, 22 bp, Homo sapiens
cagaagcaaatgccttgctgag

SEQ ID NO: 7151367 - DNA, 22 bp, Homo sapiens
cagaagcaaatgccttgctgag

SEQ ID NO: 7151368 - DNA, 22 bp, Homo sapiens
cagaagatgctttgtaaaatga

SEQ ID NO: 7151369 - DNA, 22 bp, Homo sapiens
cagaagcaaatgccttgctgag

SEQ ID NO: 7151370 - DNA, 22 bp, Homo sapiens
cagaagcaaatgccttgctgag

SEQ ID NO: 7151371 - DNA, 22 bp, Homo sapiens
cagaagatctcttagtggaggg

SEQ ID NO: 7151372 - DNA, 22 bp, Homo sapiens
cagaagatgcagtgtctgagaa

SEQ ID NO: 7151373 - DNA, 22 bp, Homo sapiens
cagaagatgcagtgtctgagaa

SEQ ID NO: 7151374 - DNA, 22 bp, Homo sapiens
cagaagatgctttgtaaaatga

SEQ ID NO: 7151375 - DNA, 22 bp, Homo sapiens
cagaagatgctttgtaaaatga

SEQ ID NO: 7151376 - DNA, 22 bp, Homo sapiens
cagaagcactaggaggaaacgt

SEQ ID NO: 7151377 - DNA, 23 bp, Homo sapiens
cagaagcacctgttgactgctgc

SEQ ID NO: 7151378 - DNA, 23 bp, Homo sapiens
cagaagcacctgttgactgctgc

SEQ ID NO: 7151379 - DNA, 22 bp, Homo sapiens
cagaagcacatgtttacatgta

SEQ ID NO: 7151380 - DNA, 22 bp, Homo sapiens
cagaagcacatgtttacatgta

SEQ ID NO: 7151381 - DNA, 22 bp, Homo sapiens
cagaagcacatgtttacatgta

SEQ ID NO: 7151382 - DNA, 22 bp, Homo sapiens
cagaagcacatgtttacatgta

SEQ ID NO: 7151383 - DNA, 22 bp, Homo sapiens
cagaagcactaggaggaaacgt

SEQ ID NO: 7151384 - DNA, 22 bp, Homo sapiens
cagaagcactaggaggaaacgt

SEQ ID NO: 7151385 - DNA, 22 bp, Homo sapiens
cagaagcagaacactagattta

SEQ ID NO: 7151386 - DNA, 22 bp, Homo sapiens
cagaagcagattctaaagcaag

SEQ ID NO: 7151387 - DNA, 22 bp, Homo sapiens
cagaagcagattctaaagcaag

SEQ ID NO: 7151388 - DNA, 22 bp, Homo sapiens
cagaagcagattctaaagcaag

SEQ ID NO: 7151389 - DNA, 18 bp, Homo sapiens
cagaagcaggcagtgcag

SEQ ID NO: 7151390 - DNA, 18 bp, Homo sapiens
cagaagcaggcagtgcag

SEQ ID NO: 7151391 - DNA, 22 bp, Homo sapiens
cagaagcagtgagagatgtgca

SEQ ID NO: 7151392 - DNA, 22 bp, Homo sapiens
cagagacagtttcacagggtct

SEQ ID NO: 7151393 - DNA, 20 bp, Homo sapiens
cagagacctgtcttcacaga

SEQ ID NO: 7151394 - DNA, 22 bp, Homo sapiens
cagagactggagtgcagtggcg

SEQ ID NO: 7151395 - DNA, 22 bp, Homo sapiens
cagagagaatcttggcagctga

SEQ ID NO: 7151396 - DNA, 22 bp, Homo sapiens
cagagagaatatgtagtatgga

SEQ ID NO: 7151397 - DNA, 22 bp, Homo sapiens
cagagagaatcttggcagctga

SEQ ID NO: 7151398 - DNA, 22 bp, Homo sapiens
cagagagaatcttggcagctga

SEQ ID NO: 7151399 - DNA, 22 bp, Homo sapiens
cagagagaatcttggcagctga

SEQ ID NO: 7151400 - DNA, 22 bp, Homo sapiens
cagagagaggtgccgataatgg

SEQ ID NO: 7151401 - DNA, 22 bp, Homo sapiens
cagagagagtcaaatctttgct

SEQ ID NO: 7151402 - DNA, 22 bp, Homo sapiens
cagagagagtcaaatctttgct

SEQ ID NO: 7151403 - DNA, 22 bp, Homo sapiens
cagagagagtctgtccctgaag

SEQ ID NO: 7151404 - DNA, 22 bp, Homo sapiens
cagagagaggccactgctatta

SEQ ID NO: 7151405 - DNA, 22 bp, Homo sapiens
cagagagaggccactgctatta

SEQ ID NO: 7151406 - DNA, 22 bp, Homo sapiens
cagagagaggggctgcctggcc

SEQ ID NO: 7151407 - DNA, 22 bp, Homo sapiens
cagagagaggggctgcctggcc

SEQ ID NO: 7151408 - DNA, 19 bp, Homo sapiens
cagagagaccaaggcgcca

SEQ ID NO: 7151409 - DNA, 19 bp, Homo sapiens
cagagagaccaaggcgcca

SEQ ID NO: 7151410 - DNA, 22 bp, Homo sapiens
cagagagaatcttggcagctga

SEQ ID NO: 7151411 - DNA, 22 bp, Homo sapiens
cagagagagcaggaaacctccg

SEQ ID NO: 7151412 - DNA, 22 bp, Homo sapiens
cagagagaggccactgctatta

SEQ ID NO: 7151413 - DNA, 18 bp, Homo sapiens
gggcggaagggaagataa

SEQ ID NO: 7151414 - DNA, 22 bp, Homo sapiens
gggcgcgggaaggagcccgaga

SEQ ID NO: 7151415 - DNA, 17 bp, Homo sapiens
gggcgcgggtagagccc

SEQ ID NO: 7151416 - DNA, 22 bp, Homo sapiens
gggcgctgggtgtcgagactca

SEQ ID NO: 7151417 - DNA, 22 bp, Homo sapiens
cagagcaggcccactgccctcc

SEQ ID NO: 7151418 - DNA, 22 bp, Homo sapiens
gggcgccgtgggaaacagccgg

SEQ ID NO: 7151419 - DNA, 22 bp, Homo sapiens
gggcgcgcacgccagacagcct

SEQ ID NO: 7151420 - DNA, 22 bp, Homo sapiens
cagagcaggaatagggtgttga

SEQ ID NO: 7151421 - DNA, 21 bp, Homo sapiens
cagagcagcgttctgctgtgg

SEQ ID NO: 7151422 - DNA, 22 bp, Homo sapiens
cagagcaggcccactgccctcc

SEQ ID NO: 7151423 - DNA, 22 bp, Homo sapiens
cagagcaggcccactgccctcc

SEQ ID NO: 7151424 - DNA, 22 bp, Homo sapiens
cagagcagcctccagggggagc

SEQ ID NO: 7151425 - DNA, 22 bp, Homo sapiens
cagagcagcctccagggggagc

SEQ ID NO: 7151426 - DNA, 22 bp, Homo sapiens
cagagcagcctccagggggagc

SEQ ID NO: 7151427 - DNA, 22 bp, Homo sapiens
cagagcagcctccagggggagc

SEQ ID NO: 7151428 - DNA, 21 bp, Homo sapiens
cagagcagcgttctgctgtgg

SEQ ID NO: 7151429 - DNA, 21 bp, Homo sapiens
cagagcagcgttctgctgtgg

SEQ ID NO: 7151430 - DNA, 21 bp, Homo sapiens
cagagcagcgttctgctgtgg

SEQ ID NO: 7151431 - DNA, 22 bp, Homo sapiens
cagagcagagtgattgttctgg

SEQ ID NO: 7151432 - DNA, 18 bp, Homo sapiens
cagagcagaggtggagcg

SEQ ID NO: 7151433 - DNA, 22 bp, Homo sapiens
cagagcagagtgattgttctgg

SEQ ID NO: 7151434 - DNA, 18 bp, Homo sapiens
cagagcagaggtggagcg

SEQ ID NO: 7151435 - DNA, 18 bp, Homo sapiens
cagagcagaggtggagcg

SEQ ID NO: 7151436 - DNA, 22 bp, Homo sapiens
cagagcagcagagcttccatgg

SEQ ID NO: 7151437 - DNA, 22 bp, Homo sapiens
cagagcagcagagcttccatgg

SEQ ID NO: 7151438 - DNA, 18 bp, Homo sapiens
gggccctggcgtccgccc

SEQ ID NO: 7151439 - DNA, 22 bp, Homo sapiens
gggccctggctttcctgttctt

SEQ ID NO: 7151440 - DNA, 20 bp, Homo sapiens
gggccctgggattcagagca

SEQ ID NO: 7151441 - DNA, 20 bp, Homo sapiens
gggccctgggattcagagca

SEQ ID NO: 7151442 - DNA, 22 bp, Homo sapiens
gggccctgggattcagagcaag

SEQ ID NO: 7151443 - DNA, 22 bp, Homo sapiens
gggccctgggattcagagcaag

SEQ ID NO: 7151444 - DNA, 22 bp, Homo sapiens
gggccctgggattcagagcaag

SEQ ID NO: 7151445 - DNA, 22 bp, Homo sapiens
cagagagcttagtgtgctgcat

SEQ ID NO: 7151446 - DNA, 21 bp, Homo sapiens
cagagagctagaacttcatga

SEQ ID NO: 7151447 - DNA, 22 bp, Homo sapiens
cagagagcttagtgtgctgcat

SEQ ID NO: 7151448 - DNA, 21 bp, Homo sapiens
cagagagctagaacttcatga

SEQ ID NO: 7151449 - DNA, 21 bp, Homo sapiens
cagagagctagaacttcatga

SEQ ID NO: 7151450 - DNA, 22 bp, Homo sapiens
cagagagcttgcccttgtatat

SEQ ID NO: 7151451 - DNA, 22 bp, Homo sapiens
cagagagcttgcccttgtatat

SEQ ID NO: 7151452 - DNA, 16 bp, Homo sapiens
cagagaggacagaggc

SEQ ID NO: 7151453 - DNA, 16 bp, Homo sapiens
cagagaggacagaggc

SEQ ID NO: 7151454 - DNA, 16 bp, Homo sapiens
cagagaggacagaggc

SEQ ID NO: 7151455 - DNA, 22 bp, Homo sapiens
cagagagagtggggtgtggatt

SEQ ID NO: 7151456 - DNA, 22 bp, Homo sapiens
cagagagagtggggtgtggatt

SEQ ID NO: 7151457 - DNA, 22 bp, Homo sapiens
cagagagagtggggtgtggatt

SEQ ID NO: 7151458 - DNA, 22 bp, Homo sapiens
cagagagagtggggtgtggatt

SEQ ID NO: 7151459 - DNA, 22 bp, Homo sapiens
cagagagcacataggatacttt

SEQ ID NO: 7151460 - DNA, 22 bp, Homo sapiens
cagagagcacataggatacttt

SEQ ID NO: 7151461 - DNA, 22 bp, Homo sapiens
cagagagcacataggatacttt

SEQ ID NO: 7151462 - DNA, 22 bp, Homo sapiens
cagagagagtggggtgtggatt

SEQ ID NO: 7151463 - DNA, 22 bp, Homo sapiens
cagagagagtctgtccctgaag

SEQ ID NO: 7151464 - DNA, 22 bp, Homo sapiens
cagagagagtctgtccctgaag

SEQ ID NO: 7151465 - DNA, 22 bp, Homo sapiens
cagagagagtctgtccctgaag

SEQ ID NO: 7151466 - DNA, 22 bp, Homo sapiens
gggccctggatttaagcatgga

SEQ ID NO: 7151467 - DNA, 22 bp, Homo sapiens
gggccctggacgtggcggcaga

SEQ ID NO: 7151468 - DNA, 22 bp, Homo sapiens
gggccctggatttaagcatgga

SEQ ID NO: 7151469 - DNA, 22 bp, Homo sapiens
gggccctggccgaatccctctg

SEQ ID NO: 7151470 - DNA, 22 bp, Homo sapiens
gggccctggccgaatccctctg

SEQ ID NO: 7151471 - DNA, 22 bp, Homo sapiens
gggccctgcgtccggaagtctg

SEQ ID NO: 7151472 - DNA, 22 bp, Homo sapiens
gggccctgcgtccggaagtctg

SEQ ID NO: 7151473 - DNA, 22 bp, Homo sapiens
gggccctggacgtggcggcaga

SEQ ID NO: 7151474 - DNA, 16 bp, Homo sapiens
cagagaggacagaggc

SEQ ID NO: 7151475 - DNA, 16 bp, Homo sapiens
cagagaggacagaggc

SEQ ID NO: 7151476 - DNA, 22 bp, Homo sapiens
cagagaggaggctatatgcaaa

SEQ ID NO: 7151477 - DNA, 22 bp, Homo sapiens
cagagaggaggctatatgcaaa

SEQ ID NO: 7151478 - DNA, 22 bp, Homo sapiens
gggccaggagtggagatatggg

SEQ ID NO: 7151479 - DNA, 22 bp, Homo sapiens
gggccaggagtggagatatggg

SEQ ID NO: 7151480 - DNA, 22 bp, Homo sapiens
gtaagaggagtgggaagcctca

SEQ ID NO: 7151481 - DNA, 22 bp, Homo sapiens
gtaagaaaaccttctttctaat

SEQ ID NO: 7151482 - DNA, 22 bp, Homo sapiens
gtaagaagatgaatccaggctg

SEQ ID NO: 7151483 - DNA, 22 bp, Homo sapiens
gtaagcaaacagcaaatgattt

SEQ ID NO: 7151484 - DNA, 22 bp, Homo sapiens
gtaagcaaacagcaaatgattt

SEQ ID NO: 7151485 - DNA, 22 bp, Homo sapiens
gtaagaggatcaaggcggtgca

SEQ ID NO: 7151486 - DNA, 20 bp, Homo sapiens
cagcagagacccatggggag

SEQ ID NO: 7151487 - DNA, 22 bp, Homo sapiens
cagcagagacggtaagcagaac

SEQ ID NO: 7151488 - DNA, 22 bp, Homo sapiens
cagcagagacggtaagcagaac

SEQ ID NO: 7151489 - DNA, 22 bp, Homo sapiens
cagcagagacggtaagcagaac

SEQ ID NO: 7151490 - DNA, 22 bp, Homo sapiens
gtaaggctaatgtctttgtggt

SEQ ID NO: 7151491 - DNA, 17 bp, Homo sapiens
gtaaggcttgcagatgc

SEQ ID NO: 7151492 - DNA, 22 bp, Homo sapiens
gtaacatttacagttcctagag

SEQ ID NO: 7151493 - DNA, 22 bp, Homo sapiens
gtaacgaataaacaagtgataa

SEQ ID NO: 7151494 - DNA, 22 bp, Homo sapiens
gtaactgggatttttcaatgtg

SEQ ID NO: 7151495 - DNA, 22 bp, Homo sapiens
gtaaacatcgacccaacagggg

SEQ ID NO: 7151496 - DNA, 22 bp, Homo sapiens
gtaaacatgctgtgtactcagc

SEQ ID NO: 7151497 - DNA, 22 bp, Homo sapiens
gtaaacatcagccactctattt

SEQ ID NO: 7151498 - DNA, 19 bp, Homo sapiens
ggtgtgccaaatgggaatg

SEQ ID NO: 7151499 - DNA, 22 bp, Homo sapiens
gtaaacatcagccactctattt

SEQ ID NO: 7151500 - DNA, 22 bp, Homo sapiens
ggtgtgacctcagtctgggtaa

SEQ ID NO: 7151501 - DNA, 22 bp, Homo sapiens
ggtgtgcagtagcaggaggcct

SEQ ID NO: 7151502 - DNA, 22 bp, Homo sapiens
ggtgtgcatggcacagggcttg

SEQ ID NO: 7151503 - DNA, 19 bp, Homo sapiens
ggtgtgaagtgaggagtta

SEQ ID NO: 7151504 - DNA, 22 bp, Homo sapiens
ggtgtctgttgcctcctggtta

SEQ ID NO: 7151505 - DNA, 22 bp, Homo sapiens
ggtgtctgttgcctcctggtta

SEQ ID NO: 7151506 - DNA, 22 bp, Homo sapiens
ggtgtctgttgcctcctggtta

SEQ ID NO: 7151507 - DNA, 22 bp, Homo sapiens
ggtgtctgtgatggcatataac

SEQ ID NO: 7151508 - DNA, 22 bp, Homo sapiens
ggtgtctggacagtgagccagg

SEQ ID NO: 7151509 - DNA, 22 bp, Homo sapiens
ggtgtctggacagtgagccagg

SEQ ID NO: 7151510 - DNA, 15 bp, Homo sapiens
ggtgtctgcagtgtg

SEQ ID NO: 7151511 - DNA, 22 bp, Homo sapiens
ggtgtctgcttccctccagctg

SEQ ID NO: 7151512 - DNA, 22 bp, Homo sapiens
ggtgtctgattccaaggccaca

SEQ ID NO: 7151513 - DNA, 22 bp, Homo sapiens
ggtgtctgattccaaggccaca

SEQ ID NO: 7151514 - DNA, 22 bp, Homo sapiens
ggtgtctcagctgctggcaggg

SEQ ID NO: 7151515 - DNA, 22 bp, Homo sapiens
ggtgtctcagctgctggcaggg

SEQ ID NO: 7151516 - DNA, 22 bp, Homo sapiens
ggtgtctgatggtggcttctca

SEQ ID NO: 7151517 - DNA, 20 bp, Homo sapiens
cagcagagacccatggggag

SEQ ID NO: 7151518 - DNA, 20 bp, Homo sapiens
cagcagagacccatggggag

SEQ ID NO: 7151519 - DNA, 20 bp, Homo sapiens
cagcagagacccatggggag

SEQ ID NO: 7151520 - DNA, 22 bp, Homo sapiens
ggtgtccttgtcctttggtacc

SEQ ID NO: 7151521 - DNA, 22 bp, Homo sapiens
ggtgtccttgttgaacgaaaat

SEQ ID NO: 7151522 - DNA, 22 bp, Homo sapiens
ggtgtcctttgggggctccgag

SEQ ID NO: 7151523 - DNA, 22 bp, Homo sapiens
ggtgtcctttgggggctccgag

SEQ ID NO: 7151524 - DNA, 20 bp, Homo sapiens
cagcagagacccatggggag

SEQ ID NO: 7151525 - DNA, 20 bp, Homo sapiens
cagcagagacccatggggag

SEQ ID NO: 7151526 - DNA, 20 bp, Homo sapiens
cagcagagacccatggggag

SEQ ID NO: 7151527 - DNA, 20 bp, Homo sapiens
cagcagagacccatggggag

SEQ ID NO: 7151528 - DNA, 18 bp, Homo sapiens
cagcagagacattcaaaa

SEQ ID NO: 7151529 - DNA, 22 bp, Homo sapiens
cagcagagaccaagtgatttga

SEQ ID NO: 7151530 - DNA, 18 bp, Homo sapiens
cagcagagacattcaaaa

SEQ ID NO: 7151531 - DNA, 22 bp, Homo sapiens
cagcagagaaattacatatttg

SEQ ID NO: 7151532 - DNA, 22 bp, Homo sapiens
cagcagagaaattacatatttg

SEQ ID NO: 7151533 - DNA, 22 bp, Homo sapiens
cagcagagaaattaaacttctg

SEQ ID NO: 7151534 - DNA, 22 bp, Homo sapiens
cagcagagaaattaaacttctg

SEQ ID NO: 7151535 - DNA, 22 bp, Homo sapiens
cagcagacttactagaatgtaa

SEQ ID NO: 7151536 - DNA, 22 bp, Homo sapiens
cagcagactggagtaggcagtg

SEQ ID NO: 7151537 - DNA, 22 bp, Homo sapiens
cagcagactggagtaggcagtg

SEQ ID NO: 7151538 - DNA, 22 bp, Homo sapiens
ggtggcaggctggcattggcaa

SEQ ID NO: 7151539 - DNA, 22 bp, Homo sapiens
ggtgctggttcagggtggctgt

SEQ ID NO: 7151540 - DNA, 22 bp, Homo sapiens
cagatggagtcccgtggagttc

SEQ ID NO: 7151541 - DNA, 22 bp, Homo sapiens
ggtgctggttcagggtggctgt

SEQ ID NO: 7151542 - DNA, 22 bp, Homo sapiens
ggtgctggttcagggtggctgt

SEQ ID NO: 7151543 - DNA, 22 bp, Homo sapiens
ggtgctggttcagggtggctgt

SEQ ID NO: 7151544 - DNA, 22 bp, Homo sapiens
cagatggagtcccgtggagttc

SEQ ID NO: 7151545 - DNA, 22 bp, Homo sapiens
cagatggagtcccgtggagttc

SEQ ID NO: 7151546 - DNA, 22 bp, Homo sapiens
cagatggaggataaaacatgca

SEQ ID NO: 7151547 - DNA, 22 bp, Homo sapiens
cagatggaacacagaaaggaga

SEQ ID NO: 7151548 - DNA, 22 bp, Homo sapiens
cagatggaaggcatagaggttt

SEQ ID NO: 7151549 - DNA, 22 bp, Homo sapiens
cagatggaacacagaaaggaga

SEQ ID NO: 7151550 - DNA, 22 bp, Homo sapiens
ggtggcagggagtgtccctggg

SEQ ID NO: 7151551 - DNA, 22 bp, Homo sapiens
ggtggcagggagtgtccctggg

SEQ ID NO: 7151552 - DNA, 18 bp, Homo sapiens
ggtggcaggtcagatgcc

SEQ ID NO: 7151553 - DNA, 18 bp, Homo sapiens
ggtggcaggtcagatgcc

SEQ ID NO: 7151554 - DNA, 18 bp, Homo sapiens
ggtggcaggtcagatgcc

SEQ ID NO: 7151555 - DNA, 22 bp, Homo sapiens
ggtggcagtagcactgggcctg

SEQ ID NO: 7151556 - DNA, 22 bp, Homo sapiens
ggtggcagtagcactgggcctg

SEQ ID NO: 7151557 - DNA, 22 bp, Homo sapiens
ggtggcagtagcactgggcctg

SEQ ID NO: 7151558 - DNA, 22 bp, Homo sapiens
ggtggcagtgcttgcgggtcta

SEQ ID NO: 7151559 - DNA, 22 bp, Homo sapiens
ggtggcagtcttaagagatctt

SEQ ID NO: 7151560 - DNA, 22 bp, Homo sapiens
ggtggcagtgcttgcgggtcta

SEQ ID NO: 7151561 - DNA, 22 bp, Homo sapiens
ggtggcagtcttaagagatctt

SEQ ID NO: 7151562 - DNA, 22 bp, Homo sapiens
ggtggcagtcttaagagatctt

SEQ ID NO: 7151563 - DNA, 22 bp, Homo sapiens
ggtggcagtagcactgggcctg

SEQ ID NO: 7151564 - DNA, 22 bp, Homo sapiens
ggtggcagtagcactgggcctg

SEQ ID NO: 7151565 - DNA, 22 bp, Homo sapiens
ggtggcagtagcactgggcctg

SEQ ID NO: 7151566 - DNA, 22 bp, Homo sapiens
ggtggcagtcttaagagatctt

SEQ ID NO: 7151567 - DNA, 22 bp, Homo sapiens
cagcactatgacatttaattct

SEQ ID NO: 7151568 - DNA, 22 bp, Homo sapiens
cagcactatgacatttaattct

SEQ ID NO: 7151569 - DNA, 22 bp, Homo sapiens
ggtgggaaggggccagtgtgcg

SEQ ID NO: 7151570 - DNA, 22 bp, Homo sapiens
ggtgggaaggggccagtgtgcg

SEQ ID NO: 7151571 - DNA, 22 bp, Homo sapiens
ggtgggaaataattaggattat

SEQ ID NO: 7151572 - DNA, 22 bp, Homo sapiens
ggtgggaaggccactgaaggtt

SEQ ID NO: 7151573 - DNA, 22 bp, Homo sapiens
ggtgggaaggccactgaaggtt

SEQ ID NO: 7151574 - DNA, 22 bp, Homo sapiens
ggtgggaaggccactgaaggtt

SEQ ID NO: 7151575 - DNA, 22 bp, Homo sapiens
ggtgggaaggggccagtgtgcg

SEQ ID NO: 7151576 - DNA, 22 bp, Homo sapiens
cagcactctggcttcgttaagt

SEQ ID NO: 7151577 - DNA, 22 bp, Homo sapiens
cagcactgctgctgtacacaca

SEQ ID NO: 7151578 - DNA, 22 bp, Homo sapiens
cagcactgctgctgtacacaca

SEQ ID NO: 7151579 - DNA, 22 bp, Homo sapiens
cagcactgctgctgtacacaca

SEQ ID NO: 7151580 - DNA, 22 bp, Homo sapiens
cagcactgctgctgtacacaca

SEQ ID NO: 7151581 - DNA, 20 bp, Homo sapiens
cagcagaaatggggtgggaa

SEQ ID NO: 7151582 - DNA, 22 bp, Homo sapiens
cagcagaacaggcagggaagct

SEQ ID NO: 7151583 - DNA, 22 bp, Homo sapiens
cagcagaacaggcagggaagct

SEQ ID NO: 7151584 - DNA, 22 bp, Homo sapiens
cagcagaacaggcagggaagct

SEQ ID NO: 7151585 - DNA, 22 bp, Homo sapiens
cagcagaacaggcagggaagct

SEQ ID NO: 7151586 - DNA, 22 bp, Homo sapiens
cagcagaacagttaaagaaacc

SEQ ID NO: 7151587 - DNA, 21 bp, Homo sapiens
cagcagaagcatctatggaag

SEQ ID NO: 7151588 - DNA, 21 bp, Homo sapiens
cagcagaagcatctatggaag

SEQ ID NO: 7151589 - DNA, 22 bp, Homo sapiens
ggtggcagtgcttgcgggtcta

SEQ ID NO: 7151590 - DNA, 22 bp, Homo sapiens
ggtggcagtggtctctgacaga

SEQ ID NO: 7151591 - DNA, 22 bp, Homo sapiens
ggtggcagtggtctctgacaga

SEQ ID NO: 7151592 - DNA, 22 bp, Homo sapiens
ggtggcagttacaggggcaaat

SEQ ID NO: 7151593 - DNA, 22 bp, Homo sapiens
ggtggcagttacaggggcaaat

SEQ ID NO: 7151594 - DNA, 22 bp, Homo sapiens
ggtggctggaggagctgatgga

SEQ ID NO: 7151595 - DNA, 22 bp, Homo sapiens
ggtggctgcttcctcaagagga

SEQ ID NO: 7151596 - DNA, 22 bp, Homo sapiens
ggtggctgggattagtagccca

SEQ ID NO: 7151597 - DNA, 22 bp, Homo sapiens
ggtggctgggattagtagccca

SEQ ID NO: 7151598 - DNA, 18 bp, Homo sapiens
ggtggctggggacggaca

SEQ ID NO: 7151599 - DNA, 18 bp, Homo sapiens
ggtggctggggacggaca

SEQ ID NO: 7151600 - DNA, 18 bp, Homo sapiens
ggtgggaagccagggcct

SEQ ID NO: 7151601 - DNA, 22 bp, Homo sapiens
ggtgcagaaggaagggagctgg

SEQ ID NO: 7151602 - DNA, 22 bp, Homo sapiens
ggtgcagaagaaagcagtcatt

SEQ ID NO: 7151603 - DNA, 22 bp, Homo sapiens
ggtgcagaagaaagcagtcatt

SEQ ID NO: 7151604 - DNA, 22 bp, Homo sapiens
ggtgcagaaggaagggagctgg

SEQ ID NO: 7151605 - DNA, 22 bp, Homo sapiens
ggtgcagaaggaagggagctgg

SEQ ID NO: 7151606 - DNA, 22 bp, Homo sapiens
ggtgcagagcagtgtcagagca

SEQ ID NO: 7151607 - DNA, 22 bp, Homo sapiens
ggtgcagagcagtgtcagagca

SEQ ID NO: 7151608 - DNA, 22 bp, Homo sapiens
ggtgcagaggagccagctgggg

SEQ ID NO: 7151609 - DNA, 22 bp, Homo sapiens
ggtgcaaggccaccatctagtg

SEQ ID NO: 7151610 - DNA, 22 bp, Homo sapiens
ggtgcaagggttgagttgagtg

SEQ ID NO: 7151611 - DNA, 22 bp, Homo sapiens
ggtgcaataaagttgtagaacc

SEQ ID NO: 7151612 - DNA, 22 bp, Homo sapiens
ggtgcagaagaaagcagtcatt

SEQ ID NO: 7151613 - DNA, 22 bp, Homo sapiens
ggtgcaagagctccaggccctg

SEQ ID NO: 7151614 - DNA, 22 bp, Homo sapiens
ggtgcaaagggcctagagagtg

SEQ ID NO: 7151615 - DNA, 22 bp, Homo sapiens
ggtgcaaacgtaattgtggttt

SEQ ID NO: 7151616 - DNA, 22 bp, Homo sapiens
ggtgcaaagatggcagttgcaa

SEQ ID NO: 7151617 - DNA, 22 bp, Homo sapiens
ggtgagaggcagaggacagctt

SEQ ID NO: 7151618 - DNA, 22 bp, Homo sapiens
ggtgagaggcagtgctgtggaa

SEQ ID NO: 7151619 - DNA, 22 bp, Homo sapiens
ggtgcaaaagtagttctgcttt

SEQ ID NO: 7151620 - DNA, 22 bp, Homo sapiens
ggtgcagctggacagagaagcc

SEQ ID NO: 7151621 - DNA, 22 bp, Homo sapiens
ggtgcagctgcagcctgggagc

SEQ ID NO: 7151622 - DNA, 22 bp, Homo sapiens
ggtgcagctgcagcctgggagc

SEQ ID NO: 7151623 - DNA, 22 bp, Homo sapiens
ggtgcagctggacagagaagcc

SEQ ID NO: 7151624 - DNA, 22 bp, Homo sapiens
ggtgcagagtccacagaaagct

SEQ ID NO: 7151625 - DNA, 22 bp, Homo sapiens
ggtgcagaggagccagctgggg

SEQ ID NO: 7151626 - DNA, 22 bp, Homo sapiens
ggtgcagagtccacagaaagct

SEQ ID NO: 7151627 - DNA, 22 bp, Homo sapiens
cagatgctatgtattatgtatg

SEQ ID NO: 7151628 - DNA, 22 bp, Homo sapiens
cagatgcttcgtgggtgagcac

SEQ ID NO: 7151629 - DNA, 22 bp, Homo sapiens
cagataaaggcttactagtagt

SEQ ID NO: 7151630 - DNA, 22 bp, Homo sapiens
cagataaaggcttactagtagt

SEQ ID NO: 7151631 - DNA, 22 bp, Homo sapiens
cagataaaggcttactagtagt

SEQ ID NO: 7151632 - DNA, 22 bp, Homo sapiens
cagataaaggcttactagtagt

SEQ ID NO: 7151633 - DNA, 22 bp, Homo sapiens
cagataaaggcttactagtagt

SEQ ID NO: 7151634 - DNA, 22 bp, Homo sapiens
cagataaaattaatattaccaa

SEQ ID NO: 7151635 - DNA, 20 bp, Homo sapiens
cagataaacgggaaagaagc

SEQ ID NO: 7151636 - DNA, 20 bp, Homo sapiens
cagataaacgggaaagaagc

SEQ ID NO: 7151637 - DNA, 22 bp, Homo sapiens
cagataaatagatagataaact

SEQ ID NO: 7151638 - DNA, 22 bp, Homo sapiens
cagataaatagatagataaact

SEQ ID NO: 7151639 - DNA, 22 bp, Homo sapiens
cagataaatagatagataaact

SEQ ID NO: 7151640 - DNA, 22 bp, Homo sapiens
cagatacaggtttttgttagat

SEQ ID NO: 7151641 - DNA, 22 bp, Homo sapiens
cagatacaggtttttgttagat

SEQ ID NO: 7151642 - DNA, 22 bp, Homo sapiens
cagatacaggtttttgttagat

SEQ ID NO: 7151643 - DNA, 22 bp, Homo sapiens
cagatacagctagctccgtggc

SEQ ID NO: 7151644 - DNA, 22 bp, Homo sapiens
cagatacagctagctccgtggc

SEQ ID NO: 7151645 - DNA, 22 bp, Homo sapiens
cagataacacaaagaaatgggc

SEQ ID NO: 7151646 - DNA, 22 bp, Homo sapiens
cagataactgaaatatcatacc

SEQ ID NO: 7151647 - DNA, 22 bp, Homo sapiens
cagatacattaaaatgatgatt

SEQ ID NO: 7151648 - DNA, 22 bp, Homo sapiens
cagatacattaaaatgatgatt

SEQ ID NO: 7151649 - DNA, 22 bp, Homo sapiens
cagatacattaaaatgatgatt

SEQ ID NO: 7151650 - DNA, 22 bp, Homo sapiens
cagatacattaaaatgatgatt

SEQ ID NO: 7151651 - DNA, 22 bp, Homo sapiens
cagatacctgggtatcatttag

SEQ ID NO: 7151652 - DNA, 22 bp, Homo sapiens
cagatagcaaatgggtaagcta

SEQ ID NO: 7151653 - DNA, 22 bp, Homo sapiens
cagatagctgactactcttctt

SEQ ID NO: 7151654 - DNA, 22 bp, Homo sapiens
cagataggaaaagctaggcata

SEQ ID NO: 7151655 - DNA, 22 bp, Homo sapiens
cagataggaaaagctaggcata

SEQ ID NO: 7151656 - DNA, 20 bp, Homo sapiens
cagataggttagtgtttcag

SEQ ID NO: 7151657 - DNA, 22 bp, Homo sapiens
cagatagtaacctttctagagc

SEQ ID NO: 7151658 - DNA, 22 bp, Homo sapiens
cagatatattcatttgcagtgc

SEQ ID NO: 7151659 - DNA, 22 bp, Homo sapiens
cagatatagtggcttgcctggg

SEQ ID NO: 7151660 - DNA, 22 bp, Homo sapiens
cagatatatattcatcaggctg

SEQ ID NO: 7151661 - DNA, 22 bp, Homo sapiens
cagatataagaaagctattgtc

SEQ ID NO: 7151662 - DNA, 22 bp, Homo sapiens
cagatataaatggatgtggtag

SEQ ID NO: 7151663 - DNA, 22 bp, Homo sapiens
ggggtgagatcaaggaagccct

SEQ ID NO: 7151664 - DNA, 22 bp, Homo sapiens
cagagtgaaaactgagctcaaa

SEQ ID NO: 7151665 - DNA, 22 bp, Homo sapiens
ggggtgagctgggcctgtgcct

SEQ ID NO: 7151666 - DNA, 22 bp, Homo sapiens
ggggtgagatcaaggaagccct

SEQ ID NO: 7151667 - DNA, 23 bp, Homo sapiens
ggggtcttggaacaggtggccct

SEQ ID NO: 7151668 - DNA, 22 bp, Homo sapiens
ggggtctgggttgctcggcctt

SEQ ID NO: 7151669 - DNA, 22 bp, Homo sapiens
ggggtctgggttgctcggcctt

SEQ ID NO: 7151670 - DNA, 22 bp, Homo sapiens
ggggtctgctgcggagcagaga

SEQ ID NO: 7151671 - DNA, 22 bp, Homo sapiens
ggggtctgctgcggagcagaga

SEQ ID NO: 7151672 - DNA, 22 bp, Homo sapiens
ggggtctgggcttagctggaat

SEQ ID NO: 7151673 - DNA, 22 bp, Homo sapiens
ggggtctgggcttagctggaat

SEQ ID NO: 7151674 - DNA, 22 bp, Homo sapiens
ggggtctgggcttagctggaat

SEQ ID NO: 7151675 - DNA, 22 bp, Homo sapiens
ggggtctgggcttagctggaat

SEQ ID NO: 7151676 - DNA, 22 bp, Homo sapiens
ggggtctgggcttagctggaat

SEQ ID NO: 7151677 - DNA, 22 bp, Homo sapiens
ggggtcctcggagcctgggtct

SEQ ID NO: 7151678 - DNA, 22 bp, Homo sapiens
ggggtcctggaggccagctgga

SEQ ID NO: 7151679 - DNA, 22 bp, Homo sapiens
ggggtcggggcatagccactta

SEQ ID NO: 7151680 - DNA, 22 bp, Homo sapiens
ggggtcggggcatagccactta

SEQ ID NO: 7151681 - DNA, 22 bp, Homo sapiens
ggggtctgctgcggagcagaga

SEQ ID NO: 7151682 - DNA, 22 bp, Homo sapiens
ggggtctgctgcggagcagaga

SEQ ID NO: 7151683 - DNA, 22 bp, Homo sapiens
ggggtctgctgcggagcagaga

SEQ ID NO: 7151684 - DNA, 22 bp, Homo sapiens
ggggtctgctgcggagcagaga

SEQ ID NO: 7151685 - DNA, 22 bp, Homo sapiens
cagagttttgtgaacaacttgg

SEQ ID NO: 7151686 - DNA, 22 bp, Homo sapiens
cagagtttcggtaagcatagaa

SEQ ID NO: 7151687 - DNA, 22 bp, Homo sapiens
cagagtttgcaagggcagaagc

SEQ ID NO: 7151688 - DNA, 19 bp, Homo sapiens
cagagtttgcaggcagagg

SEQ ID NO: 7151689 - DNA, 22 bp, Homo sapiens
cagagtgtttctttgggtgggt

SEQ ID NO: 7151690 - DNA, 19 bp, Homo sapiens
cagagttacatggctgtgg

SEQ ID NO: 7151691 - DNA, 22 bp, Homo sapiens
cagagtgtttctttgggtgggt

SEQ ID NO: 7151692 - DNA, 22 bp, Homo sapiens
cagagtgtttctttgggtgggt

SEQ ID NO: 7151693 - DNA, 22 bp, Homo sapiens
cagagttcaaagcctgctggga

SEQ ID NO: 7151694 - DNA, 22 bp, Homo sapiens
cagagtttaaacaaatgaaata

SEQ ID NO: 7151695 - DNA, 22 bp, Homo sapiens
cagagtttaaacaaatgaaata

SEQ ID NO: 7151696 - DNA, 22 bp, Homo sapiens
cagagtgtatctgtgtaagcat

SEQ ID NO: 7151697 - DNA, 22 bp, Homo sapiens
cagagtgtattctgcagttgca

SEQ ID NO: 7151698 - DNA, 22 bp, Homo sapiens
cagagtgtattctgcagttgca

SEQ ID NO: 7151699 - DNA, 22 bp, Homo sapiens
cagagtgtggcatcttccaact

SEQ ID NO: 7151700 - DNA, 22 bp, Homo sapiens
cagagtgttagcgctggttggg

SEQ ID NO: 7151701 - DNA, 22 bp, Homo sapiens
cagagtgaaaactgagctcaaa

SEQ ID NO: 7151702 - DNA, 18 bp, Homo sapiens
cagagtgggccaagagac

SEQ ID NO: 7151703 - DNA, 22 bp, Homo sapiens
cagagtgggctgtcagccacca

SEQ ID NO: 7151704 - DNA, 22 bp, Homo sapiens
cagagtggtgcaagggcagtgt

SEQ ID NO: 7151705 - DNA, 22 bp, Homo sapiens
cagagtggtgcaagggcagtgt

SEQ ID NO: 7151706 - DNA, 22 bp, Homo sapiens
cagagtgggctgtcagccacca

SEQ ID NO: 7151707 - DNA, 21 bp, Homo sapiens
cagaggctgagagggcaatct

SEQ ID NO: 7151708 - DNA, 22 bp, Homo sapiens
cagaggctgaccctgctgttgt

SEQ ID NO: 7151709 - DNA, 22 bp, Homo sapiens
cagaggcctttctacagtgata

SEQ ID NO: 7151710 - DNA, 22 bp, Homo sapiens
cagaggcctttctacagtgata

SEQ ID NO: 7151711 - DNA, 22 bp, Homo sapiens
cagaggcaggataagaactgcg

SEQ ID NO: 7151712 - DNA, 22 bp, Homo sapiens
cagaggcctttctacagtgata

SEQ ID NO: 7151713 - DNA, 22 bp, Homo sapiens
cagaggcctttctacagtgata

SEQ ID NO: 7151714 - DNA, 22 bp, Homo sapiens
cagaggcaggaagatgggcagt

SEQ ID NO: 7151715 - DNA, 22 bp, Homo sapiens
cagaggcaggataagaactgcg

SEQ ID NO: 7151716 - DNA, 22 bp, Homo sapiens
cagaggctgatggctgtagcca

SEQ ID NO: 7151717 - DNA, 22 bp, Homo sapiens
cagaggctgagcagtcagtttg

SEQ ID NO: 7151718 - DNA, 21 bp, Homo sapiens
cagaggctgagagggcaatct

SEQ ID NO: 7151719 - DNA, 21 bp, Homo sapiens
cagaggctgagagggcaatct

SEQ ID NO: 7151720 - DNA, 21 bp, Homo sapiens
cagaggctgagagggcaatct

SEQ ID NO: 7151721 - DNA, 22 bp, Homo sapiens
cagaggctgatgtgggatgggc

SEQ ID NO: 7151722 - DNA, 22 bp, Homo sapiens
cagaggctgatgtgggatgggc

SEQ ID NO: 7151723 - DNA, 22 bp, Homo sapiens
cagaggctgatgtgggatgggc

SEQ ID NO: 7151724 - DNA, 22 bp, Homo sapiens
cagaggctgatggctgtagcca

SEQ ID NO: 7151725 - DNA, 22 bp, Homo sapiens
cagaggctgatggctgtagcca

SEQ ID NO: 7151726 - DNA, 22 bp, Homo sapiens
ggggtaggtcatagcccctcta

SEQ ID NO: 7151727 - DNA, 22 bp, Homo sapiens
ggggtagggtgattgtgaagta

SEQ ID NO: 7151728 - DNA, 22 bp, Homo sapiens
ggggtagggtgattgtgaagta

SEQ ID NO: 7151729 - DNA, 22 bp, Homo sapiens
ggggtaggtcatagcccctcta

SEQ ID NO: 7151730 - DNA, 22 bp, Homo sapiens
cagaggctgctctgggtggcat

SEQ ID NO: 7151731 - DNA, 22 bp, Homo sapiens
ggggtagggtgattgtgaagta

SEQ ID NO: 7151732 - DNA, 22 bp, Homo sapiens
cagaggctgatgtgggatgggc

SEQ ID NO: 7151733 - DNA, 22 bp, Homo sapiens
cagaggctgccagccatgtgca

SEQ ID NO: 7151734 - DNA, 22 bp, Homo sapiens
cagaggctgccagccatgtgca

SEQ ID NO: 7151735 - DNA, 22 bp, Homo sapiens
cagaggctgctctgggtggcat

SEQ ID NO: 7151736 - DNA, 22 bp, Homo sapiens
cagaggctgctctgggtggcat

SEQ ID NO: 7151737 - DNA, 22 bp, Homo sapiens
cagaggctgccagccatgtgca

SEQ ID NO: 7151738 - DNA, 18 bp, Homo sapiens
gtgcatgcatgctctgcc

SEQ ID NO: 7151739 - DNA, 18 bp, Homo sapiens
gtgcatgcatgctctgcc

SEQ ID NO: 7151740 - DNA, 21 bp, Homo sapiens
gtgcatgcgccgctgagatgc

SEQ ID NO: 7151741 - DNA, 22 bp, Homo sapiens
gtgcatgctgcagtatgatttc

SEQ ID NO: 7151742 - DNA, 22 bp, Homo sapiens
gtgcatgctgcagtatgatttc

SEQ ID NO: 7151743 - DNA, 22 bp, Homo sapiens
gtgcatgaagactcagaaagtc

SEQ ID NO: 7151744 - DNA, 22 bp, Homo sapiens
gtgcatgaacaggagcctaagc

SEQ ID NO: 7151745 - DNA, 22 bp, Homo sapiens
gtgcatgaagactcagaaagtc

SEQ ID NO: 7151746 - DNA, 22 bp, Homo sapiens
gtgcatgaagactcagaaagtc

SEQ ID NO: 7151747 - DNA, 22 bp, Homo sapiens
gtgcatgcacacatgtgtgagg

SEQ ID NO: 7151748 - DNA, 22 bp, Homo sapiens
gtgcatgcacacatgtgtgagg

SEQ ID NO: 7151749 - DNA, 22 bp, Homo sapiens
gtgcatgcacacatgtgtgagg

SEQ ID NO: 7151750 - DNA, 18 bp, Homo sapiens
gtgcatgcatgctctgcc

SEQ ID NO: 7151751 - DNA, 22 bp, Homo sapiens
gtgcaggagcttctggcctgac

SEQ ID NO: 7151752 - DNA, 22 bp, Homo sapiens
gtgcaggagctcccgcagtggt

SEQ ID NO: 7151753 - DNA, 22 bp, Homo sapiens
gtgcatattttgcacacagatg

SEQ ID NO: 7151754 - DNA, 22 bp, Homo sapiens
gtgcatcaatttcccatgtgtc

SEQ ID NO: 7151755 - DNA, 22 bp, Homo sapiens
gtgcaggaggtaacatagcaaa

SEQ ID NO: 7151756 - DNA, 22 bp, Homo sapiens
gtgcatccactagggctctccc

SEQ ID NO: 7151757 - DNA, 22 bp, Homo sapiens
gtgcatcaggatctgaccagat

SEQ ID NO: 7151758 - DNA, 22 bp, Homo sapiens
gtgcatcgtgctgtaggctgac

SEQ ID NO: 7151759 - DNA, 22 bp, Homo sapiens
gtgcatccagccatgagaacca

SEQ ID NO: 7151760 - DNA, 22 bp, Homo sapiens
gtgcatcgctctaataggatga

SEQ ID NO: 7151761 - DNA, 22 bp, Homo sapiens
gtgcatggtaagatgcttcaca

SEQ ID NO: 7151762 - DNA, 22 bp, Homo sapiens
gtgcatggtaagatgcttcaca

SEQ ID NO: 7151763 - DNA, 22 bp, Homo sapiens
gtgcatgtcggggtgcatgtca

SEQ ID NO: 7151764 - DNA, 22 bp, Homo sapiens
gtgcatgtcggggtgcatgtca

SEQ ID NO: 7151765 - DNA, 22 bp, Homo sapiens
gtgcatgtgcatccatgtgtac

SEQ ID NO: 7151766 - DNA, 22 bp, Homo sapiens
gtgcatgtgcgttgactgtcca

SEQ ID NO: 7151767 - DNA, 22 bp, Homo sapiens
gtgcatgtggtaaagaggagag

SEQ ID NO: 7151768 - DNA, 22 bp, Homo sapiens
gtgcatgtgtctttatagtaga

SEQ ID NO: 7151769 - DNA, 22 bp, Homo sapiens
gtgcatgtgtctttatagtagc

SEQ ID NO: 7151770 - DNA, 22 bp, Homo sapiens
gtgcatgtgtgcgtacatgctt

SEQ ID NO: 7151771 - DNA, 22 bp, Homo sapiens
gtgcatgttaatggtgtacaaa

SEQ ID NO: 7151772 - DNA, 22 bp, Homo sapiens
gtgcatgttaatggtgtacaaa

SEQ ID NO: 7151773 - DNA, 22 bp, Homo sapiens
cagccctgtgcggagggccctg

SEQ ID NO: 7151774 - DNA, 22 bp, Homo sapiens
cagccctgtgctaagcaccctc

SEQ ID NO: 7151775 - DNA, 22 bp, Homo sapiens
cagccctgtgctaagcaccctc

SEQ ID NO: 7151776 - DNA, 20 bp, Homo sapiens
cagcctccactcactcagct

SEQ ID NO: 7151777 - DNA, 19 bp, Homo sapiens
cagcctcaatccctcgggc

SEQ ID NO: 7151778 - DNA, 22 bp, Homo sapiens
gtgccctgacacacctggtgtg

SEQ ID NO: 7151779 - DNA, 22 bp, Homo sapiens
gtgccctgacacacctggtgtg

SEQ ID NO: 7151780 - DNA, 20 bp, Homo sapiens
cagcctccactcactcagct

SEQ ID NO: 7151781 - DNA, 20 bp, Homo sapiens
cagcctccactcactcagct

SEQ ID NO: 7151782 - DNA, 22 bp, Homo sapiens
gtgcctgggacacagcagatac

SEQ ID NO: 7151783 - DNA, 22 bp, Homo sapiens
gtgcctgggacttgctccggat

SEQ ID NO: 7151784 - DNA, 22 bp, Homo sapiens
gtgcctgggcatgagcttgttg

SEQ ID NO: 7151785 - DNA, 22 bp, Homo sapiens
gtgcctgggggtaatgtaggat

SEQ ID NO: 7151786 - DNA, 22 bp, Homo sapiens
gtgcctgggggtaatgtaggat

SEQ ID NO: 7151787 - DNA, 22 bp, Homo sapiens
gtgcctgggggtaatgtaggat

SEQ ID NO: 7151788 - DNA, 22 bp, Homo sapiens
gtgcctgggggtaatgtaggat

SEQ ID NO: 7151789 - DNA, 22 bp, Homo sapiens
gtgcctggggttgagctatgaa

SEQ ID NO: 7151790 - DNA, 22 bp, Homo sapiens
gtgcctggggttgagctatgaa

SEQ ID NO: 7151791 - DNA, 22 bp, Homo sapiens
gtgcctggggttgagctatgaa

SEQ ID NO: 7151792 - DNA, 22 bp, Homo sapiens
cagcccttccttctgtttatac

SEQ ID NO: 7151793 - DNA, 22 bp, Homo sapiens
cagcccttccaggcagaattct

SEQ ID NO: 7151794 - DNA, 22 bp, Homo sapiens
cagcccttcttccaaccagctt

SEQ ID NO: 7151795 - DNA, 22 bp, Homo sapiens
cagcccttgatgataatttatc

SEQ ID NO: 7151796 - DNA, 22 bp, Homo sapiens
cagccctgttgcgcttccggcg

SEQ ID NO: 7151797 - DNA, 22 bp, Homo sapiens
cagccctgttgcgcttccggcg

SEQ ID NO: 7151798 - DNA, 22 bp, Homo sapiens
cagccctgttgcgcttccggcg

SEQ ID NO: 7151799 - DNA, 20 bp, Homo sapiens
cagccctttatcctcctatg

SEQ ID NO: 7151800 - DNA, 22 bp, Homo sapiens
cagccctttccttctcagcttt

SEQ ID NO: 7151801 - DNA, 22 bp, Homo sapiens
cagccctttccttctcagcttt

SEQ ID NO: 7151802 - DNA, 22 bp, Homo sapiens
cagccgtcagatgtgccgcagc

SEQ ID NO: 7151803 - DNA, 22 bp, Homo sapiens
cagcccttgcgacaccctggct

SEQ ID NO: 7151804 - DNA, 20 bp, Homo sapiens
cagcccttgatttacaatcc

SEQ ID NO: 7151805 - DNA, 22 bp, Homo sapiens
cagcccttggcccagggcacag

SEQ ID NO: 7151806 - DNA, 22 bp, Homo sapiens
cagcccttggcccagggcacag

SEQ ID NO: 7151807 - DNA, 22 bp, Homo sapiens
cagcccttgggccatcctagaa

SEQ ID NO: 7151808 - DNA, 22 bp, Homo sapiens
cagcccttgtttctaaagctgc

SEQ ID NO: 7151809 - DNA, 22 bp, Homo sapiens
cagctcccagtggcagctcctt

SEQ ID NO: 7151810 - DNA, 22 bp, Homo sapiens
cagctcccagtggcagctcctt

SEQ ID NO: 7151811 - DNA, 22 bp, Homo sapiens
cagctcccagtggcagctcctt

SEQ ID NO: 7151812 - DNA, 22 bp, Homo sapiens
cagctccccatggttcctgaag

SEQ ID NO: 7151813 - DNA, 22 bp, Homo sapiens
cagctccccatggttcctgaag

SEQ ID NO: 7151814 - DNA, 23 bp, Homo sapiens
cagctccagtgcactcaggtagc

SEQ ID NO: 7151815 - DNA, 23 bp, Homo sapiens
cagctccagtgcactcaggtagc

SEQ ID NO: 7151816 - DNA, 22 bp, Homo sapiens
cagctccagctctgggcgcctc

SEQ ID NO: 7151817 - DNA, 23 bp, Homo sapiens
cagctccagtgcactcaggtagc

SEQ ID NO: 7151818 - DNA, 22 bp, Homo sapiens
cagctccatcttgcttatacca

SEQ ID NO: 7151819 - DNA, 22 bp, Homo sapiens
cagctcccagaactgaccatgt

SEQ ID NO: 7151820 - DNA, 22 bp, Homo sapiens
cagctcccagaactgaccatgt

SEQ ID NO: 7151821 - DNA, 22 bp, Homo sapiens
cagctccagcccaggcagctcc

SEQ ID NO: 7151822 - DNA, 22 bp, Homo sapiens
cagctccagccgactgtaagaa

SEQ ID NO: 7151823 - DNA, 22 bp, Homo sapiens
cagctccagccgactgtaagaa

SEQ ID NO: 7151824 - DNA, 22 bp, Homo sapiens
cagctccagccgactgtaagaa

SEQ ID NO: 7151825 - DNA, 22 bp, Homo sapiens
cagctccagcctgacaccaaga

SEQ ID NO: 7151826 - DNA, 22 bp, Homo sapiens
cagctccagcctgacaccaaga

SEQ ID NO: 7151827 - DNA, 22 bp, Homo sapiens
cagctccagcctgacaccaaga

SEQ ID NO: 7151828 - DNA, 22 bp, Homo sapiens
cagctccagctctgggcgcctc

SEQ ID NO: 7151829 - DNA, 22 bp, Homo sapiens
cagctccagctctgggcgcctc

SEQ ID NO: 7151830 - DNA, 22 bp, Homo sapiens
cagctccagcccaggcagctcc

SEQ ID NO: 7151831 - DNA, 22 bp, Homo sapiens
cagctccagccaccggggggtg

SEQ ID NO: 7151832 - DNA, 22 bp, Homo sapiens
cagctccagccaccggggggtg

SEQ ID NO: 7151833 - DNA, 22 bp, Homo sapiens
cagctccagccaccggggggtg

SEQ ID NO: 7151834 - DNA, 22 bp, Homo sapiens
cagctccagccaccggggggtg

SEQ ID NO: 7151835 - DNA, 22 bp, Homo sapiens
cagctccagcccaggcagctcc

SEQ ID NO: 7151836 - DNA, 22 bp, Homo sapiens
cagctccagcccaggcagctcc

SEQ ID NO: 7151837 - DNA, 22 bp, Homo sapiens
cagctccacttgagtggggcct

SEQ ID NO: 7151838 - DNA, 22 bp, Homo sapiens
cagctccacttgagtggggcct

SEQ ID NO: 7151839 - DNA, 22 bp, Homo sapiens
cagctccacttgagtggggcct

SEQ ID NO: 7151840 - DNA, 22 bp, Homo sapiens
cagctccacttgagtggggcct

SEQ ID NO: 7151841 - DNA, 21 bp, Homo sapiens
cagctccactaaagcagctgt

SEQ ID NO: 7151842 - DNA, 21 bp, Homo sapiens
cagctccactaaagcagctgt

SEQ ID NO: 7151843 - DNA, 20 bp, Homo sapiens
gtgctgagggctgggcaatg

SEQ ID NO: 7151844 - DNA, 20 bp, Homo sapiens
gtgctgagggctgggcaatg

SEQ ID NO: 7151845 - DNA, 22 bp, Homo sapiens
cagctcaggaaggaaggccggc

SEQ ID NO: 7151846 - DNA, 21 bp, Homo sapiens
cagctccactaaagcagctgt

SEQ ID NO: 7151847 - DNA, 22 bp, Homo sapiens
gtgctgaggtgggtgggcagcc

SEQ ID NO: 7151848 - DNA, 22 bp, Homo sapiens
cagctcagcttcctgggtgtgt

SEQ ID NO: 7151849 - DNA, 22 bp, Homo sapiens
cagctcagcttcctgggtgtgt

SEQ ID NO: 7151850 - DNA, 22 bp, Homo sapiens
gtgctgagattggagtgagcag

SEQ ID NO: 7151851 - DNA, 22 bp, Homo sapiens
gtgctgagattggagtgagcag

SEQ ID NO: 7151852 - DNA, 22 bp, Homo sapiens
gtgctgagcacaccttggagca

SEQ ID NO: 7151853 - DNA, 22 bp, Homo sapiens
gtgctgagcacaccttggagca

SEQ ID NO: 7151854 - DNA, 22 bp, Homo sapiens
gtgctgaggatacagctgtgaa

SEQ ID NO: 7151855 - DNA, 22 bp, Homo sapiens
gtgctgaggagagggggtggtc

SEQ ID NO: 7151856 - DNA, 22 bp, Homo sapiens
gtgctgaggatacagctgtgaa

SEQ ID NO: 7151857 - DNA, 22 bp, Homo sapiens
gtgctgagctgcagatgcgctc

SEQ ID NO: 7151858 - DNA, 22 bp, Homo sapiens
gtgctgagctgcagatgcgctc

SEQ ID NO: 7151859 - DNA, 22 bp, Homo sapiens
gtgctgaggagagggggtggtc

SEQ ID NO: 7151860 - DNA, 22 bp, Homo sapiens
gtgctgaggagagggggtggtc

SEQ ID NO: 7151861 - DNA, 22 bp, Homo sapiens
gtgctgagcatcatgaggcact

SEQ ID NO: 7151862 - DNA, 22 bp, Homo sapiens
gtgcctggggttgagctatgaa

SEQ ID NO: 7151863 - DNA, 22 bp, Homo sapiens
gtgcctggtatgtaggtagcgg

SEQ ID NO: 7151864 - DNA, 22 bp, Homo sapiens
gtgcctggtatgtaggtagcgg

SEQ ID NO: 7151865 - DNA, 22 bp, Homo sapiens
gtgcctggtatgtaggtagcgg

SEQ ID NO: 7151866 - DNA, 22 bp, Homo sapiens
gtgcctggtttggggaatgttc

SEQ ID NO: 7151867 - DNA, 22 bp, Homo sapiens
gtgcctggtttggggaatgttc

SEQ ID NO: 7151868 - DNA, 22 bp, Homo sapiens
gtgcctggtttggggagtgttc

SEQ ID NO: 7151869 - DNA, 22 bp, Homo sapiens
gtgcctgtaagggcaggtttct

SEQ ID NO: 7151870 - DNA, 22 bp, Homo sapiens
gtgcctgtaagggcaggtttct

SEQ ID NO: 7151871 - DNA, 22 bp, Homo sapiens
gtgcctgtaagttgtatgggct

SEQ ID NO: 7151872 - DNA, 22 bp, Homo sapiens
gtgcctgtaagttgtatgggct

SEQ ID NO: 7151873 - DNA, 22 bp, Homo sapiens
gtgcctgtgccaggggtgtgct

SEQ ID NO: 7151874 - DNA, 22 bp, Homo sapiens
gtgcctgtgccaggggtgtgct

SEQ ID NO: 7151875 - DNA, 22 bp, Homo sapiens
gtgcctgtccattcccaggctc

SEQ ID NO: 7151876 - DNA, 22 bp, Homo sapiens
gtgcctgtgcggactcagggaa

SEQ ID NO: 7151877 - DNA, 22 bp, Homo sapiens
gtgcctgtgcggactcagggaa

SEQ ID NO: 7151878 - DNA, 17 bp, Homo sapiens
gtgcctgttgtcctgga

SEQ ID NO: 7151879 - DNA, 17 bp, Homo sapiens
gtgcctgttgtcctgga

SEQ ID NO: 7151880 - DNA, 17 bp, Homo sapiens
gtgcctgttgtcctgga

SEQ ID NO: 7151881 - DNA, 22 bp, Homo sapiens
gtgctgagaacaaaagtggaca

SEQ ID NO: 7151882 - DNA, 17 bp, Homo sapiens
cagctctgcagacttcc

SEQ ID NO: 7151883 - DNA, 17 bp, Homo sapiens
cagctctgcagacttcc

SEQ ID NO: 7151884 - DNA, 17 bp, Homo sapiens
cagctctgcagacttcc

SEQ ID NO: 7151885 - DNA, 22 bp, Homo sapiens
cagctctgagactgaggctatg

SEQ ID NO: 7151886 - DNA, 22 bp, Homo sapiens
cagctcctgcagctgctgccgt

SEQ ID NO: 7151887 - DNA, 22 bp, Homo sapiens
cagctcctgcagctgctgccgt

SEQ ID NO: 7151888 - DNA, 22 bp, Homo sapiens
cagctcctgcagctggctccca

SEQ ID NO: 7151889 - DNA, 22 bp, Homo sapiens
cagctcctgcagctggctccca

SEQ ID NO: 7151890 - DNA, 22 bp, Homo sapiens
cagctcctgaggactgctggga

SEQ ID NO: 7151891 - DNA, 22 bp, Homo sapiens
cagctcctgaggactgctggga

SEQ ID NO: 7151892 - DNA, 22 bp, Homo sapiens
cagctcctctgttagccctggg

SEQ ID NO: 7151893 - DNA, 22 bp, Homo sapiens
cagctctgagactgaggctatg

SEQ ID NO: 7151894 - DNA, 21 bp, Homo sapiens
cagctctgagatttctactag

SEQ ID NO: 7151895 - DNA, 21 bp, Homo sapiens
cagctctgagatttctactag

SEQ ID NO: 7151896 - DNA, 22 bp, Homo sapiens
cagctctgaggaacactccttt

SEQ ID NO: 7151897 - DNA, 21 bp, Homo sapiens
cagctctgagatttctactag

SEQ ID NO: 7151898 - DNA, 22 bp, Homo sapiens
cagctctgaggaacactccttt

SEQ ID NO: 7151899 - DNA, 22 bp, Homo sapiens
cagctctgaggaacactccttt

SEQ ID NO: 7151900 - DNA, 22 bp, Homo sapiens
cagctctgaggaacactccttt

SEQ ID NO: 7151901 - DNA, 22 bp, Homo sapiens
cagctctgaggaacactccttt

SEQ ID NO: 7151902 - DNA, 22 bp, Homo sapiens
cagctctgatgaaatgtaccag

SEQ ID NO: 7151903 - DNA, 22 bp, Homo sapiens
cagctctgatgaaatgtaccag

SEQ ID NO: 7151904 - DNA, 17 bp, Homo sapiens
cagctctgcagacttcc

SEQ ID NO: 7151905 - DNA, 22 bp, Homo sapiens
cagctcccgccatcgggaggca

SEQ ID NO: 7151906 - DNA, 22 bp, Homo sapiens
cagctcctagatcggcgaagtg

SEQ ID NO: 7151907 - DNA, 22 bp, Homo sapiens
cagctcctatgagtatgattcc

SEQ ID NO: 7151908 - DNA, 22 bp, Homo sapiens
cagctcctatgagtatgattcc

SEQ ID NO: 7151909 - DNA, 22 bp, Homo sapiens
cagctcctcacgagtcttgaaa

SEQ ID NO: 7151910 - DNA, 22 bp, Homo sapiens
cagctcctcagccctgccttgg

SEQ ID NO: 7151911 - DNA, 22 bp, Homo sapiens
cagctcctcagccctgccttgg

SEQ ID NO: 7151912 - DNA, 22 bp, Homo sapiens
cagctcctattagacactgaat

SEQ ID NO: 7151913 - DNA, 22 bp, Homo sapiens
cagctcctcagccctgccttgg

SEQ ID NO: 7151914 - DNA, 22 bp, Homo sapiens
cagctcctctggccagccctgc

SEQ ID NO: 7151915 - DNA, 22 bp, Homo sapiens
cagctcctctggccagccctgc

SEQ ID NO: 7151916 - DNA, 22 bp, Homo sapiens
cagctcctctggccagccctgc

SEQ ID NO: 7151917 - DNA, 22 bp, Homo sapiens
cagctcctctgttagccctggg

SEQ ID NO: 7151918 - DNA, 22 bp, Homo sapiens
gtgcagctgaaggctggccagc

SEQ ID NO: 7151919 - DNA, 22 bp, Homo sapiens
gtgcagctgaaggctggccagc

SEQ ID NO: 7151920 - DNA, 22 bp, Homo sapiens
gtgcagctgtggtggagccagg

SEQ ID NO: 7151921 - DNA, 22 bp, Homo sapiens
gtgcaggagccaggggtaggaa

SEQ ID NO: 7151922 - DNA, 22 bp, Homo sapiens
gtgcaggagccaggggtaggaa

SEQ ID NO: 7151923 - DNA, 22 bp, Homo sapiens
gtgcaaaatgatatcctgaagc

SEQ ID NO: 7151924 - DNA, 16 bp, Homo sapiens
gtgcaaaagtgaggag

SEQ ID NO: 7151925 - DNA, 22 bp, Homo sapiens
gtgcaaagcttaacattctgca

SEQ ID NO: 7151926 - DNA, 22 bp, Homo sapiens
gtgcaaatacatatgctgtgga

SEQ ID NO: 7151927 - DNA, 22 bp, Homo sapiens
gtgcaaatacatatgctgtgga

SEQ ID NO: 7151928 - DNA, 18 bp, Homo sapiens
gtgcaaatacttgctgac

SEQ ID NO: 7151929 - DNA, 18 bp, Homo sapiens
gtgcaaatacttgctgac

SEQ ID NO: 7151930 - DNA, 22 bp, Homo sapiens
gtgcaaatgagatggattcaag

SEQ ID NO: 7151931 - DNA, 22 bp, Homo sapiens
gtgcaaatgagatggattcaag

SEQ ID NO: 7151932 - DNA, 22 bp, Homo sapiens
gtgcaaatgattctaatgggta

SEQ ID NO: 7151933 - DNA, 22 bp, Homo sapiens
gtgcaaatgattctaatgggta

SEQ ID NO: 7151934 - DNA, 22 bp, Homo sapiens
gtgcaaatgtaattgcagtttt

SEQ ID NO: 7151935 - DNA, 22 bp, Homo sapiens
gtgcaaatgtaattgcagtttt

SEQ ID NO: 7151936 - DNA, 22 bp, Homo sapiens
gtgcaaatgtaattgccattga

SEQ ID NO: 7151937 - DNA, 22 bp, Homo sapiens
gtgcagcagggggaagacagtg

SEQ ID NO: 7151938 - DNA, 23 bp, Homo sapiens
gtgcagcagtgtctgcagtcatg

SEQ ID NO: 7151939 - DNA, 20 bp, Homo sapiens
gtgcagccaagctgagccgc

SEQ ID NO: 7151940 - DNA, 22 bp, Homo sapiens
gtgcagcctgtcgccagtggat

SEQ ID NO: 7151941 - DNA, 22 bp, Homo sapiens
gtgcagctactccttggtccta

SEQ ID NO: 7151942 - DNA, 22 bp, Homo sapiens
gtgcaaaagtaattacagtttt

SEQ ID NO: 7151943 - DNA, 22 bp, Homo sapiens
gtgcaaaagtaattgaggtttt

SEQ ID NO: 7151944 - DNA, 22 bp, Homo sapiens
gtgcaaaagtaattgcagtact

SEQ ID NO: 7151945 - DNA, 22 bp, Homo sapiens
gtgcaaaagtaattgcagtttt

SEQ ID NO: 7151946 - DNA, 22 bp, Homo sapiens
gtgcaaaagtaattgcggtttt

SEQ ID NO: 7151947 - DNA, 22 bp, Homo sapiens
gtgcaaaagtaattgctgtttt

SEQ ID NO: 7151948 - DNA, 22 bp, Homo sapiens
gtgcaaaagtaattgtggtttt

SEQ ID NO: 7151949 - DNA, 22 bp, Homo sapiens
gtgcaaaagtaattgtggtttt

SEQ ID NO: 7151950 - DNA, 22 bp, Homo sapiens
gtgcaaaagtacttgcggattt

SEQ ID NO: 7151951 - DNA, 22 bp, Homo sapiens
gtgcaaaagtcattgtggtttt

SEQ ID NO: 7151952 - DNA, 22 bp, Homo sapiens
gtgcaaaagtcattgtggtttt

SEQ ID NO: 7151953 - DNA, 22 bp, Homo sapiens
gtgaatggggcaggaaggatgg

SEQ ID NO: 7151954 - DNA, 17 bp, Homo sapiens
gtgaatggcatagtcgg

SEQ ID NO: 7151955 - DNA, 22 bp, Homo sapiens
gtgaatggttgtgaacatcttt

SEQ ID NO: 7151956 - DNA, 22 bp, Homo sapiens
gtgaatactgtatctcaggaca

SEQ ID NO: 7151957 - DNA, 22 bp, Homo sapiens
gtgaatatgatcttatttggaa

SEQ ID NO: 7151958 - DNA, 22 bp, Homo sapiens
gtgaatgaaaggatgattcttt

SEQ ID NO: 7151959 - DNA, 22 bp, Homo sapiens
gtgaatgacatattttgtactg

SEQ ID NO: 7151960 - DNA, 22 bp, Homo sapiens
gtgaatgactgttttcagcatt

SEQ ID NO: 7151961 - DNA, 22 bp, Homo sapiens
gtgaatgatagcttctctttgg

SEQ ID NO: 7151962 - DNA, 22 bp, Homo sapiens
gtgaataattttttagtataag

SEQ ID NO: 7151963 - DNA, 22 bp, Homo sapiens
gtgaataatcacccttctggat

SEQ ID NO: 7151964 - DNA, 22 bp, Homo sapiens
gtgaataatcacccttctggat

SEQ ID NO: 7151965 - DNA, 22 bp, Homo sapiens
gtgaataattttttagtataag

SEQ ID NO: 7151966 - DNA, 22 bp, Homo sapiens
gtgaataatattgtttataaaa

SEQ ID NO: 7151967 - DNA, 22 bp, Homo sapiens
gtgaataatattgtttataaaa

SEQ ID NO: 7151968 - DNA, 22 bp, Homo sapiens
gtgaataagacctaaggatgaa

SEQ ID NO: 7151969 - DNA, 22 bp, Homo sapiens
gtgaataactttctatgttaat

SEQ ID NO: 7151970 - DNA, 22 bp, Homo sapiens
gtgaataacctactccaggcct

SEQ ID NO: 7151971 - DNA, 22 bp, Homo sapiens
gtgaataactttctatgttaat

SEQ ID NO: 7151972 - DNA, 22 bp, Homo sapiens
gtgaataaaacacctgccaaga

SEQ ID NO: 7151973 - DNA, 22 bp, Homo sapiens
gtgaataaagggagttttcaaa

SEQ ID NO: 7151974 - DNA, 22 bp, Homo sapiens
gtctttcttaaacaacagaaca

SEQ ID NO: 7151975 - DNA, 22 bp, Homo sapiens
gtctttcttaattcaagtgctt

SEQ ID NO: 7151976 - DNA, 22 bp, Homo sapiens
gtctttcttaattcaagtgctt

SEQ ID NO: 7151977 - DNA, 22 bp, Homo sapiens
gtctttcttcagagcttggact

SEQ ID NO: 7151978 - DNA, 22 bp, Homo sapiens
gtcttagatttcaccgataatg

SEQ ID NO: 7151979 - DNA, 22 bp, Homo sapiens
gtctttctgctgcacggactgc

SEQ ID NO: 7151980 - DNA, 22 bp, Homo sapiens
gtctttctgccatgtgaagaga

SEQ ID NO: 7151981 - DNA, 22 bp, Homo sapiens
gtctttctgccatgtgaagaga

SEQ ID NO: 7151982 - DNA, 22 bp, Homo sapiens
gtctgtttggggacctgtggcc

SEQ ID NO: 7151983 - DNA, 22 bp, Homo sapiens
gtctgtttggggacctgtggcc

SEQ ID NO: 7151984 - DNA, 22 bp, Homo sapiens
gtcttactgcttctgaaagata

SEQ ID NO: 7151985 - DNA, 22 bp, Homo sapiens
gtctcttatgggcaggagcaca

SEQ ID NO: 7151986 - DNA, 19 bp, Homo sapiens
gtgaagtgccagaagtcag

SEQ ID NO: 7151987 - DNA, 19 bp, Homo sapiens
gtgaagtgccagaagtcag

SEQ ID NO: 7151988 - DNA, 22 bp, Homo sapiens
gtgaaggtgtgtccactgcggc

SEQ ID NO: 7151989 - DNA, 22 bp, Homo sapiens
gtctctgtgccttctccccacc

SEQ ID NO: 7151990 - DNA, 22 bp, Homo sapiens
gtctctgtggctggctccttcc

SEQ ID NO: 7151991 - DNA, 22 bp, Homo sapiens
gtctctgggttaagcagtgcat

SEQ ID NO: 7151992 - DNA, 22 bp, Homo sapiens
gtctctgtcacaactactcatc

SEQ ID NO: 7151993 - DNA, 22 bp, Homo sapiens
gtctctgtcttaggccaggcct

SEQ ID NO: 7151994 - DNA, 22 bp, Homo sapiens
gtctctgggtgtgtgatgccaa

SEQ ID NO: 7151995 - DNA, 22 bp, Homo sapiens
gtctctgggttaagcagtgcat

SEQ ID NO: 7151996 - DNA, 22 bp, Homo sapiens
gtctctgggttaagcagtgcat

SEQ ID NO: 7151997 - DNA, 22 bp, Homo sapiens
gtctctggctttatgctggttt

SEQ ID NO: 7151998 - DNA, 19 bp, Homo sapiens
gtctctggatttcaggtcc

SEQ ID NO: 7151999 - DNA, 22 bp, Homo sapiens
gtctcagtgtcacctccagctg

SEQ ID NO: 7152000 - DNA, 22 bp, Homo sapiens
gtctcagttactctccctggta

SEQ ID NO: 7152001 - DNA, 22 bp, Homo sapiens
gtctcagttgtatcacctggtt

SEQ ID NO: 7152002 - DNA, 22 bp, Homo sapiens
gtctccacagcccagctgccac

SEQ ID NO: 7152003 - DNA, 20 bp, Homo sapiens
gtctccactgggggttaacc

SEQ ID NO: 7152004 - DNA, 20 bp, Homo sapiens
gtctccactgggggttaacc

SEQ ID NO: 7152005 - DNA, 20 bp, Homo sapiens
gtctccactgggggttaacc

SEQ ID NO: 7152006 - DNA, 22 bp, Homo sapiens
gtctccagaagcctagacagcc

SEQ ID NO: 7152007 - DNA, 18 bp, Homo sapiens
gtctcaggagtggcacgt

SEQ ID NO: 7152008 - DNA, 18 bp, Homo sapiens
gtctcaggagtggcacgt

SEQ ID NO: 7152009 - DNA, 22 bp, Homo sapiens
gtctcagggactgcttctgggg

SEQ ID NO: 7152010 - DNA, 22 bp, Homo sapiens
gtctcagggcagctggaggagg

SEQ ID NO: 7152011 - DNA, 22 bp, Homo sapiens
gtctcaggtattgaatgggaac

SEQ ID NO: 7152012 - DNA, 22 bp, Homo sapiens
gtctcagggctgagggcagtgg

SEQ ID NO: 7152013 - DNA, 22 bp, Homo sapiens
gtctcagtaagaaaggctcctg

SEQ ID NO: 7152014 - DNA, 22 bp, Homo sapiens
gtctcagtccgtgctgttcagg

SEQ ID NO: 7152015 - DNA, 22 bp, Homo sapiens
cagcagagctgggaataaaatt

SEQ ID NO: 7152016 - DNA, 22 bp, Homo sapiens
cagcagagctgggctttgaatt

SEQ ID NO: 7152017 - DNA, 22 bp, Homo sapiens
cagcagagctgggctttgaatt

SEQ ID NO: 7152018 - DNA, 22 bp, Homo sapiens
cagcagagctgggctttgaatt

SEQ ID NO: 7152019 - DNA, 22 bp, Homo sapiens
cagcagagcatttggtaggagg

SEQ ID NO: 7152020 - DNA, 22 bp, Homo sapiens
cagcagagcatttggtaggagg

SEQ ID NO: 7152021 - DNA, 22 bp, Homo sapiens
cagcagagctgggaataaaatt

SEQ ID NO: 7152022 - DNA, 22 bp, Homo sapiens
cagcagagctgggaataaaatt

SEQ ID NO: 7152023 - DNA, 22 bp, Homo sapiens
cagcagagcatttggtaggagg

SEQ ID NO: 7152024 - DNA, 22 bp, Homo sapiens
cagcagagcatttggtaggagg

SEQ ID NO: 7152025 - DNA, 22 bp, Homo sapiens
cagcagagcatttggtaggagg

SEQ ID NO: 7152026 - DNA, 22 bp, Homo sapiens
cagcagagatgagattcctata

SEQ ID NO: 7152027 - DNA, 22 bp, Homo sapiens
cagcagagacggtaagcagaac

SEQ ID NO: 7152028 - DNA, 22 bp, Homo sapiens
cagcagagacggtaagcagaac

SEQ ID NO: 7152029 - DNA, 22 bp, Homo sapiens
cagcagagacggtaagcagaac

SEQ ID NO: 7152030 - DNA, 22 bp, Homo sapiens
cagcagagacggtaagcagaac

SEQ ID NO: 7152031 - DNA, 22 bp, Homo sapiens
cagcaggtatgtttgttcagca

SEQ ID NO: 7152032 - DNA, 22 bp, Homo sapiens
cagcaggtcccactgagggccc

SEQ ID NO: 7152033 - DNA, 22 bp, Homo sapiens
cagcaggtctcagcagctcctt

SEQ ID NO: 7152034 - DNA, 22 bp, Homo sapiens
cagcaggtctcagcagctcctt

SEQ ID NO: 7152035 - DNA, 22 bp, Homo sapiens
cagcagagctgtgtgggaaggg

SEQ ID NO: 7152036 - DNA, 22 bp, Homo sapiens
cagcagagctgtgtgggaaggg

SEQ ID NO: 7152037 - DNA, 22 bp, Homo sapiens
cagcagagctgtgtgggaaggg

SEQ ID NO: 7152038 - DNA, 22 bp, Homo sapiens
cagcagagctgtgtgggaaggg

SEQ ID NO: 7152039 - DNA, 22 bp, Homo sapiens
cagcagggaagctgtgctgttt

SEQ ID NO: 7152040 - DNA, 22 bp, Homo sapiens
cagcagggttaagtgactcacc

SEQ ID NO: 7152041 - DNA, 22 bp, Homo sapiens
cagcagggttaagtgactcacc

SEQ ID NO: 7152042 - DNA, 22 bp, Homo sapiens
cagcagggttaagtgactcacc

SEQ ID NO: 7152043 - DNA, 22 bp, Homo sapiens
cagcagtaattagtgctgcatg

SEQ ID NO: 7152044 - DNA, 22 bp, Homo sapiens
cagcagtacttctcagaggtat

SEQ ID NO: 7152045 - DNA, 22 bp, Homo sapiens
cagcagtacttctcagaggtat

SEQ ID NO: 7152046 - DNA, 22 bp, Homo sapiens
cagcagtagtctctgtggcttt

SEQ ID NO: 7152047 - DNA, 22 bp, Homo sapiens
cagcagtcacacaaactctgga

SEQ ID NO: 7152048 - DNA, 22 bp, Homo sapiens
cagcaggttaacagaggctggt

SEQ ID NO: 7152049 - DNA, 22 bp, Homo sapiens
cagcagtaactcccgtgcagca

SEQ ID NO: 7152050 - DNA, 22 bp, Homo sapiens
cagcaggtgctgcctgtcaccc

SEQ ID NO: 7152051 - DNA, 22 bp, Homo sapiens
cagcaggtgctgcctgtcaccc

SEQ ID NO: 7152052 - DNA, 22 bp, Homo sapiens
cagcaggtgctgcctgtcaccc

SEQ ID NO: 7152053 - DNA, 22 bp, Homo sapiens
cagcaggtggacacactcacct

SEQ ID NO: 7152054 - DNA, 22 bp, Homo sapiens
cagcaggtggacacactcacct

SEQ ID NO: 7152055 - DNA, 22 bp, Homo sapiens
cagcaggtggacacactcacct

SEQ ID NO: 7152056 - DNA, 21 bp, Homo sapiens
cagcaggtggagcctcttgtc

SEQ ID NO: 7152057 - DNA, 22 bp, Homo sapiens
cagcaggtgtctagcaagggtc

SEQ ID NO: 7152058 - DNA, 22 bp, Homo sapiens
cagcaggtgtctagcaagggtc

SEQ ID NO: 7152059 - DNA, 22 bp, Homo sapiens
cagcagtgcttcagtgtgagat

SEQ ID NO: 7152060 - DNA, 22 bp, Homo sapiens
cagcagtgcttcagtgtgagat

SEQ ID NO: 7152061 - DNA, 22 bp, Homo sapiens
cagcagtgacaagactaagaag

SEQ ID NO: 7152062 - DNA, 22 bp, Homo sapiens
cagcagtgatgtgtgagggttc

SEQ ID NO: 7152063 - DNA, 22 bp, Homo sapiens
cagcagtgatgtgtgagggttc

SEQ ID NO: 7152064 - DNA, 22 bp, Homo sapiens
cagcagtgacaagactaagaag

SEQ ID NO: 7152065 - DNA, 22 bp, Homo sapiens
cagcagtcaggcaaatgggagg

SEQ ID NO: 7152066 - DNA, 22 bp, Homo sapiens
cagcagtccctgcagtggggaa

SEQ ID NO: 7152067 - DNA, 22 bp, Homo sapiens
cagcagtctgtttcaacaggtc

SEQ ID NO: 7152068 - DNA, 22 bp, Homo sapiens
cagcagtggccatctgtgtggt

SEQ ID NO: 7152069 - DNA, 22 bp, Homo sapiens
cagcagtggctgcaggcagctg

SEQ ID NO: 7152070 - DNA, 22 bp, Homo sapiens
cagcagtggctgcaggcagctg

SEQ ID NO: 7152071 - DNA, 22 bp, Homo sapiens
cagcagtggccatctgtgtggt

SEQ ID NO: 7152072 - DNA, 22 bp, Homo sapiens
cagcagtggccatctgtgtggt

SEQ ID NO: 7152073 - DNA, 22 bp, Homo sapiens
cagcagtgcttcagtgtgagat

SEQ ID NO: 7152074 - DNA, 22 bp, Homo sapiens
cagcagtggaactacccaggga

SEQ ID NO: 7152075 - DNA, 22 bp, Homo sapiens
cagcagtggaactacccaggga

SEQ ID NO: 7152076 - DNA, 20 bp, Homo sapiens
cagcagtggatgagagtttt

SEQ ID NO: 7152077 - DNA, 22 bp, Homo sapiens
gtcctgtgggcccaccatgagc

SEQ ID NO: 7152078 - DNA, 22 bp, Homo sapiens
gtcctgtgtaagccaggacaat

SEQ ID NO: 7152079 - DNA, 22 bp, Homo sapiens
gtctatttgggatcatgatatg

SEQ ID NO: 7152080 - DNA, 22 bp, Homo sapiens
gtctcaaactcctaggctaaag

SEQ ID NO: 7152081 - DNA, 21 bp, Homo sapiens
gtctcacaaggtggcttacgt

SEQ ID NO: 7152082 - DNA, 22 bp, Homo sapiens
gtctcacacagagtagattttg

SEQ ID NO: 7152083 - DNA, 22 bp, Homo sapiens
gtctcagagtcctacttattcc

SEQ ID NO: 7152084 - DNA, 22 bp, Homo sapiens
cagcatgattggtgtctggtga

SEQ ID NO: 7152085 - DNA, 22 bp, Homo sapiens
cagcatgatttatcacaaccct

SEQ ID NO: 7152086 - DNA, 22 bp, Homo sapiens
cagcatgcaagtccagatgtgg

SEQ ID NO: 7152087 - DNA, 22 bp, Homo sapiens
cagcatgcaagtccagatgtgg

SEQ ID NO: 7152088 - DNA, 22 bp, Homo sapiens
cagcatgcagcccctggcagct

SEQ ID NO: 7152089 - DNA, 22 bp, Homo sapiens
cagcatgcagcccctggcagct

SEQ ID NO: 7152090 - DNA, 22 bp, Homo sapiens
cagcatgcaagtccagatgtgg

SEQ ID NO: 7152091 - DNA, 22 bp, Homo sapiens
cagcatgcagcccctggcagct

SEQ ID NO: 7152092 - DNA, 22 bp, Homo sapiens
cagcatgcagcccctggcagct

SEQ ID NO: 7152093 - DNA, 22 bp, Homo sapiens
cagcatgcagcccctggcagct

SEQ ID NO: 7152094 - DNA, 22 bp, Homo sapiens
cagcatgcagcccctggcagct

SEQ ID NO: 7152095 - DNA, 22 bp, Homo sapiens
cagcatgcattttctctctttg

SEQ ID NO: 7152096 - DNA, 22 bp, Homo sapiens
cagcatgcattttctctctttg

SEQ ID NO: 7152097 - DNA, 22 bp, Homo sapiens
cagcatgcccagactgagctaa

SEQ ID NO: 7152098 - DNA, 22 bp, Homo sapiens
cagcatgcccagactgagctaa

SEQ ID NO: 7152099 - DNA, 22 bp, Homo sapiens
cagcatgcccagactgagctaa

SEQ ID NO: 7152100 - DNA, 22 bp, Homo sapiens
gtcctgtggaaagctagccgct

SEQ ID NO: 7152101 - DNA, 22 bp, Homo sapiens
cagcatcttattttctatggaa

SEQ ID NO: 7152102 - DNA, 22 bp, Homo sapiens
cagcatcttcatgtgcatctcc

SEQ ID NO: 7152103 - DNA, 22 bp, Homo sapiens
cagcatctgtttttctgaccca

SEQ ID NO: 7152104 - DNA, 22 bp, Homo sapiens
cagcatcttattttctatggaa

SEQ ID NO: 7152105 - DNA, 22 bp, Homo sapiens
cagcatcttcatgtgcatctcc

SEQ ID NO: 7152106 - DNA, 18 bp, Homo sapiens
cagcatcttcattaggcc

SEQ ID NO: 7152107 - DNA, 22 bp, Homo sapiens
cagcatcttctagatccaggct

SEQ ID NO: 7152108 - DNA, 22 bp, Homo sapiens
cagcatcttctagatccaggct

SEQ ID NO: 7152109 - DNA, 22 bp, Homo sapiens
cagcatcttctagatccaggct

SEQ ID NO: 7152110 - DNA, 22 bp, Homo sapiens
cagcatcttctccaaagctgcc

SEQ ID NO: 7152111 - DNA, 22 bp, Homo sapiens
cagcatcttgaagggtaaacca

SEQ ID NO: 7152112 - DNA, 22 bp, Homo sapiens
cagcatctttataaaaagtaaa

SEQ ID NO: 7152113 - DNA, 22 bp, Homo sapiens
cagcatctttctcttctggagt

SEQ ID NO: 7152114 - DNA, 22 bp, Homo sapiens
cagcatgactcactgtggtcac

SEQ ID NO: 7152115 - DNA, 18 bp, Homo sapiens
gtcctgagctctgctgta

SEQ ID NO: 7152116 - DNA, 22 bp, Homo sapiens
gtcctgagccacatactatcca

SEQ ID NO: 7152117 - DNA, 22 bp, Homo sapiens
gtcctgagaccatggccttagt

SEQ ID NO: 7152118 - DNA, 22 bp, Homo sapiens
gtcctgaatgcctttaggcaga

SEQ ID NO: 7152119 - DNA, 22 bp, Homo sapiens
gtcctctgtttccatctgactt

SEQ ID NO: 7152120 - DNA, 22 bp, Homo sapiens
gtcctctgtttccatctgactt

SEQ ID NO: 7152121 - DNA, 22 bp, Homo sapiens
gtcctctgttagaaatgtgctt

SEQ ID NO: 7152122 - DNA, 22 bp, Homo sapiens
gtcctatattcttttaaaattt

SEQ ID NO: 7152123 - DNA, 22 bp, Homo sapiens
gtcctctgtgtaggctgcagac

SEQ ID NO: 7152124 - DNA, 22 bp, Homo sapiens
cagcagtggtgtatttgaggct

SEQ ID NO: 7152125 - DNA, 22 bp, Homo sapiens
cagcagtgtacaaggtgtcaga

SEQ ID NO: 7152126 - DNA, 22 bp, Homo sapiens
cagcagtggctgcaggcagctg

SEQ ID NO: 7152127 - DNA, 22 bp, Homo sapiens
cagcagtggctgcaggcagctg

SEQ ID NO: 7152128 - DNA, 22 bp, Homo sapiens
cagcagtggctgcaggcagctg

SEQ ID NO: 7152129 - DNA, 22 bp, Homo sapiens
cagcagtgtacaaggtgtcaga

SEQ ID NO: 7152130 - DNA, 22 bp, Homo sapiens
cagcagtgtacaaggtgtcaga

SEQ ID NO: 7152131 - DNA, 17 bp, Homo sapiens
gtcctacccatggtcta

SEQ ID NO: 7152132 - DNA, 22 bp, Homo sapiens
gtcctagagatccgggagggga

SEQ ID NO: 7152133 - DNA, 22 bp, Homo sapiens
ggcccagagctccctggcacct

SEQ ID NO: 7152134 - DNA, 22 bp, Homo sapiens
ggcccagacccaagagtggtgg

SEQ ID NO: 7152135 - DNA, 22 bp, Homo sapiens
ggcccagacccaagagtggtgg

SEQ ID NO: 7152136 - DNA, 22 bp, Homo sapiens
ggcccagacccaagagtggtgg

SEQ ID NO: 7152137 - DNA, 22 bp, Homo sapiens
ggcccagagctccctggcacct

SEQ ID NO: 7152138 - DNA, 22 bp, Homo sapiens
ggcccagagctctgggggagct

SEQ ID NO: 7152139 - DNA, 22 bp, Homo sapiens
ggcccagaagccagaagcctcc

SEQ ID NO: 7152140 - DNA, 22 bp, Homo sapiens
ggcccagaatacatgaagtata

SEQ ID NO: 7152141 - DNA, 22 bp, Homo sapiens
ggcccagaatactttgtaaaat

SEQ ID NO: 7152142 - DNA, 22 bp, Homo sapiens
ggcccagacccaagagtggtgg

SEQ ID NO: 7152143 - DNA, 22 bp, Homo sapiens
ggcccagacccaagagtggtgg

SEQ ID NO: 7152144 - DNA, 22 bp, Homo sapiens
ggcccagcacagtgcttggggg

SEQ ID NO: 7152145 - DNA, 22 bp, Homo sapiens
ggcccagagtctgcaatggagt

SEQ ID NO: 7152146 - DNA, 22 bp, Homo sapiens
ggcccagcacagtgcttggggg

SEQ ID NO: 7152147 - DNA, 22 bp, Homo sapiens
ggcccagagctctgggggagct

SEQ ID NO: 7152148 - DNA, 22 bp, Homo sapiens
ggcccagagggtcaggagctga

SEQ ID NO: 7152149 - DNA, 22 bp, Homo sapiens
ggcccagagtctgcaatggagt

SEQ ID NO: 7152150 - DNA, 22 bp, Homo sapiens
ggcccagcccgagtcagccttc

SEQ ID NO: 7152151 - DNA, 22 bp, Homo sapiens
ggcccagcatcttgtgaagttt

SEQ ID NO: 7152152 - DNA, 22 bp, Homo sapiens
ggcccagcatcttgtgaagttt

SEQ ID NO: 7152153 - DNA, 22 bp, Homo sapiens
ggcccagcacagtgcttggggg

SEQ ID NO: 7152154 - DNA, 22 bp, Homo sapiens
ggcccagcatcttgtgaagttt

SEQ ID NO: 7152155 - DNA, 22 bp, Homo sapiens
ggcccagcatcttgtgaagttt

SEQ ID NO: 7152156 - DNA, 22 bp, Homo sapiens
ggcccagcccgagtcagccttc

SEQ ID NO: 7152157 - DNA, 22 bp, Homo sapiens
ggcccagcccgagtcagccttc

SEQ ID NO: 7152158 - DNA, 22 bp, Homo sapiens
ggccccagcagaccctcctctg

SEQ ID NO: 7152159 - DNA, 22 bp, Homo sapiens
ggccccagcagaccctcctctg

SEQ ID NO: 7152160 - DNA, 22 bp, Homo sapiens
ggccccagcagtgcttgtttat

SEQ ID NO: 7152161 - DNA, 19 bp, Homo sapiens
ggccccagccagggtatca

SEQ ID NO: 7152162 - DNA, 21 bp, Homo sapiens
ggccccagcccatgggttctc

SEQ ID NO: 7152163 - DNA, 22 bp, Homo sapiens
ggccccagcctcagtcccctga

SEQ ID NO: 7152164 - DNA, 22 bp, Homo sapiens
ggcgcacgccattggccgtgcg

SEQ ID NO: 7152165 - DNA, 22 bp, Homo sapiens
ggcgagggagcagtgcggtggg

SEQ ID NO: 7152166 - DNA, 22 bp, Homo sapiens
ggcgagggagcagtgcggtggg

SEQ ID NO: 7152167 - DNA, 22 bp, Homo sapiens
ggcgagggagcagtgcggtggg

SEQ ID NO: 7152168 - DNA, 22 bp, Homo sapiens
ggcgagggagcagtgcggtggg

SEQ ID NO: 7152169 - DNA, 22 bp, Homo sapiens
ggcgaggccgggacaggctgga

SEQ ID NO: 7152170 - DNA, 22 bp, Homo sapiens
ggcgagggaagtttactgtgag

SEQ ID NO: 7152171 - DNA, 22 bp, Homo sapiens
ggcgaggccgggacaggctgga

SEQ ID NO: 7152172 - DNA, 23 bp, Homo sapiens
ggcctgtgttttgtctgaagtac

SEQ ID NO: 7152173 - DNA, 23 bp, Homo sapiens
ggcctgtgttttgtctgaagtac

SEQ ID NO: 7152174 - DNA, 23 bp, Homo sapiens
ggcctgtgttttgtctgaagtac

SEQ ID NO: 7152175 - DNA, 22 bp, Homo sapiens
ggcgccccatgatgagggctag

SEQ ID NO: 7152176 - DNA, 22 bp, Homo sapiens
ggcgccagcccaggccgtcgtg

SEQ ID NO: 7152177 - DNA, 22 bp, Homo sapiens
ggcgcccatcggtgcagagggc

SEQ ID NO: 7152178 - DNA, 22 bp, Homo sapiens
ggcgcccatcggtgcagagggc

SEQ ID NO: 7152179 - DNA, 22 bp, Homo sapiens
ggcgcccccttcaaacagagca

SEQ ID NO: 7152180 - DNA, 22 bp, Homo sapiens
ggcgcccccttcaaacagagca

SEQ ID NO: 7152181 - DNA, 22 bp, Homo sapiens
ggcgccctggtgccgcaccgcg

SEQ ID NO: 7152182 - DNA, 22 bp, Homo sapiens
ggcgccgcactcggtgcagccg

SEQ ID NO: 7152183 - DNA, 22 bp, Homo sapiens
ggcgcaggccttggatcctggt

SEQ ID NO: 7152184 - DNA, 22 bp, Homo sapiens
ggccccagctgtggtgaataga

SEQ ID NO: 7152185 - DNA, 22 bp, Homo sapiens
ggccccagcttcaaccccgtgg

SEQ ID NO: 7152186 - DNA, 22 bp, Homo sapiens
ggccccaggacctccacggtcc

SEQ ID NO: 7152187 - DNA, 22 bp, Homo sapiens
ggccccaggacctccacggtcc

SEQ ID NO: 7152188 - DNA, 22 bp, Homo sapiens
ggccccaggcctttggtctggc

SEQ ID NO: 7152189 - DNA, 22 bp, Homo sapiens
ggccccaggcctttggtctggc

SEQ ID NO: 7152190 - DNA, 22 bp, Homo sapiens
ggccccagggaagaaggtggtc

SEQ ID NO: 7152191 - DNA, 22 bp, Homo sapiens
ggccccagggaagaaggtggtc

SEQ ID NO: 7152192 - DNA, 22 bp, Homo sapiens
ggccccagggattaggccaacc

SEQ ID NO: 7152193 - DNA, 22 bp, Homo sapiens
ggccccagggattaggccaacc

SEQ ID NO: 7152194 - DNA, 22 bp, Homo sapiens
ggccccagggattaggccaacc

SEQ ID NO: 7152195 - DNA, 17 bp, Homo sapiens
ggcctgtgtggctgcag

SEQ ID NO: 7152196 - DNA, 22 bp, Homo sapiens
ggccagcggcacagcctggccc

SEQ ID NO: 7152197 - DNA, 22 bp, Homo sapiens
ggccagctacccatctgcgtca

SEQ ID NO: 7152198 - DNA, 22 bp, Homo sapiens
ggccagcggcacagcctggccc

SEQ ID NO: 7152199 - DNA, 22 bp, Homo sapiens
ggccagcctggggctcccagac

SEQ ID NO: 7152200 - DNA, 22 bp, Homo sapiens
ggccagccctcctccctgggtt

SEQ ID NO: 7152201 - DNA, 22 bp, Homo sapiens
ggccagccctcctccctgggtt

SEQ ID NO: 7152202 - DNA, 22 bp, Homo sapiens
ggccagcctggggctcccagac

SEQ ID NO: 7152203 - DNA, 22 bp, Homo sapiens
ggccagcctggggctcccagac

SEQ ID NO: 7152204 - DNA, 18 bp, Homo sapiens
ggccagccccaggccagc

SEQ ID NO: 7152205 - DNA, 18 bp, Homo sapiens
ggccagccccaggccagc

SEQ ID NO: 7152206 - DNA, 22 bp, Homo sapiens
ggccagccctcctccctgggtt

SEQ ID NO: 7152207 - DNA, 22 bp, Homo sapiens
ggccagccctcctccctgggtt

SEQ ID NO: 7152208 - DNA, 18 bp, Homo sapiens
ggccagccccaggccagc

SEQ ID NO: 7152209 - DNA, 18 bp, Homo sapiens
ggccagccccaggccagc

SEQ ID NO: 7152210 - DNA, 18 bp, Homo sapiens
ggccagccccaggccagc

SEQ ID NO: 7152211 - DNA, 18 bp, Homo sapiens
ggccagccccaggccagc

SEQ ID NO: 7152212 - DNA, 22 bp, Homo sapiens
ggccagaaagttaagctgtggc

SEQ ID NO: 7152213 - DNA, 22 bp, Homo sapiens
ggccagcccagtggtcctctct

SEQ ID NO: 7152214 - DNA, 22 bp, Homo sapiens
cacatttgggacaggagataaa

SEQ ID NO: 7152215 - DNA, 22 bp, Homo sapiens
cacatttgggacaggagataaa

SEQ ID NO: 7152216 - DNA, 19 bp, Homo sapiens
cacattttgagtctgagat

SEQ ID NO: 7152217 - DNA, 21 bp, Homo sapiens
cacatttgaacctcacagcaa

SEQ ID NO: 7152218 - DNA, 21 bp, Homo sapiens
cacatttgaacctcacagcaa

SEQ ID NO: 7152219 - DNA, 22 bp, Homo sapiens
cacatttgaaggaattagcatt

SEQ ID NO: 7152220 - DNA, 22 bp, Homo sapiens
cacatttgaaggaattagcatt

SEQ ID NO: 7152221 - DNA, 22 bp, Homo sapiens
cacatttgaaggaattagcatt

SEQ ID NO: 7152222 - DNA, 19 bp, Homo sapiens
cacattttgagtctgagat

SEQ ID NO: 7152223 - DNA, 22 bp, Homo sapiens
cacatttttactgccaacttaa

SEQ ID NO: 7152224 - DNA, 22 bp, Homo sapiens
caccaagaatcttcacttttta

SEQ ID NO: 7152225 - DNA, 22 bp, Homo sapiens
caccaagaatcttcacttttta

SEQ ID NO: 7152226 - DNA, 21 bp, Homo sapiens
caccaacacctgggataggtc

SEQ ID NO: 7152227 - DNA, 19 bp, Homo sapiens
caccaagatggctctagtc

SEQ ID NO: 7152228 - DNA, 20 bp, Homo sapiens
caccaagctaaggttacttt

SEQ ID NO: 7152229 - DNA, 22 bp, Homo sapiens
caccaataattttatatcacat

SEQ ID NO: 7152230 - DNA, 17 bp, Homo sapiens
caccaattaagaccctc

SEQ ID NO: 7152231 - DNA, 20 bp, Homo sapiens
caccacagaattggggacag

SEQ ID NO: 7152232 - DNA, 22 bp, Homo sapiens
caccacagcatccactagaagg

SEQ ID NO: 7152233 - DNA, 22 bp, Homo sapiens
caccacagcatccactagaagg

SEQ ID NO: 7152234 - DNA, 22 bp, Homo sapiens
caccacagcatccactagaagg

SEQ ID NO: 7152235 - DNA, 22 bp, Homo sapiens
caccacagcatccactagaagg

SEQ ID NO: 7152236 - DNA, 22 bp, Homo sapiens
cacccaggacaggccagatgtg

SEQ ID NO: 7152237 - DNA, 22 bp, Homo sapiens
cacccaggacaggccagatgtg

SEQ ID NO: 7152238 - DNA, 22 bp, Homo sapiens
cacccaggacaggccagatgtg

SEQ ID NO: 7152239 - DNA, 22 bp, Homo sapiens
cacccaggacaggccagatgtg

SEQ ID NO: 7152240 - DNA, 22 bp, Homo sapiens
cacccaggacaggccagatgtg

SEQ ID NO: 7152241 - DNA, 22 bp, Homo sapiens
cacccaggacaggccagatgtg

SEQ ID NO: 7152242 - DNA, 22 bp, Homo sapiens
cacccaggcaaggattctgcaa

SEQ ID NO: 7152243 - DNA, 22 bp, Homo sapiens
cacccaggcaggtggctgagaa

SEQ ID NO: 7152244 - DNA, 22 bp, Homo sapiens
cacccaggcaggtggctgagaa

SEQ ID NO: 7152245 - DNA, 22 bp, Homo sapiens
cacccaggcaggtggctgagaa

SEQ ID NO: 7152246 - DNA, 22 bp, Homo sapiens
cacccaggcaggtggctgagaa

SEQ ID NO: 7152247 - DNA, 22 bp, Homo sapiens
cacccaggcatgggttgagatg

SEQ ID NO: 7152248 - DNA, 22 bp, Homo sapiens
cacccaggcaggtggctgagaa

SEQ ID NO: 7152249 - DNA, 22 bp, Homo sapiens
cacccaggcaggtggctgagaa

SEQ ID NO: 7152250 - DNA, 22 bp, Homo sapiens
ggccagggcctggggactgtcc

SEQ ID NO: 7152251 - DNA, 22 bp, Homo sapiens
ggccagggcctggggactgtcc

SEQ ID NO: 7152252 - DNA, 22 bp, Homo sapiens
cacccagcttttgcatcctccg

SEQ ID NO: 7152253 - DNA, 22 bp, Homo sapiens
cacccaggacaaaatatggaat

SEQ ID NO: 7152254 - DNA, 22 bp, Homo sapiens
cacccagcttttgcatcctccg

SEQ ID NO: 7152255 - DNA, 22 bp, Homo sapiens
cacccaggacaaaatatggaat

SEQ ID NO: 7152256 - DNA, 22 bp, Homo sapiens
cacccagccttcacacaggagt

SEQ ID NO: 7152257 - DNA, 22 bp, Homo sapiens
cacccagcttttgcatcctccg

SEQ ID NO: 7152258 - DNA, 22 bp, Homo sapiens
cacccagcttttgcatcctccg

SEQ ID NO: 7152259 - DNA, 22 bp, Homo sapiens
ggccagctccttggcagtgcct

SEQ ID NO: 7152260 - DNA, 21 bp, Homo sapiens
ggccagctcggaaggtcccat

SEQ ID NO: 7152261 - DNA, 22 bp, Homo sapiens
cacccagcagcacttaagacta

SEQ ID NO: 7152262 - DNA, 22 bp, Homo sapiens
cacccagcattggctaagagag

SEQ ID NO: 7152263 - DNA, 22 bp, Homo sapiens
cacccagcattggctaagagag

SEQ ID NO: 7152264 - DNA, 18 bp, Homo sapiens
ggccagctcctgaggcag

SEQ ID NO: 7152265 - DNA, 22 bp, Homo sapiens
ggccagctccttggcagtgcct

SEQ ID NO: 7152266 - DNA, 22 bp, Homo sapiens
ggccagctcagtctccatcagg

SEQ ID NO: 7152267 - DNA, 22 bp, Homo sapiens
ggccagctacccatctgcgtca

SEQ ID NO: 7152268 - DNA, 22 bp, Homo sapiens
ggccagctcagactccacttgc

SEQ ID NO: 7152269 - DNA, 22 bp, Homo sapiens
ggccagctcagggtccttgggc

SEQ ID NO: 7152270 - DNA, 22 bp, Homo sapiens
ggccagctcagactccacttgc

SEQ ID NO: 7152271 - DNA, 22 bp, Homo sapiens
ggccagctcagtctccatcagg

SEQ ID NO: 7152272 - DNA, 22 bp, Homo sapiens
ggagtgagcaaatagagatttg

SEQ ID NO: 7152273 - DNA, 22 bp, Homo sapiens
ggagtgagcaaatagagatttg

SEQ ID NO: 7152274 - DNA, 22 bp, Homo sapiens
ggagtgagagagtttaaggtca

SEQ ID NO: 7152275 - DNA, 22 bp, Homo sapiens
ggagtgagcaaatagagatttg

SEQ ID NO: 7152276 - DNA, 22 bp, Homo sapiens
ggagtgactctcggggccacta

SEQ ID NO: 7152277 - DNA, 22 bp, Homo sapiens
ggagtgactctcggggccacta

SEQ ID NO: 7152278 - DNA, 22 bp, Homo sapiens
ggataaagtctttaggtggaca

SEQ ID NO: 7152279 - DNA, 21 bp, Homo sapiens
ggagtttttctggaagggact

SEQ ID NO: 7152280 - DNA, 22 bp, Homo sapiens
ggagtttgcctattgcttttgg

SEQ ID NO: 7152281 - DNA, 21 bp, Homo sapiens
ggagtttttctggaagggact

SEQ ID NO: 7152282 - DNA, 21 bp, Homo sapiens
ggagtttttctggaagggact

SEQ ID NO: 7152283 - DNA, 21 bp, Homo sapiens
ggagtttttctggaagggact

SEQ ID NO: 7152284 - DNA, 22 bp, Homo sapiens
ggagtgactcacagctgggaca

SEQ ID NO: 7152285 - DNA, 22 bp, Homo sapiens
ggagtgactcacagctgggaca

SEQ ID NO: 7152286 - DNA, 22 bp, Homo sapiens
ggagtgactcacagctgggaca

SEQ ID NO: 7152287 - DNA, 22 bp, Homo sapiens
ggagtgactcacagctgggaca

SEQ ID NO: 7152288 - DNA, 22 bp, Homo sapiens
ggagtgactcacagctgggaca

SEQ ID NO: 7152289 - DNA, 22 bp, Homo sapiens
ggagtgactcacagctgggaca

SEQ ID NO: 7152290 - DNA, 22 bp, Homo sapiens
ggagtgaagtggcgcgatctcg

SEQ ID NO: 7152291 - DNA, 22 bp, Homo sapiens
ggagtgaaaggtaagttgagct

SEQ ID NO: 7152292 - DNA, 22 bp, Homo sapiens
ggagtgaagcaaataatgctgg

SEQ ID NO: 7152293 - DNA, 22 bp, Homo sapiens
ggagtgaataagtagggggaaa

SEQ ID NO: 7152294 - DNA, 22 bp, Homo sapiens
ggagtctggagtggggcccaag

SEQ ID NO: 7152295 - DNA, 22 bp, Homo sapiens
ggagtctgtcacctgtttctct

SEQ ID NO: 7152296 - DNA, 21 bp, Homo sapiens
ggagtctgtggatgctgtttc

SEQ ID NO: 7152297 - DNA, 22 bp, Homo sapiens
ggagtctgtgtcttgaagcagt

SEQ ID NO: 7152298 - DNA, 22 bp, Homo sapiens
ggagtctgttttacatgcagga

SEQ ID NO: 7152299 - DNA, 22 bp, Homo sapiens
ggagtctgttttacatgcagga

SEQ ID NO: 7152300 - DNA, 22 bp, Homo sapiens
ggagtgaaaggtaagttgagct

SEQ ID NO: 7152301 - DNA, 22 bp, Homo sapiens
ggatagccgggtgttgtgggct

SEQ ID NO: 7152302 - DNA, 22 bp, Homo sapiens
ggatacaactagaagatggcag

SEQ ID NO: 7152303 - DNA, 22 bp, Homo sapiens
ggataagaaaattgtaataact

SEQ ID NO: 7152304 - DNA, 22 bp, Homo sapiens
ggataaagtctttaggtggaca

SEQ ID NO: 7152305 - DNA, 18 bp, Homo sapiens
ggataggaccttaggcag

SEQ ID NO: 7152306 - DNA, 22 bp, Homo sapiens
ggataggaattgagatgctatt

SEQ ID NO: 7152307 - DNA, 22 bp, Homo sapiens
ggataggaattgagatgctatt

SEQ ID NO: 7152308 - DNA, 22 bp, Homo sapiens
ggatatctgccccatgagtcac

SEQ ID NO: 7152309 - DNA, 22 bp, Homo sapiens
ggatatgacgagtttggtgatt

SEQ ID NO: 7152310 - DNA, 22 bp, Homo sapiens
ggatattaatctgtgtcatttc

SEQ ID NO: 7152311 - DNA, 22 bp, Homo sapiens
ggatattctttatagatacagt

SEQ ID NO: 7152312 - DNA, 22 bp, Homo sapiens
ggatcagaacgtgatggctgtg

SEQ ID NO: 7152313 - DNA, 22 bp, Homo sapiens
ggatcagaacgtgatggctgtg

SEQ ID NO: 7152314 - DNA, 22 bp, Homo sapiens
ggatcagaatctctgagagttt

SEQ ID NO: 7152315 - DNA, 22 bp, Homo sapiens
ggatcagaatctttgggtgtaa

SEQ ID NO: 7152316 - DNA, 22 bp, Homo sapiens
ggatcagaggatcagggacagt

SEQ ID NO: 7152317 - DNA, 22 bp, Homo sapiens
ggatcagaggatcagggacagt

SEQ ID NO: 7152318 - DNA, 22 bp, Homo sapiens
ggatcagaggatcagggacagt

SEQ ID NO: 7152319 - DNA, 20 bp, Homo sapiens
ggatcagatggagcctctgc

SEQ ID NO: 7152320 - DNA, 20 bp, Homo sapiens
ggatcagatggagcctctgc

SEQ ID NO: 7152321 - DNA, 22 bp, Homo sapiens
ggatcaggcgccatgggaagtg

SEQ ID NO: 7152322 - DNA, 22 bp, Homo sapiens
ggatcaggcgccatgggaagtg

SEQ ID NO: 7152323 - DNA, 22 bp, Homo sapiens
ggatcaggctgaagctaggact

SEQ ID NO: 7152324 - DNA, 22 bp, Homo sapiens
ggatcaggctgaagctaggact

SEQ ID NO: 7152325 - DNA, 22 bp, Homo sapiens
ggatcattaacacatccatcac

SEQ ID NO: 7152326 - DNA, 19 bp, Homo sapiens
ggatccagaggatctgcca

SEQ ID NO: 7152327 - DNA, 22 bp, Homo sapiens
ggatcattaagaatagctacta

SEQ ID NO: 7152328 - DNA, 22 bp, Homo sapiens
ggcaggaataaattatggactt

SEQ ID NO: 7152329 - DNA, 22 bp, Homo sapiens
ggcaggaagtagcagtctgagc

SEQ ID NO: 7152330 - DNA, 22 bp, Homo sapiens
ggcaggaagtagcagtctgagc

SEQ ID NO: 7152331 - DNA, 22 bp, Homo sapiens
ggcaggaagtagcagtctgagc

SEQ ID NO: 7152332 - DNA, 22 bp, Homo sapiens
ggcaggaagctcatgtggactg

SEQ ID NO: 7152333 - DNA, 22 bp, Homo sapiens
ggcaggaagctcatgtggactg

SEQ ID NO: 7152334 - DNA, 22 bp, Homo sapiens
ggcaggaagcattaaaacgatt

SEQ ID NO: 7152335 - DNA, 22 bp, Homo sapiens
ggcaggaagaggagggtgaact

SEQ ID NO: 7152336 - DNA, 22 bp, Homo sapiens
ggcaggaagaggagggtgaact

SEQ ID NO: 7152337 - DNA, 22 bp, Homo sapiens
ggcaggaaaacaatgagccagg

SEQ ID NO: 7152338 - DNA, 22 bp, Homo sapiens
ggcaggaaaacaatgagccagg

SEQ ID NO: 7152339 - DNA, 22 bp, Homo sapiens
ggcaggaaaacaatgagccagg

SEQ ID NO: 7152340 - DNA, 22 bp, Homo sapiens
ggatccagaggtgaagatggga

SEQ ID NO: 7152341 - DNA, 22 bp, Homo sapiens
ggcagctgcaaatctgctctgt

SEQ ID NO: 7152342 - DNA, 22 bp, Homo sapiens
cacatgcattggcaaaagtgta

SEQ ID NO: 7152343 - DNA, 22 bp, Homo sapiens
cacatgcccagaacttctcatt

SEQ ID NO: 7152344 - DNA, 22 bp, Homo sapiens
cacatgcatgccaggctcacag

SEQ ID NO: 7152345 - DNA, 22 bp, Homo sapiens
cacatgcattggcaaaagtgta

SEQ ID NO: 7152346 - DNA, 22 bp, Homo sapiens
cacatgcattggcaaaagtgta

SEQ ID NO: 7152347 - DNA, 22 bp, Homo sapiens
cacatgcatctgtcatgtttgg

SEQ ID NO: 7152348 - DNA, 21 bp, Homo sapiens
cacatgcatgcacaggttgta

SEQ ID NO: 7152349 - DNA, 22 bp, Homo sapiens
cacatgcatctgtcatgtttgg

SEQ ID NO: 7152350 - DNA, 22 bp, Homo sapiens
cacatgcatctgtcatgtttgg

SEQ ID NO: 7152351 - DNA, 22 bp, Homo sapiens
cacatgcatacctatgtgtata

SEQ ID NO: 7152352 - DNA, 22 bp, Homo sapiens
cacatgcatacctatgtgtata

SEQ ID NO: 7152353 - DNA, 22 bp, Homo sapiens
cacatgcatacctatgtgtata

SEQ ID NO: 7152354 - DNA, 22 bp, Homo sapiens
cacatgcatacctatgtgtata

SEQ ID NO: 7152355 - DNA, 22 bp, Homo sapiens
cacatgcatacctatgtgtata

SEQ ID NO: 7152356 - DNA, 22 bp, Homo sapiens
cacatgcatcacgacttccttt

SEQ ID NO: 7152357 - DNA, 22 bp, Homo sapiens
cacatgcatcacgacttccttt

SEQ ID NO: 7152358 - DNA, 22 bp, Homo sapiens
cacatgcagtttacgtcactga

SEQ ID NO: 7152359 - DNA, 22 bp, Homo sapiens
cacatgcagttttccagcagtc

SEQ ID NO: 7152360 - DNA, 22 bp, Homo sapiens
cacatgcataaggataattact

SEQ ID NO: 7152361 - DNA, 22 bp, Homo sapiens
cacatgcataaggataattact

SEQ ID NO: 7152362 - DNA, 22 bp, Homo sapiens
cacatgcataaggataattact

SEQ ID NO: 7152363 - DNA, 22 bp, Homo sapiens
ggcaggactgatcagtgggatg

SEQ ID NO: 7152364 - DNA, 22 bp, Homo sapiens
ggcaggagaaaggtctcttctt

SEQ ID NO: 7152365 - DNA, 22 bp, Homo sapiens
ggcaggagaaaggtctcttctt

SEQ ID NO: 7152366 - DNA, 22 bp, Homo sapiens
ggcaggactcttctgtgggccg

SEQ ID NO: 7152367 - DNA, 22 bp, Homo sapiens
ggcaggagaaaggtctcttctt

SEQ ID NO: 7152368 - DNA, 23 bp, Homo sapiens
cacatgcaggcagtggccttcaa

SEQ ID NO: 7152369 - DNA, 22 bp, Homo sapiens
cacatgcagtttacgtcactga

SEQ ID NO: 7152370 - DNA, 22 bp, Homo sapiens
cacatgcagtttacgtcactga

SEQ ID NO: 7152371 - DNA, 22 bp, Homo sapiens
cacatgcagtttacgtcactga

SEQ ID NO: 7152372 - DNA, 22 bp, Homo sapiens
ggcaggactctcaggaccaagc

SEQ ID NO: 7152373 - DNA, 22 bp, Homo sapiens
ggcaggactcttctgtgggccg

SEQ ID NO: 7152374 - DNA, 20 bp, Homo sapiens
ggcaggaccccagtggcatc

SEQ ID NO: 7152375 - DNA, 20 bp, Homo sapiens
ggcaggaccccagtggcatc

SEQ ID NO: 7152376 - DNA, 22 bp, Homo sapiens
ggcaggacagtcccagttcaaa

SEQ ID NO: 7152377 - DNA, 22 bp, Homo sapiens
ggcaggtgtggtgaccagagat

SEQ ID NO: 7152378 - DNA, 19 bp, Homo sapiens
ggcaggtgtgcttatgctt

SEQ ID NO: 7152379 - DNA, 22 bp, Homo sapiens
ggcaggtgtggagtgttatttt

SEQ ID NO: 7152380 - DNA, 22 bp, Homo sapiens
ggcaggtgtgagctgtaaagga

SEQ ID NO: 7152381 - DNA, 19 bp, Homo sapiens
ggcaggtgtgcttatgctt

SEQ ID NO: 7152382 - DNA, 22 bp, Homo sapiens
ggcaggtgtgagatcgaggcca

SEQ ID NO: 7152383 - DNA, 22 bp, Homo sapiens
ggcaggtgtgagatcgaggcca

SEQ ID NO: 7152384 - DNA, 22 bp, Homo sapiens
cacatgcccagaacttctcatt

SEQ ID NO: 7152385 - DNA, 22 bp, Homo sapiens
cacatgccttcctcaggcctct

SEQ ID NO: 7152386 - DNA, 22 bp, Homo sapiens
cacatgctagaataaatctcca

SEQ ID NO: 7152387 - DNA, 22 bp, Homo sapiens
cacatgctagaataaatctcca

SEQ ID NO: 7152388 - DNA, 22 bp, Homo sapiens
cacatgctcattggcactgttc

SEQ ID NO: 7152389 - DNA, 22 bp, Homo sapiens
cacatgctcattggcactgttc

SEQ ID NO: 7152390 - DNA, 22 bp, Homo sapiens
cacatgctcattggcactgttc

SEQ ID NO: 7152391 - DNA, 22 bp, Homo sapiens
cacatgctcattggcactgttc

SEQ ID NO: 7152392 - DNA, 22 bp, Homo sapiens
cacatgctccatacagaatggg

SEQ ID NO: 7152393 - DNA, 22 bp, Homo sapiens
cacatgctccatacagaatggg

SEQ ID NO: 7152394 - DNA, 22 bp, Homo sapiens
cacatgctccatacagaatggg

SEQ ID NO: 7152395 - DNA, 22 bp, Homo sapiens
ggcaggtgcgcatgttgcatta

SEQ ID NO: 7152396 - DNA, 22 bp, Homo sapiens
ggcaggtgcgcatgttgcatta

SEQ ID NO: 7152397 - DNA, 22 bp, Homo sapiens
ggcagtcaagagggagtctgaa

SEQ ID NO: 7152398 - DNA, 22 bp, Homo sapiens
ggcaggtgtggtgaccagagat

SEQ ID NO: 7152399 - DNA, 22 bp, Homo sapiens
ggcaggtgtttttatattaaag

SEQ ID NO: 7152400 - DNA, 22 bp, Homo sapiens
ggcagtcacttttgcttgtgcc

SEQ ID NO: 7152401 - DNA, 19 bp, Homo sapiens
ggcagtcacggtcaggagc

SEQ ID NO: 7152402 - DNA, 22 bp, Homo sapiens
ggcagtcacaggggagactggg

SEQ ID NO: 7152403 - DNA, 22 bp, Homo sapiens
ggcttgaagggaggaaagcagg

SEQ ID NO: 7152404 - DNA, 22 bp, Homo sapiens
ggcttgagacccgggagccaga

SEQ ID NO: 7152405 - DNA, 23 bp, Homo sapiens
ggcttgagctggaacagcttggt

SEQ ID NO: 7152406 - DNA, 22 bp, Homo sapiens
ggcttgctctctaaaagggctg

SEQ ID NO: 7152407 - DNA, 22 bp, Homo sapiens
ggcttggaaattgcaggacaca

SEQ ID NO: 7152408 - DNA, 22 bp, Homo sapiens
ggcttggaccagtcacagtggt

SEQ ID NO: 7152409 - DNA, 22 bp, Homo sapiens
ggcttggaaattgcaggacaca

SEQ ID NO: 7152410 - DNA, 22 bp, Homo sapiens
ggcttggaattggtaggatgta

SEQ ID NO: 7152411 - DNA, 22 bp, Homo sapiens
ggcttggaccagtcacagtggt

SEQ ID NO: 7152412 - DNA, 22 bp, Homo sapiens
cagaacagacttaacagggctg

SEQ ID NO: 7152413 - DNA, 22 bp, Homo sapiens
cagaacagacttaacagggctg

SEQ ID NO: 7152414 - DNA, 22 bp, Homo sapiens
cagaacagacttaacagggctg

SEQ ID NO: 7152415 - DNA, 22 bp, Homo sapiens
cagaacagacttaacagggctg

SEQ ID NO: 7152416 - DNA, 22 bp, Homo sapiens
cagaacagacttaacagggctg

SEQ ID NO: 7152417 - DNA, 22 bp, Homo sapiens
cagaacagacttaacagggctg

SEQ ID NO: 7152418 - DNA, 22 bp, Homo sapiens
ggcttctttttagtaaatgtca

SEQ ID NO: 7152419 - DNA, 22 bp, Homo sapiens
ggcttgaaagaataggaatgca

SEQ ID NO: 7152420 - DNA, 22 bp, Homo sapiens
ggcttctttgtaacgtgccagc

SEQ ID NO: 7152421 - DNA, 22 bp, Homo sapiens
ggcttcttctctgtgtccagca

SEQ ID NO: 7152422 - DNA, 22 bp, Homo sapiens
ggcttcttgtgtgtcaggctct

SEQ ID NO: 7152423 - DNA, 22 bp, Homo sapiens
ggcttcttgtgtgtcaggctct

SEQ ID NO: 7152424 - DNA, 20 bp, Homo sapiens
ggcttctttacatctgtgtt

SEQ ID NO: 7152425 - DNA, 20 bp, Homo sapiens
ggcttctttacatctgtgtt

SEQ ID NO: 7152426 - DNA, 20 bp, Homo sapiens
ggcttctttacatctgtgtt

SEQ ID NO: 7152427 - DNA, 22 bp, Homo sapiens
ggctgggagctggacaggccgg

SEQ ID NO: 7152428 - DNA, 22 bp, Homo sapiens
ggctgggagctggacaggccgg

SEQ ID NO: 7152429 - DNA, 22 bp, Homo sapiens
ggctgggagctggacaggccgg

SEQ ID NO: 7152430 - DNA, 19 bp, Homo sapiens
ggcttcagggagttagcat

SEQ ID NO: 7152431 - DNA, 22 bp, Homo sapiens
ggcttcaggggcccagtcagca

SEQ ID NO: 7152432 - DNA, 22 bp, Homo sapiens
ggcttcttcctggctcctatta

SEQ ID NO: 7152433 - DNA, 22 bp, Homo sapiens
ggcttcttcctggctcctatta

SEQ ID NO: 7152434 - DNA, 22 bp, Homo sapiens
cagaagagtagctgaacaagtt

SEQ ID NO: 7152435 - DNA, 22 bp, Homo sapiens
cagaagaggactgggtagctca

SEQ ID NO: 7152436 - DNA, 22 bp, Homo sapiens
cagaagagtagctgaacaagtt

SEQ ID NO: 7152437 - DNA, 22 bp, Homo sapiens
cagaagagtagctgaacaagtt

SEQ ID NO: 7152438 - DNA, 22 bp, Homo sapiens
cagaagaggactgggtagctca

SEQ ID NO: 7152439 - DNA, 22 bp, Homo sapiens
cagaagaggactgggtagctca

SEQ ID NO: 7152440 - DNA, 22 bp, Homo sapiens
cagaacattgttttctcatctg

SEQ ID NO: 7152441 - DNA, 22 bp, Homo sapiens
cagaagaggactgggtagctca

SEQ ID NO: 7152442 - DNA, 22 bp, Homo sapiens
cagaacattccatgtgccctgc

SEQ ID NO: 7152443 - DNA, 22 bp, Homo sapiens
cagaacagtcgcctgcatggat

SEQ ID NO: 7152444 - DNA, 20 bp, Homo sapiens
cagaacagtctgagaggcca

SEQ ID NO: 7152445 - DNA, 20 bp, Homo sapiens
cagaacagtctgagaggcca

SEQ ID NO: 7152446 - DNA, 20 bp, Homo sapiens
cagaacagtctgagaggcca

SEQ ID NO: 7152447 - DNA, 20 bp, Homo sapiens
cagaacagtctgagaggcca

SEQ ID NO: 7152448 - DNA, 20 bp, Homo sapiens
cagaacagtctgagaggcca

SEQ ID NO: 7152449 - DNA, 20 bp, Homo sapiens
cagaacagtctgagaggcca

SEQ ID NO: 7152450 - DNA, 20 bp, Homo sapiens
cagaacagtctgagaggcca

SEQ ID NO: 7152451 - DNA, 20 bp, Homo sapiens
cagaacagtctgagaggcca

SEQ ID NO: 7152452 - DNA, 22 bp, Homo sapiens
cagaacatccccactgctacct

SEQ ID NO: 7152453 - DNA, 20 bp, Homo sapiens
cagaacatgagcatcgagcc

SEQ ID NO: 7152454 - DNA, 20 bp, Homo sapiens
cagaacatgagcatcgagcc

SEQ ID NO: 7152455 - DNA, 22 bp, Homo sapiens
cagaacatgatataaacagaag

SEQ ID NO: 7152456 - DNA, 22 bp, Homo sapiens
cagaacattcactcatatgtgg

SEQ ID NO: 7152457 - DNA, 22 bp, Homo sapiens
cagaacattcactcatatgtgg

SEQ ID NO: 7152458 - DNA, 22 bp, Homo sapiens
cagaacattcactcatatgtgg

SEQ ID NO: 7152459 - DNA, 22 bp, Homo sapiens
cagaacagagcctgaatctctc

SEQ ID NO: 7152460 - DNA, 19 bp, Homo sapiens
cagaacagaggtcatggcc

SEQ ID NO: 7152461 - DNA, 19 bp, Homo sapiens
cagaacagaggtcatggcc

SEQ ID NO: 7152462 - DNA, 19 bp, Homo sapiens
cagaacagaggtcatggcc

SEQ ID NO: 7152463 - DNA, 19 bp, Homo sapiens
cagaacagaggtcatggcc

SEQ ID NO: 7152464 - DNA, 22 bp, Homo sapiens
cagaacagagtcaaaagtatgt

SEQ ID NO: 7152465 - DNA, 19 bp, Homo sapiens
cagaacagctgggaagaga

SEQ ID NO: 7152466 - DNA, 19 bp, Homo sapiens
cagaacagctgggaagaga

SEQ ID NO: 7152467 - DNA, 19 bp, Homo sapiens
cagaacagctgggaagaga

SEQ ID NO: 7152468 - DNA, 19 bp, Homo sapiens
cagaacagctgggaagaga

SEQ ID NO: 7152469 - DNA, 19 bp, Homo sapiens
cagaacaggaccaggggcc

SEQ ID NO: 7152470 - DNA, 19 bp, Homo sapiens
cagaacaggaccaggggcc

SEQ ID NO: 7152471 - DNA, 19 bp, Homo sapiens
cagaacaggaccaggggcc

SEQ ID NO: 7152472 - DNA, 19 bp, Homo sapiens
cagaacaggaccaggggcc

SEQ ID NO: 7152473 - DNA, 22 bp, Homo sapiens
cagaacagggcccaaggggtcg

SEQ ID NO: 7152474 - DNA, 22 bp, Homo sapiens
cagaacagggcccaaggggtcg

SEQ ID NO: 7152475 - DNA, 22 bp, Homo sapiens
cagaacaggtcatgcttgctgt

SEQ ID NO: 7152476 - DNA, 22 bp, Homo sapiens
cagaacaggtcatgcttgctgt

SEQ ID NO: 7152477 - DNA, 22 bp, Homo sapiens
cagaacaggtcatgcttgctgt

SEQ ID NO: 7152478 - DNA, 22 bp, Homo sapiens
cagaacaggtcatgcttgctgt

SEQ ID NO: 7152479 - DNA, 22 bp, Homo sapiens
cagaacaggtcatgcttgctgt

SEQ ID NO: 7152480 - DNA, 23 bp, Homo sapiens
cagaacagtaaaagatgccatgg

SEQ ID NO: 7152481 - DNA, 22 bp, Homo sapiens
cagaacagtacctagcacatag

SEQ ID NO: 7152482 - DNA, 22 bp, Homo sapiens
cagaacagtacctagcacatag

SEQ ID NO: 7152483 - DNA, 22 bp, Homo sapiens
cagaacagtacctagcacatag

SEQ ID NO: 7152484 - DNA, 22 bp, Homo sapiens
cagaacagtacctagcacatag

SEQ ID NO: 7152485 - DNA, 22 bp, Homo sapiens
cagaacagtcgcctgcatggat

SEQ ID NO: 7152486 - DNA, 22 bp, Homo sapiens
cagaacagtcgcctgcatggat

SEQ ID NO: 7152487 - DNA, 22 bp, Homo sapiens
cagaaatggtctgttcagctta

SEQ ID NO: 7152488 - DNA, 22 bp, Homo sapiens
cagaaatggtctgttcagctta

SEQ ID NO: 7152489 - DNA, 22 bp, Homo sapiens
cagaaatgtactgacatgcagt

SEQ ID NO: 7152490 - DNA, 22 bp, Homo sapiens
cagaaatggagcccaggaatct

SEQ ID NO: 7152491 - DNA, 22 bp, Homo sapiens
cagaaatggagcccaggaatct

SEQ ID NO: 7152492 - DNA, 22 bp, Homo sapiens
cagaaatggaattttccatcac

SEQ ID NO: 7152493 - DNA, 22 bp, Homo sapiens
cagaaatggaattttccatcac

SEQ ID NO: 7152494 - DNA, 22 bp, Homo sapiens
cagaaatgcctgcttctctctc

SEQ ID NO: 7152495 - DNA, 19 bp, Homo sapiens
cagaaatagcgaagtgtaa

SEQ ID NO: 7152496 - DNA, 19 bp, Homo sapiens
cagaaatagcgaagtgtaa

SEQ ID NO: 7152497 - DNA, 19 bp, Homo sapiens
cagaaatagcgaagtgtaa

SEQ ID NO: 7152498 - DNA, 22 bp, Homo sapiens
cagaaatgcctgcttctctctc

SEQ ID NO: 7152499 - DNA, 22 bp, Homo sapiens
cagaaatggaagttctggttta

SEQ ID NO: 7152500 - DNA, 21 bp, Homo sapiens
ggctgctgtcaccgctgtcac

SEQ ID NO: 7152501 - DNA, 21 bp, Homo sapiens
ggctgctgtcaccgctgtcac

SEQ ID NO: 7152502 - DNA, 22 bp, Homo sapiens
ggctgctgtgacctcaggtgat

SEQ ID NO: 7152503 - DNA, 22 bp, Homo sapiens
ggctgctgtgacctcaggtgat

SEQ ID NO: 7152504 - DNA, 22 bp, Homo sapiens
ggctgctgtgacctcaggtgat

SEQ ID NO: 7152505 - DNA, 17 bp, Homo sapiens
ggctgctgtgctggtgc

SEQ ID NO: 7152506 - DNA, 17 bp, Homo sapiens
ggctgctgtgctggtgc

SEQ ID NO: 7152507 - DNA, 22 bp, Homo sapiens
cagaaatagacaatggcagtgg

SEQ ID NO: 7152508 - DNA, 22 bp, Homo sapiens
cagaaatagacaatggcagtgg

SEQ ID NO: 7152509 - DNA, 20 bp, Homo sapiens
ggctgctggtttggctctgt

SEQ ID NO: 7152510 - DNA, 22 bp, Homo sapiens
ggctgctgtactgatgtcagtt

SEQ ID NO: 7152511 - DNA, 22 bp, Homo sapiens
ggctgctgtactgatgtcagtt

SEQ ID NO: 7152512 - DNA, 20 bp, Homo sapiens
ggctgctggtttggctctgt

SEQ ID NO: 7152513 - DNA, 20 bp, Homo sapiens
ggctgctggtttggctctgt

SEQ ID NO: 7152514 - DNA, 20 bp, Homo sapiens
ggctgctggtttggctctgt

SEQ ID NO: 7152515 - DNA, 20 bp, Homo sapiens
ggctgctggtttggctctgt

SEQ ID NO: 7152516 - DNA, 22 bp, Homo sapiens
ggctgctgtactgatgtcagtt

SEQ ID NO: 7152517 - DNA, 22 bp, Homo sapiens
ggctgctgtactgatgtcagtt

SEQ ID NO: 7152518 - DNA, 22 bp, Homo sapiens
ggctgctggtggaatggtaggc

SEQ ID NO: 7152519 - DNA, 19 bp, Homo sapiens
ggctgctggttacagaggc

SEQ ID NO: 7152520 - DNA, 19 bp, Homo sapiens
ggctgctggttacagaggc

SEQ ID NO: 7152521 - DNA, 22 bp, Homo sapiens
ggctgctggtggaatggtaggc

SEQ ID NO: 7152522 - DNA, 22 bp, Homo sapiens
ggctgctggtaggggtaggaag

SEQ ID NO: 7152523 - DNA, 22 bp, Homo sapiens
ggctgctggtaggggtaggaag

SEQ ID NO: 7152524 - DNA, 22 bp, Homo sapiens
ggctgctggtaggggtaggaag

SEQ ID NO: 7152525 - DNA, 22 bp, Homo sapiens
ggctgctggtaggggtaggaag

SEQ ID NO: 7152526 - DNA, 22 bp, Homo sapiens
ggctgggacgatgaggattagt

SEQ ID NO: 7152527 - DNA, 22 bp, Homo sapiens
cagaacagacttaacagggctg

SEQ ID NO: 7152528 - DNA, 22 bp, Homo sapiens
cagaacagacttaacagggctg

SEQ ID NO: 7152529 - DNA, 22 bp, Homo sapiens
cagaacagaatcgtgtggtgag

SEQ ID NO: 7152530 - DNA, 22 bp, Homo sapiens
ggctggctttctctccgcacct

SEQ ID NO: 7152531 - DNA, 22 bp, Homo sapiens
ggctggctttctctccgcacct

SEQ ID NO: 7152532 - DNA, 22 bp, Homo sapiens
ggctgggagccccacagagtca

SEQ ID NO: 7152533 - DNA, 22 bp, Homo sapiens
ggctgggagccccacagagtca

SEQ ID NO: 7152534 - DNA, 22 bp, Homo sapiens
ggctgggacgatgaggattagt

SEQ ID NO: 7152535 - DNA, 22 bp, Homo sapiens
ggctgggacgatgaggattagt

SEQ ID NO: 7152536 - DNA, 23 bp, Homo sapiens
ggctgggagctccgggtgcacgt

SEQ ID NO: 7152537 - DNA, 23 bp, Homo sapiens
ggctgggagctccgggtgcacgt

SEQ ID NO: 7152538 - DNA, 22 bp, Homo sapiens
ggctgggagccccacagagtca

SEQ ID NO: 7152539 - DNA, 22 bp, Homo sapiens
ggctgggagccccacagagtca

SEQ ID NO: 7152540 - DNA, 23 bp, Homo sapiens
ggctgggagctccgggtgcacgt

SEQ ID NO: 7152541 - DNA, 23 bp, Homo sapiens
ggctgggagctccgggtgcacgt

SEQ ID NO: 7152542 - DNA, 23 bp, Homo sapiens
ggctgggagctccgggtgcacgt

SEQ ID NO: 7152543 - DNA, 22 bp, Homo sapiens
ggctgggagctggacaggccgg

SEQ ID NO: 7152544 - DNA, 23 bp, Homo sapiens
ggctgggagctccgggtgcacgt

SEQ ID NO: 7152545 - DNA, 23 bp, Homo sapiens
ggctgggagctccgggtgcacgt

SEQ ID NO: 7152546 - DNA, 22 bp, Homo sapiens
cagaaatgtactgacatgcagt

SEQ ID NO: 7152547 - DNA, 22 bp, Homo sapiens
cagaaatgtgatgtacacacac

SEQ ID NO: 7152548 - DNA, 22 bp, Homo sapiens
cagaaatgtgatgtacacacac

SEQ ID NO: 7152549 - DNA, 22 bp, Homo sapiens
cagaaatgttctaatgattcag

SEQ ID NO: 7152550 - DNA, 22 bp, Homo sapiens
cagaaatgttctaatgattcag

SEQ ID NO: 7152551 - DNA, 22 bp, Homo sapiens
cagaaatgttctaatgattcag

SEQ ID NO: 7152552 - DNA, 22 bp, Homo sapiens
cagaaatgtttatatgtggtgt

SEQ ID NO: 7152553 - DNA, 22 bp, Homo sapiens
cagaaatgtttatatgtggtgt

SEQ ID NO: 7152554 - DNA, 22 bp, Homo sapiens
cagaaatgtttatgcttttgaa

SEQ ID NO: 7152555 - DNA, 22 bp, Homo sapiens
cagaaatgtttgttaatattgt

SEQ ID NO: 7152556 - DNA, 22 bp, Homo sapiens
cagaaatgtttgttaatattgt

SEQ ID NO: 7152557 - DNA, 22 bp, Homo sapiens
cagaaatgtttgttaatattgt

SEQ ID NO: 7152558 - DNA, 22 bp, Homo sapiens
cagaaatgtttgttaatattgt

SEQ ID NO: 7152559 - DNA, 22 bp, Homo sapiens
cagaaattggaatagagaaata

SEQ ID NO: 7152560 - DNA, 20 bp, Homo sapiens
cagaaatttgtaaaagggat

SEQ ID NO: 7152561 - DNA, 20 bp, Homo sapiens
cagaaatttgtaaaagggat

SEQ ID NO: 7152562 - DNA, 20 bp, Homo sapiens
cagaaatttgtaaaagggat

SEQ ID NO: 7152563 - DNA, 22 bp, Homo sapiens
cagaacacaggctaaactgaga

SEQ ID NO: 7152564 - DNA, 22 bp, Homo sapiens
cagaacacattttcagagtcaa

SEQ ID NO: 7152565 - DNA, 22 bp, Homo sapiens
cagaacacattttcagagtcaa

SEQ ID NO: 7152566 - DNA, 22 bp, Homo sapiens
cagaacagaaacgttgttccat

SEQ ID NO: 7152567 - DNA, 22 bp, Homo sapiens
cagaacagaagtaaaatttacc

SEQ ID NO: 7152568 - DNA, 22 bp, Homo sapiens
cagaacagaatcgtgtggtgag

SEQ ID NO: 7152569 - DNA, 22 bp, Homo sapiens
ggctgcagcggattggggattg

SEQ ID NO: 7152570 - DNA, 22 bp, Homo sapiens
cactgtctattaatataactta

SEQ ID NO: 7152571 - DNA, 22 bp, Homo sapiens
cactgtctattaatataactta

SEQ ID NO: 7152572 - DNA, 22 bp, Homo sapiens
cactgtctattaatataactta

SEQ ID NO: 7152573 - DNA, 22 bp, Homo sapiens
cactgtctattaatataactta

SEQ ID NO: 7152574 - DNA, 22 bp, Homo sapiens
ggctgcagcagagggactcacg

SEQ ID NO: 7152575 - DNA, 22 bp, Homo sapiens
ggctgcagccctcgcctagcca

SEQ ID NO: 7152576 - DNA, 22 bp, Homo sapiens
ggctgcagccctcgcctagcca

SEQ ID NO: 7152577 - DNA, 22 bp, Homo sapiens
ggctgcagccctcgcctagcca

SEQ ID NO: 7152578 - DNA, 22 bp, Homo sapiens
ggctgcagccctcgcctagcca

SEQ ID NO: 7152579 - DNA, 22 bp, Homo sapiens
ggctgcagcagagggactcacg

SEQ ID NO: 7152580 - DNA, 22 bp, Homo sapiens
ggctgaggctcatgccatcttg

SEQ ID NO: 7152581 - DNA, 22 bp, Homo sapiens
ggctgaggctcatgccatcttg

SEQ ID NO: 7152582 - DNA, 22 bp, Homo sapiens
ggctgaggctcatgccatcttg

SEQ ID NO: 7152583 - DNA, 22 bp, Homo sapiens
ggctgcagatagccagccacca

SEQ ID NO: 7152584 - DNA, 22 bp, Homo sapiens
ggctgcagatagccagccacca

SEQ ID NO: 7152585 - DNA, 22 bp, Homo sapiens
ggctgcagaggcgatctgaggt

SEQ ID NO: 7152586 - DNA, 22 bp, Homo sapiens
ggctgcagatagccagccacca

SEQ ID NO: 7152587 - DNA, 22 bp, Homo sapiens
ggctgcagatagccagccacca

SEQ ID NO: 7152588 - DNA, 22 bp, Homo sapiens
ggctgcagattgtagtctgtta

SEQ ID NO: 7152589 - DNA, 22 bp, Homo sapiens
ggctgcagattgtagtctgtta

SEQ ID NO: 7152590 - DNA, 22 bp, Homo sapiens
ggctgcagattgtagtctgtta

SEQ ID NO: 7152591 - DNA, 22 bp, Homo sapiens
cactgtcttttgtgaagacaat

SEQ ID NO: 7152592 - DNA, 22 bp, Homo sapiens
ggctgcctcaaagctcaagctc

SEQ ID NO: 7152593 - DNA, 22 bp, Homo sapiens
ggctgcctcaattaatcttaca

SEQ ID NO: 7152594 - DNA, 22 bp, Homo sapiens
ggctgcctcagatttgctgact

SEQ ID NO: 7152595 - DNA, 22 bp, Homo sapiens
cactgtcttttgtgaagacaat

SEQ ID NO: 7152596 - DNA, 22 bp, Homo sapiens
cactgtcttgattactatgggt

SEQ ID NO: 7152597 - DNA, 22 bp, Homo sapiens
cactgtcttgattactatgggt

SEQ ID NO: 7152598 - DNA, 22 bp, Homo sapiens
cactgtcttcagtttcactgca

SEQ ID NO: 7152599 - DNA, 22 bp, Homo sapiens
cactgtctgtgtgtccttgggg

SEQ ID NO: 7152600 - DNA, 22 bp, Homo sapiens
cactgtctgtgtgtccttgggg

SEQ ID NO: 7152601 - DNA, 22 bp, Homo sapiens
cactgtctgtgtgtccttgggg

SEQ ID NO: 7152602 - DNA, 22 bp, Homo sapiens
cactgtcttcagtttcactgca

SEQ ID NO: 7152603 - DNA, 22 bp, Homo sapiens
cactgtcttcagtttcactgca

SEQ ID NO: 7152604 - DNA, 22 bp, Homo sapiens
cactgtcttcagtttcactgca

SEQ ID NO: 7152605 - DNA, 22 bp, Homo sapiens
cactgtctgagctggtgattag

SEQ ID NO: 7152606 - DNA, 22 bp, Homo sapiens
cactgtctgagctggtgattag

SEQ ID NO: 7152607 - DNA, 22 bp, Homo sapiens
cactgtctcctagggggacttc

SEQ ID NO: 7152608 - DNA, 22 bp, Homo sapiens
cactgtctgagctggtgattag

SEQ ID NO: 7152609 - DNA, 22 bp, Homo sapiens
cactgtctgcttcgactcttca

SEQ ID NO: 7152610 - DNA, 22 bp, Homo sapiens
cactgtctgcttcgactcttca

SEQ ID NO: 7152611 - DNA, 22 bp, Homo sapiens
cactgtctgggacatgtggtct

SEQ ID NO: 7152612 - DNA, 22 bp, Homo sapiens
cactgtctgggacatgtggtct

SEQ ID NO: 7152613 - DNA, 22 bp, Homo sapiens
cactgtctgtgtgtccttgggg

SEQ ID NO: 7152614 - DNA, 22 bp, Homo sapiens
cactgtctgtgtgtccttgggg

SEQ ID NO: 7152615 - DNA, 22 bp, Homo sapiens
cactgtctgtgtgtccttgggg

SEQ ID NO: 7152616 - DNA, 22 bp, Homo sapiens
ggctgcggatctaaggctggga

SEQ ID NO: 7152617 - DNA, 22 bp, Homo sapiens
ggctgcggatctaaggctggga

SEQ ID NO: 7152618 - DNA, 22 bp, Homo sapiens
ggctgcggatctaaggctggga

SEQ ID NO: 7152619 - DNA, 22 bp, Homo sapiens
ggctgcggccgcgggtctgtgc

SEQ ID NO: 7152620 - DNA, 22 bp, Homo sapiens
ggctgctagcaatgctcaggcg

SEQ ID NO: 7152621 - DNA, 19 bp, Homo sapiens
ggctgcctttccttaccag

SEQ ID NO: 7152622 - DNA, 21 bp, Homo sapiens
ggctgctcacctaggtcccaa

SEQ ID NO: 7152623 - DNA, 21 bp, Homo sapiens
ggctgctcacctaggtcccaa

SEQ ID NO: 7152624 - DNA, 22 bp, Homo sapiens
ggctgctcacgcagccctccct

SEQ ID NO: 7152625 - DNA, 22 bp, Homo sapiens
ggctgctcacgcagccctccct

SEQ ID NO: 7152626 - DNA, 18 bp, Homo sapiens
ggctgctcctctccctac

SEQ ID NO: 7152627 - DNA, 22 bp, Homo sapiens
ggctgctcctttaccctggcag

SEQ ID NO: 7152628 - DNA, 22 bp, Homo sapiens
ggctgctcctttaccctggcag

SEQ ID NO: 7152629 - DNA, 22 bp, Homo sapiens
ggctgctcctttaccctggcag

SEQ ID NO: 7152630 - DNA, 18 bp, Homo sapiens
ggctgctcgctctccccg

SEQ ID NO: 7152631 - DNA, 22 bp, Homo sapiens
ggctgctcggagcctcctgtga

SEQ ID NO: 7152632 - DNA, 22 bp, Homo sapiens
ggcgctcagtgttgccccagag

SEQ ID NO: 7152633 - DNA, 20 bp, Homo sapiens
ggcgcctggcctcatggctg

SEQ ID NO: 7152634 - DNA, 22 bp, Homo sapiens
ggcgccgcactcggtgcagccg

SEQ ID NO: 7152635 - DNA, 20 bp, Homo sapiens
ggcgcctggcctcatggctg

SEQ ID NO: 7152636 - DNA, 22 bp, Homo sapiens
ggcgctggccacggtggctctg

SEQ ID NO: 7152637 - DNA, 22 bp, Homo sapiens
ggcgctcagtgttgccccagag

SEQ ID NO: 7152638 - DNA, 22 bp, Homo sapiens
ggcgctcagtgttgccccagag

SEQ ID NO: 7152639 - DNA, 22 bp, Homo sapiens
ggcgctcagtgttgccccagag

SEQ ID NO: 7152640 - DNA, 22 bp, Homo sapiens
ggcgctcagtgttgccccagag

SEQ ID NO: 7152641 - DNA, 22 bp, Homo sapiens
cactgagggcggagcccaggga

SEQ ID NO: 7152642 - DNA, 22 bp, Homo sapiens
cactgagggcggagcccaggga

SEQ ID NO: 7152643 - DNA, 22 bp, Homo sapiens
cactgaggtatctgtctctcct

SEQ ID NO: 7152644 - DNA, 22 bp, Homo sapiens
cactgaggtatctgtctctcct

SEQ ID NO: 7152645 - DNA, 22 bp, Homo sapiens
cactgagggcggagcccaggga

SEQ ID NO: 7152646 - DNA, 22 bp, Homo sapiens
cactgcaacctccacctcctgg

SEQ ID NO: 7152647 - DNA, 22 bp, Homo sapiens
cactgcaacctccacctcctgg

SEQ ID NO: 7152648 - DNA, 22 bp, Homo sapiens
cactgcaacctccacctcctgg

SEQ ID NO: 7152649 - DNA, 19 bp, Homo sapiens
ggctcctggggctcagccc

SEQ ID NO: 7152650 - DNA, 19 bp, Homo sapiens
ggctcctggggctcagccc

SEQ ID NO: 7152651 - DNA, 22 bp, Homo sapiens
cactgattaagtctgctagagg

SEQ ID NO: 7152652 - DNA, 22 bp, Homo sapiens
cactgatactatagagacctca

SEQ ID NO: 7152653 - DNA, 22 bp, Homo sapiens
cactgagttagtacgcaaacat

SEQ ID NO: 7152654 - DNA, 22 bp, Homo sapiens
cactgagttccctgacatttca

SEQ ID NO: 7152655 - DNA, 22 bp, Homo sapiens
cactgaggtttgttaactgagt

SEQ ID NO: 7152656 - DNA, 22 bp, Homo sapiens
cactgccctcactgtggttctc

SEQ ID NO: 7152657 - DNA, 20 bp, Homo sapiens
cactgccctccagcctgagc

SEQ ID NO: 7152658 - DNA, 22 bp, Homo sapiens
cactgccctcactgtggttctc

SEQ ID NO: 7152659 - DNA, 22 bp, Homo sapiens
cactgcccaggacctgccaccc

SEQ ID NO: 7152660 - DNA, 22 bp, Homo sapiens
cactgcccaggcacccatcttg

SEQ ID NO: 7152661 - DNA, 20 bp, Homo sapiens
cactgccctccagcctgagc

SEQ ID NO: 7152662 - DNA, 20 bp, Homo sapiens
cactgccctccagcctgagc

SEQ ID NO: 7152663 - DNA, 22 bp, Homo sapiens
cactgcccttacatgccctgca

SEQ ID NO: 7152664 - DNA, 22 bp, Homo sapiens
cactgccctgggggttgccatc

SEQ ID NO: 7152665 - DNA, 22 bp, Homo sapiens
cactgcccttacatgccctgca

SEQ ID NO: 7152666 - DNA, 22 bp, Homo sapiens
cactgcccaggacctgccaccc

SEQ ID NO: 7152667 - DNA, 22 bp, Homo sapiens
cactgcccaggcacccatcttg

SEQ ID NO: 7152668 - DNA, 22 bp, Homo sapiens
cactgcccagagggcagcattg

SEQ ID NO: 7152669 - DNA, 22 bp, Homo sapiens
cactgcccagcgtcttaggcac

SEQ ID NO: 7152670 - DNA, 22 bp, Homo sapiens
cactgcccaggacctgccaccc

SEQ ID NO: 7152671 - DNA, 22 bp, Homo sapiens
cactgcccaggacctgccaccc

SEQ ID NO: 7152672 - DNA, 22 bp, Homo sapiens
cactgcccagcgtcttaggcac

SEQ ID NO: 7152673 - DNA, 19 bp, Homo sapiens
ggctcctgtggctgcagcc

SEQ ID NO: 7152674 - DNA, 19 bp, Homo sapiens
ggctcctgtggctgcagcc

SEQ ID NO: 7152675 - DNA, 19 bp, Homo sapiens
ggctcctgtggctgcagcc

SEQ ID NO: 7152676 - DNA, 19 bp, Homo sapiens
ggctcctgtggctgcagcc

SEQ ID NO: 7152677 - DNA, 22 bp, Homo sapiens
ggctcctgtcccctcagctgct

SEQ ID NO: 7152678 - DNA, 22 bp, Homo sapiens
ggctcctgtcccctcagctgct

SEQ ID NO: 7152679 - DNA, 22 bp, Homo sapiens
ggctcctgtcccctcagctgct

SEQ ID NO: 7152680 - DNA, 22 bp, Homo sapiens
ggctcctgggggtgctcctgcc

SEQ ID NO: 7152681 - DNA, 22 bp, Homo sapiens
ggctcctgggggtgctcctgcc

SEQ ID NO: 7152682 - DNA, 16 bp, Homo sapiens
ggctcctggttccttc

SEQ ID NO: 7152683 - DNA, 22 bp, Homo sapiens
ggctcctgtagatctctaaagc

SEQ ID NO: 7152684 - DNA, 22 bp, Homo sapiens
ggctcctgtcctcctggagctc

SEQ ID NO: 7152685 - DNA, 22 bp, Homo sapiens
ggctcctgtcctcctggagctc

SEQ ID NO: 7152686 - DNA, 22 bp, Homo sapiens
ggctcctgtcctcctggagctc

SEQ ID NO: 7152687 - DNA, 18 bp, Homo sapiens
ggctcctgtgatcacatt

SEQ ID NO: 7152688 - DNA, 22 bp, Homo sapiens
ggctcctgtggcaagacagctt

SEQ ID NO: 7152689 - DNA, 22 bp, Homo sapiens
ggctcctgtggcaagacagctt

SEQ ID NO: 7152690 - DNA, 22 bp, Homo sapiens
ggctcctgtggcaagacagctt

SEQ ID NO: 7152691 - DNA, 19 bp, Homo sapiens
ggctcctgtggctgcagcc

SEQ ID NO: 7152692 - DNA, 22 bp, Homo sapiens
ggagagtggattccagctgtat

SEQ ID NO: 7152693 - DNA, 17 bp, Homo sapiens
ggagagtgggaatggcc

SEQ ID NO: 7152694 - DNA, 18 bp, Homo sapiens
ggagagtgacagagtcgt

SEQ ID NO: 7152695 - DNA, 18 bp, Homo sapiens
ggagagtgagatcaaaca

SEQ ID NO: 7152696 - DNA, 18 bp, Homo sapiens
ggagagtgagatcaaaca

SEQ ID NO: 7152697 - DNA, 17 bp, Homo sapiens
ggagagtgggaatggcc

SEQ ID NO: 7152698 - DNA, 17 bp, Homo sapiens
ggagagtgggaatggcc

SEQ ID NO: 7152699 - DNA, 22 bp, Homo sapiens
ggagagtgggagcaactgttgc

SEQ ID NO: 7152700 - DNA, 16 bp, Homo sapiens
ggagagtgtctgcaaa

SEQ ID NO: 7152701 - DNA, 22 bp, Homo sapiens
ggagagttgtttttgcctagat

SEQ ID NO: 7152702 - DNA, 22 bp, Homo sapiens
ggagagtctgccgagccagccc

SEQ ID NO: 7152703 - DNA, 18 bp, Homo sapiens
ggagagtgacagagtcgt

SEQ ID NO: 7152704 - DNA, 18 bp, Homo sapiens
ggagagtgacagagtcgt

SEQ ID NO: 7152705 - DNA, 18 bp, Homo sapiens
ggagagtgacagagtcgt

SEQ ID NO: 7152706 - DNA, 22 bp, Homo sapiens
ggagagctgacatcatgatgtt

SEQ ID NO: 7152707 - DNA, 22 bp, Homo sapiens
ggacagcttgcctggtaatgca

SEQ ID NO: 7152708 - DNA, 22 bp, Homo sapiens
ggacagctgctttcaggccaca

SEQ ID NO: 7152709 - DNA, 22 bp, Homo sapiens
ggacagctgctttcaggccaca

SEQ ID NO: 7152710 - DNA, 21 bp, Homo sapiens
ggacagctgcgcgcagggctc

SEQ ID NO: 7152711 - DNA, 22 bp, Homo sapiens
ggacagctgctttcaggccaca

SEQ ID NO: 7152712 - DNA, 22 bp, Homo sapiens
ggacagctctgccaggagctca

SEQ ID NO: 7152713 - DNA, 21 bp, Homo sapiens
ggacagctgcgcgcagggctc

SEQ ID NO: 7152714 - DNA, 22 bp, Homo sapiens
ggacagcgtggctggtggaggg

SEQ ID NO: 7152715 - DNA, 22 bp, Homo sapiens
ggacagccgagtggccttctcc

SEQ ID NO: 7152716 - DNA, 22 bp, Homo sapiens
ggacagcgtggctggtggaggg

SEQ ID NO: 7152717 - DNA, 22 bp, Homo sapiens
ggacagcccatacacatgtctg

SEQ ID NO: 7152718 - DNA, 22 bp, Homo sapiens
ggacagccgagtggccttctcc

SEQ ID NO: 7152719 - DNA, 22 bp, Homo sapiens
ggacagccgagtggccttctcc

SEQ ID NO: 7152720 - DNA, 22 bp, Homo sapiens
ggacagcccatacacatgtctg

SEQ ID NO: 7152721 - DNA, 22 bp, Homo sapiens
ggacagcccatacacatgtctg

SEQ ID NO: 7152722 - DNA, 22 bp, Homo sapiens
ggacagcattctactgtaggca

SEQ ID NO: 7152723 - DNA, 22 bp, Homo sapiens
ggacagcattctactgtaggca

SEQ ID NO: 7152724 - DNA, 22 bp, Homo sapiens
ggacagcattctactgtaggca

SEQ ID NO: 7152725 - DNA, 22 bp, Homo sapiens
ggacagcattctactgtaggca

SEQ ID NO: 7152726 - DNA, 22 bp, Homo sapiens
ggacagcattcctagttccaaa

SEQ ID NO: 7152727 - DNA, 22 bp, Homo sapiens
ggacagcattcctagttccaaa

SEQ ID NO: 7152728 - DNA, 22 bp, Homo sapiens
ggacagcacagctcttgacaac

SEQ ID NO: 7152729 - DNA, 22 bp, Homo sapiens
ggacagcagcctcttacatgaa

SEQ ID NO: 7152730 - DNA, 22 bp, Homo sapiens
ggacagcatatcagcagggcag

SEQ ID NO: 7152731 - DNA, 22 bp, Homo sapiens
ggacagcatatcagcagggcag

SEQ ID NO: 7152732 - DNA, 22 bp, Homo sapiens
ggacagcatatcagcagggcag

SEQ ID NO: 7152733 - DNA, 22 bp, Homo sapiens
ggacagcatatcagcagggcag

SEQ ID NO: 7152734 - DNA, 22 bp, Homo sapiens
ggagatagtccaggtgaaggga

SEQ ID NO: 7152735 - DNA, 22 bp, Homo sapiens
ggagatagtccaggtgaaggga

SEQ ID NO: 7152736 - DNA, 22 bp, Homo sapiens
ggagatattgcctgatgaagaa

SEQ ID NO: 7152737 - DNA, 22 bp, Homo sapiens
ggagataatccagggagggact

SEQ ID NO: 7152738 - DNA, 22 bp, Homo sapiens
ggagatagacttggtgagccac

SEQ ID NO: 7152739 - DNA, 22 bp, Homo sapiens
ggagatagacttggtgagccac

SEQ ID NO: 7152740 - DNA, 22 bp, Homo sapiens
ggagatatttgcaggtcttatg

SEQ ID NO: 7152741 - DNA, 22 bp, Homo sapiens
ggagatccaggcaaggccgcag

SEQ ID NO: 7152742 - DNA, 22 bp, Homo sapiens
ggagatccaggctgagtctttc

SEQ ID NO: 7152743 - DNA, 19 bp, Homo sapiens
ggagatcccgctgcagatg

SEQ ID NO: 7152744 - DNA, 23 bp, Homo sapiens
ggagatctaggttggcatttcct

SEQ ID NO: 7152745 - DNA, 22 bp, Homo sapiens
ggagatctcagttttataatca

SEQ ID NO: 7152746 - DNA, 22 bp, Homo sapiens
ggagatctcagttttataatca

SEQ ID NO: 7152747 - DNA, 22 bp, Homo sapiens
ggagatctgagagctggaagtg

SEQ ID NO: 7152748 - DNA, 22 bp, Homo sapiens
ggagatctgagagctggaagtg

SEQ ID NO: 7152749 - DNA, 22 bp, Homo sapiens
cacagagaactgtgggagtgtg

SEQ ID NO: 7152750 - DNA, 22 bp, Homo sapiens
cacagagaactgtgggagtgtg

SEQ ID NO: 7152751 - DNA, 22 bp, Homo sapiens
cacagagaactgtgggagtgtg

SEQ ID NO: 7152752 - DNA, 22 bp, Homo sapiens
cacagagaactgtgggagtgtg

SEQ ID NO: 7152753 - DNA, 22 bp, Homo sapiens
cacagagaatactgctcttgct

SEQ ID NO: 7152754 - DNA, 22 bp, Homo sapiens
cacagagaatactgctcttgct

SEQ ID NO: 7152755 - DNA, 22 bp, Homo sapiens
cacagagaatactgctcttgct

SEQ ID NO: 7152756 - DNA, 22 bp, Homo sapiens
cacagagaatactgctcttgct

SEQ ID NO: 7152757 - DNA, 22 bp, Homo sapiens
cacagagaatactgctcttgct

SEQ ID NO: 7152758 - DNA, 22 bp, Homo sapiens
cacagagacatgatgtcattgc

SEQ ID NO: 7152759 - DNA, 22 bp, Homo sapiens
cacagagacatgatgtcattgc

SEQ ID NO: 7152760 - DNA, 22 bp, Homo sapiens
cacagagaccccttctggggcc

SEQ ID NO: 7152761 - DNA, 22 bp, Homo sapiens
cacagagaccccttctggggcc

SEQ ID NO: 7152762 - DNA, 22 bp, Homo sapiens
cacagagacagatctattttgc

SEQ ID NO: 7152763 - DNA, 22 bp, Homo sapiens
cacagagacagatctattttgc

SEQ ID NO: 7152764 - DNA, 22 bp, Homo sapiens
cacagagacatgatgtcattgc

SEQ ID NO: 7152765 - DNA, 22 bp, Homo sapiens
cacagagacatgatgtcattgc

SEQ ID NO: 7152766 - DNA, 22 bp, Homo sapiens
cacagcaaagacactctcaact

SEQ ID NO: 7152767 - DNA, 22 bp, Homo sapiens
cacagcaaagacactctcaact

SEQ ID NO: 7152768 - DNA, 22 bp, Homo sapiens
cacagcaaaggcttcggctgat

SEQ ID NO: 7152769 - DNA, 22 bp, Homo sapiens
cacagcaaaggcttcggctgat

SEQ ID NO: 7152770 - DNA, 22 bp, Homo sapiens
cacagcaggcactatacagggc

SEQ ID NO: 7152771 - DNA, 22 bp, Homo sapiens
cacagagacagaagcacttatg

SEQ ID NO: 7152772 - DNA, 22 bp, Homo sapiens
cacagagacagatctattttgc

SEQ ID NO: 7152773 - DNA, 22 bp, Homo sapiens
cacagagaattcccatatgtga

SEQ ID NO: 7152774 - DNA, 22 bp, Homo sapiens
cacagagacagaagcacttatg

SEQ ID NO: 7152775 - DNA, 22 bp, Homo sapiens
cacagagaatgatgagtcactg

SEQ ID NO: 7152776 - DNA, 22 bp, Homo sapiens
cacagagaatgatgagtcactg

SEQ ID NO: 7152777 - DNA, 22 bp, Homo sapiens
cacagagaatgatgagtcactg

SEQ ID NO: 7152778 - DNA, 22 bp, Homo sapiens
cacagagaatgatgagtcactg

SEQ ID NO: 7152779 - DNA, 22 bp, Homo sapiens
cacagagaattcccatatgtga

SEQ ID NO: 7152780 - DNA, 22 bp, Homo sapiens
cacagagaattcccatatgtga

SEQ ID NO: 7152781 - DNA, 22 bp, Homo sapiens
cacagagaattcccatatgtga

SEQ ID NO: 7152782 - DNA, 22 bp, Homo sapiens
ggaagagcctggggtgtcaggc

SEQ ID NO: 7152783 - DNA, 22 bp, Homo sapiens
ggaagagattctttacattcat

SEQ ID NO: 7152784 - DNA, 22 bp, Homo sapiens
ggaagagaggttcagccctaag

SEQ ID NO: 7152785 - DNA, 22 bp, Homo sapiens
ggaagagaggttcagccctaag

SEQ ID NO: 7152786 - DNA, 22 bp, Homo sapiens
ggaagagagggctgggcctcaa

SEQ ID NO: 7152787 - DNA, 19 bp, Homo sapiens
ggaagagaggaaaggtgga

SEQ ID NO: 7152788 - DNA, 22 bp, Homo sapiens
ggaagagagatcccatagatgt

SEQ ID NO: 7152789 - DNA, 19 bp, Homo sapiens
ggaagagaggaaaggtgga

SEQ ID NO: 7152790 - DNA, 19 bp, Homo sapiens
ggaagagaggaaaggtgga

SEQ ID NO: 7152791 - DNA, 22 bp, Homo sapiens
ggaagagaatgatggctatggg

SEQ ID NO: 7152792 - DNA, 22 bp, Homo sapiens
ggaagagaatgatggctatggg

SEQ ID NO: 7152793 - DNA, 22 bp, Homo sapiens
ggaagagaatgatggctatggg

SEQ ID NO: 7152794 - DNA, 22 bp, Homo sapiens
ggaagagaatttctctcttttt

SEQ ID NO: 7152795 - DNA, 22 bp, Homo sapiens
ggaagagagatcccatagatgt

SEQ ID NO: 7152796 - DNA, 22 bp, Homo sapiens
ggaagagagatcccatagatgt

SEQ ID NO: 7152797 - DNA, 22 bp, Homo sapiens
ggaagagagatcccatagatgt

SEQ ID NO: 7152798 - DNA, 22 bp, Homo sapiens
ggaagactgcatggcatagtga

SEQ ID NO: 7152799 - DNA, 22 bp, Homo sapiens
ggaagactgcatggcatagtga

SEQ ID NO: 7152800 - DNA, 22 bp, Homo sapiens
ggaagagaaatgagtcaagact

SEQ ID NO: 7152801 - DNA, 22 bp, Homo sapiens
ggaagagaaatgagtcaagact

SEQ ID NO: 7152802 - DNA, 22 bp, Homo sapiens
ggaagacatctgcttgcaccag

SEQ ID NO: 7152803 - DNA, 22 bp, Homo sapiens
ggaagacatctgcttgcaccag

SEQ ID NO: 7152804 - DNA, 22 bp, Homo sapiens
ggaagagaaatgagtcaagact

SEQ ID NO: 7152805 - DNA, 22 bp, Homo sapiens
ggaagagaaatgagtcaagact

SEQ ID NO: 7152806 - DNA, 22 bp, Homo sapiens
ggaagagaatgatggctatggg

SEQ ID NO: 7152807 - DNA, 22 bp, Homo sapiens
ggaagagaatgatggctatggg

SEQ ID NO: 7152808 - DNA, 22 bp, Homo sapiens
ggaagagaatgatggctatggg

SEQ ID NO: 7152809 - DNA, 22 bp, Homo sapiens
ggaagagaatgatggctatggg

SEQ ID NO: 7152810 - DNA, 22 bp, Homo sapiens
ggaacaggaaaggagggatgct

SEQ ID NO: 7152811 - DNA, 22 bp, Homo sapiens
ggaacaggaaaggagggatgct

SEQ ID NO: 7152812 - DNA, 22 bp, Homo sapiens
ggaacaggaaaggagggatgct

SEQ ID NO: 7152813 - DNA, 22 bp, Homo sapiens
ggaacaggaaaggagggatgct

SEQ ID NO: 7152814 - DNA, 22 bp, Homo sapiens
ggaacactgccttttattttcc

SEQ ID NO: 7152815 - DNA, 22 bp, Homo sapiens
ggaacaggaaaggagggatgct

SEQ ID NO: 7152816 - DNA, 22 bp, Homo sapiens
ggacaagcctgtgagtgggttt

SEQ ID NO: 7152817 - DNA, 22 bp, Homo sapiens
ggacaaaggtctggggaacctg

SEQ ID NO: 7152818 - DNA, 22 bp, Homo sapiens
ggacaaaggtctggggaacctg

SEQ ID NO: 7152819 - DNA, 22 bp, Homo sapiens
ggacaaattccctatttgcatg

SEQ ID NO: 7152820 - DNA, 22 bp, Homo sapiens
ggacaacacttcattccagcta

SEQ ID NO: 7152821 - DNA, 22 bp, Homo sapiens
ggacaagcctcagacaaaactc

SEQ ID NO: 7152822 - DNA, 22 bp, Homo sapiens
ggaaggggccttgagcaaactg

SEQ ID NO: 7152823 - DNA, 22 bp, Homo sapiens
ggaaggggtcacctcctgatga

SEQ ID NO: 7152824 - DNA, 22 bp, Homo sapiens
ggaaggggccttgagcaaactg

SEQ ID NO: 7152825 - DNA, 22 bp, Homo sapiens
ggaaggggtcacctcctgatga

SEQ ID NO: 7152826 - DNA, 22 bp, Homo sapiens
ggacaaagctctgctgcctccc

SEQ ID NO: 7152827 - DNA, 22 bp, Homo sapiens
ggacaaagggctagccacaact

SEQ ID NO: 7152828 - DNA, 22 bp, Homo sapiens
ggacaaaggggagcctgccccg

SEQ ID NO: 7152829 - DNA, 22 bp, Homo sapiens
ggacaaaggggtacgatctagc

SEQ ID NO: 7152830 - DNA, 22 bp, Homo sapiens
ggacaaagggtggagcctctga

SEQ ID NO: 7152831 - DNA, 22 bp, Homo sapiens
ggacaaagggtggagcctctga

SEQ ID NO: 7152832 - DNA, 22 bp, Homo sapiens
ggacaaagggtggagcctctga

SEQ ID NO: 7152833 - DNA, 22 bp, Homo sapiens
ggacaaaggtagacagtctctg

SEQ ID NO: 7152834 - DNA, 22 bp, Homo sapiens
ggacagagggttgacagagtat

SEQ ID NO: 7152835 - DNA, 22 bp, Homo sapiens
ggacagcacagctcttgacaac

SEQ ID NO: 7152836 - DNA, 22 bp, Homo sapiens
ggacagagggttgacagagtat

SEQ ID NO: 7152837 - DNA, 22 bp, Homo sapiens
ggacagattgagctaggcgttt

SEQ ID NO: 7152838 - DNA, 22 bp, Homo sapiens
ggacagcacagctcttgacaac

SEQ ID NO: 7152839 - DNA, 22 bp, Homo sapiens
ggacagcacagctcttgacaac

SEQ ID NO: 7152840 - DNA, 22 bp, Homo sapiens
ggacagcacagctcttgacaac

SEQ ID NO: 7152841 - DNA, 22 bp, Homo sapiens
ggacacagataatcacacagat

SEQ ID NO: 7152842 - DNA, 22 bp, Homo sapiens
ggacacagataatcacacagat

SEQ ID NO: 7152843 - DNA, 23 bp, Homo sapiens
ggacaatcaagtttcacttatgc

SEQ ID NO: 7152844 - DNA, 22 bp, Homo sapiens
ggacacaaaagtgaataaaata

SEQ ID NO: 7152845 - DNA, 22 bp, Homo sapiens
ggacacacaagttatctaatga

SEQ ID NO: 7152846 - DNA, 22 bp, Homo sapiens
ggacacacaagttatctaatga

SEQ ID NO: 7152847 - DNA, 19 bp, Homo sapiens
ggacacagaaagctgcatt

SEQ ID NO: 7152848 - DNA, 19 bp, Homo sapiens
ggacacagaaagctgcatt

SEQ ID NO: 7152849 - DNA, 22 bp, Homo sapiens
ggacacagacctttctgttcta

SEQ ID NO: 7152850 - DNA, 22 bp, Homo sapiens
ggacacagacctttctgttcta

SEQ ID NO: 7152851 - DNA, 23 bp, Homo sapiens
ggacacagagataagtgagacaa

SEQ ID NO: 7152852 - DNA, 22 bp, Homo sapiens
ggagcaggcagggccgtgtctg

SEQ ID NO: 7152853 - DNA, 20 bp, Homo sapiens
ggagctggcatccagcctct

SEQ ID NO: 7152854 - DNA, 22 bp, Homo sapiens
ggagctggccctctgagtttgt

SEQ ID NO: 7152855 - DNA, 22 bp, Homo sapiens
ggagctggccgcctatgtgcag

SEQ ID NO: 7152856 - DNA, 22 bp, Homo sapiens
ggagctggccgcctatgtgcag

SEQ ID NO: 7152857 - DNA, 22 bp, Homo sapiens
ggagctggccgcctatgtgcag

SEQ ID NO: 7152858 - DNA, 22 bp, Homo sapiens
ggagctggccctctgagtttgt

SEQ ID NO: 7152859 - DNA, 22 bp, Homo sapiens
ggagctggccctctgagtttgt

SEQ ID NO: 7152860 - DNA, 22 bp, Homo sapiens
ggaggagacagtaaaaagcacg

SEQ ID NO: 7152861 - DNA, 22 bp, Homo sapiens
ggaggagacagtaaaaagcacg

SEQ ID NO: 7152862 - DNA, 22 bp, Homo sapiens
ggaggagacagtaaaaagcacg

SEQ ID NO: 7152863 - DNA, 22 bp, Homo sapiens
ggaggagacagtaaaaagcacg

SEQ ID NO: 7152864 - DNA, 22 bp, Homo sapiens
ggagcagcttgcatgctcaggg

SEQ ID NO: 7152865 - DNA, 22 bp, Homo sapiens
ggagcagcttgcatgctcaggg

SEQ ID NO: 7152866 - DNA, 22 bp, Homo sapiens
ggagcagcttgcatgctcaggg

SEQ ID NO: 7152867 - DNA, 22 bp, Homo sapiens
ggagcagcttgcatgctcaggg

SEQ ID NO: 7152868 - DNA, 22 bp, Homo sapiens
ggagcagcttgcatgctcaggg

SEQ ID NO: 7152869 - DNA, 22 bp, Homo sapiens
ggagcaggagtctcttgaattt

SEQ ID NO: 7152870 - DNA, 22 bp, Homo sapiens
ggaggagcatgagagggtagtg

SEQ ID NO: 7152871 - DNA, 22 bp, Homo sapiens
ggaggagcacttgacggggtct

SEQ ID NO: 7152872 - DNA, 22 bp, Homo sapiens
ggaggagcacttgacggggtct

SEQ ID NO: 7152873 - DNA, 22 bp, Homo sapiens
ggaggagcacttctgagctcag

SEQ ID NO: 7152874 - DNA, 22 bp, Homo sapiens
ggaggagcacttctgagctcag

SEQ ID NO: 7152875 - DNA, 22 bp, Homo sapiens
ggaggagcacttctgagctcag

SEQ ID NO: 7152876 - DNA, 22 bp, Homo sapiens
ggaggagcacttctgagctcag

SEQ ID NO: 7152877 - DNA, 22 bp, Homo sapiens
ggaggagagaggttgcaaacac

SEQ ID NO: 7152878 - DNA, 22 bp, Homo sapiens
ggaggagacggagtgattagtg

SEQ ID NO: 7152879 - DNA, 22 bp, Homo sapiens
ggaggagacggagtgattagtg

SEQ ID NO: 7152880 - DNA, 22 bp, Homo sapiens
ggaggagagaggttgcaaacac

SEQ ID NO: 7152881 - DNA, 22 bp, Homo sapiens
ggaggagattcccctctcactt

SEQ ID NO: 7152882 - DNA, 22 bp, Homo sapiens
ggaggagattcccctctcactt

SEQ ID NO: 7152883 - DNA, 22 bp, Homo sapiens
ggaggagaccctgtgtcagttt

SEQ ID NO: 7152884 - DNA, 22 bp, Homo sapiens
ggaggagacggagtgattagtg

SEQ ID NO: 7152885 - DNA, 22 bp, Homo sapiens
ggaggagacggagtgattagtg

SEQ ID NO: 7152886 - DNA, 22 bp, Homo sapiens
ggaggagaccctgtgtcagttt

SEQ ID NO: 7152887 - DNA, 22 bp, Homo sapiens
ggaggagaccctgtgtcagttt

SEQ ID NO: 7152888 - DNA, 22 bp, Homo sapiens
ggaggagaccctgtgtcagttt

SEQ ID NO: 7152889 - DNA, 22 bp, Homo sapiens
ggagcagccgcgtctcagggca

SEQ ID NO: 7152890 - DNA, 22 bp, Homo sapiens
ggagcagccgcgtctcagggca

SEQ ID NO: 7152891 - DNA, 22 bp, Homo sapiens
ggagcagccgcgtctcagggca

SEQ ID NO: 7152892 - DNA, 22 bp, Homo sapiens
ggagcagcctgtgtagacgggg

SEQ ID NO: 7152893 - DNA, 22 bp, Homo sapiens
ggagcagccacgtctcagggca

SEQ ID NO: 7152894 - DNA, 22 bp, Homo sapiens
ggagcagccacgtctcagggca

SEQ ID NO: 7152895 - DNA, 22 bp, Homo sapiens
ggagcagccacgtctcagggca

SEQ ID NO: 7152896 - DNA, 22 bp, Homo sapiens
cacagccatgtcctcattcttc

SEQ ID NO: 7152897 - DNA, 22 bp, Homo sapiens
cacagccatgtcctcattcttc

SEQ ID NO: 7152898 - DNA, 22 bp, Homo sapiens
cacagcccccttgacactctgg

SEQ ID NO: 7152899 - DNA, 22 bp, Homo sapiens
cacagcccccttgacactctgg

SEQ ID NO: 7152900 - DNA, 22 bp, Homo sapiens
cacagccctgcgccccagtttg

SEQ ID NO: 7152901 - DNA, 22 bp, Homo sapiens
cacagcattcacagaaagacat

SEQ ID NO: 7152902 - DNA, 22 bp, Homo sapiens
cacagcattcacagaaagacat

SEQ ID NO: 7152903 - DNA, 22 bp, Homo sapiens
cacagcattgccttccaaaagg

SEQ ID NO: 7152904 - DNA, 19 bp, Homo sapiens
cacagccacagccaacctc

SEQ ID NO: 7152905 - DNA, 19 bp, Homo sapiens
cacagccacagccaacctc

SEQ ID NO: 7152906 - DNA, 22 bp, Homo sapiens
cacagccatgtcctcattcttc

SEQ ID NO: 7152907 - DNA, 22 bp, Homo sapiens
cacagcaggcagaacgtgggca

SEQ ID NO: 7152908 - DNA, 22 bp, Homo sapiens
cacagcaggcagaacgtgggca

SEQ ID NO: 7152909 - DNA, 22 bp, Homo sapiens
cacagcagggatgaatggagtg

SEQ ID NO: 7152910 - DNA, 22 bp, Homo sapiens
cacagcagggatgaatggagtg

SEQ ID NO: 7152911 - DNA, 22 bp, Homo sapiens
cacagcagggatgaatggagtg

SEQ ID NO: 7152912 - DNA, 22 bp, Homo sapiens
cacagcagggatgaatggagtg

SEQ ID NO: 7152913 - DNA, 22 bp, Homo sapiens
cacagcagggatgaatggagtg

SEQ ID NO: 7152914 - DNA, 22 bp, Homo sapiens
cacagcagggatgaatggagtg

SEQ ID NO: 7152915 - DNA, 22 bp, Homo sapiens
cacagcagggcatggctgttgt

SEQ ID NO: 7152916 - DNA, 22 bp, Homo sapiens
cacagcagggcatggctgttgt

SEQ ID NO: 7152917 - DNA, 22 bp, Homo sapiens
cacagcagggcatggctgttgt

SEQ ID NO: 7152918 - DNA, 21 bp, Homo sapiens
cacagcagggttcctgggctc

SEQ ID NO: 7152919 - DNA, 21 bp, Homo sapiens
cacagcagggttcctgggctc

SEQ ID NO: 7152920 - DNA, 21 bp, Homo sapiens
cacagcagggttcctgggctc

SEQ ID NO: 7152921 - DNA, 22 bp, Homo sapiens
cacagcaggtgcttaatgatta

SEQ ID NO: 7152922 - DNA, 22 bp, Homo sapiens
cacagcaggtgcttaatgatta

SEQ ID NO: 7152923 - DNA, 22 bp, Homo sapiens
cacagcagtctttcactaaata

SEQ ID NO: 7152924 - DNA, 22 bp, Homo sapiens
cacagcagtctttcactaaata

SEQ ID NO: 7152925 - DNA, 22 bp, Homo sapiens
cacagcagtctttcactaaata

SEQ ID NO: 7152926 - DNA, 22 bp, Homo sapiens
cacagcagtctttcactaaata

SEQ ID NO: 7152927 - DNA, 22 bp, Homo sapiens
cacagcagtctttcactaaata

SEQ ID NO: 7152928 - DNA, 22 bp, Homo sapiens
cacagcagtctttcactaaata

SEQ ID NO: 7152929 - DNA, 22 bp, Homo sapiens
cacagcataatgaaatatactt

SEQ ID NO: 7152930 - DNA, 22 bp, Homo sapiens
cacagcataatgaaatatactt

SEQ ID NO: 7152931 - DNA, 22 bp, Homo sapiens
cacagcataatgaaatatactt

SEQ ID NO: 7152932 - DNA, 22 bp, Homo sapiens
cacagcataatgaaatatactt

SEQ ID NO: 7152933 - DNA, 22 bp, Homo sapiens
ggaggggcatagttcaccatca

SEQ ID NO: 7152934 - DNA, 22 bp, Homo sapiens
ggaggggcaggtcccaagttgt

SEQ ID NO: 7152935 - DNA, 22 bp, Homo sapiens
ggaggggcaggtcccaagttgt

SEQ ID NO: 7152936 - DNA, 22 bp, Homo sapiens
ggaggggcaggtcccaagttgt

SEQ ID NO: 7152937 - DNA, 22 bp, Homo sapiens
ggaggggcaggtcccaagttgt

SEQ ID NO: 7152938 - DNA, 22 bp, Homo sapiens
ggaggggcaggtcccaagttgt

SEQ ID NO: 7152939 - DNA, 22 bp, Homo sapiens
ggaggggcagccatggaactcc

SEQ ID NO: 7152940 - DNA, 22 bp, Homo sapiens
ggaggggcagccatggaactcc

SEQ ID NO: 7152941 - DNA, 22 bp, Homo sapiens
ggaggggcagccatggaactcc

SEQ ID NO: 7152942 - DNA, 22 bp, Homo sapiens
ggaggggcagccatggaactcc

SEQ ID NO: 7152943 - DNA, 22 bp, Homo sapiens
ggaggggcaggtcccaagttgt

SEQ ID NO: 7152944 - DNA, 22 bp, Homo sapiens
ggaggggatttagtagatgcta

SEQ ID NO: 7152945 - DNA, 22 bp, Homo sapiens
ggaggggatttagtagatgcta

SEQ ID NO: 7152946 - DNA, 22 bp, Homo sapiens
ggaggggcagccatggaactcc

SEQ ID NO: 7152947 - DNA, 22 bp, Homo sapiens
ggaggggcagccatggaactcc

SEQ ID NO: 7152948 - DNA, 22 bp, Homo sapiens
ggaggggcagccatggaactcc

SEQ ID NO: 7152949 - DNA, 22 bp, Homo sapiens
ggaggggcagccatggaactcc

SEQ ID NO: 7152950 - DNA, 22 bp, Homo sapiens
ggaggggcagccatggaactcc

SEQ ID NO: 7152951 - DNA, 22 bp, Homo sapiens
ggaggggcatagttcaccatca

SEQ ID NO: 7152952 - DNA, 22 bp, Homo sapiens
ggaggggcatagttcaccatca

SEQ ID NO: 7152953 - DNA, 22 bp, Homo sapiens
ggaggggccggctgcctgccac

SEQ ID NO: 7152954 - DNA, 22 bp, Homo sapiens
ggaggggccggctgcctgccac

SEQ ID NO: 7152955 - DNA, 22 bp, Homo sapiens
ggaggggccggctgcctgccac

SEQ ID NO: 7152956 - DNA, 22 bp, Homo sapiens
ggaggggcatagttcaccatca

SEQ ID NO: 7152957 - DNA, 22 bp, Homo sapiens
ggaggggcatagttcaccatca

SEQ ID NO: 7152958 - DNA, 22 bp, Homo sapiens
ggaggggcatagttcaccatca

SEQ ID NO: 7152959 - DNA, 22 bp, Homo sapiens
ggaggggcatagttcaccatca

SEQ ID NO: 7152960 - DNA, 22 bp, Homo sapiens
ggaggggccggctgcctgccac

SEQ ID NO: 7152961 - DNA, 22 bp, Homo sapiens
ggaggggccggctgcctgccac

SEQ ID NO: 7152962 - DNA, 22 bp, Homo sapiens
ggaggggccggctgcctgccac

SEQ ID NO: 7152963 - DNA, 22 bp, Homo sapiens
ggaggggccggctgcctgccac

SEQ ID NO: 7152964 - DNA, 22 bp, Homo sapiens
ggaggggccggctgcctgccac

SEQ ID NO: 7152965 - DNA, 22 bp, Homo sapiens
ggaggggccggctgcctgccac

SEQ ID NO: 7152966 - DNA, 22 bp, Homo sapiens
cacaggagaacccacagattct

SEQ ID NO: 7152967 - DNA, 22 bp, Homo sapiens
cacaggagaaaggggaagctcg

SEQ ID NO: 7152968 - DNA, 22 bp, Homo sapiens
cacaggagaacccacagattct

SEQ ID NO: 7152969 - DNA, 22 bp, Homo sapiens
cacaggagaaaggggaagctcg

SEQ ID NO: 7152970 - DNA, 22 bp, Homo sapiens
cacaggagaaaggggaagctcg

SEQ ID NO: 7152971 - DNA, 22 bp, Homo sapiens
cacaggagagctgggaggtgcc

SEQ ID NO: 7152972 - DNA, 22 bp, Homo sapiens
cacaggagagctgggaggtgcc

SEQ ID NO: 7152973 - DNA, 22 bp, Homo sapiens
cacaggagagctgggaggtgcc

SEQ ID NO: 7152974 - DNA, 22 bp, Homo sapiens
cacaggagagctgggaggtgcc

SEQ ID NO: 7152975 - DNA, 22 bp, Homo sapiens
cacaggagaggttaatgggggc

SEQ ID NO: 7152976 - DNA, 22 bp, Homo sapiens
cacaggagagctgggaggtgcc

SEQ ID NO: 7152977 - DNA, 22 bp, Homo sapiens
cacaggagaggttaatgggggc

SEQ ID NO: 7152978 - DNA, 22 bp, Homo sapiens
cacaggagaggttaatgggggc

SEQ ID NO: 7152979 - DNA, 22 bp, Homo sapiens
cacaggagaggttaatgggggc

SEQ ID NO: 7152980 - DNA, 18 bp, Homo sapiens
cacaggagatgacctgac

SEQ ID NO: 7152981 - DNA, 22 bp, Homo sapiens
cacaggagattgatctattggt

SEQ ID NO: 7152982 - DNA, 22 bp, Homo sapiens
ggagggcaacttttcagtaggt

SEQ ID NO: 7152983 - DNA, 22 bp, Homo sapiens
cacagctgaagtagccatgtgg

SEQ ID NO: 7152984 - DNA, 22 bp, Homo sapiens
ggagggagtttcattcctgccc

SEQ ID NO: 7152985 - DNA, 22 bp, Homo sapiens
ggagggagtttcattcctgccc

SEQ ID NO: 7152986 - DNA, 22 bp, Homo sapiens
cacagctgaagtagccatgtgg

SEQ ID NO: 7152987 - DNA, 19 bp, Homo sapiens
cacagctctgctcagggaa

SEQ ID NO: 7152988 - DNA, 19 bp, Homo sapiens
cacagctctgctcagggaa

SEQ ID NO: 7152989 - DNA, 19 bp, Homo sapiens
cacagctctgctcagggaa

SEQ ID NO: 7152990 - DNA, 22 bp, Homo sapiens
ggaggggatggtttgaccctgg

SEQ ID NO: 7152991 - DNA, 22 bp, Homo sapiens
ggaggggatggtttgaccctgg

SEQ ID NO: 7152992 - DNA, 22 bp, Homo sapiens
ggaggggagtctcccaaagccg

SEQ ID NO: 7152993 - DNA, 22 bp, Homo sapiens
ggaggggatggtttgaccctgg

SEQ ID NO: 7152994 - DNA, 22 bp, Homo sapiens
ggaggggatggtttgaccctgg

SEQ ID NO: 7152995 - DNA, 22 bp, Homo sapiens
ggaggggatggtttgaccctgg

SEQ ID NO: 7152996 - DNA, 22 bp, Homo sapiens
ggaggggatttagtagatgcta

SEQ ID NO: 7152997 - DNA, 22 bp, Homo sapiens
ggaggggatttagtagatgcta

SEQ ID NO: 7152998 - DNA, 22 bp, Homo sapiens
cacagcctccttcagagagcat

SEQ ID NO: 7152999 - DNA, 22 bp, Homo sapiens
cacagcctgctgcactcaagaa

SEQ ID NO: 7153000 - DNA, 19 bp, Homo sapiens
cacagcgaagacaaggtgg

SEQ ID NO: 7153001 - DNA, 22 bp, Homo sapiens
cacagcggcctccgatgctgat

SEQ ID NO: 7153002 - DNA, 22 bp, Homo sapiens
cacagctaactttcactgagca

SEQ ID NO: 7153003 - DNA, 22 bp, Homo sapiens
cacagctaactttcactgagca

SEQ ID NO: 7153004 - DNA, 22 bp, Homo sapiens
cacagctaatggaagtggaatc

SEQ ID NO: 7153005 - DNA, 22 bp, Homo sapiens
cacagctacctgcatgcctgct

SEQ ID NO: 7153006 - DNA, 22 bp, Homo sapiens
cacagctagatggatagataga

SEQ ID NO: 7153007 - DNA, 22 bp, Homo sapiens
cacagctagatggatagataga

SEQ ID NO: 7153008 - DNA, 22 bp, Homo sapiens
caagtgtgtaattactgggagc

SEQ ID NO: 7153009 - DNA, 22 bp, Homo sapiens
caagttaatatatagaattttg

SEQ ID NO: 7153010 - DNA, 22 bp, Homo sapiens
caagttacagcgctgacagcag

SEQ ID NO: 7153011 - DNA, 21 bp, Homo sapiens
caagtgtggatgtggaaggta

SEQ ID NO: 7153012 - DNA, 21 bp, Homo sapiens
caagtgtggatgtggaaggta

SEQ ID NO: 7153013 - DNA, 22 bp, Homo sapiens
caagtgtgtaattactgggagc

SEQ ID NO: 7153014 - DNA, 20 bp, Homo sapiens
gctgggctaccactggccct

SEQ ID NO: 7153015 - DNA, 22 bp, Homo sapiens
caagtcaatgattataagagtc

SEQ ID NO: 7153016 - DNA, 22 bp, Homo sapiens
caagtcacatggccaactgatg

SEQ ID NO: 7153017 - DNA, 22 bp, Homo sapiens
caagtcacatggccaactgatg

SEQ ID NO: 7153018 - DNA, 22 bp, Homo sapiens
caagtcacatggccaactgatg

SEQ ID NO: 7153019 - DNA, 22 bp, Homo sapiens
caagtcacttatgtgcagatat

SEQ ID NO: 7153020 - DNA, 22 bp, Homo sapiens
caagtcacttatgtgcagatat

SEQ ID NO: 7153021 - DNA, 23 bp, Homo sapiens
caagtgcaccagatatacaggtc

SEQ ID NO: 7153022 - DNA, 22 bp, Homo sapiens
caagtgcatggtggcaaagaat

SEQ ID NO: 7153023 - DNA, 22 bp, Homo sapiens
caagttctactgggacatcagt

SEQ ID NO: 7153024 - DNA, 19 bp, Homo sapiens
caagttctggagattaggg

SEQ ID NO: 7153025 - DNA, 21 bp, Homo sapiens
caagttctgtgtcttactcct

SEQ ID NO: 7153026 - DNA, 22 bp, Homo sapiens
caagttggtctcctgtagcaac

SEQ ID NO: 7153027 - DNA, 22 bp, Homo sapiens
caagttggtctcctgtagcaac

SEQ ID NO: 7153028 - DNA, 22 bp, Homo sapiens
caagttgtacagattgtattag

SEQ ID NO: 7153029 - DNA, 22 bp, Homo sapiens
caagttgtgaatgacagacttc

SEQ ID NO: 7153030 - DNA, 22 bp, Homo sapiens
caagttgttgggagggttggtt

SEQ ID NO: 7153031 - DNA, 22 bp, Homo sapiens
caagttgtttaggaggtgttgt

SEQ ID NO: 7153032 - DNA, 22 bp, Homo sapiens
caagttcacttgtctacaaggg

SEQ ID NO: 7153033 - DNA, 22 bp, Homo sapiens
caagttatttcattggaacaat

SEQ ID NO: 7153034 - DNA, 22 bp, Homo sapiens
caagttagtattggttttggga

SEQ ID NO: 7153035 - DNA, 22 bp, Homo sapiens
gctggtggtgggccagttctgt

SEQ ID NO: 7153036 - DNA, 22 bp, Homo sapiens
caatcccatcaccatctgctct

SEQ ID NO: 7153037 - DNA, 22 bp, Homo sapiens
caatctataaatatcagtttcc

SEQ ID NO: 7153038 - DNA, 22 bp, Homo sapiens
caatctatagagctttagacta

SEQ ID NO: 7153039 - DNA, 22 bp, Homo sapiens
caatctatcctctgattttgta

SEQ ID NO: 7153040 - DNA, 22 bp, Homo sapiens
caatctgagttgggaatgtatt

SEQ ID NO: 7153041 - DNA, 22 bp, Homo sapiens
caatctgagttgggaatgtatt

SEQ ID NO: 7153042 - DNA, 22 bp, Homo sapiens
caatgcaatgcaatgcaatgca

SEQ ID NO: 7153043 - DNA, 22 bp, Homo sapiens
caatgcacatggacatcaggct

SEQ ID NO: 7153044 - DNA, 22 bp, Homo sapiens
caatgcacgctcagatttgacc

SEQ ID NO: 7153045 - DNA, 22 bp, Homo sapiens
caatgcacgctcagatttgacc

SEQ ID NO: 7153046 - DNA, 22 bp, Homo sapiens
caatgcatacttcgaaatttca

SEQ ID NO: 7153047 - DNA, 22 bp, Homo sapiens
caatgcatacttcgaaatttca

SEQ ID NO: 7153048 - DNA, 22 bp, Homo sapiens
caatgcatacttcgaaatttca

SEQ ID NO: 7153049 - DNA, 22 bp, Homo sapiens
caatgcatgatggaattgcctt

SEQ ID NO: 7153050 - DNA, 22 bp, Homo sapiens
gctggtgattgcctcaggaggc

SEQ ID NO: 7153051 - DNA, 22 bp, Homo sapiens
gctggtgcattagctgcagttc

SEQ ID NO: 7153052 - DNA, 22 bp, Homo sapiens
gctggtgagcaaaggagaagga

SEQ ID NO: 7153053 - DNA, 22 bp, Homo sapiens
caagtttaaggcactgataagt

SEQ ID NO: 7153054 - DNA, 22 bp, Homo sapiens
gctggtcctcaagggcacagcc

SEQ ID NO: 7153055 - DNA, 22 bp, Homo sapiens
gctggtctagggatgggcgtat

SEQ ID NO: 7153056 - DNA, 22 bp, Homo sapiens
gctggtgccttgttgttgttac

SEQ ID NO: 7153057 - DNA, 22 bp, Homo sapiens
gctggtgctctgggccctgagg

SEQ ID NO: 7153058 - DNA, 22 bp, Homo sapiens
gctggtgctctgggccctgagg

SEQ ID NO: 7153059 - DNA, 22 bp, Homo sapiens
gctggtggcagagacatcaggt

SEQ ID NO: 7153060 - DNA, 22 bp, Homo sapiens
gctggtggcagagctccgcggc

SEQ ID NO: 7153061 - DNA, 22 bp, Homo sapiens
gctggtggcagagctccgcggc

SEQ ID NO: 7153062 - DNA, 20 bp, Homo sapiens
gctggtgggggcttgacatg

SEQ ID NO: 7153063 - DNA, 21 bp, Homo sapiens
caatggcgagatcttggctca

SEQ ID NO: 7153064 - DNA, 22 bp, Homo sapiens
caatggaagaatctgacctgca

SEQ ID NO: 7153065 - DNA, 22 bp, Homo sapiens
caatggtggtgtcagaagagat

SEQ ID NO: 7153066 - DNA, 22 bp, Homo sapiens
caatggtggtgtcagaagagat

SEQ ID NO: 7153067 - DNA, 22 bp, Homo sapiens
caatggttctcaaactatcatg

SEQ ID NO: 7153068 - DNA, 22 bp, Homo sapiens
caatggtggtgtcagaagagat

SEQ ID NO: 7153069 - DNA, 22 bp, Homo sapiens
caatggttctcaaactatcatg

SEQ ID NO: 7153070 - DNA, 22 bp, Homo sapiens
caatggctggagacaatctgct

SEQ ID NO: 7153071 - DNA, 22 bp, Homo sapiens
caatgcatgatggaattgcctt

SEQ ID NO: 7153072 - DNA, 22 bp, Homo sapiens
caatgcattattctcccacttc

SEQ ID NO: 7153073 - DNA, 22 bp, Homo sapiens
caatgctaaaaattctgtacat

SEQ ID NO: 7153074 - DNA, 22 bp, Homo sapiens
caatgctaaagtcagtagttag

SEQ ID NO: 7153075 - DNA, 22 bp, Homo sapiens
caatgctaggcagatcctgcgt

SEQ ID NO: 7153076 - DNA, 22 bp, Homo sapiens
caatgctatcatgtcagagata

SEQ ID NO: 7153077 - DNA, 22 bp, Homo sapiens
caatgcttctcattagccaatg

SEQ ID NO: 7153078 - DNA, 22 bp, Homo sapiens
caatgcttctgagggaattaca

SEQ ID NO: 7153079 - DNA, 22 bp, Homo sapiens
caatgcttttagcttcagcttg

SEQ ID NO: 7153080 - DNA, 22 bp, Homo sapiens
caatgcttttagcttcagcttg

SEQ ID NO: 7153081 - DNA, 22 bp, Homo sapiens
caatgcttttgttctttactca

SEQ ID NO: 7153082 - DNA, 22 bp, Homo sapiens
caatgcttttgttctttactca

SEQ ID NO: 7153083 - DNA, 22 bp, Homo sapiens
caatgtatcaaccagaaagttc

SEQ ID NO: 7153084 - DNA, 22 bp, Homo sapiens
caatgtatcaaccagaaagttc

SEQ ID NO: 7153085 - DNA, 22 bp, Homo sapiens
caatgtaaatattttctaatca

SEQ ID NO: 7153086 - DNA, 22 bp, Homo sapiens
caatgtaaatattttctaatca

SEQ ID NO: 7153087 - DNA, 22 bp, Homo sapiens
caatgtatcaagaagcatcagt

SEQ ID NO: 7153088 - DNA, 22 bp, Homo sapiens
gcttccacctactaaatgccac

SEQ ID NO: 7153089 - DNA, 22 bp, Homo sapiens
gcttccagaatgactaggatgt

SEQ ID NO: 7153090 - DNA, 22 bp, Homo sapiens
gcttccagaccccagtccctca

SEQ ID NO: 7153091 - DNA, 22 bp, Homo sapiens
gcttccagagagccccgcctgg

SEQ ID NO: 7153092 - DNA, 20 bp, Homo sapiens
gcttccagaggaggccccgt

SEQ ID NO: 7153093 - DNA, 20 bp, Homo sapiens
gcttccagaggaggccccgt

SEQ ID NO: 7153094 - DNA, 22 bp, Homo sapiens
gcttccagatcccatgctctta

SEQ ID NO: 7153095 - DNA, 22 bp, Homo sapiens
gcttccagcaaacactggctgc

SEQ ID NO: 7153096 - DNA, 22 bp, Homo sapiens
ggaaacaaaccactcatggtgg

SEQ ID NO: 7153097 - DNA, 22 bp, Homo sapiens
ggaaaatttccttcaaaatgtg

SEQ ID NO: 7153098 - DNA, 22 bp, Homo sapiens
gcttccagggctcagtcactgc

SEQ ID NO: 7153099 - DNA, 22 bp, Homo sapiens
gcttccagggctcagtcactgc

SEQ ID NO: 7153100 - DNA, 19 bp, Homo sapiens
gcttccagcactgcaggag

SEQ ID NO: 7153101 - DNA, 19 bp, Homo sapiens
gcttccagcactgcaggag

SEQ ID NO: 7153102 - DNA, 22 bp, Homo sapiens
gcttccagcaccagcagagggg

SEQ ID NO: 7153103 - DNA, 17 bp, Homo sapiens
ggaacaaatactatgca

SEQ ID NO: 7153104 - DNA, 18 bp, Homo sapiens
ggaacaaggctctgactc

SEQ ID NO: 7153105 - DNA, 22 bp, Homo sapiens
ggaacacagaagggctgaaaaa

SEQ ID NO: 7153106 - DNA, 22 bp, Homo sapiens
ggaacacagtgccttacaaact

SEQ ID NO: 7153107 - DNA, 22 bp, Homo sapiens
ggaacacagtgccttacaaact

SEQ ID NO: 7153108 - DNA, 22 bp, Homo sapiens
ggaacactcagaaatgctcgtc

SEQ ID NO: 7153109 - DNA, 22 bp, Homo sapiens
ggaacactcagtaattcagata

SEQ ID NO: 7153110 - DNA, 22 bp, Homo sapiens
ggaacactcgtcaaatagcggg

SEQ ID NO: 7153111 - DNA, 22 bp, Homo sapiens
ggaacactgccttttattttcc

SEQ ID NO: 7153112 - DNA, 22 bp, Homo sapiens
ggaaatggagagctacattgga

SEQ ID NO: 7153113 - DNA, 22 bp, Homo sapiens
ggaaatgtaatcacagagggtt

SEQ ID NO: 7153114 - DNA, 22 bp, Homo sapiens
ggaaatgtatgattctcatcag

SEQ ID NO: 7153115 - DNA, 22 bp, Homo sapiens
ggaaatgtatgtattaagcacc

SEQ ID NO: 7153116 - DNA, 22 bp, Homo sapiens
ggaaatgtgggctgtttctgta

SEQ ID NO: 7153117 - DNA, 21 bp, Homo sapiens
ggaaatgtggtctttacttct

SEQ ID NO: 7153118 - DNA, 18 bp, Homo sapiens
ggaaatgtttggtactag

SEQ ID NO: 7153119 - DNA, 18 bp, Homo sapiens
ggaaatgtttggtactag

SEQ ID NO: 7153120 - DNA, 22 bp, Homo sapiens
ggaaattgatctgagctcacct

SEQ ID NO: 7153121 - DNA, 22 bp, Homo sapiens
gctgggagccccgagccagcgc

SEQ ID NO: 7153122 - DNA, 22 bp, Homo sapiens
gctgggagccccgagccagcgc

SEQ ID NO: 7153123 - DNA, 19 bp, Homo sapiens
gctgggagcagaccctccc

SEQ ID NO: 7153124 - DNA, 22 bp, Homo sapiens
gctgggagccctggtctgctcc

SEQ ID NO: 7153125 - DNA, 22 bp, Homo sapiens
gctgggagccctggtctgctcc

SEQ ID NO: 7153126 - DNA, 22 bp, Homo sapiens
gctgggagccccgagccagcgc

SEQ ID NO: 7153127 - DNA, 22 bp, Homo sapiens
gctgggagcaagtactcatctt

SEQ ID NO: 7153128 - DNA, 22 bp, Homo sapiens
gctgggagcaagtactcatctt

SEQ ID NO: 7153129 - DNA, 22 bp, Homo sapiens
gctgggagcaaagccatgcata

SEQ ID NO: 7153130 - DNA, 19 bp, Homo sapiens
gctgggagcagaccctccc

SEQ ID NO: 7153131 - DNA, 19 bp, Homo sapiens
gctgggagcagaccctccc

SEQ ID NO: 7153132 - DNA, 19 bp, Homo sapiens
gctgggagcagaccctccc

SEQ ID NO: 7153133 - DNA, 22 bp, Homo sapiens
gctggccatatattttgctgtt

SEQ ID NO: 7153134 - DNA, 22 bp, Homo sapiens
gctggccatagaagccaaagag

SEQ ID NO: 7153135 - DNA, 22 bp, Homo sapiens
gctggccatatattttgctgtt

SEQ ID NO: 7153136 - DNA, 22 bp, Homo sapiens
gctggcccagcgcccagggcag

SEQ ID NO: 7153137 - DNA, 22 bp, Homo sapiens
gctggcccagcgcccagggcag

SEQ ID NO: 7153138 - DNA, 22 bp, Homo sapiens
gctggcccagcgcccagggcag

SEQ ID NO: 7153139 - DNA, 20 bp, Homo sapiens
gctgggctaccactggccct

SEQ ID NO: 7153140 - DNA, 22 bp, Homo sapiens
gctgggccttccgattctcaag

SEQ ID NO: 7153141 - DNA, 22 bp, Homo sapiens
gctgggccgacctgggctgcag

SEQ ID NO: 7153142 - DNA, 21 bp, Homo sapiens
gctgggcctgtacttgccctg

SEQ ID NO: 7153143 - DNA, 21 bp, Homo sapiens
gctgggcctgtacttgccctg

SEQ ID NO: 7153144 - DNA, 22 bp, Homo sapiens
gctgggccgacctgggctgcag

SEQ ID NO: 7153145 - DNA, 22 bp, Homo sapiens
gctgggccgacctgggctgcag

SEQ ID NO: 7153146 - DNA, 21 bp, Homo sapiens
gctgggcctgtacttgccctg

SEQ ID NO: 7153147 - DNA, 21 bp, Homo sapiens
gctgggcctgtacttgccctg

SEQ ID NO: 7153148 - DNA, 22 bp, Homo sapiens
gctgggccttccgattctcaag

SEQ ID NO: 7153149 - DNA, 22 bp, Homo sapiens
gctgggccgacctgggctgcag

SEQ ID NO: 7153150 - DNA, 22 bp, Homo sapiens
gctgggccctgggtgccctagc

SEQ ID NO: 7153151 - DNA, 22 bp, Homo sapiens
gctgggccgacctgggctgcag

SEQ ID NO: 7153152 - DNA, 22 bp, Homo sapiens
gctgggccgacctgggctgcag

SEQ ID NO: 7153153 - DNA, 22 bp, Homo sapiens
gctgggccgacctgggctgcag

SEQ ID NO: 7153154 - DNA, 22 bp, Homo sapiens
gctgggccctgggtgccctagc

SEQ ID NO: 7153155 - DNA, 22 bp, Homo sapiens
gctgggccccatccctcgagca

SEQ ID NO: 7153156 - DNA, 22 bp, Homo sapiens
gctgggccccttgaaaggcgtc

SEQ ID NO: 7153157 - DNA, 22 bp, Homo sapiens
gctgggccccatccctcgagca

SEQ ID NO: 7153158 - DNA, 22 bp, Homo sapiens
gctgggcccagatcccaggatc

SEQ ID NO: 7153159 - DNA, 22 bp, Homo sapiens
gctgggccccatccctcgagca

SEQ ID NO: 7153160 - DNA, 22 bp, Homo sapiens
gctgggcccagatcccaggatc

SEQ ID NO: 7153161 - DNA, 22 bp, Homo sapiens
gctgggcccagatcccaggatc

SEQ ID NO: 7153162 - DNA, 22 bp, Homo sapiens
gctgggccagagcagcagcact

SEQ ID NO: 7153163 - DNA, 22 bp, Homo sapiens
gctgggccagccagacatgtga

SEQ ID NO: 7153164 - DNA, 22 bp, Homo sapiens
gctgggccagccagacatgtga

SEQ ID NO: 7153165 - DNA, 22 bp, Homo sapiens
gctgggccagccagacatgtga

SEQ ID NO: 7153166 - DNA, 22 bp, Homo sapiens
gctgggccagccagacatgtga

SEQ ID NO: 7153167 - DNA, 22 bp, Homo sapiens
gctgggcccagatcccaggatc

SEQ ID NO: 7153168 - DNA, 22 bp, Homo sapiens
gctgggagccctggtctgctcc

SEQ ID NO: 7153169 - DNA, 22 bp, Homo sapiens
gctgggaggaatttggggaata

SEQ ID NO: 7153170 - DNA, 22 bp, Homo sapiens
gctgggaggaatttggggaata

SEQ ID NO: 7153171 - DNA, 22 bp, Homo sapiens
gctgggaggaatttggggaata

SEQ ID NO: 7153172 - DNA, 22 bp, Homo sapiens
gctgggaggaatttggggaata

SEQ ID NO: 7153173 - DNA, 22 bp, Homo sapiens
gctggaggctggagtgcagtgg

SEQ ID NO: 7153174 - DNA, 22 bp, Homo sapiens
gctggaggctggagtgcagtgg

SEQ ID NO: 7153175 - DNA, 16 bp, Homo sapiens
gctggagggaggggtt

SEQ ID NO: 7153176 - DNA, 16 bp, Homo sapiens
gctggagggaggggtt

SEQ ID NO: 7153177 - DNA, 22 bp, Homo sapiens
gctggcagagagctggtgagga

SEQ ID NO: 7153178 - DNA, 22 bp, Homo sapiens
gctggcagagagctggtgagga

SEQ ID NO: 7153179 - DNA, 19 bp, Homo sapiens
gctgaggtggaggaaggag

SEQ ID NO: 7153180 - DNA, 19 bp, Homo sapiens
gctgaggtggaggaaggag

SEQ ID NO: 7153181 - DNA, 20 bp, Homo sapiens
gctgaggtggaggaaggaga

SEQ ID NO: 7153182 - DNA, 19 bp, Homo sapiens
gctgaggtggaggaaggag

SEQ ID NO: 7153183 - DNA, 22 bp, Homo sapiens
gctgaggtggagattgcagtga

SEQ ID NO: 7153184 - DNA, 22 bp, Homo sapiens
gctggcagagagctggtgagga

SEQ ID NO: 7153185 - DNA, 22 bp, Homo sapiens
gctggcagagagctggtgagga

SEQ ID NO: 7153186 - DNA, 22 bp, Homo sapiens
gctggcagagagctggtgagga

SEQ ID NO: 7153187 - DNA, 22 bp, Homo sapiens
gctggcagagctctgggctggg

SEQ ID NO: 7153188 - DNA, 22 bp, Homo sapiens
gctggcagagctctgggctggg

SEQ ID NO: 7153189 - DNA, 22 bp, Homo sapiens
gctggcagagctctgggctggg

SEQ ID NO: 7153190 - DNA, 22 bp, Homo sapiens
gctggcagagctctgggctggg

SEQ ID NO: 7153191 - DNA, 22 bp, Homo sapiens
gctggcagagagctggtgagga

SEQ ID NO: 7153192 - DNA, 22 bp, Homo sapiens
gctggcagagctctgggctggg

SEQ ID NO: 7153193 - DNA, 22 bp, Homo sapiens
gctggcagagctctgggctggg

SEQ ID NO: 7153194 - DNA, 20 bp, Homo sapiens
gctggcagatgtcttgagat

SEQ ID NO: 7153195 - DNA, 20 bp, Homo sapiens
gctggcagatgtcttgagat

SEQ ID NO: 7153196 - DNA, 20 bp, Homo sapiens
gctggcagatgtcttgagat

SEQ ID NO: 7153197 - DNA, 22 bp, Homo sapiens
gctggcagcattagaccctggg

SEQ ID NO: 7153198 - DNA, 22 bp, Homo sapiens
gctggcagcattagaccctggg

SEQ ID NO: 7153199 - DNA, 19 bp, Homo sapiens
gctggcagatgtggccgtg

SEQ ID NO: 7153200 - DNA, 22 bp, Homo sapiens
gctggcagcattagaccctggg

SEQ ID NO: 7153201 - DNA, 22 bp, Homo sapiens
gctggcagcattagaccctggg

SEQ ID NO: 7153202 - DNA, 22 bp, Homo sapiens
gctggcagcattagaccctggg

SEQ ID NO: 7153203 - DNA, 19 bp, Homo sapiens
gctggcagatgtggccgtg

SEQ ID NO: 7153204 - DNA, 19 bp, Homo sapiens
gctggcagatgtggccgtg

SEQ ID NO: 7153205 - DNA, 19 bp, Homo sapiens
gctggcagatgtggccgtg

SEQ ID NO: 7153206 - DNA, 22 bp, Homo sapiens
gctggcagccaagtgaagaggg

SEQ ID NO: 7153207 - DNA, 22 bp, Homo sapiens
gctggccagtgtggtgaccacc

SEQ ID NO: 7153208 - DNA, 22 bp, Homo sapiens
gctggcagccaagtgaagaggg

SEQ ID NO: 7153209 - DNA, 22 bp, Homo sapiens
gctggcagccaagtgaagaggg

SEQ ID NO: 7153210 - DNA, 22 bp, Homo sapiens
gctggcagcattagaccctggg

SEQ ID NO: 7153211 - DNA, 22 bp, Homo sapiens
gctggcagcattagaccctggg

SEQ ID NO: 7153212 - DNA, 22 bp, Homo sapiens
gctgaggtcaggagctgtgggg

SEQ ID NO: 7153213 - DNA, 20 bp, Homo sapiens
gctgaggtcattatgcctca

SEQ ID NO: 7153214 - DNA, 22 bp, Homo sapiens
gctgaggtaggaggttgcagtg

SEQ ID NO: 7153215 - DNA, 22 bp, Homo sapiens
caaatttaggtaacagtctgta

SEQ ID NO: 7153216 - DNA, 22 bp, Homo sapiens
caaatttaggtaacagtctgta

SEQ ID NO: 7153217 - DNA, 22 bp, Homo sapiens
gctgaggtgaggctggaaagga

SEQ ID NO: 7153218 - DNA, 20 bp, Homo sapiens
gctgaggtccctgtggtttt

SEQ ID NO: 7153219 - DNA, 23 bp, Homo sapiens
gctgaggtcctgctgagtggtgg

SEQ ID NO: 7153220 - DNA, 20 bp, Homo sapiens
gctgaggtcattatgcctca

SEQ ID NO: 7153221 - DNA, 20 bp, Homo sapiens
gctgaggtccctgtggtttt

SEQ ID NO: 7153222 - DNA, 20 bp, Homo sapiens
gctgaggtccctgtggtttt

SEQ ID NO: 7153223 - DNA, 20 bp, Homo sapiens
gctgaggtccctgtggtttt

SEQ ID NO: 7153224 - DNA, 20 bp, Homo sapiens
caaattctgttgaatacacc

SEQ ID NO: 7153225 - DNA, 18 bp, Homo sapiens
caaattctcattgatttc

SEQ ID NO: 7153226 - DNA, 18 bp, Homo sapiens
caaattcagtgctggaag

SEQ ID NO: 7153227 - DNA, 18 bp, Homo sapiens
caaattcagtgctggaag

SEQ ID NO: 7153228 - DNA, 18 bp, Homo sapiens
caaattcagtgctggaag

SEQ ID NO: 7153229 - DNA, 22 bp, Homo sapiens
caaattgatctgtctttatgaa

SEQ ID NO: 7153230 - DNA, 22 bp, Homo sapiens
caaatttaagtgaggtctttgt

SEQ ID NO: 7153231 - DNA, 22 bp, Homo sapiens
caaatttaagtgaggtctttgt

SEQ ID NO: 7153232 - DNA, 22 bp, Homo sapiens
caaatttaagtgaggtctttgt

SEQ ID NO: 7153233 - DNA, 22 bp, Homo sapiens
caaatttaagtgaggtctttgt

SEQ ID NO: 7153234 - DNA, 22 bp, Homo sapiens
caaatttaagttagaaagcaat

SEQ ID NO: 7153235 - DNA, 22 bp, Homo sapiens
caaatttaagttagaaagcaat

SEQ ID NO: 7153236 - DNA, 22 bp, Homo sapiens
caaatttaagttagaaagcaat

SEQ ID NO: 7153237 - DNA, 22 bp, Homo sapiens
caaatttaagttagaaagcaat

SEQ ID NO: 7153238 - DNA, 22 bp, Homo sapiens
caaatttaggtaacagtctgta

SEQ ID NO: 7153239 - DNA, 22 bp, Homo sapiens
caaatttaggtaacagtctgta

SEQ ID NO: 7153240 - DNA, 22 bp, Homo sapiens
gcagaagggaataaggagcttt

SEQ ID NO: 7153241 - DNA, 22 bp, Homo sapiens
gcagaagggaataaggagcttt

SEQ ID NO: 7153242 - DNA, 22 bp, Homo sapiens
gcagaagggaataaggagcttt

SEQ ID NO: 7153243 - DNA, 22 bp, Homo sapiens
gcactgtgacccagagcaggtg

SEQ ID NO: 7153244 - DNA, 22 bp, Homo sapiens
gcactgtgacccagagcaggtg

SEQ ID NO: 7153245 - DNA, 22 bp, Homo sapiens
gcactgtgacccagagcaggtg

SEQ ID NO: 7153246 - DNA, 22 bp, Homo sapiens
gcactgtgatcaaggctaagca

SEQ ID NO: 7153247 - DNA, 22 bp, Homo sapiens
gcactgtgatcaaggctaagca

SEQ ID NO: 7153248 - DNA, 22 bp, Homo sapiens
gcagaagggaataaggagcttt

SEQ ID NO: 7153249 - DNA, 22 bp, Homo sapiens
gcagaaggtcaaagcaagatgt

SEQ ID NO: 7153250 - DNA, 22 bp, Homo sapiens
gcagaaggtctggcacttcagg

SEQ ID NO: 7153251 - DNA, 22 bp, Homo sapiens
gcagaaggtctggcacttcagg

SEQ ID NO: 7153252 - DNA, 22 bp, Homo sapiens
gcagaaggtctggcacttcagg

SEQ ID NO: 7153253 - DNA, 22 bp, Homo sapiens
gcagaaggttgtttgggaaagg

SEQ ID NO: 7153254 - DNA, 22 bp, Homo sapiens
gcagaagtaggctctgtgtagg

SEQ ID NO: 7153255 - DNA, 22 bp, Homo sapiens
gcagaagtcagaccatctgaat

SEQ ID NO: 7153256 - DNA, 22 bp, Homo sapiens
gcagaagtggattctacaattt

SEQ ID NO: 7153257 - DNA, 16 bp, Homo sapiens
gcagaggaaaggggag

SEQ ID NO: 7153258 - DNA, 16 bp, Homo sapiens
gcagaggaaaggggag

SEQ ID NO: 7153259 - DNA, 22 bp, Homo sapiens
gcagaattgaaatgtgtcactt

SEQ ID NO: 7153260 - DNA, 22 bp, Homo sapiens
gcagaattggatagttgtgata

SEQ ID NO: 7153261 - DNA, 16 bp, Homo sapiens
gcagaggaaaggggag

SEQ ID NO: 7153262 - DNA, 22 bp, Homo sapiens
gcagaggccatcaactttgcca

SEQ ID NO: 7153263 - DNA, 22 bp, Homo sapiens
gcagaggcctaggtggaaggcc

SEQ ID NO: 7153264 - DNA, 22 bp, Homo sapiens
gcagaatagggcataactttgc

SEQ ID NO: 7153265 - DNA, 22 bp, Homo sapiens
gcagaatattatggaaaaagta

SEQ ID NO: 7153266 - DNA, 22 bp, Homo sapiens
gcagaatgtaggccttcagtgt

SEQ ID NO: 7153267 - DNA, 22 bp, Homo sapiens
gcagaatgtccaagctgggccc

SEQ ID NO: 7153268 - DNA, 22 bp, Homo sapiens
gcagaatgtccaagctgggccc

SEQ ID NO: 7153269 - DNA, 22 bp, Homo sapiens
gcagaatgtcagtatggtcacc

SEQ ID NO: 7153270 - DNA, 22 bp, Homo sapiens
gcagaattccttcttccttggg

SEQ ID NO: 7153271 - DNA, 22 bp, Homo sapiens
gcagaggctgggtgtcccagtc

SEQ ID NO: 7153272 - DNA, 22 bp, Homo sapiens
gcagaggctgtagggaaggttg

SEQ ID NO: 7153273 - DNA, 22 bp, Homo sapiens
gcagaggctctttaatgcttag

SEQ ID NO: 7153274 - DNA, 22 bp, Homo sapiens
gcagaggctgggtgtcccagtc

SEQ ID NO: 7153275 - DNA, 22 bp, Homo sapiens
gcagaggctgggtgtcccagtc

SEQ ID NO: 7153276 - DNA, 22 bp, Homo sapiens
gcagaggcctaggtggaaggcc

SEQ ID NO: 7153277 - DNA, 22 bp, Homo sapiens
gcagaggcctgaaggtggcggg

SEQ ID NO: 7153278 - DNA, 22 bp, Homo sapiens
gcagaggcctgaaggtggcggg

SEQ ID NO: 7153279 - DNA, 22 bp, Homo sapiens
gcagaggcctgaaggtggcggg

SEQ ID NO: 7153280 - DNA, 22 bp, Homo sapiens
gcagaggcctgaaggtggcggg

SEQ ID NO: 7153281 - DNA, 22 bp, Homo sapiens
gcagaggctccattttacagat

SEQ ID NO: 7153282 - DNA, 22 bp, Homo sapiens
gcagaggctctttaatgcttag

SEQ ID NO: 7153283 - DNA, 22 bp, Homo sapiens
gcagaggggaagctgaggaatt

SEQ ID NO: 7153284 - DNA, 22 bp, Homo sapiens
gcagaggggaagctgaggaatt

SEQ ID NO: 7153285 - DNA, 22 bp, Homo sapiens
gcagagttctcttccagctaac

SEQ ID NO: 7153286 - DNA, 22 bp, Homo sapiens
gcagagtttctggcacattgga

SEQ ID NO: 7153287 - DNA, 22 bp, Homo sapiens
gcagagtttgaagtcaagatgt

SEQ ID NO: 7153288 - DNA, 22 bp, Homo sapiens
gcagaggctgtagggaaggttg

SEQ ID NO: 7153289 - DNA, 22 bp, Homo sapiens
gcagagggcaggggtgtttgtt

SEQ ID NO: 7153290 - DNA, 22 bp, Homo sapiens
gcagagggcaggggtgtttgtt

SEQ ID NO: 7153291 - DNA, 22 bp, Homo sapiens
gcagagggcaggggtgtttgtt

SEQ ID NO: 7153292 - DNA, 22 bp, Homo sapiens
gcagaggggaagctgaggaatt

SEQ ID NO: 7153293 - DNA, 22 bp, Homo sapiens
gcagaggggaagctgaggaatt

SEQ ID NO: 7153294 - DNA, 22 bp, Homo sapiens
gcagagtttgaagtcaagatgt

SEQ ID NO: 7153295 - DNA, 22 bp, Homo sapiens
gcagatagggtattaggagtaa

SEQ ID NO: 7153296 - DNA, 22 bp, Homo sapiens
gcagatagggtattaggagtaa

SEQ ID NO: 7153297 - DNA, 19 bp, Homo sapiens
gcagatgatgaggctggtc

SEQ ID NO: 7153298 - DNA, 22 bp, Homo sapiens
gcagcaggtccgcatcatcatc

SEQ ID NO: 7153299 - DNA, 22 bp, Homo sapiens
gcagccaggaagcctttccctc

SEQ ID NO: 7153300 - DNA, 21 bp, Homo sapiens
gcagccaggactttgggctgg

SEQ ID NO: 7153301 - DNA, 22 bp, Homo sapiens
gcagatgctgagatttatttct

SEQ ID NO: 7153302 - DNA, 22 bp, Homo sapiens
gcagatgctgctcctctctaga

SEQ ID NO: 7153303 - DNA, 19 bp, Homo sapiens
gcagatgatgaggctggtc

SEQ ID NO: 7153304 - DNA, 19 bp, Homo sapiens
gcagatgatgaggctggtc

SEQ ID NO: 7153305 - DNA, 22 bp, Homo sapiens
gcagccaggctacagcgggctt

SEQ ID NO: 7153306 - DNA, 22 bp, Homo sapiens
gcagccaggctacagcgggctt

SEQ ID NO: 7153307 - DNA, 22 bp, Homo sapiens
gcagccaggctacagcgggctt

SEQ ID NO: 7153308 - DNA, 22 bp, Homo sapiens
gcagccagggagagaaccaggg

SEQ ID NO: 7153309 - DNA, 22 bp, Homo sapiens
gcagccagggagagaaccaggg

SEQ ID NO: 7153310 - DNA, 22 bp, Homo sapiens
gcagccagggagagaaccaggg

SEQ ID NO: 7153311 - DNA, 22 bp, Homo sapiens
gcagccagggctaagctgggga

SEQ ID NO: 7153312 - DNA, 22 bp, Homo sapiens
gcagccagggagagaaccaggg

SEQ ID NO: 7153313 - DNA, 22 bp, Homo sapiens
gcagccagggagagaaccaggg

SEQ ID NO: 7153314 - DNA, 22 bp, Homo sapiens
gcagccagggctaagctgggga

SEQ ID NO: 7153315 - DNA, 22 bp, Homo sapiens
gcagccaggtttgaggaccact

SEQ ID NO: 7153316 - DNA, 19 bp, Homo sapiens
gcagccaggtgctctacct

SEQ ID NO: 7153317 - DNA, 22 bp, Homo sapiens
gcagccaggtttgaggaccact

SEQ ID NO: 7153318 - DNA, 22 bp, Homo sapiens
gcagccaggtttgaggaccact

SEQ ID NO: 7153319 - DNA, 19 bp, Homo sapiens
gcagccaggtgctctacct

SEQ ID NO: 7153320 - DNA, 19 bp, Homo sapiens
gcagccaggtgctctacct

SEQ ID NO: 7153321 - DNA, 19 bp, Homo sapiens
gcagccaggtgctctacct

SEQ ID NO: 7153322 - DNA, 19 bp, Homo sapiens
gcagccaggtgctctacct

SEQ ID NO: 7153323 - DNA, 22 bp, Homo sapiens
gcagccagggttaattatattt

SEQ ID NO: 7153324 - DNA, 19 bp, Homo sapiens
gcagccaggtgctctacct

SEQ ID NO: 7153325 - DNA, 22 bp, Homo sapiens
gcagccaggggctgtgacctgt

SEQ ID NO: 7153326 - DNA, 22 bp, Homo sapiens
gcagccaggggctgtgacctgt

SEQ ID NO: 7153327 - DNA, 22 bp, Homo sapiens
gcagccaggggctgtgacctgt

SEQ ID NO: 7153328 - DNA, 22 bp, Homo sapiens
gcagccaggggctgtgacctgt

SEQ ID NO: 7153329 - DNA, 22 bp, Homo sapiens
gcaggagagtctgtgccaggtt

SEQ ID NO: 7153330 - DNA, 18 bp, Homo sapiens
gcaggagatgggtggggt

SEQ ID NO: 7153331 - DNA, 22 bp, Homo sapiens
gcaggagagtctgtgccaggtt

SEQ ID NO: 7153332 - DNA, 22 bp, Homo sapiens
gcaggagagtctgtgccaggtt

SEQ ID NO: 7153333 - DNA, 22 bp, Homo sapiens
gcaggagagccagcaggcttcc

SEQ ID NO: 7153334 - DNA, 22 bp, Homo sapiens
gcagctttctaagctttattgc

SEQ ID NO: 7153335 - DNA, 22 bp, Homo sapiens
gcagctttaaacattggaaata

SEQ ID NO: 7153336 - DNA, 22 bp, Homo sapiens
gcagctttaaaggaggctctga

SEQ ID NO: 7153337 - DNA, 22 bp, Homo sapiens
gcagctttaaaggaggctctga

SEQ ID NO: 7153338 - DNA, 22 bp, Homo sapiens
gcagctttaaaggaggctctga

SEQ ID NO: 7153339 - DNA, 22 bp, Homo sapiens
gcagccttatcattagagtgtt

SEQ ID NO: 7153340 - DNA, 22 bp, Homo sapiens
gcagccttcagtttggcaggag

SEQ ID NO: 7153341 - DNA, 22 bp, Homo sapiens
gcagccttcctgacctctaccc

SEQ ID NO: 7153342 - DNA, 22 bp, Homo sapiens
gcagccttcctgacctctaccc

SEQ ID NO: 7153343 - DNA, 22 bp, Homo sapiens
gcagccttctactgaatcctct

SEQ ID NO: 7153344 - DNA, 22 bp, Homo sapiens
gcagccaggtttgaggaccact

SEQ ID NO: 7153345 - DNA, 17 bp, Homo sapiens
gcagcctcttggtagtg

SEQ ID NO: 7153346 - DNA, 17 bp, Homo sapiens
gcagcctcttggtagtg

SEQ ID NO: 7153347 - DNA, 22 bp, Homo sapiens
gcagcctgaggccctttctggc

SEQ ID NO: 7153348 - DNA, 22 bp, Homo sapiens
gcagcctgaggccctttctggc

SEQ ID NO: 7153349 - DNA, 22 bp, Homo sapiens
gcagcctgatgatctgggttgt

SEQ ID NO: 7153350 - DNA, 22 bp, Homo sapiens
gcagcctgatgatctgggttgt

SEQ ID NO: 7153351 - DNA, 22 bp, Homo sapiens
gcagcctgggcaacagagtgag

SEQ ID NO: 7153352 - DNA, 22 bp, Homo sapiens
gcagcctgggcaacagagtgag

SEQ ID NO: 7153353 - DNA, 22 bp, Homo sapiens
gcagcctgggcaacagagtgag

SEQ ID NO: 7153354 - DNA, 22 bp, Homo sapiens
gcagcctgggcaacagagtgag

SEQ ID NO: 7153355 - DNA, 22 bp, Homo sapiens
gcagcctgggcaacagagtgag

SEQ ID NO: 7153356 - DNA, 22 bp, Homo sapiens
gcagcctgggcaacagagtgag

SEQ ID NO: 7153357 - DNA, 22 bp, Homo sapiens
gcagcctgggcaacagagtgag

SEQ ID NO: 7153358 - DNA, 22 bp, Homo sapiens
gcagcctgttgtaccagcctgt

SEQ ID NO: 7153359 - DNA, 22 bp, Homo sapiens
gcagcctgttgtaccagcctgt

SEQ ID NO: 7153360 - DNA, 22 bp, Homo sapiens
gcagcctgttgtaccagcctgt

SEQ ID NO: 7153361 - DNA, 22 bp, Homo sapiens
gcagcctgttgtaccagcctgt

SEQ ID NO: 7153362 - DNA, 18 bp, Homo sapiens
gcacagagcaagtttcat

SEQ ID NO: 7153363 - DNA, 18 bp, Homo sapiens
gcacagagcaagtttcat

SEQ ID NO: 7153364 - DNA, 20 bp, Homo sapiens
gcacagagatgagcaaagta

SEQ ID NO: 7153365 - DNA, 18 bp, Homo sapiens
gcacagagcaagtttcat

SEQ ID NO: 7153366 - DNA, 23 bp, Homo sapiens
gcacagagcagttaggggaagat

SEQ ID NO: 7153367 - DNA, 23 bp, Homo sapiens
gcacagagcagttaggggaagat

SEQ ID NO: 7153368 - DNA, 23 bp, Homo sapiens
gcacagagcagttaggggaagat

SEQ ID NO: 7153369 - DNA, 18 bp, Homo sapiens
gcacagagcccaggctct

SEQ ID NO: 7153370 - DNA, 18 bp, Homo sapiens
gcacagagcccaggctct

SEQ ID NO: 7153371 - DNA, 22 bp, Homo sapiens
gcacagaggaagcacagactct

SEQ ID NO: 7153372 - DNA, 22 bp, Homo sapiens
gcacagaggaagcacagactct

SEQ ID NO: 7153373 - DNA, 22 bp, Homo sapiens
gcacagagctggccctccaggc

SEQ ID NO: 7153374 - DNA, 22 bp, Homo sapiens
gcacagagcttgtttacatttg

SEQ ID NO: 7153375 - DNA, 22 bp, Homo sapiens
gcacagaggaagcacagactct

SEQ ID NO: 7153376 - DNA, 22 bp, Homo sapiens
gcacagagcctggtaccgagaa

SEQ ID NO: 7153377 - DNA, 22 bp, Homo sapiens
gcacagagcctggtaccgagaa

SEQ ID NO: 7153378 - DNA, 22 bp, Homo sapiens
gcacagagctggccctccaggc

SEQ ID NO: 7153379 - DNA, 22 bp, Homo sapiens
gcacagagctggccctccaggc

SEQ ID NO: 7153380 - DNA, 22 bp, Homo sapiens
gcacagagctggccctccaggc

SEQ ID NO: 7153381 - DNA, 22 bp, Homo sapiens
gcacaggctgttggccttcaga

SEQ ID NO: 7153382 - DNA, 22 bp, Homo sapiens
gcacaggctgttggccttcaga

SEQ ID NO: 7153383 - DNA, 22 bp, Homo sapiens
gcacaggctgttggccttcaga

SEQ ID NO: 7153384 - DNA, 17 bp, Homo sapiens
gcacagaggccaaagga

SEQ ID NO: 7153385 - DNA, 17 bp, Homo sapiens
gcacagaggccaaagga

SEQ ID NO: 7153386 - DNA, 17 bp, Homo sapiens
gcacagaggccaaagga

SEQ ID NO: 7153387 - DNA, 22 bp, Homo sapiens
gcacagaggatgaggcagctct

SEQ ID NO: 7153388 - DNA, 22 bp, Homo sapiens
gcacagaggatgaggcagctct

SEQ ID NO: 7153389 - DNA, 22 bp, Homo sapiens
gcacagaggatgaggcagctct

SEQ ID NO: 7153390 - DNA, 21 bp, Homo sapiens
gcacagggacagatcatcaca

SEQ ID NO: 7153391 - DNA, 22 bp, Homo sapiens
gcacagggagacagccgtggcc

SEQ ID NO: 7153392 - DNA, 22 bp, Homo sapiens
gcacagggagacagccgtggcc

SEQ ID NO: 7153393 - DNA, 22 bp, Homo sapiens
gcacagggagcaggtctctggt

SEQ ID NO: 7153394 - DNA, 22 bp, Homo sapiens
gcacagggagcaggtctctggt

SEQ ID NO: 7153395 - DNA, 22 bp, Homo sapiens
gcacagggagacagccgtggcc

SEQ ID NO: 7153396 - DNA, 22 bp, Homo sapiens
gcactgtgacagcaagagtgag

SEQ ID NO: 7153397 - DNA, 22 bp, Homo sapiens
gcactgtgacagcaagagtgag

SEQ ID NO: 7153398 - DNA, 22 bp, Homo sapiens
gcactggtttatttaagaacaa

SEQ ID NO: 7153399 - DNA, 22 bp, Homo sapiens
gcactgtagtgggggagaaatg

SEQ ID NO: 7153400 - DNA, 22 bp, Homo sapiens
gcactgtagtgggggagaaatg

SEQ ID NO: 7153401 - DNA, 22 bp, Homo sapiens
gcactggtatcacctgagagct

SEQ ID NO: 7153402 - DNA, 22 bp, Homo sapiens
gcactggtcagcatgtttcgca

SEQ ID NO: 7153403 - DNA, 20 bp, Homo sapiens
gcactggtctggatctcctg

SEQ ID NO: 7153404 - DNA, 22 bp, Homo sapiens
gcactggtcttcccagcgaact

SEQ ID NO: 7153405 - DNA, 22 bp, Homo sapiens
gcactggtgtgaaacagtagat

SEQ ID NO: 7153406 - DNA, 22 bp, Homo sapiens
gcactggtgtgttagtaaggga

SEQ ID NO: 7153407 - DNA, 22 bp, Homo sapiens
gcactggttaccctgagtggct

SEQ ID NO: 7153408 - DNA, 22 bp, Homo sapiens
gcactgggggcagcagtgaggg

SEQ ID NO: 7153409 - DNA, 22 bp, Homo sapiens
gcactggggtcatagcctccag

SEQ ID NO: 7153410 - DNA, 22 bp, Homo sapiens
gcactggggtcatagcctccag

SEQ ID NO: 7153411 - DNA, 22 bp, Homo sapiens
gcactgggtgggagatctgaat

SEQ ID NO: 7153412 - DNA, 22 bp, Homo sapiens
gcactgggtgggagatctgaat

SEQ ID NO: 7153413 - DNA, 22 bp, Homo sapiens
gcactgggtgtgaggcagcgtc

SEQ ID NO: 7153414 - DNA, 22 bp, Homo sapiens
gcactgggtgtgaggcagcgtc

SEQ ID NO: 7153415 - DNA, 22 bp, Homo sapiens
gcactgggtgtgaggcagcgtc

SEQ ID NO: 7153416 - DNA, 22 bp, Homo sapiens
gcactgggtgtgaggcagcgtc

SEQ ID NO: 7153417 - DNA, 22 bp, Homo sapiens
gcactcagtaccaggtcactgc

SEQ ID NO: 7153418 - DNA, 22 bp, Homo sapiens
gcactcagtaccaggtcactgc

SEQ ID NO: 7153419 - DNA, 21 bp, Homo sapiens
gcactcagtcactactcaaga

SEQ ID NO: 7153420 - DNA, 23 bp, Homo sapiens
gcactgggctctcagcaaggtgt

SEQ ID NO: 7153421 - DNA, 22 bp, Homo sapiens
gcactgggggcagcagtgaggg

SEQ ID NO: 7153422 - DNA, 22 bp, Homo sapiens
gcactgggggcagcagtgaggg

SEQ ID NO: 7153423 - DNA, 22 bp, Homo sapiens
gcactgggggcagcagtgaggg

SEQ ID NO: 7153424 - DNA, 22 bp, Homo sapiens
gcacagggccctgtgcgtaggt

SEQ ID NO: 7153425 - DNA, 22 bp, Homo sapiens
gcacagggcaacaggtctgtta

SEQ ID NO: 7153426 - DNA, 22 bp, Homo sapiens
gcacagggcaacaggtctgtta

SEQ ID NO: 7153427 - DNA, 22 bp, Homo sapiens
gcacagggcaacaggtctgtta

SEQ ID NO: 7153428 - DNA, 22 bp, Homo sapiens
gcacagggccctgtgcgtaggt

SEQ ID NO: 7153429 - DNA, 22 bp, Homo sapiens
gcacagggagcaggtctctggt

SEQ ID NO: 7153430 - DNA, 22 bp, Homo sapiens
gcacagggagcaggtctctggt

SEQ ID NO: 7153431 - DNA, 22 bp, Homo sapiens
gcacagggagcaggtctctggt

SEQ ID NO: 7153432 - DNA, 22 bp, Homo sapiens
gcacagggaggctggcctggcc

SEQ ID NO: 7153433 - DNA, 20 bp, Homo sapiens
gcaaatggacactcagggaa

SEQ ID NO: 7153434 - DNA, 22 bp, Homo sapiens
gcaaatggagtgaagagctgga

SEQ ID NO: 7153435 - DNA, 22 bp, Homo sapiens
gcaaatggagtgaagagctgga

SEQ ID NO: 7153436 - DNA, 20 bp, Homo sapiens
gcaaatggatcccacaagcc

SEQ ID NO: 7153437 - DNA, 20 bp, Homo sapiens
gcaaatggatcccacaagcc

SEQ ID NO: 7153438 - DNA, 22 bp, Homo sapiens
gcaaacaagctgcctgaagatt

SEQ ID NO: 7153439 - DNA, 22 bp, Homo sapiens
gcaacactttgcaggcgggcag

SEQ ID NO: 7153440 - DNA, 22 bp, Homo sapiens
gcaacaagtgtaaacatgcatt

SEQ ID NO: 7153441 - DNA, 22 bp, Homo sapiens
gcaacacagatcttctttgttg

SEQ ID NO: 7153442 - DNA, 22 bp, Homo sapiens
gcaaattgaatccagtaataaa

SEQ ID NO: 7153443 - DNA, 22 bp, Homo sapiens
gcaaattgggctgactcaaggt

SEQ ID NO: 7153444 - DNA, 22 bp, Homo sapiens
gcaaatgtttttgagtgtttac

SEQ ID NO: 7153445 - DNA, 22 bp, Homo sapiens
gcaaattaaccaatcatgctcg

SEQ ID NO: 7153446 - DNA, 22 bp, Homo sapiens
gcaactgaacatgtgtgtggcc

SEQ ID NO: 7153447 - DNA, 22 bp, Homo sapiens
gcaactgaacatgtgtgtggcc

SEQ ID NO: 7153448 - DNA, 22 bp, Homo sapiens
gcaactgaacatgtgtgtggcc

SEQ ID NO: 7153449 - DNA, 22 bp, Homo sapiens
gcaactgaacatgtgtgtggcc

SEQ ID NO: 7153450 - DNA, 22 bp, Homo sapiens
gcaactgtgatttgttatcttg

SEQ ID NO: 7153451 - DNA, 22 bp, Homo sapiens
gcacacagggatttttgaatgg

SEQ ID NO: 7153452 - DNA, 22 bp, Homo sapiens
gcacacaggggagttctcagaa

SEQ ID NO: 7153453 - DNA, 22 bp, Homo sapiens
gcacacaggggagttctcagaa

SEQ ID NO: 7153454 - DNA, 23 bp, Homo sapiens
gcaacagagaagtaggagatggc

SEQ ID NO: 7153455 - DNA, 23 bp, Homo sapiens
gcaacagagaagtaggagatggc

SEQ ID NO: 7153456 - DNA, 18 bp, Homo sapiens
gcaacagatcaacagaaa

SEQ ID NO: 7153457 - DNA, 22 bp, Homo sapiens
gcaacagcattctcattgacat

SEQ ID NO: 7153458 - DNA, 22 bp, Homo sapiens
gcaacagcccaggttctgtgtg

SEQ ID NO: 7153459 - DNA, 22 bp, Homo sapiens
gcaacaggcagtttgctcatgt

SEQ ID NO: 7153460 - DNA, 22 bp, Homo sapiens
gcaacaggcagtttgctcatgt

SEQ ID NO: 7153461 - DNA, 22 bp, Homo sapiens
gcaacattcatgttctgtaacc

SEQ ID NO: 7153462 - DNA, 22 bp, Homo sapiens
atgtttctacagcgtccactga

SEQ ID NO: 7153463 - DNA, 22 bp, Homo sapiens
atgtttctaaaacttgcatggc

SEQ ID NO: 7153464 - DNA, 22 bp, Homo sapiens
atgtttctcactgtttctctat

SEQ ID NO: 7153465 - DNA, 22 bp, Homo sapiens
atgtttctagttgtatgtcact

SEQ ID NO: 7153466 - DNA, 22 bp, Homo sapiens
gcaaaaaatgcttgttgcttag

SEQ ID NO: 7153467 - DNA, 22 bp, Homo sapiens
gcaaaaaccacaattactttta

SEQ ID NO: 7153468 - DNA, 22 bp, Homo sapiens
gcaaaaaccacaattactttta

SEQ ID NO: 7153469 - DNA, 22 bp, Homo sapiens
gcaaaaaccacaattacttttg

SEQ ID NO: 7153470 - DNA, 22 bp, Homo sapiens
gcaaaaaccacaattacttttg

SEQ ID NO: 7153471 - DNA, 20 bp, Homo sapiens
gcaaaataggctctgttggt

SEQ ID NO: 7153472 - DNA, 22 bp, Homo sapiens
gcaaaatgatcttcttcaggct

SEQ ID NO: 7153473 - DNA, 22 bp, Homo sapiens
gcaaaatgatcttcttcaggct

SEQ ID NO: 7153474 - DNA, 20 bp, Homo sapiens
gcaaaataggctctgttggt

SEQ ID NO: 7153475 - DNA, 20 bp, Homo sapiens
gcaaaataggctctgttggt

SEQ ID NO: 7153476 - DNA, 22 bp, Homo sapiens
gcaaaacagtcgatgcctccca

SEQ ID NO: 7153477 - DNA, 22 bp, Homo sapiens
gcaaaactcgcaattacttttg

SEQ ID NO: 7153478 - DNA, 22 bp, Homo sapiens
gcaaaactcgcaattacttttg

SEQ ID NO: 7153479 - DNA, 22 bp, Homo sapiens
gcaaaactcggacatctaatct

SEQ ID NO: 7153480 - DNA, 22 bp, Homo sapiens
gcaaaactcggacatctaatct

SEQ ID NO: 7153481 - DNA, 22 bp, Homo sapiens
gcaaaaattccagggacgactc

SEQ ID NO: 7153482 - DNA, 22 bp, Homo sapiens
gcaaaaattccagggacgactc

SEQ ID NO: 7153483 - DNA, 22 bp, Homo sapiens
gcaaaaactgcaattacttttg

SEQ ID NO: 7153484 - DNA, 22 bp, Homo sapiens
gcaaaaactgcaattacttttg

SEQ ID NO: 7153485 - DNA, 22 bp, Homo sapiens
gcaaaaattccagggacgactc

SEQ ID NO: 7153486 - DNA, 22 bp, Homo sapiens
gcaaaacagtcgatgcctccca

SEQ ID NO: 7153487 - DNA, 22 bp, Homo sapiens
gcaaaacagtcgatgcctccca

SEQ ID NO: 7153488 - DNA, 22 bp, Homo sapiens
gcagggaggaagagatgcttcc

SEQ ID NO: 7153489 - DNA, 22 bp, Homo sapiens
gcagggaggaagagatgcttcc

SEQ ID NO: 7153490 - DNA, 22 bp, Homo sapiens
gcagggactttggcaacaggtg

SEQ ID NO: 7153491 - DNA, 22 bp, Homo sapiens
gcagggactttggcaacaggtg

SEQ ID NO: 7153492 - DNA, 22 bp, Homo sapiens
gcagggaggaagagatgcttcc

SEQ ID NO: 7153493 - DNA, 22 bp, Homo sapiens
gcagggagggcctttcatgaca

SEQ ID NO: 7153494 - DNA, 22 bp, Homo sapiens
gcagggagggcctttcatgaca

SEQ ID NO: 7153495 - DNA, 22 bp, Homo sapiens
gcagggaggtttgctgacctgg

SEQ ID NO: 7153496 - DNA, 22 bp, Homo sapiens
gcaggctgtggtatgttgggca

SEQ ID NO: 7153497 - DNA, 22 bp, Homo sapiens
gcagggacgccagggacagcaa

SEQ ID NO: 7153498 - DNA, 22 bp, Homo sapiens
gcagggacgccagggacagcaa

SEQ ID NO: 7153499 - DNA, 22 bp, Homo sapiens
gcagggacgccagggacagcaa

SEQ ID NO: 7153500 - DNA, 22 bp, Homo sapiens
gcagggactgtgatctcacaga

SEQ ID NO: 7153501 - DNA, 22 bp, Homo sapiens
gcagggactgtgatctcacaga

SEQ ID NO: 7153502 - DNA, 22 bp, Homo sapiens
gcagggactgtgatctcacaga

SEQ ID NO: 7153503 - DNA, 22 bp, Homo sapiens
gcagggactttggcaacaggtg

SEQ ID NO: 7153504 - DNA, 22 bp, Homo sapiens
gcagggactttggcaacaggtg

SEQ ID NO: 7153505 - DNA, 22 bp, Homo sapiens
gcaggctgtgaggctcagatgg

SEQ ID NO: 7153506 - DNA, 22 bp, Homo sapiens
gcaggctgtggtatgttgggca

SEQ ID NO: 7153507 - DNA, 22 bp, Homo sapiens
gcaggctgtggtatgttgggca

SEQ ID NO: 7153508 - DNA, 22 bp, Homo sapiens
gcaggctgtgaggctcagatgg

SEQ ID NO: 7153509 - DNA, 22 bp, Homo sapiens
gcaggctgtgaggctcagatgg

SEQ ID NO: 7153510 - DNA, 22 bp, Homo sapiens
gcaggctgtgaggctcagatgg

SEQ ID NO: 7153511 - DNA, 22 bp, Homo sapiens
gcaggctgtgaggctcagatgg

SEQ ID NO: 7153512 - DNA, 22 bp, Homo sapiens
gcaggctgtctaaagttagagt

SEQ ID NO: 7153513 - DNA, 22 bp, Homo sapiens
gcaggctgtctaaagttagagt

SEQ ID NO: 7153514 - DNA, 22 bp, Homo sapiens
gcaggctgtctaaagttagagt

SEQ ID NO: 7153515 - DNA, 22 bp, Homo sapiens
gcaggctgtagacaccaaacta

SEQ ID NO: 7153516 - DNA, 22 bp, Homo sapiens
gcaggctgtctaaagttagagt

SEQ ID NO: 7153517 - DNA, 22 bp, Homo sapiens
gcaggctgtctaaagttagagt

SEQ ID NO: 7153518 - DNA, 22 bp, Homo sapiens
gcaggctgtctaaagttagagt

SEQ ID NO: 7153519 - DNA, 22 bp, Homo sapiens
gcaggctgtagacaccaaacta

SEQ ID NO: 7153520 - DNA, 22 bp, Homo sapiens
gcaggctagggagctgcagtcc

SEQ ID NO: 7153521 - DNA, 22 bp, Homo sapiens
gcaggctagggagctgcagtcc

SEQ ID NO: 7153522 - DNA, 22 bp, Homo sapiens
gcaggctggtctgaccatccct

SEQ ID NO: 7153523 - DNA, 22 bp, Homo sapiens
gcaggctggtctgaccatccct

SEQ ID NO: 7153524 - DNA, 22 bp, Homo sapiens
gcaggatgaactaacacctgca

SEQ ID NO: 7153525 - DNA, 22 bp, Homo sapiens
gcaggatgaactaacacctgca

SEQ ID NO: 7153526 - DNA, 22 bp, Homo sapiens
gcaggatgaactaacacctgca

SEQ ID NO: 7153527 - DNA, 22 bp, Homo sapiens
gcaggagcagtcaggggcagct

SEQ ID NO: 7153528 - DNA, 22 bp, Homo sapiens
gcaggagcagtcaggggcagct

SEQ ID NO: 7153529 - DNA, 22 bp, Homo sapiens
gcaggagccacttcagggatgc

SEQ ID NO: 7153530 - DNA, 18 bp, Homo sapiens
gcaggagatgggtggggt

SEQ ID NO: 7153531 - DNA, 18 bp, Homo sapiens
gcaggagatgggtggggt

SEQ ID NO: 7153532 - DNA, 18 bp, Homo sapiens
gcaggagatgggtggggt

SEQ ID NO: 7153533 - DNA, 22 bp, Homo sapiens
gcaggagcaaactgcagtgtgg

SEQ ID NO: 7153534 - DNA, 22 bp, Homo sapiens
gcaggagcaaactgcagtgtgg

SEQ ID NO: 7153535 - DNA, 22 bp, Homo sapiens
gcaggagcaaactgcagtgtgg

SEQ ID NO: 7153536 - DNA, 22 bp, Homo sapiens
gcaggagcagtcaggggcagct

SEQ ID NO: 7153537 - DNA, 22 bp, Homo sapiens
gcaggagcagtcaggggcagct

SEQ ID NO: 7153538 - DNA, 22 bp, Homo sapiens
gcaggagcaatggcctatcaga

SEQ ID NO: 7153539 - DNA, 22 bp, Homo sapiens
gcaggattgggctgaaggagtg

SEQ ID NO: 7153540 - DNA, 22 bp, Homo sapiens
gcaggattgggcagagggtgaa

SEQ ID NO: 7153541 - DNA, 22 bp, Homo sapiens
gcaggctaactcataggctgtg

SEQ ID NO: 7153542 - DNA, 22 bp, Homo sapiens
gcaggatgggtgtagcccagca

SEQ ID NO: 7153543 - DNA, 22 bp, Homo sapiens
gcaggatgggtgtagcccagca

SEQ ID NO: 7153544 - DNA, 22 bp, Homo sapiens
gcaggatgggtgtagcccagca

SEQ ID NO: 7153545 - DNA, 22 bp, Homo sapiens
gcaggatggtgccctttctgcc

SEQ ID NO: 7153546 - DNA, 22 bp, Homo sapiens
gcaggatggtggaaggcctgct

SEQ ID NO: 7153547 - DNA, 22 bp, Homo sapiens
gcaggatggtggaaggcctgct

SEQ ID NO: 7153548 - DNA, 22 bp, Homo sapiens
gcaggatgaaggcagaggctga

SEQ ID NO: 7153549 - DNA, 22 bp, Homo sapiens
gcaggatgaaggcagaggctga

SEQ ID NO: 7153550 - DNA, 22 bp, Homo sapiens
gcaggatgagtgagtacattta

SEQ ID NO: 7153551 - DNA, 22 bp, Homo sapiens
gcaggatgcaacagcttgtagt

SEQ ID NO: 7153552 - DNA, 21 bp, Homo sapiens
gcaggatgcatcttggtgtct

SEQ ID NO: 7153553 - DNA, 22 bp, Homo sapiens
gcaggatgccagggcagcagcg

SEQ ID NO: 7153554 - DNA, 22 bp, Homo sapiens
gcaggatgccagggcagcagcg

SEQ ID NO: 7153555 - DNA, 22 bp, Homo sapiens
gcaggatgggagcttcactctg

SEQ ID NO: 7153556 - DNA, 22 bp, Homo sapiens
gcaggatgggagcttcactttg

SEQ ID NO: 7153557 - DNA, 22 bp, Homo sapiens
gcaggtggatcacctgaggtca

SEQ ID NO: 7153558 - DNA, 16 bp, Homo sapiens
gcaggtggatcacctg

SEQ ID NO: 7153559 - DNA, 22 bp, Homo sapiens
gcaggtggatcaccacgtcagg

SEQ ID NO: 7153560 - DNA, 22 bp, Homo sapiens
gcaggtggatcacctgaggtca

SEQ ID NO: 7153561 - DNA, 22 bp, Homo sapiens
gcaggtggatcacctgaggtca

SEQ ID NO: 7153562 - DNA, 22 bp, Homo sapiens
gcaggtggatcacctgaggtca

SEQ ID NO: 7153563 - DNA, 22 bp, Homo sapiens
gcaggtggatcacctgaggtca

SEQ ID NO: 7153564 - DNA, 14 bp, Homo sapiens
gcaggtggatcact

SEQ ID NO: 7153565 - DNA, 22 bp, Homo sapiens
gcaggtggatcacctgaggtca

SEQ ID NO: 7153566 - DNA, 15 bp, Homo sapiens
gcaggtggatcactt

SEQ ID NO: 7153567 - DNA, 22 bp, Homo sapiens
gcaggtggatcaccacgtcagg

SEQ ID NO: 7153568 - DNA, 22 bp, Homo sapiens
gcaggtggatattgctacttga

SEQ ID NO: 7153569 - DNA, 22 bp, Homo sapiens
gcaggtggatattgctacttga

SEQ ID NO: 7153570 - DNA, 14 bp, Homo sapiens
gcaggtggatcacc

SEQ ID NO: 7153571 - DNA, 22 bp, Homo sapiens
gcaggtggatcaccacgtcagg

SEQ ID NO: 7153572 - DNA, 22 bp, Homo sapiens
gcaggtggatcaccacgtcagg

SEQ ID NO: 7153573 - DNA, 22 bp, Homo sapiens
gcaggtggatattgctacttga

SEQ ID NO: 7153574 - DNA, 22 bp, Homo sapiens
gcaggtggatattgctacttga

SEQ ID NO: 7153575 - DNA, 22 bp, Homo sapiens
gcaggtggatattgctacttga

SEQ ID NO: 7153576 - DNA, 22 bp, Homo sapiens
attggcagttggctgtggttca

SEQ ID NO: 7153577 - DNA, 22 bp, Homo sapiens
attggcaggaaccgaggagggg

SEQ ID NO: 7153578 - DNA, 22 bp, Homo sapiens
attggcagggccagcatctccc

SEQ ID NO: 7153579 - DNA, 22 bp, Homo sapiens
attggtggtgaggacatgccag

SEQ ID NO: 7153580 - DNA, 22 bp, Homo sapiens
attggtggtgaggacatgccag

SEQ ID NO: 7153581 - DNA, 22 bp, Homo sapiens
attggttaagacgcatcatgct

SEQ ID NO: 7153582 - DNA, 22 bp, Homo sapiens
attggttactcaatttgactga

SEQ ID NO: 7153583 - DNA, 22 bp, Homo sapiens
attgtaaatagtgccacaataa

SEQ ID NO: 7153584 - DNA, 22 bp, Homo sapiens
attgtaaatagtgccacaataa

SEQ ID NO: 7153585 - DNA, 22 bp, Homo sapiens
attgtaaatagtgccacaataa

SEQ ID NO: 7153586 - DNA, 22 bp, Homo sapiens
attgtaaatagtgccacaataa

SEQ ID NO: 7153587 - DNA, 22 bp, Homo sapiens
attgtaaatagtgccacaataa

SEQ ID NO: 7153588 - DNA, 22 bp, Homo sapiens
attgtaaagtactgtgtacaat

SEQ ID NO: 7153589 - DNA, 22 bp, Homo sapiens
attgtaaaagtattctaagatt

SEQ ID NO: 7153590 - DNA, 22 bp, Homo sapiens
attgtaaagtactgtgtacaat

SEQ ID NO: 7153591 - DNA, 22 bp, Homo sapiens
gcagggaggtttgctgacctgg

SEQ ID NO: 7153592 - DNA, 22 bp, Homo sapiens
gcagggaggtttgctgacctgg

SEQ ID NO: 7153593 - DNA, 22 bp, Homo sapiens
gcagggatgctgaggctcagtg

SEQ ID NO: 7153594 - DNA, 22 bp, Homo sapiens
gcagggattgtcaatgctgctc

SEQ ID NO: 7153595 - DNA, 22 bp, Homo sapiens
gcagggattgtgcagggggcta

SEQ ID NO: 7153596 - DNA, 22 bp, Homo sapiens
gcagggattgtgcagggggcta

SEQ ID NO: 7153597 - DNA, 22 bp, Homo sapiens
gcagggctgggatttgagccca

SEQ ID NO: 7153598 - DNA, 22 bp, Homo sapiens
gcagggctgggatttgagccca

SEQ ID NO: 7153599 - DNA, 22 bp, Homo sapiens
gcagggctggggctgctcctga

SEQ ID NO: 7153600 - DNA, 22 bp, Homo sapiens
gcaggggtagagattgctggtg

SEQ ID NO: 7153601 - DNA, 22 bp, Homo sapiens
gcaggggtagagattgctggtg

SEQ ID NO: 7153602 - DNA, 16 bp, Homo sapiens
gcaggggtgggtggag

SEQ ID NO: 7153603 - DNA, 16 bp, Homo sapiens
gcaggggtgggtggag

SEQ ID NO: 7153604 - DNA, 16 bp, Homo sapiens
gcaggggtgggtggag

SEQ ID NO: 7153605 - DNA, 22 bp, Homo sapiens
gcaggggtagtgtcttcctgag

SEQ ID NO: 7153606 - DNA, 22 bp, Homo sapiens
gcaggggtggaggctgtcctgt

SEQ ID NO: 7153607 - DNA, 22 bp, Homo sapiens
gcaggggtggaggctgtcctgt

SEQ ID NO: 7153608 - DNA, 22 bp, Homo sapiens
gcaggggttttctgacttgagt

SEQ ID NO: 7153609 - DNA, 22 bp, Homo sapiens
gcagggtacattgggatgggat

SEQ ID NO: 7153610 - DNA, 22 bp, Homo sapiens
gcagggtacattgggatgggat

SEQ ID NO: 7153611 - DNA, 22 bp, Homo sapiens
gcagggtaggtgacaggtagtc

SEQ ID NO: 7153612 - DNA, 22 bp, Homo sapiens
gcagggtataatacttaggtga

SEQ ID NO: 7153613 - DNA, 22 bp, Homo sapiens
gcagggtccatggaggcagccc

SEQ ID NO: 7153614 - DNA, 22 bp, Homo sapiens
gcagggtccatggaggcagccc

SEQ ID NO: 7153615 - DNA, 22 bp, Homo sapiens
gcagggtccatggaggcagccc

SEQ ID NO: 7153616 - DNA, 22 bp, Homo sapiens
gcagggtccatggaggcagccc

SEQ ID NO: 7153617 - DNA, 22 bp, Homo sapiens
gcagggtccatggaggcagccc

SEQ ID NO: 7153618 - DNA, 22 bp, Homo sapiens
gcagggtccatggaggcagccc

SEQ ID NO: 7153619 - DNA, 22 bp, Homo sapiens
gcagggtccatggaggcagccc

SEQ ID NO: 7153620 - DNA, 22 bp, Homo sapiens
gcagggtcgctctaggagatca

SEQ ID NO: 7153621 - DNA, 22 bp, Homo sapiens
gcagggtcgctctaggagatca

SEQ ID NO: 7153622 - DNA, 22 bp, Homo sapiens
gcagggtcgctctaggagatca

SEQ ID NO: 7153623 - DNA, 22 bp, Homo sapiens
gcagggtctgaggccacagagg

SEQ ID NO: 7153624 - DNA, 22 bp, Homo sapiens
gcagggtcttgagaggcagcca

SEQ ID NO: 7153625 - DNA, 22 bp, Homo sapiens
gcagggtcttgagaggcagcca

SEQ ID NO: 7153626 - DNA, 22 bp, Homo sapiens
gcagggtcttgagaggcagcca

SEQ ID NO: 7153627 - DNA, 22 bp, Homo sapiens
gcagggtcttgagaggcagcca

SEQ ID NO: 7153628 - DNA, 22 bp, Homo sapiens
gcagggtcttgagaggcagcca

SEQ ID NO: 7153629 - DNA, 22 bp, Homo sapiens
gcagggtcttgagaggcagcca

SEQ ID NO: 7153630 - DNA, 22 bp, Homo sapiens
gcagggtcttgagaggcagcca

SEQ ID NO: 7153631 - DNA, 22 bp, Homo sapiens
attgttgggtctcactcctaga

SEQ ID NO: 7153632 - DNA, 22 bp, Homo sapiens
attgttgctaggattcaatgag

SEQ ID NO: 7153633 - DNA, 22 bp, Homo sapiens
attgtttacactaacttcataa

SEQ ID NO: 7153634 - DNA, 22 bp, Homo sapiens
attgtttacactaacttcataa

SEQ ID NO: 7153635 - DNA, 22 bp, Homo sapiens
attgtttacactaacttcataa

SEQ ID NO: 7153636 - DNA, 22 bp, Homo sapiens
attgtttacactaacttcataa

SEQ ID NO: 7153637 - DNA, 22 bp, Homo sapiens
gcattattaatagctgcatgag

SEQ ID NO: 7153638 - DNA, 18 bp, Homo sapiens
attgttctgtgacatgtc

SEQ ID NO: 7153639 - DNA, 22 bp, Homo sapiens
attgttgaggagactcttcaat

SEQ ID NO: 7153640 - DNA, 22 bp, Homo sapiens
attgttgaggcagttcatcttg

SEQ ID NO: 7153641 - DNA, 22 bp, Homo sapiens
attgttgagtgcttcagctgta

SEQ ID NO: 7153642 - DNA, 21 bp, Homo sapiens
attgttctggaggaaaggatt

SEQ ID NO: 7153643 - DNA, 22 bp, Homo sapiens
attgttccatgttatatcacga

SEQ ID NO: 7153644 - DNA, 22 bp, Homo sapiens
attgttcctggaaaagaacagg

SEQ ID NO: 7153645 - DNA, 22 bp, Homo sapiens
attgttcaatgtaataattttg

SEQ ID NO: 7153646 - DNA, 22 bp, Homo sapiens
attgttatgaaaataagatgtt

SEQ ID NO: 7153647 - DNA, 22 bp, Homo sapiens
attgttcaaagtgctttgcatg

SEQ ID NO: 7153648 - DNA, 22 bp, Homo sapiens
attgttcactgtgaatcttgat

SEQ ID NO: 7153649 - DNA, 22 bp, Homo sapiens
attgttcatgtatgaataaata

SEQ ID NO: 7153650 - DNA, 20 bp, Homo sapiens
gcagtgctggtgcctctgct

SEQ ID NO: 7153651 - DNA, 20 bp, Homo sapiens
gcagtgctggtgcctctgct

SEQ ID NO: 7153652 - DNA, 22 bp, Homo sapiens
attgtgcagatagtaattagga

SEQ ID NO: 7153653 - DNA, 22 bp, Homo sapiens
attgttaatgttgcactaaggt

SEQ ID NO: 7153654 - DNA, 22 bp, Homo sapiens
attgttaatgttgcactaaggt

SEQ ID NO: 7153655 - DNA, 22 bp, Homo sapiens
attgttatgaaaataagatgtt

SEQ ID NO: 7153656 - DNA, 22 bp, Homo sapiens
attgttagttagtgtggggaga

SEQ ID NO: 7153657 - DNA, 22 bp, Homo sapiens
attgtacaatgcctggaacatt

SEQ ID NO: 7153658 - DNA, 21 bp, Homo sapiens
gcagtgcagcttggagggtag

SEQ ID NO: 7153659 - DNA, 21 bp, Homo sapiens
gcagtgcagcttggagggtag

SEQ ID NO: 7153660 - DNA, 22 bp, Homo sapiens
attgtacaatgcctggaacatt

SEQ ID NO: 7153661 - DNA, 22 bp, Homo sapiens
attgtacaagtttggttattta

SEQ ID NO: 7153662 - DNA, 22 bp, Homo sapiens
attgtaagtagaaatgttatgg

SEQ ID NO: 7153663 - DNA, 22 bp, Homo sapiens
attgtaacagacacatcagatt

SEQ ID NO: 7153664 - DNA, 22 bp, Homo sapiens
attgtaacaggatccctgtggc

SEQ ID NO: 7153665 - DNA, 22 bp, Homo sapiens
attgtaattttagagaaagtgg

SEQ ID NO: 7153666 - DNA, 18 bp, Homo sapiens
gcagtgcaggaagaagag

SEQ ID NO: 7153667 - DNA, 22 bp, Homo sapiens
gcagtgcaggaacatagcttct

SEQ ID NO: 7153668 - DNA, 22 bp, Homo sapiens
gcagtgcaggacaaatcagtgc

SEQ ID NO: 7153669 - DNA, 22 bp, Homo sapiens
gcagtgcagtgggacagggcgc

SEQ ID NO: 7153670 - DNA, 22 bp, Homo sapiens
gcagtgcatgtcggaactcatt

SEQ ID NO: 7153671 - DNA, 22 bp, Homo sapiens
gcagtgcattactcacatgttt

SEQ ID NO: 7153672 - DNA, 22 bp, Homo sapiens
gcagtgccacaagatgggagga

SEQ ID NO: 7153673 - DNA, 18 bp, Homo sapiens
gcagtgccagcctctcct

SEQ ID NO: 7153674 - DNA, 18 bp, Homo sapiens
gcagtgccagcctctcct

SEQ ID NO: 7153675 - DNA, 22 bp, Homo sapiens
gcagtgctagcctcacagggtc

SEQ ID NO: 7153676 - DNA, 22 bp, Homo sapiens
gcagtgctctgcctataatgga

SEQ ID NO: 7153677 - DNA, 22 bp, Homo sapiens
gcagtgctgagaggtgatcgga

SEQ ID NO: 7153678 - DNA, 22 bp, Homo sapiens
atttaaatgcttaagagggttt

SEQ ID NO: 7153679 - DNA, 22 bp, Homo sapiens
atttaaattttctgatggagag

SEQ ID NO: 7153680 - DNA, 22 bp, Homo sapiens
atttaaattttctgatggagag

SEQ ID NO: 7153681 - DNA, 22 bp, Homo sapiens
atttaaattttctgatggagag

SEQ ID NO: 7153682 - DNA, 22 bp, Homo sapiens
atttaaatgcttaagagggttt

SEQ ID NO: 7153683 - DNA, 22 bp, Homo sapiens
atttaaatgcttaagagggttt

SEQ ID NO: 7153684 - DNA, 22 bp, Homo sapiens
atttaaatgcttaagagggttt

SEQ ID NO: 7153685 - DNA, 16 bp, Homo sapiens
attgttttcaattaga

SEQ ID NO: 7153686 - DNA, 16 bp, Homo sapiens
attgttttcaattaga

SEQ ID NO: 7153687 - DNA, 22 bp, Homo sapiens
attgttttccaaagatgctgct

SEQ ID NO: 7153688 - DNA, 22 bp, Homo sapiens
attgttttccaaagatgctgct

SEQ ID NO: 7153689 - DNA, 22 bp, Homo sapiens
attgttttgtagaatgaccctt

SEQ ID NO: 7153690 - DNA, 22 bp, Homo sapiens
attgttttgtagaatgaccctt

SEQ ID NO: 7153691 - DNA, 22 bp, Homo sapiens
attgttttgtttcccagtgact

SEQ ID NO: 7153692 - DNA, 23 bp, Homo sapiens
attgtttttggctctcagggaat

SEQ ID NO: 7153693 - DNA, 23 bp, Homo sapiens
attgtttttggctctcagggaat

SEQ ID NO: 7153694 - DNA, 22 bp, Homo sapiens
atttaaagtggtagattggcag

SEQ ID NO: 7153695 - DNA, 22 bp, Homo sapiens
atttaaagtggtagattggcag

SEQ ID NO: 7153696 - DNA, 22 bp, Homo sapiens
attgtttccccggaattattca

SEQ ID NO: 7153697 - DNA, 22 bp, Homo sapiens
gccactgtcctgtgcctgtgct

SEQ ID NO: 7153698 - DNA, 22 bp, Homo sapiens
attgttttaattccattgtgaa

SEQ ID NO: 7153699 - DNA, 22 bp, Homo sapiens
attgttttaattccattgtgaa

SEQ ID NO: 7153700 - DNA, 22 bp, Homo sapiens
attgttttaattccattgtgaa

SEQ ID NO: 7153701 - DNA, 22 bp, Homo sapiens
attgttttaattccattgtgaa

SEQ ID NO: 7153702 - DNA, 22 bp, Homo sapiens
attgttttattaaatgagccct

SEQ ID NO: 7153703 - DNA, 22 bp, Homo sapiens
attgttttattaaatgagccct

SEQ ID NO: 7153704 - DNA, 22 bp, Homo sapiens
gccactgtcataccctggcaat

SEQ ID NO: 7153705 - DNA, 22 bp, Homo sapiens
gccactgtcatcttgtgaagca

SEQ ID NO: 7153706 - DNA, 22 bp, Homo sapiens
gccactgtcatcttgtgaagca

SEQ ID NO: 7153707 - DNA, 20 bp, Homo sapiens
gccactgggcaccagcaggg

SEQ ID NO: 7153708 - DNA, 22 bp, Homo sapiens
gccactggcgctgtgcagagtg

SEQ ID NO: 7153709 - DNA, 20 bp, Homo sapiens
gccactgggcaccagcaggg

SEQ ID NO: 7153710 - DNA, 22 bp, Homo sapiens
gccactggcgctgtgcagagtg

SEQ ID NO: 7153711 - DNA, 21 bp, Homo sapiens
gccactgcactccagcctggg

SEQ ID NO: 7153712 - DNA, 21 bp, Homo sapiens
gccactgcactccagcctggg

SEQ ID NO: 7153713 - DNA, 22 bp, Homo sapiens
gccactgcactccagcccaggc

SEQ ID NO: 7153714 - DNA, 22 bp, Homo sapiens
gccactgcactccagcccaggc

SEQ ID NO: 7153715 - DNA, 21 bp, Homo sapiens
gccactgcactccagcctggg

SEQ ID NO: 7153716 - DNA, 22 bp, Homo sapiens
gccactggacccagaaagggaa

SEQ ID NO: 7153717 - DNA, 22 bp, Homo sapiens
gccactggacccagaaagggaa

SEQ ID NO: 7153718 - DNA, 22 bp, Homo sapiens
gccactggagacagtggggaag

SEQ ID NO: 7153719 - DNA, 22 bp, Homo sapiens
gccactggcatctagttggtag

SEQ ID NO: 7153720 - DNA, 19 bp, Homo sapiens
gccactcctgatgctgccc

SEQ ID NO: 7153721 - DNA, 22 bp, Homo sapiens
gccactgaacattagagctagt

SEQ ID NO: 7153722 - DNA, 22 bp, Homo sapiens
gccactgagcccggccattgtt

SEQ ID NO: 7153723 - DNA, 22 bp, Homo sapiens
gccactcatgggaggtgtgcaa

SEQ ID NO: 7153724 - DNA, 22 bp, Homo sapiens
gccactcacatgtaccagatgc

SEQ ID NO: 7153725 - DNA, 22 bp, Homo sapiens
gccactcatgggaggtgtgcaa

SEQ ID NO: 7153726 - DNA, 22 bp, Homo sapiens
gccacagtgggctggggccaga

SEQ ID NO: 7153727 - DNA, 20 bp, Homo sapiens
gccacagttttctcactgca

SEQ ID NO: 7153728 - DNA, 20 bp, Homo sapiens
gccacagttttctcactgca

SEQ ID NO: 7153729 - DNA, 22 bp, Homo sapiens
gccacgcttactgcccaggtgt

SEQ ID NO: 7153730 - DNA, 21 bp, Homo sapiens
gccacgtttcagtcttctcag

SEQ ID NO: 7153731 - DNA, 22 bp, Homo sapiens
gccactcaaatccagctttaga

SEQ ID NO: 7153732 - DNA, 22 bp, Homo sapiens
gcattcctgagaatgcagagtg

SEQ ID NO: 7153733 - DNA, 22 bp, Homo sapiens
gcattcctgtacctctctgcta

SEQ ID NO: 7153734 - DNA, 22 bp, Homo sapiens
gcattccttgagttccctgtgc

SEQ ID NO: 7153735 - DNA, 22 bp, Homo sapiens
gcattccttggtttaaaacaag

SEQ ID NO: 7153736 - DNA, 22 bp, Homo sapiens
gcattccttggtttaaaacaag

SEQ ID NO: 7153737 - DNA, 22 bp, Homo sapiens
gcattccttggtttaaaacaag

SEQ ID NO: 7153738 - DNA, 22 bp, Homo sapiens
gcattccttgttagcatttgat

SEQ ID NO: 7153739 - DNA, 22 bp, Homo sapiens
gcattcctacaggctgctatga

SEQ ID NO: 7153740 - DNA, 21 bp, Homo sapiens
gcattcctaggaggtaagcat

SEQ ID NO: 7153741 - DNA, 15 bp, Homo sapiens
gcattcctcatttcc

SEQ ID NO: 7153742 - DNA, 22 bp, Homo sapiens
gcattcagggttcacggtcaac

SEQ ID NO: 7153743 - DNA, 22 bp, Homo sapiens
gcattcatcttcctccatgcag

SEQ ID NO: 7153744 - DNA, 22 bp, Homo sapiens
gcgtggggtaggtagacatgga

SEQ ID NO: 7153745 - DNA, 22 bp, Homo sapiens
gcgtggggtaggtagacatgga

SEQ ID NO: 7153746 - DNA, 22 bp, Homo sapiens
gcgtggggtaggtagacatgga

SEQ ID NO: 7153747 - DNA, 22 bp, Homo sapiens
gcgtggtgctgccctgcacaca

SEQ ID NO: 7153748 - DNA, 22 bp, Homo sapiens
gcgtgtatgcaggtctgtgcag

SEQ ID NO: 7153749 - DNA, 22 bp, Homo sapiens
gcgtgtgtgatatgcctctgca

SEQ ID NO: 7153750 - DNA, 22 bp, Homo sapiens
gcgtgtttgcccagtgagtggc

SEQ ID NO: 7153751 - DNA, 22 bp, Homo sapiens
gcgtgtttgcccagtgagtggc

SEQ ID NO: 7153752 - DNA, 17 bp, Homo sapiens
gcgtgtccccgcgtctc

SEQ ID NO: 7153753 - DNA, 22 bp, Homo sapiens
gcgttggggaccccgaagctgg

SEQ ID NO: 7153754 - DNA, 22 bp, Homo sapiens
gcgtttgtaggggtgttttgcc

SEQ ID NO: 7153755 - DNA, 22 bp, Homo sapiens
gctaaaaggagcactagagatt

SEQ ID NO: 7153756 - DNA, 22 bp, Homo sapiens
gctaacagcaggttccgggctc

SEQ ID NO: 7153757 - DNA, 22 bp, Homo sapiens
gctaagaggagcctccttctga

SEQ ID NO: 7153758 - DNA, 22 bp, Homo sapiens
gctaagaggctatatctttctc

SEQ ID NO: 7153759 - DNA, 22 bp, Homo sapiens
gctaaggccttaactcatggag

SEQ ID NO: 7153760 - DNA, 22 bp, Homo sapiens
gctaagggaccctttctaatgt

SEQ ID NO: 7153761 - DNA, 22 bp, Homo sapiens
gctaagggataggctgcctcct

SEQ ID NO: 7153762 - DNA, 21 bp, Homo sapiens
gcctggctctcactggcctgg

SEQ ID NO: 7153763 - DNA, 22 bp, Homo sapiens
gcctggctcctaaggactggct

SEQ ID NO: 7153764 - DNA, 22 bp, Homo sapiens
gcctggctcgggcactcgccag

SEQ ID NO: 7153765 - DNA, 22 bp, Homo sapiens
gcctggctcctaagagcacaac

SEQ ID NO: 7153766 - DNA, 22 bp, Homo sapiens
gcctggctcctaagagcacaac

SEQ ID NO: 7153767 - DNA, 22 bp, Homo sapiens
gcctggctcctaaggactggct

SEQ ID NO: 7153768 - DNA, 22 bp, Homo sapiens
gcctggctcctaaggactggct

SEQ ID NO: 7153769 - DNA, 22 bp, Homo sapiens
gcctggctcctaaggactggct

SEQ ID NO: 7153770 - DNA, 22 bp, Homo sapiens
gcctggctctgagggagctcct

SEQ ID NO: 7153771 - DNA, 22 bp, Homo sapiens
gcctggctctgagggagctcct

SEQ ID NO: 7153772 - DNA, 22 bp, Homo sapiens
gcctggctctgagtttctctcc

SEQ ID NO: 7153773 - DNA, 22 bp, Homo sapiens
gcctggctctgagtttctctcc

SEQ ID NO: 7153774 - DNA, 22 bp, Homo sapiens
gcgcaggcccgggtcagggccg

SEQ ID NO: 7153775 - DNA, 22 bp, Homo sapiens
gcgccccatctacagtactttt

SEQ ID NO: 7153776 - DNA, 22 bp, Homo sapiens
gcgccccatctacagtactttt

SEQ ID NO: 7153777 - DNA, 21 bp, Homo sapiens
gctcaaagggcttgccatgct

SEQ ID NO: 7153778 - DNA, 22 bp, Homo sapiens
gctcaaaggccaggtagcagca

SEQ ID NO: 7153779 - DNA, 22 bp, Homo sapiens
gctcaaagcactttgcaaatat

SEQ ID NO: 7153780 - DNA, 23 bp, Homo sapiens
gctcaggcatcattcttcctggc

SEQ ID NO: 7153781 - DNA, 23 bp, Homo sapiens
gctcaggcatcattcttcctggc

SEQ ID NO: 7153782 - DNA, 22 bp, Homo sapiens
gctcagggctaaggctgagggg

SEQ ID NO: 7153783 - DNA, 22 bp, Homo sapiens
gctcagggctaaggctgagggg

SEQ ID NO: 7153784 - DNA, 22 bp, Homo sapiens
gctatttttgagccatttataa

SEQ ID NO: 7153785 - DNA, 22 bp, Homo sapiens
gctatttttgagccatttataa

SEQ ID NO: 7153786 - DNA, 22 bp, Homo sapiens
gctatttctttaaattgatctc

SEQ ID NO: 7153787 - DNA, 22 bp, Homo sapiens
gctatttttgagccatttataa

SEQ ID NO: 7153788 - DNA, 22 bp, Homo sapiens
gctatttattaaaatggtgaag

SEQ ID NO: 7153789 - DNA, 22 bp, Homo sapiens
gctatttctatattataaagaa

SEQ ID NO: 7153790 - DNA, 22 bp, Homo sapiens
gctacagactgagcatggctct

SEQ ID NO: 7153791 - DNA, 22 bp, Homo sapiens
gctacacaatagcgttcactta

SEQ ID NO: 7153792 - DNA, 22 bp, Homo sapiens
gctacagactgagcatggctct

SEQ ID NO: 7153793 - DNA, 22 bp, Homo sapiens
gctacacaaaaggagagtgagt

SEQ ID NO: 7153794 - DNA, 22 bp, Homo sapiens
gctacacaaaaggagagtgagt

SEQ ID NO: 7153795 - DNA, 22 bp, Homo sapiens
gctaattcacagtaggaaattt

SEQ ID NO: 7153796 - DNA, 22 bp, Homo sapiens
gctacaaactgtcatggtgctt

SEQ ID NO: 7153797 - DNA, 22 bp, Homo sapiens
gctacaaagagagcccactcta

SEQ ID NO: 7153798 - DNA, 22 bp, Homo sapiens
gctacaaagtggtaggaggtca

SEQ ID NO: 7153799 - DNA, 22 bp, Homo sapiens
gctaagggaggcatgccgtggt

SEQ ID NO: 7153800 - DNA, 22 bp, Homo sapiens
gctaataattcctttgtgaact

SEQ ID NO: 7153801 - DNA, 22 bp, Homo sapiens
gctaatcaatgttaaggctgtg

SEQ ID NO: 7153802 - DNA, 22 bp, Homo sapiens
gctaatcaatgttaaggctgtg

SEQ ID NO: 7153803 - DNA, 22 bp, Homo sapiens
gctaatgactgagtttttagca

SEQ ID NO: 7153804 - DNA, 22 bp, Homo sapiens
gctatgtgtgttttgctgcagc

SEQ ID NO: 7153805 - DNA, 22 bp, Homo sapiens
gctattgtgacagcttttcgcc

SEQ ID NO: 7153806 - DNA, 22 bp, Homo sapiens
gctattgtgacagcttttcgcc

SEQ ID NO: 7153807 - DNA, 22 bp, Homo sapiens
gctattgtttattttgaatcta

SEQ ID NO: 7153808 - DNA, 22 bp, Homo sapiens
gctattgtacatttcttgtttg

SEQ ID NO: 7153809 - DNA, 22 bp, Homo sapiens
gctattactgatggagatttag

SEQ ID NO: 7153810 - DNA, 22 bp, Homo sapiens
gctattacttttggagtgtggg

SEQ ID NO: 7153811 - DNA, 23 bp, Homo sapiens
gctcaggtggctcagggactgat

SEQ ID NO: 7153812 - DNA, 20 bp, Homo sapiens
gctcaggtgacagtcaggag

SEQ ID NO: 7153813 - DNA, 22 bp, Homo sapiens
gctcaggtgttacctcctctag

SEQ ID NO: 7153814 - DNA, 22 bp, Homo sapiens
gctcaggtgttacctcctctag

SEQ ID NO: 7153815 - DNA, 18 bp, Homo sapiens
gctcaggtatagacaggg

SEQ ID NO: 7153816 - DNA, 22 bp, Homo sapiens
gctcaggtcttacccatgcctg

SEQ ID NO: 7153817 - DNA, 22 bp, Homo sapiens
gctcagggtgcagtgtccatga

SEQ ID NO: 7153818 - DNA, 22 bp, Homo sapiens
gctcagggtcccttggtgctgg

SEQ ID NO: 7153819 - DNA, 22 bp, Homo sapiens
gctcagggtcccttggtgctgg

SEQ ID NO: 7153820 - DNA, 22 bp, Homo sapiens
gctcaggggaatgggctgccgt

SEQ ID NO: 7153821 - DNA, 22 bp, Homo sapiens
gctcagggtcccttggtgctgg

SEQ ID NO: 7153822 - DNA, 22 bp, Homo sapiens
gctcagggtcccttggtgctgg

SEQ ID NO: 7153823 - DNA, 22 bp, Homo sapiens
gctcagggtcccttggtgctgg

SEQ ID NO: 7153824 - DNA, 22 bp, Homo sapiens
gctcagggtcccttggtgctgg

SEQ ID NO: 7153825 - DNA, 22 bp, Homo sapiens
gctcagggtcccttggtgctgg

SEQ ID NO: 7153826 - DNA, 22 bp, Homo sapiens
gctcagggctaaggctgagggg

SEQ ID NO: 7153827 - DNA, 22 bp, Homo sapiens
gctcaggggaatgggctgccgt

SEQ ID NO: 7153828 - DNA, 22 bp, Homo sapiens
gctcaggggaatgggctgccgt

SEQ ID NO: 7153829 - DNA, 22 bp, Homo sapiens
gctccaggcagcatagtggatg

SEQ ID NO: 7153830 - DNA, 22 bp, Homo sapiens
gctccaggcagcatagtggatg

SEQ ID NO: 7153831 - DNA, 22 bp, Homo sapiens
gctccaggccccagcgttccgc

SEQ ID NO: 7153832 - DNA, 22 bp, Homo sapiens
gctccaggccccagcgttccgc

SEQ ID NO: 7153833 - DNA, 22 bp, Homo sapiens
gctccaggcgagctggaccaga

SEQ ID NO: 7153834 - DNA, 22 bp, Homo sapiens
gctccaggcgagctggaccaga

SEQ ID NO: 7153835 - DNA, 22 bp, Homo sapiens
gctccaggcgagctggaccaga

SEQ ID NO: 7153836 - DNA, 22 bp, Homo sapiens
gctccaggcgagctggaccaga

SEQ ID NO: 7153837 - DNA, 22 bp, Homo sapiens
gctccaggcgagctggaccaga

SEQ ID NO: 7153838 - DNA, 17 bp, Homo sapiens
gctccaggcgtgagtga

SEQ ID NO: 7153839 - DNA, 22 bp, Homo sapiens
gctctaactattaagaggtcat

SEQ ID NO: 7153840 - DNA, 22 bp, Homo sapiens
gctctaaagtccagtcaactag

SEQ ID NO: 7153841 - DNA, 22 bp, Homo sapiens
gctctaaagggttggacaggtg

SEQ ID NO: 7153842 - DNA, 21 bp, Homo sapiens
gctctaagctttgggaagaat

SEQ ID NO: 7153843 - DNA, 22 bp, Homo sapiens
gctctaaagggttggacaggtg

SEQ ID NO: 7153844 - DNA, 22 bp, Homo sapiens
gctctaaagtccagtcaactag

SEQ ID NO: 7153845 - DNA, 22 bp, Homo sapiens
gctctaagtgagaaggtgccat

SEQ ID NO: 7153846 - DNA, 22 bp, Homo sapiens
gctctagaaagaaggatgtggg

SEQ ID NO: 7153847 - DNA, 20 bp, Homo sapiens
gctctaaagccacagattga

SEQ ID NO: 7153848 - DNA, 20 bp, Homo sapiens
gctctaaagccacagattga

SEQ ID NO: 7153849 - DNA, 22 bp, Homo sapiens
gctctaaagagaatctatgcgg

SEQ ID NO: 7153850 - DNA, 22 bp, Homo sapiens
gctctaaagagaatctatgcgg

SEQ ID NO: 7153851 - DNA, 19 bp, Homo sapiens
gctctaaaagattttgaag

SEQ ID NO: 7153852 - DNA, 19 bp, Homo sapiens
gctctaaaagattttgaag

SEQ ID NO: 7153853 - DNA, 20 bp, Homo sapiens
gctctaaaccacaaagccca

SEQ ID NO: 7153854 - DNA, 20 bp, Homo sapiens
gctctaaaccacaaagccca

SEQ ID NO: 7153855 - DNA, 22 bp, Homo sapiens
gctctaaagaacccagaggagt

SEQ ID NO: 7153856 - DNA, 22 bp, Homo sapiens
gctctaaagaacccagaggagt

SEQ ID NO: 7153857 - DNA, 22 bp, Homo sapiens
gctctagattgttacaaagttc

SEQ ID NO: 7153858 - DNA, 22 bp, Homo sapiens
gctctagcaaggctggcctggg

SEQ ID NO: 7153859 - DNA, 22 bp, Homo sapiens
gctctagcccatttcctgcttg

SEQ ID NO: 7153860 - DNA, 22 bp, Homo sapiens
gctctaggagaggggcagtcca

SEQ ID NO: 7153861 - DNA, 22 bp, Homo sapiens
gctctagtaggaatgtccctct

SEQ ID NO: 7153862 - DNA, 22 bp, Homo sapiens
gctctagtaggaatgtccctct

SEQ ID NO: 7153863 - DNA, 22 bp, Homo sapiens
gctctatgagtttctcagttta

SEQ ID NO: 7153864 - DNA, 20 bp, Homo sapiens
gctctgaaccaagagctgtc

SEQ ID NO: 7153865 - DNA, 22 bp, Homo sapiens
gctcgcgccgcaccggtccacc

SEQ ID NO: 7153866 - DNA, 22 bp, Homo sapiens
gctccttctggctcccttttgg

SEQ ID NO: 7153867 - DNA, 22 bp, Homo sapiens
gctcctggatgttcaagtcggc

SEQ ID NO: 7153868 - DNA, 22 bp, Homo sapiens
gctcctggatgttcaagtcggc

SEQ ID NO: 7153869 - DNA, 22 bp, Homo sapiens
gctcggtggccagcctgaggcc

SEQ ID NO: 7153870 - DNA, 22 bp, Homo sapiens
gctcgcgccgcaccggtccacc

SEQ ID NO: 7153871 - DNA, 22 bp, Homo sapiens
gctcgcttagattttcctctga

SEQ ID NO: 7153872 - DNA, 22 bp, Homo sapiens
gctcggagaactgggggctccg

SEQ ID NO: 7153873 - DNA, 17 bp, Homo sapiens
gctccaggcgtgagtga

SEQ ID NO: 7153874 - DNA, 22 bp, Homo sapiens
gctcctggatgttcaagtcggc

SEQ ID NO: 7153875 - DNA, 22 bp, Homo sapiens
gctctgagaggatgctgagcag

SEQ ID NO: 7153876 - DNA, 22 bp, Homo sapiens
gctctgagagctacacagggta

SEQ ID NO: 7153877 - DNA, 22 bp, Homo sapiens
gctctgagacagtagagatggc

SEQ ID NO: 7153878 - DNA, 22 bp, Homo sapiens
gctctgagacagtagagatggc

SEQ ID NO: 7153879 - DNA, 22 bp, Homo sapiens
gctctgagagagcaaagtcacc

SEQ ID NO: 7153880 - DNA, 22 bp, Homo sapiens
gctctgaagggtgagctgttcg

SEQ ID NO: 7153881 - DNA, 22 bp, Homo sapiens
gctctgaatcaatcagataagg

SEQ ID NO: 7153882 - DNA, 22 bp, Homo sapiens
gctctgaatcaatcagataagg

SEQ ID NO: 7153883 - DNA, 22 bp, Homo sapiens
gctctgacaaaggccacttaca

SEQ ID NO: 7153884 - DNA, 22 bp, Homo sapiens
gctctgacacatttgttctacc

SEQ ID NO: 7153885 - DNA, 20 bp, Homo sapiens
gctctgaccatatcaagaca

SEQ ID NO: 7153886 - DNA, 22 bp, Homo sapiens
gctctgacctggccgccctgct

SEQ ID NO: 7153887 - DNA, 22 bp, Homo sapiens
gctctgactgagcttcctgcct

SEQ ID NO: 7153888 - DNA, 22 bp, Homo sapiens
gctctgactgagcttcctgcct

SEQ ID NO: 7153889 - DNA, 22 bp, Homo sapiens
gctctgactggtgggccacagt

SEQ ID NO: 7153890 - DNA, 22 bp, Homo sapiens
gctctgacttcctgcgctccag

SEQ ID NO: 7153891 - DNA, 22 bp, Homo sapiens
gctctgagaaccaggaacacag

SEQ ID NO: 7153892 - DNA, 22 bp, Homo sapiens
caaatattccaggtacatccct

SEQ ID NO: 7153893 - DNA, 22 bp, Homo sapiens
caaatcacaatgtgagactgag

SEQ ID NO: 7153894 - DNA, 22 bp, Homo sapiens
caaatcaccacttaatgggtta

SEQ ID NO: 7153895 - DNA, 22 bp, Homo sapiens
caaatagacttaagcatctgta

SEQ ID NO: 7153896 - DNA, 22 bp, Homo sapiens
gctctgagaggatgctgagcag

SEQ ID NO: 7153897 - DNA, 22 bp, Homo sapiens
gctctgagaggatgctgagcag

SEQ ID NO: 7153898 - DNA, 22 bp, Homo sapiens
gctctgagaggatgctgagcag

SEQ ID NO: 7153899 - DNA, 19 bp, Homo sapiens
gctctgagaggggcatggg

SEQ ID NO: 7153900 - DNA, 19 bp, Homo sapiens
gctctgagaggggcatggg

SEQ ID NO: 7153901 - DNA, 19 bp, Homo sapiens
gctctgagaggggcatggg

SEQ ID NO: 7153902 - DNA, 19 bp, Homo sapiens
gctctgagaggggcatggg

SEQ ID NO: 7153903 - DNA, 22 bp, Homo sapiens
gctctgagaggtgcagcagtaa

SEQ ID NO: 7153904 - DNA, 22 bp, Homo sapiens
caaatcatggaataactagaga

SEQ ID NO: 7153905 - DNA, 22 bp, Homo sapiens
caaatcatggaataactagaga

SEQ ID NO: 7153906 - DNA, 22 bp, Homo sapiens
caaatcatggaataactagaga

SEQ ID NO: 7153907 - DNA, 22 bp, Homo sapiens
caaatcatggaataactagaga

SEQ ID NO: 7153908 - DNA, 22 bp, Homo sapiens
caaatcatggctctagcttaca

SEQ ID NO: 7153909 - DNA, 22 bp, Homo sapiens
caaatcatggctctagcttaca

SEQ ID NO: 7153910 - DNA, 22 bp, Homo sapiens
caaatcatggctctagcttaca

SEQ ID NO: 7153911 - DNA, 20 bp, Homo sapiens
caaatccctgctctgtgctg

SEQ ID NO: 7153912 - DNA, 20 bp, Homo sapiens
caaatccctgctctgtgctg

SEQ ID NO: 7153913 - DNA, 20 bp, Homo sapiens
caaatccctgctctgtgctg

SEQ ID NO: 7153914 - DNA, 20 bp, Homo sapiens
caaatccctgctctgtgctg

SEQ ID NO: 7153915 - DNA, 20 bp, Homo sapiens
caaatccctgctctgtgctg

SEQ ID NO: 7153916 - DNA, 20 bp, Homo sapiens
caaatccctgctctgtgctg

SEQ ID NO: 7153917 - DNA, 22 bp, Homo sapiens
caaatcctcacctcatcatgaa

SEQ ID NO: 7153918 - DNA, 17 bp, Homo sapiens
caaatcctaggatgtct

SEQ ID NO: 7153919 - DNA, 22 bp, Homo sapiens
caaatcctggagccatggtaac

SEQ ID NO: 7153920 - DNA, 22 bp, Homo sapiens
caaatcctggagccatggtaac

SEQ ID NO: 7153921 - DNA, 22 bp, Homo sapiens
caaatctatatgttgatattct

SEQ ID NO: 7153922 - DNA, 22 bp, Homo sapiens
caaatctatatgttgatattct

SEQ ID NO: 7153923 - DNA, 22 bp, Homo sapiens
caaatctgagtctacaatttta

SEQ ID NO: 7153924 - DNA, 22 bp, Homo sapiens
caaatctttaattgaggaatca

SEQ ID NO: 7153925 - DNA, 15 bp, Homo sapiens
gctctgggtatttga

SEQ ID NO: 7153926 - DNA, 22 bp, Homo sapiens
gctctgggtgaacttggagcaa

SEQ ID NO: 7153927 - DNA, 22 bp, Homo sapiens
gctctgggtgaacttggagcaa

SEQ ID NO: 7153928 - DNA, 22 bp, Homo sapiens
gctctgggtgaacttggagcaa

SEQ ID NO: 7153929 - DNA, 22 bp, Homo sapiens
gctctgggtgaacttggagcaa

SEQ ID NO: 7153930 - DNA, 22 bp, Homo sapiens
gctctgggtgaacttggagcaa

SEQ ID NO: 7153931 - DNA, 22 bp, Homo sapiens
caaatgaaaatggcgtcttgga

SEQ ID NO: 7153932 - DNA, 22 bp, Homo sapiens
caaatgaaaatggcgtcttgga

SEQ ID NO: 7153933 - DNA, 22 bp, Homo sapiens
caaatgaagaaccttctcacct

SEQ ID NO: 7153934 - DNA, 15 bp, Homo sapiens
gctctgggtatttga

SEQ ID NO: 7153935 - DNA, 22 bp, Homo sapiens
gctctgggtgaatggcagattg

SEQ ID NO: 7153936 - DNA, 22 bp, Homo sapiens
gctctgggtgaatggcagattg

SEQ ID NO: 7153937 - DNA, 22 bp, Homo sapiens
gctctgggtgaatggcagattg

SEQ ID NO: 7153938 - DNA, 20 bp, Homo sapiens
gctctgggtggtaaatgact

SEQ ID NO: 7153939 - DNA, 20 bp, Homo sapiens
gctctgggtggtaaatgact

SEQ ID NO: 7153940 - DNA, 22 bp, Homo sapiens
gctctgggttctgatttatgag

SEQ ID NO: 7153941 - DNA, 22 bp, Homo sapiens
gctctgggtgaagggtaccatt

SEQ ID NO: 7153942 - DNA, 22 bp, Homo sapiens
gctctgggtgaagggtaccatt

SEQ ID NO: 7153943 - DNA, 22 bp, Homo sapiens
gctctgggtgaagggtaccatt

SEQ ID NO: 7153944 - DNA, 22 bp, Homo sapiens
gctctgggtgaatggcagattg

SEQ ID NO: 7153945 - DNA, 22 bp, Homo sapiens
gctctgggtgaatggcagattg

SEQ ID NO: 7153946 - DNA, 20 bp, Homo sapiens
gctgaggagcagtgtggttg

SEQ ID NO: 7153947 - DNA, 20 bp, Homo sapiens
gctgaggagcagtgtggttg

SEQ ID NO: 7153948 - DNA, 20 bp, Homo sapiens
gctgaggagcagtgtggttg

SEQ ID NO: 7153949 - DNA, 22 bp, Homo sapiens
gctgaggagcgagaactctgct

SEQ ID NO: 7153950 - DNA, 22 bp, Homo sapiens
gctgaggaagtcaggtggccca

SEQ ID NO: 7153951 - DNA, 22 bp, Homo sapiens
gctgaggacatacacattgtgc

SEQ ID NO: 7153952 - DNA, 22 bp, Homo sapiens
gctgaggacatacacattgtgc

SEQ ID NO: 7153953 - DNA, 22 bp, Homo sapiens
gctgaggacatacacattgtgc

SEQ ID NO: 7153954 - DNA, 22 bp, Homo sapiens
gctgaggacatcatggaaggaa

SEQ ID NO: 7153955 - DNA, 22 bp, Homo sapiens
gctgaggacatcatggaaggaa

SEQ ID NO: 7153956 - DNA, 22 bp, Homo sapiens
gctgaggacatcatggaaggaa

SEQ ID NO: 7153957 - DNA, 22 bp, Homo sapiens
gctgaggaagtcaggtggccca

SEQ ID NO: 7153958 - DNA, 22 bp, Homo sapiens
gctgaggaaaggctggaaggga

SEQ ID NO: 7153959 - DNA, 22 bp, Homo sapiens
gctgaggaaaccaatgctcaga

SEQ ID NO: 7153960 - DNA, 22 bp, Homo sapiens
gctgaggaaaccaatgctcaga

SEQ ID NO: 7153961 - DNA, 22 bp, Homo sapiens
gctgaggaaaggctggaaggga

SEQ ID NO: 7153962 - DNA, 22 bp, Homo sapiens
gctgaggaaaggctggaaggga

SEQ ID NO: 7153963 - DNA, 22 bp, Homo sapiens
gctgaggaaaccaatgctcaga

SEQ ID NO: 7153964 - DNA, 22 bp, Homo sapiens
gctgaggaaaccaatgctcaga

SEQ ID NO: 7153965 - DNA, 22 bp, Homo sapiens
gctgaggaaaccaatgctcaga

SEQ ID NO: 7153966 - DNA, 22 bp, Homo sapiens
gctgagctgggacagtcctggg

SEQ ID NO: 7153967 - DNA, 22 bp, Homo sapiens
gctctggtaccagctactccta

SEQ ID NO: 7153968 - DNA, 22 bp, Homo sapiens
gctctgggttctgatttatgag

SEQ ID NO: 7153969 - DNA, 22 bp, Homo sapiens
gctctggtagatcctcaggctc

SEQ ID NO: 7153970 - DNA, 22 bp, Homo sapiens
gctctggtctgcttatatctat

SEQ ID NO: 7153971 - DNA, 22 bp, Homo sapiens
gctctggtgagtgtagttcagg

SEQ ID NO: 7153972 - DNA, 22 bp, Homo sapiens
gctctggtggtgatcagacgct

SEQ ID NO: 7153973 - DNA, 22 bp, Homo sapiens
gctctggttaaaaagaattaaa

SEQ ID NO: 7153974 - DNA, 22 bp, Homo sapiens
gctctggttccagcgcgcccga

SEQ ID NO: 7153975 - DNA, 22 bp, Homo sapiens
gctctggttccagcgcgcccga

SEQ ID NO: 7153976 - DNA, 22 bp, Homo sapiens
caaatgaagggagctgaagtct

SEQ ID NO: 7153977 - DNA, 22 bp, Homo sapiens
caaatgaaggtggtgggtcatt

SEQ ID NO: 7153978 - DNA, 22 bp, Homo sapiens
caaatgaagtccaaagggctta

SEQ ID NO: 7153979 - DNA, 22 bp, Homo sapiens
caaatgaagtccaaagggctta

SEQ ID NO: 7153980 - DNA, 22 bp, Homo sapiens
caaatgaatagggagtgtgatg

SEQ ID NO: 7153981 - DNA, 22 bp, Homo sapiens
caaatgaatagggagtgtgatg

SEQ ID NO: 7153982 - DNA, 22 bp, Homo sapiens
caaatgaatagggagtgtgatg

SEQ ID NO: 7153983 - DNA, 22 bp, Homo sapiens
gctgaggaggtgtggttaggtg

SEQ ID NO: 7153984 - DNA, 22 bp, Homo sapiens
gctgaggagcgagaactctgct

SEQ ID NO: 7153985 - DNA, 22 bp, Homo sapiens
caaatgaagagggcaacttctg

SEQ ID NO: 7153986 - DNA, 22 bp, Homo sapiens
caaatgaagagggcaacttctg

SEQ ID NO: 7153987 - DNA, 20 bp, Homo sapiens
caaatgaagctgttggcctc

SEQ ID NO: 7153988 - DNA, 20 bp, Homo sapiens
caaatgaagctgttggcctc

SEQ ID NO: 7153989 - DNA, 22 bp, Homo sapiens
caaatgaagggagctgaagtct

SEQ ID NO: 7153990 - DNA, 22 bp, Homo sapiens
caaatgaagggagctgaagtct

SEQ ID NO: 7153991 - DNA, 22 bp, Homo sapiens
caaatgaatttccctgcaaatg

SEQ ID NO: 7153992 - DNA, 22 bp, Homo sapiens
caaatgaatttccctgcaaatg

SEQ ID NO: 7153993 - DNA, 22 bp, Homo sapiens
caaatgaatatttccatgggtt

SEQ ID NO: 7153994 - DNA, 22 bp, Homo sapiens
caaatgaatatttccatgggtt

SEQ ID NO: 7153995 - DNA, 22 bp, Homo sapiens
caaatgaatttccctgcaaatg

SEQ ID NO: 7153996 - DNA, 22 bp, Homo sapiens
caaatgaatttccctgcaaatg

SEQ ID NO: 7153997 - DNA, 22 bp, Homo sapiens
caaattagaggtttgttttgat

SEQ ID NO: 7153998 - DNA, 22 bp, Homo sapiens
caaattagaggtttgttttgat

SEQ ID NO: 7153999 - DNA, 22 bp, Homo sapiens
caaattcaaatttcatcagtgt

SEQ ID NO: 7154000 - DNA, 22 bp, Homo sapiens
caaattcaaatttcatcagtgt

SEQ ID NO: 7154001 - DNA, 22 bp, Homo sapiens
caaattcagaaaattggtagag

SEQ ID NO: 7154002 - DNA, 22 bp, Homo sapiens
gccccgcgcctggctccaggtg

SEQ ID NO: 7154003 - DNA, 22 bp, Homo sapiens
gcccctccatccatcaccgggg

SEQ ID NO: 7154004 - DNA, 22 bp, Homo sapiens
gccccgcagtgcgtgctggtct

SEQ ID NO: 7154005 - DNA, 22 bp, Homo sapiens
gccccgtcgtggggccagggat

SEQ ID NO: 7154006 - DNA, 22 bp, Homo sapiens
gcccctccatccatcaccgggg

SEQ ID NO: 7154007 - DNA, 22 bp, Homo sapiens
gcccctccatccatcaccgggg

SEQ ID NO: 7154008 - DNA, 22 bp, Homo sapiens
gccctccaccagagcccttctc

SEQ ID NO: 7154009 - DNA, 22 bp, Homo sapiens
gccctccaccagagcccttctc

SEQ ID NO: 7154010 - DNA, 22 bp, Homo sapiens
gccctccatgagacacagtgta

SEQ ID NO: 7154011 - DNA, 22 bp, Homo sapiens
gccctccatgagacacagtgta

SEQ ID NO: 7154012 - DNA, 22 bp, Homo sapiens
gccctccatgagacacagtgta

SEQ ID NO: 7154013 - DNA, 22 bp, Homo sapiens
gccctccatgagacacagtgta

SEQ ID NO: 7154014 - DNA, 21 bp, Homo sapiens
gccccctggactcctcatcca

SEQ ID NO: 7154015 - DNA, 22 bp, Homo sapiens
gcccaggagttgaagggctgac

SEQ ID NO: 7154016 - DNA, 22 bp, Homo sapiens
gcccccttgacctaatcacctt

SEQ ID NO: 7154017 - DNA, 22 bp, Homo sapiens
gcccccttgacctaatcacctt

SEQ ID NO: 7154018 - DNA, 22 bp, Homo sapiens
gcccaggagttgaagggctgac

SEQ ID NO: 7154019 - DNA, 22 bp, Homo sapiens
gcccaggagttcaagtctagtg

SEQ ID NO: 7154020 - DNA, 22 bp, Homo sapiens
gcccaggagttcaagtctagtg

SEQ ID NO: 7154021 - DNA, 22 bp, Homo sapiens
gcccaggagttgaagggctgac

SEQ ID NO: 7154022 - DNA, 22 bp, Homo sapiens
gcccaggagttgaagggctgac

SEQ ID NO: 7154023 - DNA, 22 bp, Homo sapiens
gcccaggagttgaagggctgac

SEQ ID NO: 7154024 - DNA, 22 bp, Homo sapiens
gcccaggagttcaaggctgcag

SEQ ID NO: 7154025 - DNA, 22 bp, Homo sapiens
gcccaggagttcaaggctgcag

SEQ ID NO: 7154026 - DNA, 22 bp, Homo sapiens
gcccaggaggttgggctgtgca

SEQ ID NO: 7154027 - DNA, 22 bp, Homo sapiens
gcccaggagttcaaggctgcag

SEQ ID NO: 7154028 - DNA, 22 bp, Homo sapiens
gcccaggaggttgggctgtgca

SEQ ID NO: 7154029 - DNA, 22 bp, Homo sapiens
gcccaggagttcaaggctgcag

SEQ ID NO: 7154030 - DNA, 22 bp, Homo sapiens
gcccaggagttcaaggctgcag

SEQ ID NO: 7154031 - DNA, 22 bp, Homo sapiens
gcccaggagttcaaggctgcag

SEQ ID NO: 7154032 - DNA, 22 bp, Homo sapiens
gcccaggagttcaagtctagtg

SEQ ID NO: 7154033 - DNA, 22 bp, Homo sapiens
gcccaggagttcaagtctagtg

SEQ ID NO: 7154034 - DNA, 22 bp, Homo sapiens
gcccagcccctgggtggacgtg

SEQ ID NO: 7154035 - DNA, 22 bp, Homo sapiens
gcccagcccctgggtggacgtg

SEQ ID NO: 7154036 - DNA, 22 bp, Homo sapiens
gcccaggaggtcaagtagctat

SEQ ID NO: 7154037 - DNA, 22 bp, Homo sapiens
gcccaggaggtcaagtagctat

SEQ ID NO: 7154038 - DNA, 22 bp, Homo sapiens
gcccaggaggtggaggtgcagt

SEQ ID NO: 7154039 - DNA, 22 bp, Homo sapiens
gcccaggaggtggaggtgcagt

SEQ ID NO: 7154040 - DNA, 22 bp, Homo sapiens
gcccaggaggtggaggtgcagt

SEQ ID NO: 7154041 - DNA, 22 bp, Homo sapiens
gcccaggaggtggaggtgcagt

SEQ ID NO: 7154042 - DNA, 22 bp, Homo sapiens
gccctcctgcaggggcttctgg

SEQ ID NO: 7154043 - DNA, 22 bp, Homo sapiens
gccctcctgcaggggcttctgg

SEQ ID NO: 7154044 - DNA, 22 bp, Homo sapiens
gccctcctggcaggcagtgatg

SEQ ID NO: 7154045 - DNA, 22 bp, Homo sapiens
gccctgcaccccaatggcatga

SEQ ID NO: 7154046 - DNA, 19 bp, Homo sapiens
gccctcctcactgagctct

SEQ ID NO: 7154047 - DNA, 19 bp, Homo sapiens
gccctcctcactgagctct

SEQ ID NO: 7154048 - DNA, 19 bp, Homo sapiens
gccctcctcactgagctct

SEQ ID NO: 7154049 - DNA, 19 bp, Homo sapiens
gccctcctcactgagctct

SEQ ID NO: 7154050 - DNA, 22 bp, Homo sapiens
gccctccctacagcctatttct

SEQ ID NO: 7154051 - DNA, 22 bp, Homo sapiens
gccctccctacagcctatttct

SEQ ID NO: 7154052 - DNA, 22 bp, Homo sapiens
gccctccctacagcctatttct

SEQ ID NO: 7154053 - DNA, 23 bp, Homo sapiens
gccctccctcccaggtgggtgtt

SEQ ID NO: 7154054 - DNA, 23 bp, Homo sapiens
gccctccctcccaggtgggtgtt

SEQ ID NO: 7154055 - DNA, 23 bp, Homo sapiens
gccctccctcccaggtgggtgtt

SEQ ID NO: 7154056 - DNA, 22 bp, Homo sapiens
gccctcccctctgggtggtgag

SEQ ID NO: 7154057 - DNA, 22 bp, Homo sapiens
gccctcccctctgggtggtgag

SEQ ID NO: 7154058 - DNA, 22 bp, Homo sapiens
gccctcccctctgggtggtgag

SEQ ID NO: 7154059 - DNA, 22 bp, Homo sapiens
gccctccatggtgatccaggcc

SEQ ID NO: 7154060 - DNA, 22 bp, Homo sapiens
gccctcccctctgggtggtgag

SEQ ID NO: 7154061 - DNA, 22 bp, Homo sapiens
gccctccatggtgatccaggcc

SEQ ID NO: 7154062 - DNA, 22 bp, Homo sapiens
gccctcccctctgggtggtgag

SEQ ID NO: 7154063 - DNA, 22 bp, Homo sapiens
atttcttccttctcctagaaga

SEQ ID NO: 7154064 - DNA, 22 bp, Homo sapiens
atttcttccttctcctagaaga

SEQ ID NO: 7154065 - DNA, 23 bp, Homo sapiens
gccctgcccttagcacactcaca

SEQ ID NO: 7154066 - DNA, 22 bp, Homo sapiens
gccctgccgggtattttgtgct

SEQ ID NO: 7154067 - DNA, 23 bp, Homo sapiens
gccctgcccttagcacactcaca

SEQ ID NO: 7154068 - DNA, 22 bp, Homo sapiens
gccctgccctgagccgtagacc

SEQ ID NO: 7154069 - DNA, 22 bp, Homo sapiens
gccctgccctgttgaaactaga

SEQ ID NO: 7154070 - DNA, 22 bp, Homo sapiens
gccctgccctctcggcactcgc

SEQ ID NO: 7154071 - DNA, 22 bp, Homo sapiens
gccctgccctgagccgtagacc

SEQ ID NO: 7154072 - DNA, 22 bp, Homo sapiens
gccctgcagtgcggaggtggca

SEQ ID NO: 7154073 - DNA, 22 bp, Homo sapiens
gccctgcaccccaatggcatga

SEQ ID NO: 7154074 - DNA, 22 bp, Homo sapiens
gccctcctttgcttctcctagt

SEQ ID NO: 7154075 - DNA, 19 bp, Homo sapiens
gccctgcaggaggtggggc

SEQ ID NO: 7154076 - DNA, 22 bp, Homo sapiens
atttacattccatggtggttac

SEQ ID NO: 7154077 - DNA, 22 bp, Homo sapiens
atttacattccatggtggttac

SEQ ID NO: 7154078 - DNA, 17 bp, Homo sapiens
atttacattgtcaccga

SEQ ID NO: 7154079 - DNA, 22 bp, Homo sapiens
atttacataatagactttaggt

SEQ ID NO: 7154080 - DNA, 22 bp, Homo sapiens
atttacagtttagcatttcaag

SEQ ID NO: 7154081 - DNA, 22 bp, Homo sapiens
atttacagtttagcatttcaag

SEQ ID NO: 7154082 - DNA, 22 bp, Homo sapiens
atttacagtttagcatttcaag

SEQ ID NO: 7154083 - DNA, 22 bp, Homo sapiens
atttacataatagactttaggt

SEQ ID NO: 7154084 - DNA, 22 bp, Homo sapiens
atttacataatagactttaggt

SEQ ID NO: 7154085 - DNA, 22 bp, Homo sapiens
atttacataatagactttaggt

SEQ ID NO: 7154086 - DNA, 22 bp, Homo sapiens
atttacagaccctcccactaag

SEQ ID NO: 7154087 - DNA, 22 bp, Homo sapiens
atttacagaccctcccactaag

SEQ ID NO: 7154088 - DNA, 22 bp, Homo sapiens
atttacagaccctcccactaag

SEQ ID NO: 7154089 - DNA, 22 bp, Homo sapiens
atttacagacgtggattagtgc

SEQ ID NO: 7154090 - DNA, 22 bp, Homo sapiens
atttacagacgtggattagtgc

SEQ ID NO: 7154091 - DNA, 22 bp, Homo sapiens
atttacagacgtggattagtgc

SEQ ID NO: 7154092 - DNA, 22 bp, Homo sapiens
atttacagacgtggattagtgc

SEQ ID NO: 7154093 - DNA, 22 bp, Homo sapiens
atttacagtgtgcctactatat

SEQ ID NO: 7154094 - DNA, 22 bp, Homo sapiens
atttacagtgtgcctactatat

SEQ ID NO: 7154095 - DNA, 22 bp, Homo sapiens
atttacagtgtgcctactatat

SEQ ID NO: 7154096 - DNA, 22 bp, Homo sapiens
atttacagtgtgcctactatat

SEQ ID NO: 7154097 - DNA, 22 bp, Homo sapiens
atttacagtgtgcctactatat

SEQ ID NO: 7154098 - DNA, 22 bp, Homo sapiens
atttacagtttagcatttcaag

SEQ ID NO: 7154099 - DNA, 22 bp, Homo sapiens
atttacagtttagcatttcaag

SEQ ID NO: 7154100 - DNA, 22 bp, Homo sapiens
atttacagtttagcatttcaag

SEQ ID NO: 7154101 - DNA, 22 bp, Homo sapiens
atttacagtttagcatttcaag

SEQ ID NO: 7154102 - DNA, 18 bp, Homo sapiens
gccagagggaagcaggtg

SEQ ID NO: 7154103 - DNA, 18 bp, Homo sapiens
gccagagggaagcaggtg

SEQ ID NO: 7154104 - DNA, 18 bp, Homo sapiens
gccagagggaagcaggtg

SEQ ID NO: 7154105 - DNA, 22 bp, Homo sapiens
gccagagggattcctggtgtgt

SEQ ID NO: 7154106 - DNA, 18 bp, Homo sapiens
atttacccagcaacgtgg

SEQ ID NO: 7154107 - DNA, 22 bp, Homo sapiens
atttactaatgtcatatcgcgt

SEQ ID NO: 7154108 - DNA, 18 bp, Homo sapiens
gccagagggaagcaggtg

SEQ ID NO: 7154109 - DNA, 18 bp, Homo sapiens
gccagagggaagcaggtg

SEQ ID NO: 7154110 - DNA, 18 bp, Homo sapiens
gccagagggaagcaggtg

SEQ ID NO: 7154111 - DNA, 18 bp, Homo sapiens
gccagagggaagcaggtg

SEQ ID NO: 7154112 - DNA, 17 bp, Homo sapiens
atttacattgtcaccga

SEQ ID NO: 7154113 - DNA, 17 bp, Homo sapiens
atttacattgtcaccga

SEQ ID NO: 7154114 - DNA, 17 bp, Homo sapiens
atttacattgtcaccga

SEQ ID NO: 7154115 - DNA, 22 bp, Homo sapiens
atttacatttatttgagaaggt

SEQ ID NO: 7154116 - DNA, 22 bp, Homo sapiens
atttacatttatttgagaaggt

SEQ ID NO: 7154117 - DNA, 22 bp, Homo sapiens
atttaccatatgtactgagtat

SEQ ID NO: 7154118 - DNA, 22 bp, Homo sapiens
gccagagggattcctggtgtgt

SEQ ID NO: 7154119 - DNA, 18 bp, Homo sapiens
gccagagggcccaaggtc

SEQ ID NO: 7154120 - DNA, 18 bp, Homo sapiens
gccagagggcccaaggtc

SEQ ID NO: 7154121 - DNA, 22 bp, Homo sapiens
gccagaggggctcgaaggcgcg

SEQ ID NO: 7154122 - DNA, 22 bp, Homo sapiens
gccagaggggctcgaaggcgcg

SEQ ID NO: 7154123 - DNA, 22 bp, Homo sapiens
gccagaggggctcgaaggcgcg

SEQ ID NO: 7154124 - DNA, 22 bp, Homo sapiens
gccagaggggctcgaaggcgcg

SEQ ID NO: 7154125 - DNA, 22 bp, Homo sapiens
gccagaggggctcgaaggcgcg

SEQ ID NO: 7154126 - DNA, 22 bp, Homo sapiens
gccagaggggctcgaaggcgcg

SEQ ID NO: 7154127 - DNA, 22 bp, Homo sapiens
gccagaggggctcgaaggcgcg

SEQ ID NO: 7154128 - DNA, 18 bp, Homo sapiens
gccagaggtactactgat

SEQ ID NO: 7154129 - DNA, 18 bp, Homo sapiens
gccagaggtactactgat

SEQ ID NO: 7154130 - DNA, 22 bp, Homo sapiens
gccagaggtatcaaagatagta

SEQ ID NO: 7154131 - DNA, 22 bp, Homo sapiens
gccagaggtatcaaagatagta

SEQ ID NO: 7154132 - DNA, 18 bp, Homo sapiens
gccagaggtactactgat

SEQ ID NO: 7154133 - DNA, 18 bp, Homo sapiens
gccagaggtactactgat

SEQ ID NO: 7154134 - DNA, 20 bp, Homo sapiens
gcccactctaatccactgtc

SEQ ID NO: 7154135 - DNA, 20 bp, Homo sapiens
gcccactctaatccactgtc

SEQ ID NO: 7154136 - DNA, 22 bp, Homo sapiens
gcccactccagcttctcccaca

SEQ ID NO: 7154137 - DNA, 22 bp, Homo sapiens
gcccactccagcttctcccaca

SEQ ID NO: 7154138 - DNA, 22 bp, Homo sapiens
gccagaggttcaacaactgtct

SEQ ID NO: 7154139 - DNA, 22 bp, Homo sapiens
gccagaggttcaacaactgtct

SEQ ID NO: 7154140 - DNA, 22 bp, Homo sapiens
gcccactccagcttctcccaca

SEQ ID NO: 7154141 - DNA, 22 bp, Homo sapiens
gcccagcaggacagagtggttt

SEQ ID NO: 7154142 - DNA, 22 bp, Homo sapiens
gcccagcaggacagagtggttt

SEQ ID NO: 7154143 - DNA, 22 bp, Homo sapiens
gcccagcaggacagagtggttt

SEQ ID NO: 7154144 - DNA, 22 bp, Homo sapiens
gcccagcaggacagagtggttt

SEQ ID NO: 7154145 - DNA, 22 bp, Homo sapiens
gcccagcaggacagagtggttt

SEQ ID NO: 7154146 - DNA, 22 bp, Homo sapiens
gcccagcaggggatggcagctc

SEQ ID NO: 7154147 - DNA, 22 bp, Homo sapiens
gcccagcaggggatggcagctc

SEQ ID NO: 7154148 - DNA, 22 bp, Homo sapiens
gcccagcaggggatggcagctc

SEQ ID NO: 7154149 - DNA, 22 bp, Homo sapiens
gcccagcaggggatggcagctc

SEQ ID NO: 7154150 - DNA, 22 bp, Homo sapiens
gcccagcaggggatggcagctc

SEQ ID NO: 7154151 - DNA, 22 bp, Homo sapiens
gcccagccacagtcactttcat

SEQ ID NO: 7154152 - DNA, 22 bp, Homo sapiens
gcccagccacagtcactttcat

SEQ ID NO: 7154153 - DNA, 22 bp, Homo sapiens
gcccagccacagtcactttcat

SEQ ID NO: 7154154 - DNA, 22 bp, Homo sapiens
gcccagccagagctgtgtgatg

SEQ ID NO: 7154155 - DNA, 22 bp, Homo sapiens
gcccagccagagctgtgtgatg

SEQ ID NO: 7154156 - DNA, 22 bp, Homo sapiens
gcccagccagagctgtgtgatg

SEQ ID NO: 7154157 - DNA, 22 bp, Homo sapiens
gcccagccagagctgtgtgatg

SEQ ID NO: 7154158 - DNA, 22 bp, Homo sapiens
gcccagccagagctgtgtgatg

SEQ ID NO: 7154159 - DNA, 22 bp, Homo sapiens
gcccagcccagaaaggttcgga

SEQ ID NO: 7154160 - DNA, 22 bp, Homo sapiens
gcccagcccagaaaggttcgga

SEQ ID NO: 7154161 - DNA, 22 bp, Homo sapiens
gcccagcccctgggtggacgtg

SEQ ID NO: 7154162 - DNA, 22 bp, Homo sapiens
gcccagcccctgggtggacgtg

SEQ ID NO: 7154163 - DNA, 22 bp, Homo sapiens
gcccagcccctgggtggacgtg

SEQ ID NO: 7154164 - DNA, 22 bp, Homo sapiens
gcccagcccctgggtggacgtg

SEQ ID NO: 7154165 - DNA, 22 bp, Homo sapiens
atttgcataatagtgatttgta

SEQ ID NO: 7154166 - DNA, 22 bp, Homo sapiens
atttgcaggtgtcgattagtct

SEQ ID NO: 7154167 - DNA, 22 bp, Homo sapiens
atttgcagttattgttcatgaa

SEQ ID NO: 7154168 - DNA, 22 bp, Homo sapiens
atttgcataaggatgctactgt

SEQ ID NO: 7154169 - DNA, 18 bp, Homo sapiens
atttgcaggcatgcaggc

SEQ ID NO: 7154170 - DNA, 22 bp, Homo sapiens
atttgcagggaagggcagaagg

SEQ ID NO: 7154171 - DNA, 22 bp, Homo sapiens
atttgcagattctgtcaggttt

SEQ ID NO: 7154172 - DNA, 22 bp, Homo sapiens
atttgcagctaggatccaaagt

SEQ ID NO: 7154173 - DNA, 22 bp, Homo sapiens
atttgcagaagggagggggacc

SEQ ID NO: 7154174 - DNA, 22 bp, Homo sapiens
atttgcagagctctgaattttg

SEQ ID NO: 7154175 - DNA, 22 bp, Homo sapiens
atttgatttgtagatagtgtag

SEQ ID NO: 7154176 - DNA, 22 bp, Homo sapiens
atttgatttgtagatagtgtag

SEQ ID NO: 7154177 - DNA, 22 bp, Homo sapiens
atttgatttgtagatagtgtag

SEQ ID NO: 7154178 - DNA, 22 bp, Homo sapiens
atttgattagctgtgtaatttt

SEQ ID NO: 7154179 - DNA, 22 bp, Homo sapiens
atttgattagctgtgtaatttt

SEQ ID NO: 7154180 - DNA, 22 bp, Homo sapiens
atttgagatggtaaataacttt

SEQ ID NO: 7154181 - DNA, 22 bp, Homo sapiens
atttgagatggtaaataacttt

SEQ ID NO: 7154182 - DNA, 22 bp, Homo sapiens
atttgagatggtaaataacttt

SEQ ID NO: 7154183 - DNA, 22 bp, Homo sapiens
atttgagcttggtagaggagag

SEQ ID NO: 7154184 - DNA, 22 bp, Homo sapiens
atttgattagctgtgtaatttt

SEQ ID NO: 7154185 - DNA, 22 bp, Homo sapiens
atttgagaaaggagggaacttt

SEQ ID NO: 7154186 - DNA, 22 bp, Homo sapiens
atttgagaaaggagggaacttt

SEQ ID NO: 7154187 - DNA, 23 bp, Homo sapiens
atttgagaaagtatttttaagac

SEQ ID NO: 7154188 - DNA, 23 bp, Homo sapiens
atttgacagagcatagcatttct

SEQ ID NO: 7154189 - DNA, 23 bp, Homo sapiens
atttgacagagcatagcatttct

SEQ ID NO: 7154190 - DNA, 22 bp, Homo sapiens
atttgcctgtaagacaaggcct

SEQ ID NO: 7154191 - DNA, 22 bp, Homo sapiens
atttgccttactgaagaaggag

SEQ ID NO: 7154192 - DNA, 22 bp, Homo sapiens
atttgccttactgaagaaggag

SEQ ID NO: 7154193 - DNA, 20 bp, Homo sapiens
atttgcatctgaataactta

SEQ ID NO: 7154194 - DNA, 22 bp, Homo sapiens
atttgcatgcttctattgtgaa

SEQ ID NO: 7154195 - DNA, 23 bp, Homo sapiens
atttgcatggccggattatggat

SEQ ID NO: 7154196 - DNA, 23 bp, Homo sapiens
attttaaccttgactaacatgca

SEQ ID NO: 7154197 - DNA, 22 bp, Homo sapiens
atttgccttttaaactcacaat

SEQ ID NO: 7154198 - DNA, 22 bp, Homo sapiens
atttgtctgcttgctgccttcc

SEQ ID NO: 7154199 - DNA, 22 bp, Homo sapiens
atttgtctgcttgctgccttcc

SEQ ID NO: 7154200 - DNA, 22 bp, Homo sapiens
atttgtcttcagtaggttcttc

SEQ ID NO: 7154201 - DNA, 22 bp, Homo sapiens
atttgtcttcagtaggttcttc

SEQ ID NO: 7154202 - DNA, 22 bp, Homo sapiens
atttgtctttgagtgccctgct

SEQ ID NO: 7154203 - DNA, 22 bp, Homo sapiens
atttgtctttggacctgtgaga

SEQ ID NO: 7154204 - DNA, 22 bp, Homo sapiens
atttgtctttggacctgtgaga

SEQ ID NO: 7154205 - DNA, 22 bp, Homo sapiens
attttaaggcttatttaaaggc

SEQ ID NO: 7154206 - DNA, 22 bp, Homo sapiens
attttaaggcttatttaaaggc

SEQ ID NO: 7154207 - DNA, 22 bp, Homo sapiens
attttaataagatccatttggt

SEQ ID NO: 7154208 - DNA, 22 bp, Homo sapiens
attttaataagatccatttggt

SEQ ID NO: 7154209 - DNA, 22 bp, Homo sapiens
attttaataagatccatttggt

SEQ ID NO: 7154210 - DNA, 22 bp, Homo sapiens
attttaataagattcccaagta

SEQ ID NO: 7154211 - DNA, 23 bp, Homo sapiens
attttacaggtcagttccttgaa

SEQ ID NO: 7154212 - DNA, 23 bp, Homo sapiens
attttacaggtcagttccttgaa

SEQ ID NO: 7154213 - DNA, 22 bp, Homo sapiens
gcctggctccctctgcagctcc

SEQ ID NO: 7154214 - DNA, 22 bp, Homo sapiens
gcctggctcctaagagcacaac

SEQ ID NO: 7154215 - DNA, 22 bp, Homo sapiens
gcctggctatggcctcccccat

SEQ ID NO: 7154216 - DNA, 22 bp, Homo sapiens
gcctggctcacagagcagcctt

SEQ ID NO: 7154217 - DNA, 22 bp, Homo sapiens
gcctggctcacagagcagcctt

SEQ ID NO: 7154218 - DNA, 22 bp, Homo sapiens
gcctggctcacagagcagcctt

SEQ ID NO: 7154219 - DNA, 22 bp, Homo sapiens
gcctggctccctctgcagctcc

SEQ ID NO: 7154220 - DNA, 18 bp, Homo sapiens
attttgaacaatgctgta

SEQ ID NO: 7154221 - DNA, 18 bp, Homo sapiens
attttgaactgggaatat

SEQ ID NO: 7154222 - DNA, 18 bp, Homo sapiens
attttgaactgggaatat

SEQ ID NO: 7154223 - DNA, 22 bp, Homo sapiens
attttgaagggaattgaagttc

SEQ ID NO: 7154224 - DNA, 22 bp, Homo sapiens
attttgaagggaattgaagttc

SEQ ID NO: 7154225 - DNA, 18 bp, Homo sapiens
attttgaacaatgctgta

SEQ ID NO: 7154226 - DNA, 18 bp, Homo sapiens
attttgaacaatgctgta

SEQ ID NO: 7154227 - DNA, 22 bp, Homo sapiens
attttgaaatacttgaaggaaa

SEQ ID NO: 7154228 - DNA, 22 bp, Homo sapiens
attttgaaatacttgaaggaaa

SEQ ID NO: 7154229 - DNA, 22 bp, Homo sapiens
attttgaaatacttgaaggaaa

SEQ ID NO: 7154230 - DNA, 22 bp, Homo sapiens
attttgaaaagcatttgagtaa

SEQ ID NO: 7154231 - DNA, 22 bp, Homo sapiens
attttgaaaccaagttatttcc

SEQ ID NO: 7154232 - DNA, 22 bp, Homo sapiens
attttgaaaccaagttatttcc

SEQ ID NO: 7154233 - DNA, 22 bp, Homo sapiens
attttgaaaccaagttatttcc

SEQ ID NO: 7154234 - DNA, 22 bp, Homo sapiens
attttgaaaccaagttatttcc

SEQ ID NO: 7154235 - DNA, 22 bp, Homo sapiens
attttcttctctccctggctgc

SEQ ID NO: 7154236 - DNA, 22 bp, Homo sapiens
attttcttctctccctggctgc

SEQ ID NO: 7154237 - DNA, 22 bp, Homo sapiens
attttcttctctccctggctgc

SEQ ID NO: 7154238 - DNA, 22 bp, Homo sapiens
attttcttctctccctggctgc

SEQ ID NO: 7154239 - DNA, 22 bp, Homo sapiens
attttcttctctccctggctgc

SEQ ID NO: 7154240 - DNA, 22 bp, Homo sapiens
attttgaaaagcatttgagtaa

SEQ ID NO: 7154241 - DNA, 22 bp, Homo sapiens
attttgaaaagcatttgagtaa

SEQ ID NO: 7154242 - DNA, 22 bp, Homo sapiens
attttgaaaagcatttgagtaa

SEQ ID NO: 7154243 - DNA, 22 bp, Homo sapiens
attttctgtgtgcagataaata

SEQ ID NO: 7154244 - DNA, 22 bp, Homo sapiens
attttcttctctccctggctgc

SEQ ID NO: 7154245 - DNA, 22 bp, Homo sapiens
attttctagatagatgatgcat

SEQ ID NO: 7154246 - DNA, 22 bp, Homo sapiens
attttctagatagatgatgcat

SEQ ID NO: 7154247 - DNA, 22 bp, Homo sapiens
gcctgcctagaattgcagcttt

SEQ ID NO: 7154248 - DNA, 22 bp, Homo sapiens
gcctgcctagaattgcagcttt

SEQ ID NO: 7154249 - DNA, 22 bp, Homo sapiens
gcctgcctagaattgcagcttt

SEQ ID NO: 7154250 - DNA, 23 bp, Homo sapiens
gcctgccgcctggctgagaactg

SEQ ID NO: 7154251 - DNA, 22 bp, Homo sapiens
gcctgccctgaaagaggtgaag

SEQ ID NO: 7154252 - DNA, 22 bp, Homo sapiens
gcctgccctgaaagaggtgaag

SEQ ID NO: 7154253 - DNA, 21 bp, Homo sapiens
gcctgccctctgtgatggcca

SEQ ID NO: 7154254 - DNA, 22 bp, Homo sapiens
gcctgccctgaaagaggtgaag

SEQ ID NO: 7154255 - DNA, 21 bp, Homo sapiens
gcctgccctctgtgatggcca

SEQ ID NO: 7154256 - DNA, 22 bp, Homo sapiens
gcctgccccttcctgggcaggg

SEQ ID NO: 7154257 - DNA, 22 bp, Homo sapiens
gcctgccccttcctgggcaggg

SEQ ID NO: 7154258 - DNA, 22 bp, Homo sapiens
gcctgccccttcctgggcaggg

SEQ ID NO: 7154259 - DNA, 22 bp, Homo sapiens
gcctgccccttcctgggcaggg

SEQ ID NO: 7154260 - DNA, 21 bp, Homo sapiens
gcctgccccatgtttctgttg

SEQ ID NO: 7154261 - DNA, 22 bp, Homo sapiens
gcctgccccttcctgggcaggg

SEQ ID NO: 7154262 - DNA, 22 bp, Homo sapiens
gcctgcccacggggctggcata

SEQ ID NO: 7154263 - DNA, 22 bp, Homo sapiens
gcctgcccacggggctggcata

SEQ ID NO: 7154264 - DNA, 22 bp, Homo sapiens
gcctgcccacggggctggcata

SEQ ID NO: 7154265 - DNA, 22 bp, Homo sapiens
gcctgcccacggggctggcata

SEQ ID NO: 7154266 - DNA, 22 bp, Homo sapiens
attttactactccaattaatga

SEQ ID NO: 7154267 - DNA, 23 bp, Homo sapiens
attttacaggtcagttccttgaa

SEQ ID NO: 7154268 - DNA, 22 bp, Homo sapiens
attttacataaggaaggtttaa

SEQ ID NO: 7154269 - DNA, 22 bp, Homo sapiens
attttacataaggaaggtttaa

SEQ ID NO: 7154270 - DNA, 22 bp, Homo sapiens
attttacataaggaaggtttaa

SEQ ID NO: 7154271 - DNA, 23 bp, Homo sapiens
attttacaggtcagttccttgaa

SEQ ID NO: 7154272 - DNA, 23 bp, Homo sapiens
attttacaggtcagttccttgaa

SEQ ID NO: 7154273 - DNA, 22 bp, Homo sapiens
attttacataaggaaggtttaa

SEQ ID NO: 7154274 - DNA, 22 bp, Homo sapiens
gatcgattcagtgtgcctaccc

SEQ ID NO: 7154275 - DNA, 22 bp, Homo sapiens
gatcctttggtttctgatttag

SEQ ID NO: 7154276 - DNA, 18 bp, Homo sapiens
gatcgggggcgccccaag

SEQ ID NO: 7154277 - DNA, 22 bp, Homo sapiens
gatctagaaggcaaatatagtg

SEQ ID NO: 7154278 - DNA, 22 bp, Homo sapiens
gatcctgtctccgcaccgtgtt

SEQ ID NO: 7154279 - DNA, 22 bp, Homo sapiens
gatcctgtctgtggagtcagca

SEQ ID NO: 7154280 - DNA, 22 bp, Homo sapiens
gatcctgttagaaatgtagact

SEQ ID NO: 7154281 - DNA, 22 bp, Homo sapiens
gatcctgttataatttggatgt

SEQ ID NO: 7154282 - DNA, 22 bp, Homo sapiens
gatatttacattaagcacattg

SEQ ID NO: 7154283 - DNA, 22 bp, Homo sapiens
gatatttacattaagcacattg

SEQ ID NO: 7154284 - DNA, 22 bp, Homo sapiens
gatatttacaaatttgccaata

SEQ ID NO: 7154285 - DNA, 22 bp, Homo sapiens
gatcctgggactgaatgggtgc

SEQ ID NO: 7154286 - DNA, 22 bp, Homo sapiens
gatatttacaaatttgccaata

SEQ ID NO: 7154287 - DNA, 22 bp, Homo sapiens
gatatttacaaatttgccaata

SEQ ID NO: 7154288 - DNA, 22 bp, Homo sapiens
gagttaatgtgtacacaaaggg

SEQ ID NO: 7154289 - DNA, 22 bp, Homo sapiens
gagttaatactgagtttattaa

SEQ ID NO: 7154290 - DNA, 22 bp, Homo sapiens
gagttaatagggttctttgtga

SEQ ID NO: 7154291 - DNA, 22 bp, Homo sapiens
gagttacacaaaatttctattt

SEQ ID NO: 7154292 - DNA, 22 bp, Homo sapiens
gagttaattcgaatattctagc

SEQ ID NO: 7154293 - DNA, 22 bp, Homo sapiens
gagttacacaaaatttctattt

SEQ ID NO: 7154294 - DNA, 22 bp, Homo sapiens
gagttacacagaagtcagtttg

SEQ ID NO: 7154295 - DNA, 22 bp, Homo sapiens
gagttacacagaagtcagtttg

SEQ ID NO: 7154296 - DNA, 22 bp, Homo sapiens
gagttacacagaagtcagtttg

SEQ ID NO: 7154297 - DNA, 22 bp, Homo sapiens
gagttacagagaggattatggt

SEQ ID NO: 7154298 - DNA, 22 bp, Homo sapiens
gagttacagagaggattatggt

SEQ ID NO: 7154299 - DNA, 22 bp, Homo sapiens
gagttacatggacattctctcc

SEQ ID NO: 7154300 - DNA, 22 bp, Homo sapiens
gagttacatggacattctctcc

SEQ ID NO: 7154301 - DNA, 22 bp, Homo sapiens
gagttacattcattgttacgct

SEQ ID NO: 7154302 - DNA, 22 bp, Homo sapiens
gagttacattcattgttacgct

SEQ ID NO: 7154303 - DNA, 22 bp, Homo sapiens
gagttacatttggtgacacttc

SEQ ID NO: 7154304 - DNA, 22 bp, Homo sapiens
gagttacatttggtgacacttc

SEQ ID NO: 7154305 - DNA, 22 bp, Homo sapiens
gagttatagatggactattatt

SEQ ID NO: 7154306 - DNA, 22 bp, Homo sapiens
gagttatagatggactattatt

SEQ ID NO: 7154307 - DNA, 22 bp, Homo sapiens
gagttatatcctgagtcatatt

SEQ ID NO: 7154308 - DNA, 22 bp, Homo sapiens
gagttatatcctgagtcatatt

SEQ ID NO: 7154309 - DNA, 22 bp, Homo sapiens
gagttagagccatagagcacgg

SEQ ID NO: 7154310 - DNA, 22 bp, Homo sapiens
gagttagcaaagggtggcaggg

SEQ ID NO: 7154311 - DNA, 22 bp, Homo sapiens
gagttagggccccgcggccgtg

SEQ ID NO: 7154312 - DNA, 22 bp, Homo sapiens
gagttagggccccgcggccgtg

SEQ ID NO: 7154313 - DNA, 22 bp, Homo sapiens
gagttataacctagtttaactg

SEQ ID NO: 7154314 - DNA, 22 bp, Homo sapiens
gagttatatttgcgatattgga

SEQ ID NO: 7154315 - DNA, 22 bp, Homo sapiens
gagttatatttgcgatattgga

SEQ ID NO: 7154316 - DNA, 22 bp, Homo sapiens
gagttattgagtatagaatgta

SEQ ID NO: 7154317 - DNA, 22 bp, Homo sapiens
gatctctgctggaagggacacc

SEQ ID NO: 7154318 - DNA, 21 bp, Homo sapiens
gatctctggaatgactctggc

SEQ ID NO: 7154319 - DNA, 18 bp, Homo sapiens
gatctctgcagtgcctac

SEQ ID NO: 7154320 - DNA, 21 bp, Homo sapiens
gatctctggaaggagaaagct

SEQ ID NO: 7154321 - DNA, 22 bp, Homo sapiens
gatctagaccagaagctgttgt

SEQ ID NO: 7154322 - DNA, 21 bp, Homo sapiens
gatctagacttgggcccagta

SEQ ID NO: 7154323 - DNA, 22 bp, Homo sapiens
gatctatttactcttttcctag

SEQ ID NO: 7154324 - DNA, 22 bp, Homo sapiens
gatctcctggacgtcttgttaa

SEQ ID NO: 7154325 - DNA, 22 bp, Homo sapiens
gatctgaatcaatagaataact

SEQ ID NO: 7154326 - DNA, 22 bp, Homo sapiens
gatctgagatctaaaccagagg

SEQ ID NO: 7154327 - DNA, 22 bp, Homo sapiens
gatctggaagaaagggagggca

SEQ ID NO: 7154328 - DNA, 22 bp, Homo sapiens
gatctggaatctgaaggctgag

SEQ ID NO: 7154329 - DNA, 22 bp, Homo sapiens
gatctggaatctgaaggctgag

SEQ ID NO: 7154330 - DNA, 22 bp, Homo sapiens
gatctggaatctgaaggctgag

SEQ ID NO: 7154331 - DNA, 22 bp, Homo sapiens
gatctggaatctgaaggctgag

SEQ ID NO: 7154332 - DNA, 22 bp, Homo sapiens
gatctggaatctgaaggctgag

SEQ ID NO: 7154333 - DNA, 22 bp, Homo sapiens
gatctgggagcctcatggagac

SEQ ID NO: 7154334 - DNA, 22 bp, Homo sapiens
atgtttcatttagatatcaggc

SEQ ID NO: 7154335 - DNA, 22 bp, Homo sapiens
atgtttccattttcttgtatca

SEQ ID NO: 7154336 - DNA, 22 bp, Homo sapiens
atgtttcgtggaaaaagagtct

SEQ ID NO: 7154337 - DNA, 23 bp, Homo sapiens
gagtgcagaatagacatgcagtg

SEQ ID NO: 7154338 - DNA, 17 bp, Homo sapiens
gagtgcagacacaagca

SEQ ID NO: 7154339 - DNA, 22 bp, Homo sapiens
gagtgcagatgccagccccagt

SEQ ID NO: 7154340 - DNA, 21 bp, Homo sapiens
gagtgcagcaaggtagagtct

SEQ ID NO: 7154341 - DNA, 21 bp, Homo sapiens
gagtgcagcaaggtagagtct

SEQ ID NO: 7154342 - DNA, 22 bp, Homo sapiens
gagtgcaggcctgagcaccatc

SEQ ID NO: 7154343 - DNA, 21 bp, Homo sapiens
gagtgcaggtctgatgccatc

SEQ ID NO: 7154344 - DNA, 23 bp, Homo sapiens
gagtgcagaatagacatgcagtg

SEQ ID NO: 7154345 - DNA, 22 bp, Homo sapiens
gagtccagttctttccagcagt

SEQ ID NO: 7154346 - DNA, 22 bp, Homo sapiens
gagtccagtgatgttcctggtc

SEQ ID NO: 7154347 - DNA, 22 bp, Homo sapiens
gagtccagttagtgaggctggg

SEQ ID NO: 7154348 - DNA, 22 bp, Homo sapiens
gagtccagttagtgaggctggg

SEQ ID NO: 7154349 - DNA, 22 bp, Homo sapiens
gagtccagttagtgaggctggg

SEQ ID NO: 7154350 - DNA, 22 bp, Homo sapiens
gagtccagtagttaggacagag

SEQ ID NO: 7154351 - DNA, 22 bp, Homo sapiens
gagtccagtagttaggacagag

SEQ ID NO: 7154352 - DNA, 22 bp, Homo sapiens
gagtccagtagttaggacagag

SEQ ID NO: 7154353 - DNA, 20 bp, Homo sapiens
gagtccaggggcctgtagca

SEQ ID NO: 7154354 - DNA, 22 bp, Homo sapiens
gagtccaggctgttgctcatct

SEQ ID NO: 7154355 - DNA, 20 bp, Homo sapiens
gagtccaggggcctgtagca

SEQ ID NO: 7154356 - DNA, 20 bp, Homo sapiens
gagtccaggggcctgtagca

SEQ ID NO: 7154357 - DNA, 22 bp, Homo sapiens
atgtttaattatctgggttttg

SEQ ID NO: 7154358 - DNA, 22 bp, Homo sapiens
atgtttaattatctgggttttg

SEQ ID NO: 7154359 - DNA, 20 bp, Homo sapiens
atgtttaatgttgtccaccc

SEQ ID NO: 7154360 - DNA, 21 bp, Homo sapiens
gagtgcaggtctgatgccatc

SEQ ID NO: 7154361 - DNA, 21 bp, Homo sapiens
gagtgcaggtctgatgccatc

SEQ ID NO: 7154362 - DNA, 22 bp, Homo sapiens
atgtttattgttttaagctgct

SEQ ID NO: 7154363 - DNA, 22 bp, Homo sapiens
atgtttattttgcagagtaggg

SEQ ID NO: 7154364 - DNA, 22 bp, Homo sapiens
atgtttcaatgcactttagcct

SEQ ID NO: 7154365 - DNA, 22 bp, Homo sapiens
atgtttcaagagaaaaagagac

SEQ ID NO: 7154366 - DNA, 22 bp, Homo sapiens
atgtttcaagagaaaaagagac

SEQ ID NO: 7154367 - DNA, 22 bp, Homo sapiens
atgtttcaaatatatagagttg

SEQ ID NO: 7154368 - DNA, 22 bp, Homo sapiens
atgtttcaaatatatagagttg

SEQ ID NO: 7154369 - DNA, 22 bp, Homo sapiens
atgtttcaccagttttataaga

SEQ ID NO: 7154370 - DNA, 22 bp, Homo sapiens
atgtttcaccagttttataaga

SEQ ID NO: 7154371 - DNA, 22 bp, Homo sapiens
atgtttcaccagcaaattacct

SEQ ID NO: 7154372 - DNA, 22 bp, Homo sapiens
atgtttcaccagcaaattacct

SEQ ID NO: 7154373 - DNA, 22 bp, Homo sapiens
atgtttcagatacagatcaaat

SEQ ID NO: 7154374 - DNA, 22 bp, Homo sapiens
atgtttcagatacagatcaaat

SEQ ID NO: 7154375 - DNA, 22 bp, Homo sapiens
atgtttcaccagttttataaga

SEQ ID NO: 7154376 - DNA, 22 bp, Homo sapiens
atgtttcagatacagatcaaat

SEQ ID NO: 7154377 - DNA, 22 bp, Homo sapiens
atgtttcaggaaatcagctaga

SEQ ID NO: 7154378 - DNA, 22 bp, Homo sapiens
atgtttcaggaaatcagctaga

SEQ ID NO: 7154379 - DNA, 22 bp, Homo sapiens
atgtttcaggaaatcagctaga

SEQ ID NO: 7154380 - DNA, 22 bp, Homo sapiens
atgtttcaggcgaactaacatg

SEQ ID NO: 7154381 - DNA, 22 bp, Homo sapiens
atgtttcaggcgaactaacatg

SEQ ID NO: 7154382 - DNA, 22 bp, Homo sapiens
atgtttcagggtgatagaaggt

SEQ ID NO: 7154383 - DNA, 22 bp, Homo sapiens
atgtttcagggtgatagaaggt

SEQ ID NO: 7154384 - DNA, 22 bp, Homo sapiens
atgtttcagggtgatagaaggt

SEQ ID NO: 7154385 - DNA, 22 bp, Homo sapiens
atgtttcagttctaaagttaga

SEQ ID NO: 7154386 - DNA, 22 bp, Homo sapiens
atgtttcagttctaaagttaga

SEQ ID NO: 7154387 - DNA, 22 bp, Homo sapiens
atgtttcagttctaaagttaga

SEQ ID NO: 7154388 - DNA, 22 bp, Homo sapiens
atgtttcagttctaaagttaga

SEQ ID NO: 7154389 - DNA, 22 bp, Homo sapiens
atgtttcatgactgagcaaaat

SEQ ID NO: 7154390 - DNA, 22 bp, Homo sapiens
atgtttcatgactgagcaaaat

SEQ ID NO: 7154391 - DNA, 22 bp, Homo sapiens
atgtttcatttagatatcaggc

SEQ ID NO: 7154392 - DNA, 22 bp, Homo sapiens
atgtttcatttagatatcaggc

SEQ ID NO: 7154393 - DNA, 22 bp, Homo sapiens
gagttaaatattttctgaagtt

SEQ ID NO: 7154394 - DNA, 22 bp, Homo sapiens
gagttaaatgacttggttaagg

SEQ ID NO: 7154395 - DNA, 22 bp, Homo sapiens
gagggatgtgcctgaaggcagg

SEQ ID NO: 7154396 - DNA, 22 bp, Homo sapiens
gagggcaaaacagagaagatgt

SEQ ID NO: 7154397 - DNA, 22 bp, Homo sapiens
gagggatgtcaggggaccttgg

SEQ ID NO: 7154398 - DNA, 22 bp, Homo sapiens
gagggatgtgcctgaaggcagg

SEQ ID NO: 7154399 - DNA, 22 bp, Homo sapiens
gagggatgtgcctgaaggcagg

SEQ ID NO: 7154400 - DNA, 22 bp, Homo sapiens
gagggatggtgtgagaggctca

SEQ ID NO: 7154401 - DNA, 22 bp, Homo sapiens
gagggatggtgtgagaggctca

SEQ ID NO: 7154402 - DNA, 22 bp, Homo sapiens
gagggatggtagttgacactga

SEQ ID NO: 7154403 - DNA, 22 bp, Homo sapiens
gagggatggtagttgacactga

SEQ ID NO: 7154404 - DNA, 22 bp, Homo sapiens
gagggatggtgtgagaggctca

SEQ ID NO: 7154405 - DNA, 22 bp, Homo sapiens
gagggatggtgtgagaggctca

SEQ ID NO: 7154406 - DNA, 22 bp, Homo sapiens
gagggatggtgtgagaggctca

SEQ ID NO: 7154407 - DNA, 22 bp, Homo sapiens
gagggaaaggttaatacatgat

SEQ ID NO: 7154408 - DNA, 22 bp, Homo sapiens
gagggaaaggttaatacatgat

SEQ ID NO: 7154409 - DNA, 22 bp, Homo sapiens
gaggctgtttgtggcagtgatg

SEQ ID NO: 7154410 - DNA, 22 bp, Homo sapiens
gaggctgttcagtgtccagctt

SEQ ID NO: 7154411 - DNA, 23 bp, Homo sapiens
gaggcttgatcagcttcctccac

SEQ ID NO: 7154412 - DNA, 22 bp, Homo sapiens
gaggcttgcaccatgagcacca

SEQ ID NO: 7154413 - DNA, 22 bp, Homo sapiens
gagggaaacagatgggttgtgg

SEQ ID NO: 7154414 - DNA, 22 bp, Homo sapiens
gaggcttttagtatggggactg

SEQ ID NO: 7154415 - DNA, 22 bp, Homo sapiens
gaggctgtgtttcagtgaggcc

SEQ ID NO: 7154416 - DNA, 22 bp, Homo sapiens
gaggctggaatattagaaatgt

SEQ ID NO: 7154417 - DNA, 22 bp, Homo sapiens
gaggctggaatattagaaatgt

SEQ ID NO: 7154418 - DNA, 22 bp, Homo sapiens
gaggctggaatattagaaatgt

SEQ ID NO: 7154419 - DNA, 22 bp, Homo sapiens
gaggctgtgtcttggggtggaa

SEQ ID NO: 7154420 - DNA, 23 bp, Homo sapiens
gaggccacattcccctgcttgag

SEQ ID NO: 7154421 - DNA, 23 bp, Homo sapiens
gaggccacattcccctgcttgag

SEQ ID NO: 7154422 - DNA, 22 bp, Homo sapiens
gaggccacattacttggtgggt

SEQ ID NO: 7154423 - DNA, 23 bp, Homo sapiens
gaggccacattcccctgcttgag

SEQ ID NO: 7154424 - DNA, 23 bp, Homo sapiens
gaggccacattcccctgcttgag

SEQ ID NO: 7154425 - DNA, 22 bp, Homo sapiens
gaggccacattacttggtgggt

SEQ ID NO: 7154426 - DNA, 22 bp, Homo sapiens
gaggccacagtgtctgggggcc

SEQ ID NO: 7154427 - DNA, 22 bp, Homo sapiens
gaggccacagtcctgaggcatc

SEQ ID NO: 7154428 - DNA, 22 bp, Homo sapiens
gaggccacagctatcagggaca

SEQ ID NO: 7154429 - DNA, 22 bp, Homo sapiens
gaggccacagtcagtgttcatc

SEQ ID NO: 7154430 - DNA, 22 bp, Homo sapiens
gaggccacagtcagtgttcatc

SEQ ID NO: 7154431 - DNA, 22 bp, Homo sapiens
gaggccacagtcctgaggcatc

SEQ ID NO: 7154432 - DNA, 22 bp, Homo sapiens
gaggccaaggtgggcagatcac

SEQ ID NO: 7154433 - DNA, 17 bp, Homo sapiens
gaggccaaggcaggcgg

SEQ ID NO: 7154434 - DNA, 22 bp, Homo sapiens
gaggccaactttggagaacagg

SEQ ID NO: 7154435 - DNA, 22 bp, Homo sapiens
gaggccaactttggagaacagg

SEQ ID NO: 7154436 - DNA, 22 bp, Homo sapiens
gaggccaaggtgggcagatcac

SEQ ID NO: 7154437 - DNA, 22 bp, Homo sapiens
gaggccaagttggagaccaggt

SEQ ID NO: 7154438 - DNA, 22 bp, Homo sapiens
gaggccaagttggagaccaggt

SEQ ID NO: 7154439 - DNA, 22 bp, Homo sapiens
gaggccaatgaagtgagtttaa

SEQ ID NO: 7154440 - DNA, 22 bp, Homo sapiens
gaggccacagctatcagggaca

SEQ ID NO: 7154441 - DNA, 22 bp, Homo sapiens
atgtcacattggagctgctgga

SEQ ID NO: 7154442 - DNA, 22 bp, Homo sapiens
atgtcacatggttctggggcct

SEQ ID NO: 7154443 - DNA, 22 bp, Homo sapiens
atgtcacattggagctgctgga

SEQ ID NO: 7154444 - DNA, 22 bp, Homo sapiens
atgtcacatggtcacctctagc

SEQ ID NO: 7154445 - DNA, 22 bp, Homo sapiens
atgtcacatggtcacctctagc

SEQ ID NO: 7154446 - DNA, 22 bp, Homo sapiens
gaggcattaaagggaatcttct

SEQ ID NO: 7154447 - DNA, 22 bp, Homo sapiens
atgtcacatgagagcgcagcac

SEQ ID NO: 7154448 - DNA, 22 bp, Homo sapiens
atgtcacatggcctgtactttg

SEQ ID NO: 7154449 - DNA, 22 bp, Homo sapiens
atgtcacatggcctgtactttg

SEQ ID NO: 7154450 - DNA, 22 bp, Homo sapiens
atgtcacatggtcacctctagc

SEQ ID NO: 7154451 - DNA, 22 bp, Homo sapiens
atgtcacatctgggatggccct

SEQ ID NO: 7154452 - DNA, 22 bp, Homo sapiens
gaggggtcacatgggctggctt

SEQ ID NO: 7154453 - DNA, 22 bp, Homo sapiens
gagggggtctatgaggtagagc

SEQ ID NO: 7154454 - DNA, 23 bp, Homo sapiens
gaggtacagcaccagtgaatagg

SEQ ID NO: 7154455 - DNA, 22 bp, Homo sapiens
gaggtaattactatgttcagat

SEQ ID NO: 7154456 - DNA, 22 bp, Homo sapiens
gaggtacagagtgttccaatgt

SEQ ID NO: 7154457 - DNA, 18 bp, Homo sapiens
gaggtagataagattttc

SEQ ID NO: 7154458 - DNA, 18 bp, Homo sapiens
gaggtagataagattttc

SEQ ID NO: 7154459 - DNA, 22 bp, Homo sapiens
gaggtacatgaggatacacagg

SEQ ID NO: 7154460 - DNA, 22 bp, Homo sapiens
gaggtacagagtgttccaatgt

SEQ ID NO: 7154461 - DNA, 22 bp, Homo sapiens
gaggtacatgaggatacacagg

SEQ ID NO: 7154462 - DNA, 22 bp, Homo sapiens
gaggtactttctggttcaggtg

SEQ ID NO: 7154463 - DNA, 22 bp, Homo sapiens
gaggtagcgagtggacagtgca

SEQ ID NO: 7154464 - DNA, 22 bp, Homo sapiens
gaggtagcgagtggacagtgca

SEQ ID NO: 7154465 - DNA, 22 bp, Homo sapiens
gaggtagccacagatagagact

SEQ ID NO: 7154466 - DNA, 17 bp, Homo sapiens
gaggtaggaagtgagtc

SEQ ID NO: 7154467 - DNA, 17 bp, Homo sapiens
gaggtaggaagtgagtc

SEQ ID NO: 7154468 - DNA, 17 bp, Homo sapiens
gaggtaggaagtgagtc

SEQ ID NO: 7154469 - DNA, 22 bp, Homo sapiens
gaggtaggaggtaggtattgtg

SEQ ID NO: 7154470 - DNA, 22 bp, Homo sapiens
gaggtaggaggtaggtattgtg

SEQ ID NO: 7154471 - DNA, 22 bp, Homo sapiens
gaggtaggaggtaggtattgtg

SEQ ID NO: 7154472 - DNA, 22 bp, Homo sapiens
gaggtaggcagggtgacttggc

SEQ ID NO: 7154473 - DNA, 22 bp, Homo sapiens
gaggtaggctgtgaaagggggt

SEQ ID NO: 7154474 - DNA, 22 bp, Homo sapiens
gaggttggggctgcagtgagct

SEQ ID NO: 7154475 - DNA, 22 bp, Homo sapiens
gaggtagggcagaggctgaatg

SEQ ID NO: 7154476 - DNA, 22 bp, Homo sapiens
gaggtaggctgtgaaagggggt

SEQ ID NO: 7154477 - DNA, 22 bp, Homo sapiens
gaggtaggctgtgaaagggggt

SEQ ID NO: 7154478 - DNA, 22 bp, Homo sapiens
gaggtagggaagacaaatatgc

SEQ ID NO: 7154479 - DNA, 22 bp, Homo sapiens
gaggttggggctgcagtgagct

SEQ ID NO: 7154480 - DNA, 22 bp, Homo sapiens
gaggttggggctgcagtgagct

SEQ ID NO: 7154481 - DNA, 22 bp, Homo sapiens
gaggttggggctgcagtgagct

SEQ ID NO: 7154482 - DNA, 22 bp, Homo sapiens
gaggttggtgaggggacacggt

SEQ ID NO: 7154483 - DNA, 22 bp, Homo sapiens
gaggttggtgaggggacacggt

SEQ ID NO: 7154484 - DNA, 22 bp, Homo sapiens
gagtccagcagaatgagccaag

SEQ ID NO: 7154485 - DNA, 22 bp, Homo sapiens
gagtccaggatttgagctctgt

SEQ ID NO: 7154486 - DNA, 22 bp, Homo sapiens
gagtccaggatttgagctctgt

SEQ ID NO: 7154487 - DNA, 22 bp, Homo sapiens
gagtccaggatttgagctctgt

SEQ ID NO: 7154488 - DNA, 22 bp, Homo sapiens
gagtccaggcatccctcccata

SEQ ID NO: 7154489 - DNA, 22 bp, Homo sapiens
gagtccaggctggtcaaatagc

SEQ ID NO: 7154490 - DNA, 22 bp, Homo sapiens
gagggggctctgccaacctgtc

SEQ ID NO: 7154491 - DNA, 22 bp, Homo sapiens
gaggggggcgccctgcagtgca

SEQ ID NO: 7154492 - DNA, 22 bp, Homo sapiens
gaggggggcgccctgcagtgca

SEQ ID NO: 7154493 - DNA, 22 bp, Homo sapiens
gagggggctctgccaacctgtc

SEQ ID NO: 7154494 - DNA, 22 bp, Homo sapiens
gagggggctctgccaacctgtc

SEQ ID NO: 7154495 - DNA, 22 bp, Homo sapiens
gaggggggcgccctgcagtgca

SEQ ID NO: 7154496 - DNA, 22 bp, Homo sapiens
gaggggggcgccctgcagtgca

SEQ ID NO: 7154497 - DNA, 22 bp, Homo sapiens
gagggggtctatgaggtagagc

SEQ ID NO: 7154498 - DNA, 22 bp, Homo sapiens
gagggggtctatgaggtagagc

SEQ ID NO: 7154499 - DNA, 22 bp, Homo sapiens
gagggggctagcgcagtgccca

SEQ ID NO: 7154500 - DNA, 22 bp, Homo sapiens
gagggggctagcgcagtgccca

SEQ ID NO: 7154501 - DNA, 22 bp, Homo sapiens
gagggggctagcgcagtgccca

SEQ ID NO: 7154502 - DNA, 22 bp, Homo sapiens
gagggggctagcgcagtgccca

SEQ ID NO: 7154503 - DNA, 22 bp, Homo sapiens
gagggggctagcgcagtgccca

SEQ ID NO: 7154504 - DNA, 22 bp, Homo sapiens
gagggggctagcgcagtgccca

SEQ ID NO: 7154505 - DNA, 22 bp, Homo sapiens
gagggggctagcgcagtgccca

SEQ ID NO: 7154506 - DNA, 22 bp, Homo sapiens
gagggggctccctgaagccagt

SEQ ID NO: 7154507 - DNA, 22 bp, Homo sapiens
gagggggctccctgaagccagt

SEQ ID NO: 7154508 - DNA, 22 bp, Homo sapiens
gagggggcgtgcaaggctccgc

SEQ ID NO: 7154509 - DNA, 19 bp, Homo sapiens
gaggggaggaattgacaag

SEQ ID NO: 7154510 - DNA, 22 bp, Homo sapiens
gaggggagtaaagtcatgttac

SEQ ID NO: 7154511 - DNA, 22 bp, Homo sapiens
gagggggcgaacagaagcaagg

SEQ ID NO: 7154512 - DNA, 19 bp, Homo sapiens
gaggggaggaattgacaag

SEQ ID NO: 7154513 - DNA, 19 bp, Homo sapiens
gaggggaggaattgacaag

SEQ ID NO: 7154514 - DNA, 22 bp, Homo sapiens
gagggcagaaaattatgcggtg

SEQ ID NO: 7154515 - DNA, 22 bp, Homo sapiens
gagggcagaaaattatgcggtg

SEQ ID NO: 7154516 - DNA, 22 bp, Homo sapiens
gagggcagaaaattatgcggtg

SEQ ID NO: 7154517 - DNA, 22 bp, Homo sapiens
gagggcacgaaacaaccacttc

SEQ ID NO: 7154518 - DNA, 22 bp, Homo sapiens
gagggcaccagaagagccagat

SEQ ID NO: 7154519 - DNA, 22 bp, Homo sapiens
gagggcaccagaagagccagat

SEQ ID NO: 7154520 - DNA, 22 bp, Homo sapiens
gaggaaggagggaaagcgcgcg

SEQ ID NO: 7154521 - DNA, 22 bp, Homo sapiens
gaggaaggagggaaagcgcgcg

SEQ ID NO: 7154522 - DNA, 22 bp, Homo sapiens
gaggaaggatttagtttgaggg

SEQ ID NO: 7154523 - DNA, 22 bp, Homo sapiens
gaggaaggatttagtttgaggg

SEQ ID NO: 7154524 - DNA, 22 bp, Homo sapiens
gaggaaggaatgcagtgtatgc

SEQ ID NO: 7154525 - DNA, 22 bp, Homo sapiens
gaggaaggaatgcagtgtatgc

SEQ ID NO: 7154526 - DNA, 22 bp, Homo sapiens
gaggaagcttttgatcgcccag

SEQ ID NO: 7154527 - DNA, 22 bp, Homo sapiens
gaggaaggaatgcagtgtatgc

SEQ ID NO: 7154528 - DNA, 22 bp, Homo sapiens
gaggaaggctaaggggcttaga

SEQ ID NO: 7154529 - DNA, 22 bp, Homo sapiens
gaggaaggctaaggggcttaga

SEQ ID NO: 7154530 - DNA, 22 bp, Homo sapiens
gaggaaggatttagtttgaggg

SEQ ID NO: 7154531 - DNA, 22 bp, Homo sapiens
gaggaaggatttagtttgaggg

SEQ ID NO: 7154532 - DNA, 22 bp, Homo sapiens
gaggaaggctaaggggcttaga

SEQ ID NO: 7154533 - DNA, 22 bp, Homo sapiens
gaggaaggctaaggggcttaga

SEQ ID NO: 7154534 - DNA, 20 bp, Homo sapiens
atggttcaggccagctgtct

SEQ ID NO: 7154535 - DNA, 22 bp, Homo sapiens
atggttgaacttaaagggaatg

SEQ ID NO: 7154536 - DNA, 22 bp, Homo sapiens
atggttgaagaccagtggaaaa

SEQ ID NO: 7154537 - DNA, 22 bp, Homo sapiens
atggttgacccatgtgagttag

SEQ ID NO: 7154538 - DNA, 22 bp, Homo sapiens
atggtttaagggagaatattga

SEQ ID NO: 7154539 - DNA, 22 bp, Homo sapiens
gaggaagctgcgtggcatttca

SEQ ID NO: 7154540 - DNA, 22 bp, Homo sapiens
gaggaagcagggcttggctgag

SEQ ID NO: 7154541 - DNA, 22 bp, Homo sapiens
gaggaagatggttgagtggtcc

SEQ ID NO: 7154542 - DNA, 22 bp, Homo sapiens
gagctttgctggaagcctgggg

SEQ ID NO: 7154543 - DNA, 22 bp, Homo sapiens
gagctttgcattattcagaagc

SEQ ID NO: 7154544 - DNA, 22 bp, Homo sapiens
gagctttgcctaaaactagaat

SEQ ID NO: 7154545 - DNA, 22 bp, Homo sapiens
gagctttgatcgctaagcctca

SEQ ID NO: 7154546 - DNA, 22 bp, Homo sapiens
gagctttgctggaagcctgggg

SEQ ID NO: 7154547 - DNA, 22 bp, Homo sapiens
gagctttggggaagaatacaga

SEQ ID NO: 7154548 - DNA, 22 bp, Homo sapiens
gagctttggtgccaagtatttg

SEQ ID NO: 7154549 - DNA, 22 bp, Homo sapiens
gagctttgtaaaaaacttgcac

SEQ ID NO: 7154550 - DNA, 22 bp, Homo sapiens
gagctttgtagcaggaaggaag

SEQ ID NO: 7154551 - DNA, 22 bp, Homo sapiens
gagctttgtcccttgggggctc

SEQ ID NO: 7154552 - DNA, 22 bp, Homo sapiens
gagctttgtctcctggagaccc

SEQ ID NO: 7154553 - DNA, 22 bp, Homo sapiens
gagctttgtgctggtaggtggt

SEQ ID NO: 7154554 - DNA, 22 bp, Homo sapiens
gagctttgttccgtggtggcac

SEQ ID NO: 7154555 - DNA, 22 bp, Homo sapiens
gagcttggtgttatttctgtgg

SEQ ID NO: 7154556 - DNA, 22 bp, Homo sapiens
gagctttaccttaggttctgtt

SEQ ID NO: 7154557 - DNA, 22 bp, Homo sapiens
gagcttggtgctgcctgttgtc

SEQ ID NO: 7154558 - DNA, 22 bp, Homo sapiens
gagcttggtgttatttctgtgg

SEQ ID NO: 7154559 - DNA, 22 bp, Homo sapiens
gagctttagctgagacctgctt

SEQ ID NO: 7154560 - DNA, 22 bp, Homo sapiens
gagctttaggagaaggaggtca

SEQ ID NO: 7154561 - DNA, 22 bp, Homo sapiens
gagctttcacagggtctcattg

SEQ ID NO: 7154562 - DNA, 22 bp, Homo sapiens
gagctttctgtgttccagttgc

SEQ ID NO: 7154563 - DNA, 22 bp, Homo sapiens
gagctttgagattcttatggta

SEQ ID NO: 7154564 - DNA, 22 bp, Homo sapiens
gagcttggggcatatggtgcta

SEQ ID NO: 7154565 - DNA, 22 bp, Homo sapiens
gagcttgggtgccatgctgagc

SEQ ID NO: 7154566 - DNA, 22 bp, Homo sapiens
gagcttggtgatgcctcctggt

SEQ ID NO: 7154567 - DNA, 22 bp, Homo sapiens
gagcttggtgcacagtggttaa

SEQ ID NO: 7154568 - DNA, 22 bp, Homo sapiens
gagctctgtgaatgtggggagg

SEQ ID NO: 7154569 - DNA, 22 bp, Homo sapiens
gagctggggcggatactcagct

SEQ ID NO: 7154570 - DNA, 22 bp, Homo sapiens
gagctggggcggatactcagct

SEQ ID NO: 7154571 - DNA, 22 bp, Homo sapiens
gagctggggcggatactcagct

SEQ ID NO: 7154572 - DNA, 22 bp, Homo sapiens
gagctggggcggatactcagct

SEQ ID NO: 7154573 - DNA, 22 bp, Homo sapiens
gagcttggggcatatggtgcta

SEQ ID NO: 7154574 - DNA, 22 bp, Homo sapiens
gagctctggacgaggggagtgg

SEQ ID NO: 7154575 - DNA, 22 bp, Homo sapiens
gagctctgcttgggttcttagg

SEQ ID NO: 7154576 - DNA, 22 bp, Homo sapiens
gagctctgcggaaaacgtgccg

SEQ ID NO: 7154577 - DNA, 22 bp, Homo sapiens
gagctctgcggaaaacgtgccg

SEQ ID NO: 7154578 - DNA, 22 bp, Homo sapiens
gagctctgctactcaaagtatg

SEQ ID NO: 7154579 - DNA, 22 bp, Homo sapiens
gagctctgcttgggttcttagg

SEQ ID NO: 7154580 - DNA, 22 bp, Homo sapiens
gagctctggcagggcaggtctg

SEQ ID NO: 7154581 - DNA, 22 bp, Homo sapiens
gagctctggcagggcaggtctg

SEQ ID NO: 7154582 - DNA, 22 bp, Homo sapiens
gagctctggcagggcaggtctg

SEQ ID NO: 7154583 - DNA, 22 bp, Homo sapiens
gagctctggcagggcaggtctg

SEQ ID NO: 7154584 - DNA, 22 bp, Homo sapiens
gagctctgggaaacaaagtgta

SEQ ID NO: 7154585 - DNA, 22 bp, Homo sapiens
gagctctgtgaatgtggggagg

SEQ ID NO: 7154586 - DNA, 22 bp, Homo sapiens
gagctctgtccacacttggaga

SEQ ID NO: 7154587 - DNA, 22 bp, Homo sapiens
gagctggggcggatactcagct

SEQ ID NO: 7154588 - DNA, 22 bp, Homo sapiens
gagctggggcggatactcagct

SEQ ID NO: 7154589 - DNA, 22 bp, Homo sapiens
gagctctgtacacagagggtgt

SEQ ID NO: 7154590 - DNA, 22 bp, Homo sapiens
gagctctgtccacacttggaga

SEQ ID NO: 7154591 - DNA, 22 bp, Homo sapiens
gagctctggttcatgatctatt

SEQ ID NO: 7154592 - DNA, 22 bp, Homo sapiens
atgtacaacctgcatgacagtc

SEQ ID NO: 7154593 - DNA, 22 bp, Homo sapiens
atgtacaagctgttttactgca

SEQ ID NO: 7154594 - DNA, 22 bp, Homo sapiens
atgtacaatctagggtttgcat

SEQ ID NO: 7154595 - DNA, 22 bp, Homo sapiens
atgtacaatctatcacaagaag

SEQ ID NO: 7154596 - DNA, 22 bp, Homo sapiens
atgtacaacctgcatgacagtc

SEQ ID NO: 7154597 - DNA, 22 bp, Homo sapiens
atgtacaacctgcatgacagtc

SEQ ID NO: 7154598 - DNA, 22 bp, Homo sapiens
atgtacaacctgcatgacagtc

SEQ ID NO: 7154599 - DNA, 22 bp, Homo sapiens
atgtacaaaatgccactgaatt

SEQ ID NO: 7154600 - DNA, 22 bp, Homo sapiens
atgtacaaaatgttttgaaatg

SEQ ID NO: 7154601 - DNA, 22 bp, Homo sapiens
atgtacaaaatgttttgaaatg

SEQ ID NO: 7154602 - DNA, 22 bp, Homo sapiens
atgtacaaaatgttttgaaatg

SEQ ID NO: 7154603 - DNA, 22 bp, Homo sapiens
atgtcacagctcccattcctcc

SEQ ID NO: 7154604 - DNA, 22 bp, Homo sapiens
atgtcacaggcaacaagattgc

SEQ ID NO: 7154605 - DNA, 22 bp, Homo sapiens
atgtcacaggcaacaagattgc

SEQ ID NO: 7154606 - DNA, 22 bp, Homo sapiens
atgtcacaggcaacaagattgc

SEQ ID NO: 7154607 - DNA, 22 bp, Homo sapiens
atgtcacagcaggagtattctt

SEQ ID NO: 7154608 - DNA, 22 bp, Homo sapiens
atgtcacagtctgactcagtga

SEQ ID NO: 7154609 - DNA, 22 bp, Homo sapiens
atgtcacagtctgactcagtga

SEQ ID NO: 7154610 - DNA, 22 bp, Homo sapiens
atgtcacagtctgactcagtga

SEQ ID NO: 7154611 - DNA, 22 bp, Homo sapiens
atgtcacagtctgactcagtga

SEQ ID NO: 7154612 - DNA, 22 bp, Homo sapiens
atgtcacagtgttgctggaagt

SEQ ID NO: 7154613 - DNA, 22 bp, Homo sapiens
atgtcacagttgcaacatgaat

SEQ ID NO: 7154614 - DNA, 22 bp, Homo sapiens
atgtcacagttgcaacatgaat

SEQ ID NO: 7154615 - DNA, 22 bp, Homo sapiens
atgtcacagttgcaacatgaat

SEQ ID NO: 7154616 - DNA, 22 bp, Homo sapiens
atgtcacagcaggagtattctt

SEQ ID NO: 7154617 - DNA, 22 bp, Homo sapiens
atgtcacagcaggagtattctt

SEQ ID NO: 7154618 - DNA, 18 bp, Homo sapiens
atgtcacagagggctgaa

SEQ ID NO: 7154619 - DNA, 22 bp, Homo sapiens
atgtcacagcaggagtattctt

SEQ ID NO: 7154620 - DNA, 22 bp, Homo sapiens
atgtcacaaaagtcccattatg

SEQ ID NO: 7154621 - DNA, 22 bp, Homo sapiens
atgtatttctatgtagtgaaga

SEQ ID NO: 7154622 - DNA, 22 bp, Homo sapiens
atgtatttgaaatttgagacat

SEQ ID NO: 7154623 - DNA, 22 bp, Homo sapiens
atgtatttctatgtagtgaaga

SEQ ID NO: 7154624 - DNA, 22 bp, Homo sapiens
atgtaagtattcaaaatatttc

SEQ ID NO: 7154625 - DNA, 22 bp, Homo sapiens
atgtaatagggtaacataacat

SEQ ID NO: 7154626 - DNA, 22 bp, Homo sapiens
atgtaagccttgtctcaggggg

SEQ ID NO: 7154627 - DNA, 22 bp, Homo sapiens
atgtaaggctgcctatgacact

SEQ ID NO: 7154628 - DNA, 22 bp, Homo sapiens
atgtaaggttcagagtatgtga

SEQ ID NO: 7154629 - DNA, 17 bp, Homo sapiens
atgtaagaagaaagcag

SEQ ID NO: 7154630 - DNA, 22 bp, Homo sapiens
atgtaagactttaagaacctaa

SEQ ID NO: 7154631 - DNA, 22 bp, Homo sapiens
atgtaagagtctaagattgtag

SEQ ID NO: 7154632 - DNA, 22 bp, Homo sapiens
atgtaatttatgttatccataa

SEQ ID NO: 7154633 - DNA, 22 bp, Homo sapiens
atgtaatttatgttatccataa

SEQ ID NO: 7154634 - DNA, 22 bp, Homo sapiens
atgtaatttgccctcaagttaa

SEQ ID NO: 7154635 - DNA, 22 bp, Homo sapiens
atgtacaaaatgccactgaatt

SEQ ID NO: 7154636 - DNA, 22 bp, Homo sapiens
atgtaattctaagactgaagaa

SEQ ID NO: 7154637 - DNA, 22 bp, Homo sapiens
atgtaacaaatggtatacatgt

SEQ ID NO: 7154638 - DNA, 22 bp, Homo sapiens
atgtaaattgtactgacacacg

SEQ ID NO: 7154639 - DNA, 22 bp, Homo sapiens
atgtaaagtataaagtaagggg

SEQ ID NO: 7154640 - DNA, 22 bp, Homo sapiens
atgtaaagtataaagtaagggg

SEQ ID NO: 7154641 - DNA, 22 bp, Homo sapiens
atgtaaagtatctgaaatgctg

SEQ ID NO: 7154642 - DNA, 22 bp, Homo sapiens
atgtaaagtatctgaaatgctg

SEQ ID NO: 7154643 - DNA, 22 bp, Homo sapiens
atgtaaagtatctgaaatgctg

SEQ ID NO: 7154644 - DNA, 22 bp, Homo sapiens
atgtaaagttacttgagttttg

SEQ ID NO: 7154645 - DNA, 22 bp, Homo sapiens
atgtaaagttacttgagttttg

SEQ ID NO: 7154646 - DNA, 22 bp, Homo sapiens
atgtaaagttcagtacagtttt

SEQ ID NO: 7154647 - DNA, 22 bp, Homo sapiens
atgtaacaggtgaagctctgag

SEQ ID NO: 7154648 - DNA, 22 bp, Homo sapiens
atgtaacaaatggtatacatgt

SEQ ID NO: 7154649 - DNA, 22 bp, Homo sapiens
atgtaacatatgtgatcgcatt

SEQ ID NO: 7154650 - DNA, 22 bp, Homo sapiens
atgtaacatatgtgatcgcatt

SEQ ID NO: 7154651 - DNA, 22 bp, Homo sapiens
atgtaacatatgtgatcgcatt

SEQ ID NO: 7154652 - DNA, 19 bp, Homo sapiens
gagcgcagagggcagggga

SEQ ID NO: 7154653 - DNA, 20 bp, Homo sapiens
gagccttcccctcaccactg

SEQ ID NO: 7154654 - DNA, 18 bp, Homo sapiens
gagctctgcctcccagtc

SEQ ID NO: 7154655 - DNA, 18 bp, Homo sapiens
gagctctgcctcccagtc

SEQ ID NO: 7154656 - DNA, 18 bp, Homo sapiens
gagctctgcctcccagtc

SEQ ID NO: 7154657 - DNA, 22 bp, Homo sapiens
gagctctgccatggctcccacc

SEQ ID NO: 7154658 - DNA, 22 bp, Homo sapiens
gagctctgccatggctcccacc

SEQ ID NO: 7154659 - DNA, 22 bp, Homo sapiens
gagctctgccatggctcccacc

SEQ ID NO: 7154660 - DNA, 18 bp, Homo sapiens
gagctctgcctcccagtc

SEQ ID NO: 7154661 - DNA, 18 bp, Homo sapiens
gagctctgcctcccagtc

SEQ ID NO: 7154662 - DNA, 22 bp, Homo sapiens
gagcggaggcttggaggccagc

SEQ ID NO: 7154663 - DNA, 23 bp, Homo sapiens
gagctctgcactaggccctggga

SEQ ID NO: 7154664 - DNA, 23 bp, Homo sapiens
gagctctgcactaggccctggga

SEQ ID NO: 7154665 - DNA, 23 bp, Homo sapiens
gagctctgcactaggccctggga

SEQ ID NO: 7154666 - DNA, 23 bp, Homo sapiens
gagctctgcactaggccctggga

SEQ ID NO: 7154667 - DNA, 22 bp, Homo sapiens
gagctctgcagattgttttagg

SEQ ID NO: 7154668 - DNA, 22 bp, Homo sapiens
gagctctgcagattgttttagg

SEQ ID NO: 7154669 - DNA, 22 bp, Homo sapiens
gagcctgggtccttccctggga

SEQ ID NO: 7154670 - DNA, 22 bp, Homo sapiens
gagcctgggtccttccctggga

SEQ ID NO: 7154671 - DNA, 22 bp, Homo sapiens
gagcctgggtccttccctggga

SEQ ID NO: 7154672 - DNA, 22 bp, Homo sapiens
gagcctggggaccctcctgagt

SEQ ID NO: 7154673 - DNA, 22 bp, Homo sapiens
gagcctggggaccctcctgagt

SEQ ID NO: 7154674 - DNA, 22 bp, Homo sapiens
gagcctggggaccctcctgagt

SEQ ID NO: 7154675 - DNA, 22 bp, Homo sapiens
gagcctggggaccctcctgagt

SEQ ID NO: 7154676 - DNA, 22 bp, Homo sapiens
gagcctggggaccctcctgagt

SEQ ID NO: 7154677 - DNA, 20 bp, Homo sapiens
gagcctgggaagtctaaggt

SEQ ID NO: 7154678 - DNA, 20 bp, Homo sapiens
gagcctgggaagtctaaggt

SEQ ID NO: 7154679 - DNA, 22 bp, Homo sapiens
gagcctgggactgggggtcatg

SEQ ID NO: 7154680 - DNA, 22 bp, Homo sapiens
gagcctgggactgggggtcatg

SEQ ID NO: 7154681 - DNA, 22 bp, Homo sapiens
gagcctgggactgggggtcatg

SEQ ID NO: 7154682 - DNA, 22 bp, Homo sapiens
gagcctggcctcctgcctcagc

SEQ ID NO: 7154683 - DNA, 22 bp, Homo sapiens
gagcctggcctcctgcctcagc

SEQ ID NO: 7154684 - DNA, 22 bp, Homo sapiens
gagcctggcctcctgcctcagc

SEQ ID NO: 7154685 - DNA, 22 bp, Homo sapiens
gagcctggcctcctgcctcagc

SEQ ID NO: 7154686 - DNA, 22 bp, Homo sapiens
gagcagtgactggagcatgaga

SEQ ID NO: 7154687 - DNA, 22 bp, Homo sapiens
gagccctcttccctagtgatcg

SEQ ID NO: 7154688 - DNA, 22 bp, Homo sapiens
gagccctgaacaacagcaggaa

SEQ ID NO: 7154689 - DNA, 22 bp, Homo sapiens
gagccctgaacaacagcaggaa

SEQ ID NO: 7154690 - DNA, 22 bp, Homo sapiens
gagccctgaacaacagcaggaa

SEQ ID NO: 7154691 - DNA, 22 bp, Homo sapiens
gagccctgaacaacagcaggaa

SEQ ID NO: 7154692 - DNA, 22 bp, Homo sapiens
gagcagtaggagaaccctgagc

SEQ ID NO: 7154693 - DNA, 22 bp, Homo sapiens
gagcagtgaagacagaagtaca

SEQ ID NO: 7154694 - DNA, 22 bp, Homo sapiens
gagcaggtttcaatgctgatgc

SEQ ID NO: 7154695 - DNA, 22 bp, Homo sapiens
gagcagtagagtacatggctcc

SEQ ID NO: 7154696 - DNA, 17 bp, Homo sapiens
gagcagggatgcggttc

SEQ ID NO: 7154697 - DNA, 22 bp, Homo sapiens
gagcagggccacttctgtacct

SEQ ID NO: 7154698 - DNA, 22 bp, Homo sapiens
gagcagggccacttctgtacct

SEQ ID NO: 7154699 - DNA, 22 bp, Homo sapiens
gagcagggccacttctgtacct

SEQ ID NO: 7154700 - DNA, 22 bp, Homo sapiens
gagcagggcttgtcctcctcat

SEQ ID NO: 7154701 - DNA, 22 bp, Homo sapiens
gagcaggtctttcatggtgcat

SEQ ID NO: 7154702 - DNA, 22 bp, Homo sapiens
gagcaggtctttcatggtgcat

SEQ ID NO: 7154703 - DNA, 22 bp, Homo sapiens
gagcaggtctttcatggtgcat

SEQ ID NO: 7154704 - DNA, 22 bp, Homo sapiens
gagcaggtctttcatggtgcat

SEQ ID NO: 7154705 - DNA, 22 bp, Homo sapiens
gagcaggtctttcatggtgcat

SEQ ID NO: 7154706 - DNA, 22 bp, Homo sapiens
gagcagctgagctggaatgaga

SEQ ID NO: 7154707 - DNA, 22 bp, Homo sapiens
gagcagctgagctggaatgaga

SEQ ID NO: 7154708 - DNA, 22 bp, Homo sapiens
gagcagctctgggtgacccagt

SEQ ID NO: 7154709 - DNA, 22 bp, Homo sapiens
gagcagctctgggtgacccagt

SEQ ID NO: 7154710 - DNA, 22 bp, Homo sapiens
gagcagctctgggtgacccagt

SEQ ID NO: 7154711 - DNA, 22 bp, Homo sapiens
gagcagctctgtgcctggagac

SEQ ID NO: 7154712 - DNA, 22 bp, Homo sapiens
gagcagggagacaactctggtg

SEQ ID NO: 7154713 - DNA, 17 bp, Homo sapiens
gagcagggatgcggttc

SEQ ID NO: 7154714 - DNA, 17 bp, Homo sapiens
gagcagggatgcggttc

SEQ ID NO: 7154715 - DNA, 17 bp, Homo sapiens
gagcagggatgcggttc

SEQ ID NO: 7154716 - DNA, 22 bp, Homo sapiens
gagcagctgagctggaatgaga

SEQ ID NO: 7154717 - DNA, 19 bp, Homo sapiens
gagcagctgcacccattga

SEQ ID NO: 7154718 - DNA, 22 bp, Homo sapiens
atgctttttaaacttaattgga

SEQ ID NO: 7154719 - DNA, 21 bp, Homo sapiens
atggaaaaacaggtagagcat

SEQ ID NO: 7154720 - DNA, 21 bp, Homo sapiens
atggaaaaacaggtagagcat

SEQ ID NO: 7154721 - DNA, 22 bp, Homo sapiens
gagaggaatatcattatattag

SEQ ID NO: 7154722 - DNA, 22 bp, Homo sapiens
atgctttttaaacttaattgga

SEQ ID NO: 7154723 - DNA, 22 bp, Homo sapiens
atgcttttggtctttggtccgg

SEQ ID NO: 7154724 - DNA, 22 bp, Homo sapiens
atgcttttggtctttggtccgg

SEQ ID NO: 7154725 - DNA, 22 bp, Homo sapiens
gagaggctctgaggactggggt

SEQ ID NO: 7154726 - DNA, 22 bp, Homo sapiens
gagaggctctgaggactggggt

SEQ ID NO: 7154727 - DNA, 22 bp, Homo sapiens
gagaggctctgaggactggggt

SEQ ID NO: 7154728 - DNA, 22 bp, Homo sapiens
gagaggctctgaggactggggt

SEQ ID NO: 7154729 - DNA, 22 bp, Homo sapiens
gagaggctctgaggactggggt

SEQ ID NO: 7154730 - DNA, 22 bp, Homo sapiens
gagaggctctgaggactggggt

SEQ ID NO: 7154731 - DNA, 22 bp, Homo sapiens
gagaggctctgaggactggggt

SEQ ID NO: 7154732 - DNA, 22 bp, Homo sapiens
gagaggctccgccactgctcag

SEQ ID NO: 7154733 - DNA, 22 bp, Homo sapiens
gagaggctccgccactgctcag

SEQ ID NO: 7154734 - DNA, 22 bp, Homo sapiens
gagaggctccatgaccccggca

SEQ ID NO: 7154735 - DNA, 22 bp, Homo sapiens
gagaggaatgaggttaaggact

SEQ ID NO: 7154736 - DNA, 22 bp, Homo sapiens
gagaggaatgaggttaaggact

SEQ ID NO: 7154737 - DNA, 22 bp, Homo sapiens
gagaggaatgaggttaaggact

SEQ ID NO: 7154738 - DNA, 22 bp, Homo sapiens
gagaggctgactggctgtcctg

SEQ ID NO: 7154739 - DNA, 22 bp, Homo sapiens
gagaggctgaaatcacaggagc

SEQ ID NO: 7154740 - DNA, 22 bp, Homo sapiens
gagaggctgactggctgtcctg

SEQ ID NO: 7154741 - DNA, 22 bp, Homo sapiens
gagaggctgaaatcacaggagc

SEQ ID NO: 7154742 - DNA, 22 bp, Homo sapiens
gagaggctgaaatcacaggagc

SEQ ID NO: 7154743 - DNA, 22 bp, Homo sapiens
gagaggctgaaatcacaggagc

SEQ ID NO: 7154744 - DNA, 22 bp, Homo sapiens
gagaggctgatcctgcagagaa

SEQ ID NO: 7154745 - DNA, 22 bp, Homo sapiens
gagaggctgatcctgcagagaa

SEQ ID NO: 7154746 - DNA, 22 bp, Homo sapiens
gagaggctgatcctgcagagaa

SEQ ID NO: 7154747 - DNA, 22 bp, Homo sapiens
gagaggctggcagtgccaggtt

SEQ ID NO: 7154748 - DNA, 22 bp, Homo sapiens
gagaggctggcagtgccaggtt

SEQ ID NO: 7154749 - DNA, 22 bp, Homo sapiens
gagaggctggcagtgccaggtt

SEQ ID NO: 7154750 - DNA, 22 bp, Homo sapiens
gagaggctgcatatgcacactg

SEQ ID NO: 7154751 - DNA, 22 bp, Homo sapiens
gagaggctgcatatgcacactg

SEQ ID NO: 7154752 - DNA, 22 bp, Homo sapiens
gagaggtagcagtaagaacagg

SEQ ID NO: 7154753 - DNA, 22 bp, Homo sapiens
gagaggctgggttggagatcga

SEQ ID NO: 7154754 - DNA, 22 bp, Homo sapiens
gagaggtccattcccctgtcag

SEQ ID NO: 7154755 - DNA, 22 bp, Homo sapiens
gagaggtcggggacactgcaaa

SEQ ID NO: 7154756 - DNA, 22 bp, Homo sapiens
gagcagctcgagaaggaagcag

SEQ ID NO: 7154757 - DNA, 22 bp, Homo sapiens
gagcagctcgagaaggaagcag

SEQ ID NO: 7154758 - DNA, 22 bp, Homo sapiens
gagcagctcagaggactagtgt

SEQ ID NO: 7154759 - DNA, 22 bp, Homo sapiens
gagcagctccagccgcatgact

SEQ ID NO: 7154760 - DNA, 22 bp, Homo sapiens
gagcagctccagccgcatgact

SEQ ID NO: 7154761 - DNA, 22 bp, Homo sapiens
gagcacagtaaagcagtgtcac

SEQ ID NO: 7154762 - DNA, 22 bp, Homo sapiens
gagcacagtaaagcagtgtcac

SEQ ID NO: 7154763 - DNA, 22 bp, Homo sapiens
gagcagctaaaattctcatgca

SEQ ID NO: 7154764 - DNA, 22 bp, Homo sapiens
gagcagctcagaggactagtgt

SEQ ID NO: 7154765 - DNA, 22 bp, Homo sapiens
gagcagctcagaggactagtgt

SEQ ID NO: 7154766 - DNA, 22 bp, Homo sapiens
gagaggtgaatgtggatgccac

SEQ ID NO: 7154767 - DNA, 22 bp, Homo sapiens
gagaggtgaatgtggatgccac

SEQ ID NO: 7154768 - DNA, 22 bp, Homo sapiens
gagaggtgaaggctgccctggg

SEQ ID NO: 7154769 - DNA, 22 bp, Homo sapiens
gagaggtgaaaggatagtttga

SEQ ID NO: 7154770 - DNA, 22 bp, Homo sapiens
gagaggtgaaatagttgtccgg

SEQ ID NO: 7154771 - DNA, 22 bp, Homo sapiens
gagaggtgaaggctgccctggg

SEQ ID NO: 7154772 - DNA, 22 bp, Homo sapiens
gagaggtgtgtttcagataaga

SEQ ID NO: 7154773 - DNA, 22 bp, Homo sapiens
gagaggtgtgtttcagataaga

SEQ ID NO: 7154774 - DNA, 22 bp, Homo sapiens
gagaggtggtgaggacttgtct

SEQ ID NO: 7154775 - DNA, 22 bp, Homo sapiens
gagaggtggaggttgcagtgag

SEQ ID NO: 7154776 - DNA, 22 bp, Homo sapiens
gagaggtggaggttgcagtgag

SEQ ID NO: 7154777 - DNA, 22 bp, Homo sapiens
gagaggtggaggttgcagtgag

SEQ ID NO: 7154778 - DNA, 22 bp, Homo sapiens
gagaggtggaggttgcagtgag

SEQ ID NO: 7154779 - DNA, 22 bp, Homo sapiens
gagaggtggaggttgcagtgag

SEQ ID NO: 7154780 - DNA, 22 bp, Homo sapiens
atgcccacaacactgcactttt

SEQ ID NO: 7154781 - DNA, 22 bp, Homo sapiens
atgcccacaacactgcactttt

SEQ ID NO: 7154782 - DNA, 22 bp, Homo sapiens
atgcccacagagagggaaattt

SEQ ID NO: 7154783 - DNA, 22 bp, Homo sapiens
atgcccaccctcagcccaggct

SEQ ID NO: 7154784 - DNA, 22 bp, Homo sapiens
atgcccactcccattacaggac

SEQ ID NO: 7154785 - DNA, 22 bp, Homo sapiens
atgcatatgcatctgtgtacat

SEQ ID NO: 7154786 - DNA, 22 bp, Homo sapiens
atgccacttcattccagcctcg

SEQ ID NO: 7154787 - DNA, 22 bp, Homo sapiens
atgccacttcattccagcctcg

SEQ ID NO: 7154788 - DNA, 22 bp, Homo sapiens
atgccattttatactcattcaa

SEQ ID NO: 7154789 - DNA, 22 bp, Homo sapiens
atgcccaatgtcacaatttttg

SEQ ID NO: 7154790 - DNA, 22 bp, Homo sapiens
atgcccaatgtcacaatttttg

SEQ ID NO: 7154791 - DNA, 22 bp, Homo sapiens
atgcatatgcatctgtgtacat

SEQ ID NO: 7154792 - DNA, 22 bp, Homo sapiens
atgcatatgcatctgtgtacat

SEQ ID NO: 7154793 - DNA, 22 bp, Homo sapiens
atgcatatgcaatgcacaattt

SEQ ID NO: 7154794 - DNA, 22 bp, Homo sapiens
atgcatatgcaatgcacaattt

SEQ ID NO: 7154795 - DNA, 22 bp, Homo sapiens
atgcatatgcaatgcacaattt

SEQ ID NO: 7154796 - DNA, 22 bp, Homo sapiens
atgcatatctcctatctcctca

SEQ ID NO: 7154797 - DNA, 22 bp, Homo sapiens
atgcatatgcaatgcacaattt

SEQ ID NO: 7154798 - DNA, 22 bp, Homo sapiens
atgcatatctcctatctcctca

SEQ ID NO: 7154799 - DNA, 22 bp, Homo sapiens
atgcatatcagtgattgtttgc

SEQ ID NO: 7154800 - DNA, 22 bp, Homo sapiens
atgcatatctcctatctcctca

SEQ ID NO: 7154801 - DNA, 22 bp, Homo sapiens
atgcatatcagtgattgtttgc

SEQ ID NO: 7154802 - DNA, 22 bp, Homo sapiens
atgcatatcacagtctccatgt

SEQ ID NO: 7154803 - DNA, 22 bp, Homo sapiens
atgcatatcagtgattgtttgc

SEQ ID NO: 7154804 - DNA, 22 bp, Homo sapiens
atgcatatcagtgattgtttgc

SEQ ID NO: 7154805 - DNA, 20 bp, Homo sapiens
atgcatatatgtggtgtctg

SEQ ID NO: 7154806 - DNA, 22 bp, Homo sapiens
atgcatatcacagtctccatgt

SEQ ID NO: 7154807 - DNA, 22 bp, Homo sapiens
atgcatatcacagtctccatgt

SEQ ID NO: 7154808 - DNA, 22 bp, Homo sapiens
atgcatatcacagtctccatgt

SEQ ID NO: 7154809 - DNA, 22 bp, Homo sapiens
atgcatatatacatacacagtc

SEQ ID NO: 7154810 - DNA, 20 bp, Homo sapiens
atgcatatatgtggtgtctg

SEQ ID NO: 7154811 - DNA, 20 bp, Homo sapiens
atgcatatatgtggtgtctg

SEQ ID NO: 7154812 - DNA, 22 bp, Homo sapiens
atgccctgctctcgggaaggga

SEQ ID NO: 7154813 - DNA, 22 bp, Homo sapiens
atgccctgctgccatctggccg

SEQ ID NO: 7154814 - DNA, 22 bp, Homo sapiens
atgccctgcatcaagtgacact

SEQ ID NO: 7154815 - DNA, 22 bp, Homo sapiens
atgccctgcatcaagtgacact

SEQ ID NO: 7154816 - DNA, 22 bp, Homo sapiens
atgccctctgtttcccaaggcc

SEQ ID NO: 7154817 - DNA, 22 bp, Homo sapiens
atgcccagggctggtgaggtcc

SEQ ID NO: 7154818 - DNA, 22 bp, Homo sapiens
atgcccagaaccccctggatgg

SEQ ID NO: 7154819 - DNA, 22 bp, Homo sapiens
atgcccagaaccccctggatgg

SEQ ID NO: 7154820 - DNA, 22 bp, Homo sapiens
atgcccaggcccatacctagat

SEQ ID NO: 7154821 - DNA, 22 bp, Homo sapiens
gacagggactccctggttagaa

SEQ ID NO: 7154822 - DNA, 22 bp, Homo sapiens
gacagggactccctggttagaa

SEQ ID NO: 7154823 - DNA, 22 bp, Homo sapiens
gacagggaggaaagagactgct

SEQ ID NO: 7154824 - DNA, 22 bp, Homo sapiens
gacagggactccctggttagaa

SEQ ID NO: 7154825 - DNA, 22 bp, Homo sapiens
gacagggacgaggcttcaggca

SEQ ID NO: 7154826 - DNA, 22 bp, Homo sapiens
gacagggacgaggcttcaggca

SEQ ID NO: 7154827 - DNA, 22 bp, Homo sapiens
gacagggacgaggcttcaggca

SEQ ID NO: 7154828 - DNA, 22 bp, Homo sapiens
atgcctggactgacatgcactg

SEQ ID NO: 7154829 - DNA, 22 bp, Homo sapiens
atgcctggactgacatgcactg

SEQ ID NO: 7154830 - DNA, 20 bp, Homo sapiens
atgcctctaattttgcaaac

SEQ ID NO: 7154831 - DNA, 22 bp, Homo sapiens
atgcctcctcaaatctgccaca

SEQ ID NO: 7154832 - DNA, 22 bp, Homo sapiens
atgcctcctcaaatctgccaca

SEQ ID NO: 7154833 - DNA, 22 bp, Homo sapiens
atgcctcctcaaatctgccaca

SEQ ID NO: 7154834 - DNA, 22 bp, Homo sapiens
atgcctcctgtgccactgtgat

SEQ ID NO: 7154835 - DNA, 22 bp, Homo sapiens
atgcctcctgtgccactgtgat

SEQ ID NO: 7154836 - DNA, 22 bp, Homo sapiens
atgcctccttctgaaacagggc

SEQ ID NO: 7154837 - DNA, 22 bp, Homo sapiens
atgcctccttctgaaacagggc

SEQ ID NO: 7154838 - DNA, 20 bp, Homo sapiens
atgcctctaattttgcaaac

SEQ ID NO: 7154839 - DNA, 22 bp, Homo sapiens
atgccctgtggcagtacatatt

SEQ ID NO: 7154840 - DNA, 20 bp, Homo sapiens
atgccctgtcctcttctgtt

SEQ ID NO: 7154841 - DNA, 22 bp, Homo sapiens
atgccctgtgactctcctggac

SEQ ID NO: 7154842 - DNA, 22 bp, Homo sapiens
atgccctgtgactctcctggac

SEQ ID NO: 7154843 - DNA, 22 bp, Homo sapiens
atgccctgctgctggggcagtg

SEQ ID NO: 7154844 - DNA, 22 bp, Homo sapiens
atgccctggggctacctctgag

SEQ ID NO: 7154845 - DNA, 23 bp, Homo sapiens
atgccctgtagaggctgctgacc

SEQ ID NO: 7154846 - DNA, 22 bp, Homo sapiens
atgccctgtggttcatgtgaga

SEQ ID NO: 7154847 - DNA, 22 bp, Homo sapiens
atgcccttcaacgtgaggattt

SEQ ID NO: 7154848 - DNA, 22 bp, Homo sapiens
atgcccttcatttatcatgaaa

SEQ ID NO: 7154849 - DNA, 22 bp, Homo sapiens
atgcctccaagattcttacgtt

SEQ ID NO: 7154850 - DNA, 22 bp, Homo sapiens
atgcctccaagattcttacgtt

SEQ ID NO: 7154851 - DNA, 22 bp, Homo sapiens
atgccctttaatttcactgtta

SEQ ID NO: 7154852 - DNA, 22 bp, Homo sapiens
atgcctcccctgtgtcttttat

SEQ ID NO: 7154853 - DNA, 22 bp, Homo sapiens
atgcctcccctgtgtcttttat

SEQ ID NO: 7154854 - DNA, 22 bp, Homo sapiens
atgcctccctgtccttcagttc

SEQ ID NO: 7154855 - DNA, 22 bp, Homo sapiens
atgcctccctgtccttcagttc

SEQ ID NO: 7154856 - DNA, 22 bp, Homo sapiens
atgcctccctgtccttcagttc

SEQ ID NO: 7154857 - DNA, 22 bp, Homo sapiens
atgcctccgcatgtgcctttga

SEQ ID NO: 7154858 - DNA, 22 bp, Homo sapiens
atgcctccgcatgtgcctttga

SEQ ID NO: 7154859 - DNA, 22 bp, Homo sapiens
atgcctcctcaaatctgccaca

SEQ ID NO: 7154860 - DNA, 22 bp, Homo sapiens
atgcatatatacatacacagtc

SEQ ID NO: 7154861 - DNA, 22 bp, Homo sapiens
atgcatatatacatacacagtc

SEQ ID NO: 7154862 - DNA, 22 bp, Homo sapiens
atgcatatatacatacacagtc

SEQ ID NO: 7154863 - DNA, 22 bp, Homo sapiens
atgcatatagaacatttgacat

SEQ ID NO: 7154864 - DNA, 22 bp, Homo sapiens
atgcatatagaacatttgacat

SEQ ID NO: 7154865 - DNA, 22 bp, Homo sapiens
atgcatataatggccagaacaa

SEQ ID NO: 7154866 - DNA, 22 bp, Homo sapiens
atgcatatagaacatttgacat

SEQ ID NO: 7154867 - DNA, 22 bp, Homo sapiens
atgcatatagaacatttgacat

SEQ ID NO: 7154868 - DNA, 22 bp, Homo sapiens
atgcatataaggcacatgtatt

SEQ ID NO: 7154869 - DNA, 22 bp, Homo sapiens
atgcatataatggccagaacaa

SEQ ID NO: 7154870 - DNA, 22 bp, Homo sapiens
atgcatataatggccagaacaa

SEQ ID NO: 7154871 - DNA, 22 bp, Homo sapiens
atgcatataaggcacatgtatt

SEQ ID NO: 7154872 - DNA, 22 bp, Homo sapiens
atgcatataaggcacatgtatt

SEQ ID NO: 7154873 - DNA, 22 bp, Homo sapiens
atgcatataaggcacatgtatt

SEQ ID NO: 7154874 - DNA, 22 bp, Homo sapiens
atgcatacagatttaaaatttt

SEQ ID NO: 7154875 - DNA, 19 bp, Homo sapiens
atgcatacttgcatagttt

SEQ ID NO: 7154876 - DNA, 22 bp, Homo sapiens
atgcataatgtatgtattgact

SEQ ID NO: 7154877 - DNA, 19 bp, Homo sapiens
gaatgtttctgtctcttct

SEQ ID NO: 7154878 - DNA, 19 bp, Homo sapiens
gaatgtttctgtctcttct

SEQ ID NO: 7154879 - DNA, 19 bp, Homo sapiens
gaatgtttctgtctcttct

SEQ ID NO: 7154880 - DNA, 22 bp, Homo sapiens
gaatgtttgactaaaggtagct

SEQ ID NO: 7154881 - DNA, 22 bp, Homo sapiens
gaatgtttaaaaggtgcagttt

SEQ ID NO: 7154882 - DNA, 22 bp, Homo sapiens
gaatgtttaaaaggtgcagttt

SEQ ID NO: 7154883 - DNA, 22 bp, Homo sapiens
gaatgtttaaggaaggcgtggc

SEQ ID NO: 7154884 - DNA, 22 bp, Homo sapiens
gaatgtttaaggaaggcgtggc

SEQ ID NO: 7154885 - DNA, 20 bp, Homo sapiens
gaatgtttcacttgctccat

SEQ ID NO: 7154886 - DNA, 20 bp, Homo sapiens
gaatgtttcacttgctccat

SEQ ID NO: 7154887 - DNA, 22 bp, Homo sapiens
gaatgtttcatgtgtatgttag

SEQ ID NO: 7154888 - DNA, 22 bp, Homo sapiens
gaatgtttcatgtgtatgttag

SEQ ID NO: 7154889 - DNA, 22 bp, Homo sapiens
gaatgtttcatgtgtatgttag

SEQ ID NO: 7154890 - DNA, 22 bp, Homo sapiens
gaatgtcagggccagaagaggc

SEQ ID NO: 7154891 - DNA, 22 bp, Homo sapiens
gaatgtcagttgcgggcatttc

SEQ ID NO: 7154892 - DNA, 22 bp, Homo sapiens
gaatgtcagttgcgggcatttc

SEQ ID NO: 7154893 - DNA, 22 bp, Homo sapiens
gaatgtccctgcagttgctgcc

SEQ ID NO: 7154894 - DNA, 22 bp, Homo sapiens
gaatgtcctcctggatcactcc

SEQ ID NO: 7154895 - DNA, 19 bp, Homo sapiens
gaatgtctcctacttctga

SEQ ID NO: 7154896 - DNA, 22 bp, Homo sapiens
gaatgtcttctgttcccagctg

SEQ ID NO: 7154897 - DNA, 22 bp, Homo sapiens
gaatgtcttctgttcccagctg

SEQ ID NO: 7154898 - DNA, 22 bp, Homo sapiens
gaatgtgaggttgtatgtgaaa

SEQ ID NO: 7154899 - DNA, 22 bp, Homo sapiens
gaatgtgggctgtgaagaggag

SEQ ID NO: 7154900 - DNA, 22 bp, Homo sapiens
gaatgtgggctgtgaagaggag

SEQ ID NO: 7154901 - DNA, 22 bp, Homo sapiens
gaatgtgggctgtgaagaggag

SEQ ID NO: 7154902 - DNA, 22 bp, Homo sapiens
gaatgtgggctgtgaagaggag

SEQ ID NO: 7154903 - DNA, 22 bp, Homo sapiens
gaatgtgtcaccctgtcccatg

SEQ ID NO: 7154904 - DNA, 22 bp, Homo sapiens
gaatgtgtactgagtgcccctt

SEQ ID NO: 7154905 - DNA, 22 bp, Homo sapiens
gaatgttaatgcacttctagct

SEQ ID NO: 7154906 - DNA, 22 bp, Homo sapiens
gaatgttaatgcacttctagct

SEQ ID NO: 7154907 - DNA, 22 bp, Homo sapiens
gaatgttaatgcacttctagct

SEQ ID NO: 7154908 - DNA, 22 bp, Homo sapiens
gaatgttactttgattttgtcc

SEQ ID NO: 7154909 - DNA, 22 bp, Homo sapiens
gaatgttactttgattttgtcc

SEQ ID NO: 7154910 - DNA, 22 bp, Homo sapiens
gaatgttactttgattttgtcc

SEQ ID NO: 7154911 - DNA, 22 bp, Homo sapiens
gaatgttagagattcttaggtt

SEQ ID NO: 7154912 - DNA, 22 bp, Homo sapiens
gaatgttagagattcttaggtt

SEQ ID NO: 7154913 - DNA, 22 bp, Homo sapiens
gaatgttagagattcttaggtt

SEQ ID NO: 7154914 - DNA, 22 bp, Homo sapiens
gaatgttatgtatccagtcaca

SEQ ID NO: 7154915 - DNA, 22 bp, Homo sapiens
gaatgttatgtatccagtcaca

SEQ ID NO: 7154916 - DNA, 22 bp, Homo sapiens
gaatgttattgaactacgagct

SEQ ID NO: 7154917 - DNA, 22 bp, Homo sapiens
gaatgttattgaactacgagct

SEQ ID NO: 7154918 - DNA, 22 bp, Homo sapiens
gaatgttattgaactacgagct

SEQ ID NO: 7154919 - DNA, 22 bp, Homo sapiens
gaatgttattggacagcagtgg

SEQ ID NO: 7154920 - DNA, 22 bp, Homo sapiens
gaatgttattggacagcagtgg

SEQ ID NO: 7154921 - DNA, 22 bp, Homo sapiens
gaatgtttaaaaggtgcagttt

SEQ ID NO: 7154922 - DNA, 22 bp, Homo sapiens
gaatcatagaacattaatagaa

SEQ ID NO: 7154923 - DNA, 22 bp, Homo sapiens
gaatcatagaacattaatagaa

SEQ ID NO: 7154924 - DNA, 22 bp, Homo sapiens
gaagcagagcctaaggcagaca

SEQ ID NO: 7154925 - DNA, 22 bp, Homo sapiens
gaagcagagcctaaggcagaca

SEQ ID NO: 7154926 - DNA, 23 bp, Homo sapiens
gaagcagatgtctgagtaggcag

SEQ ID NO: 7154927 - DNA, 22 bp, Homo sapiens
gaagcacattagatgtgtcttc

SEQ ID NO: 7154928 - DNA, 22 bp, Homo sapiens
gaagcactgcatttcaagatca

SEQ ID NO: 7154929 - DNA, 22 bp, Homo sapiens
gaagcactgtgctgctaagttg

SEQ ID NO: 7154930 - DNA, 22 bp, Homo sapiens
gaagcagaacccactccccaac

SEQ ID NO: 7154931 - DNA, 22 bp, Homo sapiens
atgcacaagaggctagaaaaga

SEQ ID NO: 7154932 - DNA, 22 bp, Homo sapiens
atgcacaagcaagagataatgg

SEQ ID NO: 7154933 - DNA, 22 bp, Homo sapiens
atgcacaagcaagagataatgg

SEQ ID NO: 7154934 - DNA, 22 bp, Homo sapiens
atgcacaagcaagagataatgg

SEQ ID NO: 7154935 - DNA, 22 bp, Homo sapiens
atgcacaagcaagagataatgg

SEQ ID NO: 7154936 - DNA, 22 bp, Homo sapiens
gaagcaatctggctcccagcca

SEQ ID NO: 7154937 - DNA, 22 bp, Homo sapiens
gaagcaatgtgttttcaacatt

SEQ ID NO: 7154938 - DNA, 22 bp, Homo sapiens
gaagcaattaagtttgtgatct

SEQ ID NO: 7154939 - DNA, 22 bp, Homo sapiens
gaagcaattaagtttgtgatct

SEQ ID NO: 7154940 - DNA, 22 bp, Homo sapiens
gaagcaatttagaatcagaagc

SEQ ID NO: 7154941 - DNA, 22 bp, Homo sapiens
gaagcacaaagtgtagttccga

SEQ ID NO: 7154942 - DNA, 22 bp, Homo sapiens
gaagcacagggctcgatctcag

SEQ ID NO: 7154943 - DNA, 22 bp, Homo sapiens
gaagcacatggctatagctatt

SEQ ID NO: 7154944 - DNA, 22 bp, Homo sapiens
gaagcacatggctgtgagcaac

SEQ ID NO: 7154945 - DNA, 22 bp, Homo sapiens
gaagcacatggctgtgagcaac

SEQ ID NO: 7154946 - DNA, 20 bp, Homo sapiens
atgcttaagtgttcattatt

SEQ ID NO: 7154947 - DNA, 20 bp, Homo sapiens
atgcttaagtgttcattatt

SEQ ID NO: 7154948 - DNA, 22 bp, Homo sapiens
atgcttaatacactgttaaagg

SEQ ID NO: 7154949 - DNA, 22 bp, Homo sapiens
atgcttaatacactgttaaagg

SEQ ID NO: 7154950 - DNA, 22 bp, Homo sapiens
atgcttgtagtgtaatcactgt

SEQ ID NO: 7154951 - DNA, 22 bp, Homo sapiens
gacagttttgctgaaattgagc

SEQ ID NO: 7154952 - DNA, 22 bp, Homo sapiens
gacagtttttaatcctttcatg

SEQ ID NO: 7154953 - DNA, 22 bp, Homo sapiens
gacagtttttaatcctttcatg

SEQ ID NO: 7154954 - DNA, 22 bp, Homo sapiens
atgctttacagttttccaaaca

SEQ ID NO: 7154955 - DNA, 22 bp, Homo sapiens
atgctttacagttttccaaaca

SEQ ID NO: 7154956 - DNA, 22 bp, Homo sapiens
atgctttacagttttccaaaca

SEQ ID NO: 7154957 - DNA, 22 bp, Homo sapiens
atgctttaaactataaatccac

SEQ ID NO: 7154958 - DNA, 22 bp, Homo sapiens
atgctttaaatgtcttttgctt

SEQ ID NO: 7154959 - DNA, 22 bp, Homo sapiens
atgctttaaaacgtatgtgtaa

SEQ ID NO: 7154960 - DNA, 22 bp, Homo sapiens
atgctttaaaacgtatgtgtaa

SEQ ID NO: 7154961 - DNA, 22 bp, Homo sapiens
atgctttaaaacgtatgtgtaa

SEQ ID NO: 7154962 - DNA, 19 bp, Homo sapiens
atgctttatgttatttctt

SEQ ID NO: 7154963 - DNA, 22 bp, Homo sapiens
atgctttatacaaaacacttaa

SEQ ID NO: 7154964 - DNA, 22 bp, Homo sapiens
atgctttatacaaaacacttaa

SEQ ID NO: 7154965 - DNA, 22 bp, Homo sapiens
atgctttatacaaaacacttaa

SEQ ID NO: 7154966 - DNA, 22 bp, Homo sapiens
atgctttatacaaaacacttaa

SEQ ID NO: 7154967 - DNA, 22 bp, Homo sapiens
atgctttacgacaaaaaactca

SEQ ID NO: 7154968 - DNA, 22 bp, Homo sapiens
atgctttacgacaaaaaactca

SEQ ID NO: 7154969 - DNA, 22 bp, Homo sapiens
atgctttacgacaaaaaactca

SEQ ID NO: 7154970 - DNA, 22 bp, Homo sapiens
atgctttagtgtcaagtttggg

SEQ ID NO: 7154971 - DNA, 22 bp, Homo sapiens
atgctttagtgtcaagtttggg

SEQ ID NO: 7154972 - DNA, 22 bp, Homo sapiens
atgctttagttcaaaggactta

SEQ ID NO: 7154973 - DNA, 22 bp, Homo sapiens
gacagggaggaaagagactgct

SEQ ID NO: 7154974 - DNA, 22 bp, Homo sapiens
gacagggaggaaagagactgct

SEQ ID NO: 7154975 - DNA, 22 bp, Homo sapiens
gacagggaggaaagagactgct

SEQ ID NO: 7154976 - DNA, 22 bp, Homo sapiens
gacagggaggaaagagactgct

SEQ ID NO: 7154977 - DNA, 22 bp, Homo sapiens
gacagggaggagcagagcttct

SEQ ID NO: 7154978 - DNA, 22 bp, Homo sapiens
gacagggaggagcagagcttct

SEQ ID NO: 7154979 - DNA, 22 bp, Homo sapiens
gacagggaggagcagagcttct

SEQ ID NO: 7154980 - DNA, 22 bp, Homo sapiens
gacagggaggagcagagcttct

SEQ ID NO: 7154981 - DNA, 22 bp, Homo sapiens
gacagggcatggtgcagagttc

SEQ ID NO: 7154982 - DNA, 22 bp, Homo sapiens
gacagggcaagactctgtctaa

SEQ ID NO: 7154983 - DNA, 22 bp, Homo sapiens
gacagggccgcagatggagact

SEQ ID NO: 7154984 - DNA, 22 bp, Homo sapiens
gacagggccgcagatggagact

SEQ ID NO: 7154985 - DNA, 23 bp, Homo sapiens
gacagggctgacttggcagctgc

SEQ ID NO: 7154986 - DNA, 23 bp, Homo sapiens
gacagggctgacttggcagctgc

SEQ ID NO: 7154987 - DNA, 22 bp, Homo sapiens
gacagggcgagactcagtctca

SEQ ID NO: 7154988 - DNA, 22 bp, Homo sapiens
gacagggccgcagatggagact

SEQ ID NO: 7154989 - DNA, 22 bp, Homo sapiens
gacagggccgcagatggagact

SEQ ID NO: 7154990 - DNA, 22 bp, Homo sapiens
gacagggccgcagatggagact

SEQ ID NO: 7154991 - DNA, 22 bp, Homo sapiens
gacagggccaaaccggctgatc

SEQ ID NO: 7154992 - DNA, 22 bp, Homo sapiens
gacagggcatggtgcagagttc

SEQ ID NO: 7154993 - DNA, 22 bp, Homo sapiens
gacagggcatggtgcagagttc

SEQ ID NO: 7154994 - DNA, 22 bp, Homo sapiens
gacagtttaggttcaaatctca

SEQ ID NO: 7154995 - DNA, 22 bp, Homo sapiens
gacagtttctgaatgcgtactt

SEQ ID NO: 7154996 - DNA, 22 bp, Homo sapiens
gacagtttctgaatgcgtactt

SEQ ID NO: 7154997 - DNA, 22 bp, Homo sapiens
gacagtttggatgggggtttgc

SEQ ID NO: 7154998 - DNA, 22 bp, Homo sapiens
gacagttttgctaaaaggttga

SEQ ID NO: 7154999 - DNA, 22 bp, Homo sapiens
gacagtgtttgtataattcctg

SEQ ID NO: 7155000 - DNA, 22 bp, Homo sapiens
gacagtttaagcacctaatatt

SEQ ID NO: 7155001 - DNA, 22 bp, Homo sapiens
gacagtttaagcacctaatatt

SEQ ID NO: 7155002 - DNA, 22 bp, Homo sapiens
gacagtttaggttcaaatctca

SEQ ID NO: 7155003 - DNA, 22 bp, Homo sapiens
gacagtggttccaaggcagctt

SEQ ID NO: 7155004 - DNA, 22 bp, Homo sapiens
gacagtggttccaaggcagctt

SEQ ID NO: 7155005 - DNA, 22 bp, Homo sapiens
gacagtggttccaaggcagctt

SEQ ID NO: 7155006 - DNA, 22 bp, Homo sapiens
gacagtgtccctctggggtgga

SEQ ID NO: 7155007 - DNA, 22 bp, Homo sapiens
gacagtgtgaacatctaatagt

SEQ ID NO: 7155008 - DNA, 22 bp, Homo sapiens
gacagtgtgaacatctaatagt

SEQ ID NO: 7155009 - DNA, 22 bp, Homo sapiens
gacagtggagccacgttgggag

SEQ ID NO: 7155010 - DNA, 23 bp, Homo sapiens
gacagggctgacttggcagctgc

SEQ ID NO: 7155011 - DNA, 23 bp, Homo sapiens
gacagggctgacttggcagctgc

SEQ ID NO: 7155012 - DNA, 22 bp, Homo sapiens
gacagtgctatggtaggacatt

SEQ ID NO: 7155013 - DNA, 22 bp, Homo sapiens
gactttctaatgctctgtagat

SEQ ID NO: 7155014 - DNA, 22 bp, Homo sapiens
gactggggctctagccaggcct

SEQ ID NO: 7155015 - DNA, 22 bp, Homo sapiens
gactgggggcagccgcaccagt

SEQ ID NO: 7155016 - DNA, 22 bp, Homo sapiens
gactggggtaaggtgaggaggt

SEQ ID NO: 7155017 - DNA, 22 bp, Homo sapiens
gaccctgagcaaaagcagttct

SEQ ID NO: 7155018 - DNA, 22 bp, Homo sapiens
gaccctggaactttcagcagag

SEQ ID NO: 7155019 - DNA, 22 bp, Homo sapiens
gaccctggaactttcagcagag

SEQ ID NO: 7155020 - DNA, 22 bp, Homo sapiens
gaccctggaactttcagcagag

SEQ ID NO: 7155021 - DNA, 22 bp, Homo sapiens
gaccccagaggaaggggcgccg

SEQ ID NO: 7155022 - DNA, 21 bp, Homo sapiens
gaccccagaccagcagacaca

SEQ ID NO: 7155023 - DNA, 22 bp, Homo sapiens
atgctttatgttctggcatttt

SEQ ID NO: 7155024 - DNA, 22 bp, Homo sapiens
atgctttatgttctggcatttt

SEQ ID NO: 7155025 - DNA, 22 bp, Homo sapiens
atgctttatgttctggcatttt

SEQ ID NO: 7155026 - DNA, 22 bp, Homo sapiens
atgctttattggagacagtcat

SEQ ID NO: 7155027 - DNA, 22 bp, Homo sapiens
gaccctcctactaccctggaaa

SEQ ID NO: 7155028 - DNA, 22 bp, Homo sapiens
gaccctcctactaccctggaaa

SEQ ID NO: 7155029 - DNA, 22 bp, Homo sapiens
gaccctcattgtcaccgtgagc

SEQ ID NO: 7155030 - DNA, 22 bp, Homo sapiens
gaccccatctggctgccccagg

SEQ ID NO: 7155031 - DNA, 18 bp, Homo sapiens
gaccccgggatctgtcga

SEQ ID NO: 7155032 - DNA, 18 bp, Homo sapiens
gaccccgggatctgtcga

SEQ ID NO: 7155033 - DNA, 22 bp, Homo sapiens
gaccccaggcagatcagggggt

SEQ ID NO: 7155034 - DNA, 22 bp, Homo sapiens
gaccccaggcagatcagggggt

SEQ ID NO: 7155035 - DNA, 22 bp, Homo sapiens
gacccctagagataggaggaac

SEQ ID NO: 7155036 - DNA, 22 bp, Homo sapiens
gactttgacgaaagagtcatta

SEQ ID NO: 7155037 - DNA, 22 bp, Homo sapiens
gactttgattaaatcaagcaaa

SEQ ID NO: 7155038 - DNA, 19 bp, Homo sapiens
gactttggaaatgctgttt

SEQ ID NO: 7155039 - DNA, 22 bp, Homo sapiens
gactttggagtggttctgctgc

SEQ ID NO: 7155040 - DNA, 22 bp, Homo sapiens
gactttggattcattatctgga

SEQ ID NO: 7155041 - DNA, 22 bp, Homo sapiens
gactttggcttttattctaggt

SEQ ID NO: 7155042 - DNA, 22 bp, Homo sapiens
gactttggtataccttgcttta

SEQ ID NO: 7155043 - DNA, 22 bp, Homo sapiens
atgctttattggagacagtcat

SEQ ID NO: 7155044 - DNA, 22 bp, Homo sapiens
gactttctgctatactttctgt

SEQ ID NO: 7155045 - DNA, 22 bp, Homo sapiens
gactttctgtccagtgatttct

SEQ ID NO: 7155046 - DNA, 21 bp, Homo sapiens
gactttcttaccagatttttg

SEQ ID NO: 7155047 - DNA, 21 bp, Homo sapiens
gactttcttaccagatttttg

SEQ ID NO: 7155048 - DNA, 22 bp, Homo sapiens
gactttcttgtagtgtctgatg

SEQ ID NO: 7155049 - DNA, 22 bp, Homo sapiens
atgcttttccaggagaaatata

SEQ ID NO: 7155050 - DNA, 22 bp, Homo sapiens
atgcttttccaggagaaatata

SEQ ID NO: 7155051 - DNA, 22 bp, Homo sapiens
atgcttttcctaaaatgatgcc

SEQ ID NO: 7155052 - DNA, 22 bp, Homo sapiens
atgcttttatgtcacatggtca

SEQ ID NO: 7155053 - DNA, 22 bp, Homo sapiens
atgcttttatgtcacatggtca

SEQ ID NO: 7155054 - DNA, 22 bp, Homo sapiens
atgctttgtttaaagattttca

SEQ ID NO: 7155055 - DNA, 22 bp, Homo sapiens
atgcttttaactcctttatccc

SEQ ID NO: 7155056 - DNA, 22 bp, Homo sapiens
atgctttggccaatgagaagtg

SEQ ID NO: 7155057 - DNA, 22 bp, Homo sapiens
atgctttgatttggtttctcta

SEQ ID NO: 7155058 - DNA, 22 bp, Homo sapiens
atgctttgaagtttttcctcat

SEQ ID NO: 7155059 - DNA, 22 bp, Homo sapiens
atgctttgatagtttattacat

SEQ ID NO: 7155060 - DNA, 22 bp, Homo sapiens
atgctttctcttagttcattga

SEQ ID NO: 7155061 - DNA, 22 bp, Homo sapiens
atgctttcttctttcctgtaag

SEQ ID NO: 7155062 - DNA, 22 bp, Homo sapiens
atgctttattgttaggtcatgt

SEQ ID NO: 7155063 - DNA, 22 bp, Homo sapiens
atgctttattgttaggtcatgt

SEQ ID NO: 7155064 - DNA, 22 bp, Homo sapiens
atgctttattgttaggtcatgt

SEQ ID NO: 7155065 - DNA, 22 bp, Homo sapiens
cttgagaatcttctctgaagag

SEQ ID NO: 7155066 - DNA, 22 bp, Homo sapiens
cttgagaatcttctctgaagag

SEQ ID NO: 7155067 - DNA, 22 bp, Homo sapiens
cttgagaaggaggaagggcttt

SEQ ID NO: 7155068 - DNA, 22 bp, Homo sapiens
cttgagaaggaggaagggcttt

SEQ ID NO: 7155069 - DNA, 22 bp, Homo sapiens
cttgagaacatctccagctcac

SEQ ID NO: 7155070 - DNA, 22 bp, Homo sapiens
cttgagaacatctccagctcac

SEQ ID NO: 7155071 - DNA, 22 bp, Homo sapiens
cttgagaagagatttatatttg

SEQ ID NO: 7155072 - DNA, 22 bp, Homo sapiens
cttgagaagcattaagaggtag

SEQ ID NO: 7155073 - DNA, 22 bp, Homo sapiens
cttgagaaggaggaagggcttt

SEQ ID NO: 7155074 - DNA, 22 bp, Homo sapiens
cttgagaatcttgatgtctacc

SEQ ID NO: 7155075 - DNA, 22 bp, Homo sapiens
cttgagaatgtgagccacagat

SEQ ID NO: 7155076 - DNA, 22 bp, Homo sapiens
cttgagaatgtgagccacagat

SEQ ID NO: 7155077 - DNA, 21 bp, Homo sapiens
cttgagaattaactgttcatt

SEQ ID NO: 7155078 - DNA, 22 bp, Homo sapiens
cttgagagccactcctggggcc

SEQ ID NO: 7155079 - DNA, 22 bp, Homo sapiens
atcttcccaggctggggagagg

SEQ ID NO: 7155080 - DNA, 22 bp, Homo sapiens
atcttcccaggctggggagagg

SEQ ID NO: 7155081 - DNA, 22 bp, Homo sapiens
atcttcccaggctggggagagg

SEQ ID NO: 7155082 - DNA, 22 bp, Homo sapiens
atcttcccaggctggggagagg

SEQ ID NO: 7155083 - DNA, 22 bp, Homo sapiens
atcttcccaggctggggagagg

SEQ ID NO: 7155084 - DNA, 22 bp, Homo sapiens
atcttccttcactttctcccac

SEQ ID NO: 7155085 - DNA, 22 bp, Homo sapiens
cttgagaaaggaacaggaagct

SEQ ID NO: 7155086 - DNA, 22 bp, Homo sapiens
cttgagaaaggaacaggaagct

SEQ ID NO: 7155087 - DNA, 22 bp, Homo sapiens
cttgagaaaggaacaggaagct

SEQ ID NO: 7155088 - DNA, 22 bp, Homo sapiens
cttgagaacagggttaggtaac

SEQ ID NO: 7155089 - DNA, 22 bp, Homo sapiens
cttgagaacagggttaggtaac

SEQ ID NO: 7155090 - DNA, 22 bp, Homo sapiens
atcttcatcaagttcacagtgg

SEQ ID NO: 7155091 - DNA, 22 bp, Homo sapiens
atcttcagttttcagtgagcca

SEQ ID NO: 7155092 - DNA, 22 bp, Homo sapiens
atcttcaatatttttgtgtaga

SEQ ID NO: 7155093 - DNA, 22 bp, Homo sapiens
atcttcaacttgatcatttgaa

SEQ ID NO: 7155094 - DNA, 21 bp, Homo sapiens
atcttcaactgattggaggag

SEQ ID NO: 7155095 - DNA, 22 bp, Homo sapiens
atcttcaacttgatcatttgaa

SEQ ID NO: 7155096 - DNA, 22 bp, Homo sapiens
atcttcaaagcacatcgtttgt

SEQ ID NO: 7155097 - DNA, 19 bp, Homo sapiens
atcttcaaagccagcagca

SEQ ID NO: 7155098 - DNA, 22 bp, Homo sapiens
atcttcaactcagagagtgctg

SEQ ID NO: 7155099 - DNA, 22 bp, Homo sapiens
atgaatgaatgagagtaggtca

SEQ ID NO: 7155100 - DNA, 22 bp, Homo sapiens
atgaatgaataccatgcaacta

SEQ ID NO: 7155101 - DNA, 22 bp, Homo sapiens
atgaatgaagaacatctgtgcc

SEQ ID NO: 7155102 - DNA, 22 bp, Homo sapiens
atgaatgaaatacagagtactt

SEQ ID NO: 7155103 - DNA, 22 bp, Homo sapiens
atgaatcaagtgagaacagcat

SEQ ID NO: 7155104 - DNA, 22 bp, Homo sapiens
atgaatcagaatctgcatttta

SEQ ID NO: 7155105 - DNA, 22 bp, Homo sapiens
atgaatccaaagtttactatta

SEQ ID NO: 7155106 - DNA, 22 bp, Homo sapiens
atgaatgaaatacagagtactt

SEQ ID NO: 7155107 - DNA, 22 bp, Homo sapiens
atgaatgaaatacagagtactt

SEQ ID NO: 7155108 - DNA, 22 bp, Homo sapiens
atgaatatgagactgagagcct

SEQ ID NO: 7155109 - DNA, 22 bp, Homo sapiens
atgaatatgtacacatctgtca

SEQ ID NO: 7155110 - DNA, 22 bp, Homo sapiens
atgaatatgtacacatctgtca

SEQ ID NO: 7155111 - DNA, 22 bp, Homo sapiens
atgaataagtaaactcctttgg

SEQ ID NO: 7155112 - DNA, 22 bp, Homo sapiens
atgaataagtaaactcctttgg

SEQ ID NO: 7155113 - DNA, 22 bp, Homo sapiens
atgaatatgagactgagagcct

SEQ ID NO: 7155114 - DNA, 22 bp, Homo sapiens
atgaataaaacattttaatcag

SEQ ID NO: 7155115 - DNA, 22 bp, Homo sapiens
atgaagcagttaaggtgcatga

SEQ ID NO: 7155116 - DNA, 22 bp, Homo sapiens
atgaataaacaggtgcctcttc

SEQ ID NO: 7155117 - DNA, 22 bp, Homo sapiens
atgaataaacaggtgcctcttc

SEQ ID NO: 7155118 - DNA, 22 bp, Homo sapiens
atgaagttctcaataatcatgt

SEQ ID NO: 7155119 - DNA, 22 bp, Homo sapiens
atgaataaaacattttaatcag

SEQ ID NO: 7155120 - DNA, 22 bp, Homo sapiens
cttgagtacagatcatattatt

SEQ ID NO: 7155121 - DNA, 22 bp, Homo sapiens
cttgagtattttaatccataat

SEQ ID NO: 7155122 - DNA, 22 bp, Homo sapiens
atgaagcagcgttgtagagtga

SEQ ID NO: 7155123 - DNA, 22 bp, Homo sapiens
atgaagcaggcacagcttcagg

SEQ ID NO: 7155124 - DNA, 22 bp, Homo sapiens
cttgagggcaggattctgtttt

SEQ ID NO: 7155125 - DNA, 22 bp, Homo sapiens
cttgaggctgcactccagggcc

SEQ ID NO: 7155126 - DNA, 22 bp, Homo sapiens
cttgagatgtcatctgctttgg

SEQ ID NO: 7155127 - DNA, 22 bp, Homo sapiens
cttgagcacagcggcttcagga

SEQ ID NO: 7155128 - DNA, 22 bp, Homo sapiens
cttgagcacagcggcttcagga

SEQ ID NO: 7155129 - DNA, 22 bp, Homo sapiens
cttgagcacagcggcttcagga

SEQ ID NO: 7155130 - DNA, 22 bp, Homo sapiens
cttgagcatcggatggaatttc

SEQ ID NO: 7155131 - DNA, 22 bp, Homo sapiens
cttgagcatcggatggaatttc

SEQ ID NO: 7155132 - DNA, 22 bp, Homo sapiens
cttgagctaggaaggctgaggc

SEQ ID NO: 7155133 - DNA, 22 bp, Homo sapiens
gaaaatgagcctcagctacatt

SEQ ID NO: 7155134 - DNA, 22 bp, Homo sapiens
gaaaatgagcctcagctacatt

SEQ ID NO: 7155135 - DNA, 22 bp, Homo sapiens
gaaaatgagcctcagctacatt

SEQ ID NO: 7155136 - DNA, 22 bp, Homo sapiens
gaaaatgagcctcagctacatt

SEQ ID NO: 7155137 - DNA, 22 bp, Homo sapiens
gaaaataggctgcatctccttc

SEQ ID NO: 7155138 - DNA, 22 bp, Homo sapiens
gaaaatagttcatcacaatgat

SEQ ID NO: 7155139 - DNA, 22 bp, Homo sapiens
gaaaatagttcatcacaatgat

SEQ ID NO: 7155140 - DNA, 22 bp, Homo sapiens
gaaaatagttcatcacaatgat

SEQ ID NO: 7155141 - DNA, 22 bp, Homo sapiens
gaaaatagcagatagaccaatg

SEQ ID NO: 7155142 - DNA, 22 bp, Homo sapiens
gaaaatagcagatagaccaatg

SEQ ID NO: 7155143 - DNA, 22 bp, Homo sapiens
gaaaataggcagatgcattgta

SEQ ID NO: 7155144 - DNA, 22 bp, Homo sapiens
gaaaataggcagatgcattgta

SEQ ID NO: 7155145 - DNA, 20 bp, Homo sapiens
gaaaataggccagccaggta

SEQ ID NO: 7155146 - DNA, 22 bp, Homo sapiens
gaaaagaactgcatgggattaa

SEQ ID NO: 7155147 - DNA, 22 bp, Homo sapiens
gaaaagaactgcatgggattaa

SEQ ID NO: 7155148 - DNA, 22 bp, Homo sapiens
gaaaagaactgcatgggattaa

SEQ ID NO: 7155149 - DNA, 22 bp, Homo sapiens
gaaaacttggatctctagaatg

SEQ ID NO: 7155150 - DNA, 22 bp, Homo sapiens
gaaaagaactgcatgggattaa

SEQ ID NO: 7155151 - DNA, 22 bp, Homo sapiens
gaaaagaactgcatgggattaa

SEQ ID NO: 7155152 - DNA, 22 bp, Homo sapiens
gaaaagaactgcatgggattaa

SEQ ID NO: 7155153 - DNA, 22 bp, Homo sapiens
gaaaagaactgcatgggattaa

SEQ ID NO: 7155154 - DNA, 22 bp, Homo sapiens
gaaaagaactgcatgggattaa

SEQ ID NO: 7155155 - DNA, 22 bp, Homo sapiens
gaaaactattggcctagaacaa

SEQ ID NO: 7155156 - DNA, 22 bp, Homo sapiens
gaaaactattggcctagaacaa

SEQ ID NO: 7155157 - DNA, 22 bp, Homo sapiens
gaaaactattggcctagaacaa

SEQ ID NO: 7155158 - DNA, 22 bp, Homo sapiens
gaaaactgtgattagaatgcct

SEQ ID NO: 7155159 - DNA, 22 bp, Homo sapiens
gaaaactgtgattagaatgcct

SEQ ID NO: 7155160 - DNA, 22 bp, Homo sapiens
gaaaacttggatctctagaatg

SEQ ID NO: 7155161 - DNA, 22 bp, Homo sapiens
gaaaactaacggaaaagttagg

SEQ ID NO: 7155162 - DNA, 22 bp, Homo sapiens
gaaaactaacggaaaagttagg

SEQ ID NO: 7155163 - DNA, 22 bp, Homo sapiens
gaaaactaacggaaaagttagg

SEQ ID NO: 7155164 - DNA, 22 bp, Homo sapiens
atgaattgaggaaaacagtcgt

SEQ ID NO: 7155165 - DNA, 22 bp, Homo sapiens
atgaattgaaagaagaatatct

SEQ ID NO: 7155166 - DNA, 22 bp, Homo sapiens
atgaatgggtcattatttgatc

SEQ ID NO: 7155167 - DNA, 19 bp, Homo sapiens
atgaatgtgttcttacctc

SEQ ID NO: 7155168 - DNA, 22 bp, Homo sapiens
atgaattaaggataactggtct

SEQ ID NO: 7155169 - DNA, 22 bp, Homo sapiens
ctttttcccaggtggagagagg

SEQ ID NO: 7155170 - DNA, 22 bp, Homo sapiens
gaaaacatccagagatagacct

SEQ ID NO: 7155171 - DNA, 19 bp, Homo sapiens
gaaaacatgggtgagggtc

SEQ ID NO: 7155172 - DNA, 22 bp, Homo sapiens
gaaaaccacctcccatcaagca

SEQ ID NO: 7155173 - DNA, 21 bp, Homo sapiens
gaaaaccatttgcatcatgag

SEQ ID NO: 7155174 - DNA, 21 bp, Homo sapiens
gaaaaccatttgcatcatgag

SEQ ID NO: 7155175 - DNA, 22 bp, Homo sapiens
gaaaactaacggaaaagttagg

SEQ ID NO: 7155176 - DNA, 22 bp, Homo sapiens
atgaatgattaaagagtacagt

SEQ ID NO: 7155177 - DNA, 22 bp, Homo sapiens
atgaatgattaaagagtacagt

SEQ ID NO: 7155178 - DNA, 22 bp, Homo sapiens
atgaatgattaaagagtacagt

SEQ ID NO: 7155179 - DNA, 22 bp, Homo sapiens
atgaatgattaaagagtacagt

SEQ ID NO: 7155180 - DNA, 22 bp, Homo sapiens
atgaatgagtgctaggtttgtc

SEQ ID NO: 7155181 - DNA, 19 bp, Homo sapiens
atgaatgatccggtttctc

SEQ ID NO: 7155182 - DNA, 22 bp, Homo sapiens
atgaatgatgcaaaagacactg

SEQ ID NO: 7155183 - DNA, 22 bp, Homo sapiens
atgaatgatgcaaaagacactg

SEQ ID NO: 7155184 - DNA, 22 bp, Homo sapiens
atgaatgatgccagttgaaatg

SEQ ID NO: 7155185 - DNA, 22 bp, Homo sapiens
atgaatgagattaccaatgtga

SEQ ID NO: 7155186 - DNA, 22 bp, Homo sapiens
atgaatgagagaatagtggagc

SEQ ID NO: 7155187 - DNA, 22 bp, Homo sapiens
atgaatgagattaccaatgtga

SEQ ID NO: 7155188 - DNA, 22 bp, Homo sapiens
atgaatgagaaagctgaaatct

SEQ ID NO: 7155189 - DNA, 22 bp, Homo sapiens
atgaatgactgtctactttggg

SEQ ID NO: 7155190 - DNA, 22 bp, Homo sapiens
atgaatgattttatgtaaatga

SEQ ID NO: 7155191 - DNA, 21 bp, Homo sapiens
atgaatgatttctactcttaa

SEQ ID NO: 7155192 - DNA, 21 bp, Homo sapiens
atgaatgatttctactcttaa

SEQ ID NO: 7155193 - DNA, 22 bp, Homo sapiens
atgaatgatttgtcagtcacag

SEQ ID NO: 7155194 - DNA, 22 bp, Homo sapiens
atgaatgattttatgtaaatga

SEQ ID NO: 7155195 - DNA, 22 bp, Homo sapiens
atgaatgattttatgtaaatga

SEQ ID NO: 7155196 - DNA, 22 bp, Homo sapiens
atgcaagacccagaaatcatta

SEQ ID NO: 7155197 - DNA, 22 bp, Homo sapiens
atgcaaatgcagccattgcaga

SEQ ID NO: 7155198 - DNA, 22 bp, Homo sapiens
atgcaaatgctagagaatgttg

SEQ ID NO: 7155199 - DNA, 22 bp, Homo sapiens
atgcaaatgcagccattgcaga

SEQ ID NO: 7155200 - DNA, 22 bp, Homo sapiens
atgcaagatgtatagaagactt

SEQ ID NO: 7155201 - DNA, 22 bp, Homo sapiens
atgcaagattcagcaggaagat

SEQ ID NO: 7155202 - DNA, 22 bp, Homo sapiens
atgcaaatgaacatgttgctag

SEQ ID NO: 7155203 - DNA, 22 bp, Homo sapiens
atgcaaatgaacatgttgctag

SEQ ID NO: 7155204 - DNA, 22 bp, Homo sapiens
gaagaaagattggcatgcttca

SEQ ID NO: 7155205 - DNA, 22 bp, Homo sapiens
gaagaaagattggcatgcttca

SEQ ID NO: 7155206 - DNA, 22 bp, Homo sapiens
gaagaaagattggcatgcttca

SEQ ID NO: 7155207 - DNA, 22 bp, Homo sapiens
gaagaaagattggcatgcttca

SEQ ID NO: 7155208 - DNA, 22 bp, Homo sapiens
gaagaaagattggcatgcttca

SEQ ID NO: 7155209 - DNA, 22 bp, Homo sapiens
gaagaaagatcaaatagtttcc

SEQ ID NO: 7155210 - DNA, 22 bp, Homo sapiens
gaagaaagatcaaatagtttcc

SEQ ID NO: 7155211 - DNA, 22 bp, Homo sapiens
gaagaaagatcaaatagtttcc

SEQ ID NO: 7155212 - DNA, 22 bp, Homo sapiens
atgcaagtcttaatagtttagg

SEQ ID NO: 7155213 - DNA, 22 bp, Homo sapiens
atgcaataccttctgaaaataa

SEQ ID NO: 7155214 - DNA, 22 bp, Homo sapiens
atgcaatatagggaagatagat

SEQ ID NO: 7155215 - DNA, 22 bp, Homo sapiens
atgcaatatagggaagatagat

SEQ ID NO: 7155216 - DNA, 22 bp, Homo sapiens
atgcacaacagacgaatggaag

SEQ ID NO: 7155217 - DNA, 21 bp, Homo sapiens
atgcacaaaaagactctttct

SEQ ID NO: 7155218 - DNA, 22 bp, Homo sapiens
atgcaatatgtgtttctgttta

SEQ ID NO: 7155219 - DNA, 22 bp, Homo sapiens
gaacattattgtacaaatgtct

SEQ ID NO: 7155220 - DNA, 22 bp, Homo sapiens
gaacattattgtacaaatgtct

SEQ ID NO: 7155221 - DNA, 22 bp, Homo sapiens
gaacattcacagactcaccatt

SEQ ID NO: 7155222 - DNA, 23 bp, Homo sapiens
gaacattcattggttgctttaga

SEQ ID NO: 7155223 - DNA, 22 bp, Homo sapiens
gaacatctgccttgtggctgcc

SEQ ID NO: 7155224 - DNA, 22 bp, Homo sapiens
gaacatctgggatcattgctgt

SEQ ID NO: 7155225 - DNA, 22 bp, Homo sapiens
gaacatctgtgatctctttggg

SEQ ID NO: 7155226 - DNA, 22 bp, Homo sapiens
gaacatctgttaaataaaggta

SEQ ID NO: 7155227 - DNA, 22 bp, Homo sapiens
gaacatcttatccatttcctct

SEQ ID NO: 7155228 - DNA, 22 bp, Homo sapiens
gaacatcttatccatttcctct

SEQ ID NO: 7155229 - DNA, 22 bp, Homo sapiens
gaacatctttaggggaccatca

SEQ ID NO: 7155230 - DNA, 22 bp, Homo sapiens
gaacatctttaggggaccatca

SEQ ID NO: 7155231 - DNA, 22 bp, Homo sapiens
gaacatttgatgatgacattgg

SEQ ID NO: 7155232 - DNA, 22 bp, Homo sapiens
gaacattcttggaggaaataac

SEQ ID NO: 7155233 - DNA, 22 bp, Homo sapiens
gaacattgctttatttcttcta

SEQ ID NO: 7155234 - DNA, 22 bp, Homo sapiens
gaactttataactgtaaatgtc

SEQ ID NO: 7155235 - DNA, 22 bp, Homo sapiens
gaactttaggattttcacaggt

SEQ ID NO: 7155236 - DNA, 22 bp, Homo sapiens
gaacatttgatgatgacattgg

SEQ ID NO: 7155237 - DNA, 22 bp, Homo sapiens
gaactttattccagaagaaagc

SEQ ID NO: 7155238 - DNA, 22 bp, Homo sapiens
gaactttattccagaagaaagc

SEQ ID NO: 7155239 - DNA, 22 bp, Homo sapiens
gaactttgcaaatgtcagaagc

SEQ ID NO: 7155240 - DNA, 22 bp, Homo sapiens
gaaatatacatgaagtcggctg

SEQ ID NO: 7155241 - DNA, 22 bp, Homo sapiens
gaaatatacattgcaggaagag

SEQ ID NO: 7155242 - DNA, 22 bp, Homo sapiens
gaaatatacattgcaggaagag

SEQ ID NO: 7155243 - DNA, 22 bp, Homo sapiens
gaaatctccaatcttttcttta

SEQ ID NO: 7155244 - DNA, 22 bp, Homo sapiens
gaaaatgcctctggcattaaac

SEQ ID NO: 7155245 - DNA, 22 bp, Homo sapiens
gaaaatgcctctggcattaaac

SEQ ID NO: 7155246 - DNA, 22 bp, Homo sapiens
gaaaatgagcctcagctacatt

SEQ ID NO: 7155247 - DNA, 22 bp, Homo sapiens
gaaatcttccaatggtcacatc

SEQ ID NO: 7155248 - DNA, 22 bp, Homo sapiens
gaaatcttgctcattgtgacaa

SEQ ID NO: 7155249 - DNA, 22 bp, Homo sapiens
gaaatcttttaaccattcattt

SEQ ID NO: 7155250 - DNA, 22 bp, Homo sapiens
gaaatcttttaaccattcattt

SEQ ID NO: 7155251 - DNA, 22 bp, Homo sapiens
gaaatcttttcatctcatttga

SEQ ID NO: 7155252 - DNA, 22 bp, Homo sapiens
gaaatcttttccaattgtttag

SEQ ID NO: 7155253 - DNA, 22 bp, Homo sapiens
gaaatcttttccaattgtttag

SEQ ID NO: 7155254 - DNA, 22 bp, Homo sapiens
gaaatgaaacaggcttttaagg

SEQ ID NO: 7155255 - DNA, 22 bp, Homo sapiens
gaaatgaaacaggcttttaagg

SEQ ID NO: 7155256 - DNA, 22 bp, Homo sapiens
gaaatgaaatagcaccaaggtt

SEQ ID NO: 7155257 - DNA, 22 bp, Homo sapiens
gaaatgaactgattatcattgc

SEQ ID NO: 7155258 - DNA, 22 bp, Homo sapiens
gaaatgaactgattatcattgc

SEQ ID NO: 7155259 - DNA, 22 bp, Homo sapiens
atgaggcatgtgaggagaaggg

SEQ ID NO: 7155260 - DNA, 22 bp, Homo sapiens
atgaggcatgtgaggagaaggg

SEQ ID NO: 7155261 - DNA, 22 bp, Homo sapiens
atgaggcatgggatcaaaatga

SEQ ID NO: 7155262 - DNA, 22 bp, Homo sapiens
atgaggcatctgcagtcactag

SEQ ID NO: 7155263 - DNA, 21 bp, Homo sapiens
atgaggcatgagagggtttct

SEQ ID NO: 7155264 - DNA, 22 bp, Homo sapiens
atgaggcatatcctcctatggt

SEQ ID NO: 7155265 - DNA, 16 bp, Homo sapiens
atgaggcataggctgc

SEQ ID NO: 7155266 - DNA, 22 bp, Homo sapiens
atgaggcatctaacattgcaaa

SEQ ID NO: 7155267 - DNA, 22 bp, Homo sapiens
atgaggcatctgcagtcactag

SEQ ID NO: 7155268 - DNA, 22 bp, Homo sapiens
gaaatgattttagtttatcatg

SEQ ID NO: 7155269 - DNA, 22 bp, Homo sapiens
gaaatgattttagtttatcatg

SEQ ID NO: 7155270 - DNA, 22 bp, Homo sapiens
atgaggcagtctggcctgaggg

SEQ ID NO: 7155271 - DNA, 22 bp, Homo sapiens
gaaatgatgtctgtgctgccac

SEQ ID NO: 7155272 - DNA, 22 bp, Homo sapiens
gaaatgattttagtttatcatg

SEQ ID NO: 7155273 - DNA, 22 bp, Homo sapiens
gaaatgatgtctgtgctgccac

SEQ ID NO: 7155274 - DNA, 22 bp, Homo sapiens
atgaggcatagcagggatcgga

SEQ ID NO: 7155275 - DNA, 22 bp, Homo sapiens
atgaggcatagcagggatcgga

SEQ ID NO: 7155276 - DNA, 23 bp, Homo sapiens
atgaggcattaaacaggcttttt

SEQ ID NO: 7155277 - DNA, 22 bp, Homo sapiens
atgaggcatgtgaggagaaggg

SEQ ID NO: 7155278 - DNA, 22 bp, Homo sapiens
atgaggcatgtgaggagaaggg

SEQ ID NO: 7155279 - DNA, 22 bp, Homo sapiens
atgaggcattccactcaaactc

SEQ ID NO: 7155280 - DNA, 15 bp, Homo sapiens
atgaggcatttgggg

SEQ ID NO: 7155281 - DNA, 22 bp, Homo sapiens
gaacaatgaaagacataaactc

SEQ ID NO: 7155282 - DNA, 22 bp, Homo sapiens
gaacaatgagtcattcaggtga

SEQ ID NO: 7155283 - DNA, 22 bp, Homo sapiens
atgaggcattcacagaaggcac

SEQ ID NO: 7155284 - DNA, 22 bp, Homo sapiens
atgaggcattcacagaaggcac

SEQ ID NO: 7155285 - DNA, 22 bp, Homo sapiens
gaacatcagtcataatttaacg

SEQ ID NO: 7155286 - DNA, 22 bp, Homo sapiens
gaacataattaaatgtcctggg

SEQ ID NO: 7155287 - DNA, 22 bp, Homo sapiens
gaacatatgcatgtttgttttg

SEQ ID NO: 7155288 - DNA, 19 bp, Homo sapiens
gaacaatttgttagctctc

SEQ ID NO: 7155289 - DNA, 22 bp, Homo sapiens
gaacaatgagtcattcaggtga

SEQ ID NO: 7155290 - DNA, 19 bp, Homo sapiens
gaacaatttgttagctctc

SEQ ID NO: 7155291 - DNA, 22 bp, Homo sapiens
cttattcagcacttgctctgta

SEQ ID NO: 7155292 - DNA, 22 bp, Homo sapiens
cttattcagcaagtttgggtac

SEQ ID NO: 7155293 - DNA, 22 bp, Homo sapiens
cttattcagcacttgctctgta

SEQ ID NO: 7155294 - DNA, 22 bp, Homo sapiens
cttattcagatacagactcttg

SEQ ID NO: 7155295 - DNA, 22 bp, Homo sapiens
cttattcagatacagactcttg

SEQ ID NO: 7155296 - DNA, 22 bp, Homo sapiens
cttattcagaccttggattctt

SEQ ID NO: 7155297 - DNA, 22 bp, Homo sapiens
cttattcagaaggagaaatgga

SEQ ID NO: 7155298 - DNA, 22 bp, Homo sapiens
cttattcaatgctggaaatgtt

SEQ ID NO: 7155299 - DNA, 21 bp, Homo sapiens
cttattcactgttatttatca

SEQ ID NO: 7155300 - DNA, 22 bp, Homo sapiens
cttattcagaaggagaaatgga

SEQ ID NO: 7155301 - DNA, 22 bp, Homo sapiens
cttattcatatattctcggtag

SEQ ID NO: 7155302 - DNA, 22 bp, Homo sapiens
cttattcataagtcagacacac

SEQ ID NO: 7155303 - DNA, 22 bp, Homo sapiens
cttcaaatgtgattttaataac

SEQ ID NO: 7155304 - DNA, 22 bp, Homo sapiens
cttcaacagttttagaacactg

SEQ ID NO: 7155305 - DNA, 22 bp, Homo sapiens
cttcaacttccctagatgtcat

SEQ ID NO: 7155306 - DNA, 22 bp, Homo sapiens
cttcaactttgtaagtagaatt

SEQ ID NO: 7155307 - DNA, 22 bp, Homo sapiens
cttcaagaagacagcagagcat

SEQ ID NO: 7155308 - DNA, 22 bp, Homo sapiens
cttcaagaagacagcagagcat

SEQ ID NO: 7155309 - DNA, 22 bp, Homo sapiens
cttattatggcatgtaagtggg

SEQ ID NO: 7155310 - DNA, 22 bp, Homo sapiens
cttattataaaatcctgtttga

SEQ ID NO: 7155311 - DNA, 22 bp, Homo sapiens
cttattataaaatcctgtttga

SEQ ID NO: 7155312 - DNA, 22 bp, Homo sapiens
cttattagtgtctgtctgagtt

SEQ ID NO: 7155313 - DNA, 19 bp, Homo sapiens
cttattagagtgagagctt

SEQ ID NO: 7155314 - DNA, 22 bp, Homo sapiens
cttattagagttgtgttctgtt

SEQ ID NO: 7155315 - DNA, 22 bp, Homo sapiens
cttatgtatgctactttgtggt

SEQ ID NO: 7155316 - DNA, 22 bp, Homo sapiens
cttattaatggaatcctaatga

SEQ ID NO: 7155317 - DNA, 22 bp, Homo sapiens
cttattagaaagaaaagacatg

SEQ ID NO: 7155318 - DNA, 19 bp, Homo sapiens
cttattagagtgagagctt

SEQ ID NO: 7155319 - DNA, 22 bp, Homo sapiens
cttatgtacacacatatattgt

SEQ ID NO: 7155320 - DNA, 22 bp, Homo sapiens
cttatgattcaaataggatctt

SEQ ID NO: 7155321 - DNA, 19 bp, Homo sapiens
cttatgcagctgagcttgg

SEQ ID NO: 7155322 - DNA, 22 bp, Homo sapiens
cttatgaagaccctacctccag

SEQ ID NO: 7155323 - DNA, 19 bp, Homo sapiens
cttatgcagctgagcttgg

SEQ ID NO: 7155324 - DNA, 22 bp, Homo sapiens
cttatggaagaaacctcagaga

SEQ ID NO: 7155325 - DNA, 22 bp, Homo sapiens
cttcaagatccatagatattgc

SEQ ID NO: 7155326 - DNA, 22 bp, Homo sapiens
cttcaagatatttctagaatca

SEQ ID NO: 7155327 - DNA, 22 bp, Homo sapiens
cttcaagagaatgcagggatgt

SEQ ID NO: 7155328 - DNA, 22 bp, Homo sapiens
cttcaaggcttattccagttgt

SEQ ID NO: 7155329 - DNA, 22 bp, Homo sapiens
cttcaaggtggctaaatggggc

SEQ ID NO: 7155330 - DNA, 22 bp, Homo sapiens
cttcaagtcgccaaatgctgaa

SEQ ID NO: 7155331 - DNA, 22 bp, Homo sapiens
cttcaagttgggcggcgggcag

SEQ ID NO: 7155332 - DNA, 22 bp, Homo sapiens
cttcaagttgtctgagggtggg

SEQ ID NO: 7155333 - DNA, 20 bp, Homo sapiens
cttcaagttatggttggcaa

SEQ ID NO: 7155334 - DNA, 22 bp, Homo sapiens
cttcctctcttgcccataagag

SEQ ID NO: 7155335 - DNA, 22 bp, Homo sapiens
cttcctctcttgcccataagag

SEQ ID NO: 7155336 - DNA, 22 bp, Homo sapiens
cttcctctatgttcaggtagaa

SEQ ID NO: 7155337 - DNA, 22 bp, Homo sapiens
cttccttctcactagcagcgcc

SEQ ID NO: 7155338 - DNA, 22 bp, Homo sapiens
cttccttctgaagcatagaagc

SEQ ID NO: 7155339 - DNA, 22 bp, Homo sapiens
cttccttccttccccgaaatgc

SEQ ID NO: 7155340 - DNA, 22 bp, Homo sapiens
cttccttgctgtctgctccagg

SEQ ID NO: 7155341 - DNA, 22 bp, Homo sapiens
cttccttgcggcccctgcctag

SEQ ID NO: 7155342 - DNA, 22 bp, Homo sapiens
cttccttctgaagcatagaagc

SEQ ID NO: 7155343 - DNA, 22 bp, Homo sapiens
cttccttctgtaagaccagttg

SEQ ID NO: 7155344 - DNA, 22 bp, Homo sapiens
cttaagatttgcgatacctaat

SEQ ID NO: 7155345 - DNA, 22 bp, Homo sapiens
cttaagcaaaatattctttcac

SEQ ID NO: 7155346 - DNA, 22 bp, Homo sapiens
cttaagatttgagatacctaat

SEQ ID NO: 7155347 - DNA, 22 bp, Homo sapiens
cttaagatgaggtcatgctata

SEQ ID NO: 7155348 - DNA, 22 bp, Homo sapiens
cttaagatgaggtcatgctata

SEQ ID NO: 7155349 - DNA, 22 bp, Homo sapiens
cttaagacaggctcaaagatta

SEQ ID NO: 7155350 - DNA, 22 bp, Homo sapiens
cttaagaagcaagtctcagcaa

SEQ ID NO: 7155351 - DNA, 20 bp, Homo sapiens
cttaacaatggctctgatga

SEQ ID NO: 7155352 - DNA, 22 bp, Homo sapiens
cttaacagagagaagtgttgct

SEQ ID NO: 7155353 - DNA, 22 bp, Homo sapiens
cttaacagcaagatctgtgtca

SEQ ID NO: 7155354 - DNA, 21 bp, Homo sapiens
cttaacattttaaatgaaagg

SEQ ID NO: 7155355 - DNA, 22 bp, Homo sapiens
cttaagaaattgcattctaatc

SEQ ID NO: 7155356 - DNA, 22 bp, Homo sapiens
cttaacaaacagtgtggatata

SEQ ID NO: 7155357 - DNA, 22 bp, Homo sapiens
cttaacaagcccaactttcatt

SEQ ID NO: 7155358 - DNA, 22 bp, Homo sapiens
ctgtttctcccatgtccaagtg

SEQ ID NO: 7155359 - DNA, 22 bp, Homo sapiens
ctgtttctcccatgtccaagtg

SEQ ID NO: 7155360 - DNA, 19 bp, Homo sapiens
atcatcactcatggtcctg

SEQ ID NO: 7155361 - DNA, 22 bp, Homo sapiens
atcatcagggacatttctgtgc

SEQ ID NO: 7155362 - DNA, 22 bp, Homo sapiens
atcatcatcaacaagaaacatt

SEQ ID NO: 7155363 - DNA, 22 bp, Homo sapiens
atcatacagcctttgttagtgt

SEQ ID NO: 7155364 - DNA, 22 bp, Homo sapiens
atcatacatgtaactaagtaaa

SEQ ID NO: 7155365 - DNA, 22 bp, Homo sapiens
atcatagaacacctacctacct

SEQ ID NO: 7155366 - DNA, 22 bp, Homo sapiens
atcatagaggaaaatccacgtt

SEQ ID NO: 7155367 - DNA, 21 bp, Homo sapiens
atccatccatcttggcctaac

SEQ ID NO: 7155368 - DNA, 20 bp, Homo sapiens
atccatcagagaaaataaag

SEQ ID NO: 7155369 - DNA, 20 bp, Homo sapiens
atccatcatgtccatgactt

SEQ ID NO: 7155370 - DNA, 22 bp, Homo sapiens
atccatctttcctgctgaactg

SEQ ID NO: 7155371 - DNA, 22 bp, Homo sapiens
atccatgaaggtacttctcagg

SEQ ID NO: 7155372 - DNA, 22 bp, Homo sapiens
atccatgaccctctcaacaacc

SEQ ID NO: 7155373 - DNA, 22 bp, Homo sapiens
cttaatctcacctgcaaagtcc

SEQ ID NO: 7155374 - DNA, 22 bp, Homo sapiens
cttaatcatggcttgtgggagg

SEQ ID NO: 7155375 - DNA, 22 bp, Homo sapiens
cttaatctcacctgcaaagtcc

SEQ ID NO: 7155376 - DNA, 22 bp, Homo sapiens
cttagattttcaatgtgaacta

SEQ ID NO: 7155377 - DNA, 22 bp, Homo sapiens
cttagcaaatgcctgtgctgct

SEQ ID NO: 7155378 - DNA, 22 bp, Homo sapiens
cttagcaagaatcagctgctgg

SEQ ID NO: 7155379 - DNA, 22 bp, Homo sapiens
atccatttcctccactataaag

SEQ ID NO: 7155380 - DNA, 22 bp, Homo sapiens
atccatttcctccactataaag

SEQ ID NO: 7155381 - DNA, 22 bp, Homo sapiens
atccatttctatcttgctgagg

SEQ ID NO: 7155382 - DNA, 22 bp, Homo sapiens
atccatttctatcttgctgagg

SEQ ID NO: 7155383 - DNA, 22 bp, Homo sapiens
atccatttgaaagaacagtcca

SEQ ID NO: 7155384 - DNA, 22 bp, Homo sapiens
atccatttgacataatttcagc

SEQ ID NO: 7155385 - DNA, 22 bp, Homo sapiens
atccatttgacataatttcagc

SEQ ID NO: 7155386 - DNA, 22 bp, Homo sapiens
atccattgtggtcttgtacatt

SEQ ID NO: 7155387 - DNA, 22 bp, Homo sapiens
atccatttaattgaggggaagg

SEQ ID NO: 7155388 - DNA, 22 bp, Homo sapiens
atccatttaattgaggggaagg

SEQ ID NO: 7155389 - DNA, 22 bp, Homo sapiens
atccatttcctccactataaag

SEQ ID NO: 7155390 - DNA, 22 bp, Homo sapiens
atccattgtcttgttggcttct

SEQ ID NO: 7155391 - DNA, 23 bp, Homo sapiens
atccatgcttaagtaatcatttg

SEQ ID NO: 7155392 - DNA, 22 bp, Homo sapiens
atccatggaggacaagagcaat

SEQ ID NO: 7155393 - DNA, 23 bp, Homo sapiens
atccatgtgagaatagactagca

SEQ ID NO: 7155394 - DNA, 22 bp, Homo sapiens
atctggtgacacgaggagctgg

SEQ ID NO: 7155395 - DNA, 22 bp, Homo sapiens
atctgggtttcaaagaagcctt

SEQ ID NO: 7155396 - DNA, 20 bp, Homo sapiens
atctggctcagatcctgcag

SEQ ID NO: 7155397 - DNA, 22 bp, Homo sapiens
atctggctcattcagggaacgg

SEQ ID NO: 7155398 - DNA, 22 bp, Homo sapiens
cttcttaatgacagattaaaat

SEQ ID NO: 7155399 - DNA, 22 bp, Homo sapiens
cttctgttactgttagctgaag

SEQ ID NO: 7155400 - DNA, 22 bp, Homo sapiens
cttcttaaatatttggctgact

SEQ ID NO: 7155401 - DNA, 22 bp, Homo sapiens
cttcttaaatatttggctgact

SEQ ID NO: 7155402 - DNA, 22 bp, Homo sapiens
cttcttaaatatttggctgact

SEQ ID NO: 7155403 - DNA, 22 bp, Homo sapiens
cttcttaaattggattgctatt

SEQ ID NO: 7155404 - DNA, 22 bp, Homo sapiens
cttcttaaattggattgctatt

SEQ ID NO: 7155405 - DNA, 22 bp, Homo sapiens
atctggttcttcttaggcatca

SEQ ID NO: 7155406 - DNA, 22 bp, Homo sapiens
atctggtttggggatccttgtg

SEQ ID NO: 7155407 - DNA, 22 bp, Homo sapiens
atctggtttggggatccttgtg

SEQ ID NO: 7155408 - DNA, 22 bp, Homo sapiens
atctggttttggctgtgtccct

SEQ ID NO: 7155409 - DNA, 22 bp, Homo sapiens
atctggttttggctgtgtccct

SEQ ID NO: 7155410 - DNA, 22 bp, Homo sapiens
atctgtaaagataatcatatgt

SEQ ID NO: 7155411 - DNA, 22 bp, Homo sapiens
atctgtaacatcagtagcagaa

SEQ ID NO: 7155412 - DNA, 22 bp, Homo sapiens
atctgtaacatcagtagcagaa

SEQ ID NO: 7155413 - DNA, 22 bp, Homo sapiens
atctgtaactgctatcatctcc

SEQ ID NO: 7155414 - DNA, 22 bp, Homo sapiens
atctgtaaatgcaaatgtagct

SEQ ID NO: 7155415 - DNA, 22 bp, Homo sapiens
atctgtaattttgaatgcaaat

SEQ ID NO: 7155416 - DNA, 22 bp, Homo sapiens
atctgtagaagatactctgaga

SEQ ID NO: 7155417 - DNA, 22 bp, Homo sapiens
atctgtatatttttcaatgcaa

SEQ ID NO: 7155418 - DNA, 22 bp, Homo sapiens
atctgtcaggagcaaggactac

SEQ ID NO: 7155419 - DNA, 22 bp, Homo sapiens
atctgtccctcctcacagcctc

SEQ ID NO: 7155420 - DNA, 22 bp, Homo sapiens
atctgttcccctatgctctcta

SEQ ID NO: 7155421 - DNA, 22 bp, Homo sapiens
atctgttcccctatgctctcta

SEQ ID NO: 7155422 - DNA, 22 bp, Homo sapiens
atctgttatttacccatctctg

SEQ ID NO: 7155423 - DNA, 22 bp, Homo sapiens
atctgtggcagtgatgagtctt

SEQ ID NO: 7155424 - DNA, 22 bp, Homo sapiens
atctgtggccaaaagactgttg

SEQ ID NO: 7155425 - DNA, 22 bp, Homo sapiens
atctgtggctggtgagaggcag

SEQ ID NO: 7155426 - DNA, 22 bp, Homo sapiens
atctgtggtcaaaatagaaact

SEQ ID NO: 7155427 - DNA, 22 bp, Homo sapiens
atctgtgtatgaaagtataact

SEQ ID NO: 7155428 - DNA, 22 bp, Homo sapiens
atctgtgtgttattgtttatca

SEQ ID NO: 7155429 - DNA, 22 bp, Homo sapiens
atctgtcttgccttgcatattt

SEQ ID NO: 7155430 - DNA, 22 bp, Homo sapiens
atctgtcttttaatgttaatgc

SEQ ID NO: 7155431 - DNA, 22 bp, Homo sapiens
atctgtcttgccttgcatattt

SEQ ID NO: 7155432 - DNA, 22 bp, Homo sapiens
atctgtcttgccttgcatattt

SEQ ID NO: 7155433 - DNA, 22 bp, Homo sapiens
atctgtcttgccttgcatattt

SEQ ID NO: 7155434 - DNA, 22 bp, Homo sapiens
atctgtcttccaccacacatcc

SEQ ID NO: 7155435 - DNA, 22 bp, Homo sapiens
atctgtcttttattcatgagct

SEQ ID NO: 7155436 - DNA, 22 bp, Homo sapiens
atctgtggaaattggcaagtgc

SEQ ID NO: 7155437 - DNA, 22 bp, Homo sapiens
atctgtcctggagctaggcttc

SEQ ID NO: 7155438 - DNA, 22 bp, Homo sapiens
atctgtcctctgtctggaggct

SEQ ID NO: 7155439 - DNA, 22 bp, Homo sapiens
atctgtctatgatatagtctgt

SEQ ID NO: 7155440 - DNA, 22 bp, Homo sapiens
cttccttgtggtccttctcatt

SEQ ID NO: 7155441 - DNA, 22 bp, Homo sapiens
cttccttgctgtctgctccagg

SEQ ID NO: 7155442 - DNA, 22 bp, Homo sapiens
cttccttgtggtccttctcatt

SEQ ID NO: 7155443 - DNA, 22 bp, Homo sapiens
cttccttgtggtccttctcatt

SEQ ID NO: 7155444 - DNA, 19 bp, Homo sapiens
atctcctttcttcaagctt

SEQ ID NO: 7155445 - DNA, 21 bp, Homo sapiens
atctcgggcttctcgcccagc

SEQ ID NO: 7155446 - DNA, 22 bp, Homo sapiens
atctccttggtctcgttccagg

SEQ ID NO: 7155447 - DNA, 19 bp, Homo sapiens
atctcctttcttcaagctt

SEQ ID NO: 7155448 - DNA, 19 bp, Homo sapiens
atctcctttcttcaagctt

SEQ ID NO: 7155449 - DNA, 21 bp, Homo sapiens
atctcgggcttctcgcccagc

SEQ ID NO: 7155450 - DNA, 22 bp, Homo sapiens
atctctaaagtctgttcagctc

SEQ ID NO: 7155451 - DNA, 22 bp, Homo sapiens
atctctaagtacctccaagggt

SEQ ID NO: 7155452 - DNA, 22 bp, Homo sapiens
atctctaatcaccagctctagc

SEQ ID NO: 7155453 - DNA, 22 bp, Homo sapiens
atctctaatttaaaaagtaaca

SEQ ID NO: 7155454 - DNA, 22 bp, Homo sapiens
atctctaatttaaaaagtaaca

SEQ ID NO: 7155455 - DNA, 22 bp, Homo sapiens
atctctaatttaaaaagtaaca

SEQ ID NO: 7155456 - DNA, 22 bp, Homo sapiens
atctctaatttaaaaagtaaca

SEQ ID NO: 7155457 - DNA, 20 bp, Homo sapiens
atctcctgctaccacccatt

SEQ ID NO: 7155458 - DNA, 22 bp, Homo sapiens
atctccttggatcacgtttagt

SEQ ID NO: 7155459 - DNA, 22 bp, Homo sapiens
atctcctcccgcgccgagctcg

SEQ ID NO: 7155460 - DNA, 23 bp, Homo sapiens
atctcctgagaacccacagtggt

SEQ ID NO: 7155461 - DNA, 22 bp, Homo sapiens
cttctgagatgttgttttacag

SEQ ID NO: 7155462 - DNA, 22 bp, Homo sapiens
cttctgagatgttgttttacag

SEQ ID NO: 7155463 - DNA, 22 bp, Homo sapiens
atctctgatttacagcatctct

SEQ ID NO: 7155464 - DNA, 22 bp, Homo sapiens
atctctgatttacagcatctct

SEQ ID NO: 7155465 - DNA, 22 bp, Homo sapiens
cttctccttatatgtcccgttc

SEQ ID NO: 7155466 - DNA, 23 bp, Homo sapiens
atctctctttattcttggggata

SEQ ID NO: 7155467 - DNA, 22 bp, Homo sapiens
atctctgaaggctccaggagag

SEQ ID NO: 7155468 - DNA, 22 bp, Homo sapiens
cttctccttatatgtcccgttc

SEQ ID NO: 7155469 - DNA, 23 bp, Homo sapiens
atctctctggtggtcacagtcag

SEQ ID NO: 7155470 - DNA, 23 bp, Homo sapiens
atctctctggtggtcacagtcag

SEQ ID NO: 7155471 - DNA, 23 bp, Homo sapiens
atctctctggtggtcacagtcag

SEQ ID NO: 7155472 - DNA, 15 bp, Homo sapiens
atctctctagctgct

SEQ ID NO: 7155473 - DNA, 22 bp, Homo sapiens
atctctctatgcactgaggact

SEQ ID NO: 7155474 - DNA, 22 bp, Homo sapiens
atctctctgcccaggggctgtg

SEQ ID NO: 7155475 - DNA, 22 bp, Homo sapiens
atctctccttcagctgaggccc

SEQ ID NO: 7155476 - DNA, 17 bp, Homo sapiens
atctctctaaggcaggc

SEQ ID NO: 7155477 - DNA, 22 bp, Homo sapiens
atctctccttatgaagcattat

SEQ ID NO: 7155478 - DNA, 22 bp, Homo sapiens
atctctccttcagctgaggccc

SEQ ID NO: 7155479 - DNA, 22 bp, Homo sapiens
atctctccttcagctgaggccc

SEQ ID NO: 7155480 - DNA, 22 bp, Homo sapiens
atctctaatttaaaaagtaaca

SEQ ID NO: 7155481 - DNA, 22 bp, Homo sapiens
atctctatctttattgaaatct

SEQ ID NO: 7155482 - DNA, 22 bp, Homo sapiens
cttctgcaagagcatcagttgt

SEQ ID NO: 7155483 - DNA, 22 bp, Homo sapiens
cttctgattagcaagtttgtat

SEQ ID NO: 7155484 - DNA, 19 bp, Homo sapiens
cttctgatggaaagccaac

SEQ ID NO: 7155485 - DNA, 22 bp, Homo sapiens
cttctgatctggattcctaact

SEQ ID NO: 7155486 - DNA, 22 bp, Homo sapiens
cttctgattagcaagtttgtat

SEQ ID NO: 7155487 - DNA, 22 bp, Homo sapiens
cttctgagatgttgttttacag

SEQ ID NO: 7155488 - DNA, 22 bp, Homo sapiens
cttctgagatgttgttttacag

SEQ ID NO: 7155489 - DNA, 22 bp, Homo sapiens
cttctgcccctgtagcctgagt

SEQ ID NO: 7155490 - DNA, 22 bp, Homo sapiens
cttctgtgcgcctctattccct

SEQ ID NO: 7155491 - DNA, 22 bp, Homo sapiens
cttctgtgctaaatgcaaaacc

SEQ ID NO: 7155492 - DNA, 22 bp, Homo sapiens
cttctgtgctaaatgcaaaacc

SEQ ID NO: 7155493 - DNA, 22 bp, Homo sapiens
cttctgtgcttcacagttgcca

SEQ ID NO: 7155494 - DNA, 22 bp, Homo sapiens
cttctgtgtagaaaggtagccc

SEQ ID NO: 7155495 - DNA, 22 bp, Homo sapiens
cttctgtgttaaatgagtcttt

SEQ ID NO: 7155496 - DNA, 22 bp, Homo sapiens
cttctgtgttttactatatgta

SEQ ID NO: 7155497 - DNA, 22 bp, Homo sapiens
cttctgttactgttagctgaag

SEQ ID NO: 7155498 - DNA, 22 bp, Homo sapiens
atattcacagatagaaggttct

SEQ ID NO: 7155499 - DNA, 22 bp, Homo sapiens
atattcactgagcataaagcca

SEQ ID NO: 7155500 - DNA, 23 bp, Homo sapiens
atattcacgccgccagaggtccc

SEQ ID NO: 7155501 - DNA, 22 bp, Homo sapiens
atattcactcctggtgagacta

SEQ ID NO: 7155502 - DNA, 22 bp, Homo sapiens
atattcaaattacatttactaa

SEQ ID NO: 7155503 - DNA, 22 bp, Homo sapiens
atattcaaattacatttactaa

SEQ ID NO: 7155504 - DNA, 18 bp, Homo sapiens
atattcaagaagacagag

SEQ ID NO: 7155505 - DNA, 22 bp, Homo sapiens
atattattttccctggagttgt

SEQ ID NO: 7155506 - DNA, 22 bp, Homo sapiens
atattattttccctggagttgt

SEQ ID NO: 7155507 - DNA, 22 bp, Homo sapiens
atattattctagtaacagtgat

SEQ ID NO: 7155508 - DNA, 22 bp, Homo sapiens
ctgggtggcagagcctgcagtg

SEQ ID NO: 7155509 - DNA, 22 bp, Homo sapiens
ctgggtggcagagcctgcagtg

SEQ ID NO: 7155510 - DNA, 22 bp, Homo sapiens
ctgggtggcagagcctgcagtg

SEQ ID NO: 7155511 - DNA, 22 bp, Homo sapiens
ctgggtggcagagcctgcagtg

SEQ ID NO: 7155512 - DNA, 20 bp, Homo sapiens
ctgggtggcaagcaaggggg

SEQ ID NO: 7155513 - DNA, 22 bp, Homo sapiens
ctgggtggcagagcctgcagtg

SEQ ID NO: 7155514 - DNA, 22 bp, Homo sapiens
ctgggtggcagagcctgcagtg

SEQ ID NO: 7155515 - DNA, 20 bp, Homo sapiens
ctgggtggcaagcaaggggg

SEQ ID NO: 7155516 - DNA, 20 bp, Homo sapiens
ctgggtggcaagcaaggggg

SEQ ID NO: 7155517 - DNA, 22 bp, Homo sapiens
ctgggtggagcctggtcatctg

SEQ ID NO: 7155518 - DNA, 22 bp, Homo sapiens
ctgggtggagcctggtcatctg

SEQ ID NO: 7155519 - DNA, 22 bp, Homo sapiens
ctgggtggagcctggtcatctg

SEQ ID NO: 7155520 - DNA, 18 bp, Homo sapiens
ctgggtctccaggctgcc

SEQ ID NO: 7155521 - DNA, 20 bp, Homo sapiens
ctgggtggcaagcaaggggg

SEQ ID NO: 7155522 - DNA, 20 bp, Homo sapiens
ctgggtggcaagcaaggggg

SEQ ID NO: 7155523 - DNA, 20 bp, Homo sapiens
ctgggtggcaagcaaggggg

SEQ ID NO: 7155524 - DNA, 22 bp, Homo sapiens
ctgggtggagcctggtcatctg

SEQ ID NO: 7155525 - DNA, 22 bp, Homo sapiens
ctgggtggatcgcagccccagg

SEQ ID NO: 7155526 - DNA, 22 bp, Homo sapiens
ctgggtggatcgcagccccagg

SEQ ID NO: 7155527 - DNA, 22 bp, Homo sapiens
ctgggtggatcgcagccccagg

SEQ ID NO: 7155528 - DNA, 22 bp, Homo sapiens
ctggtccattctctccctgaag

SEQ ID NO: 7155529 - DNA, 17 bp, Homo sapiens
ctggtcccaccaagccc

SEQ ID NO: 7155530 - DNA, 22 bp, Homo sapiens
ctggtcccagcagagctctgag

SEQ ID NO: 7155531 - DNA, 22 bp, Homo sapiens
ctggtccagtggatgctgaggg

SEQ ID NO: 7155532 - DNA, 22 bp, Homo sapiens
ctggtccagttgtctcctaagc

SEQ ID NO: 7155533 - DNA, 22 bp, Homo sapiens
ctggtcccagctctgccaccaa

SEQ ID NO: 7155534 - DNA, 22 bp, Homo sapiens
ctggtccctggacctccctgga

SEQ ID NO: 7155535 - DNA, 22 bp, Homo sapiens
ctggtcctaaagccctactcca

SEQ ID NO: 7155536 - DNA, 22 bp, Homo sapiens
ctggtcatcactctaacagact

SEQ ID NO: 7155537 - DNA, 22 bp, Homo sapiens
ctggtcatcactctaacagact

SEQ ID NO: 7155538 - DNA, 22 bp, Homo sapiens
ctggtcatcactctaacagact

SEQ ID NO: 7155539 - DNA, 22 bp, Homo sapiens
ctggtcatgccaggtttgctgc

SEQ ID NO: 7155540 - DNA, 22 bp, Homo sapiens
ctggtcatgccaggtttgctgc

SEQ ID NO: 7155541 - DNA, 22 bp, Homo sapiens
ctggtcatgccaggtttgctgc

SEQ ID NO: 7155542 - DNA, 22 bp, Homo sapiens
ctggtcattcaggtgttttaaa

SEQ ID NO: 7155543 - DNA, 22 bp, Homo sapiens
ctggtcattcaggtgttttaaa

SEQ ID NO: 7155544 - DNA, 22 bp, Homo sapiens
ctggtcaggggatggggctcag

SEQ ID NO: 7155545 - DNA, 22 bp, Homo sapiens
ctggtcagggtagtgttgcaga

SEQ ID NO: 7155546 - DNA, 22 bp, Homo sapiens
ctggtcagggtagtgttgcaga

SEQ ID NO: 7155547 - DNA, 22 bp, Homo sapiens
ctggtcagggctctttgggagc

SEQ ID NO: 7155548 - DNA, 22 bp, Homo sapiens
ctggtcaggaaggtggggacag

SEQ ID NO: 7155549 - DNA, 18 bp, Homo sapiens
ctggtcagggcaatgggc

SEQ ID NO: 7155550 - DNA, 18 bp, Homo sapiens
ctggtcagggcaatgggc

SEQ ID NO: 7155551 - DNA, 18 bp, Homo sapiens
ctggtcagggcaatgggc

SEQ ID NO: 7155552 - DNA, 22 bp, Homo sapiens
ctggtcagggctctttgggagc

SEQ ID NO: 7155553 - DNA, 22 bp, Homo sapiens
ctgggtggcgtctggggccagt

SEQ ID NO: 7155554 - DNA, 22 bp, Homo sapiens
ctgggtggcagagcctgcagtg

SEQ ID NO: 7155555 - DNA, 22 bp, Homo sapiens
ctgggtggcgtctggggccagt

SEQ ID NO: 7155556 - DNA, 22 bp, Homo sapiens
ctgggtggcgtctggggccagt

SEQ ID NO: 7155557 - DNA, 22 bp, Homo sapiens
ctgggtggcgtctggggccagt

SEQ ID NO: 7155558 - DNA, 22 bp, Homo sapiens
ctgggtggcgtctggggccagt

SEQ ID NO: 7155559 - DNA, 22 bp, Homo sapiens
ctgggtggctgtccagccagcc

SEQ ID NO: 7155560 - DNA, 22 bp, Homo sapiens
ctgggtggctgtccagccagcc

SEQ ID NO: 7155561 - DNA, 22 bp, Homo sapiens
ctgggtggctgtccagccagcc

SEQ ID NO: 7155562 - DNA, 22 bp, Homo sapiens
ctgggtggctgtccagccagcc

SEQ ID NO: 7155563 - DNA, 22 bp, Homo sapiens
ctgggggcaagcagacagctgt

SEQ ID NO: 7155564 - DNA, 19 bp, Homo sapiens
ctggggctttggtactgcc

SEQ ID NO: 7155565 - DNA, 23 bp, Homo sapiens
ctggggctttcaaatctgggcag

SEQ ID NO: 7155566 - DNA, 19 bp, Homo sapiens
ctggggctttggtactgcc

SEQ ID NO: 7155567 - DNA, 22 bp, Homo sapiens
atattattctagtaacagtgat

SEQ ID NO: 7155568 - DNA, 22 bp, Homo sapiens
atattattctagtaacagtgat

SEQ ID NO: 7155569 - DNA, 22 bp, Homo sapiens
ctgggggcaatggtcagagtgt

SEQ ID NO: 7155570 - DNA, 22 bp, Homo sapiens
ctgggggcaagcagacagctgt

SEQ ID NO: 7155571 - DNA, 19 bp, Homo sapiens
ctgggaggtgttcagagaa

SEQ ID NO: 7155572 - DNA, 19 bp, Homo sapiens
ctgggaggtgttcagagaa

SEQ ID NO: 7155573 - DNA, 19 bp, Homo sapiens
ctgggaggtgttcagagaa

SEQ ID NO: 7155574 - DNA, 22 bp, Homo sapiens
ctggggcatctgacagataaat

SEQ ID NO: 7155575 - DNA, 22 bp, Homo sapiens
ctggggcatgggcccctagagg

SEQ ID NO: 7155576 - DNA, 22 bp, Homo sapiens
ctggggcatgggcccctagagg

SEQ ID NO: 7155577 - DNA, 22 bp, Homo sapiens
ctggggcatgggcccctagagg

SEQ ID NO: 7155578 - DNA, 22 bp, Homo sapiens
ctggggctgtgggagacaaggc

SEQ ID NO: 7155579 - DNA, 22 bp, Homo sapiens
ctggggctgtgggagacaaggc

SEQ ID NO: 7155580 - DNA, 22 bp, Homo sapiens
ctggggctgtgggagacaaggc

SEQ ID NO: 7155581 - DNA, 22 bp, Homo sapiens
ctggggcatgggcccctagagg

SEQ ID NO: 7155582 - DNA, 22 bp, Homo sapiens
ctggggctgtaggaggacttat

SEQ ID NO: 7155583 - DNA, 22 bp, Homo sapiens
ctggggctgtgggagacaaggc

SEQ ID NO: 7155584 - DNA, 22 bp, Homo sapiens
ctggggcttcaatgcttcggtg

SEQ ID NO: 7155585 - DNA, 22 bp, Homo sapiens
ctggggcttcaatgcttcggtg

SEQ ID NO: 7155586 - DNA, 23 bp, Homo sapiens
ctggggctttcaaatctgggcag

SEQ ID NO: 7155587 - DNA, 22 bp, Homo sapiens
ctggggcttcaatgcttcggtg

SEQ ID NO: 7155588 - DNA, 22 bp, Homo sapiens
ctggggcttcaatgcttcggtg

SEQ ID NO: 7155589 - DNA, 23 bp, Homo sapiens
ctggggctttcaaatctgggcag

SEQ ID NO: 7155590 - DNA, 23 bp, Homo sapiens
ctggggctttcaaatctgggcag

SEQ ID NO: 7155591 - DNA, 20 bp, Homo sapiens
ctgggaggtcttccaaatca

SEQ ID NO: 7155592 - DNA, 22 bp, Homo sapiens
ctgggaggggtagccaatccta

SEQ ID NO: 7155593 - DNA, 22 bp, Homo sapiens
ctgggaggcggaggttgtagtg

SEQ ID NO: 7155594 - DNA, 22 bp, Homo sapiens
ctgggaggcggaggttgtagtg

SEQ ID NO: 7155595 - DNA, 22 bp, Homo sapiens
ctgggaggggtagccaatccta

SEQ ID NO: 7155596 - DNA, 22 bp, Homo sapiens
ctgggaggggtagccaatccta

SEQ ID NO: 7155597 - DNA, 22 bp, Homo sapiens
ctgggaggcggaggttgtagtg

SEQ ID NO: 7155598 - DNA, 22 bp, Homo sapiens
ctgggaggcggaggttgtagtg

SEQ ID NO: 7155599 - DNA, 22 bp, Homo sapiens
ctgggaggtgcagcaaaaatca

SEQ ID NO: 7155600 - DNA, 22 bp, Homo sapiens
ctgggaggtgaacagaaaaact

SEQ ID NO: 7155601 - DNA, 22 bp, Homo sapiens
ctgggaggtgaacagaaaaact

SEQ ID NO: 7155602 - DNA, 22 bp, Homo sapiens
ctgggaggtggaggttgcattg

SEQ ID NO: 7155603 - DNA, 22 bp, Homo sapiens
ctgggaggtggaggttgcattg

SEQ ID NO: 7155604 - DNA, 22 bp, Homo sapiens
ctgggaggtggaggttgcattg

SEQ ID NO: 7155605 - DNA, 19 bp, Homo sapiens
ctgggaggtgttcagagaa

SEQ ID NO: 7155606 - DNA, 19 bp, Homo sapiens
ctgggaggtgttcagagaa

SEQ ID NO: 7155607 - DNA, 22 bp, Homo sapiens
ctgggaggtggaggttgcattg

SEQ ID NO: 7155608 - DNA, 22 bp, Homo sapiens
ctgggaggattcattgaggtga

SEQ ID NO: 7155609 - DNA, 22 bp, Homo sapiens
ctgggaggacaacttggagctc

SEQ ID NO: 7155610 - DNA, 22 bp, Homo sapiens
ctgggaggatacacaagatcag

SEQ ID NO: 7155611 - DNA, 22 bp, Homo sapiens
ctgggaggatacacaagatcag

SEQ ID NO: 7155612 - DNA, 22 bp, Homo sapiens
ctgggaggatacacaagatcag

SEQ ID NO: 7155613 - DNA, 22 bp, Homo sapiens
ctgggaggcggaggttgcagtg

SEQ ID NO: 7155614 - DNA, 22 bp, Homo sapiens
ctgggaggcggaggttgcagtg

SEQ ID NO: 7155615 - DNA, 22 bp, Homo sapiens
ctgggaggattcattgaggtga

SEQ ID NO: 7155616 - DNA, 22 bp, Homo sapiens
ctgggaggattcattgaggtga

SEQ ID NO: 7155617 - DNA, 22 bp, Homo sapiens
ctgggaggacaacttggagctc

SEQ ID NO: 7155618 - DNA, 22 bp, Homo sapiens
ctgggaggacaacttggagctc

SEQ ID NO: 7155619 - DNA, 22 bp, Homo sapiens
ctgggaggacaacttggagctc

SEQ ID NO: 7155620 - DNA, 22 bp, Homo sapiens
ctgggaggacaacttggagctc

SEQ ID NO: 7155621 - DNA, 22 bp, Homo sapiens
ctgggaggacaacttggagctc

SEQ ID NO: 7155622 - DNA, 22 bp, Homo sapiens
ctgggagcttttagaaatgcag

SEQ ID NO: 7155623 - DNA, 22 bp, Homo sapiens
ctgggagcttggagcctttggt

SEQ ID NO: 7155624 - DNA, 22 bp, Homo sapiens
ctgggagcttgttaggaatgca

SEQ ID NO: 7155625 - DNA, 22 bp, Homo sapiens
ctgggagcttgttaggaatgca

SEQ ID NO: 7155626 - DNA, 22 bp, Homo sapiens
ctgtcgcctggtcctctctgga

SEQ ID NO: 7155627 - DNA, 19 bp, Homo sapiens
ctgtccttggctgcactgt

SEQ ID NO: 7155628 - DNA, 23 bp, Homo sapiens
ctgtccttggtcttggctgagtg

SEQ ID NO: 7155629 - DNA, 22 bp, Homo sapiens
ctgtcgtctgtgctgtaggatg

SEQ ID NO: 7155630 - DNA, 22 bp, Homo sapiens
ctgtctacagatgaaataagca

SEQ ID NO: 7155631 - DNA, 22 bp, Homo sapiens
ctgtctcaagactgcaggcact

SEQ ID NO: 7155632 - DNA, 22 bp, Homo sapiens
ctgtctcaagactgcaggcact

SEQ ID NO: 7155633 - DNA, 22 bp, Homo sapiens
ctgtctccagggcaggtgcagg

SEQ ID NO: 7155634 - DNA, 22 bp, Homo sapiens
ctgtctccagggcaggtgcagg

SEQ ID NO: 7155635 - DNA, 22 bp, Homo sapiens
atcagctgctacattggcctct

SEQ ID NO: 7155636 - DNA, 22 bp, Homo sapiens
atcagctggaacaagtgtctga

SEQ ID NO: 7155637 - DNA, 22 bp, Homo sapiens
atcagctggaacaagtgtctga

SEQ ID NO: 7155638 - DNA, 22 bp, Homo sapiens
atcagctggaacaagtgtctga

SEQ ID NO: 7155639 - DNA, 20 bp, Homo sapiens
atcagctggagaacattatg

SEQ ID NO: 7155640 - DNA, 22 bp, Homo sapiens
atcagcttttctcatcagaaat

SEQ ID NO: 7155641 - DNA, 22 bp, Homo sapiens
atcaggaaaaattgtgaaaggg

SEQ ID NO: 7155642 - DNA, 22 bp, Homo sapiens
atcaggaaagagtggaactctg

SEQ ID NO: 7155643 - DNA, 22 bp, Homo sapiens
atcaggaaagagtggaactctg

SEQ ID NO: 7155644 - DNA, 22 bp, Homo sapiens
ctgtctctgataagctcgaggg

SEQ ID NO: 7155645 - DNA, 22 bp, Homo sapiens
ctgtctctctaggacactgggg

SEQ ID NO: 7155646 - DNA, 22 bp, Homo sapiens
ctgtctctctaggacactgggg

SEQ ID NO: 7155647 - DNA, 22 bp, Homo sapiens
ctgtctctgataagctcgaggg

SEQ ID NO: 7155648 - DNA, 22 bp, Homo sapiens
atcaggtgcattagattaatta

SEQ ID NO: 7155649 - DNA, 22 bp, Homo sapiens
ctgtctctgtcttaactcccag

SEQ ID NO: 7155650 - DNA, 22 bp, Homo sapiens
atcaggtagatttaatattctg

SEQ ID NO: 7155651 - DNA, 22 bp, Homo sapiens
ctgtctcctccactgcatggga

SEQ ID NO: 7155652 - DNA, 22 bp, Homo sapiens
ctgtctcctccactgcatggga

SEQ ID NO: 7155653 - DNA, 22 bp, Homo sapiens
ctgtctcctccactgcatggga

SEQ ID NO: 7155654 - DNA, 22 bp, Homo sapiens
ctgtctcctccactgcatggga

SEQ ID NO: 7155655 - DNA, 22 bp, Homo sapiens
ctgtctccagggcaggtgcagg

SEQ ID NO: 7155656 - DNA, 22 bp, Homo sapiens
ctgtctccgccctcttggtagg

SEQ ID NO: 7155657 - DNA, 22 bp, Homo sapiens
ctgtctccgccctcttggtagg

SEQ ID NO: 7155658 - DNA, 22 bp, Homo sapiens
ctgtctcctcctttgttcttaa

SEQ ID NO: 7155659 - DNA, 23 bp, Homo sapiens
ctgtctcctgggctaggtggaat

SEQ ID NO: 7155660 - DNA, 22 bp, Homo sapiens
ctgtctcctcctttgttcttaa

SEQ ID NO: 7155661 - DNA, 23 bp, Homo sapiens
ctgtctcctgggctaggtggaat

SEQ ID NO: 7155662 - DNA, 22 bp, Homo sapiens
atcataaagtgctatctgattg

SEQ ID NO: 7155663 - DNA, 22 bp, Homo sapiens
atcataaagtgctatctgattg

SEQ ID NO: 7155664 - DNA, 22 bp, Homo sapiens
atcataaagtgctatctgattg

SEQ ID NO: 7155665 - DNA, 22 bp, Homo sapiens
atcataaaccactttgtaatct

SEQ ID NO: 7155666 - DNA, 22 bp, Homo sapiens
atcataaaccactttgtaatct

SEQ ID NO: 7155667 - DNA, 22 bp, Homo sapiens
atcataaaccactttgtaatct

SEQ ID NO: 7155668 - DNA, 22 bp, Homo sapiens
atcataaaccactttgtaatct

SEQ ID NO: 7155669 - DNA, 22 bp, Homo sapiens
atcataaaccactttgtaatct

SEQ ID NO: 7155670 - DNA, 22 bp, Homo sapiens
atcataaagtgctatctgattg

SEQ ID NO: 7155671 - DNA, 22 bp, Homo sapiens
atcataaagtgctatctgattg

SEQ ID NO: 7155672 - DNA, 22 bp, Homo sapiens
atcataaagtgctatctgattg

SEQ ID NO: 7155673 - DNA, 22 bp, Homo sapiens
atcataattgctccagtgatat

SEQ ID NO: 7155674 - DNA, 22 bp, Homo sapiens
atcatacactcacataaacaga

SEQ ID NO: 7155675 - DNA, 22 bp, Homo sapiens
atcataaaattgcaccatttct

SEQ ID NO: 7155676 - DNA, 22 bp, Homo sapiens
atcataaaattgcaccatttct

SEQ ID NO: 7155677 - DNA, 22 bp, Homo sapiens
atcagtttgtatatgaaacact

SEQ ID NO: 7155678 - DNA, 22 bp, Homo sapiens
atcagtttgtatatgaaacact

SEQ ID NO: 7155679 - DNA, 22 bp, Homo sapiens
atcagttttgggggacatactg

SEQ ID NO: 7155680 - DNA, 22 bp, Homo sapiens
atcagtttctgtgaagaacaca

SEQ ID NO: 7155681 - DNA, 22 bp, Homo sapiens
atcagtttctgtgaagaacaca

SEQ ID NO: 7155682 - DNA, 22 bp, Homo sapiens
atcagtttctgtgaagaacaca

SEQ ID NO: 7155683 - DNA, 22 bp, Homo sapiens
atcagtttctgtgaagaacaca

SEQ ID NO: 7155684 - DNA, 22 bp, Homo sapiens
atcacaaaggtctcagagcaca

SEQ ID NO: 7155685 - DNA, 22 bp, Homo sapiens
atcacaatccctctctctgata

SEQ ID NO: 7155686 - DNA, 22 bp, Homo sapiens
atcacaatcttcaaatcgattc

SEQ ID NO: 7155687 - DNA, 22 bp, Homo sapiens
atcacacagcaaggtggaggca

SEQ ID NO: 7155688 - DNA, 22 bp, Homo sapiens
atcacactggacattggatact

SEQ ID NO: 7155689 - DNA, 22 bp, Homo sapiens
atcacaaaggtctcagagcaca

SEQ ID NO: 7155690 - DNA, 22 bp, Homo sapiens
atcacaaaggtctcagagcaca

SEQ ID NO: 7155691 - DNA, 22 bp, Homo sapiens
atcacaaaggtctcagagcaca

SEQ ID NO: 7155692 - DNA, 22 bp, Homo sapiens
atcacaaagggttttctctgag

SEQ ID NO: 7155693 - DNA, 22 bp, Homo sapiens
atcacaaaggtctcagagcaca

SEQ ID NO: 7155694 - DNA, 22 bp, Homo sapiens
atcacaaaggtctcagagcaca

SEQ ID NO: 7155695 - DNA, 22 bp, Homo sapiens
atcaagaatgttcattcttcta

SEQ ID NO: 7155696 - DNA, 22 bp, Homo sapiens
atcaagaattgggagctattga

SEQ ID NO: 7155697 - DNA, 20 bp, Homo sapiens
ctgtaaactgcgtctgtaat

SEQ ID NO: 7155698 - DNA, 20 bp, Homo sapiens
ctgtaaactgcgtctgtaat

SEQ ID NO: 7155699 - DNA, 22 bp, Homo sapiens
atcacagctagtaagtggagga

SEQ ID NO: 7155700 - DNA, 22 bp, Homo sapiens
ctgtaaactaggtcatttttaa

SEQ ID NO: 7155701 - DNA, 22 bp, Homo sapiens
atcacagcacacctgacatgta

SEQ ID NO: 7155702 - DNA, 22 bp, Homo sapiens
atcacagcacacctgacatgta

SEQ ID NO: 7155703 - DNA, 22 bp, Homo sapiens
atcacagctagtaagtggagga

SEQ ID NO: 7155704 - DNA, 22 bp, Homo sapiens
ctgtaaagatcacagagctggt

SEQ ID NO: 7155705 - DNA, 22 bp, Homo sapiens
ctgtaaagatcacagagctggt

SEQ ID NO: 7155706 - DNA, 22 bp, Homo sapiens
ctgtaaagtaagaggtaagtta

SEQ ID NO: 7155707 - DNA, 22 bp, Homo sapiens
ctgtaaataatgacagttgact

SEQ ID NO: 7155708 - DNA, 22 bp, Homo sapiens
ctgtaaacttctggaggtcaag

SEQ ID NO: 7155709 - DNA, 22 bp, Homo sapiens
ctgtaaagacactaactatgga

SEQ ID NO: 7155710 - DNA, 22 bp, Homo sapiens
ctgtaaagatcacagagctggt

SEQ ID NO: 7155711 - DNA, 19 bp, Homo sapiens
atcacagacgtgcctcatc

SEQ ID NO: 7155712 - DNA, 22 bp, Homo sapiens
atcacagagctcccttccactg

SEQ ID NO: 7155713 - DNA, 18 bp, Homo sapiens
atcacagagggggagtct

SEQ ID NO: 7155714 - DNA, 22 bp, Homo sapiens
atcacagattgtgaataactat

SEQ ID NO: 7155715 - DNA, 22 bp, Homo sapiens
atcagctcaagaacgttcccca

SEQ ID NO: 7155716 - DNA, 22 bp, Homo sapiens
atcagctcattttgatggaaat

SEQ ID NO: 7155717 - DNA, 22 bp, Homo sapiens
atcagctgaaaaacaggcagca

SEQ ID NO: 7155718 - DNA, 22 bp, Homo sapiens
atcagctgatgaatggatgaat

SEQ ID NO: 7155719 - DNA, 21 bp, Homo sapiens
atcagcatcacgtcagtgtcc

SEQ ID NO: 7155720 - DNA, 22 bp, Homo sapiens
atcagcatctttaacaattacc

SEQ ID NO: 7155721 - DNA, 22 bp, Homo sapiens
atcagcattcccaaatgatgtg

SEQ ID NO: 7155722 - DNA, 22 bp, Homo sapiens
atcagcattcccaaatgatgtg

SEQ ID NO: 7155723 - DNA, 22 bp, Homo sapiens
atcagccaattacagaacatga

SEQ ID NO: 7155724 - DNA, 22 bp, Homo sapiens
atcagctaattagaattaggat

SEQ ID NO: 7155725 - DNA, 22 bp, Homo sapiens
atcagcaggtgctggtggagac

SEQ ID NO: 7155726 - DNA, 22 bp, Homo sapiens
atcagcacaacgtacagagaaa

SEQ ID NO: 7155727 - DNA, 22 bp, Homo sapiens
atcagcacaacgtacagagaaa

SEQ ID NO: 7155728 - DNA, 22 bp, Homo sapiens
atcagcagatgctcaatgaaca

SEQ ID NO: 7155729 - DNA, 22 bp, Homo sapiens
ctgtaatcccagctactcggga

SEQ ID NO: 7155730 - DNA, 22 bp, Homo sapiens
ctgtaatcccagctacctggga

SEQ ID NO: 7155731 - DNA, 22 bp, Homo sapiens
ctgtaatcccagctactcggga

SEQ ID NO: 7155732 - DNA, 22 bp, Homo sapiens
ctgtaatcccagctacctggga

SEQ ID NO: 7155733 - DNA, 22 bp, Homo sapiens
ctgtaatcccagctacctggga

SEQ ID NO: 7155734 - DNA, 22 bp, Homo sapiens
ctgtaatcccagctacctggga

SEQ ID NO: 7155735 - DNA, 22 bp, Homo sapiens
ctgtaagatgggataagacttt

SEQ ID NO: 7155736 - DNA, 22 bp, Homo sapiens
ctgtaagatgggataagacttt

SEQ ID NO: 7155737 - DNA, 21 bp, Homo sapiens
ctgtaagaaatcagttttatc

SEQ ID NO: 7155738 - DNA, 22 bp, Homo sapiens
ctgtaacctcctctttccattc

SEQ ID NO: 7155739 - DNA, 22 bp, Homo sapiens
ctgtaactctgccaagaaggct

SEQ ID NO: 7155740 - DNA, 19 bp, Homo sapiens
ctggctcttgggtggagga

SEQ ID NO: 7155741 - DNA, 19 bp, Homo sapiens
ctggctcttgggtggagga

SEQ ID NO: 7155742 - DNA, 22 bp, Homo sapiens
ctggctctttcagccgctggag

SEQ ID NO: 7155743 - DNA, 22 bp, Homo sapiens
ctggctctttcctagctaggct

SEQ ID NO: 7155744 - DNA, 22 bp, Homo sapiens
ctggctctttcctagctaggct

SEQ ID NO: 7155745 - DNA, 22 bp, Homo sapiens
ctggctctttcctagctaggct

SEQ ID NO: 7155746 - DNA, 22 bp, Homo sapiens
ctggctctttcctagctaggct

SEQ ID NO: 7155747 - DNA, 22 bp, Homo sapiens
ctggctgacacaaaggtatcga

SEQ ID NO: 7155748 - DNA, 22 bp, Homo sapiens
ctggctctttcctagctaggct

SEQ ID NO: 7155749 - DNA, 22 bp, Homo sapiens
ctggctctttcctagctaggct

SEQ ID NO: 7155750 - DNA, 22 bp, Homo sapiens
ctggctcttgcgactcagcttg

SEQ ID NO: 7155751 - DNA, 22 bp, Homo sapiens
ctggctcttggctagggagagt

SEQ ID NO: 7155752 - DNA, 22 bp, Homo sapiens
ctggctcttggctagggagagt

SEQ ID NO: 7155753 - DNA, 22 bp, Homo sapiens
atataaagtgtttagaaagctg

SEQ ID NO: 7155754 - DNA, 22 bp, Homo sapiens
atataaagtgtttagaaagctg

SEQ ID NO: 7155755 - DNA, 22 bp, Homo sapiens
atataaagtgtttagaaagctg

SEQ ID NO: 7155756 - DNA, 22 bp, Homo sapiens
atataaagagcttagtatagtg

SEQ ID NO: 7155757 - DNA, 22 bp, Homo sapiens
atataaagagcttagtatagtg

SEQ ID NO: 7155758 - DNA, 22 bp, Homo sapiens
atataaagagcttagtatagtg

SEQ ID NO: 7155759 - DNA, 22 bp, Homo sapiens
atataaagagcttagtatagtg

SEQ ID NO: 7155760 - DNA, 22 bp, Homo sapiens
atataaagaagtggaaaatgag

SEQ ID NO: 7155761 - DNA, 22 bp, Homo sapiens
atataaagaagtggaaaatgag

SEQ ID NO: 7155762 - DNA, 23 bp, Homo sapiens
atataaacaccagatagattgta

SEQ ID NO: 7155763 - DNA, 23 bp, Homo sapiens
atataaacaccagatagattgta

SEQ ID NO: 7155764 - DNA, 22 bp, Homo sapiens
atataaagaagtggaaaatgag

SEQ ID NO: 7155765 - DNA, 22 bp, Homo sapiens
atataaagaagtggaaaatgag

SEQ ID NO: 7155766 - DNA, 22 bp, Homo sapiens
atataaagaagtggaaaatgag

SEQ ID NO: 7155767 - DNA, 22 bp, Homo sapiens
atataaagaagtggaaaatgag

SEQ ID NO: 7155768 - DNA, 23 bp, Homo sapiens
atataaacaccagatagattgta

SEQ ID NO: 7155769 - DNA, 23 bp, Homo sapiens
atataaacaccagatagattgta

SEQ ID NO: 7155770 - DNA, 22 bp, Homo sapiens
atagttttgctgtcaggtccta

SEQ ID NO: 7155771 - DNA, 22 bp, Homo sapiens
atagttttctatgcactgttat

SEQ ID NO: 7155772 - DNA, 22 bp, Homo sapiens
atagttttctatgcactgttat

SEQ ID NO: 7155773 - DNA, 22 bp, Homo sapiens
atagtttgtgaaacacagcagt

SEQ ID NO: 7155774 - DNA, 22 bp, Homo sapiens
atagttttaaaacctcaggaag

SEQ ID NO: 7155775 - DNA, 22 bp, Homo sapiens
atagttttatagatattgtgta

SEQ ID NO: 7155776 - DNA, 23 bp, Homo sapiens
atagttttccctggttcttgcca

SEQ ID NO: 7155777 - DNA, 22 bp, Homo sapiens
ctggcctttagccccagtgtct

SEQ ID NO: 7155778 - DNA, 22 bp, Homo sapiens
ctggcctttcgtgagagctggg

SEQ ID NO: 7155779 - DNA, 22 bp, Homo sapiens
ctggcctttcgtgagagctggg

SEQ ID NO: 7155780 - DNA, 22 bp, Homo sapiens
ctggccttggaagggagcccgt

SEQ ID NO: 7155781 - DNA, 22 bp, Homo sapiens
ctggccttgttcctccccaagt

SEQ ID NO: 7155782 - DNA, 19 bp, Homo sapiens
ctggcctgtgtcctgtgct

SEQ ID NO: 7155783 - DNA, 19 bp, Homo sapiens
ctggcctgtgtcctgtgct

SEQ ID NO: 7155784 - DNA, 19 bp, Homo sapiens
ctggcctgtgtcctgtgct

SEQ ID NO: 7155785 - DNA, 19 bp, Homo sapiens
ctggcctgtgtcctgtgct

SEQ ID NO: 7155786 - DNA, 22 bp, Homo sapiens
ctggcctctgtgttcaccatag

SEQ ID NO: 7155787 - DNA, 22 bp, Homo sapiens
ctggcctctctgagcagggagc

SEQ ID NO: 7155788 - DNA, 22 bp, Homo sapiens
ctggcctctctgagcagggagc

SEQ ID NO: 7155789 - DNA, 22 bp, Homo sapiens
ctggcctctctgagcagggagc

SEQ ID NO: 7155790 - DNA, 22 bp, Homo sapiens
ctggcctctgtgttcaccatag

SEQ ID NO: 7155791 - DNA, 22 bp, Homo sapiens
ctggcgagcaggaggcgacggc

SEQ ID NO: 7155792 - DNA, 22 bp, Homo sapiens
ctggcgtgaaggtggccatgag

SEQ ID NO: 7155793 - DNA, 22 bp, Homo sapiens
ctggcgtgaaggtggccatgag

SEQ ID NO: 7155794 - DNA, 22 bp, Homo sapiens
ctggctaaagagcaagaagatg

SEQ ID NO: 7155795 - DNA, 22 bp, Homo sapiens
ctggctagataaaaccagccaa

SEQ ID NO: 7155796 - DNA, 22 bp, Homo sapiens
ctggctagcacctcagctcaga

SEQ ID NO: 7155797 - DNA, 22 bp, Homo sapiens
ctggctcaataaatattagctg

SEQ ID NO: 7155798 - DNA, 22 bp, Homo sapiens
ctggctcaataaatattagctg

SEQ ID NO: 7155799 - DNA, 22 bp, Homo sapiens
ctggctcaataaatattagctg

SEQ ID NO: 7155800 - DNA, 22 bp, Homo sapiens
ctggctcaatttgtactgctgt

SEQ ID NO: 7155801 - DNA, 22 bp, Homo sapiens
ctggctcaatttgtactgctgt

SEQ ID NO: 7155802 - DNA, 22 bp, Homo sapiens
ctggctcacaggtgagatgcat

SEQ ID NO: 7155803 - DNA, 22 bp, Homo sapiens
ctggctcacaggtgagatgcat

SEQ ID NO: 7155804 - DNA, 22 bp, Homo sapiens
ctggctcacaggtgagatgcat

SEQ ID NO: 7155805 - DNA, 22 bp, Homo sapiens
ctggctcacaggtgagatgcat

SEQ ID NO: 7155806 - DNA, 22 bp, Homo sapiens
atagtgcagccccttttctatt

SEQ ID NO: 7155807 - DNA, 22 bp, Homo sapiens
atagtgcagtggactgagttaa

SEQ ID NO: 7155808 - DNA, 22 bp, Homo sapiens
atagtgcattttattatcagca

SEQ ID NO: 7155809 - DNA, 22 bp, Homo sapiens
atagtgggtacaggggcagaga

SEQ ID NO: 7155810 - DNA, 22 bp, Homo sapiens
atagtttaccttccagatggct

SEQ ID NO: 7155811 - DNA, 22 bp, Homo sapiens
atagtttgaaggctgttctact

SEQ ID NO: 7155812 - DNA, 22 bp, Homo sapiens
atagtttgggcaaagaggacct

SEQ ID NO: 7155813 - DNA, 22 bp, Homo sapiens
ctggctgaggcagagcctgggg

SEQ ID NO: 7155814 - DNA, 22 bp, Homo sapiens
ctggctgattttctcacttctc

SEQ ID NO: 7155815 - DNA, 22 bp, Homo sapiens
ctggctgcaaaatctattcact

SEQ ID NO: 7155816 - DNA, 19 bp, Homo sapiens
ctggctgcaatgccagggt

SEQ ID NO: 7155817 - DNA, 19 bp, Homo sapiens
ctggctgcaatgccagggt

SEQ ID NO: 7155818 - DNA, 22 bp, Homo sapiens
atataatagtttcataaaggct

SEQ ID NO: 7155819 - DNA, 22 bp, Homo sapiens
atataatacaacctgctaagtg

SEQ ID NO: 7155820 - DNA, 22 bp, Homo sapiens
atataatagtttcataaaggct

SEQ ID NO: 7155821 - DNA, 22 bp, Homo sapiens
atatacacatgtgtatacattt

SEQ ID NO: 7155822 - DNA, 22 bp, Homo sapiens
atatacacatttgcttatgtgt

SEQ ID NO: 7155823 - DNA, 22 bp, Homo sapiens
atatacaggtggtatgtgtaaa

SEQ ID NO: 7155824 - DNA, 22 bp, Homo sapiens
atatacaggtggtatgtgtaaa

SEQ ID NO: 7155825 - DNA, 22 bp, Homo sapiens
atatacaggtggtatgtgtaaa

SEQ ID NO: 7155826 - DNA, 22 bp, Homo sapiens
atatacagtatgtactgtggtt

SEQ ID NO: 7155827 - DNA, 22 bp, Homo sapiens
atatacagggagaaacagctta

SEQ ID NO: 7155828 - DNA, 22 bp, Homo sapiens
atatacactgtttcagttgaag

SEQ ID NO: 7155829 - DNA, 22 bp, Homo sapiens
atatacactgtttcagttgaag

SEQ ID NO: 7155830 - DNA, 22 bp, Homo sapiens
atatacactccactgatacagg

SEQ ID NO: 7155831 - DNA, 22 bp, Homo sapiens
atatacactcaccatggtattt

SEQ ID NO: 7155832 - DNA, 22 bp, Homo sapiens
atatacactccactgatacagg

SEQ ID NO: 7155833 - DNA, 22 bp, Homo sapiens
atatacactccactgatacagg

SEQ ID NO: 7155834 - DNA, 20 bp, Homo sapiens
atataccatcccacaacagg

SEQ ID NO: 7155835 - DNA, 20 bp, Homo sapiens
atataccatcccacaacagg

SEQ ID NO: 7155836 - DNA, 22 bp, Homo sapiens
atatacatgggaatatgtggag

SEQ ID NO: 7155837 - DNA, 22 bp, Homo sapiens
atatacatgggaatatgtggag

SEQ ID NO: 7155838 - DNA, 19 bp, Homo sapiens
atatacatactgtgtgcat

SEQ ID NO: 7155839 - DNA, 19 bp, Homo sapiens
atatacatactgtgtgcat

SEQ ID NO: 7155840 - DNA, 22 bp, Homo sapiens
atatactgaggagactttatat

SEQ ID NO: 7155841 - DNA, 22 bp, Homo sapiens
atatacctgaagttggtaatta

SEQ ID NO: 7155842 - DNA, 22 bp, Homo sapiens
atatacctgaagttggtaatta

SEQ ID NO: 7155843 - DNA, 22 bp, Homo sapiens
atatactgatagctgcacttct

SEQ ID NO: 7155844 - DNA, 22 bp, Homo sapiens
atatactgtaggccactataag

SEQ ID NO: 7155845 - DNA, 22 bp, Homo sapiens
atatactgtaggccactataag

SEQ ID NO: 7155846 - DNA, 22 bp, Homo sapiens
atatacttggagactatcattg

SEQ ID NO: 7155847 - DNA, 22 bp, Homo sapiens
atatacttggagactatcattg

SEQ ID NO: 7155848 - DNA, 22 bp, Homo sapiens
atatactgtagtggtttagagc

SEQ ID NO: 7155849 - DNA, 22 bp, Homo sapiens
atatactgtgttccatggacca

SEQ ID NO: 7155850 - DNA, 22 bp, Homo sapiens
atatacttggagactatcattg

SEQ ID NO: 7155851 - DNA, 22 bp, Homo sapiens
atatacttggagactatcattg

SEQ ID NO: 7155852 - DNA, 22 bp, Homo sapiens
ctgggagaggaacctcgagggt

SEQ ID NO: 7155853 - DNA, 22 bp, Homo sapiens
ctgggagaggaacctcgagggt

SEQ ID NO: 7155854 - DNA, 22 bp, Homo sapiens
ctgggagaggaacctcgagggt

SEQ ID NO: 7155855 - DNA, 22 bp, Homo sapiens
ctgggagaggctgctccgctct

SEQ ID NO: 7155856 - DNA, 22 bp, Homo sapiens
ctgggagaggctgctccgctct

SEQ ID NO: 7155857 - DNA, 22 bp, Homo sapiens
ctgggagctggaatgggagaag

SEQ ID NO: 7155858 - DNA, 22 bp, Homo sapiens
ctgggagctggaatgggagaag

SEQ ID NO: 7155859 - DNA, 22 bp, Homo sapiens
ctgggagctggatgccctgccc

SEQ ID NO: 7155860 - DNA, 22 bp, Homo sapiens
ctgggagctggaatgggagaag

SEQ ID NO: 7155861 - DNA, 22 bp, Homo sapiens
ctgggagctggaatgggagaag

SEQ ID NO: 7155862 - DNA, 22 bp, Homo sapiens
ctgggagctggatgccctgccc

SEQ ID NO: 7155863 - DNA, 22 bp, Homo sapiens
ctgggagctggatgccctgccc

SEQ ID NO: 7155864 - DNA, 22 bp, Homo sapiens
ctgggagctggatgccctgccc

SEQ ID NO: 7155865 - DNA, 22 bp, Homo sapiens
ctgggagctgtcaggagcgtgt

SEQ ID NO: 7155866 - DNA, 22 bp, Homo sapiens
ctgggagctgtcaggagcgtgt

SEQ ID NO: 7155867 - DNA, 22 bp, Homo sapiens
ctgggagctgtcaggagcgtgt

SEQ ID NO: 7155868 - DNA, 22 bp, Homo sapiens
ctgggagctgtcaggagcgtgt

SEQ ID NO: 7155869 - DNA, 22 bp, Homo sapiens
ctgggagcttggagcctttggt

SEQ ID NO: 7155870 - DNA, 22 bp, Homo sapiens
ctgggagcttgttaggaatgca

SEQ ID NO: 7155871 - DNA, 22 bp, Homo sapiens
ctgggagcttgttaggaatgca

SEQ ID NO: 7155872 - DNA, 22 bp, Homo sapiens
ctgggagcttgttaggaatgca

SEQ ID NO: 7155873 - DNA, 22 bp, Homo sapiens
atacatgtgtccctgatttatt

SEQ ID NO: 7155874 - DNA, 22 bp, Homo sapiens
atacatgtgggtctaaacatat

SEQ ID NO: 7155875 - DNA, 22 bp, Homo sapiens
atacatgtgggtctaaacatat

SEQ ID NO: 7155876 - DNA, 22 bp, Homo sapiens
atacatgtgccatgttggtgta

SEQ ID NO: 7155877 - DNA, 22 bp, Homo sapiens
atacatgtgccgcgttggtgtg

SEQ ID NO: 7155878 - DNA, 22 bp, Homo sapiens
atacatgtgctatgttggtgta

SEQ ID NO: 7155879 - DNA, 22 bp, Homo sapiens
atacatgtcatcatatgtttgt

SEQ ID NO: 7155880 - DNA, 22 bp, Homo sapiens
atacatgtaactgcattgtaat

SEQ ID NO: 7155881 - DNA, 17 bp, Homo sapiens
atacatgtaaagtgctt

SEQ ID NO: 7155882 - DNA, 22 bp, Homo sapiens
ctggcacatagtaggtgcacag

SEQ ID NO: 7155883 - DNA, 22 bp, Homo sapiens
atacatgatgggtgtatagttt

SEQ ID NO: 7155884 - DNA, 22 bp, Homo sapiens
atacatgatgggtgtatagttt

SEQ ID NO: 7155885 - DNA, 22 bp, Homo sapiens
atacatgattttttgagggtgg

SEQ ID NO: 7155886 - DNA, 19 bp, Homo sapiens
atacatgcatttacatgct

SEQ ID NO: 7155887 - DNA, 19 bp, Homo sapiens
atacatgcatttacatgct

SEQ ID NO: 7155888 - DNA, 22 bp, Homo sapiens
atacatgcgccatgttggtgtg

SEQ ID NO: 7155889 - DNA, 22 bp, Homo sapiens
ctggcacagccactgcaggcag

SEQ ID NO: 7155890 - DNA, 22 bp, Homo sapiens
ctggcacagcttgggccccatc

SEQ ID NO: 7155891 - DNA, 22 bp, Homo sapiens
ctggcacagcttgggccccatc

SEQ ID NO: 7155892 - DNA, 22 bp, Homo sapiens
ctggcacagcttgggccccatc

SEQ ID NO: 7155893 - DNA, 22 bp, Homo sapiens
ctggcacaggatccgagacctt

SEQ ID NO: 7155894 - DNA, 22 bp, Homo sapiens
ctggcacaggatccgagacctt

SEQ ID NO: 7155895 - DNA, 20 bp, Homo sapiens
ctggcacagggtccgtcctt

SEQ ID NO: 7155896 - DNA, 22 bp, Homo sapiens
ctggcacagttaacatatgcta

SEQ ID NO: 7155897 - DNA, 22 bp, Homo sapiens
ctggcacagttaacatatgcta

SEQ ID NO: 7155898 - DNA, 22 bp, Homo sapiens
ctggcacataattagtgatcct

SEQ ID NO: 7155899 - DNA, 22 bp, Homo sapiens
ctggcacataattagtgatcct

SEQ ID NO: 7155900 - DNA, 22 bp, Homo sapiens
ctggcacatagcaaatctcaac

SEQ ID NO: 7155901 - DNA, 22 bp, Homo sapiens
atacacattactttctgtctga

SEQ ID NO: 7155902 - DNA, 20 bp, Homo sapiens
atacacattcatagaaaaat

SEQ ID NO: 7155903 - DNA, 20 bp, Homo sapiens
atacacattcatagaaaaat

SEQ ID NO: 7155904 - DNA, 20 bp, Homo sapiens
atacacattcatagaaaaat

SEQ ID NO: 7155905 - DNA, 20 bp, Homo sapiens
atacacattcatagaaaaat

SEQ ID NO: 7155906 - DNA, 22 bp, Homo sapiens
ctggagtgcagtggcatgatca

SEQ ID NO: 7155907 - DNA, 22 bp, Homo sapiens
ctggagtgcagtggcatgatca

SEQ ID NO: 7155908 - DNA, 22 bp, Homo sapiens
ctggagtggccggtgctgtggc

SEQ ID NO: 7155909 - DNA, 22 bp, Homo sapiens
ctggcaagtactgggccagctc

SEQ ID NO: 7155910 - DNA, 22 bp, Homo sapiens
atacacattactttctgtctga

SEQ ID NO: 7155911 - DNA, 22 bp, Homo sapiens
atacacatgttattgtggaagc

SEQ ID NO: 7155912 - DNA, 22 bp, Homo sapiens
atacacatgttattgtggaagc

SEQ ID NO: 7155913 - DNA, 20 bp, Homo sapiens
atacacatgcagacagatgc

SEQ ID NO: 7155914 - DNA, 22 bp, Homo sapiens
atacacatgtgtatgtgcatgc

SEQ ID NO: 7155915 - DNA, 22 bp, Homo sapiens
ctggcaagtggttgggatggat

SEQ ID NO: 7155916 - DNA, 22 bp, Homo sapiens
ctggcaatgggagtagtagggt

SEQ ID NO: 7155917 - DNA, 22 bp, Homo sapiens
ctggcacaaaagaaaactgcca

SEQ ID NO: 7155918 - DNA, 22 bp, Homo sapiens
ctggcacaaaagaaaactgcca

SEQ ID NO: 7155919 - DNA, 22 bp, Homo sapiens
ctggcaatgggagtagtagggt

SEQ ID NO: 7155920 - DNA, 22 bp, Homo sapiens
ctggcacaaatggaaaccaagc

SEQ ID NO: 7155921 - DNA, 22 bp, Homo sapiens
ctggcacaactccacctcagcg

SEQ ID NO: 7155922 - DNA, 22 bp, Homo sapiens
ctggcacaactccacctcagcg

SEQ ID NO: 7155923 - DNA, 22 bp, Homo sapiens
ctggcacaatgtcacttttgct

SEQ ID NO: 7155924 - DNA, 22 bp, Homo sapiens
ctggcacacaagtatttccttt

SEQ ID NO: 7155925 - DNA, 22 bp, Homo sapiens
ctggcacacagaggccctcggg

SEQ ID NO: 7155926 - DNA, 22 bp, Homo sapiens
ctggcacacagcaggctctcag

SEQ ID NO: 7155927 - DNA, 22 bp, Homo sapiens
ctggcacacagcaggctctcag

SEQ ID NO: 7155928 - DNA, 22 bp, Homo sapiens
ctggcacacagcaggctctcag

SEQ ID NO: 7155929 - DNA, 22 bp, Homo sapiens
ctggcacacagtaggcaccaat

SEQ ID NO: 7155930 - DNA, 22 bp, Homo sapiens
ctggcacacagtaggcaccaat

SEQ ID NO: 7155931 - DNA, 22 bp, Homo sapiens
ctggcacacagtaggcaccaat

SEQ ID NO: 7155932 - DNA, 22 bp, Homo sapiens
ctggcacacagtaggcaccaat

SEQ ID NO: 7155933 - DNA, 22 bp, Homo sapiens
ctggcacacgtggcagggtagg

SEQ ID NO: 7155934 - DNA, 22 bp, Homo sapiens
ctggcacacgtggcagggtagg

SEQ ID NO: 7155935 - DNA, 22 bp, Homo sapiens
ctggcacagagacagaaggatt

SEQ ID NO: 7155936 - DNA, 22 bp, Homo sapiens
ctggcacagagacagaaggatt

SEQ ID NO: 7155937 - DNA, 22 bp, Homo sapiens
ctggcacagagacagaaggatt

SEQ ID NO: 7155938 - DNA, 22 bp, Homo sapiens
ctggcacagagacagaaggatt

SEQ ID NO: 7155939 - DNA, 22 bp, Homo sapiens
ctggcacagagtgagcattcaa

SEQ ID NO: 7155940 - DNA, 22 bp, Homo sapiens
ctggcacagagtgagcattcaa

SEQ ID NO: 7155941 - DNA, 22 bp, Homo sapiens
ctggcacagagacagaaggatt

SEQ ID NO: 7155942 - DNA, 22 bp, Homo sapiens
ctggcacagagtgagcattcaa

SEQ ID NO: 7155943 - DNA, 22 bp, Homo sapiens
ctggcacagccactgcaggcag

SEQ ID NO: 7155944 - DNA, 22 bp, Homo sapiens
ctggcctcggcagcaggaacag

SEQ ID NO: 7155945 - DNA, 22 bp, Homo sapiens
ctggcctcggcagcaggaacag

SEQ ID NO: 7155946 - DNA, 22 bp, Homo sapiens
ctggcctcacctcagacttact

SEQ ID NO: 7155947 - DNA, 22 bp, Homo sapiens
ctggcctaggaatggttttccg

SEQ ID NO: 7155948 - DNA, 22 bp, Homo sapiens
ctggcctcacagaggctaagcc

SEQ ID NO: 7155949 - DNA, 22 bp, Homo sapiens
ctggcctcacctcagacttact

SEQ ID NO: 7155950 - DNA, 22 bp, Homo sapiens
ctggccggtatttgcctctggg

SEQ ID NO: 7155951 - DNA, 22 bp, Homo sapiens
ctggcctaaaaatacagaacaa

SEQ ID NO: 7155952 - DNA, 20 bp, Homo sapiens
ctggccagaacgcctacaca

SEQ ID NO: 7155953 - DNA, 20 bp, Homo sapiens
ctggccagaacgcctacaca

SEQ ID NO: 7155954 - DNA, 20 bp, Homo sapiens
ctggccagaacgcctacaca

SEQ ID NO: 7155955 - DNA, 22 bp, Homo sapiens
ctggccagaagcacctttggcg

SEQ ID NO: 7155956 - DNA, 22 bp, Homo sapiens
ctggccagaagcacctttggcg

SEQ ID NO: 7155957 - DNA, 22 bp, Homo sapiens
ctggccagactacacatgtgtg

SEQ ID NO: 7155958 - DNA, 22 bp, Homo sapiens
ctggccagactacacatgtgtg

SEQ ID NO: 7155959 - DNA, 22 bp, Homo sapiens
ctggccagactacacatgtgtg

SEQ ID NO: 7155960 - DNA, 22 bp, Homo sapiens
ctggccagaggttcctctgccc

SEQ ID NO: 7155961 - DNA, 22 bp, Homo sapiens
ctggccagaggttcctctgccc

SEQ ID NO: 7155962 - DNA, 22 bp, Homo sapiens
ctggccagaggttcctctgccc

SEQ ID NO: 7155963 - DNA, 22 bp, Homo sapiens
ctggccctaggcaaacacagat

SEQ ID NO: 7155964 - DNA, 22 bp, Homo sapiens
ctggccctatgagcctcctgat

SEQ ID NO: 7155965 - DNA, 22 bp, Homo sapiens
ctggccctatgagcctcctgat

SEQ ID NO: 7155966 - DNA, 22 bp, Homo sapiens
ctggcccttctcttgcttcctg

SEQ ID NO: 7155967 - DNA, 22 bp, Homo sapiens
ctggcccttgacttacagcagg

SEQ ID NO: 7155968 - DNA, 22 bp, Homo sapiens
ctggcaggtggaggttgcagtg

SEQ ID NO: 7155969 - DNA, 22 bp, Homo sapiens
ctggcaggtggatggggactcc

SEQ ID NO: 7155970 - DNA, 22 bp, Homo sapiens
ctggcaggtggatggggactcc

SEQ ID NO: 7155971 - DNA, 22 bp, Homo sapiens
ctggcaggtggatggggactcc

SEQ ID NO: 7155972 - DNA, 22 bp, Homo sapiens
ctggcaggtggatggggactcc

SEQ ID NO: 7155973 - DNA, 22 bp, Homo sapiens
ctggcaggtggatggggactcc

SEQ ID NO: 7155974 - DNA, 22 bp, Homo sapiens
ctggcaggtggatggggactcc

SEQ ID NO: 7155975 - DNA, 22 bp, Homo sapiens
ctggcaggttatagagctgccc

SEQ ID NO: 7155976 - DNA, 22 bp, Homo sapiens
ctggcaggttatagagctgccc

SEQ ID NO: 7155977 - DNA, 22 bp, Homo sapiens
ctggcaggtggatggggactcc

SEQ ID NO: 7155978 - DNA, 22 bp, Homo sapiens
ctggcaggttatagagctgccc

SEQ ID NO: 7155979 - DNA, 22 bp, Homo sapiens
ctggcaggttatagagctgccc

SEQ ID NO: 7155980 - DNA, 22 bp, Homo sapiens
ctggcaggttatagagctgccc

SEQ ID NO: 7155981 - DNA, 22 bp, Homo sapiens
ctggcaggttatagagctgccc

SEQ ID NO: 7155982 - DNA, 22 bp, Homo sapiens
ctggcaggttatagagctgccc

SEQ ID NO: 7155983 - DNA, 22 bp, Homo sapiens
ctggcaggtggaggttgcagtg

SEQ ID NO: 7155984 - DNA, 22 bp, Homo sapiens
ctggcaggtggaggttgcagtg

SEQ ID NO: 7155985 - DNA, 22 bp, Homo sapiens
ctggcaggtggaggttgcagtg

SEQ ID NO: 7155986 - DNA, 22 bp, Homo sapiens
ctggcaggtggaggttgcagtg

SEQ ID NO: 7155987 - DNA, 22 bp, Homo sapiens
ctggcaggtggaggttgcagtg

SEQ ID NO: 7155988 - DNA, 22 bp, Homo sapiens
ctggcaggtctcgctgacgtgt

SEQ ID NO: 7155989 - DNA, 22 bp, Homo sapiens
ctggcaggtctcgctgacgtgt

SEQ ID NO: 7155990 - DNA, 22 bp, Homo sapiens
ctggcaggtctcgctgacgtgt

SEQ ID NO: 7155991 - DNA, 22 bp, Homo sapiens
ctggcaggtccagctggactca

SEQ ID NO: 7155992 - DNA, 22 bp, Homo sapiens
ctggcagcttcaggacactcgg

SEQ ID NO: 7155993 - DNA, 22 bp, Homo sapiens
ctggccactggaggtggcaccc

SEQ ID NO: 7155994 - DNA, 22 bp, Homo sapiens
ctggccactggtggtcataggc

SEQ ID NO: 7155995 - DNA, 20 bp, Homo sapiens
ctggccagaacgcctacaca

SEQ ID NO: 7155996 - DNA, 20 bp, Homo sapiens
ctggccagaacgcctacaca

SEQ ID NO: 7155997 - DNA, 22 bp, Homo sapiens
ctggccactgcgggcctctgcc

SEQ ID NO: 7155998 - DNA, 22 bp, Homo sapiens
ctggccactggaggtggcaccc

SEQ ID NO: 7155999 - DNA, 22 bp, Homo sapiens
ctggcaggtttggtgtctggtg

SEQ ID NO: 7156000 - DNA, 22 bp, Homo sapiens
ctggcaggtttggtgtctggtg

SEQ ID NO: 7156001 - DNA, 22 bp, Homo sapiens
ctggcaggtttggtgtctggtg

SEQ ID NO: 7156002 - DNA, 22 bp, Homo sapiens
ctggcaggtttggtgtctggtg

SEQ ID NO: 7156003 - DNA, 22 bp, Homo sapiens
ctggcaggttatagagctgccc

SEQ ID NO: 7156004 - DNA, 22 bp, Homo sapiens
ctggcaggtttggtgtctggtg

SEQ ID NO: 7156005 - DNA, 22 bp, Homo sapiens
ctggcaggtttggtgtctggtg

SEQ ID NO: 7156006 - DNA, 22 bp, Homo sapiens
ctgctgtgcttgtggccacccg

SEQ ID NO: 7156007 - DNA, 22 bp, Homo sapiens
ctgctgtgcttgtggccacccg

SEQ ID NO: 7156008 - DNA, 22 bp, Homo sapiens
ctgctgtggatgcaggacctca

SEQ ID NO: 7156009 - DNA, 22 bp, Homo sapiens
ctgctgtggatgcaggacctca

SEQ ID NO: 7156010 - DNA, 22 bp, Homo sapiens
ctgctgtgccttaaaatgcaag

SEQ ID NO: 7156011 - DNA, 22 bp, Homo sapiens
ctgctgtgcctcttttcacgtg

SEQ ID NO: 7156012 - DNA, 22 bp, Homo sapiens
ctgctgtgcctcttttcacgtg

SEQ ID NO: 7156013 - DNA, 22 bp, Homo sapiens
ctgctgtgcaggtgcctatgat

SEQ ID NO: 7156014 - DNA, 22 bp, Homo sapiens
ctgctgtgcatatttatctagg

SEQ ID NO: 7156015 - DNA, 22 bp, Homo sapiens
ctgctgtgcagacagactctct

SEQ ID NO: 7156016 - DNA, 22 bp, Homo sapiens
ctgctgtgcagacagactctct

SEQ ID NO: 7156017 - DNA, 22 bp, Homo sapiens
ctgctggggtcagagcactggg

SEQ ID NO: 7156018 - DNA, 22 bp, Homo sapiens
ctgctgggggacacaggtccgg

SEQ ID NO: 7156019 - DNA, 22 bp, Homo sapiens
ctgctgggggacacaggtccgg

SEQ ID NO: 7156020 - DNA, 22 bp, Homo sapiens
ctgctggggtcagagcactggg

SEQ ID NO: 7156021 - DNA, 22 bp, Homo sapiens
ctgctggggtcagagcactggg

SEQ ID NO: 7156022 - DNA, 22 bp, Homo sapiens
ctgctggggtcagagcactggg

SEQ ID NO: 7156023 - DNA, 22 bp, Homo sapiens
ctgctgggggacacaggtccgg

SEQ ID NO: 7156024 - DNA, 22 bp, Homo sapiens
ctgctgggggacacaggtccgg

SEQ ID NO: 7156025 - DNA, 22 bp, Homo sapiens
ctgctgggggacacaggtccgg

SEQ ID NO: 7156026 - DNA, 22 bp, Homo sapiens
ctgctgtgggttaagacactgt

SEQ ID NO: 7156027 - DNA, 20 bp, Homo sapiens
ctgctgtggtcctttatttt

SEQ ID NO: 7156028 - DNA, 22 bp, Homo sapiens
ctgctgtgggcagggtagctgg

SEQ ID NO: 7156029 - DNA, 21 bp, Homo sapiens
ctgctgtggcccccgacatgc

SEQ ID NO: 7156030 - DNA, 22 bp, Homo sapiens
ctgctgtggccagccaggtcaa

SEQ ID NO: 7156031 - DNA, 22 bp, Homo sapiens
ctgctgtggatgcaggacctca

SEQ ID NO: 7156032 - DNA, 22 bp, Homo sapiens
ctgctgtgtcagagtccagggg

SEQ ID NO: 7156033 - DNA, 22 bp, Homo sapiens
atacaagttaatgagaatgaca

SEQ ID NO: 7156034 - DNA, 22 bp, Homo sapiens
atacaagttctcatgtgtatct

SEQ ID NO: 7156035 - DNA, 22 bp, Homo sapiens
ctgctgtggtgtcaagcatctc

SEQ ID NO: 7156036 - DNA, 22 bp, Homo sapiens
ctgctgtggtgtcaagcatctc

SEQ ID NO: 7156037 - DNA, 22 bp, Homo sapiens
ctgctgtggtgtcaagcatctc

SEQ ID NO: 7156038 - DNA, 22 bp, Homo sapiens
ctgctgtgtcagagtccagggg

SEQ ID NO: 7156039 - DNA, 22 bp, Homo sapiens
ctgctgtgtcagagtccagggg

SEQ ID NO: 7156040 - DNA, 22 bp, Homo sapiens
ctgctgtgtatcattttagatg

SEQ ID NO: 7156041 - DNA, 22 bp, Homo sapiens
atacacatatcaggtgtataca

SEQ ID NO: 7156042 - DNA, 22 bp, Homo sapiens
atacacatatcaggtgtataca

SEQ ID NO: 7156043 - DNA, 22 bp, Homo sapiens
atacacatatcaggtgtataca

SEQ ID NO: 7156044 - DNA, 19 bp, Homo sapiens
atacacatacgtaaactga

SEQ ID NO: 7156045 - DNA, 22 bp, Homo sapiens
atacacatatatacacgtttaa

SEQ ID NO: 7156046 - DNA, 19 bp, Homo sapiens
atacacatacgtaaactga

SEQ ID NO: 7156047 - DNA, 19 bp, Homo sapiens
atacacatacgtaaactga

SEQ ID NO: 7156048 - DNA, 21 bp, Homo sapiens
atacacatacacataaatgtg

SEQ ID NO: 7156049 - DNA, 21 bp, Homo sapiens
atacacatacacataaatgtg

SEQ ID NO: 7156050 - DNA, 21 bp, Homo sapiens
atacacatacacataaatgtg

SEQ ID NO: 7156051 - DNA, 20 bp, Homo sapiens
atacacatattcttgcaact

SEQ ID NO: 7156052 - DNA, 22 bp, Homo sapiens
atacacatatgtgtgtatatgt

SEQ ID NO: 7156053 - DNA, 20 bp, Homo sapiens
atacacatattcttgcaact

SEQ ID NO: 7156054 - DNA, 22 bp, Homo sapiens
atacacatatgtgtgtatatgt

SEQ ID NO: 7156055 - DNA, 22 bp, Homo sapiens
atacacatatcaggtgtataca

SEQ ID NO: 7156056 - DNA, 22 bp, Homo sapiens
atacacatatcaggtgtataca

SEQ ID NO: 7156057 - DNA, 22 bp, Homo sapiens
atacacatatgtgtgtatatgt

SEQ ID NO: 7156058 - DNA, 22 bp, Homo sapiens
atacacatatgtgtgtatatgt

SEQ ID NO: 7156059 - DNA, 22 bp, Homo sapiens
atacacatgcacacatgtgtgt

SEQ ID NO: 7156060 - DNA, 20 bp, Homo sapiens
atacacatgcagacagatgc

SEQ ID NO: 7156061 - DNA, 20 bp, Homo sapiens
atacacatgcagacagatgc

SEQ ID NO: 7156062 - DNA, 20 bp, Homo sapiens
atacacatgcagacagatgc

SEQ ID NO: 7156063 - DNA, 22 bp, Homo sapiens
atacacatgcacacatgtgtgt

SEQ ID NO: 7156064 - DNA, 22 bp, Homo sapiens
atacacatgcacacatgtgtgt

SEQ ID NO: 7156065 - DNA, 22 bp, Homo sapiens
atacacatgcacacatgtgtgt

SEQ ID NO: 7156066 - DNA, 20 bp, Homo sapiens
atacacatattcttgcaact

SEQ ID NO: 7156067 - DNA, 20 bp, Homo sapiens
atacacatattcttgcaact

SEQ ID NO: 7156068 - DNA, 22 bp, Homo sapiens
atacacatctatttaagagaca

SEQ ID NO: 7156069 - DNA, 22 bp, Homo sapiens
atacacatctatttaagagaca

SEQ ID NO: 7156070 - DNA, 22 bp, Homo sapiens
atacacatctatttaagagaca

SEQ ID NO: 7156071 - DNA, 22 bp, Homo sapiens
atacacatctatttaagagaca

SEQ ID NO: 7156072 - DNA, 15 bp, Homo sapiens
atacacatgagggag

SEQ ID NO: 7156073 - DNA, 22 bp, Homo sapiens
ctgctgggctcctcatgtgact

SEQ ID NO: 7156074 - DNA, 22 bp, Homo sapiens
ctgctgggctcctcatgtgact

SEQ ID NO: 7156075 - DNA, 22 bp, Homo sapiens
ctgctgggcagaggctgcatga

SEQ ID NO: 7156076 - DNA, 22 bp, Homo sapiens
ctgctgggcagaggctgcatga

SEQ ID NO: 7156077 - DNA, 22 bp, Homo sapiens
ctgctgggcagaggctgcatga

SEQ ID NO: 7156078 - DNA, 22 bp, Homo sapiens
ctgctgggcctggtctctgagg

SEQ ID NO: 7156079 - DNA, 19 bp, Homo sapiens
ctgctcaggtcagtctgtc

SEQ ID NO: 7156080 - DNA, 22 bp, Homo sapiens
ctgctgcccagtgtgcattggg

SEQ ID NO: 7156081 - DNA, 22 bp, Homo sapiens
ctgctgcccagtgtgcattggg

SEQ ID NO: 7156082 - DNA, 22 bp, Homo sapiens
ctgctcagcggaaggaagagcg

SEQ ID NO: 7156083 - DNA, 19 bp, Homo sapiens
ctgctcaggtcagtctgtc

SEQ ID NO: 7156084 - DNA, 19 bp, Homo sapiens
ctgctcagagcagctccag

SEQ ID NO: 7156085 - DNA, 19 bp, Homo sapiens
ctgctcagagcagctccag

SEQ ID NO: 7156086 - DNA, 19 bp, Homo sapiens
ctgctcagagcagctccag

SEQ ID NO: 7156087 - DNA, 20 bp, Homo sapiens
ctgctcagaccaactcttct

SEQ ID NO: 7156088 - DNA, 20 bp, Homo sapiens
ctgctcagaccaactcttct

SEQ ID NO: 7156089 - DNA, 19 bp, Homo sapiens
ctgctcagagcagctccag

SEQ ID NO: 7156090 - DNA, 19 bp, Homo sapiens
ctgctcagagcagctccag

SEQ ID NO: 7156091 - DNA, 22 bp, Homo sapiens
ctgctcaagtgcgcacccaggg

SEQ ID NO: 7156092 - DNA, 22 bp, Homo sapiens
ctgctagcccgccggccagcga

SEQ ID NO: 7156093 - DNA, 22 bp, Homo sapiens
ctgctatgtatattttatgaga

SEQ ID NO: 7156094 - DNA, 22 bp, Homo sapiens
ctgctaccctagagctcactct

SEQ ID NO: 7156095 - DNA, 22 bp, Homo sapiens
ctgctacttaccagctgtgtaa

SEQ ID NO: 7156096 - DNA, 22 bp, Homo sapiens
ctgctagcccaggatgcaggga

SEQ ID NO: 7156097 - DNA, 22 bp, Homo sapiens
ctgctagcccaggatgcaggga

SEQ ID NO: 7156098 - DNA, 22 bp, Homo sapiens
ctgctaaacctctctgagagct

SEQ ID NO: 7156099 - DNA, 22 bp, Homo sapiens
ctgctaattttgtgcaagtctg

SEQ ID NO: 7156100 - DNA, 22 bp, Homo sapiens
ctgcctgtgccaatgctccttt

SEQ ID NO: 7156101 - DNA, 22 bp, Homo sapiens
ctgcctgtgccaatgctccttt

SEQ ID NO: 7156102 - DNA, 22 bp, Homo sapiens
ctgcctgtgccaccgcctcatt

SEQ ID NO: 7156103 - DNA, 22 bp, Homo sapiens
ctgcctgtgccaccgcctcatt

SEQ ID NO: 7156104 - DNA, 22 bp, Homo sapiens
ctgcctgtgccaccgcctcatt

SEQ ID NO: 7156105 - DNA, 22 bp, Homo sapiens
ctgcctgtgccaccgcctcatt

SEQ ID NO: 7156106 - DNA, 22 bp, Homo sapiens
ctgcctgtgcatgcagtcagaa

SEQ ID NO: 7156107 - DNA, 22 bp, Homo sapiens
ctgcctgtgaacatactggggg

SEQ ID NO: 7156108 - DNA, 22 bp, Homo sapiens
ctgcctgtgatttttctctagt

SEQ ID NO: 7156109 - DNA, 22 bp, Homo sapiens
ctgcctgtgatttttctctagt

SEQ ID NO: 7156110 - DNA, 22 bp, Homo sapiens
ctgcctggtgcggtgcccaccc

SEQ ID NO: 7156111 - DNA, 22 bp, Homo sapiens
ctgcctggtgcggtgcccaccc

SEQ ID NO: 7156112 - DNA, 22 bp, Homo sapiens
ctgcctgtaactttctgaagca

SEQ ID NO: 7156113 - DNA, 22 bp, Homo sapiens
ctgcctgtaactttctgaagca

SEQ ID NO: 7156114 - DNA, 22 bp, Homo sapiens
ctgcctgtaactttctgaagca

SEQ ID NO: 7156115 - DNA, 22 bp, Homo sapiens
ctgcctgtattgtctgcttggg

SEQ ID NO: 7156116 - DNA, 22 bp, Homo sapiens
ctgcctggaaggagcaagggga

SEQ ID NO: 7156117 - DNA, 22 bp, Homo sapiens
ctgcctgggttcaagtcctgtt

SEQ ID NO: 7156118 - DNA, 22 bp, Homo sapiens
ctgcctgggttcaagtcctgtt

SEQ ID NO: 7156119 - DNA, 22 bp, Homo sapiens
ctgcctgggttcaagtcctgtt

SEQ ID NO: 7156120 - DNA, 22 bp, Homo sapiens
ataaagctttgaaatggagata

SEQ ID NO: 7156121 - DNA, 22 bp, Homo sapiens
ataaaggataatccattagact

SEQ ID NO: 7156122 - DNA, 22 bp, Homo sapiens
ctgcctggaaggagcaagggga

SEQ ID NO: 7156123 - DNA, 22 bp, Homo sapiens
ctgcctggaaggagcaagggga

SEQ ID NO: 7156124 - DNA, 22 bp, Homo sapiens
ctgcctggaaggagcaagggga

SEQ ID NO: 7156125 - DNA, 22 bp, Homo sapiens
ctgcctggtactttaggcactt

SEQ ID NO: 7156126 - DNA, 22 bp, Homo sapiens
ctgcctggtctcaggcatgggg

SEQ ID NO: 7156127 - DNA, 22 bp, Homo sapiens
ctgcctggtctcaggcatgggg

SEQ ID NO: 7156128 - DNA, 22 bp, Homo sapiens
ctgcctggtctcaggcatgggg

SEQ ID NO: 7156129 - DNA, 22 bp, Homo sapiens
ctgcctggtctcaggcatgggg

SEQ ID NO: 7156130 - DNA, 22 bp, Homo sapiens
ctgcctggtctcaggcatgggg

SEQ ID NO: 7156131 - DNA, 22 bp, Homo sapiens
agttctgtcctccccactcttt

SEQ ID NO: 7156132 - DNA, 22 bp, Homo sapiens
agttctgtctgacaccgaagtt

SEQ ID NO: 7156133 - DNA, 22 bp, Homo sapiens
agttctgtctgattctaatgca

SEQ ID NO: 7156134 - DNA, 22 bp, Homo sapiens
agttctgtctgattctaatgca

SEQ ID NO: 7156135 - DNA, 22 bp, Homo sapiens
agttctgtgacaatatcattac

SEQ ID NO: 7156136 - DNA, 22 bp, Homo sapiens
agttctgtgacaatatcattac

SEQ ID NO: 7156137 - DNA, 22 bp, Homo sapiens
agttctgtggctgtgccctgta

SEQ ID NO: 7156138 - DNA, 22 bp, Homo sapiens
agttctggcccagggtttcttg

SEQ ID NO: 7156139 - DNA, 22 bp, Homo sapiens
agttctgggaaaaacatggcca

SEQ ID NO: 7156140 - DNA, 22 bp, Homo sapiens
agttctgacctaacctttctca

SEQ ID NO: 7156141 - DNA, 22 bp, Homo sapiens
agttctgaatgaggaatctggg

SEQ ID NO: 7156142 - DNA, 22 bp, Homo sapiens
agttctctttagctcatatggt

SEQ ID NO: 7156143 - DNA, 22 bp, Homo sapiens
agttctgactctgaatctggga

SEQ ID NO: 7156144 - DNA, 22 bp, Homo sapiens
agttctgagcatctaggcagct

SEQ ID NO: 7156145 - DNA, 22 bp, Homo sapiens
agttctgataaaggaggaagat

SEQ ID NO: 7156146 - DNA, 22 bp, Homo sapiens
agttctgctatcttgtcttctt

SEQ ID NO: 7156147 - DNA, 22 bp, Homo sapiens
agttctctggctcctttccaga

SEQ ID NO: 7156148 - DNA, 22 bp, Homo sapiens
agttctctggctcctttccaga

SEQ ID NO: 7156149 - DNA, 22 bp, Homo sapiens
agttctcttggaagttatgtga

SEQ ID NO: 7156150 - DNA, 22 bp, Homo sapiens
agttctcttggaagttatgtga

SEQ ID NO: 7156151 - DNA, 22 bp, Homo sapiens
agttctctttagctcatatggt

SEQ ID NO: 7156152 - DNA, 22 bp, Homo sapiens
agttctcacttcagagctgccc

SEQ ID NO: 7156153 - DNA, 22 bp, Homo sapiens
agttctcagaattgcacctcaa

SEQ ID NO: 7156154 - DNA, 22 bp, Homo sapiens
agttctcatcatgaagcataag

SEQ ID NO: 7156155 - DNA, 22 bp, Homo sapiens
agttctcgagcgtccctgtttc

SEQ ID NO: 7156156 - DNA, 22 bp, Homo sapiens
agttctctatgaagtctattgt

SEQ ID NO: 7156157 - DNA, 22 bp, Homo sapiens
agttctaattgcgttttcttgc

SEQ ID NO: 7156158 - DNA, 22 bp, Homo sapiens
agttctaaacacttgaggaacc

SEQ ID NO: 7156159 - DNA, 22 bp, Homo sapiens
agttcgagatctgctgatgaga

SEQ ID NO: 7156160 - DNA, 22 bp, Homo sapiens
agttctataattaaaatgaagg

SEQ ID NO: 7156161 - DNA, 22 bp, Homo sapiens
agttctattgggtaggttctgt

SEQ ID NO: 7156162 - DNA, 22 bp, Homo sapiens
agttctatttctaacatgttat

SEQ ID NO: 7156163 - DNA, 22 bp, Homo sapiens
agttctatttctaacatgttat

SEQ ID NO: 7156164 - DNA, 22 bp, Homo sapiens
ctgcaggctcgaagacacggat

SEQ ID NO: 7156165 - DNA, 22 bp, Homo sapiens
ctgcaggctgagcgcctgccgg

SEQ ID NO: 7156166 - DNA, 22 bp, Homo sapiens
ataaaagaagttttggtacttg

SEQ ID NO: 7156167 - DNA, 22 bp, Homo sapiens
ataaaagatcccttctgagctc

SEQ ID NO: 7156168 - DNA, 20 bp, Homo sapiens
ataaaactctaatctggcct

SEQ ID NO: 7156169 - DNA, 22 bp, Homo sapiens
ataaaacttattagaattgtgt

SEQ ID NO: 7156170 - DNA, 22 bp, Homo sapiens
ataaaacttattagaattgtgt

SEQ ID NO: 7156171 - DNA, 22 bp, Homo sapiens
ataaaacttattagaattgtgt

SEQ ID NO: 7156172 - DNA, 22 bp, Homo sapiens
ataaaacttgggtatgatccct

SEQ ID NO: 7156173 - DNA, 22 bp, Homo sapiens
ataaaagaagttttggtacttg

SEQ ID NO: 7156174 - DNA, 22 bp, Homo sapiens
ataaaagaagttttggtacttg

SEQ ID NO: 7156175 - DNA, 22 bp, Homo sapiens
ataaaagaagttttggtacttg

SEQ ID NO: 7156176 - DNA, 22 bp, Homo sapiens
ataaaagaagttttggtacttg

SEQ ID NO: 7156177 - DNA, 22 bp, Homo sapiens
agttcttattgaatagaaatca

SEQ ID NO: 7156178 - DNA, 22 bp, Homo sapiens
agttcttacaggggacctttga

SEQ ID NO: 7156179 - DNA, 22 bp, Homo sapiens
agttcttattgaatagaaatca

SEQ ID NO: 7156180 - DNA, 22 bp, Homo sapiens
agttcttattttggaactgagg

SEQ ID NO: 7156181 - DNA, 22 bp, Homo sapiens
agttctgtgctcactctacccc

SEQ ID NO: 7156182 - DNA, 21 bp, Homo sapiens
agttctgttatgctggactca

SEQ ID NO: 7156183 - DNA, 22 bp, Homo sapiens
agttctgttgtctagggaagcc

SEQ ID NO: 7156184 - DNA, 22 bp, Homo sapiens
agttttgtaattctcaaaaata

SEQ ID NO: 7156185 - DNA, 22 bp, Homo sapiens
ataaaaatgagggcggtagcta

SEQ ID NO: 7156186 - DNA, 22 bp, Homo sapiens
ataaaaaggacagatgtggtct

SEQ ID NO: 7156187 - DNA, 22 bp, Homo sapiens
ataaaccagaagtaaaagctac

SEQ ID NO: 7156188 - DNA, 22 bp, Homo sapiens
ataaaccagaagtaaaagctac

SEQ ID NO: 7156189 - DNA, 22 bp, Homo sapiens
ataaactcatgccaagaaatga

SEQ ID NO: 7156190 - DNA, 22 bp, Homo sapiens
ataaactcatgctgaaaaccca

SEQ ID NO: 7156191 - DNA, 22 bp, Homo sapiens
ataaactctattttgaggagat

SEQ ID NO: 7156192 - DNA, 22 bp, Homo sapiens
ataaactctgcctcagaagagc

SEQ ID NO: 7156193 - DNA, 22 bp, Homo sapiens
ataaactgaagggaacactgag

SEQ ID NO: 7156194 - DNA, 21 bp, Homo sapiens
ataaactgcatcaagttggtg

SEQ ID NO: 7156195 - DNA, 22 bp, Homo sapiens
ataaactgggtatcaagaggcc

SEQ ID NO: 7156196 - DNA, 22 bp, Homo sapiens
ataaacatctgtttctcttctg

SEQ ID NO: 7156197 - DNA, 22 bp, Homo sapiens
ataaacatctgtttctcttctg

SEQ ID NO: 7156198 - DNA, 22 bp, Homo sapiens
ataaacatctgtttctcttctg

SEQ ID NO: 7156199 - DNA, 22 bp, Homo sapiens
ataaaatggtaaacgaagctga

SEQ ID NO: 7156200 - DNA, 22 bp, Homo sapiens
ataaacatctgtttctcttctg

SEQ ID NO: 7156201 - DNA, 22 bp, Homo sapiens
ctgcagggagaggggacagcct

SEQ ID NO: 7156202 - DNA, 22 bp, Homo sapiens
ataaaatcagagttggattgga

SEQ ID NO: 7156203 - DNA, 22 bp, Homo sapiens
ataaaatctttatgtgctctgc

SEQ ID NO: 7156204 - DNA, 22 bp, Homo sapiens
ataaaatctttatgtgctctgc

SEQ ID NO: 7156205 - DNA, 22 bp, Homo sapiens
ctgcagggagaggggacagcct

SEQ ID NO: 7156206 - DNA, 22 bp, Homo sapiens
ctgcagggacccaagtctttgg

SEQ ID NO: 7156207 - DNA, 22 bp, Homo sapiens
ctgcagggagaggggacagcct

SEQ ID NO: 7156208 - DNA, 22 bp, Homo sapiens
ctgcagggagaggggacagcct

SEQ ID NO: 7156209 - DNA, 22 bp, Homo sapiens
ctgcagggagaggggacagcct

SEQ ID NO: 7156210 - DNA, 22 bp, Homo sapiens
ctgcagggaccacaagcaggtt

SEQ ID NO: 7156211 - DNA, 22 bp, Homo sapiens
ctgcagggaccacaagcaggtt

SEQ ID NO: 7156212 - DNA, 22 bp, Homo sapiens
ctgcagggacccaagtctttgg

SEQ ID NO: 7156213 - DNA, 22 bp, Homo sapiens
ctgcagggacccaagtctttgg

SEQ ID NO: 7156214 - DNA, 22 bp, Homo sapiens
ctgcagggaccacaagcaggtt

SEQ ID NO: 7156215 - DNA, 22 bp, Homo sapiens
ctgcagggaccacaagcaggtt

SEQ ID NO: 7156216 - DNA, 22 bp, Homo sapiens
ctgcagggaccacaagcaggtt

SEQ ID NO: 7156217 - DNA, 22 bp, Homo sapiens
ctgcagggaccacaagcaggtt

SEQ ID NO: 7156218 - DNA, 22 bp, Homo sapiens
ctgcagggaactgaggcccaga

SEQ ID NO: 7156219 - DNA, 22 bp, Homo sapiens
ctgcagggaactgaggcccaga

SEQ ID NO: 7156220 - DNA, 22 bp, Homo sapiens
ctgcagggaactgaggcccaga

SEQ ID NO: 7156221 - DNA, 22 bp, Homo sapiens
ctgcagggaactgaggcccaga

SEQ ID NO: 7156222 - DNA, 22 bp, Homo sapiens
ctgcaggcttccagggctgtgg

SEQ ID NO: 7156223 - DNA, 22 bp, Homo sapiens
ctgcagggaactgaggcccaga

SEQ ID NO: 7156224 - DNA, 22 bp, Homo sapiens
ctgcagggaactgaggcccaga

SEQ ID NO: 7156225 - DNA, 22 bp, Homo sapiens
ctgcaggctgagcgcctgccgg

SEQ ID NO: 7156226 - DNA, 22 bp, Homo sapiens
ataaagctaagacttacatgaa

SEQ ID NO: 7156227 - DNA, 22 bp, Homo sapiens
ataaagcctttctgttttcagg

SEQ ID NO: 7156228 - DNA, 22 bp, Homo sapiens
ataaagctaagacttacatgaa

SEQ ID NO: 7156229 - DNA, 22 bp, Homo sapiens
ataaagctattcctctcttttt

SEQ ID NO: 7156230 - DNA, 22 bp, Homo sapiens
ataaagctatttttaattctgt

SEQ ID NO: 7156231 - DNA, 22 bp, Homo sapiens
ataaagctatttttaattctgt

SEQ ID NO: 7156232 - DNA, 22 bp, Homo sapiens
ataaagcatctagtctgtcact

SEQ ID NO: 7156233 - DNA, 22 bp, Homo sapiens
ataaagcatctagtctgtcact

SEQ ID NO: 7156234 - DNA, 22 bp, Homo sapiens
ataaagcatgcttgtttggaga

SEQ ID NO: 7156235 - DNA, 22 bp, Homo sapiens
ataaagcatttcccctgtgtgg

SEQ ID NO: 7156236 - DNA, 22 bp, Homo sapiens
ataaagcaagcataccattaag

SEQ ID NO: 7156237 - DNA, 22 bp, Homo sapiens
ataaagcaagcataccattaag

SEQ ID NO: 7156238 - DNA, 22 bp, Homo sapiens
ataaagcaaataggactattgc

SEQ ID NO: 7156239 - DNA, 22 bp, Homo sapiens
ataaagcaagcataccattaag

SEQ ID NO: 7156240 - DNA, 22 bp, Homo sapiens
ataaagcaagcataccattaag

SEQ ID NO: 7156241 - DNA, 22 bp, Homo sapiens
ataaagcaatagattgtgtaat

SEQ ID NO: 7156242 - DNA, 22 bp, Homo sapiens
ataaagcaggtccccagacact

SEQ ID NO: 7156243 - DNA, 22 bp, Homo sapiens
ataaacttgagtctcagagtat

SEQ ID NO: 7156244 - DNA, 22 bp, Homo sapiens
ataaacttgagtctcagagtat

SEQ ID NO: 7156245 - DNA, 22 bp, Homo sapiens
ataaactgtgctggatgatgag

SEQ ID NO: 7156246 - DNA, 22 bp, Homo sapiens
ataaactggtaggaaaacagta

SEQ ID NO: 7156247 - DNA, 23 bp, Homo sapiens
ataaactgtcaaaagccagccct

SEQ ID NO: 7156248 - DNA, 22 bp, Homo sapiens
ataaacttgagtctcagagtat

SEQ ID NO: 7156249 - DNA, 22 bp, Homo sapiens
ataaacttgagtctcagagtat

SEQ ID NO: 7156250 - DNA, 22 bp, Homo sapiens
ataaactttagcggaaggagga

SEQ ID NO: 7156251 - DNA, 22 bp, Homo sapiens
ataaagacatgcttacttgccc

SEQ ID NO: 7156252 - DNA, 22 bp, Homo sapiens
ataaagaccagtatcttatgtt

SEQ ID NO: 7156253 - DNA, 22 bp, Homo sapiens
ataaagaggatgtatttacagc

SEQ ID NO: 7156254 - DNA, 22 bp, Homo sapiens
ataaagaggatgtatttacagc

SEQ ID NO: 7156255 - DNA, 22 bp, Homo sapiens
ataaagatagaatgctttcctg

SEQ ID NO: 7156256 - DNA, 22 bp, Homo sapiens
ataaagatttctttttctctac

SEQ ID NO: 7156257 - DNA, 22 bp, Homo sapiens
ataaagatttttaggcatttct

SEQ ID NO: 7156258 - DNA, 22 bp, Homo sapiens
ataaagcaaataggactattgc

SEQ ID NO: 7156259 - DNA, 22 bp, Homo sapiens
agtggccactagaagctcagct

SEQ ID NO: 7156260 - DNA, 22 bp, Homo sapiens
agtggccactagaagctcagct

SEQ ID NO: 7156261 - DNA, 22 bp, Homo sapiens
agtggccacccactgagacagg

SEQ ID NO: 7156262 - DNA, 22 bp, Homo sapiens
agtggccactagaagctcagct

SEQ ID NO: 7156263 - DNA, 22 bp, Homo sapiens
agtggccactagaagctcagct

SEQ ID NO: 7156264 - DNA, 22 bp, Homo sapiens
agtggccaccatgccagctctc

SEQ ID NO: 7156265 - DNA, 22 bp, Homo sapiens
agtggccaccatgccagctctc

SEQ ID NO: 7156266 - DNA, 22 bp, Homo sapiens
agtggccaatatgtcatgctct

SEQ ID NO: 7156267 - DNA, 22 bp, Homo sapiens
agtggccaccatgccagctctc

SEQ ID NO: 7156268 - DNA, 22 bp, Homo sapiens
agtggccaccatgccagctctc

SEQ ID NO: 7156269 - DNA, 22 bp, Homo sapiens
agtggccactgacttggaaatc

SEQ ID NO: 7156270 - DNA, 20 bp, Homo sapiens
agtggccactgcagagatgc

SEQ ID NO: 7156271 - DNA, 20 bp, Homo sapiens
agtggccactgcagagatgc

SEQ ID NO: 7156272 - DNA, 22 bp, Homo sapiens
agtggccagcagcctagcctag

SEQ ID NO: 7156273 - DNA, 22 bp, Homo sapiens
agtggccaggaaaggtccagcc

SEQ ID NO: 7156274 - DNA, 22 bp, Homo sapiens
agtggccaggaaaggtccagcc

SEQ ID NO: 7156275 - DNA, 22 bp, Homo sapiens
agtggccagcagcctagcctag

SEQ ID NO: 7156276 - DNA, 22 bp, Homo sapiens
agtggccaggaaaggtccagcc

SEQ ID NO: 7156277 - DNA, 22 bp, Homo sapiens
agtggcagtttgggagctacag

SEQ ID NO: 7156278 - DNA, 22 bp, Homo sapiens
agtggcagtttgggagctacag

SEQ ID NO: 7156279 - DNA, 22 bp, Homo sapiens
agtggcagtggggcagggccct

SEQ ID NO: 7156280 - DNA, 22 bp, Homo sapiens
agtggcagtggggcagggccct

SEQ ID NO: 7156281 - DNA, 22 bp, Homo sapiens
agtggccaacttatatgaaaaa

SEQ ID NO: 7156282 - DNA, 22 bp, Homo sapiens
agtggccaatatgtcatgctct

SEQ ID NO: 7156283 - DNA, 22 bp, Homo sapiens
agtggcagtggggcagggccct

SEQ ID NO: 7156284 - DNA, 22 bp, Homo sapiens
agtggcagggctggctgctgca

SEQ ID NO: 7156285 - DNA, 22 bp, Homo sapiens
agtggcagtggggcagggccct

SEQ ID NO: 7156286 - DNA, 22 bp, Homo sapiens
agtggcagaagccaagtctgca

SEQ ID NO: 7156287 - DNA, 22 bp, Homo sapiens
agtggcaatgtagagagtgatc

SEQ ID NO: 7156288 - DNA, 22 bp, Homo sapiens
agtggaggttattgagttaagg

SEQ ID NO: 7156289 - DNA, 22 bp, Homo sapiens
agtggaggttattgagttaagg

SEQ ID NO: 7156290 - DNA, 22 bp, Homo sapiens
agtggagttgagttgatggatt

SEQ ID NO: 7156291 - DNA, 22 bp, Homo sapiens
agtggatggtattgggaccagg

SEQ ID NO: 7156292 - DNA, 22 bp, Homo sapiens
agtggcaaaagcaggcttaggc

SEQ ID NO: 7156293 - DNA, 22 bp, Homo sapiens
agtggaggttacagctgtacat

SEQ ID NO: 7156294 - DNA, 22 bp, Homo sapiens
agtggaggcactaattggattt

SEQ ID NO: 7156295 - DNA, 22 bp, Homo sapiens
agtggaggcactaattggattt

SEQ ID NO: 7156296 - DNA, 22 bp, Homo sapiens
agtggaggttacagctgtacat

SEQ ID NO: 7156297 - DNA, 22 bp, Homo sapiens
agtggaggttattgagttaagg

SEQ ID NO: 7156298 - DNA, 22 bp, Homo sapiens
agtggagcttttcctatcagag

SEQ ID NO: 7156299 - DNA, 22 bp, Homo sapiens
agtggagcttttcctatcagag

SEQ ID NO: 7156300 - DNA, 22 bp, Homo sapiens
agtggagcagagaggggatctt

SEQ ID NO: 7156301 - DNA, 20 bp, Homo sapiens
agtggagcagcccaagcagc

SEQ ID NO: 7156302 - DNA, 22 bp, Homo sapiens
agtggagcaggcggcgctcact

SEQ ID NO: 7156303 - DNA, 22 bp, Homo sapiens
agtggagcgtgttacctttgct

SEQ ID NO: 7156304 - DNA, 22 bp, Homo sapiens
agtggagctaaggtatctttta

SEQ ID NO: 7156305 - DNA, 22 bp, Homo sapiens
agtggagacaggacagtcgata

SEQ ID NO: 7156306 - DNA, 22 bp, Homo sapiens
agtggagacaggacagtcgata

SEQ ID NO: 7156307 - DNA, 22 bp, Homo sapiens
agtggagaccccacttctacat

SEQ ID NO: 7156308 - DNA, 22 bp, Homo sapiens
agtggagaatatgcagaaagcc

SEQ ID NO: 7156309 - DNA, 22 bp, Homo sapiens
agtggagaagaggatggtctcc

SEQ ID NO: 7156310 - DNA, 22 bp, Homo sapiens
agtggagaagaggatggtctcc

SEQ ID NO: 7156311 - DNA, 22 bp, Homo sapiens
agtggagaatatgcagaaagcc

SEQ ID NO: 7156312 - DNA, 22 bp, Homo sapiens
agtggagaatatgcagaaagcc

SEQ ID NO: 7156313 - DNA, 22 bp, Homo sapiens
agtggagaatatgcagaaagcc

SEQ ID NO: 7156314 - DNA, 22 bp, Homo sapiens
agtggagaagaggatggtctcc

SEQ ID NO: 7156315 - DNA, 22 bp, Homo sapiens
agtggactcttcccagtgcttg

SEQ ID NO: 7156316 - DNA, 22 bp, Homo sapiens
agtggacttttagtatccttat

SEQ ID NO: 7156317 - DNA, 22 bp, Homo sapiens
agtggactaaagccaggcagca

SEQ ID NO: 7156318 - DNA, 22 bp, Homo sapiens
agtggactaaagccaggcagca

SEQ ID NO: 7156319 - DNA, 22 bp, Homo sapiens
agtggacccggaacagaggccc

SEQ ID NO: 7156320 - DNA, 22 bp, Homo sapiens
agtggaccagaagactgaagct

SEQ ID NO: 7156321 - DNA, 22 bp, Homo sapiens
agtggacattctgcacttggag

SEQ ID NO: 7156322 - DNA, 22 bp, Homo sapiens
agtgctttgtggagaatttgta

SEQ ID NO: 7156323 - DNA, 22 bp, Homo sapiens
agtgctttgtggagaatttgta

SEQ ID NO: 7156324 - DNA, 22 bp, Homo sapiens
agtgcttttatatcattaatcc

SEQ ID NO: 7156325 - DNA, 22 bp, Homo sapiens
agtgctgtcagttttatagata

SEQ ID NO: 7156326 - DNA, 22 bp, Homo sapiens
agtgctttgtagtttcattgtg

SEQ ID NO: 7156327 - DNA, 22 bp, Homo sapiens
agtgctttgtagtttcattgtg

SEQ ID NO: 7156328 - DNA, 22 bp, Homo sapiens
agtgcttttattatatacagga

SEQ ID NO: 7156329 - DNA, 22 bp, Homo sapiens
agtgcttttgtcattgaatctt

SEQ ID NO: 7156330 - DNA, 22 bp, Homo sapiens
agtgcttttgtcattgaatctt

SEQ ID NO: 7156331 - DNA, 22 bp, Homo sapiens
agtggaaggctgggaaatgcgg

SEQ ID NO: 7156332 - DNA, 22 bp, Homo sapiens
agtggaaggtcaggggacagtg

SEQ ID NO: 7156333 - DNA, 21 bp, Homo sapiens
agtggaacccttagggtcagg

SEQ ID NO: 7156334 - DNA, 22 bp, Homo sapiens
agtggaagagccatgttccaac

SEQ ID NO: 7156335 - DNA, 22 bp, Homo sapiens
agtggaaagaaccctggactca

SEQ ID NO: 7156336 - DNA, 22 bp, Homo sapiens
agtggaaggtcaggggacagtg

SEQ ID NO: 7156337 - DNA, 22 bp, Homo sapiens
agtggacaaccatgctgagatt

SEQ ID NO: 7156338 - DNA, 22 bp, Homo sapiens
agtggacaaccatgctgagatt

SEQ ID NO: 7156339 - DNA, 22 bp, Homo sapiens
agtgcagggggaaagggtgtct

SEQ ID NO: 7156340 - DNA, 22 bp, Homo sapiens
agtgcagggggaaagggtgtct

SEQ ID NO: 7156341 - DNA, 22 bp, Homo sapiens
agtgcagggggaaagggtgtct

SEQ ID NO: 7156342 - DNA, 22 bp, Homo sapiens
agtgcattatatgtttcaatgg

SEQ ID NO: 7156343 - DNA, 22 bp, Homo sapiens
agtgcattcagtattcataggc

SEQ ID NO: 7156344 - DNA, 22 bp, Homo sapiens
agtgcattcagtattcataggc

SEQ ID NO: 7156345 - DNA, 22 bp, Homo sapiens
agtgcattcctggggaagaagc

SEQ ID NO: 7156346 - DNA, 22 bp, Homo sapiens
agtgcattctctaattacaggt

SEQ ID NO: 7156347 - DNA, 22 bp, Homo sapiens
agtgcattctgtcatcttggtt

SEQ ID NO: 7156348 - DNA, 22 bp, Homo sapiens
agtgcattctgtcatcttggtt

SEQ ID NO: 7156349 - DNA, 19 bp, Homo sapiens
agtgcattttatgtttcaa

SEQ ID NO: 7156350 - DNA, 20 bp, Homo sapiens
agtgccaaatgttgtttgtt

SEQ ID NO: 7156351 - DNA, 19 bp, Homo sapiens
agtgccaagggtggattgt

SEQ ID NO: 7156352 - DNA, 22 bp, Homo sapiens
agtgccaaggtattaatttata

SEQ ID NO: 7156353 - DNA, 22 bp, Homo sapiens
agtgccaaggtattaatttata

SEQ ID NO: 7156354 - DNA, 22 bp, Homo sapiens
agtgccagctccacacagcagc

SEQ ID NO: 7156355 - DNA, 22 bp, Homo sapiens
agtgcagggcctgcccagcagg

SEQ ID NO: 7156356 - DNA, 22 bp, Homo sapiens
agtgcagggcctgcccagcagg

SEQ ID NO: 7156357 - DNA, 22 bp, Homo sapiens
agtgcagggcctgcccagcagg

SEQ ID NO: 7156358 - DNA, 22 bp, Homo sapiens
agtgcagggcctgcccagcagg

SEQ ID NO: 7156359 - DNA, 22 bp, Homo sapiens
agtgatttatgtatgtgcacgt

SEQ ID NO: 7156360 - DNA, 22 bp, Homo sapiens
agtgattgttttaaaaatgcct

SEQ ID NO: 7156361 - DNA, 21 bp, Homo sapiens
agtgatttatgagagaatgac

SEQ ID NO: 7156362 - DNA, 22 bp, Homo sapiens
agtgatgttgactagctataag

SEQ ID NO: 7156363 - DNA, 22 bp, Homo sapiens
agtgatgttgattttaccactt

SEQ ID NO: 7156364 - DNA, 22 bp, Homo sapiens
agtgatgtctaacttgatccct

SEQ ID NO: 7156365 - DNA, 22 bp, Homo sapiens
agtgatgtgggagagtatagct

SEQ ID NO: 7156366 - DNA, 22 bp, Homo sapiens
agtgctgtcagttttatagata

SEQ ID NO: 7156367 - DNA, 22 bp, Homo sapiens
agtgcgtggtttacagctagtt

SEQ ID NO: 7156368 - DNA, 22 bp, Homo sapiens
agtgcgtgggcaggcatggaag

SEQ ID NO: 7156369 - DNA, 22 bp, Homo sapiens
agtgcgtggtttacagctagtt

SEQ ID NO: 7156370 - DNA, 22 bp, Homo sapiens
agtgctaaaggatcacagggtc

SEQ ID NO: 7156371 - DNA, 22 bp, Homo sapiens
agtgctaatgtgcaatatagag

SEQ ID NO: 7156372 - DNA, 22 bp, Homo sapiens
agtgccttgtgtgtgggcagcc

SEQ ID NO: 7156373 - DNA, 19 bp, Homo sapiens
agtgccttgctctctaggt

SEQ ID NO: 7156374 - DNA, 22 bp, Homo sapiens
agtgcgtggacccctggctgct

SEQ ID NO: 7156375 - DNA, 22 bp, Homo sapiens
agtgcgtggacccctggctgct

SEQ ID NO: 7156376 - DNA, 22 bp, Homo sapiens
agtgcgtgggcaggcatggaag

SEQ ID NO: 7156377 - DNA, 22 bp, Homo sapiens
agtgcctggaccccatgacata

SEQ ID NO: 7156378 - DNA, 22 bp, Homo sapiens
agtgcctggcacatggaaggtg

SEQ ID NO: 7156379 - DNA, 22 bp, Homo sapiens
agtgccttaaacagcatcggag

SEQ ID NO: 7156380 - DNA, 22 bp, Homo sapiens
agtgccttctctgggctaggtc

SEQ ID NO: 7156381 - DNA, 22 bp, Homo sapiens
agtgccctgtcactggaactga

SEQ ID NO: 7156382 - DNA, 22 bp, Homo sapiens
agtgccctgtggcttcagcaat

SEQ ID NO: 7156383 - DNA, 22 bp, Homo sapiens
agtgcctggaccccatgacata

SEQ ID NO: 7156384 - DNA, 22 bp, Homo sapiens
agtgcctggaccccatgacata

SEQ ID NO: 7156385 - DNA, 20 bp, Homo sapiens
agtgccagggcaggtgagag

SEQ ID NO: 7156386 - DNA, 20 bp, Homo sapiens
agtgccagggcaggtgagag

SEQ ID NO: 7156387 - DNA, 21 bp, Homo sapiens
agtgccagtaggtatggagga

SEQ ID NO: 7156388 - DNA, 22 bp, Homo sapiens
agtgccagttaataagaaatgg

SEQ ID NO: 7156389 - DNA, 22 bp, Homo sapiens
agtgccctggcccagctggacc

SEQ ID NO: 7156390 - DNA, 22 bp, Homo sapiens
agtgccctggcccagctggacc

SEQ ID NO: 7156391 - DNA, 22 bp, Homo sapiens
agtgccctggacggcggcccca

SEQ ID NO: 7156392 - DNA, 22 bp, Homo sapiens
agtgccctgctggggcaggaga

SEQ ID NO: 7156393 - DNA, 22 bp, Homo sapiens
agtgcccacctctcttcagcta

SEQ ID NO: 7156394 - DNA, 22 bp, Homo sapiens
agtgccccatgggtgcctgggg

SEQ ID NO: 7156395 - DNA, 22 bp, Homo sapiens
agtgcccagttaggttggagca

SEQ ID NO: 7156396 - DNA, 22 bp, Homo sapiens
agtgccccatgggtgcctgggg

SEQ ID NO: 7156397 - DNA, 22 bp, Homo sapiens
agtgccctcgtgcccagggcct

SEQ ID NO: 7156398 - DNA, 22 bp, Homo sapiens
agtgccctcgtgcccagggcct

SEQ ID NO: 7156399 - DNA, 22 bp, Homo sapiens
agtctttcctgcttgactgttc

SEQ ID NO: 7156400 - DNA, 19 bp, Homo sapiens
agtctttgcctggggcctt

SEQ ID NO: 7156401 - DNA, 22 bp, Homo sapiens
agtctttatacagaaatatatg

SEQ ID NO: 7156402 - DNA, 18 bp, Homo sapiens
agtcttctgatccatttt

SEQ ID NO: 7156403 - DNA, 18 bp, Homo sapiens
agtcttctgatccatttt

SEQ ID NO: 7156404 - DNA, 22 bp, Homo sapiens
ctcaccacaccgtcggcctcct

SEQ ID NO: 7156405 - DNA, 22 bp, Homo sapiens
ctcaccacagagcctgtccagc

SEQ ID NO: 7156406 - DNA, 22 bp, Homo sapiens
ctcaccacagagcctgtccagc

SEQ ID NO: 7156407 - DNA, 22 bp, Homo sapiens
ctcacatgatggcctttttcat

SEQ ID NO: 7156408 - DNA, 22 bp, Homo sapiens
ctcacattccacttgtgccaac

SEQ ID NO: 7156409 - DNA, 23 bp, Homo sapiens
ctcaccaagcgccgccgctgtgt

SEQ ID NO: 7156410 - DNA, 23 bp, Homo sapiens
ctcaccaagcgccgccgctgtgt

SEQ ID NO: 7156411 - DNA, 23 bp, Homo sapiens
ctcaccaagcgccgccgctgtgt

SEQ ID NO: 7156412 - DNA, 23 bp, Homo sapiens
ctcaccaagcgccgccgctgtgt

SEQ ID NO: 7156413 - DNA, 22 bp, Homo sapiens
ctcacagttttctgtagtccaa

SEQ ID NO: 7156414 - DNA, 22 bp, Homo sapiens
ctcacagttttttcctgttaat

SEQ ID NO: 7156415 - DNA, 22 bp, Homo sapiens
ctcacagttgtggtacctggtt

SEQ ID NO: 7156416 - DNA, 22 bp, Homo sapiens
ctcacagtttcacagtgtagat

SEQ ID NO: 7156417 - DNA, 22 bp, Homo sapiens
ctcacagtttcacagtgtagat

SEQ ID NO: 7156418 - DNA, 22 bp, Homo sapiens
ctcacatgagatctgtacatcc

SEQ ID NO: 7156419 - DNA, 22 bp, Homo sapiens
ctcacatgagatctgtacatcc

SEQ ID NO: 7156420 - DNA, 22 bp, Homo sapiens
ctcacatgatggcctttttcat

SEQ ID NO: 7156421 - DNA, 22 bp, Homo sapiens
ctcacagtgtaatattgaaccc

SEQ ID NO: 7156422 - DNA, 22 bp, Homo sapiens
ctcacagtgtcaacattaacta

SEQ ID NO: 7156423 - DNA, 22 bp, Homo sapiens
ctcacagttggagaatttagat

SEQ ID NO: 7156424 - DNA, 22 bp, Homo sapiens
ctcacagttggctcattaatga

SEQ ID NO: 7156425 - DNA, 22 bp, Homo sapiens
ctcacagttggctcattaatga

SEQ ID NO: 7156426 - DNA, 22 bp, Homo sapiens
agtctatttcagtcttactagt

SEQ ID NO: 7156427 - DNA, 22 bp, Homo sapiens
agtctatttcagtcttactagt

SEQ ID NO: 7156428 - DNA, 22 bp, Homo sapiens
agtctatttgctgtccgagcaa

SEQ ID NO: 7156429 - DNA, 22 bp, Homo sapiens
agtctattttgcttattctatg

SEQ ID NO: 7156430 - DNA, 22 bp, Homo sapiens
agtctattttcagaagcagttt

SEQ ID NO: 7156431 - DNA, 22 bp, Homo sapiens
agtctattttagctgcatatgt

SEQ ID NO: 7156432 - DNA, 20 bp, Homo sapiens
ctcacagtcaatgcagaggt

SEQ ID NO: 7156433 - DNA, 22 bp, Homo sapiens
agtctcacttcttgagctatgc

SEQ ID NO: 7156434 - DNA, 21 bp, Homo sapiens
ctcacagtctgttttccttgc

SEQ ID NO: 7156435 - DNA, 22 bp, Homo sapiens
ctcacagtgatgtcttatgaca

SEQ ID NO: 7156436 - DNA, 22 bp, Homo sapiens
agtctcagagtacctgagggac

SEQ ID NO: 7156437 - DNA, 20 bp, Homo sapiens
ctcacagtcaatgcagaggt

SEQ ID NO: 7156438 - DNA, 22 bp, Homo sapiens
ctcacagtctctccctaatttt

SEQ ID NO: 7156439 - DNA, 22 bp, Homo sapiens
ctcacagtctctccctaatttt

SEQ ID NO: 7156440 - DNA, 22 bp, Homo sapiens
ctcacagtctgcctttcccttg

SEQ ID NO: 7156441 - DNA, 22 bp, Homo sapiens
agtctacaatcttaaatgaact

SEQ ID NO: 7156442 - DNA, 22 bp, Homo sapiens
agtctacaatcttaaatgaact

SEQ ID NO: 7156443 - DNA, 22 bp, Homo sapiens
agtctacaccccaggctccggg

SEQ ID NO: 7156444 - DNA, 18 bp, Homo sapiens
agtctacactggttctta

SEQ ID NO: 7156445 - DNA, 22 bp, Homo sapiens
agtctacagttccctcaggtcc

SEQ ID NO: 7156446 - DNA, 22 bp, Homo sapiens
agtctagaaacaaggtagagct

SEQ ID NO: 7156447 - DNA, 22 bp, Homo sapiens
agtctagaatgtgcaccaagct

SEQ ID NO: 7156448 - DNA, 22 bp, Homo sapiens
agtctagagattctgaagggaa

SEQ ID NO: 7156449 - DNA, 22 bp, Homo sapiens
agtctagaggatgggtccagat

SEQ ID NO: 7156450 - DNA, 22 bp, Homo sapiens
agtctagatccccagtgctgtc

SEQ ID NO: 7156451 - DNA, 22 bp, Homo sapiens
agtctagatccccagtgctgtc

SEQ ID NO: 7156452 - DNA, 22 bp, Homo sapiens
agtctagatgatcctaggaata

SEQ ID NO: 7156453 - DNA, 22 bp, Homo sapiens
agtctagatgtgtactaggtta

SEQ ID NO: 7156454 - DNA, 20 bp, Homo sapiens
agtctaggagagggtaaagc

SEQ ID NO: 7156455 - DNA, 20 bp, Homo sapiens
agtctaggattttggcagct

SEQ ID NO: 7156456 - DNA, 22 bp, Homo sapiens
agtctaggcagccctgcagggt

SEQ ID NO: 7156457 - DNA, 22 bp, Homo sapiens
agtctagggaatactgaaaggt

SEQ ID NO: 7156458 - DNA, 22 bp, Homo sapiens
agtctagggattgaagcatgat

SEQ ID NO: 7156459 - DNA, 22 bp, Homo sapiens
agtctagggattgaagcatgat

SEQ ID NO: 7156460 - DNA, 22 bp, Homo sapiens
agtctagggtggggtccacagg

SEQ ID NO: 7156461 - DNA, 22 bp, Homo sapiens
agtctaggtacgggtccaactt

SEQ ID NO: 7156462 - DNA, 22 bp, Homo sapiens
agtctaggtaggacaccccagg

SEQ ID NO: 7156463 - DNA, 22 bp, Homo sapiens
agtctagtaggatctctgggct

SEQ ID NO: 7156464 - DNA, 22 bp, Homo sapiens
agtctagtaggatctctgggct

SEQ ID NO: 7156465 - DNA, 22 bp, Homo sapiens
agtctatattgtgaaagtaaaa

SEQ ID NO: 7156466 - DNA, 22 bp, Homo sapiens
agtctattgcctaacagagagg

SEQ ID NO: 7156467 - DNA, 22 bp, Homo sapiens
agtgagggactagtgctgggga

SEQ ID NO: 7156468 - DNA, 22 bp, Homo sapiens
agtgagggactagtgctgggga

SEQ ID NO: 7156469 - DNA, 22 bp, Homo sapiens
agtgaggctaataggcaatggt

SEQ ID NO: 7156470 - DNA, 22 bp, Homo sapiens
agtgacttcttaaaccatggtc

SEQ ID NO: 7156471 - DNA, 22 bp, Homo sapiens
agtgacttcttaaaccatggtc

SEQ ID NO: 7156472 - DNA, 22 bp, Homo sapiens
agtgacttgacacttgtgaggg

SEQ ID NO: 7156473 - DNA, 17 bp, Homo sapiens
agtgacttggaaagagc

SEQ ID NO: 7156474 - DNA, 22 bp, Homo sapiens
agtgacttggcatgatgagaag

SEQ ID NO: 7156475 - DNA, 22 bp, Homo sapiens
agtgactttagttgaatcttgt

SEQ ID NO: 7156476 - DNA, 19 bp, Homo sapiens
agtgagaacatgtgcacac

SEQ ID NO: 7156477 - DNA, 19 bp, Homo sapiens
agtgagaacatgtgcacac

SEQ ID NO: 7156478 - DNA, 19 bp, Homo sapiens
agtgagaacatgtgcacac

SEQ ID NO: 7156479 - DNA, 22 bp, Homo sapiens
agtgacttctcctaatgtcata

SEQ ID NO: 7156480 - DNA, 22 bp, Homo sapiens
agtgacttctcctaatgtcata

SEQ ID NO: 7156481 - DNA, 22 bp, Homo sapiens
agtgacttaaaggaacttactg

SEQ ID NO: 7156482 - DNA, 22 bp, Homo sapiens
agtgacttaattcattatattt

SEQ ID NO: 7156483 - DNA, 22 bp, Homo sapiens
agtgacttctccgtggcaggat

SEQ ID NO: 7156484 - DNA, 22 bp, Homo sapiens
agtgaaattgctgtaagaggaa

SEQ ID NO: 7156485 - DNA, 21 bp, Homo sapiens
agtgaaattgcatcagaggga

SEQ ID NO: 7156486 - DNA, 22 bp, Homo sapiens
agtgaaattcctggtctttgtt

SEQ ID NO: 7156487 - DNA, 22 bp, Homo sapiens
agtgaaatgattctgagcaaga

SEQ ID NO: 7156488 - DNA, 22 bp, Homo sapiens
agtgaaatgatagtgtaaatac

SEQ ID NO: 7156489 - DNA, 22 bp, Homo sapiens
agtgaaatgactgaatcagata

SEQ ID NO: 7156490 - DNA, 22 bp, Homo sapiens
agtgaaatcctggtcaacaggt

SEQ ID NO: 7156491 - DNA, 22 bp, Homo sapiens
agtgaaaacctaatcatgcagt

SEQ ID NO: 7156492 - DNA, 22 bp, Homo sapiens
agtgaaaagatgcatttctctg

SEQ ID NO: 7156493 - DNA, 22 bp, Homo sapiens
agtgaaaagatgcatttctctg

SEQ ID NO: 7156494 - DNA, 22 bp, Homo sapiens
agtgaaaggaaaaactgatatt

SEQ ID NO: 7156495 - DNA, 22 bp, Homo sapiens
agtgaaatcaggttttgactgc

SEQ ID NO: 7156496 - DNA, 22 bp, Homo sapiens
agtgaaatcaggttttgactgc

SEQ ID NO: 7156497 - DNA, 22 bp, Homo sapiens
agtgaaatcaggttttgactgc

SEQ ID NO: 7156498 - DNA, 22 bp, Homo sapiens
agtgaaatatgcccattgctgt

SEQ ID NO: 7156499 - DNA, 22 bp, Homo sapiens
agtgaaatatgcccattgctgt

SEQ ID NO: 7156500 - DNA, 22 bp, Homo sapiens
agtgaaatactgtcgtttttag

SEQ ID NO: 7156501 - DNA, 22 bp, Homo sapiens
agtgaaaggaaaaactgatatt

SEQ ID NO: 7156502 - DNA, 22 bp, Homo sapiens
agtgaaaggttgagaatattct

SEQ ID NO: 7156503 - DNA, 22 bp, Homo sapiens
agtgaaaggttgagaatattct

SEQ ID NO: 7156504 - DNA, 22 bp, Homo sapiens
agtgaggggattcaggcaaggt

SEQ ID NO: 7156505 - DNA, 22 bp, Homo sapiens
agtgagggactagtgctgggga

SEQ ID NO: 7156506 - DNA, 22 bp, Homo sapiens
agtgagggactagtgctgggga

SEQ ID NO: 7156507 - DNA, 22 bp, Homo sapiens
agtgagggactccatgactcct

SEQ ID NO: 7156508 - DNA, 22 bp, Homo sapiens
agtgaggggattcaggcaaggt

SEQ ID NO: 7156509 - DNA, 22 bp, Homo sapiens
agtgaggggcagctgagtgggc

SEQ ID NO: 7156510 - DNA, 22 bp, Homo sapiens
agtgaggggattcaggcaaggt

SEQ ID NO: 7156511 - DNA, 22 bp, Homo sapiens
agtgaggggattcaggcaaggt

SEQ ID NO: 7156512 - DNA, 22 bp, Homo sapiens
agtgaggggattcaggcaaggt

SEQ ID NO: 7156513 - DNA, 22 bp, Homo sapiens
agtgaggggcagctgagtgggc

SEQ ID NO: 7156514 - DNA, 22 bp, Homo sapiens
agtgaggtaattagagctgctg

SEQ ID NO: 7156515 - DNA, 22 bp, Homo sapiens
agtgaggtcaggatctcaggga

SEQ ID NO: 7156516 - DNA, 22 bp, Homo sapiens
agtgaggtcatactggagaggg

SEQ ID NO: 7156517 - DNA, 22 bp, Homo sapiens
agtgagtttagggtgcaggtgt

SEQ ID NO: 7156518 - DNA, 18 bp, Homo sapiens
agtgagttgttgaaagaa

SEQ ID NO: 7156519 - DNA, 22 bp, Homo sapiens
agtgataatgtggtaattattt

SEQ ID NO: 7156520 - DNA, 22 bp, Homo sapiens
agtgataatgtggtaattattt

SEQ ID NO: 7156521 - DNA, 22 bp, Homo sapiens
agtgataatgtggtaattattt

SEQ ID NO: 7156522 - DNA, 22 bp, Homo sapiens
agtgataggacatatggatttt

SEQ ID NO: 7156523 - DNA, 22 bp, Homo sapiens
agtgatatatgttgccagagag

SEQ ID NO: 7156524 - DNA, 22 bp, Homo sapiens
agtgatatatgttgccagagag

SEQ ID NO: 7156525 - DNA, 22 bp, Homo sapiens
agtgatgccacacaatgctttg

SEQ ID NO: 7156526 - DNA, 22 bp, Homo sapiens
agtgatggcatatatagatgtg

SEQ ID NO: 7156527 - DNA, 22 bp, Homo sapiens
agtgatggcatcgggtccagca

SEQ ID NO: 7156528 - DNA, 22 bp, Homo sapiens
agtgatggggccctgcactgat

SEQ ID NO: 7156529 - DNA, 22 bp, Homo sapiens
agtgatggggccctgcactgat

SEQ ID NO: 7156530 - DNA, 22 bp, Homo sapiens
agtgatggtttccagtcactga

SEQ ID NO: 7156531 - DNA, 22 bp, Homo sapiens
agtgatgtaacaaacagagtta

SEQ ID NO: 7156532 - DNA, 22 bp, Homo sapiens
agtggccaggaaaggtccagcc

SEQ ID NO: 7156533 - DNA, 22 bp, Homo sapiens
agtggccagtgaaggcggcagc

SEQ ID NO: 7156534 - DNA, 22 bp, Homo sapiens
agtggccagtgctgctctgggg

SEQ ID NO: 7156535 - DNA, 22 bp, Homo sapiens
agtggccagtgaaggcggcagc

SEQ ID NO: 7156536 - DNA, 22 bp, Homo sapiens
agtggccagtgaaggcggcagc

SEQ ID NO: 7156537 - DNA, 22 bp, Homo sapiens
agtggccagtgctgctctgggg

SEQ ID NO: 7156538 - DNA, 22 bp, Homo sapiens
agtggccatccctcaggtaggc

SEQ ID NO: 7156539 - DNA, 22 bp, Homo sapiens
agtggccatccctcaggtaggc

SEQ ID NO: 7156540 - DNA, 22 bp, Homo sapiens
agtggccagtgctgctctgggg

SEQ ID NO: 7156541 - DNA, 22 bp, Homo sapiens
agtggccatccctcaggtaggc

SEQ ID NO: 7156542 - DNA, 22 bp, Homo sapiens
agtggccatccctcaggtaggc

SEQ ID NO: 7156543 - DNA, 22 bp, Homo sapiens
agtggccatggcaggtgagcat

SEQ ID NO: 7156544 - DNA, 22 bp, Homo sapiens
agtggccatggcaggtgagcat

SEQ ID NO: 7156545 - DNA, 22 bp, Homo sapiens
agtggccccacagtagggctta

SEQ ID NO: 7156546 - DNA, 22 bp, Homo sapiens
agtggccccacagtagggctta

SEQ ID NO: 7156547 - DNA, 22 bp, Homo sapiens
agtggcccctagggaacagcct

SEQ ID NO: 7156548 - DNA, 22 bp, Homo sapiens
agtggcccttagtggcaaagtc

SEQ ID NO: 7156549 - DNA, 22 bp, Homo sapiens
agtggctagatcatgagtgagc

SEQ ID NO: 7156550 - DNA, 22 bp, Homo sapiens
agtggctcagagtctattgagg

SEQ ID NO: 7156551 - DNA, 22 bp, Homo sapiens
agtggcggggattagcagtgtt

SEQ ID NO: 7156552 - DNA, 22 bp, Homo sapiens
agtggcctggagccccgcctgg

SEQ ID NO: 7156553 - DNA, 21 bp, Homo sapiens
agtggctctcagcttgctaag

SEQ ID NO: 7156554 - DNA, 22 bp, Homo sapiens
agtggctccaaaccgtagtcat

SEQ ID NO: 7156555 - DNA, 22 bp, Homo sapiens
agtggctctccaagaagtcaca

SEQ ID NO: 7156556 - DNA, 22 bp, Homo sapiens
agtggctcttgggtcactgggc

SEQ ID NO: 7156557 - DNA, 22 bp, Homo sapiens
agtggctcttgggtcactgggc

SEQ ID NO: 7156558 - DNA, 22 bp, Homo sapiens
agtggctcttgggtcactgggc

SEQ ID NO: 7156559 - DNA, 20 bp, Homo sapiens
agtggggagtcaggagtgcc

SEQ ID NO: 7156560 - DNA, 20 bp, Homo sapiens
agtggggagtcaggagtgcc

SEQ ID NO: 7156561 - DNA, 22 bp, Homo sapiens
agtggggagtttccagatgtgt

SEQ ID NO: 7156562 - DNA, 22 bp, Homo sapiens
agtggggccgcggtcctgccct

SEQ ID NO: 7156563 - DNA, 22 bp, Homo sapiens
agtggggccgcggtcctgccct

SEQ ID NO: 7156564 - DNA, 22 bp, Homo sapiens
agtgggtgagcttggtctagat

SEQ ID NO: 7156565 - DNA, 22 bp, Homo sapiens
agtgggtgataagaccaaggag

SEQ ID NO: 7156566 - DNA, 20 bp, Homo sapiens
agtgggtgatgaaggaatag

SEQ ID NO: 7156567 - DNA, 22 bp, Homo sapiens
agtgggtgagcttggtctagat

SEQ ID NO: 7156568 - DNA, 22 bp, Homo sapiens
agtgggtgagcttggtctagat

SEQ ID NO: 7156569 - DNA, 19 bp, Homo sapiens
agtgggtaatagaggctcc

SEQ ID NO: 7156570 - DNA, 19 bp, Homo sapiens
agtgggtaatagaggctcc

SEQ ID NO: 7156571 - DNA, 22 bp, Homo sapiens
agtgggtactgggcaggcagag

SEQ ID NO: 7156572 - DNA, 22 bp, Homo sapiens
agtgggtactgggcaggcagag

SEQ ID NO: 7156573 - DNA, 22 bp, Homo sapiens
agtgggtaggcctctggtgcct

SEQ ID NO: 7156574 - DNA, 22 bp, Homo sapiens
agtgggtaggcctctggtgcct

SEQ ID NO: 7156575 - DNA, 22 bp, Homo sapiens
agtgggtagggccagatacctt

SEQ ID NO: 7156576 - DNA, 22 bp, Homo sapiens
agtgggtaggcctctggtgcct

SEQ ID NO: 7156577 - DNA, 22 bp, Homo sapiens
agtgggtgacagtgaacacgta

SEQ ID NO: 7156578 - DNA, 22 bp, Homo sapiens
agtgggtgacagtgaacacgta

SEQ ID NO: 7156579 - DNA, 22 bp, Homo sapiens
agtgggtgacagttaacaggtt

SEQ ID NO: 7156580 - DNA, 22 bp, Homo sapiens
agtgggtgagcttggtctagat

SEQ ID NO: 7156581 - DNA, 22 bp, Homo sapiens
agtgggtgagcttggtctagat

SEQ ID NO: 7156582 - DNA, 22 bp, Homo sapiens
agtggtagagtcaaggttgtaa

SEQ ID NO: 7156583 - DNA, 22 bp, Homo sapiens
agtggtagacaatttaaaaata

SEQ ID NO: 7156584 - DNA, 19 bp, Homo sapiens
agtggtagatgagcaggag

SEQ ID NO: 7156585 - DNA, 22 bp, Homo sapiens
agtgggtgtagtcttcctcctg

SEQ ID NO: 7156586 - DNA, 22 bp, Homo sapiens
agtggtagaaaatgcagctcga

SEQ ID NO: 7156587 - DNA, 22 bp, Homo sapiens
agtggtagagagatactttagg

SEQ ID NO: 7156588 - DNA, 22 bp, Homo sapiens
agtggtagcattgggacttgca

SEQ ID NO: 7156589 - DNA, 22 bp, Homo sapiens
agtggtcctgcaaacccgtgtg

SEQ ID NO: 7156590 - DNA, 22 bp, Homo sapiens
agtggtcctcagcctcggctca

SEQ ID NO: 7156591 - DNA, 22 bp, Homo sapiens
agtggtccttaagctgctgggt

SEQ ID NO: 7156592 - DNA, 22 bp, Homo sapiens
agtgggtgcaaccatggctagg

SEQ ID NO: 7156593 - DNA, 20 bp, Homo sapiens
agtgggtgatgaaggaatag

SEQ ID NO: 7156594 - DNA, 22 bp, Homo sapiens
agtgggtgcaaccatggctagg

SEQ ID NO: 7156595 - DNA, 22 bp, Homo sapiens
agtgggtgcaaccatggctagg

SEQ ID NO: 7156596 - DNA, 22 bp, Homo sapiens
agtgggtggcgcagaggaggaa

SEQ ID NO: 7156597 - DNA, 22 bp, Homo sapiens
agtgggtggcgcagaggaggaa

SEQ ID NO: 7156598 - DNA, 22 bp, Homo sapiens
agtgggtggcgcagaggaggaa

SEQ ID NO: 7156599 - DNA, 22 bp, Homo sapiens
agtgggtggcgcagaggaggaa

SEQ ID NO: 7156600 - DNA, 22 bp, Homo sapiens
agtgggtgggtgtctgacagtt

SEQ ID NO: 7156601 - DNA, 22 bp, Homo sapiens
agtgggtgggtgtctgacagtt

SEQ ID NO: 7156602 - DNA, 22 bp, Homo sapiens
agtgggtgggtgtctgacagtt

SEQ ID NO: 7156603 - DNA, 22 bp, Homo sapiens
agtgggtgggtgtctgacagtt

SEQ ID NO: 7156604 - DNA, 22 bp, Homo sapiens
agtgggtgggtgtctgacagtt

SEQ ID NO: 7156605 - DNA, 22 bp, Homo sapiens
agtgggtgggtgtctgacagtt

SEQ ID NO: 7156606 - DNA, 20 bp, Homo sapiens
agtgggtgtaagttattgcc

SEQ ID NO: 7156607 - DNA, 20 bp, Homo sapiens
agtgggtgtaagttattgcc

SEQ ID NO: 7156608 - DNA, 22 bp, Homo sapiens
ctctggagttcttcaagctact

SEQ ID NO: 7156609 - DNA, 22 bp, Homo sapiens
ctctggagttctcatgaggaac

SEQ ID NO: 7156610 - DNA, 22 bp, Homo sapiens
ctctggagttctcatgaggaac

SEQ ID NO: 7156611 - DNA, 22 bp, Homo sapiens
ctctggagttctcatgaggaac

SEQ ID NO: 7156612 - DNA, 22 bp, Homo sapiens
ctctggagttcttcaagctact

SEQ ID NO: 7156613 - DNA, 20 bp, Homo sapiens
ctctggagttggggaacatt

SEQ ID NO: 7156614 - DNA, 20 bp, Homo sapiens
ctctggagttggggaacatt

SEQ ID NO: 7156615 - DNA, 20 bp, Homo sapiens
ctctggagttggggaacatt

SEQ ID NO: 7156616 - DNA, 20 bp, Homo sapiens
ctctggagttggggaacatt

SEQ ID NO: 7156617 - DNA, 21 bp, Homo sapiens
ctctggagtttgaaggctggg

SEQ ID NO: 7156618 - DNA, 22 bp, Homo sapiens
ctctggagtgggtggccgggag

SEQ ID NO: 7156619 - DNA, 22 bp, Homo sapiens
ctctggagtgtctggccagggt

SEQ ID NO: 7156620 - DNA, 22 bp, Homo sapiens
ctctggagtgtctggccagggt

SEQ ID NO: 7156621 - DNA, 22 bp, Homo sapiens
ctctggagtgtctggccagggt

SEQ ID NO: 7156622 - DNA, 22 bp, Homo sapiens
ctctggagttagtgatctgggc

SEQ ID NO: 7156623 - DNA, 22 bp, Homo sapiens
ctctggagttcccttgatctga

SEQ ID NO: 7156624 - DNA, 22 bp, Homo sapiens
ctctggagttcccttgatctga

SEQ ID NO: 7156625 - DNA, 22 bp, Homo sapiens
ctctggagtgtctggccagggt

SEQ ID NO: 7156626 - DNA, 19 bp, Homo sapiens
agtgtgagactccatctca

SEQ ID NO: 7156627 - DNA, 22 bp, Homo sapiens
agtgtgagatgattgaggagca

SEQ ID NO: 7156628 - DNA, 22 bp, Homo sapiens
agtgtgagatgattgaggagca

SEQ ID NO: 7156629 - DNA, 22 bp, Homo sapiens
agtgtctttgacacattcaaag

SEQ ID NO: 7156630 - DNA, 22 bp, Homo sapiens
agtgtctttgtctctcaagcac

SEQ ID NO: 7156631 - DNA, 22 bp, Homo sapiens
agtgtgacataagagccctgga

SEQ ID NO: 7156632 - DNA, 22 bp, Homo sapiens
agtgtgacataagagccctgga

SEQ ID NO: 7156633 - DNA, 22 bp, Homo sapiens
agtgtgagctaatagcagagcc

SEQ ID NO: 7156634 - DNA, 22 bp, Homo sapiens
agtgtgagctaatagcagagcc

SEQ ID NO: 7156635 - DNA, 22 bp, Homo sapiens
agtgtgagcctacaggccaaag

SEQ ID NO: 7156636 - DNA, 22 bp, Homo sapiens
agtgtgagtaattcagggaggg

SEQ ID NO: 7156637 - DNA, 22 bp, Homo sapiens
agtgtgagtaattcagggaggg

SEQ ID NO: 7156638 - DNA, 22 bp, Homo sapiens
agtgtgagtaattcagggaggg

SEQ ID NO: 7156639 - DNA, 22 bp, Homo sapiens
agtgtgagtaattcagggaggg

SEQ ID NO: 7156640 - DNA, 22 bp, Homo sapiens
agtgtgagctaatagcagagcc

SEQ ID NO: 7156641 - DNA, 22 bp, Homo sapiens
agtgtgagtaattcagggaggg

SEQ ID NO: 7156642 - DNA, 22 bp, Homo sapiens
agtgtcccctacagaggcattc

SEQ ID NO: 7156643 - DNA, 22 bp, Homo sapiens
agtgtcctacagctcctgcctg

SEQ ID NO: 7156644 - DNA, 22 bp, Homo sapiens
agtgtcctagcaagccggtcct

SEQ ID NO: 7156645 - DNA, 22 bp, Homo sapiens
agtgtcctagcaagccggtcct

SEQ ID NO: 7156646 - DNA, 19 bp, Homo sapiens
agtgtcctagtcatttgcc

SEQ ID NO: 7156647 - DNA, 22 bp, Homo sapiens
agtgtcctcaggctttgttcct

SEQ ID NO: 7156648 - DNA, 19 bp, Homo sapiens
agtgtcctagtcatttgcc

SEQ ID NO: 7156649 - DNA, 22 bp, Homo sapiens
agtgtcctcaggctttgttcct

SEQ ID NO: 7156650 - DNA, 22 bp, Homo sapiens
agtgtcctcatctgtaaaatga

SEQ ID NO: 7156651 - DNA, 22 bp, Homo sapiens
agtgtctgggctcccttggagc

SEQ ID NO: 7156652 - DNA, 22 bp, Homo sapiens
agtgtctgggctcccttggagc

SEQ ID NO: 7156653 - DNA, 22 bp, Homo sapiens
agtgtctggtctctgaactaaa

SEQ ID NO: 7156654 - DNA, 22 bp, Homo sapiens
agtgtctggtctctgaactaaa

SEQ ID NO: 7156655 - DNA, 22 bp, Homo sapiens
agtgtcctctattatgacttta

SEQ ID NO: 7156656 - DNA, 22 bp, Homo sapiens
agtgtcctcctctgggagccag

SEQ ID NO: 7156657 - DNA, 22 bp, Homo sapiens
agtgtctttggctaagtgctgt

SEQ ID NO: 7156658 - DNA, 22 bp, Homo sapiens
agtgtctttggctaagtgctgt

SEQ ID NO: 7156659 - DNA, 17 bp, Homo sapiens
agtgtcagaagacagtt

SEQ ID NO: 7156660 - DNA, 22 bp, Homo sapiens
agtgtcacaaacctgccttgta

SEQ ID NO: 7156661 - DNA, 22 bp, Homo sapiens
agtgtcagctaattattcatga

SEQ ID NO: 7156662 - DNA, 18 bp, Homo sapiens
agtgtcagctgcagctca

SEQ ID NO: 7156663 - DNA, 22 bp, Homo sapiens
agtgtcagttgccttgtcataa

SEQ ID NO: 7156664 - DNA, 22 bp, Homo sapiens
agtgtcatcgtgaaaacatagc

SEQ ID NO: 7156665 - DNA, 22 bp, Homo sapiens
agtgtcatttccacgacattca

SEQ ID NO: 7156666 - DNA, 22 bp, Homo sapiens
agtgtacaaaatgatagataaa

SEQ ID NO: 7156667 - DNA, 22 bp, Homo sapiens
agtgtacaaaatgatagataaa

SEQ ID NO: 7156668 - DNA, 21 bp, Homo sapiens
ctctggagtttgaaggctggg

SEQ ID NO: 7156669 - DNA, 22 bp, Homo sapiens
agtgtacaaaatgatagataaa

SEQ ID NO: 7156670 - DNA, 22 bp, Homo sapiens
agtgtattatgcagcggaggtc

SEQ ID NO: 7156671 - DNA, 22 bp, Homo sapiens
agtgtattcagaatgtagcaaa

SEQ ID NO: 7156672 - DNA, 22 bp, Homo sapiens
agtgtattgattggaacagcct

SEQ ID NO: 7156673 - DNA, 22 bp, Homo sapiens
agtgtatttgcctataaaaatg

SEQ ID NO: 7156674 - DNA, 22 bp, Homo sapiens
agtgtatttgcctataaaaatg

SEQ ID NO: 7156675 - DNA, 20 bp, Homo sapiens
agtgtatttgggtagagtgt

SEQ ID NO: 7156676 - DNA, 19 bp, Homo sapiens
agtgtatttttttctgtag

SEQ ID NO: 7156677 - DNA, 22 bp, Homo sapiens
agtgtcaactcggaataaggat

SEQ ID NO: 7156678 - DNA, 22 bp, Homo sapiens
ctgagctgctcccgctgcagcg

SEQ ID NO: 7156679 - DNA, 22 bp, Homo sapiens
ctgagctgctcccgctgcagcg

SEQ ID NO: 7156680 - DNA, 22 bp, Homo sapiens
ctgagctgctcccgctgcagcg

SEQ ID NO: 7156681 - DNA, 22 bp, Homo sapiens
ctgagctgctttgcttttgggg

SEQ ID NO: 7156682 - DNA, 22 bp, Homo sapiens
agttatttcagtaacataatag

SEQ ID NO: 7156683 - DNA, 22 bp, Homo sapiens
agttatttcagtaacataatag

SEQ ID NO: 7156684 - DNA, 22 bp, Homo sapiens
ctgagctgaaacttgagaggct

SEQ ID NO: 7156685 - DNA, 22 bp, Homo sapiens
ctgagctgacatcttcctcttt

SEQ ID NO: 7156686 - DNA, 22 bp, Homo sapiens
ctgagctgcagtcctggctctg

SEQ ID NO: 7156687 - DNA, 22 bp, Homo sapiens
agttcatgtggtttaacttaat

SEQ ID NO: 7156688 - DNA, 22 bp, Homo sapiens
agttcatgtggtttaacttaat

SEQ ID NO: 7156689 - DNA, 22 bp, Homo sapiens
agttcatggaagattcaatgga

SEQ ID NO: 7156690 - DNA, 22 bp, Homo sapiens
agttcatggaagattcaatgga

SEQ ID NO: 7156691 - DNA, 23 bp, Homo sapiens
agttcataatttcttatttgtgt

SEQ ID NO: 7156692 - DNA, 23 bp, Homo sapiens
agttcataatttcttatttgtgt

SEQ ID NO: 7156693 - DNA, 19 bp, Homo sapiens
agttatttctaaatttacc

SEQ ID NO: 7156694 - DNA, 19 bp, Homo sapiens
agttatttctaaatttacc

SEQ ID NO: 7156695 - DNA, 22 bp, Homo sapiens
agttcatttaaatcaggtactt

SEQ ID NO: 7156696 - DNA, 22 bp, Homo sapiens
agttcattttatttgtcagggt

SEQ ID NO: 7156697 - DNA, 19 bp, Homo sapiens
agttccacactttatctgg

SEQ ID NO: 7156698 - DNA, 20 bp, Homo sapiens
agttccacatggctggggag

SEQ ID NO: 7156699 - DNA, 20 bp, Homo sapiens
agttccacatggctggggag

SEQ ID NO: 7156700 - DNA, 22 bp, Homo sapiens
agttccaccatttaggatctgt

SEQ ID NO: 7156701 - DNA, 22 bp, Homo sapiens
agttccactgatggcctacaaa

SEQ ID NO: 7156702 - DNA, 22 bp, Homo sapiens
agttccactgatggcctacaaa

SEQ ID NO: 7156703 - DNA, 22 bp, Homo sapiens
agttccctccacaacttctcac

SEQ ID NO: 7156704 - DNA, 22 bp, Homo sapiens
agttccctccacaacttctcac

SEQ ID NO: 7156705 - DNA, 22 bp, Homo sapiens
agttccctggatgagctaaaaa

SEQ ID NO: 7156706 - DNA, 22 bp, Homo sapiens
agttccagctgtgaccagaaaa

SEQ ID NO: 7156707 - DNA, 22 bp, Homo sapiens
agttccatccttccactgccct

SEQ ID NO: 7156708 - DNA, 22 bp, Homo sapiens
ctgagcagccccaccagccatt

SEQ ID NO: 7156709 - DNA, 22 bp, Homo sapiens
agttaactattttaagattgtt

SEQ ID NO: 7156710 - DNA, 22 bp, Homo sapiens
agttaactcattttataatgcc

SEQ ID NO: 7156711 - DNA, 19 bp, Homo sapiens
ctgagcagcggcagcactt

SEQ ID NO: 7156712 - DNA, 22 bp, Homo sapiens
ctgagccaaggggacagtgaca

SEQ ID NO: 7156713 - DNA, 22 bp, Homo sapiens
agttaacacagtcaggagtaac

SEQ ID NO: 7156714 - DNA, 22 bp, Homo sapiens
agttaacacatccagaatagag

SEQ ID NO: 7156715 - DNA, 22 bp, Homo sapiens
agttaacacatccagaatagag

SEQ ID NO: 7156716 - DNA, 22 bp, Homo sapiens
agttaactaaactgtgagtaaa

SEQ ID NO: 7156717 - DNA, 22 bp, Homo sapiens
ctgagccagcgggctcactttt

SEQ ID NO: 7156718 - DNA, 22 bp, Homo sapiens
ctgagccagcgggctcactttt

SEQ ID NO: 7156719 - DNA, 22 bp, Homo sapiens
ctgagccagcgggctcactttt

SEQ ID NO: 7156720 - DNA, 22 bp, Homo sapiens
ctgagccagagggagtcgggtc

SEQ ID NO: 7156721 - DNA, 22 bp, Homo sapiens
ctgagccagagggagtcgggtc

SEQ ID NO: 7156722 - DNA, 22 bp, Homo sapiens
ctgagccaaggggacagtgaca

SEQ ID NO: 7156723 - DNA, 22 bp, Homo sapiens
ctgagccaccggcagggacatc

SEQ ID NO: 7156724 - DNA, 22 bp, Homo sapiens
ctgagccaccggcagggacatc

SEQ ID NO: 7156725 - DNA, 22 bp, Homo sapiens
ctgagccactgcttgttcagtg

SEQ ID NO: 7156726 - DNA, 22 bp, Homo sapiens
ctgagccactgcttgttcagtg

SEQ ID NO: 7156727 - DNA, 22 bp, Homo sapiens
ctgagctgaaacttgagaggct

SEQ ID NO: 7156728 - DNA, 22 bp, Homo sapiens
ctgagccagggccacacatgga

SEQ ID NO: 7156729 - DNA, 22 bp, Homo sapiens
ctgagctaggagttaggaagct

SEQ ID NO: 7156730 - DNA, 22 bp, Homo sapiens
ctgagccagctggcatgtgcta

SEQ ID NO: 7156731 - DNA, 22 bp, Homo sapiens
ctgagccagctggcatgtgcta

SEQ ID NO: 7156732 - DNA, 22 bp, Homo sapiens
ctgagccagctggcatgtgcta

SEQ ID NO: 7156733 - DNA, 22 bp, Homo sapiens
ctgagccagcgggctcactttt

SEQ ID NO: 7156734 - DNA, 22 bp, Homo sapiens
ctgagccagctggcatgtgcta

SEQ ID NO: 7156735 - DNA, 22 bp, Homo sapiens
ctgagccagctggcatgtgcta

SEQ ID NO: 7156736 - DNA, 22 bp, Homo sapiens
ctgagccagggccacacatgga

SEQ ID NO: 7156737 - DNA, 22 bp, Homo sapiens
ctgagccagggccacacatgga

SEQ ID NO: 7156738 - DNA, 22 bp, Homo sapiens
ctgagccagctggcatgtgcta

SEQ ID NO: 7156739 - DNA, 22 bp, Homo sapiens
ctgagccagctggcatgtgcta

SEQ ID NO: 7156740 - DNA, 19 bp, Homo sapiens
agtgtgagtaattggagtt

SEQ ID NO: 7156741 - DNA, 22 bp, Homo sapiens
agtgtgagttacaaagtgtgaa

SEQ ID NO: 7156742 - DNA, 20 bp, Homo sapiens
agtgtgcatttagagtctgc

SEQ ID NO: 7156743 - DNA, 22 bp, Homo sapiens
agtgtgcccagtaattggctga

SEQ ID NO: 7156744 - DNA, 22 bp, Homo sapiens
agtgtggattggctggagctat

SEQ ID NO: 7156745 - DNA, 22 bp, Homo sapiens
agtgtggatttagttgtgcttt

SEQ ID NO: 7156746 - DNA, 22 bp, Homo sapiens
agtgtggattggctggagctat

SEQ ID NO: 7156747 - DNA, 22 bp, Homo sapiens
agtgtggagccactgagtggct

SEQ ID NO: 7156748 - DNA, 22 bp, Homo sapiens
agtgtggagccactgagtggct

SEQ ID NO: 7156749 - DNA, 22 bp, Homo sapiens
agtgtggagccactgagtggct

SEQ ID NO: 7156750 - DNA, 22 bp, Homo sapiens
agtgtggacttttcctaggagg

SEQ ID NO: 7156751 - DNA, 22 bp, Homo sapiens
agtgtggacttttcctaggagg

SEQ ID NO: 7156752 - DNA, 22 bp, Homo sapiens
agtgtggagcatcgagggcaga

SEQ ID NO: 7156753 - DNA, 22 bp, Homo sapiens
agtgtggagcatcgagggcaga

SEQ ID NO: 7156754 - DNA, 22 bp, Homo sapiens
agtgtgctgcttaaacagttgt

SEQ ID NO: 7156755 - DNA, 22 bp, Homo sapiens
agtgtgctgagcaggtgggggt

SEQ ID NO: 7156756 - DNA, 22 bp, Homo sapiens
agtgtgctgtttccagaagggc

SEQ ID NO: 7156757 - DNA, 22 bp, Homo sapiens
agtgtgcttaagtttatcagga

SEQ ID NO: 7156758 - DNA, 22 bp, Homo sapiens
agtgtgcttaagtttatcagga

SEQ ID NO: 7156759 - DNA, 22 bp, Homo sapiens
agtgtttattagatttcccttt

SEQ ID NO: 7156760 - DNA, 18 bp, Homo sapiens
agtgtttatttaggtgaa

SEQ ID NO: 7156761 - DNA, 18 bp, Homo sapiens
agtgtttatttaggtgaa

SEQ ID NO: 7156762 - DNA, 22 bp, Homo sapiens
agtgtttcaagaagcaggaagt

SEQ ID NO: 7156763 - DNA, 22 bp, Homo sapiens
agtgtttcaagtgatgctttgg

SEQ ID NO: 7156764 - DNA, 22 bp, Homo sapiens
agtgtttatggaatcttagtta

SEQ ID NO: 7156765 - DNA, 22 bp, Homo sapiens
agtgtttatggaatcttagtta

SEQ ID NO: 7156766 - DNA, 19 bp, Homo sapiens
agtgtttatgtagtgccta

SEQ ID NO: 7156767 - DNA, 18 bp, Homo sapiens
agtgttctcgttttataa

SEQ ID NO: 7156768 - DNA, 22 bp, Homo sapiens
agtgtggcaggaatgactagaa

SEQ ID NO: 7156769 - DNA, 22 bp, Homo sapiens
agtgtggccaatgaggatgggc

SEQ ID NO: 7156770 - DNA, 22 bp, Homo sapiens
agtgtggccaatgaggatgggc

SEQ ID NO: 7156771 - DNA, 22 bp, Homo sapiens
agtgtgggccacgcagctgagc

SEQ ID NO: 7156772 - DNA, 22 bp, Homo sapiens
agtgtgggccacgcagctgagc

SEQ ID NO: 7156773 - DNA, 22 bp, Homo sapiens
agtgtgggccacgcagctgagc

SEQ ID NO: 7156774 - DNA, 22 bp, Homo sapiens
agtgtgggccacgcagctgagc

SEQ ID NO: 7156775 - DNA, 22 bp, Homo sapiens
agtgtgggcccccaggttagcc

SEQ ID NO: 7156776 - DNA, 22 bp, Homo sapiens
agtgtgggcccccaggttagcc

SEQ ID NO: 7156777 - DNA, 22 bp, Homo sapiens
agtgtgggcccccaggttagcc

SEQ ID NO: 7156778 - DNA, 22 bp, Homo sapiens
agtgtgggggctttggtgtcac

SEQ ID NO: 7156779 - DNA, 22 bp, Homo sapiens
agtgtttgggggccttgtaaca

SEQ ID NO: 7156780 - DNA, 22 bp, Homo sapiens
agtgtttggggtgattgtaacc

SEQ ID NO: 7156781 - DNA, 22 bp, Homo sapiens
agtgtttgggggccttgtaaca

SEQ ID NO: 7156782 - DNA, 22 bp, Homo sapiens
agtgtttgcatctcattgattt

SEQ ID NO: 7156783 - DNA, 22 bp, Homo sapiens
agtgtttctcagaagggcctat

SEQ ID NO: 7156784 - DNA, 22 bp, Homo sapiens
agtgtttctggaatcagtgttt

SEQ ID NO: 7156785 - DNA, 22 bp, Homo sapiens
agtgtttctggaatcagtgttt

SEQ ID NO: 7156786 - DNA, 22 bp, Homo sapiens
agtgtttctggcaaatgaaagt

SEQ ID NO: 7156787 - DNA, 22 bp, Homo sapiens
agtgtttctgtgccccagtgtt

SEQ ID NO: 7156788 - DNA, 22 bp, Homo sapiens
agtgtttgagacacatttcact

SEQ ID NO: 7156789 - DNA, 22 bp, Homo sapiens
agtgtttcaatcctaggggttg

SEQ ID NO: 7156790 - DNA, 22 bp, Homo sapiens
agtgtttcacagcactttttct

SEQ ID NO: 7156791 - DNA, 22 bp, Homo sapiens
agtgtttcaccgtatgttctca

SEQ ID NO: 7156792 - DNA, 19 bp, Homo sapiens
agtgtttcatgtgctttta

SEQ ID NO: 7156793 - DNA, 22 bp, Homo sapiens
agtgtttcccagtaggatgaaa

SEQ ID NO: 7156794 - DNA, 22 bp, Homo sapiens
agtgtttcctgagtgttatcat

SEQ ID NO: 7156795 - DNA, 17 bp, Homo sapiens
agtgtttccttatcatt

SEQ ID NO: 7156796 - DNA, 17 bp, Homo sapiens
agtgtttccttatcatt

SEQ ID NO: 7156797 - DNA, 22 bp, Homo sapiens
agtgtttctaagtagatgtgaa

SEQ ID NO: 7156798 - DNA, 20 bp, Homo sapiens
agtgtttctcaacatggggc

SEQ ID NO: 7156799 - DNA, 20 bp, Homo sapiens
agtgtttctcaacatggggc

SEQ ID NO: 7156800 - DNA, 20 bp, Homo sapiens
agtgtttctcaacatggggc

SEQ ID NO: 7156801 - DNA, 22 bp, Homo sapiens
agtgtttgtcccgttagaaatg

SEQ ID NO: 7156802 - DNA, 22 bp, Homo sapiens
agtgttttattagaacacagcc

SEQ ID NO: 7156803 - DNA, 22 bp, Homo sapiens
agtgttttattagaacacagcc

SEQ ID NO: 7156804 - DNA, 22 bp, Homo sapiens
agtgttttattagaacacagcc

SEQ ID NO: 7156805 - DNA, 22 bp, Homo sapiens
agtgttttattagaacacagcc

SEQ ID NO: 7156806 - DNA, 22 bp, Homo sapiens
agtgttttatttcagcactttg

SEQ ID NO: 7156807 - DNA, 22 bp, Homo sapiens
agtgttttatttcagcactttg

SEQ ID NO: 7156808 - DNA, 22 bp, Homo sapiens
agtgttttatttcagcactttg

SEQ ID NO: 7156809 - DNA, 22 bp, Homo sapiens
agtgttttgctaatcctattaa

SEQ ID NO: 7156810 - DNA, 22 bp, Homo sapiens
agtgttttggagtgggaaggca

SEQ ID NO: 7156811 - DNA, 22 bp, Homo sapiens
agtgtttttacaagcactctgg

SEQ ID NO: 7156812 - DNA, 22 bp, Homo sapiens
agtgtttttcaggagcagaaca

SEQ ID NO: 7156813 - DNA, 22 bp, Homo sapiens
agtgtttttgggtagggtgagt

SEQ ID NO: 7156814 - DNA, 21 bp, Homo sapiens
agttaaacctttagagaacta

SEQ ID NO: 7156815 - DNA, 22 bp, Homo sapiens
agttaaactctagtagatacaa

SEQ ID NO: 7156816 - DNA, 22 bp, Homo sapiens
agttaaactctagtagatacaa

SEQ ID NO: 7156817 - DNA, 22 bp, Homo sapiens
agttaaacttgcctttattcct

SEQ ID NO: 7156818 - DNA, 22 bp, Homo sapiens
agttaaactttgccagatggga

SEQ ID NO: 7156819 - DNA, 22 bp, Homo sapiens
agttaaatcatggccattggaa

SEQ ID NO: 7156820 - DNA, 22 bp, Homo sapiens
agttaaatcattactgacagag

SEQ ID NO: 7156821 - DNA, 22 bp, Homo sapiens
agttaaatcattactgacagag

SEQ ID NO: 7156822 - DNA, 22 bp, Homo sapiens
agttaaatgtcagtagcttaac

SEQ ID NO: 7156823 - DNA, 22 bp, Homo sapiens
agttaaatgtgttagccagggt

SEQ ID NO: 7156824 - DNA, 22 bp, Homo sapiens
agttaacaagttggcaatcaac

SEQ ID NO: 7156825 - DNA, 22 bp, Homo sapiens
agttaacacaagtaagattcca

SEQ ID NO: 7156826 - DNA, 22 bp, Homo sapiens
agttaacacaagtaagattcca

SEQ ID NO: 7156827 - DNA, 22 bp, Homo sapiens
aggtggcagcagcctggtgaaa

SEQ ID NO: 7156828 - DNA, 22 bp, Homo sapiens
aggtggcagcaggagatgtgga

SEQ ID NO: 7156829 - DNA, 22 bp, Homo sapiens
aggtggcagcaggagatgtgga

SEQ ID NO: 7156830 - DNA, 22 bp, Homo sapiens
aggtggcagcagaatcagggag

SEQ ID NO: 7156831 - DNA, 22 bp, Homo sapiens
aggtggcagcagcctggtgaaa

SEQ ID NO: 7156832 - DNA, 22 bp, Homo sapiens
aggtggcagatgggggtgctcg

SEQ ID NO: 7156833 - DNA, 22 bp, Homo sapiens
aggtggcagatgggggtgctcg

SEQ ID NO: 7156834 - DNA, 22 bp, Homo sapiens
aggtggcagagtgacaggctga

SEQ ID NO: 7156835 - DNA, 22 bp, Homo sapiens
aggtggcagcagaatcagggag

SEQ ID NO: 7156836 - DNA, 22 bp, Homo sapiens
ccttcattgcatctttaagaga

SEQ ID NO: 7156837 - DNA, 22 bp, Homo sapiens
cctgtttggtacaatctgccaa

SEQ ID NO: 7156838 - DNA, 22 bp, Homo sapiens
aggtggcaggaggtcagagaaa

SEQ ID NO: 7156839 - DNA, 22 bp, Homo sapiens
ccttccagagttcagtctgccc

SEQ ID NO: 7156840 - DNA, 22 bp, Homo sapiens
ccttccagatgtaagagctgat

SEQ ID NO: 7156841 - DNA, 22 bp, Homo sapiens
ccttccagagttcagtctgccc

SEQ ID NO: 7156842 - DNA, 22 bp, Homo sapiens
ccttccagaggcgtgacaccct

SEQ ID NO: 7156843 - DNA, 22 bp, Homo sapiens
ccttccagagttcagtctgccc

SEQ ID NO: 7156844 - DNA, 22 bp, Homo sapiens
ccttccagaaagcacttagtta

SEQ ID NO: 7156845 - DNA, 22 bp, Homo sapiens
ccttccaagtgctgctttttcc

SEQ ID NO: 7156846 - DNA, 22 bp, Homo sapiens
ccttccaggagtctctgcaggt

SEQ ID NO: 7156847 - DNA, 22 bp, Homo sapiens
ccttccaggctggaggcttggg

SEQ ID NO: 7156848 - DNA, 22 bp, Homo sapiens
ccttccaggctggaggcttggg

SEQ ID NO: 7156849 - DNA, 22 bp, Homo sapiens
ccttccagggagcaggcagtgt

SEQ ID NO: 7156850 - DNA, 22 bp, Homo sapiens
ccttccagggagcaggcagtgt

SEQ ID NO: 7156851 - DNA, 22 bp, Homo sapiens
ccttccagggagcaggcagtgt

SEQ ID NO: 7156852 - DNA, 22 bp, Homo sapiens
ccttccagggctctccagaacc

SEQ ID NO: 7156853 - DNA, 22 bp, Homo sapiens
ccttccagggctctccagaacc

SEQ ID NO: 7156854 - DNA, 22 bp, Homo sapiens
ccttccagccccatctcatcgt

SEQ ID NO: 7156855 - DNA, 22 bp, Homo sapiens
ccttccaggagtctctgcaggt

SEQ ID NO: 7156856 - DNA, 22 bp, Homo sapiens
ccttccaggagtctctgcaggt

SEQ ID NO: 7156857 - DNA, 22 bp, Homo sapiens
cctgtggggctgaaagaggctt

SEQ ID NO: 7156858 - DNA, 22 bp, Homo sapiens
cctgtggggctgaaagaggctt

SEQ ID NO: 7156859 - DNA, 22 bp, Homo sapiens
cctgtgggtacaacagggtcac

SEQ ID NO: 7156860 - DNA, 22 bp, Homo sapiens
cctgtgggtacaacagggtcac

SEQ ID NO: 7156861 - DNA, 22 bp, Homo sapiens
cctgtgggtacaacagggtcac

SEQ ID NO: 7156862 - DNA, 22 bp, Homo sapiens
aggtggcaaggggcgcctctct

SEQ ID NO: 7156863 - DNA, 22 bp, Homo sapiens
aggtggcaaggggcgcctctct

SEQ ID NO: 7156864 - DNA, 22 bp, Homo sapiens
aggtggcaaggggcgcctctct

SEQ ID NO: 7156865 - DNA, 22 bp, Homo sapiens
cctgtgggcttgagtgtagggt

SEQ ID NO: 7156866 - DNA, 22 bp, Homo sapiens
cctgtggggagagatctcttag

SEQ ID NO: 7156867 - DNA, 22 bp, Homo sapiens
cctgtggggccatctcagtcac

SEQ ID NO: 7156868 - DNA, 22 bp, Homo sapiens
aggtggcagagctggcccagcg

SEQ ID NO: 7156869 - DNA, 22 bp, Homo sapiens
aggtggcagactaacagaagga

SEQ ID NO: 7156870 - DNA, 22 bp, Homo sapiens
aggtggcagagctggcccagcg

SEQ ID NO: 7156871 - DNA, 22 bp, Homo sapiens
aggtggcagagtgacaggctga

SEQ ID NO: 7156872 - DNA, 22 bp, Homo sapiens
aggtggcagagtgacaggctga

SEQ ID NO: 7156873 - DNA, 22 bp, Homo sapiens
aggtggcagagtgacaggctga

SEQ ID NO: 7156874 - DNA, 22 bp, Homo sapiens
aggtggcagaggactcctcctg

SEQ ID NO: 7156875 - DNA, 22 bp, Homo sapiens
cctgtgggaggttctgtgagtc

SEQ ID NO: 7156876 - DNA, 22 bp, Homo sapiens
cctgtgggaggttctgtgagtc

SEQ ID NO: 7156877 - DNA, 22 bp, Homo sapiens
cctgtgggaggttctgtgagtc

SEQ ID NO: 7156878 - DNA, 23 bp, Homo sapiens
cctgtgggatggcttaatatttt

SEQ ID NO: 7156879 - DNA, 22 bp, Homo sapiens
cctgtgggaggggcctggcgcg

SEQ ID NO: 7156880 - DNA, 22 bp, Homo sapiens
cctgtgggagcccaggcagata

SEQ ID NO: 7156881 - DNA, 22 bp, Homo sapiens
cctgtgggagggagcggctgga

SEQ ID NO: 7156882 - DNA, 22 bp, Homo sapiens
cctgtgggcctgcacgtgggga

SEQ ID NO: 7156883 - DNA, 22 bp, Homo sapiens
cctgtgggcgcagctggagtca

SEQ ID NO: 7156884 - DNA, 22 bp, Homo sapiens
cctgtgggcctgcacgtgggga

SEQ ID NO: 7156885 - DNA, 22 bp, Homo sapiens
cctgtgggctgagaacaagggc

SEQ ID NO: 7156886 - DNA, 22 bp, Homo sapiens
cctgtgggccaaggacctgcca

SEQ ID NO: 7156887 - DNA, 22 bp, Homo sapiens
cctgtgggccaaggacctgcca

SEQ ID NO: 7156888 - DNA, 22 bp, Homo sapiens
cctgtgggccctggacagagac

SEQ ID NO: 7156889 - DNA, 22 bp, Homo sapiens
cctgtgggccctggacagagac

SEQ ID NO: 7156890 - DNA, 22 bp, Homo sapiens
aggtgcagcatgagtccaacgg

SEQ ID NO: 7156891 - DNA, 21 bp, Homo sapiens
aggtgcagaggcctcactcac

SEQ ID NO: 7156892 - DNA, 23 bp, Homo sapiens
aggtgcagccctggacctgcccc

SEQ ID NO: 7156893 - DNA, 18 bp, Homo sapiens
aggtgcagcctctgaggc

SEQ ID NO: 7156894 - DNA, 22 bp, Homo sapiens
aggtgcagctggtggagtctgg

SEQ ID NO: 7156895 - DNA, 22 bp, Homo sapiens
aggtgcagctggtggagtctgg

SEQ ID NO: 7156896 - DNA, 22 bp, Homo sapiens
aggtgcagctggtggagtctgg

SEQ ID NO: 7156897 - DNA, 22 bp, Homo sapiens
aggtgcagctgacaccatgtgg

SEQ ID NO: 7156898 - DNA, 18 bp, Homo sapiens
aggtgcagcctctgaggc

SEQ ID NO: 7156899 - DNA, 21 bp, Homo sapiens
cctgtgccagtctatgtgttc

SEQ ID NO: 7156900 - DNA, 22 bp, Homo sapiens
aggtgcaggagctgtgcaggga

SEQ ID NO: 7156901 - DNA, 22 bp, Homo sapiens
cctgtgccagctgggccctgcc

SEQ ID NO: 7156902 - DNA, 22 bp, Homo sapiens
aggtgcagctggtggagtctgg

SEQ ID NO: 7156903 - DNA, 22 bp, Homo sapiens
aggtgcagctggtggagtctgg

SEQ ID NO: 7156904 - DNA, 22 bp, Homo sapiens
aggtgcagctggtggagtctgg

SEQ ID NO: 7156905 - DNA, 17 bp, Homo sapiens
aggtgcagaggcagagc

SEQ ID NO: 7156906 - DNA, 17 bp, Homo sapiens
aggtgcagaggcagagc

SEQ ID NO: 7156907 - DNA, 17 bp, Homo sapiens
aggtgcagaggcagagc

SEQ ID NO: 7156908 - DNA, 17 bp, Homo sapiens
aggtgcagaggcagagc

SEQ ID NO: 7156909 - DNA, 17 bp, Homo sapiens
aggtgcagaggcagagc

SEQ ID NO: 7156910 - DNA, 17 bp, Homo sapiens
aggtgcagaggcagagc

SEQ ID NO: 7156911 - DNA, 22 bp, Homo sapiens
cctggggtcagggacgctgtgc

SEQ ID NO: 7156912 - DNA, 22 bp, Homo sapiens
cctggggtcacttgcagccgca

SEQ ID NO: 7156913 - DNA, 22 bp, Homo sapiens
cctggggtatataggtgaatat

SEQ ID NO: 7156914 - DNA, 22 bp, Homo sapiens
cctggggctttctttgtatcat

SEQ ID NO: 7156915 - DNA, 22 bp, Homo sapiens
cctggggctttctttgtatcat

SEQ ID NO: 7156916 - DNA, 22 bp, Homo sapiens
cctggggctctgcacagagcag

SEQ ID NO: 7156917 - DNA, 22 bp, Homo sapiens
cctggggctctgcacagagcag

SEQ ID NO: 7156918 - DNA, 22 bp, Homo sapiens
cctggggctctgcacagagcag

SEQ ID NO: 7156919 - DNA, 22 bp, Homo sapiens
cctgggggccaggaaggtgtga

SEQ ID NO: 7156920 - DNA, 22 bp, Homo sapiens
cctgggctttgagggcaggatg

SEQ ID NO: 7156921 - DNA, 22 bp, Homo sapiens
cctggggctccagagcagcgga

SEQ ID NO: 7156922 - DNA, 22 bp, Homo sapiens
cctggggctccagagcagcgga

SEQ ID NO: 7156923 - DNA, 22 bp, Homo sapiens
cctggggctctgcacagagcag

SEQ ID NO: 7156924 - DNA, 22 bp, Homo sapiens
cctggggctctgcacagagcag

SEQ ID NO: 7156925 - DNA, 22 bp, Homo sapiens
aggtcctggtcttgagtcttaa

SEQ ID NO: 7156926 - DNA, 22 bp, Homo sapiens
cctgggaggtggaggttgcagt

SEQ ID NO: 7156927 - DNA, 20 bp, Homo sapiens
aggtcctgggactggcagag

SEQ ID NO: 7156928 - DNA, 22 bp, Homo sapiens
aggtaatagggttcagaattat

SEQ ID NO: 7156929 - DNA, 22 bp, Homo sapiens
aggtaatagggttcagaattat

SEQ ID NO: 7156930 - DNA, 22 bp, Homo sapiens
aggtaattactagagttattta

SEQ ID NO: 7156931 - DNA, 22 bp, Homo sapiens
aggtaattactagagttattta

SEQ ID NO: 7156932 - DNA, 22 bp, Homo sapiens
aggtaatttctccaaacatgct

SEQ ID NO: 7156933 - DNA, 22 bp, Homo sapiens
aggtacaaaagagtatatgaga

SEQ ID NO: 7156934 - DNA, 22 bp, Homo sapiens
aggtaattgtatgttccaagca

SEQ ID NO: 7156935 - DNA, 22 bp, Homo sapiens
aggtaattgtatgttccaagca

SEQ ID NO: 7156936 - DNA, 22 bp, Homo sapiens
aggtaattttgtgttaatgatt

SEQ ID NO: 7156937 - DNA, 22 bp, Homo sapiens
aggtaattttgtgttaatgatt

SEQ ID NO: 7156938 - DNA, 22 bp, Homo sapiens
aggtacagatgaaagtctagtt

SEQ ID NO: 7156939 - DNA, 22 bp, Homo sapiens
aggtatttatgagagcacatat

SEQ ID NO: 7156940 - DNA, 22 bp, Homo sapiens
aggtatttatgagagcacatat

SEQ ID NO: 7156941 - DNA, 17 bp, Homo sapiens
aggtatttaaggagctg

SEQ ID NO: 7156942 - DNA, 22 bp, Homo sapiens
aggtatttatgagagcacatat

SEQ ID NO: 7156943 - DNA, 22 bp, Homo sapiens
aggtacagatgaaagtctagtt

SEQ ID NO: 7156944 - DNA, 22 bp, Homo sapiens
aggtacagcaatataagaggtc

SEQ ID NO: 7156945 - DNA, 22 bp, Homo sapiens
aggtattccagtggtcaccaag

SEQ ID NO: 7156946 - DNA, 22 bp, Homo sapiens
aggtcacacttggatcatagaa

SEQ ID NO: 7156947 - DNA, 22 bp, Homo sapiens
aggtaaggctgtaagctaagcc

SEQ ID NO: 7156948 - DNA, 22 bp, Homo sapiens
aggtaagggctgcgactataag

SEQ ID NO: 7156949 - DNA, 22 bp, Homo sapiens
aggtaaggaaattgaggcaatt

SEQ ID NO: 7156950 - DNA, 22 bp, Homo sapiens
aggtaacattgcctccatctga

SEQ ID NO: 7156951 - DNA, 22 bp, Homo sapiens
aggtaactggctaactgaacga

SEQ ID NO: 7156952 - DNA, 22 bp, Homo sapiens
aggtaactgtggctaggtaact

SEQ ID NO: 7156953 - DNA, 22 bp, Homo sapiens
aggtaaattcagcagtgacatt

SEQ ID NO: 7156954 - DNA, 22 bp, Homo sapiens
aggtaacactacttagtatact

SEQ ID NO: 7156955 - DNA, 22 bp, Homo sapiens
aggtaacatgtggtgctataag

SEQ ID NO: 7156956 - DNA, 22 bp, Homo sapiens
cctgaggttgaagtataaattg

SEQ ID NO: 7156957 - DNA, 19 bp, Homo sapiens
cctgaggtggggtggaagg

SEQ ID NO: 7156958 - DNA, 22 bp, Homo sapiens
cctgaggttatccatctacctg

SEQ ID NO: 7156959 - DNA, 18 bp, Homo sapiens
cctgaggtgggaggaagg

SEQ ID NO: 7156960 - DNA, 18 bp, Homo sapiens
cctgaggtgggaggaagg

SEQ ID NO: 7156961 - DNA, 18 bp, Homo sapiens
cctgaggtgggaggaagg

SEQ ID NO: 7156962 - DNA, 22 bp, Homo sapiens
cctgaggtggctgcagcactgc

SEQ ID NO: 7156963 - DNA, 22 bp, Homo sapiens
cctgaggtctagagtcagggtg

SEQ ID NO: 7156964 - DNA, 22 bp, Homo sapiens
cctgagtagctggaattaaagg

SEQ ID NO: 7156965 - DNA, 22 bp, Homo sapiens
agggtgggctagactcttcccc

SEQ ID NO: 7156966 - DNA, 23 bp, Homo sapiens
agggtggcttgctttgcttcctt

SEQ ID NO: 7156967 - DNA, 22 bp, Homo sapiens
agggtgggctagactcttcccc

SEQ ID NO: 7156968 - DNA, 22 bp, Homo sapiens
agggttgcctctgagtgctccg

SEQ ID NO: 7156969 - DNA, 22 bp, Homo sapiens
agggttgcatttttagaggctc

SEQ ID NO: 7156970 - DNA, 22 bp, Homo sapiens
agggttgcaggggccatgccca

SEQ ID NO: 7156971 - DNA, 22 bp, Homo sapiens
agggttgcaccatgttggtcag

SEQ ID NO: 7156972 - DNA, 22 bp, Homo sapiens
agggttgcagcagaggcccagt

SEQ ID NO: 7156973 - DNA, 22 bp, Homo sapiens
agggtgggctagactcttcccc

SEQ ID NO: 7156974 - DNA, 19 bp, Homo sapiens
agggttacccgctgccacc

SEQ ID NO: 7156975 - DNA, 22 bp, Homo sapiens
aggtaaaatagatagtatttct

SEQ ID NO: 7156976 - DNA, 22 bp, Homo sapiens
aggtaaagaaaggtgtaacatt

SEQ ID NO: 7156977 - DNA, 22 bp, Homo sapiens
aggtaaagaaaggtgtaacatt

SEQ ID NO: 7156978 - DNA, 22 bp, Homo sapiens
agggttttcatttctgagcatt

SEQ ID NO: 7156979 - DNA, 22 bp, Homo sapiens
agggttgcttgagcccaggagt

SEQ ID NO: 7156980 - DNA, 22 bp, Homo sapiens
agggtttcttgcttatggtgct

SEQ ID NO: 7156981 - DNA, 22 bp, Homo sapiens
cctgggaggctgtgggtctgct

SEQ ID NO: 7156982 - DNA, 22 bp, Homo sapiens
cctgggaggctgtgggtctgct

SEQ ID NO: 7156983 - DNA, 22 bp, Homo sapiens
cctgggaggctgtttccagcct

SEQ ID NO: 7156984 - DNA, 22 bp, Homo sapiens
cctgggaggctgtgggtctgct

SEQ ID NO: 7156985 - DNA, 22 bp, Homo sapiens
cctgggagggcaagtgctgatg

SEQ ID NO: 7156986 - DNA, 22 bp, Homo sapiens
cctgggagggcaagtgctgatg

SEQ ID NO: 7156987 - DNA, 22 bp, Homo sapiens
cctgggagggcaagtgctgatg

SEQ ID NO: 7156988 - DNA, 22 bp, Homo sapiens
cctgggagggcaagtgctgatg

SEQ ID NO: 7156989 - DNA, 22 bp, Homo sapiens
cctgggagggcaagtgctgatg

SEQ ID NO: 7156990 - DNA, 22 bp, Homo sapiens
cctgggaggtggaggttgcagc

SEQ ID NO: 7156991 - DNA, 22 bp, Homo sapiens
cctgggaggtggaggttgcagc

SEQ ID NO: 7156992 - DNA, 22 bp, Homo sapiens
cctgggaggtggaggttgcagc

SEQ ID NO: 7156993 - DNA, 22 bp, Homo sapiens
cctgggaggtggaggttgcagc

SEQ ID NO: 7156994 - DNA, 22 bp, Homo sapiens
cctgggaggtggaggttgcagt

SEQ ID NO: 7156995 - DNA, 22 bp, Homo sapiens
cctgggaggtggaggttgcagt

SEQ ID NO: 7156996 - DNA, 22 bp, Homo sapiens
cctgggaggtggaggttgcagt

SEQ ID NO: 7156997 - DNA, 22 bp, Homo sapiens
aggtcaggtatcagcaggtatt

SEQ ID NO: 7156998 - DNA, 22 bp, Homo sapiens
aggtcaggtatcagcaggtatt

SEQ ID NO: 7156999 - DNA, 22 bp, Homo sapiens
aggtcaggaggttaagagtctt

SEQ ID NO: 7157000 - DNA, 22 bp, Homo sapiens
aggtcagggtattcacgtctgt

SEQ ID NO: 7157001 - DNA, 22 bp, Homo sapiens
aggtcaggtatcagcaggtatt

SEQ ID NO: 7157002 - DNA, 19 bp, Homo sapiens
aggtcagtggctcaggcat

SEQ ID NO: 7157003 - DNA, 22 bp, Homo sapiens
aggtcagttttaggaaagagca

SEQ ID NO: 7157004 - DNA, 22 bp, Homo sapiens
aggtcataatcagttattcaaa

SEQ ID NO: 7157005 - DNA, 22 bp, Homo sapiens
cctgggagaactgctgggttgg

SEQ ID NO: 7157006 - DNA, 21 bp, Homo sapiens
cctgggagaattgggtgtggc

SEQ ID NO: 7157007 - DNA, 21 bp, Homo sapiens
cctgggagaattgggtgtggc

SEQ ID NO: 7157008 - DNA, 21 bp, Homo sapiens
cctgggagaattgggtgtggc

SEQ ID NO: 7157009 - DNA, 22 bp, Homo sapiens
cctgggaggctgaggctgcagt

SEQ ID NO: 7157010 - DNA, 22 bp, Homo sapiens
cctgggaggctgaggctgcagt

SEQ ID NO: 7157011 - DNA, 22 bp, Homo sapiens
cctgggaggctgaggctgcagt

SEQ ID NO: 7157012 - DNA, 22 bp, Homo sapiens
cctgggaggctgtgggtctgct

SEQ ID NO: 7157013 - DNA, 22 bp, Homo sapiens
cctgggaggctgtgggtctgct

SEQ ID NO: 7157014 - DNA, 22 bp, Homo sapiens
cctgggaggctgtgggtctgct

SEQ ID NO: 7157015 - DNA, 22 bp, Homo sapiens
cctgggaggctgtgggtctgct

SEQ ID NO: 7157016 - DNA, 18 bp, Homo sapiens
aggtcaggaaagcagagt

SEQ ID NO: 7157017 - DNA, 18 bp, Homo sapiens
aggtcaggaaagcagagt

SEQ ID NO: 7157018 - DNA, 22 bp, Homo sapiens
aggtcagctgctgataggcagc

SEQ ID NO: 7157019 - DNA, 22 bp, Homo sapiens
aggtcagctgctgataggcagc

SEQ ID NO: 7157020 - DNA, 18 bp, Homo sapiens
aggtcaggaaagcagagt

SEQ ID NO: 7157021 - DNA, 22 bp, Homo sapiens
aggtcaggaggcctctgccatt

SEQ ID NO: 7157022 - DNA, 22 bp, Homo sapiens
aggtcaggaggcctctgccatt

SEQ ID NO: 7157023 - DNA, 22 bp, Homo sapiens
aggtcaggaggcctctgccatt

SEQ ID NO: 7157024 - DNA, 22 bp, Homo sapiens
aggtcaggaggttaagagtctt

SEQ ID NO: 7157025 - DNA, 22 bp, Homo sapiens
aggtcaggaggttaagagtctt

SEQ ID NO: 7157026 - DNA, 22 bp, Homo sapiens
aggtcagcaggccaggggcgaa

SEQ ID NO: 7157027 - DNA, 22 bp, Homo sapiens
aggtcagcatgctcctctctgt

SEQ ID NO: 7157028 - DNA, 22 bp, Homo sapiens
aggtcagcatgctcctctctgt

SEQ ID NO: 7157029 - DNA, 22 bp, Homo sapiens
aggtcagcatgctcctctctgt

SEQ ID NO: 7157030 - DNA, 21 bp, Homo sapiens
aggtcagcccagctctggaag

SEQ ID NO: 7157031 - DNA, 21 bp, Homo sapiens
aggtcagcccagctctggaag

SEQ ID NO: 7157032 - DNA, 22 bp, Homo sapiens
aggtcagccctctctgggcagg

SEQ ID NO: 7157033 - DNA, 22 bp, Homo sapiens
aggtcagctagacagctctctg

SEQ ID NO: 7157034 - DNA, 22 bp, Homo sapiens
aggtcagctagacagctctctg

SEQ ID NO: 7157035 - DNA, 22 bp, Homo sapiens
aggtcacccgtttgactatcca

SEQ ID NO: 7157036 - DNA, 22 bp, Homo sapiens
aggtcaccatggcatgctccac

SEQ ID NO: 7157037 - DNA, 22 bp, Homo sapiens
aggtcaccatggcatgctccac

SEQ ID NO: 7157038 - DNA, 22 bp, Homo sapiens
aggtcagaaaaggagagcattg

SEQ ID NO: 7157039 - DNA, 22 bp, Homo sapiens
aggtcacccgtttgactatcca

SEQ ID NO: 7157040 - DNA, 22 bp, Homo sapiens
aggtcacgtcctgtgatgtcat

SEQ ID NO: 7157041 - DNA, 22 bp, Homo sapiens
agtaggaggcgggagcatgaag

SEQ ID NO: 7157042 - DNA, 22 bp, Homo sapiens
agtaggactaggggttgaggca

SEQ ID NO: 7157043 - DNA, 22 bp, Homo sapiens
agtagcttatagccaaagagag

SEQ ID NO: 7157044 - DNA, 22 bp, Homo sapiens
agtaggaggcgggagcatgaag

SEQ ID NO: 7157045 - DNA, 22 bp, Homo sapiens
agtaggaggcgggagcatgaag

SEQ ID NO: 7157046 - DNA, 22 bp, Homo sapiens
agtaggataagagcctgtccaa

SEQ ID NO: 7157047 - DNA, 22 bp, Homo sapiens
agtaggatgctttatatgaaag

SEQ ID NO: 7157048 - DNA, 20 bp, Homo sapiens
agtagcagtgtgacattgac

SEQ ID NO: 7157049 - DNA, 22 bp, Homo sapiens
agtagcagtgacagctgaggta

SEQ ID NO: 7157050 - DNA, 22 bp, Homo sapiens
agtagcagtgacagctgaggta

SEQ ID NO: 7157051 - DNA, 22 bp, Homo sapiens
agtagcagtgacagctgaggta

SEQ ID NO: 7157052 - DNA, 22 bp, Homo sapiens
agtagcagagttggactatgca

SEQ ID NO: 7157053 - DNA, 22 bp, Homo sapiens
agtagcagagttggactatgca

SEQ ID NO: 7157054 - DNA, 22 bp, Homo sapiens
agtaggctgttttatgggccaa

SEQ ID NO: 7157055 - DNA, 22 bp, Homo sapiens
agtagggagaccggaggccgcc

SEQ ID NO: 7157056 - DNA, 22 bp, Homo sapiens
agtagggagaccggaggccgcc

SEQ ID NO: 7157057 - DNA, 20 bp, Homo sapiens
agtaggggaatgcaagagca

SEQ ID NO: 7157058 - DNA, 20 bp, Homo sapiens
agtaggggaatgcaagagca

SEQ ID NO: 7157059 - DNA, 20 bp, Homo sapiens
agtaggggaatgcaagagca

SEQ ID NO: 7157060 - DNA, 22 bp, Homo sapiens
agtatttctgaatattatcata

SEQ ID NO: 7157061 - DNA, 23 bp, Homo sapiens
agtcaagatgcatctgtgaggaa

SEQ ID NO: 7157062 - DNA, 22 bp, Homo sapiens
agtcaagattctggcactagca

SEQ ID NO: 7157063 - DNA, 22 bp, Homo sapiens
agtcaaggctattatgtgggaa

SEQ ID NO: 7157064 - DNA, 22 bp, Homo sapiens
agtcaatattcaagtgtaaata

SEQ ID NO: 7157065 - DNA, 22 bp, Homo sapiens
agtacagtggtcataatataaa

SEQ ID NO: 7157066 - DNA, 22 bp, Homo sapiens
agtacatacttcaaatgtactt

SEQ ID NO: 7157067 - DNA, 22 bp, Homo sapiens
agtacagttataagtggtcttg

SEQ ID NO: 7157068 - DNA, 22 bp, Homo sapiens
agtagaaatgtaagaaggatta

SEQ ID NO: 7157069 - DNA, 22 bp, Homo sapiens
agtagaaatgtagtgtagagaa

SEQ ID NO: 7157070 - DNA, 22 bp, Homo sapiens
agtagaaatgtaagaaggatta

SEQ ID NO: 7157071 - DNA, 22 bp, Homo sapiens
agtaacaaagtgggagaatgat

SEQ ID NO: 7157072 - DNA, 22 bp, Homo sapiens
agtaacaaagtgggagaatgat

SEQ ID NO: 7157073 - DNA, 22 bp, Homo sapiens
agtaacaaatagctgcctttaa

SEQ ID NO: 7157074 - DNA, 22 bp, Homo sapiens
agtaacaaatagctgcctttaa

SEQ ID NO: 7157075 - DNA, 22 bp, Homo sapiens
agtaacaaatattcattggatt

SEQ ID NO: 7157076 - DNA, 22 bp, Homo sapiens
agtaacaaatattcattggatt

SEQ ID NO: 7157077 - DNA, 22 bp, Homo sapiens
agtaacaaatgcatctgggcat

SEQ ID NO: 7157078 - DNA, 22 bp, Homo sapiens
agtaacaagtgccaacgttaga

SEQ ID NO: 7157079 - DNA, 22 bp, Homo sapiens
agtaacaagtgccaacgttaga

SEQ ID NO: 7157080 - DNA, 22 bp, Homo sapiens
agtaacaagtgccaacgttaga

SEQ ID NO: 7157081 - DNA, 22 bp, Homo sapiens
agtaacactattttcatatgta

SEQ ID NO: 7157082 - DNA, 22 bp, Homo sapiens
agtaacacttggaatgatagca

SEQ ID NO: 7157083 - DNA, 19 bp, Homo sapiens
agtagcagaaagtgcagtg

SEQ ID NO: 7157084 - DNA, 19 bp, Homo sapiens
agtagcagaaagtgcagtg

SEQ ID NO: 7157085 - DNA, 19 bp, Homo sapiens
agtagcagaaagtgcagtg

SEQ ID NO: 7157086 - DNA, 19 bp, Homo sapiens
agtagcagaaagtgcagtg

SEQ ID NO: 7157087 - DNA, 22 bp, Homo sapiens
agtagacattttgcaacatctg

SEQ ID NO: 7157088 - DNA, 22 bp, Homo sapiens
agtagatagattctaagcacta

SEQ ID NO: 7157089 - DNA, 22 bp, Homo sapiens
agtagattccagtgatagttaa

SEQ ID NO: 7157090 - DNA, 22 bp, Homo sapiens
agtagattttagattacatagt

SEQ ID NO: 7157091 - DNA, 22 bp, Homo sapiens
agtagattttagattacatagt

SEQ ID NO: 7157092 - DNA, 22 bp, Homo sapiens
agtagatttttgaatgtaagtt

SEQ ID NO: 7157093 - DNA, 22 bp, Homo sapiens
agtagatttttgaatgtaagtt

SEQ ID NO: 7157094 - DNA, 22 bp, Homo sapiens
agtagaatcagcctcttgatgg

SEQ ID NO: 7157095 - DNA, 20 bp, Homo sapiens
agtagacaactgcaggtgtg

SEQ ID NO: 7157096 - DNA, 22 bp, Homo sapiens
agtagaatagatggatactatt

SEQ ID NO: 7157097 - DNA, 22 bp, Homo sapiens
agtagaataattggattacagt

SEQ ID NO: 7157098 - DNA, 22 bp, Homo sapiens
agtagacagacagaacacagcc

SEQ ID NO: 7157099 - DNA, 22 bp, Homo sapiens
agtagacaatatggatttaatg

SEQ ID NO: 7157100 - DNA, 22 bp, Homo sapiens
agtagacagacccatggcttta

SEQ ID NO: 7157101 - DNA, 22 bp, Homo sapiens
agtagacagccttgctcctgag

SEQ ID NO: 7157102 - DNA, 22 bp, Homo sapiens
agtagacatgagcaatgataat

SEQ ID NO: 7157103 - DNA, 22 bp, Homo sapiens
agtagacatgagcaatgataat

SEQ ID NO: 7157104 - DNA, 22 bp, Homo sapiens
agtaaataacagagaaaatggg

SEQ ID NO: 7157105 - DNA, 22 bp, Homo sapiens
agtaaataacagagaaaatggg

SEQ ID NO: 7157106 - DNA, 22 bp, Homo sapiens
agtaaataacagagaaaatggg

SEQ ID NO: 7157107 - DNA, 22 bp, Homo sapiens
agtaaataacagagaaaatggg

SEQ ID NO: 7157108 - DNA, 22 bp, Homo sapiens
agtaaagcggtgtcacagaatg

SEQ ID NO: 7157109 - DNA, 22 bp, Homo sapiens
agtaaagtaccaaagtgtgagt

SEQ ID NO: 7157110 - DNA, 22 bp, Homo sapiens
agtaaagtaccaaagtgtgagt

SEQ ID NO: 7157111 - DNA, 22 bp, Homo sapiens
agtaaatgaaagcaattttaga

SEQ ID NO: 7157112 - DNA, 22 bp, Homo sapiens
agtaaatgaaagcaattttaga

SEQ ID NO: 7157113 - DNA, 22 bp, Homo sapiens
agtaaatggcccagggttatca

SEQ ID NO: 7157114 - DNA, 18 bp, Homo sapiens
agtaaatgttaaatattg

SEQ ID NO: 7157115 - DNA, 18 bp, Homo sapiens
agtaaatgttaaatattg

SEQ ID NO: 7157116 - DNA, 22 bp, Homo sapiens
agtaaatgtttatcacacagat

SEQ ID NO: 7157117 - DNA, 22 bp, Homo sapiens
agtaaatgtttatcacacagat

SEQ ID NO: 7157118 - DNA, 22 bp, Homo sapiens
agtaaatttctgcatgtgtact

SEQ ID NO: 7157119 - DNA, 22 bp, Homo sapiens
agtaacaaagaaagcctttgga

SEQ ID NO: 7157120 - DNA, 22 bp, Homo sapiens
agtaaacatgtaattgttcatt

SEQ ID NO: 7157121 - DNA, 22 bp, Homo sapiens
agtaaacatttcagatttattt

SEQ ID NO: 7157122 - DNA, 22 bp, Homo sapiens
agtaaagcattgtcttcagagt

SEQ ID NO: 7157123 - DNA, 22 bp, Homo sapiens
agtaaagcagagttgcagtaca

SEQ ID NO: 7157124 - DNA, 22 bp, Homo sapiens
agtaaagcagagttgcagtaca

SEQ ID NO: 7157125 - DNA, 22 bp, Homo sapiens
agtaaactgtgggtacagatgt

SEQ ID NO: 7157126 - DNA, 22 bp, Homo sapiens
agtaaactgtgggtacagatgt

SEQ ID NO: 7157127 - DNA, 22 bp, Homo sapiens
agtaaactgggaaggtgcaggg

SEQ ID NO: 7157128 - DNA, 21 bp, Homo sapiens
agtaaactgtctgcttgagca

SEQ ID NO: 7157129 - DNA, 22 bp, Homo sapiens
agtaaactgtgggtacagatgt

SEQ ID NO: 7157130 - DNA, 22 bp, Homo sapiens
agtaaactttctcaggctccct

SEQ ID NO: 7157131 - DNA, 22 bp, Homo sapiens
agtaaactgtgtgcctttgact

SEQ ID NO: 7157132 - DNA, 22 bp, Homo sapiens
agtaaacattttcatattttct

SEQ ID NO: 7157133 - DNA, 22 bp, Homo sapiens
ccttctcctgccttgggttcat

SEQ ID NO: 7157134 - DNA, 22 bp, Homo sapiens
ccttctctaccatgtgaggaaa

SEQ ID NO: 7157135 - DNA, 22 bp, Homo sapiens
ccttctcctgccttgggttcat

SEQ ID NO: 7157136 - DNA, 22 bp, Homo sapiens
ccttctctactcctgatgcatg

SEQ ID NO: 7157137 - DNA, 22 bp, Homo sapiens
ccttctctactcctgatgcatg

SEQ ID NO: 7157138 - DNA, 22 bp, Homo sapiens
ccttctctctgaagaccccaaa

SEQ ID NO: 7157139 - DNA, 22 bp, Homo sapiens
agtaaaaattgaggtgcaaaat

SEQ ID NO: 7157140 - DNA, 22 bp, Homo sapiens
agtaaaaattgaggtgcaaaat

SEQ ID NO: 7157141 - DNA, 22 bp, Homo sapiens
agtaaacagtttcttagaagaa

SEQ ID NO: 7157142 - DNA, 22 bp, Homo sapiens
ccttccagtgactaaggaggaa

SEQ ID NO: 7157143 - DNA, 21 bp, Homo sapiens
ccttctccattacagtaagct

SEQ ID NO: 7157144 - DNA, 22 bp, Homo sapiens
ccttctcccctctgcagggtgt

SEQ ID NO: 7157145 - DNA, 22 bp, Homo sapiens
ccttccagggctctccagaacc

SEQ ID NO: 7157146 - DNA, 22 bp, Homo sapiens
ccttccagggtttttgccaatc

SEQ ID NO: 7157147 - DNA, 22 bp, Homo sapiens
ccttccaggtgcaggcaagcct

SEQ ID NO: 7157148 - DNA, 22 bp, Homo sapiens
ccttccaggtgcaggcaagcct

SEQ ID NO: 7157149 - DNA, 22 bp, Homo sapiens
ccttccaggttttggctccatt

SEQ ID NO: 7157150 - DNA, 22 bp, Homo sapiens
ccttccaggttttggctccatt

SEQ ID NO: 7157151 - DNA, 22 bp, Homo sapiens
ccttccagtgactaaggaggaa

SEQ ID NO: 7157152 - DNA, 22 bp, Homo sapiens
ctaggcacttgtaaggccgctc

SEQ ID NO: 7157153 - DNA, 22 bp, Homo sapiens
ctaggcagactgagctctaggg

SEQ ID NO: 7157154 - DNA, 22 bp, Homo sapiens
ctaggcactcacgtggctttag

SEQ ID NO: 7157155 - DNA, 22 bp, Homo sapiens
ctaggcacactgggccctttac

SEQ ID NO: 7157156 - DNA, 18 bp, Homo sapiens
ctaggcaccaggcacccc

SEQ ID NO: 7157157 - DNA, 22 bp, Homo sapiens
ctaggcacctgggccctgtggc

SEQ ID NO: 7157158 - DNA, 22 bp, Homo sapiens
ctaggaggcgggggctgcagta

SEQ ID NO: 7157159 - DNA, 21 bp, Homo sapiens
ctaggaggcccagaagacctc

SEQ ID NO: 7157160 - DNA, 22 bp, Homo sapiens
ctaggaggcgggggctgcagta

SEQ ID NO: 7157161 - DNA, 22 bp, Homo sapiens
ctaggaatccttttagagttgg

SEQ ID NO: 7157162 - DNA, 22 bp, Homo sapiens
ctagctttttatgacaatcttg

SEQ ID NO: 7157163 - DNA, 22 bp, Homo sapiens
ctaggaaagacacagagagttt

SEQ ID NO: 7157164 - DNA, 22 bp, Homo sapiens
ctaggaaagacacagagagttt

SEQ ID NO: 7157165 - DNA, 22 bp, Homo sapiens
ctaggaaagacacagagagttt

SEQ ID NO: 7157166 - DNA, 22 bp, Homo sapiens
ctaggaaagacacagagagttt

SEQ ID NO: 7157167 - DNA, 22 bp, Homo sapiens
ctaggaaatactgtttcaaggc

SEQ ID NO: 7157168 - DNA, 22 bp, Homo sapiens
ctaggaaatgaatacagtacac

SEQ ID NO: 7157169 - DNA, 22 bp, Homo sapiens
ctaggaacagttcaacagttta

SEQ ID NO: 7157170 - DNA, 20 bp, Homo sapiens
ctaggaactatggtctggct

SEQ ID NO: 7157171 - DNA, 22 bp, Homo sapiens
ctaggaagagaaggaattcccc

SEQ ID NO: 7157172 - DNA, 22 bp, Homo sapiens
ctaggaagctgtgcggaccctg

SEQ ID NO: 7157173 - DNA, 22 bp, Homo sapiens
ctaggaatcaccaagattctag

SEQ ID NO: 7157174 - DNA, 22 bp, Homo sapiens
ctagctcttacactctgaatag

SEQ ID NO: 7157175 - DNA, 22 bp, Homo sapiens
ctagagaaaatgatagcaggaa

SEQ ID NO: 7157176 - DNA, 22 bp, Homo sapiens
ctagagaaaaagcttaggtacg

SEQ ID NO: 7157177 - DNA, 22 bp, Homo sapiens
ctagctccatataaagcaggat

SEQ ID NO: 7157178 - DNA, 22 bp, Homo sapiens
ctagctgacgggttgataggtg

SEQ ID NO: 7157179 - DNA, 22 bp, Homo sapiens
ctagaattgcattctatgaata

SEQ ID NO: 7157180 - DNA, 22 bp, Homo sapiens
ctagacacagtttttgctccca

SEQ ID NO: 7157181 - DNA, 21 bp, Homo sapiens
agtcacattgggggtttaggg

SEQ ID NO: 7157182 - DNA, 22 bp, Homo sapiens
agtcacatttgggggtgtcaaa

SEQ ID NO: 7157183 - DNA, 22 bp, Homo sapiens
agtcacattctggggtactggg

SEQ ID NO: 7157184 - DNA, 22 bp, Homo sapiens
agtcacattctggggtactggg

SEQ ID NO: 7157185 - DNA, 22 bp, Homo sapiens
agtcacatgggattagaaccca

SEQ ID NO: 7157186 - DNA, 22 bp, Homo sapiens
agtcacatgcattttcttcaat

SEQ ID NO: 7157187 - DNA, 22 bp, Homo sapiens
agtcacatggactcaggatgac

SEQ ID NO: 7157188 - DNA, 22 bp, Homo sapiens
agtcacatggactcaggatgac

SEQ ID NO: 7157189 - DNA, 22 bp, Homo sapiens
agtcacatgcattttcttcaat

SEQ ID NO: 7157190 - DNA, 20 bp, Homo sapiens
agtcacatgcatacacaagt

SEQ ID NO: 7157191 - DNA, 20 bp, Homo sapiens
agtcacatgcatacacaagt

SEQ ID NO: 7157192 - DNA, 22 bp, Homo sapiens
agtcacatgagcactaattagg

SEQ ID NO: 7157193 - DNA, 22 bp, Homo sapiens
agtcacatgagcactaattagg

SEQ ID NO: 7157194 - DNA, 22 bp, Homo sapiens
agtcacatcgattataaaattt

SEQ ID NO: 7157195 - DNA, 22 bp, Homo sapiens
agtcacatcgattataaaattt

SEQ ID NO: 7157196 - DNA, 22 bp, Homo sapiens
agtcacatagtgttttggaatc

SEQ ID NO: 7157197 - DNA, 22 bp, Homo sapiens
agtcacatagtgttttggaatc

SEQ ID NO: 7157198 - DNA, 22 bp, Homo sapiens
agtcacatagtgttttggaatc

SEQ ID NO: 7157199 - DNA, 22 bp, Homo sapiens
agtcacatagctctggtttctt

SEQ ID NO: 7157200 - DNA, 22 bp, Homo sapiens
agtcacagttctgctgtctgag

SEQ ID NO: 7157201 - DNA, 22 bp, Homo sapiens
agtcacagttctgctgtctgag

SEQ ID NO: 7157202 - DNA, 22 bp, Homo sapiens
agtcacagtttccctgagagag

SEQ ID NO: 7157203 - DNA, 20 bp, Homo sapiens
agtcacagtatcagtcttag

SEQ ID NO: 7157204 - DNA, 22 bp, Homo sapiens
agtcacagttcctacccagtaa

SEQ ID NO: 7157205 - DNA, 22 bp, Homo sapiens
agtcacagttcctacccagtaa

SEQ ID NO: 7157206 - DNA, 22 bp, Homo sapiens
agtcacagaaacccaggtgtgg

SEQ ID NO: 7157207 - DNA, 22 bp, Homo sapiens
agtcacaataccgtgtgtcagt

SEQ ID NO: 7157208 - DNA, 22 bp, Homo sapiens
agtcacaataccgtgtgtcagt

SEQ ID NO: 7157209 - DNA, 22 bp, Homo sapiens
agtcaattcttttcaactcaag

SEQ ID NO: 7157210 - DNA, 22 bp, Homo sapiens
agtcacaggcaagagggctcca

SEQ ID NO: 7157211 - DNA, 20 bp, Homo sapiens
agtcacaggcctggaacatg

SEQ ID NO: 7157212 - DNA, 19 bp, Homo sapiens
agtcacagggaagaggaac

SEQ ID NO: 7157213 - DNA, 22 bp, Homo sapiens
agtcacagggggcccctgcaac

SEQ ID NO: 7157214 - DNA, 22 bp, Homo sapiens
agtcacagggtacacaaggatt

SEQ ID NO: 7157215 - DNA, 22 bp, Homo sapiens
agtcacagggtacacaaggatt

SEQ ID NO: 7157216 - DNA, 22 bp, Homo sapiens
agtcaggaagctggagctgggg

SEQ ID NO: 7157217 - DNA, 22 bp, Homo sapiens
agtcaggaagctggagctgggg

SEQ ID NO: 7157218 - DNA, 22 bp, Homo sapiens
agtcagcttggctcctcccatg

SEQ ID NO: 7157219 - DNA, 22 bp, Homo sapiens
agtcaggatatgccttgtgggc

SEQ ID NO: 7157220 - DNA, 22 bp, Homo sapiens
agtcaggagctgctgcattgta

SEQ ID NO: 7157221 - DNA, 22 bp, Homo sapiens
agtcaggagctgctgcattgta

SEQ ID NO: 7157222 - DNA, 22 bp, Homo sapiens
agtcaggagatattttgatatg

SEQ ID NO: 7157223 - DNA, 22 bp, Homo sapiens
agtcaggacacagcatgaacat

SEQ ID NO: 7157224 - DNA, 22 bp, Homo sapiens
agtcagcagtgaaagcacagcc

SEQ ID NO: 7157225 - DNA, 22 bp, Homo sapiens
agtcagcagcctggccaggaga

SEQ ID NO: 7157226 - DNA, 22 bp, Homo sapiens
agtcagctgcagcagctttggt

SEQ ID NO: 7157227 - DNA, 22 bp, Homo sapiens
agtcagctgctgcacacagcag

SEQ ID NO: 7157228 - DNA, 22 bp, Homo sapiens
ctatattggtggccatttggaa

SEQ ID NO: 7157229 - DNA, 22 bp, Homo sapiens
ctatattctggaatgtccattt

SEQ ID NO: 7157230 - DNA, 22 bp, Homo sapiens
ctagtgaaatttgcaagtaatt

SEQ ID NO: 7157231 - DNA, 22 bp, Homo sapiens
ctatatctacatttgctgtttg

SEQ ID NO: 7157232 - DNA, 22 bp, Homo sapiens
ctagtgaaatttgcaagtaatt

SEQ ID NO: 7157233 - DNA, 22 bp, Homo sapiens
ctagtctgtgtgggaccagggc

SEQ ID NO: 7157234 - DNA, 22 bp, Homo sapiens
ctagtctggacatctcacatgt

SEQ ID NO: 7157235 - DNA, 22 bp, Homo sapiens
agtcaggatttaaactcagaca

SEQ ID NO: 7157236 - DNA, 22 bp, Homo sapiens
ctagtctgcagcggggaggggt

SEQ ID NO: 7157237 - DNA, 22 bp, Homo sapiens
ctatatttcttggctttaaaca

SEQ ID NO: 7157238 - DNA, 22 bp, Homo sapiens
ctatatttcttggctttaaaca

SEQ ID NO: 7157239 - DNA, 22 bp, Homo sapiens
ctatatttcttggctttaaaca

SEQ ID NO: 7157240 - DNA, 22 bp, Homo sapiens
ctatatttggtgagggatgtct

SEQ ID NO: 7157241 - DNA, 22 bp, Homo sapiens
ctatatttggtgagggatgtct

SEQ ID NO: 7157242 - DNA, 22 bp, Homo sapiens
ctatcattttacatggttggtg

SEQ ID NO: 7157243 - DNA, 22 bp, Homo sapiens
ctatcaaacagccattaatata

SEQ ID NO: 7157244 - DNA, 22 bp, Homo sapiens
ctatcaagaggtagcagtgact

SEQ ID NO: 7157245 - DNA, 22 bp, Homo sapiens
ctatcaaacagccattaatata

SEQ ID NO: 7157246 - DNA, 22 bp, Homo sapiens
ctatctcatgcatcaactcttc

SEQ ID NO: 7157247 - DNA, 22 bp, Homo sapiens
ctatctctccacaatgccagtg

SEQ ID NO: 7157248 - DNA, 22 bp, Homo sapiens
ctatctcagagaaggacatttg

SEQ ID NO: 7157249 - DNA, 22 bp, Homo sapiens
ctatcccatccttctagctgac

SEQ ID NO: 7157250 - DNA, 22 bp, Homo sapiens
ctatctcttgttttcctgaagc

SEQ ID NO: 7157251 - DNA, 22 bp, Homo sapiens
ctatgagaagaaaacaagatta

SEQ ID NO: 7157252 - DNA, 22 bp, Homo sapiens
ctatgaccccagcatgaataag

SEQ ID NO: 7157253 - DNA, 22 bp, Homo sapiens
ctatgaccccagcatgaataag

SEQ ID NO: 7157254 - DNA, 22 bp, Homo sapiens
ctatgaaaggatttggagttgt

SEQ ID NO: 7157255 - DNA, 22 bp, Homo sapiens
ctatgaaatgtcagattctgca

SEQ ID NO: 7157256 - DNA, 22 bp, Homo sapiens
ctatgacacaggccattatata

SEQ ID NO: 7157257 - DNA, 22 bp, Homo sapiens
ctattctagattacagtataaa

SEQ ID NO: 7157258 - DNA, 22 bp, Homo sapiens
ctattctagtctgtcatgtcca

SEQ ID NO: 7157259 - DNA, 22 bp, Homo sapiens
ctatttatctatttctgaatga

SEQ ID NO: 7157260 - DNA, 22 bp, Homo sapiens
agtcctgggtccagcaggtcct

SEQ ID NO: 7157261 - DNA, 22 bp, Homo sapiens
agtcctgggtccagcaggtcct

SEQ ID NO: 7157262 - DNA, 22 bp, Homo sapiens
agtcctgggtctggagaatgga

SEQ ID NO: 7157263 - DNA, 22 bp, Homo sapiens
ctattgggccaaagaagatgcc

SEQ ID NO: 7157264 - DNA, 17 bp, Homo sapiens
ctattgggccatttctt

SEQ ID NO: 7157265 - DNA, 22 bp, Homo sapiens
ctattgggtatttattgagcac

SEQ ID NO: 7157266 - DNA, 22 bp, Homo sapiens
ctattgggtcagaaatgagaaa

SEQ ID NO: 7157267 - DNA, 22 bp, Homo sapiens
ctattgggtcagccttctggct

SEQ ID NO: 7157268 - DNA, 22 bp, Homo sapiens
ctattggtatttgaaacataaa

SEQ ID NO: 7157269 - DNA, 22 bp, Homo sapiens
ctattggtatttgaaacataaa

SEQ ID NO: 7157270 - DNA, 22 bp, Homo sapiens
ctatttaagaataaaaggggca

SEQ ID NO: 7157271 - DNA, 22 bp, Homo sapiens
ctatttacgctgctggggatca

SEQ ID NO: 7157272 - DNA, 22 bp, Homo sapiens
ctatttacgctgctggggatca

SEQ ID NO: 7157273 - DNA, 22 bp, Homo sapiens
ctattgaattaactattaaagt

SEQ ID NO: 7157274 - DNA, 22 bp, Homo sapiens
ctattgaggacataaggactct

SEQ ID NO: 7157275 - DNA, 22 bp, Homo sapiens
ctattgcccaaatctcaaccgc

SEQ ID NO: 7157276 - DNA, 22 bp, Homo sapiens
ctattgggatcctgacaaatct

SEQ ID NO: 7157277 - DNA, 22 bp, Homo sapiens
ctattgaattaactattaaagt

SEQ ID NO: 7157278 - DNA, 22 bp, Homo sapiens
ctattgaatagcccaaatcatt

SEQ ID NO: 7157279 - DNA, 22 bp, Homo sapiens
ctattgaaagtgtacaattcaa

SEQ ID NO: 7157280 - DNA, 22 bp, Homo sapiens
ccaaagagagacctttcttctc

SEQ ID NO: 7157281 - DNA, 22 bp, Homo sapiens
ccaaagagctagaattataggc

SEQ ID NO: 7157282 - DNA, 22 bp, Homo sapiens
ccaaagaaacccaagctcaggg

SEQ ID NO: 7157283 - DNA, 22 bp, Homo sapiens
ccaaagaaacccaagctcaggg

SEQ ID NO: 7157284 - DNA, 21 bp, Homo sapiens
ccaaagaactgccatttgtca

SEQ ID NO: 7157285 - DNA, 18 bp, Homo sapiens
aggcaggatcctggcctc

SEQ ID NO: 7157286 - DNA, 21 bp, Homo sapiens
aggcaggattcaaacacagag

SEQ ID NO: 7157287 - DNA, 21 bp, Homo sapiens
aggcaggattcaaacacagag

SEQ ID NO: 7157288 - DNA, 22 bp, Homo sapiens
ccaaaggatgtccctgtgtttt

SEQ ID NO: 7157289 - DNA, 22 bp, Homo sapiens
ccaaaggccaagctcaggtaaa

SEQ ID NO: 7157290 - DNA, 22 bp, Homo sapiens
aggcaggcccctgagaatagac

SEQ ID NO: 7157291 - DNA, 22 bp, Homo sapiens
aggcaggcccctgagaatagac

SEQ ID NO: 7157292 - DNA, 22 bp, Homo sapiens
aggcaggcccctgagaatagac

SEQ ID NO: 7157293 - DNA, 22 bp, Homo sapiens
aggcaggcccctgagaatagac

SEQ ID NO: 7157294 - DNA, 22 bp, Homo sapiens
aggcaggcccctgagaatagac

SEQ ID NO: 7157295 - DNA, 22 bp, Homo sapiens
aggcaggccctctggaaaggta

SEQ ID NO: 7157296 - DNA, 22 bp, Homo sapiens
aggcaggcccctgagaatagac

SEQ ID NO: 7157297 - DNA, 22 bp, Homo sapiens
ccaaaatgtttgaatgcatgtg

SEQ ID NO: 7157298 - DNA, 22 bp, Homo sapiens
ccaaaatgtttgaatgcatgtg

SEQ ID NO: 7157299 - DNA, 22 bp, Homo sapiens
ccaaaatgtttgaatgcatgtg

SEQ ID NO: 7157300 - DNA, 22 bp, Homo sapiens
ccaaaattaagcctcttatgtt

SEQ ID NO: 7157301 - DNA, 22 bp, Homo sapiens
ccaaaattaagcctcttatgtt

SEQ ID NO: 7157302 - DNA, 22 bp, Homo sapiens
ccaaaattattacatttgtagg

SEQ ID NO: 7157303 - DNA, 22 bp, Homo sapiens
ccaaaataacagcccaattcac

SEQ ID NO: 7157304 - DNA, 22 bp, Homo sapiens
ccaaaatattagtgcttaagta

SEQ ID NO: 7157305 - DNA, 22 bp, Homo sapiens
ccaaaatattagtgcttaagta

SEQ ID NO: 7157306 - DNA, 22 bp, Homo sapiens
ccaaactgtgtcgtctgcatag

SEQ ID NO: 7157307 - DNA, 22 bp, Homo sapiens
ccaaacttaacgatgtttttgt

SEQ ID NO: 7157308 - DNA, 22 bp, Homo sapiens
ccaaaattattacatttgtagg

SEQ ID NO: 7157309 - DNA, 22 bp, Homo sapiens
ccaaacatttcaaatttagaga

SEQ ID NO: 7157310 - DNA, 22 bp, Homo sapiens
aggcaggcctacacaatgggag

SEQ ID NO: 7157311 - DNA, 22 bp, Homo sapiens
aggcaggcctacacaatgggag

SEQ ID NO: 7157312 - DNA, 22 bp, Homo sapiens
aggcaggcctacacaatgggag

SEQ ID NO: 7157313 - DNA, 18 bp, Homo sapiens
aggcaggcggatcacaag

SEQ ID NO: 7157314 - DNA, 18 bp, Homo sapiens
aggcaggcggatcacaag

SEQ ID NO: 7157315 - DNA, 18 bp, Homo sapiens
aggcaggcggatcacaag

SEQ ID NO: 7157316 - DNA, 18 bp, Homo sapiens
aggcaggcggatcacaag

SEQ ID NO: 7157317 - DNA, 22 bp, Homo sapiens
aggcaggcctacacaatgggag

SEQ ID NO: 7157318 - DNA, 22 bp, Homo sapiens
aggcaggcctacacaatgggag

SEQ ID NO: 7157319 - DNA, 22 bp, Homo sapiens
aggcaggccgtgtccctcctca

SEQ ID NO: 7157320 - DNA, 22 bp, Homo sapiens
aggcaggcctacacaatgggag

SEQ ID NO: 7157321 - DNA, 22 bp, Homo sapiens
aggcaggcctacacaatgggag

SEQ ID NO: 7157322 - DNA, 22 bp, Homo sapiens
aggcaggccctctggaaaggta

SEQ ID NO: 7157323 - DNA, 22 bp, Homo sapiens
aggcaggccctctggaaaggta

SEQ ID NO: 7157324 - DNA, 22 bp, Homo sapiens
aggcaggccctctggaaaggta

SEQ ID NO: 7157325 - DNA, 22 bp, Homo sapiens
aggcaggccctgggccatcccg

SEQ ID NO: 7157326 - DNA, 22 bp, Homo sapiens
aggcaggccctgggccatcccg

SEQ ID NO: 7157327 - DNA, 22 bp, Homo sapiens
aggcaggccctctggaaaggta

SEQ ID NO: 7157328 - DNA, 22 bp, Homo sapiens
aggcaggccctgggccatcccg

SEQ ID NO: 7157329 - DNA, 22 bp, Homo sapiens
aggcaggccgtgtccctcctca

SEQ ID NO: 7157330 - DNA, 22 bp, Homo sapiens
aggcaggctagtcgcttgagcc

SEQ ID NO: 7157331 - DNA, 22 bp, Homo sapiens
aggcaggctagtcgcttgagcc

SEQ ID NO: 7157332 - DNA, 22 bp, Homo sapiens
aggcaggctcaatgcccagtct

SEQ ID NO: 7157333 - DNA, 22 bp, Homo sapiens
aggcaggctcaatgcccagtct

SEQ ID NO: 7157334 - DNA, 22 bp, Homo sapiens
aggcaggctagtcgcttgagcc

SEQ ID NO: 7157335 - DNA, 22 bp, Homo sapiens
aggcaggctagtcgcttgagcc

SEQ ID NO: 7157336 - DNA, 22 bp, Homo sapiens
aggcaggctcaatgcccagtct

SEQ ID NO: 7157337 - DNA, 22 bp, Homo sapiens
aggcaggctcaggcccatgctt

SEQ ID NO: 7157338 - DNA, 22 bp, Homo sapiens
aggcaggctctgggtatgtgca

SEQ ID NO: 7157339 - DNA, 22 bp, Homo sapiens
aggcaggctcaggcccatgctt

SEQ ID NO: 7157340 - DNA, 22 bp, Homo sapiens
aggcaggctcaggcccatgctt

SEQ ID NO: 7157341 - DNA, 22 bp, Homo sapiens
aggcaggctctgggtatgtgca

SEQ ID NO: 7157342 - DNA, 22 bp, Homo sapiens
aggcaggctgctatggagtaga

SEQ ID NO: 7157343 - DNA, 22 bp, Homo sapiens
aggcaggctgctatggagtaga

SEQ ID NO: 7157344 - DNA, 22 bp, Homo sapiens
aggcaggctgctatggagtaga

SEQ ID NO: 7157345 - DNA, 22 bp, Homo sapiens
aggcaggctgctatggagtaga

SEQ ID NO: 7157346 - DNA, 23 bp, Homo sapiens
aggcagagccaaggtcaaaaccc

SEQ ID NO: 7157347 - DNA, 20 bp, Homo sapiens
aggcagagcgcacttttaga

SEQ ID NO: 7157348 - DNA, 23 bp, Homo sapiens
aggcagagccaaggtcaaaaccc

SEQ ID NO: 7157349 - DNA, 23 bp, Homo sapiens
aggcagagccaaggtcaaaaccc

SEQ ID NO: 7157350 - DNA, 20 bp, Homo sapiens
aggcagagcgcacttttaga

SEQ ID NO: 7157351 - DNA, 20 bp, Homo sapiens
aggcagagcgcacttttaga

SEQ ID NO: 7157352 - DNA, 22 bp, Homo sapiens
aggcagagctaggaagaattgt

SEQ ID NO: 7157353 - DNA, 20 bp, Homo sapiens
aggcagagcgcacttttaga

SEQ ID NO: 7157354 - DNA, 20 bp, Homo sapiens
aggcagagcgcacttttaga

SEQ ID NO: 7157355 - DNA, 22 bp, Homo sapiens
aggcagagctgatgttctgtga

SEQ ID NO: 7157356 - DNA, 22 bp, Homo sapiens
aggcagagctgatgttctgtga

SEQ ID NO: 7157357 - DNA, 22 bp, Homo sapiens
aggcagagctgatgttctgtga

SEQ ID NO: 7157358 - DNA, 22 bp, Homo sapiens
aggcagagctgatgttctgtga

SEQ ID NO: 7157359 - DNA, 22 bp, Homo sapiens
aggcagagctaggaagaattgt

SEQ ID NO: 7157360 - DNA, 22 bp, Homo sapiens
aggcagagctaggaagaattgt

SEQ ID NO: 7157361 - DNA, 22 bp, Homo sapiens
aggcagagctaggaagaattgt

SEQ ID NO: 7157362 - DNA, 22 bp, Homo sapiens
aggcagagctaggaagaattgt

SEQ ID NO: 7157363 - DNA, 22 bp, Homo sapiens
aggcagagctgatgttctgtga

SEQ ID NO: 7157364 - DNA, 22 bp, Homo sapiens
aggcagagctgatgttctgtga

SEQ ID NO: 7157365 - DNA, 22 bp, Homo sapiens
aggcagaggagaatgatcttcc

SEQ ID NO: 7157366 - DNA, 22 bp, Homo sapiens
aggcagaggagaatgatcttcc

SEQ ID NO: 7157367 - DNA, 19 bp, Homo sapiens
aggcagaggcttggctagc

SEQ ID NO: 7157368 - DNA, 19 bp, Homo sapiens
aggcagaggcttggctagc

SEQ ID NO: 7157369 - DNA, 22 bp, Homo sapiens
aggcagaggagaatgatcttcc

SEQ ID NO: 7157370 - DNA, 22 bp, Homo sapiens
aggcagaggagaatgatcttcc

SEQ ID NO: 7157371 - DNA, 22 bp, Homo sapiens
aggcagaggagaatgatcttcc

SEQ ID NO: 7157372 - DNA, 22 bp, Homo sapiens
aggcagaggaagggtggatttg

SEQ ID NO: 7157373 - DNA, 22 bp, Homo sapiens
aggcagaggaagggtggatttg

SEQ ID NO: 7157374 - DNA, 22 bp, Homo sapiens
aggcagaggagaatgatcttcc

SEQ ID NO: 7157375 - DNA, 22 bp, Homo sapiens
aggcagaggagaatgatcttcc

SEQ ID NO: 7157376 - DNA, 22 bp, Homo sapiens
aggcagaggaagggtggatttg

SEQ ID NO: 7157377 - DNA, 22 bp, Homo sapiens
aggcagagctgggttttgaaat

SEQ ID NO: 7157378 - DNA, 22 bp, Homo sapiens
aggcagaggaagggtggatttg

SEQ ID NO: 7157379 - DNA, 22 bp, Homo sapiens
aggcagaggaagggtggatttg

SEQ ID NO: 7157380 - DNA, 22 bp, Homo sapiens
aggcagaggaagggtggatttg

SEQ ID NO: 7157381 - DNA, 22 bp, Homo sapiens
aggcagagctgggttttgaaat

SEQ ID NO: 7157382 - DNA, 22 bp, Homo sapiens
aggcagagctgggttttgaaat

SEQ ID NO: 7157383 - DNA, 22 bp, Homo sapiens
aggcagagctgggttttgaaat

SEQ ID NO: 7157384 - DNA, 22 bp, Homo sapiens
aggcagagctgggttttgaaat

SEQ ID NO: 7157385 - DNA, 22 bp, Homo sapiens
aggcagagctgggttttgaaat

SEQ ID NO: 7157386 - DNA, 22 bp, Homo sapiens
aggcagagctgggttttgaaat

SEQ ID NO: 7157387 - DNA, 20 bp, Homo sapiens
aggcagctggccaggcaggt

SEQ ID NO: 7157388 - DNA, 20 bp, Homo sapiens
aggcagctggccaggcaggt

SEQ ID NO: 7157389 - DNA, 20 bp, Homo sapiens
aggcagctggccaggcaggt

SEQ ID NO: 7157390 - DNA, 23 bp, Homo sapiens
aggcagctgggtagcatctttct

SEQ ID NO: 7157391 - DNA, 23 bp, Homo sapiens
aggcagctgggtagcatctttct

SEQ ID NO: 7157392 - DNA, 22 bp, Homo sapiens
aggcagctgtgaggactggatt

SEQ ID NO: 7157393 - DNA, 22 bp, Homo sapiens
aggcagctgtgaggactggatt

SEQ ID NO: 7157394 - DNA, 22 bp, Homo sapiens
aggcagctgtgaggactggatt

SEQ ID NO: 7157395 - DNA, 22 bp, Homo sapiens
aggcagctggcagcacccaggg

SEQ ID NO: 7157396 - DNA, 19 bp, Homo sapiens
aggcagaggcttggctagc

SEQ ID NO: 7157397 - DNA, 19 bp, Homo sapiens
aggcagaggcttggctagc

SEQ ID NO: 7157398 - DNA, 19 bp, Homo sapiens
aggcagaggcttggctagc

SEQ ID NO: 7157399 - DNA, 22 bp, Homo sapiens
aggcagctttcagtgtctctca

SEQ ID NO: 7157400 - DNA, 22 bp, Homo sapiens
aggcaggaaaatcgcttgaacc

SEQ ID NO: 7157401 - DNA, 22 bp, Homo sapiens
ccaaaaggaactttttgaaggt

SEQ ID NO: 7157402 - DNA, 22 bp, Homo sapiens
ccaaaaggaactttttgaaggt

SEQ ID NO: 7157403 - DNA, 22 bp, Homo sapiens
ccaaaaggaactttttgaaggt

SEQ ID NO: 7157404 - DNA, 22 bp, Homo sapiens
aggcagcttaagccctggccca

SEQ ID NO: 7157405 - DNA, 22 bp, Homo sapiens
aggcagcttaagccctggccca

SEQ ID NO: 7157406 - DNA, 22 bp, Homo sapiens
aggcagcttctgattagcagcg

SEQ ID NO: 7157407 - DNA, 22 bp, Homo sapiens
aggcagctttaactggtagtag

SEQ ID NO: 7157408 - DNA, 22 bp, Homo sapiens
aggcagctttcagtgtctctca

SEQ ID NO: 7157409 - DNA, 22 bp, Homo sapiens
aggcagctttcagtgtctctca

SEQ ID NO: 7157410 - DNA, 20 bp, Homo sapiens
aggcacagttcctagttggg

SEQ ID NO: 7157411 - DNA, 20 bp, Homo sapiens
aggcacagttcctagttggg

SEQ ID NO: 7157412 - DNA, 20 bp, Homo sapiens
aggcacagttcctagttggg

SEQ ID NO: 7157413 - DNA, 20 bp, Homo sapiens
aggcacagttcctagttggg

SEQ ID NO: 7157414 - DNA, 22 bp, Homo sapiens
aggcacagtggctcacacctgt

SEQ ID NO: 7157415 - DNA, 22 bp, Homo sapiens
aggcacagtggctcacacctgt

SEQ ID NO: 7157416 - DNA, 22 bp, Homo sapiens
aggcacagtggccctgtttggg

SEQ ID NO: 7157417 - DNA, 22 bp, Homo sapiens
aggcacagtggccctgtttggg

SEQ ID NO: 7157418 - DNA, 22 bp, Homo sapiens
aggcacagtggctcacacctgt

SEQ ID NO: 7157419 - DNA, 22 bp, Homo sapiens
aggcacagtggctcacacctgt

SEQ ID NO: 7157420 - DNA, 22 bp, Homo sapiens
aggcacagtggctcacacctgt

SEQ ID NO: 7157421 - DNA, 19 bp, Homo sapiens
aggcacaggttgtctggac

SEQ ID NO: 7157422 - DNA, 19 bp, Homo sapiens
aggcacaggttgtctggac

SEQ ID NO: 7157423 - DNA, 22 bp, Homo sapiens
aggcacaggtggacttcacagt

SEQ ID NO: 7157424 - DNA, 19 bp, Homo sapiens
aggcacaggttgtctggac

SEQ ID NO: 7157425 - DNA, 19 bp, Homo sapiens
aggcacaggttgtctggac

SEQ ID NO: 7157426 - DNA, 19 bp, Homo sapiens
aggcacaggttgtctggac

SEQ ID NO: 7157427 - DNA, 22 bp, Homo sapiens
aggcacagtgcctggaatcaaa

SEQ ID NO: 7157428 - DNA, 22 bp, Homo sapiens
aggcacagtgcctggaatcaaa

SEQ ID NO: 7157429 - DNA, 22 bp, Homo sapiens
aggcacagtgcctggaatcaaa

SEQ ID NO: 7157430 - DNA, 22 bp, Homo sapiens
aggcactgaatatccagtaaaa

SEQ ID NO: 7157431 - DNA, 23 bp, Homo sapiens
aggcactgaatgtgtcagtgagt

SEQ ID NO: 7157432 - DNA, 22 bp, Homo sapiens
aggcactgaatatccagtaaaa

SEQ ID NO: 7157433 - DNA, 22 bp, Homo sapiens
aggcactgaagtggtaaatgta

SEQ ID NO: 7157434 - DNA, 22 bp, Homo sapiens
aggcactgaagtggtaaatgta

SEQ ID NO: 7157435 - DNA, 22 bp, Homo sapiens
aggcactgaaggaagcttgcgc

SEQ ID NO: 7157436 - DNA, 22 bp, Homo sapiens
aggcactgaaggaagcttgcgc

SEQ ID NO: 7157437 - DNA, 22 bp, Homo sapiens
aggcactgaaaggtggccagag

SEQ ID NO: 7157438 - DNA, 22 bp, Homo sapiens
aggcactgaaaggtggccagag

SEQ ID NO: 7157439 - DNA, 22 bp, Homo sapiens
aggcactgaagaactctttttg

SEQ ID NO: 7157440 - DNA, 22 bp, Homo sapiens
aggcacagtttcatccccgggc

SEQ ID NO: 7157441 - DNA, 22 bp, Homo sapiens
aggcactgaaaggtggccagag

SEQ ID NO: 7157442 - DNA, 22 bp, Homo sapiens
aggcactgacagattctgtgtc

SEQ ID NO: 7157443 - DNA, 22 bp, Homo sapiens
aggcactgacagattctgtgtc

SEQ ID NO: 7157444 - DNA, 22 bp, Homo sapiens
aggcactgacaattctggactg

SEQ ID NO: 7157445 - DNA, 22 bp, Homo sapiens
aggcactgacagattctgtgtc

SEQ ID NO: 7157446 - DNA, 23 bp, Homo sapiens
aggcactgaatgtgtcagtgagt

SEQ ID NO: 7157447 - DNA, 23 bp, Homo sapiens
aggcactgaatgtgtcagtgagt

SEQ ID NO: 7157448 - DNA, 22 bp, Homo sapiens
aggcactgagaggctgtgttgc

SEQ ID NO: 7157449 - DNA, 22 bp, Homo sapiens
aggcactgactcaagggagcca

SEQ ID NO: 7157450 - DNA, 22 bp, Homo sapiens
aggcactgacctgcttccttga

SEQ ID NO: 7157451 - DNA, 22 bp, Homo sapiens
aggcactgactcaagggagcca

SEQ ID NO: 7157452 - DNA, 22 bp, Homo sapiens
aggcagagaaaaaccagatatg

SEQ ID NO: 7157453 - DNA, 22 bp, Homo sapiens
aggcactttccttgaggagttt

SEQ ID NO: 7157454 - DNA, 22 bp, Homo sapiens
aggcactttctgtatgctagtt

SEQ ID NO: 7157455 - DNA, 22 bp, Homo sapiens
aggcactgattctcagagttac

SEQ ID NO: 7157456 - DNA, 22 bp, Homo sapiens
aggcactgattctgttttccat

SEQ ID NO: 7157457 - DNA, 22 bp, Homo sapiens
aggcactttaggatcaggttga

SEQ ID NO: 7157458 - DNA, 22 bp, Homo sapiens
aggcactgattctcagagttac

SEQ ID NO: 7157459 - DNA, 22 bp, Homo sapiens
aggcactgattctcagagttac

SEQ ID NO: 7157460 - DNA, 16 bp, Homo sapiens
aggcagagatttaccc

SEQ ID NO: 7157461 - DNA, 22 bp, Homo sapiens
aggcagagagcagtggccgtct

SEQ ID NO: 7157462 - DNA, 22 bp, Homo sapiens
aggcagagagcagtggccgtct

SEQ ID NO: 7157463 - DNA, 22 bp, Homo sapiens
aggcagagagcagtggccgtct

SEQ ID NO: 7157464 - DNA, 16 bp, Homo sapiens
aggcagagatttaccc

SEQ ID NO: 7157465 - DNA, 16 bp, Homo sapiens
aggcagagatttaccc

SEQ ID NO: 7157466 - DNA, 16 bp, Homo sapiens
aggcagagatttaccc

SEQ ID NO: 7157467 - DNA, 23 bp, Homo sapiens
aggcagagccaaggtcaaaaccc

SEQ ID NO: 7157468 - DNA, 22 bp, Homo sapiens
aggcagagagcagtggccgtct

SEQ ID NO: 7157469 - DNA, 22 bp, Homo sapiens
aggcagagagcagtggccgtct

SEQ ID NO: 7157470 - DNA, 22 bp, Homo sapiens
aggcagagagcagtggccgtct

SEQ ID NO: 7157471 - DNA, 22 bp, Homo sapiens
aggcagagagcagtggccgtct

SEQ ID NO: 7157472 - DNA, 22 bp, Homo sapiens
aggcagagagcagtggccgtct

SEQ ID NO: 7157473 - DNA, 22 bp, Homo sapiens
aggagtttggcacatgtatgca

SEQ ID NO: 7157474 - DNA, 22 bp, Homo sapiens
aggagtttcaaagcttccatgt

SEQ ID NO: 7157475 - DNA, 22 bp, Homo sapiens
aggagtttcaaagcttccatgt

SEQ ID NO: 7157476 - DNA, 22 bp, Homo sapiens
aggataaattctccaaagtgtg

SEQ ID NO: 7157477 - DNA, 22 bp, Homo sapiens
aggataaaggtcattattccca

SEQ ID NO: 7157478 - DNA, 16 bp, Homo sapiens
aggagttgaggctatt

SEQ ID NO: 7157479 - DNA, 23 bp, Homo sapiens
aggagttgagggttgggttggca

SEQ ID NO: 7157480 - DNA, 23 bp, Homo sapiens
aggagttgagggttgggttggca

SEQ ID NO: 7157481 - DNA, 23 bp, Homo sapiens
aggagttgagggttgggttggca

SEQ ID NO: 7157482 - DNA, 22 bp, Homo sapiens
aggagtgttcagcgtggggatg

SEQ ID NO: 7157483 - DNA, 22 bp, Homo sapiens
aggagtgttcagcgtggggatg

SEQ ID NO: 7157484 - DNA, 21 bp, Homo sapiens
aggagttgagtgcacagttgg

SEQ ID NO: 7157485 - DNA, 22 bp, Homo sapiens
aggagttgattacgtttatttt

SEQ ID NO: 7157486 - DNA, 23 bp, Homo sapiens
aggagttgcatgatttttagagc

SEQ ID NO: 7157487 - DNA, 21 bp, Homo sapiens
aggagttgctgtggcctggtt

SEQ ID NO: 7157488 - DNA, 21 bp, Homo sapiens
aggagttgctgtggcctggtt

SEQ ID NO: 7157489 - DNA, 22 bp, Homo sapiens
aggagttggtcaccgtggccca

SEQ ID NO: 7157490 - DNA, 22 bp, Homo sapiens
aggagttggtgctctccaaata

SEQ ID NO: 7157491 - DNA, 22 bp, Homo sapiens
aggagttgtatgtccaagggac

SEQ ID NO: 7157492 - DNA, 22 bp, Homo sapiens
aggagttgtatgtccaagggac

SEQ ID NO: 7157493 - DNA, 22 bp, Homo sapiens
aggatcatgtggtcattcctga

SEQ ID NO: 7157494 - DNA, 23 bp, Homo sapiens
aggatcctggtacaggagcagag

SEQ ID NO: 7157495 - DNA, 22 bp, Homo sapiens
aggatcagtgaatactcagggt

SEQ ID NO: 7157496 - DNA, 22 bp, Homo sapiens
aggatcatataagctccagcta

SEQ ID NO: 7157497 - DNA, 22 bp, Homo sapiens
aggatcagtgaatactcagggt

SEQ ID NO: 7157498 - DNA, 22 bp, Homo sapiens
aggatcctgtatggagaagctg

SEQ ID NO: 7157499 - DNA, 22 bp, Homo sapiens
aggatctgttgaataaatttga

SEQ ID NO: 7157500 - DNA, 22 bp, Homo sapiens
aggatagaagccccatgttctt

SEQ ID NO: 7157501 - DNA, 22 bp, Homo sapiens
aggatagttgtgaagataggct

SEQ ID NO: 7157502 - DNA, 22 bp, Homo sapiens
aggatataaaaagactatttgg

SEQ ID NO: 7157503 - DNA, 18 bp, Homo sapiens
aggatattaagagtacag

SEQ ID NO: 7157504 - DNA, 22 bp, Homo sapiens
aggatattgtatccatctgagt

SEQ ID NO: 7157505 - DNA, 22 bp, Homo sapiens
aggatatttgcttaagatagct

SEQ ID NO: 7157506 - DNA, 22 bp, Homo sapiens
aggatatttgtaaagattttga

SEQ ID NO: 7157507 - DNA, 22 bp, Homo sapiens
aggatcaggccctctagggtag

SEQ ID NO: 7157508 - DNA, 22 bp, Homo sapiens
aggatcagagctttgtttctga

SEQ ID NO: 7157509 - DNA, 22 bp, Homo sapiens
aggatcaggccctctagggtag

SEQ ID NO: 7157510 - DNA, 22 bp, Homo sapiens
catgtgtgaatcttgtgatcat

SEQ ID NO: 7157511 - DNA, 22 bp, Homo sapiens
catgtgtcctagctattctcct

SEQ ID NO: 7157512 - DNA, 22 bp, Homo sapiens
catgtgtctaatctactaatat

SEQ ID NO: 7157513 - DNA, 22 bp, Homo sapiens
catgtgtctaatctactaatat

SEQ ID NO: 7157514 - DNA, 22 bp, Homo sapiens
catgtgtcttgctgccctccat

SEQ ID NO: 7157515 - DNA, 22 bp, Homo sapiens
catgtgtctaatctactaatat

SEQ ID NO: 7157516 - DNA, 21 bp, Homo sapiens
catgtgtcttgtgttactgct

SEQ ID NO: 7157517 - DNA, 22 bp, Homo sapiens
catgtgtctttatggagccaca

SEQ ID NO: 7157518 - DNA, 22 bp, Homo sapiens
aggatgagaagattggaatctt

SEQ ID NO: 7157519 - DNA, 22 bp, Homo sapiens
catgtccttctcattgcctcat

SEQ ID NO: 7157520 - DNA, 22 bp, Homo sapiens
catgtgtccacccttgaacaca

SEQ ID NO: 7157521 - DNA, 22 bp, Homo sapiens
catgtgtcctagctattctcct

SEQ ID NO: 7157522 - DNA, 22 bp, Homo sapiens
aggatgaataactgaaatggtg

SEQ ID NO: 7157523 - DNA, 22 bp, Homo sapiens
catgtgtgacaaactgcctgca

SEQ ID NO: 7157524 - DNA, 23 bp, Homo sapiens
catgtgtgacagtatcactgttt

SEQ ID NO: 7157525 - DNA, 22 bp, Homo sapiens
catgtgtgagtgagcagtcttc

SEQ ID NO: 7157526 - DNA, 22 bp, Homo sapiens
catgtgtggagggcatgcatgg

SEQ ID NO: 7157527 - DNA, 22 bp, Homo sapiens
aggcacaggtggacttcacagt

SEQ ID NO: 7157528 - DNA, 22 bp, Homo sapiens
aggcacaggtggacttcacagt

SEQ ID NO: 7157529 - DNA, 22 bp, Homo sapiens
aggcacaggtggacttcacagt

SEQ ID NO: 7157530 - DNA, 22 bp, Homo sapiens
aggcacaggtggacttcacagt

SEQ ID NO: 7157531 - DNA, 22 bp, Homo sapiens
catgtgtggtctgtggctatct

SEQ ID NO: 7157532 - DNA, 22 bp, Homo sapiens
aggcacagggatgcggagccag

SEQ ID NO: 7157533 - DNA, 22 bp, Homo sapiens
cagtgaggagtccagggcagag

SEQ ID NO: 7157534 - DNA, 22 bp, Homo sapiens
cagtgaggagtccagggcagag

SEQ ID NO: 7157535 - DNA, 22 bp, Homo sapiens
cagtctgaacactgggctactc

SEQ ID NO: 7157536 - DNA, 22 bp, Homo sapiens
aggacaagacaaggaccagaga

SEQ ID NO: 7157537 - DNA, 22 bp, Homo sapiens
cagtctcttttcagctccatcc

SEQ ID NO: 7157538 - DNA, 22 bp, Homo sapiens
aggaatttttctagccggagtt

SEQ ID NO: 7157539 - DNA, 22 bp, Homo sapiens
aggacaaaggaccagatctgga

SEQ ID NO: 7157540 - DNA, 22 bp, Homo sapiens
aggacaaaggaccagatctgga

SEQ ID NO: 7157541 - DNA, 22 bp, Homo sapiens
aggacaagacaaggaccagaga

SEQ ID NO: 7157542 - DNA, 22 bp, Homo sapiens
aggaattgagatcctaggtttt

SEQ ID NO: 7157543 - DNA, 22 bp, Homo sapiens
aggaattcctgggaaggcacag

SEQ ID NO: 7157544 - DNA, 22 bp, Homo sapiens
aggaattgagatcctaggtttt

SEQ ID NO: 7157545 - DNA, 22 bp, Homo sapiens
aggaattgcctggggcctggga

SEQ ID NO: 7157546 - DNA, 22 bp, Homo sapiens
aggaattactcatctgtggtat

SEQ ID NO: 7157547 - DNA, 22 bp, Homo sapiens
aggaattaacaatatatttagg

SEQ ID NO: 7157548 - DNA, 22 bp, Homo sapiens
aggaattaataaccagtaagcc

SEQ ID NO: 7157549 - DNA, 22 bp, Homo sapiens
aggaattcaagaccagctgggc

SEQ ID NO: 7157550 - DNA, 22 bp, Homo sapiens
aggaattcaagaccagctgggc

SEQ ID NO: 7157551 - DNA, 22 bp, Homo sapiens
aggaattcaagaccagctgggc

SEQ ID NO: 7157552 - DNA, 22 bp, Homo sapiens
aggaattcaagaccagctgggc

SEQ ID NO: 7157553 - DNA, 22 bp, Homo sapiens
aggaattgtgttgtagtggaga

SEQ ID NO: 7157554 - DNA, 22 bp, Homo sapiens
aggaatttaagggctcagagag

SEQ ID NO: 7157555 - DNA, 22 bp, Homo sapiens
aggaatttaagggctcagagag

SEQ ID NO: 7157556 - DNA, 22 bp, Homo sapiens
aggaatttagacagggcataaa

SEQ ID NO: 7157557 - DNA, 19 bp, Homo sapiens
aggaatttctcagggaggc

SEQ ID NO: 7157558 - DNA, 22 bp, Homo sapiens
aggaatttgagtgctgtaggaa

SEQ ID NO: 7157559 - DNA, 22 bp, Homo sapiens
aggaatttgctggaacacagat

SEQ ID NO: 7157560 - DNA, 22 bp, Homo sapiens
aggaatttggaatttttcctgt

SEQ ID NO: 7157561 - DNA, 22 bp, Homo sapiens
aggaatttggggttacatgatg

SEQ ID NO: 7157562 - DNA, 22 bp, Homo sapiens
aggaattttaatatgcttgtct

SEQ ID NO: 7157563 - DNA, 22 bp, Homo sapiens
aggaattttacaagctggttgc

SEQ ID NO: 7157564 - DNA, 22 bp, Homo sapiens
aggaattttacaagctggttgc

SEQ ID NO: 7157565 - DNA, 22 bp, Homo sapiens
aggaattttacatctcagagag

SEQ ID NO: 7157566 - DNA, 22 bp, Homo sapiens
aggaattttacatctcagagag

SEQ ID NO: 7157567 - DNA, 22 bp, Homo sapiens
aggaattttcacagttgggtat

SEQ ID NO: 7157568 - DNA, 22 bp, Homo sapiens
aggaattttcacagttgggtat

SEQ ID NO: 7157569 - DNA, 22 bp, Homo sapiens
aggaattttgtatggatactgt

SEQ ID NO: 7157570 - DNA, 22 bp, Homo sapiens
cagtgagggaagatctcagcac

SEQ ID NO: 7157571 - DNA, 22 bp, Homo sapiens
cagtgaggctctgctgagcggt

SEQ ID NO: 7157572 - DNA, 22 bp, Homo sapiens
cagtgagggaagatctcagcac

SEQ ID NO: 7157573 - DNA, 22 bp, Homo sapiens
cagtgagggaagatctcagcac

SEQ ID NO: 7157574 - DNA, 22 bp, Homo sapiens
cagtgaggctctgctgagcggt

SEQ ID NO: 7157575 - DNA, 22 bp, Homo sapiens
cagtgaggctctgctgagcggt

SEQ ID NO: 7157576 - DNA, 21 bp, Homo sapiens
cagtgaggccctcctgttccc

SEQ ID NO: 7157577 - DNA, 21 bp, Homo sapiens
cagtgaggccctcctgttccc

SEQ ID NO: 7157578 - DNA, 17 bp, Homo sapiens
cagtgaggcctttcctc

SEQ ID NO: 7157579 - DNA, 22 bp, Homo sapiens
cagtgcagccaaggacaggcac

SEQ ID NO: 7157580 - DNA, 17 bp, Homo sapiens
cagtgcagataagtgag

SEQ ID NO: 7157581 - DNA, 22 bp, Homo sapiens
cagtgcagccaaggacaggcac

SEQ ID NO: 7157582 - DNA, 22 bp, Homo sapiens
cagtgcagccaaggacaggcac

SEQ ID NO: 7157583 - DNA, 22 bp, Homo sapiens
cagtgcagccaaggacaggcac

SEQ ID NO: 7157584 - DNA, 22 bp, Homo sapiens
cagtgagggcccccttccaggt

SEQ ID NO: 7157585 - DNA, 22 bp, Homo sapiens
cagtgagggcccccttccaggt

SEQ ID NO: 7157586 - DNA, 17 bp, Homo sapiens
cagtgcagataagtgag

SEQ ID NO: 7157587 - DNA, 22 bp, Homo sapiens
cagtgagggcattcagtgctgg

SEQ ID NO: 7157588 - DNA, 22 bp, Homo sapiens
cagtgagggcattcagtgctgg

SEQ ID NO: 7157589 - DNA, 22 bp, Homo sapiens
cagtgagggcattcagtgctgg

SEQ ID NO: 7157590 - DNA, 22 bp, Homo sapiens
cagtgagggcattcagtgctgg

SEQ ID NO: 7157591 - DNA, 22 bp, Homo sapiens
cagtgagggcattcagtgctgg

SEQ ID NO: 7157592 - DNA, 23 bp, Homo sapiens
cagtgcagggcaactcagactcc

SEQ ID NO: 7157593 - DNA, 22 bp, Homo sapiens
cagtgcaggctgggggccctgc

SEQ ID NO: 7157594 - DNA, 23 bp, Homo sapiens
cagtgcagggcaactcagactcc

SEQ ID NO: 7157595 - DNA, 22 bp, Homo sapiens
cagtgcaggctgggggccctgc

SEQ ID NO: 7157596 - DNA, 22 bp, Homo sapiens
cagtgcaggcttgtggccgcag

SEQ ID NO: 7157597 - DNA, 23 bp, Homo sapiens
cagtgcagggcaactcagactcc

SEQ ID NO: 7157598 - DNA, 23 bp, Homo sapiens
cagtgcagggcaactcagactcc

SEQ ID NO: 7157599 - DNA, 23 bp, Homo sapiens
cagtgcagggcaactcagactcc

SEQ ID NO: 7157600 - DNA, 21 bp, Homo sapiens
cagtgcaggggttagcgtgta

SEQ ID NO: 7157601 - DNA, 20 bp, Homo sapiens
aggagatgatccagagtcag

SEQ ID NO: 7157602 - DNA, 20 bp, Homo sapiens
aggagatgatccagagtcag

SEQ ID NO: 7157603 - DNA, 20 bp, Homo sapiens
aggagatgatccagagtcag

SEQ ID NO: 7157604 - DNA, 22 bp, Homo sapiens
cagtgcaggctgggggccctgc

SEQ ID NO: 7157605 - DNA, 22 bp, Homo sapiens
cagtgcaggctgggggccctgc

SEQ ID NO: 7157606 - DNA, 22 bp, Homo sapiens
cagtgcaggaagtgagatgcct

SEQ ID NO: 7157607 - DNA, 22 bp, Homo sapiens
cagtgcaggaagtgagatgcct

SEQ ID NO: 7157608 - DNA, 22 bp, Homo sapiens
cagtgcaggaagtgagatgcct

SEQ ID NO: 7157609 - DNA, 22 bp, Homo sapiens
cagtgcaggaagtgagatgcct

SEQ ID NO: 7157610 - DNA, 22 bp, Homo sapiens
cagtgcaggaagtgagatgcct

SEQ ID NO: 7157611 - DNA, 22 bp, Homo sapiens
cagtgcaggaagtgagatgcct

SEQ ID NO: 7157612 - DNA, 22 bp, Homo sapiens
cagtgcagccaaggacaggcac

SEQ ID NO: 7157613 - DNA, 22 bp, Homo sapiens
cagtgcagctgccccgctggta

SEQ ID NO: 7157614 - DNA, 22 bp, Homo sapiens
aggagctgggctgctgctggga

SEQ ID NO: 7157615 - DNA, 17 bp, Homo sapiens
aggagctgggggtggtg

SEQ ID NO: 7157616 - DNA, 17 bp, Homo sapiens
aggagctgggggtggtg

SEQ ID NO: 7157617 - DNA, 22 bp, Homo sapiens
aggagctgggcccaaggatgct

SEQ ID NO: 7157618 - DNA, 22 bp, Homo sapiens
aggagctgggctgctgctggga

SEQ ID NO: 7157619 - DNA, 22 bp, Homo sapiens
aggagctgggctgctgctggga

SEQ ID NO: 7157620 - DNA, 22 bp, Homo sapiens
aggagctgggctgctgctggga

SEQ ID NO: 7157621 - DNA, 22 bp, Homo sapiens
aggagctgggcccaaggatgct

SEQ ID NO: 7157622 - DNA, 22 bp, Homo sapiens
aggagctgggcccaaggatgct

SEQ ID NO: 7157623 - DNA, 22 bp, Homo sapiens
aggagctgggcccaaggatgct

SEQ ID NO: 7157624 - DNA, 22 bp, Homo sapiens
aggagctgggcccaaggatgct

SEQ ID NO: 7157625 - DNA, 22 bp, Homo sapiens
aggagctgggcccaaggatgct

SEQ ID NO: 7157626 - DNA, 22 bp, Homo sapiens
aggagctgggagaaggactaaa

SEQ ID NO: 7157627 - DNA, 22 bp, Homo sapiens
aggagctggcctagaaaggaga

SEQ ID NO: 7157628 - DNA, 22 bp, Homo sapiens
aggagctgggagaaggactaaa

SEQ ID NO: 7157629 - DNA, 22 bp, Homo sapiens
aggagctgggagaaggactaaa

SEQ ID NO: 7157630 - DNA, 22 bp, Homo sapiens
aggagctggcctagaaaggaga

SEQ ID NO: 7157631 - DNA, 22 bp, Homo sapiens
aggagctggcctagaaaggaga

SEQ ID NO: 7157632 - DNA, 22 bp, Homo sapiens
aggagctggccactaggatgca

SEQ ID NO: 7157633 - DNA, 22 bp, Homo sapiens
aggagctggcctagaaaggaga

SEQ ID NO: 7157634 - DNA, 22 bp, Homo sapiens
aggagctggcctagaaaggaga

SEQ ID NO: 7157635 - DNA, 22 bp, Homo sapiens
aggagctgatagtctatggaga

SEQ ID NO: 7157636 - DNA, 22 bp, Homo sapiens
aggagctggccactaggatgca

SEQ ID NO: 7157637 - DNA, 22 bp, Homo sapiens
aggagctggccactaggatgca

SEQ ID NO: 7157638 - DNA, 22 bp, Homo sapiens
aggagctggccactaggatgca

SEQ ID NO: 7157639 - DNA, 22 bp, Homo sapiens
cagtggagagacttttactctt

SEQ ID NO: 7157640 - DNA, 23 bp, Homo sapiens
cagtggagactcatgcttcctta

SEQ ID NO: 7157641 - DNA, 22 bp, Homo sapiens
cagtggaatatataggggattt

SEQ ID NO: 7157642 - DNA, 23 bp, Homo sapiens
cagtggagactcatgcttcctta

SEQ ID NO: 7157643 - DNA, 23 bp, Homo sapiens
cagtggagactcatgcttcctta

SEQ ID NO: 7157644 - DNA, 22 bp, Homo sapiens
cagtggaatatataggggattt

SEQ ID NO: 7157645 - DNA, 22 bp, Homo sapiens
cagtggaagctggctgtgaaga

SEQ ID NO: 7157646 - DNA, 22 bp, Homo sapiens
cagtggaaatcagagtgagagt

SEQ ID NO: 7157647 - DNA, 22 bp, Homo sapiens
aggagcagcccactcctgtcct

SEQ ID NO: 7157648 - DNA, 22 bp, Homo sapiens
aggagcagcccactcctgtcct

SEQ ID NO: 7157649 - DNA, 22 bp, Homo sapiens
aggagcagaccgtagtcctgca

SEQ ID NO: 7157650 - DNA, 22 bp, Homo sapiens
aggagatggagctcagtgggca

SEQ ID NO: 7157651 - DNA, 22 bp, Homo sapiens
aggagcagattggtaagatcat

SEQ ID NO: 7157652 - DNA, 22 bp, Homo sapiens
aggagatggagctcagtgggca

SEQ ID NO: 7157653 - DNA, 22 bp, Homo sapiens
aggagcagattggtaagatcat

SEQ ID NO: 7157654 - DNA, 22 bp, Homo sapiens
aggagcagattggtaagatcat

SEQ ID NO: 7157655 - DNA, 22 bp, Homo sapiens
aggagcagcccactcctgtcct

SEQ ID NO: 7157656 - DNA, 22 bp, Homo sapiens
aggagcagcccactcctgtcct

SEQ ID NO: 7157657 - DNA, 22 bp, Homo sapiens
aggagcagcttctgaaccatgt

SEQ ID NO: 7157658 - DNA, 21 bp, Homo sapiens
aggagcattgttgtggtggag

SEQ ID NO: 7157659 - DNA, 22 bp, Homo sapiens
aggagccaaaagctgaacaaga

SEQ ID NO: 7157660 - DNA, 22 bp, Homo sapiens
aggagccaaaagctgaacaaga

SEQ ID NO: 7157661 - DNA, 22 bp, Homo sapiens
aggagccaaaagctgaacaaga

SEQ ID NO: 7157662 - DNA, 22 bp, Homo sapiens
aggagccaaattttagactctg

SEQ ID NO: 7157663 - DNA, 22 bp, Homo sapiens
aggagccaaacatattgagaga

SEQ ID NO: 7157664 - DNA, 22 bp, Homo sapiens
aggagccaaacatattgagaga

SEQ ID NO: 7157665 - DNA, 22 bp, Homo sapiens
aggagccaaacatattgagaga

SEQ ID NO: 7157666 - DNA, 22 bp, Homo sapiens
cagtggaaatcagagtgagagt

SEQ ID NO: 7157667 - DNA, 22 bp, Homo sapiens
cagtgcttttttaccttccaac

SEQ ID NO: 7157668 - DNA, 22 bp, Homo sapiens
cagtggaaactatgctgctgga

SEQ ID NO: 7157669 - DNA, 22 bp, Homo sapiens
aggagccacctaggagctgttt

SEQ ID NO: 7157670 - DNA, 22 bp, Homo sapiens
cagtgcttttaaaacaacatca

SEQ ID NO: 7157671 - DNA, 22 bp, Homo sapiens
aggagccaatctgataaagcca

SEQ ID NO: 7157672 - DNA, 22 bp, Homo sapiens
aggagccaaggaaaacagtatt

SEQ ID NO: 7157673 - DNA, 22 bp, Homo sapiens
aggagccaaggaaaacagtatt

SEQ ID NO: 7157674 - DNA, 22 bp, Homo sapiens
aggagccaagcagaactaagga

SEQ ID NO: 7157675 - DNA, 22 bp, Homo sapiens
aggagccaaattttagactctg

SEQ ID NO: 7157676 - DNA, 22 bp, Homo sapiens
aggagccaagatggggcaagta

SEQ ID NO: 7157677 - DNA, 22 bp, Homo sapiens
aggaggtgacagcctgcatctg

SEQ ID NO: 7157678 - DNA, 22 bp, Homo sapiens
aggaggtgacagcctgcatctg

SEQ ID NO: 7157679 - DNA, 22 bp, Homo sapiens
aggaggtgacagcctgcatctg

SEQ ID NO: 7157680 - DNA, 22 bp, Homo sapiens
aggaggtgacagcctgcatctg

SEQ ID NO: 7157681 - DNA, 22 bp, Homo sapiens
aggaggtcagagccccatgctg

SEQ ID NO: 7157682 - DNA, 22 bp, Homo sapiens
aggaggtgacagcctgcatctg

SEQ ID NO: 7157683 - DNA, 22 bp, Homo sapiens
aggaggtgcgtggtgatcccct

SEQ ID NO: 7157684 - DNA, 22 bp, Homo sapiens
aggaggtgagcggtcatgtggt

SEQ ID NO: 7157685 - DNA, 22 bp, Homo sapiens
aggaggtgagcggtcatgtggt

SEQ ID NO: 7157686 - DNA, 22 bp, Homo sapiens
aggaggtgagcggtcatgtggt

SEQ ID NO: 7157687 - DNA, 22 bp, Homo sapiens
aggaggtgagcggtcatgtggt

SEQ ID NO: 7157688 - DNA, 22 bp, Homo sapiens
aggagggtttcaatgggatgag

SEQ ID NO: 7157689 - DNA, 22 bp, Homo sapiens
aggaggtagtcttataaatgtt

SEQ ID NO: 7157690 - DNA, 22 bp, Homo sapiens
aggagggttgaggaggatactt

SEQ ID NO: 7157691 - DNA, 22 bp, Homo sapiens
aggagggtttcaatgggatgag

SEQ ID NO: 7157692 - DNA, 22 bp, Homo sapiens
aggagggtttcaatgggatgag

SEQ ID NO: 7157693 - DNA, 22 bp, Homo sapiens
aggagggtggggtctgcctgtc

SEQ ID NO: 7157694 - DNA, 22 bp, Homo sapiens
aggagggtggggtctgcctgtc

SEQ ID NO: 7157695 - DNA, 22 bp, Homo sapiens
aggagggtggcctcatgtgagt

SEQ ID NO: 7157696 - DNA, 22 bp, Homo sapiens
aggagggtggcctcatgtgagt

SEQ ID NO: 7157697 - DNA, 22 bp, Homo sapiens
aggagggtggcctcatgtgagt

SEQ ID NO: 7157698 - DNA, 22 bp, Homo sapiens
aggaggggcatagaaatgtaat

SEQ ID NO: 7157699 - DNA, 22 bp, Homo sapiens
aggaggggcaatgatagtctgg

SEQ ID NO: 7157700 - DNA, 22 bp, Homo sapiens
aggaggggcaatgatagtctgg

SEQ ID NO: 7157701 - DNA, 22 bp, Homo sapiens
aggaggggcaatgatagtctgg

SEQ ID NO: 7157702 - DNA, 22 bp, Homo sapiens
aggaggctggttcaggccatat

SEQ ID NO: 7157703 - DNA, 22 bp, Homo sapiens
aggaggctggttcaggccatat

SEQ ID NO: 7157704 - DNA, 22 bp, Homo sapiens
aggaggctggttcaggccatat

SEQ ID NO: 7157705 - DNA, 22 bp, Homo sapiens
aggaggctggttcaggccatat

SEQ ID NO: 7157706 - DNA, 22 bp, Homo sapiens
aggaggctggttcaggccatat

SEQ ID NO: 7157707 - DNA, 22 bp, Homo sapiens
aggaggctggttcaggccatat

SEQ ID NO: 7157708 - DNA, 22 bp, Homo sapiens
aggaggctggttcaggccatat

SEQ ID NO: 7157709 - DNA, 22 bp, Homo sapiens
aggagtgggggcgagaagttaa

SEQ ID NO: 7157710 - DNA, 22 bp, Homo sapiens
aggagtggaattactgggttct

SEQ ID NO: 7157711 - DNA, 22 bp, Homo sapiens
aggagtatctaataatctgaga

SEQ ID NO: 7157712 - DNA, 22 bp, Homo sapiens
catccaaactctcattatctgt

SEQ ID NO: 7157713 - DNA, 22 bp, Homo sapiens
aggaggtgttgatagaaggttt

SEQ ID NO: 7157714 - DNA, 22 bp, Homo sapiens
aggaggtgttgatagaaggttt

SEQ ID NO: 7157715 - DNA, 22 bp, Homo sapiens
aggaggttgccagtctgggggt

SEQ ID NO: 7157716 - DNA, 22 bp, Homo sapiens
catccaaactctcattatctgt

SEQ ID NO: 7157717 - DNA, 22 bp, Homo sapiens
catcatttttgtaagctggtag

SEQ ID NO: 7157718 - DNA, 22 bp, Homo sapiens
catcattttgtatccaagggga

SEQ ID NO: 7157719 - DNA, 22 bp, Homo sapiens
catcattttgtatccaagggga

SEQ ID NO: 7157720 - DNA, 22 bp, Homo sapiens
catcattttattaaccaagaaa

SEQ ID NO: 7157721 - DNA, 22 bp, Homo sapiens
aggagtgtgaagagcctagatc

SEQ ID NO: 7157722 - DNA, 22 bp, Homo sapiens
aggagtgtggccagggctctgg

SEQ ID NO: 7157723 - DNA, 22 bp, Homo sapiens
aggagtgtggccagggctctgg

SEQ ID NO: 7157724 - DNA, 22 bp, Homo sapiens
aggagtgttagagtagagctgg

SEQ ID NO: 7157725 - DNA, 22 bp, Homo sapiens
aggagtgttagagtagagctgg

SEQ ID NO: 7157726 - DNA, 22 bp, Homo sapiens
aggagtgttagagtagagctgg

SEQ ID NO: 7157727 - DNA, 22 bp, Homo sapiens
aggagtggtgcaggacctgcca

SEQ ID NO: 7157728 - DNA, 22 bp, Homo sapiens
aggagtggtgcaggacctgcca

SEQ ID NO: 7157729 - DNA, 22 bp, Homo sapiens
aggagtggtgcaggacctgcca

SEQ ID NO: 7157730 - DNA, 22 bp, Homo sapiens
aggagtgtgaagagcctagatc

SEQ ID NO: 7157731 - DNA, 22 bp, Homo sapiens
aggagtggtgcaggacctgcca

SEQ ID NO: 7157732 - DNA, 22 bp, Homo sapiens
aggagtgggggcgagaagttaa

SEQ ID NO: 7157733 - DNA, 22 bp, Homo sapiens
aggagtgggggcgagaagttaa

SEQ ID NO: 7157734 - DNA, 22 bp, Homo sapiens
aggagtggtgcaggacctgcca

SEQ ID NO: 7157735 - DNA, 22 bp, Homo sapiens
catcatttcacttagatgaagt

SEQ ID NO: 7157736 - DNA, 22 bp, Homo sapiens
catcatttcacttagatgaagt

SEQ ID NO: 7157737 - DNA, 22 bp, Homo sapiens
catcatttcacttagatgaagt

SEQ ID NO: 7157738 - DNA, 22 bp, Homo sapiens
catcatttaattataggggctg

SEQ ID NO: 7157739 - DNA, 22 bp, Homo sapiens
catcattgcctgtttcccttgg

SEQ ID NO: 7157740 - DNA, 22 bp, Homo sapiens
catcattgttagggactctaac

SEQ ID NO: 7157741 - DNA, 23 bp, Homo sapiens
catcattgttatgggtgctacta

SEQ ID NO: 7157742 - DNA, 23 bp, Homo sapiens
catcattgttatgggtgctacta

SEQ ID NO: 7157743 - DNA, 22 bp, Homo sapiens
catcattaccatcattagtagt

SEQ ID NO: 7157744 - DNA, 22 bp, Homo sapiens
catcattaccttgtaaccaata

SEQ ID NO: 7157745 - DNA, 19 bp, Homo sapiens
catcattatcagttcactg

SEQ ID NO: 7157746 - DNA, 22 bp, Homo sapiens
catcattgaacacttcttcctg

SEQ ID NO: 7157747 - DNA, 22 bp, Homo sapiens
catcattgaacacttcttcctg

SEQ ID NO: 7157748 - DNA, 22 bp, Homo sapiens
catcattgcctgtttcccttgg

SEQ ID NO: 7157749 - DNA, 22 bp, Homo sapiens
catcatttgttcacttgattcc

SEQ ID NO: 7157750 - DNA, 22 bp, Homo sapiens
catcatttgtttgcatgcagga

SEQ ID NO: 7157751 - DNA, 20 bp, Homo sapiens
catcattttaaaatctctcc

SEQ ID NO: 7157752 - DNA, 22 bp, Homo sapiens
catcattttattaaccaagaaa

SEQ ID NO: 7157753 - DNA, 22 bp, Homo sapiens
catcattttattaaccaagaaa

SEQ ID NO: 7157754 - DNA, 22 bp, Homo sapiens
catcatttgtttgcatgcagga

SEQ ID NO: 7157755 - DNA, 20 bp, Homo sapiens
catcattttaaaatctctcc

SEQ ID NO: 7157756 - DNA, 20 bp, Homo sapiens
catcattttaaaatctctcc

SEQ ID NO: 7157757 - DNA, 20 bp, Homo sapiens
catcattttaaaatctctcc

SEQ ID NO: 7157758 - DNA, 22 bp, Homo sapiens
cagttataggagccattgtata

SEQ ID NO: 7157759 - DNA, 22 bp, Homo sapiens
cagttatcaaatactatgaagg

SEQ ID NO: 7157760 - DNA, 17 bp, Homo sapiens
aggagctgggggtggtg

SEQ ID NO: 7157761 - DNA, 22 bp, Homo sapiens
cagttataggagccattgtata

SEQ ID NO: 7157762 - DNA, 22 bp, Homo sapiens
cagttattctagttccacatct

SEQ ID NO: 7157763 - DNA, 22 bp, Homo sapiens
cagttattctagttccacatct

SEQ ID NO: 7157764 - DNA, 21 bp, Homo sapiens
cagttattcttgatgtgtgtg

SEQ ID NO: 7157765 - DNA, 22 bp, Homo sapiens
cagttatttcaacagagaggat

SEQ ID NO: 7157766 - DNA, 22 bp, Homo sapiens
cagttattttgaggattaaatg

SEQ ID NO: 7157767 - DNA, 23 bp, Homo sapiens
cagttcccactgtctgtcacaag

SEQ ID NO: 7157768 - DNA, 22 bp, Homo sapiens
cagttcatccccatgttttcaa

SEQ ID NO: 7157769 - DNA, 22 bp, Homo sapiens
cagttcatccccatgttttcaa

SEQ ID NO: 7157770 - DNA, 22 bp, Homo sapiens
cagttcagctgtcagcctccca

SEQ ID NO: 7157771 - DNA, 22 bp, Homo sapiens
cagttcagactacccacattgt

SEQ ID NO: 7157772 - DNA, 22 bp, Homo sapiens
cagttcagctagaagaaacaaa

SEQ ID NO: 7157773 - DNA, 22 bp, Homo sapiens
cagttcaaagttaagcagcagt

SEQ ID NO: 7157774 - DNA, 22 bp, Homo sapiens
cagttctctgtgcctcgctggg

SEQ ID NO: 7157775 - DNA, 22 bp, Homo sapiens
cagttctacttggatgtctgca

SEQ ID NO: 7157776 - DNA, 22 bp, Homo sapiens
cagttctacttggatgtctgca

SEQ ID NO: 7157777 - DNA, 22 bp, Homo sapiens
cagttccctccgccagcacttc

SEQ ID NO: 7157778 - DNA, 22 bp, Homo sapiens
cagttccctccgccagcacttc

SEQ ID NO: 7157779 - DNA, 23 bp, Homo sapiens
cagttcccactgtctgtcacaag

SEQ ID NO: 7157780 - DNA, 22 bp, Homo sapiens
cagttccctaatgtgtagaaga

SEQ ID NO: 7157781 - DNA, 22 bp, Homo sapiens
cagttcccttcttctggcccct

SEQ ID NO: 7157782 - DNA, 22 bp, Homo sapiens
cagttcccttcttctggcccct

SEQ ID NO: 7157783 - DNA, 22 bp, Homo sapiens
cagttcctcaaaggttaaatgt

SEQ ID NO: 7157784 - DNA, 22 bp, Homo sapiens
cagttcctggttccattcttct

SEQ ID NO: 7157785 - DNA, 22 bp, Homo sapiens
cagttccttgagaatggttgct

SEQ ID NO: 7157786 - DNA, 22 bp, Homo sapiens
catcactacaaatttaagaaat

SEQ ID NO: 7157787 - DNA, 22 bp, Homo sapiens
catcactgaaccccaactttct

SEQ ID NO: 7157788 - DNA, 22 bp, Homo sapiens
catcacatttaattaaaatgtc

SEQ ID NO: 7157789 - DNA, 22 bp, Homo sapiens
cagttctctttccactggaggc

SEQ ID NO: 7157790 - DNA, 22 bp, Homo sapiens
aggaggctgcaaccctgaggcc

SEQ ID NO: 7157791 - DNA, 22 bp, Homo sapiens
catcagagtcagagctctttct

SEQ ID NO: 7157792 - DNA, 22 bp, Homo sapiens
catcagagtcagagctctttct

SEQ ID NO: 7157793 - DNA, 22 bp, Homo sapiens
aggaggctgcaaccctgaggcc

SEQ ID NO: 7157794 - DNA, 23 bp, Homo sapiens
catcagaggttgccactccctgg

SEQ ID NO: 7157795 - DNA, 22 bp, Homo sapiens
catcagaggtacttaatgaatg

SEQ ID NO: 7157796 - DNA, 22 bp, Homo sapiens
catcagaatgttagagaaggga

SEQ ID NO: 7157797 - DNA, 22 bp, Homo sapiens
catcagaattacttggggagct

SEQ ID NO: 7157798 - DNA, 22 bp, Homo sapiens
catcagacctgccagactaggt

SEQ ID NO: 7157799 - DNA, 22 bp, Homo sapiens
aggaggctgggcacagtggcct

SEQ ID NO: 7157800 - DNA, 22 bp, Homo sapiens
aggaggctggttcaggccatat

SEQ ID NO: 7157801 - DNA, 22 bp, Homo sapiens
aggaggctgggcacagtggcct

SEQ ID NO: 7157802 - DNA, 22 bp, Homo sapiens
aggaggctgcaaccctgaggcc

SEQ ID NO: 7157803 - DNA, 22 bp, Homo sapiens
aggaggctgcaaccctgaggcc

SEQ ID NO: 7157804 - DNA, 22 bp, Homo sapiens
aggaggctgggcacagtggcct

SEQ ID NO: 7157805 - DNA, 22 bp, Homo sapiens
aggaggctgggcacagtggcct

SEQ ID NO: 7157806 - DNA, 22 bp, Homo sapiens
catcactgaaccccaactttct

SEQ ID NO: 7157807 - DNA, 22 bp, Homo sapiens
catcactgaaccccaactttct

SEQ ID NO: 7157808 - DNA, 22 bp, Homo sapiens
catcactgacgctgagattcca

SEQ ID NO: 7157809 - DNA, 22 bp, Homo sapiens
catcactgacgctgagattcca

SEQ ID NO: 7157810 - DNA, 22 bp, Homo sapiens
catcactgcttctaaaatggtg

SEQ ID NO: 7157811 - DNA, 22 bp, Homo sapiens
catcactgcttctaaaatggtg

SEQ ID NO: 7157812 - DNA, 22 bp, Homo sapiens
catcactggcatcatgggaggg

SEQ ID NO: 7157813 - DNA, 22 bp, Homo sapiens
catcactggcatcatgggaggg

SEQ ID NO: 7157814 - DNA, 22 bp, Homo sapiens
catcactggctgctgacagatg

SEQ ID NO: 7157815 - DNA, 22 bp, Homo sapiens
catcactgtcaccatctttcct

SEQ ID NO: 7157816 - DNA, 22 bp, Homo sapiens
catcactgtcaccatctttcct

SEQ ID NO: 7157817 - DNA, 22 bp, Homo sapiens
catcactgtccaaagttcagtt

SEQ ID NO: 7157818 - DNA, 22 bp, Homo sapiens
catcactgtccaaagttcagtt

SEQ ID NO: 7157819 - DNA, 22 bp, Homo sapiens
catcactgtcctcagcattcca

SEQ ID NO: 7157820 - DNA, 22 bp, Homo sapiens
catcactgtcctcagcattcca

SEQ ID NO: 7157821 - DNA, 22 bp, Homo sapiens
catcactgtcctcagcattcca

SEQ ID NO: 7157822 - DNA, 22 bp, Homo sapiens
catcacttttaaaggtgatcga

SEQ ID NO: 7157823 - DNA, 22 bp, Homo sapiens
catcacttttaaaggtgatcga

SEQ ID NO: 7157824 - DNA, 22 bp, Homo sapiens
catcacttttaaaggtgatcga

SEQ ID NO: 7157825 - DNA, 22 bp, Homo sapiens
catcagaaaccttgaggaaact

SEQ ID NO: 7157826 - DNA, 20 bp, Homo sapiens
catcagaaatcctgacccac

SEQ ID NO: 7157827 - DNA, 22 bp, Homo sapiens
catcagaacaaatcggttaaga

SEQ ID NO: 7157828 - DNA, 22 bp, Homo sapiens
catcagaagatggctctggaaa

SEQ ID NO: 7157829 - DNA, 22 bp, Homo sapiens
catcagaaggaaggacgattat

SEQ ID NO: 7157830 - DNA, 22 bp, Homo sapiens
catcagaaggccagagggtagc

SEQ ID NO: 7157831 - DNA, 22 bp, Homo sapiens
catcagaatctgagtctctgcc

SEQ ID NO: 7157832 - DNA, 22 bp, Homo sapiens
catcagaatgttagagaaggga

SEQ ID NO: 7157833 - DNA, 22 bp, Homo sapiens
aggaagggtgtcatgagccctt

SEQ ID NO: 7157834 - DNA, 22 bp, Homo sapiens
aggaagggtgtcatgagccctt

SEQ ID NO: 7157835 - DNA, 22 bp, Homo sapiens
aggaagggtgtcatgagccctt

SEQ ID NO: 7157836 - DNA, 22 bp, Homo sapiens
aggaagggtgtcatgagccctt

SEQ ID NO: 7157837 - DNA, 22 bp, Homo sapiens
aggaagggtggatagtaacgtg

SEQ ID NO: 7157838 - DNA, 22 bp, Homo sapiens
aggaagggttctttctgtttat

SEQ ID NO: 7157839 - DNA, 22 bp, Homo sapiens
aggaagggtgtcatgagccctt

SEQ ID NO: 7157840 - DNA, 22 bp, Homo sapiens
aggaagggttctttgtgaaaga

SEQ ID NO: 7157841 - DNA, 22 bp, Homo sapiens
aggaagggttctttgtgaaaga

SEQ ID NO: 7157842 - DNA, 22 bp, Homo sapiens
aggaagggttctttgtgaaaga

SEQ ID NO: 7157843 - DNA, 22 bp, Homo sapiens
aggaagggttctttgtgaaaga

SEQ ID NO: 7157844 - DNA, 22 bp, Homo sapiens
aggaagggttctttctgtttat

SEQ ID NO: 7157845 - DNA, 22 bp, Homo sapiens
aggaagggtggatagtaacgtg

SEQ ID NO: 7157846 - DNA, 22 bp, Homo sapiens
aggaagggtggatagtaacgtg

SEQ ID NO: 7157847 - DNA, 22 bp, Homo sapiens
aggaagggtggatagtaacgtg

SEQ ID NO: 7157848 - DNA, 22 bp, Homo sapiens
aggaagggtggatagtaacgtg

SEQ ID NO: 7157849 - DNA, 22 bp, Homo sapiens
aggaaggggagaagttaaagct

SEQ ID NO: 7157850 - DNA, 22 bp, Homo sapiens
aggaaggggagaagttaaagct

SEQ ID NO: 7157851 - DNA, 22 bp, Homo sapiens
aggaagggtggatagtaacgtg

SEQ ID NO: 7157852 - DNA, 22 bp, Homo sapiens
aggaagggtggatagtaacgtg

SEQ ID NO: 7157853 - DNA, 22 bp, Homo sapiens
aggaaggggagaagttaaagct

SEQ ID NO: 7157854 - DNA, 20 bp, Homo sapiens
aggaaggagaatctgagcaa

SEQ ID NO: 7157855 - DNA, 22 bp, Homo sapiens
aggaagggctgtttctccaaga

SEQ ID NO: 7157856 - DNA, 22 bp, Homo sapiens
aggaagggctgtttctccaaga

SEQ ID NO: 7157857 - DNA, 22 bp, Homo sapiens
aggaagtgaaagggaaggagtt

SEQ ID NO: 7157858 - DNA, 20 bp, Homo sapiens
caggtccagcacgtgcacgg

SEQ ID NO: 7157859 - DNA, 22 bp, Homo sapiens
caggtccagtaaaaagagtcct

SEQ ID NO: 7157860 - DNA, 22 bp, Homo sapiens
caggtccagtcactggtctgca

SEQ ID NO: 7157861 - DNA, 17 bp, Homo sapiens
caggtcccagggtctct

SEQ ID NO: 7157862 - DNA, 17 bp, Homo sapiens
caggtcccagggtctct

SEQ ID NO: 7157863 - DNA, 17 bp, Homo sapiens
caggtcccagggtctct

SEQ ID NO: 7157864 - DNA, 17 bp, Homo sapiens
caggtcccagggtctct

SEQ ID NO: 7157865 - DNA, 22 bp, Homo sapiens
caggtccccagggtacctacct

SEQ ID NO: 7157866 - DNA, 22 bp, Homo sapiens
caggtcccctcccctaccaggc

SEQ ID NO: 7157867 - DNA, 22 bp, Homo sapiens
caggtcccctcccctaccaggc

SEQ ID NO: 7157868 - DNA, 22 bp, Homo sapiens
caggtcccctcccctaccaggc

SEQ ID NO: 7157869 - DNA, 22 bp, Homo sapiens
caggtcccctcccctaccaggc

SEQ ID NO: 7157870 - DNA, 22 bp, Homo sapiens
caggtcccgccccgggctgacc

SEQ ID NO: 7157871 - DNA, 22 bp, Homo sapiens
caggtcccgccccgggctgacc

SEQ ID NO: 7157872 - DNA, 22 bp, Homo sapiens
caggtcccgttccccagagatt

SEQ ID NO: 7157873 - DNA, 22 bp, Homo sapiens
aggaagggttctttgtgaaaga

SEQ ID NO: 7157874 - DNA, 22 bp, Homo sapiens
aggaagggttctttgtgaaaga

SEQ ID NO: 7157875 - DNA, 22 bp, Homo sapiens
aggaaggtaatgaactgaggag

SEQ ID NO: 7157876 - DNA, 22 bp, Homo sapiens
aggaaggtaatgaactgaggag

SEQ ID NO: 7157877 - DNA, 22 bp, Homo sapiens
aggaagggttctttgtgaaaga

SEQ ID NO: 7157878 - DNA, 22 bp, Homo sapiens
aggaagtcagaatgctggggag

SEQ ID NO: 7157879 - DNA, 22 bp, Homo sapiens
aggaagtcagctgccatgctgt

SEQ ID NO: 7157880 - DNA, 14 bp, Homo sapiens
aggaatgtcctagg

SEQ ID NO: 7157881 - DNA, 22 bp, Homo sapiens
aggaatgtcgtcataaacatga

SEQ ID NO: 7157882 - DNA, 22 bp, Homo sapiens
aggaatgtcgtcataaacatga

SEQ ID NO: 7157883 - DNA, 22 bp, Homo sapiens
aggaatgtcgtcataaacatga

SEQ ID NO: 7157884 - DNA, 22 bp, Homo sapiens
caggtcctggcatcaggcaggt

SEQ ID NO: 7157885 - DNA, 22 bp, Homo sapiens
caggtcctggcatcaggcaggt

SEQ ID NO: 7157886 - DNA, 22 bp, Homo sapiens
caggtcctggcatcaggcaggt

SEQ ID NO: 7157887 - DNA, 22 bp, Homo sapiens
caggtcctggcatcaggcaggt

SEQ ID NO: 7157888 - DNA, 22 bp, Homo sapiens
caggtcctggcatcaggcaggt

SEQ ID NO: 7157889 - DNA, 22 bp, Homo sapiens
caggtccctgcgccccggcctc

SEQ ID NO: 7157890 - DNA, 22 bp, Homo sapiens
caggtcctcacgcctcaccctt

SEQ ID NO: 7157891 - DNA, 22 bp, Homo sapiens
caggtcctcgggggaggccggc

SEQ ID NO: 7157892 - DNA, 22 bp, Homo sapiens
caggtcctcgggggaggccggc

SEQ ID NO: 7157893 - DNA, 22 bp, Homo sapiens
caggtcctctgagatgggaggt

SEQ ID NO: 7157894 - DNA, 22 bp, Homo sapiens
caggtcctggcagctgactcag

SEQ ID NO: 7157895 - DNA, 22 bp, Homo sapiens
aggaatgtctgagaaagaggca

SEQ ID NO: 7157896 - DNA, 22 bp, Homo sapiens
aggaatgtctgagaaagaggca

SEQ ID NO: 7157897 - DNA, 22 bp, Homo sapiens
aggaatgtctgagaaagaggca

SEQ ID NO: 7157898 - DNA, 22 bp, Homo sapiens
aggaatgtcgtcataaacatga

SEQ ID NO: 7157899 - DNA, 22 bp, Homo sapiens
aggaatgtgaaacaggtggctg

SEQ ID NO: 7157900 - DNA, 22 bp, Homo sapiens
aggaatgtgaaacaggtggctg

SEQ ID NO: 7157901 - DNA, 22 bp, Homo sapiens
aggaatgtgaaacaggtggctg

SEQ ID NO: 7157902 - DNA, 22 bp, Homo sapiens
aggaatgtgaccactagactct

SEQ ID NO: 7157903 - DNA, 22 bp, Homo sapiens
aggaatgtgaccactagactct

SEQ ID NO: 7157904 - DNA, 22 bp, Homo sapiens
aggaatgtgaccactagactct

SEQ ID NO: 7157905 - DNA, 22 bp, Homo sapiens
aggaatgtgactattttttcag

SEQ ID NO: 7157906 - DNA, 22 bp, Homo sapiens
aggaatgtgactattttttcag

SEQ ID NO: 7157907 - DNA, 22 bp, Homo sapiens
aggaatgtgaccactagactct

SEQ ID NO: 7157908 - DNA, 22 bp, Homo sapiens
aggaatgtgactattttttcag

SEQ ID NO: 7157909 - DNA, 22 bp, Homo sapiens
aggaatgtgaggcaagttgtga

SEQ ID NO: 7157910 - DNA, 22 bp, Homo sapiens
aggaatgtgaggcaagttgtga

SEQ ID NO: 7157911 - DNA, 22 bp, Homo sapiens
aggaatgtgaggcaagttgtga

SEQ ID NO: 7157912 - DNA, 23 bp, Homo sapiens
aggaatgtgcccacccatctcct

SEQ ID NO: 7157913 - DNA, 23 bp, Homo sapiens
aggaatgtgcccacccatctcct

SEQ ID NO: 7157914 - DNA, 23 bp, Homo sapiens
aggaatgtgcccacccatctcct

SEQ ID NO: 7157915 - DNA, 22 bp, Homo sapiens
aggaatgtgcctagcctccctg

SEQ ID NO: 7157916 - DNA, 22 bp, Homo sapiens
aggaatgtgcctagcctccctg

SEQ ID NO: 7157917 - DNA, 23 bp, Homo sapiens
aggaatgtgcccacccatctcct

SEQ ID NO: 7157918 - DNA, 22 bp, Homo sapiens
aggaatgtgcctagcctccctg

SEQ ID NO: 7157919 - DNA, 22 bp, Homo sapiens
aggaatgtggaaggtggcggcg

SEQ ID NO: 7157920 - DNA, 22 bp, Homo sapiens
aggaatgtggaaggtggcggcg

SEQ ID NO: 7157921 - DNA, 22 bp, Homo sapiens
aggaatgtggaaggtggcggcg

SEQ ID NO: 7157922 - DNA, 22 bp, Homo sapiens
aggaatgtggcaatcttcaagt

SEQ ID NO: 7157923 - DNA, 22 bp, Homo sapiens
aggaatgtggcaatcttcaagt

SEQ ID NO: 7157924 - DNA, 22 bp, Homo sapiens
aggaatgtggcaatcttcaagt

SEQ ID NO: 7157925 - DNA, 22 bp, Homo sapiens
aggaatgtggcctagggaggag

SEQ ID NO: 7157926 - DNA, 22 bp, Homo sapiens
aggaatgtggcctagggaggag

SEQ ID NO: 7157927 - DNA, 22 bp, Homo sapiens
aggaatgtggcaatcttcaagt

SEQ ID NO: 7157928 - DNA, 22 bp, Homo sapiens
aggaatgtggcctagggaggag

SEQ ID NO: 7157929 - DNA, 16 bp, Homo sapiens
aggaatgtggcggaac

SEQ ID NO: 7157930 - DNA, 16 bp, Homo sapiens
aggaatgtggcggaac

SEQ ID NO: 7157931 - DNA, 16 bp, Homo sapiens
aggaatgtggcggaac

SEQ ID NO: 7157932 - DNA, 21 bp, Homo sapiens
aggaatgtgtatatatacaat

SEQ ID NO: 7157933 - DNA, 21 bp, Homo sapiens
aggaatgtgtatatatacaat

SEQ ID NO: 7157934 - DNA, 21 bp, Homo sapiens
aggaatgtgtatatatacaat

SEQ ID NO: 7157935 - DNA, 22 bp, Homo sapiens
aggaatgtgtgtccaccgggga

SEQ ID NO: 7157936 - DNA, 22 bp, Homo sapiens
aggaatgtgtgtccaccgggga

SEQ ID NO: 7157937 - DNA, 22 bp, Homo sapiens
aggaatgtgtgtccaccgggga

SEQ ID NO: 7157938 - DNA, 22 bp, Homo sapiens
aggaatgtgtttctaggctgtt

SEQ ID NO: 7157939 - DNA, 22 bp, Homo sapiens
aggaatgtgtttctaggctgtt

SEQ ID NO: 7157940 - DNA, 22 bp, Homo sapiens
aggaatgtgtttctaggctgtt

SEQ ID NO: 7157941 - DNA, 22 bp, Homo sapiens
aggaatgttaaagattaagagc

SEQ ID NO: 7157942 - DNA, 22 bp, Homo sapiens
aggaatgttaaagattaagagc

SEQ ID NO: 7157943 - DNA, 22 bp, Homo sapiens
aggaatgttaaagattaagagc

SEQ ID NO: 7157944 - DNA, 22 bp, Homo sapiens
aggaatgttaagaaggtctacc

SEQ ID NO: 7157945 - DNA, 22 bp, Homo sapiens
aggaatgttaagaaggtctacc

SEQ ID NO: 7157946 - DNA, 22 bp, Homo sapiens
aggaatgttaagaaggtctacc

SEQ ID NO: 7157947 - DNA, 22 bp, Homo sapiens
aggaatgttaagaaggtctacc

SEQ ID NO: 7157948 - DNA, 22 bp, Homo sapiens
aggaatgttaggagatgagtct

SEQ ID NO: 7157949 - DNA, 22 bp, Homo sapiens
aggaatgttaggagatgagtct

SEQ ID NO: 7157950 - DNA, 22 bp, Homo sapiens
aggaatgttaggagatgagtct

SEQ ID NO: 7157951 - DNA, 22 bp, Homo sapiens
aggaatgttagttctgtataca

SEQ ID NO: 7157952 - DNA, 22 bp, Homo sapiens
aggaatgttagttctgtataca

SEQ ID NO: 7157953 - DNA, 22 bp, Homo sapiens
aggaatgttagttctgtataca

SEQ ID NO: 7157954 - DNA, 22 bp, Homo sapiens
aggaatgtttacacgacagaaa

SEQ ID NO: 7157955 - DNA, 22 bp, Homo sapiens
aggaatgtttacacgacagaaa

SEQ ID NO: 7157956 - DNA, 22 bp, Homo sapiens
aggaatgtttacacgacagaaa

SEQ ID NO: 7157957 - DNA, 22 bp, Homo sapiens
aggaatgtttagaatgtcagaa

SEQ ID NO: 7157958 - DNA, 22 bp, Homo sapiens
aggaatgtttagaatgtcagaa

SEQ ID NO: 7157959 - DNA, 22 bp, Homo sapiens
aggaatgtttagaatgtcagaa

SEQ ID NO: 7157960 - DNA, 22 bp, Homo sapiens
aggaatgtttagaatgtcagaa

SEQ ID NO: 7157961 - DNA, 22 bp, Homo sapiens
aggaatgtttagaatgtcagaa

SEQ ID NO: 7157962 - DNA, 20 bp, Homo sapiens
aggaaggagaatctgagcaa

SEQ ID NO: 7157963 - DNA, 20 bp, Homo sapiens
aggaaggagaatctgagcaa

SEQ ID NO: 7157964 - DNA, 22 bp, Homo sapiens
aggaagcactggaaggggttgg

SEQ ID NO: 7157965 - DNA, 22 bp, Homo sapiens
aggaagcaaaaggcagggtcta

SEQ ID NO: 7157966 - DNA, 22 bp, Homo sapiens
aggaagcaaaaggcagggtcta

SEQ ID NO: 7157967 - DNA, 22 bp, Homo sapiens
aggaagcaaaaggcagggtcta

SEQ ID NO: 7157968 - DNA, 22 bp, Homo sapiens
aggaagcaaaaggcagggtcta

SEQ ID NO: 7157969 - DNA, 22 bp, Homo sapiens
aggaagatgggagagctctgga

SEQ ID NO: 7157970 - DNA, 22 bp, Homo sapiens
aggaagatgtgcaaagttggaa

SEQ ID NO: 7157971 - DNA, 22 bp, Homo sapiens
aggaagatgtgtttagcaggtt

SEQ ID NO: 7157972 - DNA, 22 bp, Homo sapiens
aggaagagtgttacctatgggt

SEQ ID NO: 7157973 - DNA, 20 bp, Homo sapiens
aggaagatcctttcttttaa

SEQ ID NO: 7157974 - DNA, 22 bp, Homo sapiens
aggaagatgggagagctctgga

SEQ ID NO: 7157975 - DNA, 22 bp, Homo sapiens
aggaagaggtgtgcaatggtgt

SEQ ID NO: 7157976 - DNA, 22 bp, Homo sapiens
aggaagaggtgtgcaatggtgt

SEQ ID NO: 7157977 - DNA, 22 bp, Homo sapiens
aggaagaggtgtgcaatggtgt

SEQ ID NO: 7157978 - DNA, 22 bp, Homo sapiens
aggaagaggtgtgcaatggtgt

SEQ ID NO: 7157979 - DNA, 22 bp, Homo sapiens
aggaagaggtagctgtcaaggg

SEQ ID NO: 7157980 - DNA, 22 bp, Homo sapiens
aggaagagggtggcagataatc

SEQ ID NO: 7157981 - DNA, 22 bp, Homo sapiens
aggaagaggtagctgtcaaggg

SEQ ID NO: 7157982 - DNA, 22 bp, Homo sapiens
aggaagaggtagctgtcaaggg

SEQ ID NO: 7157983 - DNA, 22 bp, Homo sapiens
cagggtttcaccatgttagcag

SEQ ID NO: 7157984 - DNA, 22 bp, Homo sapiens
cagggtttcaccatgttagcag

SEQ ID NO: 7157985 - DNA, 22 bp, Homo sapiens
cagggtttcaccatgttagcag

SEQ ID NO: 7157986 - DNA, 22 bp, Homo sapiens
cagggtttcaccatgttagcag

SEQ ID NO: 7157987 - DNA, 22 bp, Homo sapiens
cagggtttcaccatgttagcag

SEQ ID NO: 7157988 - DNA, 22 bp, Homo sapiens
cagggttgggctccaaggatgg

SEQ ID NO: 7157989 - DNA, 17 bp, Homo sapiens
aggaaacattttctttc

SEQ ID NO: 7157990 - DNA, 17 bp, Homo sapiens
aggaaacattttctttc

SEQ ID NO: 7157991 - DNA, 22 bp, Homo sapiens
aggaaacattgatattgggaaa

SEQ ID NO: 7157992 - DNA, 22 bp, Homo sapiens
aggaaacatgaatctgccttga

SEQ ID NO: 7157993 - DNA, 22 bp, Homo sapiens
aggaaacatgaatctgccttga

SEQ ID NO: 7157994 - DNA, 22 bp, Homo sapiens
aggaaacagagtgaagcttggg

SEQ ID NO: 7157995 - DNA, 22 bp, Homo sapiens
aggaaacagtgaacttggcagg

SEQ ID NO: 7157996 - DNA, 22 bp, Homo sapiens
aggaaacagttggtaatgcata

SEQ ID NO: 7157997 - DNA, 22 bp, Homo sapiens
aggaaacagttggtaatgcata

SEQ ID NO: 7157998 - DNA, 22 bp, Homo sapiens
aggaaacagttggtaatgcata

SEQ ID NO: 7157999 - DNA, 22 bp, Homo sapiens
aggaaacatccttatctattct

SEQ ID NO: 7158000 - DNA, 22 bp, Homo sapiens
aggaaacatccttatctattct

SEQ ID NO: 7158001 - DNA, 22 bp, Homo sapiens
aggaaacatccttatctattct

SEQ ID NO: 7158002 - DNA, 22 bp, Homo sapiens
cagggtggggctggctatcaaa

SEQ ID NO: 7158003 - DNA, 22 bp, Homo sapiens
cagggtggtaccagcatctagt

SEQ ID NO: 7158004 - DNA, 22 bp, Homo sapiens
cagggtggtaccagcatctagt

SEQ ID NO: 7158005 - DNA, 22 bp, Homo sapiens
cagggtggtaccagcatctagt

SEQ ID NO: 7158006 - DNA, 22 bp, Homo sapiens
cagggtggtaccagcatctagt

SEQ ID NO: 7158007 - DNA, 22 bp, Homo sapiens
cagggtgcttccgtggagctgt

SEQ ID NO: 7158008 - DNA, 22 bp, Homo sapiens
cagggtggggctggctatcaaa

SEQ ID NO: 7158009 - DNA, 22 bp, Homo sapiens
cagggtgctgcaccatccctca

SEQ ID NO: 7158010 - DNA, 22 bp, Homo sapiens
cagggtgctgcaccatccctca

SEQ ID NO: 7158011 - DNA, 22 bp, Homo sapiens
cagggtggtaccagcatctagt

SEQ ID NO: 7158012 - DNA, 22 bp, Homo sapiens
cagggtggtaccagcatctagt

SEQ ID NO: 7158013 - DNA, 22 bp, Homo sapiens
cagggtggtaccagcatctagt

SEQ ID NO: 7158014 - DNA, 22 bp, Homo sapiens
cagggtggtgaatagctatagt

SEQ ID NO: 7158015 - DNA, 22 bp, Homo sapiens
cagggtggtaccagcatctagt

SEQ ID NO: 7158016 - DNA, 22 bp, Homo sapiens
cagggtggtgaatagctatagt

SEQ ID NO: 7158017 - DNA, 22 bp, Homo sapiens
cagggtggtgaatagctatagt

SEQ ID NO: 7158018 - DNA, 22 bp, Homo sapiens
cagggtggtgaatagctatagt

SEQ ID NO: 7158019 - DNA, 22 bp, Homo sapiens
cagggtggtgaatagctatagt

SEQ ID NO: 7158020 - DNA, 22 bp, Homo sapiens
cagggtgtatagtgtagaagtt

SEQ ID NO: 7158021 - DNA, 22 bp, Homo sapiens
cagggtgtatagtgtagaagtt

SEQ ID NO: 7158022 - DNA, 22 bp, Homo sapiens
cagggtgtgaacagtgtaaaac

SEQ ID NO: 7158023 - DNA, 22 bp, Homo sapiens
cagggtgtggtctgcattcgga

SEQ ID NO: 7158024 - DNA, 22 bp, Homo sapiens
cagggtgtggtctgcattcgga

SEQ ID NO: 7158025 - DNA, 22 bp, Homo sapiens
cagggttcagtgggccctcttg

SEQ ID NO: 7158026 - DNA, 22 bp, Homo sapiens
agctttcactgatatgctttga

SEQ ID NO: 7158027 - DNA, 22 bp, Homo sapiens
agctttcaggataatgaaaaag

SEQ ID NO: 7158028 - DNA, 22 bp, Homo sapiens
agctttccactatcttaggggt

SEQ ID NO: 7158029 - DNA, 22 bp, Homo sapiens
agctttatatttaatgaattct

SEQ ID NO: 7158030 - DNA, 22 bp, Homo sapiens
agcttctgttcatcttccaggc

SEQ ID NO: 7158031 - DNA, 22 bp, Homo sapiens
agctttatatttaatgaattct

SEQ ID NO: 7158032 - DNA, 22 bp, Homo sapiens
agctttatatttaatgaattct

SEQ ID NO: 7158033 - DNA, 22 bp, Homo sapiens
agctttatatttaatgaattct

SEQ ID NO: 7158034 - DNA, 22 bp, Homo sapiens
agctttattaactctccaggtg

SEQ ID NO: 7158035 - DNA, 22 bp, Homo sapiens
agctttattcatgatttcaggg

SEQ ID NO: 7158036 - DNA, 22 bp, Homo sapiens
agctttattcatgatttcaggg

SEQ ID NO: 7158037 - DNA, 22 bp, Homo sapiens
agctttatttgtcattcacggc

SEQ ID NO: 7158038 - DNA, 22 bp, Homo sapiens
agctttatttgtcattcacggc

SEQ ID NO: 7158039 - DNA, 22 bp, Homo sapiens
agcttctctggtcttctgccaa

SEQ ID NO: 7158040 - DNA, 22 bp, Homo sapiens
agcttctgaaagtctgttttcc

SEQ ID NO: 7158041 - DNA, 22 bp, Homo sapiens
agcttctgcccgtgtttgctct

SEQ ID NO: 7158042 - DNA, 22 bp, Homo sapiens
agcttctgcccgtgtttgctct

SEQ ID NO: 7158043 - DNA, 22 bp, Homo sapiens
agcttctgcatcttttcttccc

SEQ ID NO: 7158044 - DNA, 22 bp, Homo sapiens
agcttctctcagggtatctttc

SEQ ID NO: 7158045 - DNA, 22 bp, Homo sapiens
agcttctctcagggtatctttc

SEQ ID NO: 7158046 - DNA, 22 bp, Homo sapiens
agcttctctctttgcactcaca

SEQ ID NO: 7158047 - DNA, 22 bp, Homo sapiens
agcttctggaaggcaaggcttg

SEQ ID NO: 7158048 - DNA, 22 bp, Homo sapiens
agcttctgcccgtgtttgctct

SEQ ID NO: 7158049 - DNA, 22 bp, Homo sapiens
agcttctggaaggcaaggcttg

SEQ ID NO: 7158050 - DNA, 22 bp, Homo sapiens
caggcttgctgctagagcactt

SEQ ID NO: 7158051 - DNA, 22 bp, Homo sapiens
agcttctccctttcctattggt

SEQ ID NO: 7158052 - DNA, 22 bp, Homo sapiens
caggcttgagggcaggcccagt

SEQ ID NO: 7158053 - DNA, 22 bp, Homo sapiens
caggcttgattattcagacaat

SEQ ID NO: 7158054 - DNA, 22 bp, Homo sapiens
caggcttgctagaggagccaaa

SEQ ID NO: 7158055 - DNA, 22 bp, Homo sapiens
caggcttgctagaggagccaaa

SEQ ID NO: 7158056 - DNA, 22 bp, Homo sapiens
caggcttcgctctgtgggcagg

SEQ ID NO: 7158057 - DNA, 22 bp, Homo sapiens
caggcttcttttctttccagac

SEQ ID NO: 7158058 - DNA, 22 bp, Homo sapiens
caggcttcttttctttccagac

SEQ ID NO: 7158059 - DNA, 22 bp, Homo sapiens
caggcttgaagcttcagagtat

SEQ ID NO: 7158060 - DNA, 22 bp, Homo sapiens
caggcttgaagcttcagagtat

SEQ ID NO: 7158061 - DNA, 22 bp, Homo sapiens
caggcttgagggcaggcccagt

SEQ ID NO: 7158062 - DNA, 22 bp, Homo sapiens
agctggtgctgaagctcttgag

SEQ ID NO: 7158063 - DNA, 22 bp, Homo sapiens
agctggtgctgaagctcttgag

SEQ ID NO: 7158064 - DNA, 22 bp, Homo sapiens
agctggtgctgaagctcttgag

SEQ ID NO: 7158065 - DNA, 22 bp, Homo sapiens
agctggtgctgaagctcttgag

SEQ ID NO: 7158066 - DNA, 22 bp, Homo sapiens
agctggtgctcggggagctggc

SEQ ID NO: 7158067 - DNA, 22 bp, Homo sapiens
agctggtgctcggggagctggc

SEQ ID NO: 7158068 - DNA, 22 bp, Homo sapiens
agctggtgctcggggagctggc

SEQ ID NO: 7158069 - DNA, 22 bp, Homo sapiens
caggctggagttcagtggtgtg

SEQ ID NO: 7158070 - DNA, 22 bp, Homo sapiens
caggctggagttcagtggtgtg

SEQ ID NO: 7158071 - DNA, 22 bp, Homo sapiens
caggctgtgaaactgagatgcg

SEQ ID NO: 7158072 - DNA, 22 bp, Homo sapiens
caggctgtctgctgaggaaagg

SEQ ID NO: 7158073 - DNA, 22 bp, Homo sapiens
caggctgtgaaactgagatgcg

SEQ ID NO: 7158074 - DNA, 22 bp, Homo sapiens
caggctgtgaaactgagatgcg

SEQ ID NO: 7158075 - DNA, 22 bp, Homo sapiens
caggctgtggatcaggagcctt

SEQ ID NO: 7158076 - DNA, 22 bp, Homo sapiens
caggctgtgggagtcaggaccc

SEQ ID NO: 7158077 - DNA, 22 bp, Homo sapiens
caggctgtgggagtcaggaccc

SEQ ID NO: 7158078 - DNA, 22 bp, Homo sapiens
caggcttaggagtcagcctgct

SEQ ID NO: 7158079 - DNA, 22 bp, Homo sapiens
caggcttcagcatccacttagt

SEQ ID NO: 7158080 - DNA, 22 bp, Homo sapiens
cagggacataagaggaacatgg

SEQ ID NO: 7158081 - DNA, 22 bp, Homo sapiens
cagggacataagaggaacatgg

SEQ ID NO: 7158082 - DNA, 22 bp, Homo sapiens
cagggacaggggagaaaagatg

SEQ ID NO: 7158083 - DNA, 20 bp, Homo sapiens
cagggacagtggcagattca

SEQ ID NO: 7158084 - DNA, 20 bp, Homo sapiens
cagggacagtggcagattca

SEQ ID NO: 7158085 - DNA, 22 bp, Homo sapiens
cagggacataagaggaacatgg

SEQ ID NO: 7158086 - DNA, 22 bp, Homo sapiens
cagggacatgactggtctctgt

SEQ ID NO: 7158087 - DNA, 22 bp, Homo sapiens
cagggacaggggagaaaagatg

SEQ ID NO: 7158088 - DNA, 22 bp, Homo sapiens
cagggacagggatcatttgctt

SEQ ID NO: 7158089 - DNA, 22 bp, Homo sapiens
cagggacaggggagaaaagatg

SEQ ID NO: 7158090 - DNA, 22 bp, Homo sapiens
cagggacagggatcatttgctt

SEQ ID NO: 7158091 - DNA, 22 bp, Homo sapiens
cagggacagcgggactctgaca

SEQ ID NO: 7158092 - DNA, 22 bp, Homo sapiens
cagggacagggatcatttgctt

SEQ ID NO: 7158093 - DNA, 22 bp, Homo sapiens
cagggacagcgggactctgaca

SEQ ID NO: 7158094 - DNA, 22 bp, Homo sapiens
cagggacagcgggactctgaca

SEQ ID NO: 7158095 - DNA, 22 bp, Homo sapiens
agctttctcttctttagaaagt

SEQ ID NO: 7158096 - DNA, 22 bp, Homo sapiens
agctttctctcagccaggctgc

SEQ ID NO: 7158097 - DNA, 22 bp, Homo sapiens
agctttctggttacagtcttca

SEQ ID NO: 7158098 - DNA, 22 bp, Homo sapiens
agctttctccctgacgctttgg

SEQ ID NO: 7158099 - DNA, 20 bp, Homo sapiens
agctttctccttggagctcc

SEQ ID NO: 7158100 - DNA, 22 bp, Homo sapiens
cagggacatttccaagagaatt

SEQ ID NO: 7158101 - DNA, 22 bp, Homo sapiens
cagggacattggtggccaggtt

SEQ ID NO: 7158102 - DNA, 22 bp, Homo sapiens
cagggacattggtggccaggtt

SEQ ID NO: 7158103 - DNA, 22 bp, Homo sapiens
cagggacatttccaagagaatt

SEQ ID NO: 7158104 - DNA, 22 bp, Homo sapiens
cagggacattggtggccaggtt

SEQ ID NO: 7158105 - DNA, 22 bp, Homo sapiens
cagggacattggtggccaggtt

SEQ ID NO: 7158106 - DNA, 22 bp, Homo sapiens
agctttggggacagccaaggtt

SEQ ID NO: 7158107 - DNA, 22 bp, Homo sapiens
cagggactgagatccagactgt

SEQ ID NO: 7158108 - DNA, 22 bp, Homo sapiens
cagggactacagccagccctcc

SEQ ID NO: 7158109 - DNA, 22 bp, Homo sapiens
cagggaccctactagctcacac

SEQ ID NO: 7158110 - DNA, 22 bp, Homo sapiens
cagggaccctactagctcacac

SEQ ID NO: 7158111 - DNA, 22 bp, Homo sapiens
cagggaccctactagctcacac

SEQ ID NO: 7158112 - DNA, 22 bp, Homo sapiens
cagggactcgctggacataccg

SEQ ID NO: 7158113 - DNA, 22 bp, Homo sapiens
cagggactgagatccagactgt

SEQ ID NO: 7158114 - DNA, 20 bp, Homo sapiens
aggaaaagggtggtggtaga

SEQ ID NO: 7158115 - DNA, 22 bp, Homo sapiens
aggaaaacacagtattgatgga

SEQ ID NO: 7158116 - DNA, 20 bp, Homo sapiens
aggaaaagggtggtggtaga

SEQ ID NO: 7158117 - DNA, 20 bp, Homo sapiens
aggaaaagggtggtggtaga

SEQ ID NO: 7158118 - DNA, 20 bp, Homo sapiens
aggaaaagggtggtggtaga

SEQ ID NO: 7158119 - DNA, 20 bp, Homo sapiens
aggaaaagggtggtggtaga

SEQ ID NO: 7158120 - DNA, 22 bp, Homo sapiens
aggaaaagtgtgaagtatggag

SEQ ID NO: 7158121 - DNA, 22 bp, Homo sapiens
aggaaaagtgtgaagtatggag

SEQ ID NO: 7158122 - DNA, 22 bp, Homo sapiens
aggaaaagtgtgaagtatggag

SEQ ID NO: 7158123 - DNA, 22 bp, Homo sapiens
agctttgggggtaggtatagag

SEQ ID NO: 7158124 - DNA, 22 bp, Homo sapiens
aggaaaaataaggcagcagggc

SEQ ID NO: 7158125 - DNA, 22 bp, Homo sapiens
aggaaaaataaggcagcagggc

SEQ ID NO: 7158126 - DNA, 20 bp, Homo sapiens
aggaaaaatggaaactggag

SEQ ID NO: 7158127 - DNA, 20 bp, Homo sapiens
aggaaaaatggaaactggag

SEQ ID NO: 7158128 - DNA, 22 bp, Homo sapiens
aggaaaatcaatgtctttttaa

SEQ ID NO: 7158129 - DNA, 22 bp, Homo sapiens
aggaaaagtgtgaagtatggag

SEQ ID NO: 7158130 - DNA, 22 bp, Homo sapiens
aggaaaatgaaacagcaactgt

SEQ ID NO: 7158131 - DNA, 22 bp, Homo sapiens
aggaaaatgaaacagcaactgt

SEQ ID NO: 7158132 - DNA, 22 bp, Homo sapiens
aggaaaatgatattctgctgtt

SEQ ID NO: 7158133 - DNA, 22 bp, Homo sapiens
aggaaaatggaccagagttgtt

SEQ ID NO: 7158134 - DNA, 22 bp, Homo sapiens
aggaaaatggaccagagttgtt

SEQ ID NO: 7158135 - DNA, 22 bp, Homo sapiens
aggaaacagagtgaagcttggg

SEQ ID NO: 7158136 - DNA, 22 bp, Homo sapiens
aggaaacagaggtgccacaata

SEQ ID NO: 7158137 - DNA, 22 bp, Homo sapiens
aggaaacagaggtgccacaata

SEQ ID NO: 7158138 - DNA, 22 bp, Homo sapiens
aggaaacaacttggcatgagcc

SEQ ID NO: 7158139 - DNA, 22 bp, Homo sapiens
aggaaacaacttggcatgagcc

SEQ ID NO: 7158140 - DNA, 22 bp, Homo sapiens
aggaaacaacttggcatgagcc

SEQ ID NO: 7158141 - DNA, 22 bp, Homo sapiens
aggaaacaacttggcatgagcc

SEQ ID NO: 7158142 - DNA, 22 bp, Homo sapiens
aggaaaattatcatgagagcca

SEQ ID NO: 7158143 - DNA, 22 bp, Homo sapiens
aggaaaatggaccagagttgtt

SEQ ID NO: 7158144 - DNA, 22 bp, Homo sapiens
agctgggcagactgcagtggtt

SEQ ID NO: 7158145 - DNA, 22 bp, Homo sapiens
agctgggcagactgcagtggtt

SEQ ID NO: 7158146 - DNA, 22 bp, Homo sapiens
agctgggcagactgcagtggtt

SEQ ID NO: 7158147 - DNA, 22 bp, Homo sapiens
agctgggcagactgcagtggtt

SEQ ID NO: 7158148 - DNA, 22 bp, Homo sapiens
agctgggcagtgcttggattca

SEQ ID NO: 7158149 - DNA, 22 bp, Homo sapiens
agctgggcagtgcttggattca

SEQ ID NO: 7158150 - DNA, 23 bp, Homo sapiens
agctgggccaggtggtcagacct

SEQ ID NO: 7158151 - DNA, 21 bp, Homo sapiens
agctgggcctcagcctgcagt

SEQ ID NO: 7158152 - DNA, 21 bp, Homo sapiens
agctgggcctcagcctgcagt

SEQ ID NO: 7158153 - DNA, 23 bp, Homo sapiens
agctgggccaggtggtcagacct

SEQ ID NO: 7158154 - DNA, 22 bp, Homo sapiens
agctgggcaccccgctgcgtct

SEQ ID NO: 7158155 - DNA, 22 bp, Homo sapiens
agctgggactcaactgtctggg

SEQ ID NO: 7158156 - DNA, 22 bp, Homo sapiens
agctgggactcaactgtctggg

SEQ ID NO: 7158157 - DNA, 22 bp, Homo sapiens
agctgggcaccccgctgcgtct

SEQ ID NO: 7158158 - DNA, 22 bp, Homo sapiens
agctgggcaccccgctgcgtct

SEQ ID NO: 7158159 - DNA, 22 bp, Homo sapiens
agctggaggagtttctcctagc

SEQ ID NO: 7158160 - DNA, 22 bp, Homo sapiens
agctggaggataactcacttct

SEQ ID NO: 7158161 - DNA, 22 bp, Homo sapiens
agctgggactcaactgtctggg

SEQ ID NO: 7158162 - DNA, 22 bp, Homo sapiens
agctgggcctgatttgcagggg

SEQ ID NO: 7158163 - DNA, 22 bp, Homo sapiens
agctgggcctgatttgcagggg

SEQ ID NO: 7158164 - DNA, 22 bp, Homo sapiens
agctgggcctgagctggaagct

SEQ ID NO: 7158165 - DNA, 22 bp, Homo sapiens
agctgggcctgagctggaagct

SEQ ID NO: 7158166 - DNA, 21 bp, Homo sapiens
agctgggcctcagcctgcagt

SEQ ID NO: 7158167 - DNA, 22 bp, Homo sapiens
agctgggcctgagctggaagct

SEQ ID NO: 7158168 - DNA, 22 bp, Homo sapiens
agctgggcctgagctggaagct

SEQ ID NO: 7158169 - DNA, 22 bp, Homo sapiens
agctgggcctgagctggaagct

SEQ ID NO: 7158170 - DNA, 22 bp, Homo sapiens
agctgggcgcagtggctggtga

SEQ ID NO: 7158171 - DNA, 22 bp, Homo sapiens
agctgggcgcagtggctggtga

SEQ ID NO: 7158172 - DNA, 22 bp, Homo sapiens
agctgggcgcagtggctggtga

SEQ ID NO: 7158173 - DNA, 22 bp, Homo sapiens
agctgggcctgatttgcagggg

SEQ ID NO: 7158174 - DNA, 22 bp, Homo sapiens
agctgggcgcagtggctggtga

SEQ ID NO: 7158175 - DNA, 22 bp, Homo sapiens
agctgggcgcagtggctggtga

SEQ ID NO: 7158176 - DNA, 22 bp, Homo sapiens
agctgggctccaagagggatct

SEQ ID NO: 7158177 - DNA, 22 bp, Homo sapiens
agctgggctccaagagggatct

SEQ ID NO: 7158178 - DNA, 22 bp, Homo sapiens
agctgggctccaagagggatct

SEQ ID NO: 7158179 - DNA, 22 bp, Homo sapiens
agctgggctccaagagggatct

SEQ ID NO: 7158180 - DNA, 22 bp, Homo sapiens
agctgggctgatgactcatgtt

SEQ ID NO: 7158181 - DNA, 22 bp, Homo sapiens
agctgggctgatgactcatgtt

SEQ ID NO: 7158182 - DNA, 22 bp, Homo sapiens
agctgggctggagctccaagcg

SEQ ID NO: 7158183 - DNA, 22 bp, Homo sapiens
agctgggctggagctccaagcg

SEQ ID NO: 7158184 - DNA, 22 bp, Homo sapiens
agctgggctgatgactcatgtt

SEQ ID NO: 7158185 - DNA, 22 bp, Homo sapiens
caggcagaggaagtctgggtct

SEQ ID NO: 7158186 - DNA, 22 bp, Homo sapiens
agctggagccagtgtgaggctt

SEQ ID NO: 7158187 - DNA, 19 bp, Homo sapiens
agctggagattggagggca

SEQ ID NO: 7158188 - DNA, 19 bp, Homo sapiens
agctggagattggagggca

SEQ ID NO: 7158189 - DNA, 19 bp, Homo sapiens
agctggagattggagggca

SEQ ID NO: 7158190 - DNA, 22 bp, Homo sapiens
agctggagatgcccagcaccgg

SEQ ID NO: 7158191 - DNA, 22 bp, Homo sapiens
agctggagattctggggacagt

SEQ ID NO: 7158192 - DNA, 22 bp, Homo sapiens
agctggagattctggggacagt

SEQ ID NO: 7158193 - DNA, 22 bp, Homo sapiens
agctggagattctggggacagt

SEQ ID NO: 7158194 - DNA, 19 bp, Homo sapiens
agctggagattggagggca

SEQ ID NO: 7158195 - DNA, 19 bp, Homo sapiens
agctggagattggagggca

SEQ ID NO: 7158196 - DNA, 22 bp, Homo sapiens
agctggagccagtgtgaggctt

SEQ ID NO: 7158197 - DNA, 22 bp, Homo sapiens
agctggagccagtgtgaggctt

SEQ ID NO: 7158198 - DNA, 22 bp, Homo sapiens
agctggagccagtgtgaggctt

SEQ ID NO: 7158199 - DNA, 22 bp, Homo sapiens
agctggagccagtgtgaggctt

SEQ ID NO: 7158200 - DNA, 22 bp, Homo sapiens
agctggagccagtgtgaggctt

SEQ ID NO: 7158201 - DNA, 22 bp, Homo sapiens
agctggagcttcaagcaggtaa

SEQ ID NO: 7158202 - DNA, 22 bp, Homo sapiens
agctggagcttcaagcaggtaa

SEQ ID NO: 7158203 - DNA, 22 bp, Homo sapiens
agctggagccagtgtgaggctt

SEQ ID NO: 7158204 - DNA, 22 bp, Homo sapiens
agctggagcttcaagcaggtaa

SEQ ID NO: 7158205 - DNA, 22 bp, Homo sapiens
agctggagcttcaagcaggtaa

SEQ ID NO: 7158206 - DNA, 22 bp, Homo sapiens
agctggagcttcaagcaggtaa

SEQ ID NO: 7158207 - DNA, 22 bp, Homo sapiens
agctggagatgagtgacgtgcc

SEQ ID NO: 7158208 - DNA, 22 bp, Homo sapiens
agctggagatgcccagcaccgg

SEQ ID NO: 7158209 - DNA, 22 bp, Homo sapiens
agctggagatgcccagcaccgg

SEQ ID NO: 7158210 - DNA, 22 bp, Homo sapiens
agctggagatcatgctgatact

SEQ ID NO: 7158211 - DNA, 22 bp, Homo sapiens
agctggagatcatgctgatact

SEQ ID NO: 7158212 - DNA, 22 bp, Homo sapiens
agctggagagtttccaggaagg

SEQ ID NO: 7158213 - DNA, 22 bp, Homo sapiens
agctggagagtttccaggaagg

SEQ ID NO: 7158214 - DNA, 22 bp, Homo sapiens
agctggagaaacctgggagggt

SEQ ID NO: 7158215 - DNA, 22 bp, Homo sapiens
agctggagaataggaattagtg

SEQ ID NO: 7158216 - DNA, 22 bp, Homo sapiens
agctggagaaacctgggagggt

SEQ ID NO: 7158217 - DNA, 22 bp, Homo sapiens
agctggagaaacctgggagggt

SEQ ID NO: 7158218 - DNA, 21 bp, Homo sapiens
agctggaatctggctgtgctt

SEQ ID NO: 7158219 - DNA, 21 bp, Homo sapiens
agctggaatctggctgtgctt

SEQ ID NO: 7158220 - DNA, 22 bp, Homo sapiens
agctggaattacaggcacgcac

SEQ ID NO: 7158221 - DNA, 22 bp, Homo sapiens
agctggagaaacctgggagggt

SEQ ID NO: 7158222 - DNA, 22 bp, Homo sapiens
agctggtgagggttgaggggta

SEQ ID NO: 7158223 - DNA, 22 bp, Homo sapiens
agctggtgagggttgaggggta

SEQ ID NO: 7158224 - DNA, 22 bp, Homo sapiens
agctggtgagggttgaggggta

SEQ ID NO: 7158225 - DNA, 22 bp, Homo sapiens
agctggtgagggttgaggggta

SEQ ID NO: 7158226 - DNA, 22 bp, Homo sapiens
agctggtgcctgcttttgtgtg

SEQ ID NO: 7158227 - DNA, 22 bp, Homo sapiens
agctggtgcctgcttttgtgtg

SEQ ID NO: 7158228 - DNA, 22 bp, Homo sapiens
agctggtgctcaggggcatgga

SEQ ID NO: 7158229 - DNA, 22 bp, Homo sapiens
agctggtgctcaggggcatgga

SEQ ID NO: 7158230 - DNA, 22 bp, Homo sapiens
agctggtgctcaggggcatgga

SEQ ID NO: 7158231 - DNA, 22 bp, Homo sapiens
agctggtgaacctgaggcacag

SEQ ID NO: 7158232 - DNA, 22 bp, Homo sapiens
agctggtgaacctgaggcacag

SEQ ID NO: 7158233 - DNA, 20 bp, Homo sapiens
agctggtgaattaaagactg

SEQ ID NO: 7158234 - DNA, 22 bp, Homo sapiens
agctggtcctaattgagccatt

SEQ ID NO: 7158235 - DNA, 22 bp, Homo sapiens
agctggtccttcaatctagcat

SEQ ID NO: 7158236 - DNA, 22 bp, Homo sapiens
agctggtccttccctgccctgt

SEQ ID NO: 7158237 - DNA, 22 bp, Homo sapiens
agctggtccacttttgtatctt

SEQ ID NO: 7158238 - DNA, 22 bp, Homo sapiens
agctggtaagtggcagagattc

SEQ ID NO: 7158239 - DNA, 22 bp, Homo sapiens
agctggtatgaacaggatagga

SEQ ID NO: 7158240 - DNA, 22 bp, Homo sapiens
agctggtatttgttagggagtt

SEQ ID NO: 7158241 - DNA, 22 bp, Homo sapiens
agctgggtttctggcaggctta

SEQ ID NO: 7158242 - DNA, 22 bp, Homo sapiens
agctgggtttctggcaggctta

SEQ ID NO: 7158243 - DNA, 22 bp, Homo sapiens
agctggtaagtggcagagattc

SEQ ID NO: 7158244 - DNA, 19 bp, Homo sapiens
agctgggtgttagtggaga

SEQ ID NO: 7158245 - DNA, 19 bp, Homo sapiens
agctgggtgttagtggaga

SEQ ID NO: 7158246 - DNA, 22 bp, Homo sapiens
agctgggtgttcttgggcctaa

SEQ ID NO: 7158247 - DNA, 22 bp, Homo sapiens
agctgggtgttcttgggcctaa

SEQ ID NO: 7158248 - DNA, 22 bp, Homo sapiens
agctgggttcagaggcacatgg

SEQ ID NO: 7158249 - DNA, 17 bp, Homo sapiens
agctgggttctcaggaa

SEQ ID NO: 7158250 - DNA, 17 bp, Homo sapiens
agctgggttctcaggaa

SEQ ID NO: 7158251 - DNA, 17 bp, Homo sapiens
agctgggttctcaggaa

SEQ ID NO: 7158252 - DNA, 17 bp, Homo sapiens
agctgggttctcaggaa

SEQ ID NO: 7158253 - DNA, 22 bp, Homo sapiens
agctgggttgacaagatggaaa

SEQ ID NO: 7158254 - DNA, 22 bp, Homo sapiens
agctgggttgacaagatggaaa

SEQ ID NO: 7158255 - DNA, 22 bp, Homo sapiens
caggcagagtcagattagactt

SEQ ID NO: 7158256 - DNA, 22 bp, Homo sapiens
caggcagagtcagattagactt

SEQ ID NO: 7158257 - DNA, 22 bp, Homo sapiens
caggcagagtgagaagcccttg

SEQ ID NO: 7158258 - DNA, 22 bp, Homo sapiens
caggcagagtgagaagcccttg

SEQ ID NO: 7158259 - DNA, 20 bp, Homo sapiens
caggcagaggatgctgacca

SEQ ID NO: 7158260 - DNA, 20 bp, Homo sapiens
caggcagaggatgctgacca

SEQ ID NO: 7158261 - DNA, 20 bp, Homo sapiens
caggcagaggatgctgacca

SEQ ID NO: 7158262 - DNA, 20 bp, Homo sapiens
caggcagaggatgctgacca

SEQ ID NO: 7158263 - DNA, 22 bp, Homo sapiens
caggcagaggaggccttctcct

SEQ ID NO: 7158264 - DNA, 19 bp, Homo sapiens
agctggggcggtgtgtgtt

SEQ ID NO: 7158265 - DNA, 22 bp, Homo sapiens
agctgggtgcggtggctcatgc

SEQ ID NO: 7158266 - DNA, 22 bp, Homo sapiens
agctgggtgcggtggctcatgc

SEQ ID NO: 7158267 - DNA, 22 bp, Homo sapiens
caggcagagtgaggtggtctaa

SEQ ID NO: 7158268 - DNA, 22 bp, Homo sapiens
caggcagagtgaggtggtctaa

SEQ ID NO: 7158269 - DNA, 22 bp, Homo sapiens
caggcagagtgaggtggtctaa

SEQ ID NO: 7158270 - DNA, 22 bp, Homo sapiens
caggcagagtgaggtggtctaa

SEQ ID NO: 7158271 - DNA, 19 bp, Homo sapiens
agctggggcggtgtgtgtt

SEQ ID NO: 7158272 - DNA, 19 bp, Homo sapiens
agctggggcggtgtgtgtt

SEQ ID NO: 7158273 - DNA, 22 bp, Homo sapiens
agctgggtggtgctgagccttg

SEQ ID NO: 7158274 - DNA, 22 bp, Homo sapiens
agctgggtgtagggctggacaa

SEQ ID NO: 7158275 - DNA, 22 bp, Homo sapiens
agctgggtgtgtatcagataaa

SEQ ID NO: 7158276 - DNA, 21 bp, Homo sapiens
agctgggtgggctgagtgaca

SEQ ID NO: 7158277 - DNA, 21 bp, Homo sapiens
agctgggtgggctgagtgaca

SEQ ID NO: 7158278 - DNA, 21 bp, Homo sapiens
agctgggtgggctgagtgaca

SEQ ID NO: 7158279 - DNA, 21 bp, Homo sapiens
agctgggtgctaatgacaact

SEQ ID NO: 7158280 - DNA, 21 bp, Homo sapiens
agctgggtgctaatgacaact

SEQ ID NO: 7158281 - DNA, 22 bp, Homo sapiens
agctgggtggcctctcctcggg

SEQ ID NO: 7158282 - DNA, 22 bp, Homo sapiens
agctgggtggcctctcctcggg

SEQ ID NO: 7158283 - DNA, 23 bp, Homo sapiens
agctgggtggcctgcgtgaagct

SEQ ID NO: 7158284 - DNA, 22 bp, Homo sapiens
agctggaagctgatgagcacag

SEQ ID NO: 7158285 - DNA, 22 bp, Homo sapiens
agctggaagctgatgagcacag

SEQ ID NO: 7158286 - DNA, 22 bp, Homo sapiens
agctggaaagaaggtggcagcc

SEQ ID NO: 7158287 - DNA, 22 bp, Homo sapiens
agctggaaagaaggtggcagcc

SEQ ID NO: 7158288 - DNA, 22 bp, Homo sapiens
agctggaacccgggtgggcagc

SEQ ID NO: 7158289 - DNA, 22 bp, Homo sapiens
agctggaacccgggtgggcagc

SEQ ID NO: 7158290 - DNA, 22 bp, Homo sapiens
agctgctgggagaagtgagcca

SEQ ID NO: 7158291 - DNA, 22 bp, Homo sapiens
agctgctgggaccccagatcca

SEQ ID NO: 7158292 - DNA, 22 bp, Homo sapiens
agctgcctgcttatgagctcca

SEQ ID NO: 7158293 - DNA, 22 bp, Homo sapiens
agctgcctggagccagagttga

SEQ ID NO: 7158294 - DNA, 22 bp, Homo sapiens
agctgcctccctgtgcttgtcc

SEQ ID NO: 7158295 - DNA, 22 bp, Homo sapiens
agctgcctccctgtgcttgtcc

SEQ ID NO: 7158296 - DNA, 22 bp, Homo sapiens
agctgcctccctgtgcttgtcc

SEQ ID NO: 7158297 - DNA, 22 bp, Homo sapiens
agctgcctcctggtgccccatc

SEQ ID NO: 7158298 - DNA, 22 bp, Homo sapiens
agctgcctcctggtgccccatc

SEQ ID NO: 7158299 - DNA, 22 bp, Homo sapiens
agctgcctcctggtgccccatc

SEQ ID NO: 7158300 - DNA, 22 bp, Homo sapiens
agctgcctcctggtgccccatc

SEQ ID NO: 7158301 - DNA, 17 bp, Homo sapiens
agctgcctctcccacca

SEQ ID NO: 7158302 - DNA, 17 bp, Homo sapiens
agctgcctctcccacca

SEQ ID NO: 7158303 - DNA, 17 bp, Homo sapiens
agctgcctctcccacca

SEQ ID NO: 7158304 - DNA, 22 bp, Homo sapiens
agctgcctctcttgaggttacg

SEQ ID NO: 7158305 - DNA, 22 bp, Homo sapiens
agctgcctgcatttatatcctg

SEQ ID NO: 7158306 - DNA, 22 bp, Homo sapiens
agctgcctgccatgccgctggt

SEQ ID NO: 7158307 - DNA, 22 bp, Homo sapiens
agctgcctgccatgccgctggt

SEQ ID NO: 7158308 - DNA, 21 bp, Homo sapiens
agctgcctgctctggacctgg

SEQ ID NO: 7158309 - DNA, 21 bp, Homo sapiens
agctgcctgctctggacctgg

SEQ ID NO: 7158310 - DNA, 22 bp, Homo sapiens
agctgcctgcttatgagctcca

SEQ ID NO: 7158311 - DNA, 20 bp, Homo sapiens
agctgcccttttcacatgtt

SEQ ID NO: 7158312 - DNA, 22 bp, Homo sapiens
agctgccctttatgatgctgaa

SEQ ID NO: 7158313 - DNA, 22 bp, Homo sapiens
agctgcccttctcttgcccttg

SEQ ID NO: 7158314 - DNA, 22 bp, Homo sapiens
agctgccctttatgatgctgaa

SEQ ID NO: 7158315 - DNA, 22 bp, Homo sapiens
agctgcccttaataggcattca

SEQ ID NO: 7158316 - DNA, 22 bp, Homo sapiens
agctgccctgtggggagggttg

SEQ ID NO: 7158317 - DNA, 22 bp, Homo sapiens
agctgccctgtggggagggttg

SEQ ID NO: 7158318 - DNA, 22 bp, Homo sapiens
agctgccctgggtcttgctgct

SEQ ID NO: 7158319 - DNA, 21 bp, Homo sapiens
agctgcctccacttctgaggc

SEQ ID NO: 7158320 - DNA, 21 bp, Homo sapiens
agctgcctccacttctgaggc

SEQ ID NO: 7158321 - DNA, 21 bp, Homo sapiens
agctgcctccacttctgaggc

SEQ ID NO: 7158322 - DNA, 22 bp, Homo sapiens
agctgcctcagcaacacagacc

SEQ ID NO: 7158323 - DNA, 22 bp, Homo sapiens
agctgcctcagtcactcatggc

SEQ ID NO: 7158324 - DNA, 20 bp, Homo sapiens
agctgcccttttcacatgtt

SEQ ID NO: 7158325 - DNA, 22 bp, Homo sapiens
agctgcctcagcaacacagacc

SEQ ID NO: 7158326 - DNA, 22 bp, Homo sapiens
agctgccctgggctggagatgg

SEQ ID NO: 7158327 - DNA, 22 bp, Homo sapiens
agctgccctgggctggagatgg

SEQ ID NO: 7158328 - DNA, 18 bp, Homo sapiens
agctgccctgggctggag

SEQ ID NO: 7158329 - DNA, 22 bp, Homo sapiens
agctgccctggcggagctgctc

SEQ ID NO: 7158330 - DNA, 20 bp, Homo sapiens
agctgcccctgggcactgcc

SEQ ID NO: 7158331 - DNA, 22 bp, Homo sapiens
agctgccctcgctggggccaga

SEQ ID NO: 7158332 - DNA, 22 bp, Homo sapiens
agctgccctcgctggggccaga

SEQ ID NO: 7158333 - DNA, 22 bp, Homo sapiens
agctgccctggcggagctgctc

SEQ ID NO: 7158334 - DNA, 20 bp, Homo sapiens
agctgcccctgggcactgcc

SEQ ID NO: 7158335 - DNA, 22 bp, Homo sapiens
agctgcccctcattttcaccac

SEQ ID NO: 7158336 - DNA, 22 bp, Homo sapiens
agctgcccctcattttcaccac

SEQ ID NO: 7158337 - DNA, 22 bp, Homo sapiens
agctgcccccagggctgtgctt

SEQ ID NO: 7158338 - DNA, 22 bp, Homo sapiens
agctgccagatgacagtgctat

SEQ ID NO: 7158339 - DNA, 22 bp, Homo sapiens
agctgccagatgacagtgctat

SEQ ID NO: 7158340 - DNA, 22 bp, Homo sapiens
caggaagagaacatggaggctg

SEQ ID NO: 7158341 - DNA, 22 bp, Homo sapiens
caggaagaccagggctgtggct

SEQ ID NO: 7158342 - DNA, 22 bp, Homo sapiens
caggaagaccagggctgtggct

SEQ ID NO: 7158343 - DNA, 22 bp, Homo sapiens
caggaagaccagggctgtggct

SEQ ID NO: 7158344 - DNA, 22 bp, Homo sapiens
caggaagaccagggctgtggct

SEQ ID NO: 7158345 - DNA, 22 bp, Homo sapiens
caggaagaagggtggtgagtcc

SEQ ID NO: 7158346 - DNA, 22 bp, Homo sapiens
caggaagaagggtggtgagtcc

SEQ ID NO: 7158347 - DNA, 22 bp, Homo sapiens
caggaagaagggtggtgagtcc

SEQ ID NO: 7158348 - DNA, 22 bp, Homo sapiens
caggaagaccagggctgtggct

SEQ ID NO: 7158349 - DNA, 22 bp, Homo sapiens
caggaagaccagggctgtggct

SEQ ID NO: 7158350 - DNA, 22 bp, Homo sapiens
caggaagaaagaggtgaggtgt

SEQ ID NO: 7158351 - DNA, 22 bp, Homo sapiens
caggaagaaagaggtgaggtgt

SEQ ID NO: 7158352 - DNA, 22 bp, Homo sapiens
caggaacctgtgcgtagggatg

SEQ ID NO: 7158353 - DNA, 22 bp, Homo sapiens
caggaactcaaggtttgtaaca

SEQ ID NO: 7158354 - DNA, 22 bp, Homo sapiens
caggaagaaagaggtgaggtgt

SEQ ID NO: 7158355 - DNA, 22 bp, Homo sapiens
caggaagaaagaggtgaggtgt

SEQ ID NO: 7158356 - DNA, 22 bp, Homo sapiens
caggaagaaagaggtgaggtgt

SEQ ID NO: 7158357 - DNA, 22 bp, Homo sapiens
caggaaatgaacaggaatgaac

SEQ ID NO: 7158358 - DNA, 23 bp, Homo sapiens
caggaaatgaatccaggaggatg

SEQ ID NO: 7158359 - DNA, 22 bp, Homo sapiens
caggaaatgcgtagttgaactt

SEQ ID NO: 7158360 - DNA, 22 bp, Homo sapiens
caggaaatgctatcatagctga

SEQ ID NO: 7158361 - DNA, 22 bp, Homo sapiens
caggaaccagaaccttcccccg

SEQ ID NO: 7158362 - DNA, 22 bp, Homo sapiens
caggaacccccactctcagctc

SEQ ID NO: 7158363 - DNA, 22 bp, Homo sapiens
caggaacctaaagagacattac

SEQ ID NO: 7158364 - DNA, 22 bp, Homo sapiens
caggaacctaaagagacattac

SEQ ID NO: 7158365 - DNA, 22 bp, Homo sapiens
agctgaagaaatgggaagcatt

SEQ ID NO: 7158366 - DNA, 22 bp, Homo sapiens
agctgaagaaatgggaagcatt

SEQ ID NO: 7158367 - DNA, 22 bp, Homo sapiens
agctgaagaaatgggaagcatt

SEQ ID NO: 7158368 - DNA, 22 bp, Homo sapiens
agctcttttgctctccaagttt

SEQ ID NO: 7158369 - DNA, 22 bp, Homo sapiens
caggaaatatctcaacacttta

SEQ ID NO: 7158370 - DNA, 22 bp, Homo sapiens
caggaaaatctgcccacacaag

SEQ ID NO: 7158371 - DNA, 22 bp, Homo sapiens
agctgaagaaatgggaagcatt

SEQ ID NO: 7158372 - DNA, 22 bp, Homo sapiens
agctgaagaaatgggaagcatt

SEQ ID NO: 7158373 - DNA, 22 bp, Homo sapiens
agctgaagacctcaagtaagag

SEQ ID NO: 7158374 - DNA, 22 bp, Homo sapiens
caggaaaaggagactttagcac

SEQ ID NO: 7158375 - DNA, 17 bp, Homo sapiens
caggaaaatatgagtga

SEQ ID NO: 7158376 - DNA, 17 bp, Homo sapiens
caggaaaatatgagtga

SEQ ID NO: 7158377 - DNA, 22 bp, Homo sapiens
caggaaatatctcctggcagag

SEQ ID NO: 7158378 - DNA, 23 bp, Homo sapiens
caggaaatcaattcttccagcat

SEQ ID NO: 7158379 - DNA, 22 bp, Homo sapiens
caggaaatcactctgattttgg

SEQ ID NO: 7158380 - DNA, 21 bp, Homo sapiens
caggaaatcagtgtgaattag

SEQ ID NO: 7158381 - DNA, 22 bp, Homo sapiens
ccaggaaggcctggatgccccc

SEQ ID NO: 7158382 - DNA, 22 bp, Homo sapiens
ccaggaaggcctggatgccccc

SEQ ID NO: 7158383 - DNA, 22 bp, Homo sapiens
ccaggaaggcgttgttcctctc

SEQ ID NO: 7158384 - DNA, 22 bp, Homo sapiens
ccaggaagggctctttaaagac

SEQ ID NO: 7158385 - DNA, 22 bp, Homo sapiens
ccaggaaggtatgggaagaaaa

SEQ ID NO: 7158386 - DNA, 22 bp, Homo sapiens
ccaggaaggtatgggaagaaaa

SEQ ID NO: 7158387 - DNA, 22 bp, Homo sapiens
aggcctgggacgggagccgtga

SEQ ID NO: 7158388 - DNA, 22 bp, Homo sapiens
aggcctgggacgggagccgtga

SEQ ID NO: 7158389 - DNA, 22 bp, Homo sapiens
aggcctgggacgggagccgtga

SEQ ID NO: 7158390 - DNA, 18 bp, Homo sapiens
aggcctgggaagctgagg

SEQ ID NO: 7158391 - DNA, 22 bp, Homo sapiens
aggcctggcctttatgttcaag

SEQ ID NO: 7158392 - DNA, 22 bp, Homo sapiens
aggcctggctttggtttgctga

SEQ ID NO: 7158393 - DNA, 22 bp, Homo sapiens
aggcctggctttggtttgctga

SEQ ID NO: 7158394 - DNA, 22 bp, Homo sapiens
aggcctggctttggtttgctga

SEQ ID NO: 7158395 - DNA, 22 bp, Homo sapiens
aggcctggcctgggcggcattg

SEQ ID NO: 7158396 - DNA, 22 bp, Homo sapiens
aggcctggcctgggcggcattg

SEQ ID NO: 7158397 - DNA, 22 bp, Homo sapiens
aggcctggccccagttgctagg

SEQ ID NO: 7158398 - DNA, 22 bp, Homo sapiens
aggcctggcctgggcggcattg

SEQ ID NO: 7158399 - DNA, 22 bp, Homo sapiens
aggcctggcctttatgttcaag

SEQ ID NO: 7158400 - DNA, 22 bp, Homo sapiens
aggcctggcctttatgttcaag

SEQ ID NO: 7158401 - DNA, 22 bp, Homo sapiens
aggcctgctgtcttgaggccaa

SEQ ID NO: 7158402 - DNA, 22 bp, Homo sapiens
aggcctgctgtgtagcctgttg

SEQ ID NO: 7158403 - DNA, 22 bp, Homo sapiens
aggcctggcatgagacctgaga

SEQ ID NO: 7158404 - DNA, 22 bp, Homo sapiens
aggcctggcatgagacctgaga

SEQ ID NO: 7158405 - DNA, 22 bp, Homo sapiens
aggcctggcatgagacctgaga

SEQ ID NO: 7158406 - DNA, 22 bp, Homo sapiens
aggcctggccccagttgctagg

SEQ ID NO: 7158407 - DNA, 22 bp, Homo sapiens
aggcctggccccagttgctagg

SEQ ID NO: 7158408 - DNA, 22 bp, Homo sapiens
ccaggaatgaaatgtagataaa

SEQ ID NO: 7158409 - DNA, 22 bp, Homo sapiens
ccaggaatgaaatgtagataaa

SEQ ID NO: 7158410 - DNA, 22 bp, Homo sapiens
ccaggacaagccagagggacag

SEQ ID NO: 7158411 - DNA, 22 bp, Homo sapiens
ccaggacaagccagagggacag

SEQ ID NO: 7158412 - DNA, 22 bp, Homo sapiens
ccaggaaggtatgggaagaaaa

SEQ ID NO: 7158413 - DNA, 22 bp, Homo sapiens
ccaggaaggtgtttaactagag

SEQ ID NO: 7158414 - DNA, 22 bp, Homo sapiens
ccaggaaggtgtttaactagag

SEQ ID NO: 7158415 - DNA, 22 bp, Homo sapiens
ccaggaagtatgacccaacaga

SEQ ID NO: 7158416 - DNA, 22 bp, Homo sapiens
aggcgctgcatgtgaaggagtt

SEQ ID NO: 7158417 - DNA, 22 bp, Homo sapiens
aggcctgtctggggctcagcca

SEQ ID NO: 7158418 - DNA, 22 bp, Homo sapiens
aggcctgtcccagctgaggacg

SEQ ID NO: 7158419 - DNA, 22 bp, Homo sapiens
aggcctgtctgaggtccccact

SEQ ID NO: 7158420 - DNA, 22 bp, Homo sapiens
aggcctgtagttcctctttcca

SEQ ID NO: 7158421 - DNA, 22 bp, Homo sapiens
aggcctgtcccagctgaggacg

SEQ ID NO: 7158422 - DNA, 22 bp, Homo sapiens
ccaggacaagccagagggacag

SEQ ID NO: 7158423 - DNA, 22 bp, Homo sapiens
ccaggacaagtgtggccatggc

SEQ ID NO: 7158424 - DNA, 22 bp, Homo sapiens
ccaggacaagtgtggccatggc

SEQ ID NO: 7158425 - DNA, 22 bp, Homo sapiens
aggcctgtaatcccagcacttt

SEQ ID NO: 7158426 - DNA, 22 bp, Homo sapiens
aggcgtgggaggatctgaggcc

SEQ ID NO: 7158427 - DNA, 22 bp, Homo sapiens
aggcggtggccaaggagcggga

SEQ ID NO: 7158428 - DNA, 22 bp, Homo sapiens
aggcggtggccaaggagcggga

SEQ ID NO: 7158429 - DNA, 22 bp, Homo sapiens
aggcggtggccaaggagcggga

SEQ ID NO: 7158430 - DNA, 22 bp, Homo sapiens
aggcggtgtgctttgcagagca

SEQ ID NO: 7158431 - DNA, 22 bp, Homo sapiens
aggcggtgtgctttgcagagca

SEQ ID NO: 7158432 - DNA, 22 bp, Homo sapiens
aggcggtgctgtggacagtgac

SEQ ID NO: 7158433 - DNA, 22 bp, Homo sapiens
aggcggtgctgtggacagtgac

SEQ ID NO: 7158434 - DNA, 22 bp, Homo sapiens
aggcggggaggcgctgctgtag

SEQ ID NO: 7158435 - DNA, 22 bp, Homo sapiens
aggcgggttcagggctgccatg

SEQ ID NO: 7158436 - DNA, 22 bp, Homo sapiens
aggcggctggtgtcctgcaggt

SEQ ID NO: 7158437 - DNA, 22 bp, Homo sapiens
aggcggggaggcgctgctgtag

SEQ ID NO: 7158438 - DNA, 22 bp, Homo sapiens
aggcgctgcgctggggccagaa

SEQ ID NO: 7158439 - DNA, 22 bp, Homo sapiens
aggcgctgtgcttggggctgga

SEQ ID NO: 7158440 - DNA, 22 bp, Homo sapiens
aggcggagctcagtgtgtccaa

SEQ ID NO: 7158441 - DNA, 19 bp, Homo sapiens
aggcggctcgcgcgcctcc

SEQ ID NO: 7158442 - DNA, 22 bp, Homo sapiens
aggcggctggtgtcctgcaggt

SEQ ID NO: 7158443 - DNA, 22 bp, Homo sapiens
ccagctctgcttgcccagtcag

SEQ ID NO: 7158444 - DNA, 22 bp, Homo sapiens
ccagctctgcttgcccagtcag

SEQ ID NO: 7158445 - DNA, 22 bp, Homo sapiens
ccagctctgcttgcccagtcag

SEQ ID NO: 7158446 - DNA, 21 bp, Homo sapiens
ccagctctgcctccagttggt

SEQ ID NO: 7158447 - DNA, 22 bp, Homo sapiens
ccagctctgcttgcccagtcag

SEQ ID NO: 7158448 - DNA, 22 bp, Homo sapiens
ccagctctgcttgcccagtcag

SEQ ID NO: 7158449 - DNA, 22 bp, Homo sapiens
ccagctctggcttcttgctggg

SEQ ID NO: 7158450 - DNA, 22 bp, Homo sapiens
ccagctctggcttcttgctggg

SEQ ID NO: 7158451 - DNA, 22 bp, Homo sapiens
ccagctctggcttcttgctggg

SEQ ID NO: 7158452 - DNA, 22 bp, Homo sapiens
ccagctctgcttgcccagtcag

SEQ ID NO: 7158453 - DNA, 22 bp, Homo sapiens
ccagctctgcttgcccagtcag

SEQ ID NO: 7158454 - DNA, 22 bp, Homo sapiens
ccagctctggcttcttgctggg

SEQ ID NO: 7158455 - DNA, 22 bp, Homo sapiens
ccagctctggcttcttgctggg

SEQ ID NO: 7158456 - DNA, 22 bp, Homo sapiens
ccagctctggcttcttgctggg

SEQ ID NO: 7158457 - DNA, 22 bp, Homo sapiens
ccagctctgtaagctgtgaaat

SEQ ID NO: 7158458 - DNA, 22 bp, Homo sapiens
ccagctctgtaagctgtgaaat

SEQ ID NO: 7158459 - DNA, 22 bp, Homo sapiens
ccagctcttggtgcacttacat

SEQ ID NO: 7158460 - DNA, 22 bp, Homo sapiens
ccagctcttggtgcacttacat

SEQ ID NO: 7158461 - DNA, 22 bp, Homo sapiens
ccagctcttggtgcacttacat

SEQ ID NO: 7158462 - DNA, 22 bp, Homo sapiens
ccagctcttggtgcacttacat

SEQ ID NO: 7158463 - DNA, 22 bp, Homo sapiens
ccagctcttttggctgagtgag

SEQ ID NO: 7158464 - DNA, 22 bp, Homo sapiens
ccagctcttttggctgagtgag

SEQ ID NO: 7158465 - DNA, 22 bp, Homo sapiens
ccagctctgtaagctgtgaaat

SEQ ID NO: 7158466 - DNA, 22 bp, Homo sapiens
ccagcaggagatgcctgtgtct

SEQ ID NO: 7158467 - DNA, 22 bp, Homo sapiens
ccagcaggagagaacatttccc

SEQ ID NO: 7158468 - DNA, 22 bp, Homo sapiens
ccagcaggagatgcctgtgtct

SEQ ID NO: 7158469 - DNA, 22 bp, Homo sapiens
ccagcaggagatgcctgtgtct

SEQ ID NO: 7158470 - DNA, 22 bp, Homo sapiens
ccagcaggagactagcaacata

SEQ ID NO: 7158471 - DNA, 22 bp, Homo sapiens
ccagcaggagactagcaacata

SEQ ID NO: 7158472 - DNA, 22 bp, Homo sapiens
ccagcaggagactagcaacata

SEQ ID NO: 7158473 - DNA, 21 bp, Homo sapiens
ccagctctgcctccagttggt

SEQ ID NO: 7158474 - DNA, 21 bp, Homo sapiens
ccagctctgcctccagttggt

SEQ ID NO: 7158475 - DNA, 21 bp, Homo sapiens
ccagctctgcctccagttggt

SEQ ID NO: 7158476 - DNA, 21 bp, Homo sapiens
ccagctctgcctccagttggt

SEQ ID NO: 7158477 - DNA, 21 bp, Homo sapiens
ccagctctgcctccagttggt

SEQ ID NO: 7158478 - DNA, 21 bp, Homo sapiens
ccagctctgcctccagttggt

SEQ ID NO: 7158479 - DNA, 23 bp, Homo sapiens
ccagctccgtgagcctcgggctc

SEQ ID NO: 7158480 - DNA, 23 bp, Homo sapiens
ccagctccgtgagcctcgggctc

SEQ ID NO: 7158481 - DNA, 23 bp, Homo sapiens
ccagctccgtgagcctcgggctc

SEQ ID NO: 7158482 - DNA, 23 bp, Homo sapiens
ccagctccgtgagcctcgggctc

SEQ ID NO: 7158483 - DNA, 22 bp, Homo sapiens
ccagctccggtgtgcttatttc

SEQ ID NO: 7158484 - DNA, 22 bp, Homo sapiens
ccagctccggtgtgcttatttc

SEQ ID NO: 7158485 - DNA, 22 bp, Homo sapiens
ccagcaggagatgcctgtgtct

SEQ ID NO: 7158486 - DNA, 22 bp, Homo sapiens
ccagcaggagatgcctgtgtct

SEQ ID NO: 7158487 - DNA, 22 bp, Homo sapiens
ccagcaggcagtcatatccttt

SEQ ID NO: 7158488 - DNA, 22 bp, Homo sapiens
ccagctggagccaaggtggact

SEQ ID NO: 7158489 - DNA, 22 bp, Homo sapiens
ccagctggagccaaggtggact

SEQ ID NO: 7158490 - DNA, 22 bp, Homo sapiens
ccagctggagccaaggtggact

SEQ ID NO: 7158491 - DNA, 20 bp, Homo sapiens
ccagctgagccaaggggaga

SEQ ID NO: 7158492 - DNA, 20 bp, Homo sapiens
ccagctgagccaaggggaga

SEQ ID NO: 7158493 - DNA, 22 bp, Homo sapiens
ccagctggaaacaaatagagtg

SEQ ID NO: 7158494 - DNA, 22 bp, Homo sapiens
ccagctggaacggcagcccagc

SEQ ID NO: 7158495 - DNA, 22 bp, Homo sapiens
ccagctgacgatgcctggtctc

SEQ ID NO: 7158496 - DNA, 22 bp, Homo sapiens
ccagctgacgatgcctggtctc

SEQ ID NO: 7158497 - DNA, 22 bp, Homo sapiens
ccagctgagaagtgtaaagtga

SEQ ID NO: 7158498 - DNA, 22 bp, Homo sapiens
ccagctgagaagtgtaaagtga

SEQ ID NO: 7158499 - DNA, 22 bp, Homo sapiens
ccagctcttttggctgagtgag

SEQ ID NO: 7158500 - DNA, 22 bp, Homo sapiens
aggcctgctgtcttgaggccaa

SEQ ID NO: 7158501 - DNA, 22 bp, Homo sapiens
ccagctggcccagctgtgctcc

SEQ ID NO: 7158502 - DNA, 22 bp, Homo sapiens
ccagctggcccagctgtgctcc

SEQ ID NO: 7158503 - DNA, 22 bp, Homo sapiens
aggcctctgctggaaagagttg

SEQ ID NO: 7158504 - DNA, 22 bp, Homo sapiens
ccagctggcactgtggctgccc

SEQ ID NO: 7158505 - DNA, 22 bp, Homo sapiens
ccagctggcactgtggctgccc

SEQ ID NO: 7158506 - DNA, 22 bp, Homo sapiens
ccagctggcactgtggctgccc

SEQ ID NO: 7158507 - DNA, 22 bp, Homo sapiens
ccagctggcaggagagtcaggg

SEQ ID NO: 7158508 - DNA, 22 bp, Homo sapiens
ccagctggcaggagagtcaggg

SEQ ID NO: 7158509 - DNA, 22 bp, Homo sapiens
ccagctggcccagctgtgctcc

SEQ ID NO: 7158510 - DNA, 22 bp, Homo sapiens
ccagaacacagtggaagaatat

SEQ ID NO: 7158511 - DNA, 22 bp, Homo sapiens
ccagaacagacctgcctgacct

SEQ ID NO: 7158512 - DNA, 22 bp, Homo sapiens
ccagaaatggccctagtcagag

SEQ ID NO: 7158513 - DNA, 22 bp, Homo sapiens
ccagaaatggccctagtcagag

SEQ ID NO: 7158514 - DNA, 22 bp, Homo sapiens
ccagaaatggccctcaggtgac

SEQ ID NO: 7158515 - DNA, 22 bp, Homo sapiens
ccagaacacagtggaagaatat

SEQ ID NO: 7158516 - DNA, 22 bp, Homo sapiens
ccagaaagttcagctgtgaatg

SEQ ID NO: 7158517 - DNA, 22 bp, Homo sapiens
ccagaaagttcagctgtgaatg

SEQ ID NO: 7158518 - DNA, 22 bp, Homo sapiens
ccagaaaggtaaacactggatt

SEQ ID NO: 7158519 - DNA, 22 bp, Homo sapiens
ccagaaaggtaaacactggatt

SEQ ID NO: 7158520 - DNA, 22 bp, Homo sapiens
ccagaaatcctctctttcttgc

SEQ ID NO: 7158521 - DNA, 22 bp, Homo sapiens
ccagaaatgagtagaggatgct

SEQ ID NO: 7158522 - DNA, 22 bp, Homo sapiens
ccagaaatgagtagaggatgct

SEQ ID NO: 7158523 - DNA, 22 bp, Homo sapiens
ccagaacagacctgcctgacct

SEQ ID NO: 7158524 - DNA, 22 bp, Homo sapiens
ccagaaccaaaagcatggagta

SEQ ID NO: 7158525 - DNA, 22 bp, Homo sapiens
ccagaaccaaaagcatggagta

SEQ ID NO: 7158526 - DNA, 22 bp, Homo sapiens
ccagaactgagaaaataaattt

SEQ ID NO: 7158527 - DNA, 22 bp, Homo sapiens
ccagaactgagaaaataaattt

SEQ ID NO: 7158528 - DNA, 22 bp, Homo sapiens
ccagaacgtttgtgcgaggcag

SEQ ID NO: 7158529 - DNA, 22 bp, Homo sapiens
ccagaactgggcaacagaaagt

SEQ ID NO: 7158530 - DNA, 22 bp, Homo sapiens
ccagaactgggcaacagaaagt

SEQ ID NO: 7158531 - DNA, 22 bp, Homo sapiens
ccagaagaaaaagctggtatta

SEQ ID NO: 7158532 - DNA, 22 bp, Homo sapiens
ccagaagaacttaattcaaaac

SEQ ID NO: 7158533 - DNA, 22 bp, Homo sapiens
ccagaaagataggaaatcaagt

SEQ ID NO: 7158534 - DNA, 22 bp, Homo sapiens
ccagaaagataggaaatcaagt

SEQ ID NO: 7158535 - DNA, 22 bp, Homo sapiens
ccagaaagataggaaatcaagt

SEQ ID NO: 7158536 - DNA, 22 bp, Homo sapiens
ccagaaagactttttaggtacg

SEQ ID NO: 7158537 - DNA, 22 bp, Homo sapiens
ccagaaagactttttaggtacg

SEQ ID NO: 7158538 - DNA, 22 bp, Homo sapiens
ccagaaaatatggctaaggtga

SEQ ID NO: 7158539 - DNA, 22 bp, Homo sapiens
ccagaaacacctggattctgtt

SEQ ID NO: 7158540 - DNA, 22 bp, Homo sapiens
aggcaggctgctatggagtaga

SEQ ID NO: 7158541 - DNA, 18 bp, Homo sapiens
aggcaggctggagtgact

SEQ ID NO: 7158542 - DNA, 18 bp, Homo sapiens
aggcaggctggagtgact

SEQ ID NO: 7158543 - DNA, 22 bp, Homo sapiens
ccactgggggctgcaggcactc

SEQ ID NO: 7158544 - DNA, 22 bp, Homo sapiens
ccactgggggctgcaggcactc

SEQ ID NO: 7158545 - DNA, 22 bp, Homo sapiens
ccactgggggctgctcccaggt

SEQ ID NO: 7158546 - DNA, 22 bp, Homo sapiens
ccagaaaatatggctaaggtga

SEQ ID NO: 7158547 - DNA, 22 bp, Homo sapiens
ccactgggggctgcaggcactc

SEQ ID NO: 7158548 - DNA, 22 bp, Homo sapiens
ccactgggggctgcaggcactc

SEQ ID NO: 7158549 - DNA, 22 bp, Homo sapiens
aggccacagtactttgcagacc

SEQ ID NO: 7158550 - DNA, 22 bp, Homo sapiens
aggccacagtactttgcagacc

SEQ ID NO: 7158551 - DNA, 22 bp, Homo sapiens
aggccacaagaactaccccatc

SEQ ID NO: 7158552 - DNA, 22 bp, Homo sapiens
aggccacaagaactaccccatc

SEQ ID NO: 7158553 - DNA, 22 bp, Homo sapiens
aggccacagtactttgcagacc

SEQ ID NO: 7158554 - DNA, 22 bp, Homo sapiens
aggccacagtcagtgggtgctg

SEQ ID NO: 7158555 - DNA, 22 bp, Homo sapiens
aggccacagtcagtgggtgctg

SEQ ID NO: 7158556 - DNA, 22 bp, Homo sapiens
aggccacagtcagtgggtgctg

SEQ ID NO: 7158557 - DNA, 22 bp, Homo sapiens
aggccacagtcagtgggtgctg

SEQ ID NO: 7158558 - DNA, 22 bp, Homo sapiens
aggccacagttgaggccagcaa

SEQ ID NO: 7158559 - DNA, 22 bp, Homo sapiens
aggccacagttgaggccagcaa

SEQ ID NO: 7158560 - DNA, 22 bp, Homo sapiens
aggccacagttgaggccagcaa

SEQ ID NO: 7158561 - DNA, 22 bp, Homo sapiens
ccagactggggctccttgaggg

SEQ ID NO: 7158562 - DNA, 21 bp, Homo sapiens
ccagacttgagtgtatgttgt

SEQ ID NO: 7158563 - DNA, 22 bp, Homo sapiens
ccagagaaaaatgtgtccctgt

SEQ ID NO: 7158564 - DNA, 22 bp, Homo sapiens
ccagagaaaagaggccaaggat

SEQ ID NO: 7158565 - DNA, 22 bp, Homo sapiens
ccagagaaagctcacaggcagt

SEQ ID NO: 7158566 - DNA, 22 bp, Homo sapiens
ccagagaaagctcacaggcagt

SEQ ID NO: 7158567 - DNA, 22 bp, Homo sapiens
ccagagaaagctcacaggcagt

SEQ ID NO: 7158568 - DNA, 22 bp, Homo sapiens
ccagaagaccggggagtcaggg

SEQ ID NO: 7158569 - DNA, 22 bp, Homo sapiens
ccagaagaccggggagtcaggg

SEQ ID NO: 7158570 - DNA, 22 bp, Homo sapiens
ccagacagttccttgaggttca

SEQ ID NO: 7158571 - DNA, 22 bp, Homo sapiens
ccagacagttccttgaggttca

SEQ ID NO: 7158572 - DNA, 22 bp, Homo sapiens
ccagacatgtgcccttgaggaa

SEQ ID NO: 7158573 - DNA, 22 bp, Homo sapiens
ccagacatgtgcccttgaggaa

SEQ ID NO: 7158574 - DNA, 22 bp, Homo sapiens
ccagaccaccctggccatgcac

SEQ ID NO: 7158575 - DNA, 22 bp, Homo sapiens
ccagaccaccctggccatgcac

SEQ ID NO: 7158576 - DNA, 22 bp, Homo sapiens
ccagaccagactgacttgagcc

SEQ ID NO: 7158577 - DNA, 22 bp, Homo sapiens
ccagaccagactgacttgagcc

SEQ ID NO: 7158578 - DNA, 22 bp, Homo sapiens
ccagaccctccattcaagctcc

SEQ ID NO: 7158579 - DNA, 22 bp, Homo sapiens
ccagaccctgctctggggctct

SEQ ID NO: 7158580 - DNA, 22 bp, Homo sapiens
ccagaccctgctctggggctct

SEQ ID NO: 7158581 - DNA, 22 bp, Homo sapiens
ccagaccctttcttggcatgtg

SEQ ID NO: 7158582 - DNA, 22 bp, Homo sapiens
ccagaccctttcttggcatgtg

SEQ ID NO: 7158583 - DNA, 22 bp, Homo sapiens
ccagaccctttcttggcatgtg

SEQ ID NO: 7158584 - DNA, 22 bp, Homo sapiens
ccagacctaagcatcagtgcat

SEQ ID NO: 7158585 - DNA, 22 bp, Homo sapiens
ccagacctgcaaggctgagagg

SEQ ID NO: 7158586 - DNA, 22 bp, Homo sapiens
ccagactgagggtccctgagct

SEQ ID NO: 7158587 - DNA, 22 bp, Homo sapiens
ccagactgcttgcttcccagcc

SEQ ID NO: 7158588 - DNA, 22 bp, Homo sapiens
ccagagctgaggagatgggctt

SEQ ID NO: 7158589 - DNA, 22 bp, Homo sapiens
ccagagctccagggctacagaa

SEQ ID NO: 7158590 - DNA, 22 bp, Homo sapiens
ccagagctccagggctacagaa

SEQ ID NO: 7158591 - DNA, 22 bp, Homo sapiens
ccagagctgaggagatgggctt

SEQ ID NO: 7158592 - DNA, 22 bp, Homo sapiens
ccagagctgagggagcctgagc

SEQ ID NO: 7158593 - DNA, 22 bp, Homo sapiens
ccagagcctggcatctgcataa

SEQ ID NO: 7158594 - DNA, 22 bp, Homo sapiens
ccagagcctggcatctgcataa

SEQ ID NO: 7158595 - DNA, 22 bp, Homo sapiens
ccagagctaaacacacaggctg

SEQ ID NO: 7158596 - DNA, 17 bp, Homo sapiens
ccagagctactgagact

SEQ ID NO: 7158597 - DNA, 17 bp, Homo sapiens
ccagagctactgagact

SEQ ID NO: 7158598 - DNA, 22 bp, Homo sapiens
ccagagctccagggctacagaa

SEQ ID NO: 7158599 - DNA, 22 bp, Homo sapiens
ccagagctccagggctacagaa

SEQ ID NO: 7158600 - DNA, 22 bp, Homo sapiens
aggccagaaatgtcagggagtg

SEQ ID NO: 7158601 - DNA, 22 bp, Homo sapiens
aggccagaaaaagacagctcca

SEQ ID NO: 7158602 - DNA, 22 bp, Homo sapiens
aggccagaaaaagacagctcca

SEQ ID NO: 7158603 - DNA, 22 bp, Homo sapiens
aggccagaaatgtcagggagtg

SEQ ID NO: 7158604 - DNA, 22 bp, Homo sapiens
aggccagaaatgtcagggagtg

SEQ ID NO: 7158605 - DNA, 21 bp, Homo sapiens
ccagagcctgctgagccccct

SEQ ID NO: 7158606 - DNA, 21 bp, Homo sapiens
ccagagcctgctgagccccct

SEQ ID NO: 7158607 - DNA, 22 bp, Homo sapiens
ccagagcctggcatctgcataa

SEQ ID NO: 7158608 - DNA, 22 bp, Homo sapiens
ccagagcctggcatctgcataa

SEQ ID NO: 7158609 - DNA, 22 bp, Homo sapiens
ccagagcctggcatctgcataa

SEQ ID NO: 7158610 - DNA, 22 bp, Homo sapiens
ccagagcctggcatctgcataa

SEQ ID NO: 7158611 - DNA, 22 bp, Homo sapiens
aggccacattgtgattcccgca

SEQ ID NO: 7158612 - DNA, 22 bp, Homo sapiens
aggccacattgtgattcccgca

SEQ ID NO: 7158613 - DNA, 22 bp, Homo sapiens
aggccaccaccctatctcctgg

SEQ ID NO: 7158614 - DNA, 22 bp, Homo sapiens
aggccactcagggggccaagat

SEQ ID NO: 7158615 - DNA, 22 bp, Homo sapiens
aggccagaaaaagacagctcca

SEQ ID NO: 7158616 - DNA, 22 bp, Homo sapiens
aggccacagttgaggccagcaa

SEQ ID NO: 7158617 - DNA, 22 bp, Homo sapiens
aggccacatagcttgcatgtag

SEQ ID NO: 7158618 - DNA, 22 bp, Homo sapiens
aggccacatagcttgcatgtag

SEQ ID NO: 7158619 - DNA, 22 bp, Homo sapiens
aggccacatagcttgcatgtag

SEQ ID NO: 7158620 - DNA, 22 bp, Homo sapiens
aggccaggttcctcaatcttga

SEQ ID NO: 7158621 - DNA, 22 bp, Homo sapiens
aggccaggttcctcaatcttga

SEQ ID NO: 7158622 - DNA, 22 bp, Homo sapiens
aggccaggttcctcaatcttga

SEQ ID NO: 7158623 - DNA, 22 bp, Homo sapiens
aggccaggtggtcatgcttgct

SEQ ID NO: 7158624 - DNA, 22 bp, Homo sapiens
aggccaggtggtcatgcttgct

SEQ ID NO: 7158625 - DNA, 22 bp, Homo sapiens
aggccaggatagcatggatcag

SEQ ID NO: 7158626 - DNA, 22 bp, Homo sapiens
aggccaggcaacattctgaagt

SEQ ID NO: 7158627 - DNA, 22 bp, Homo sapiens
aggccaggcaacattctgaagt

SEQ ID NO: 7158628 - DNA, 22 bp, Homo sapiens
aggccagtgcctttccagggct

SEQ ID NO: 7158629 - DNA, 22 bp, Homo sapiens
aggccagtgtggctggagcaca

SEQ ID NO: 7158630 - DNA, 22 bp, Homo sapiens
aggccatgaggtcatgggagat

SEQ ID NO: 7158631 - DNA, 22 bp, Homo sapiens
aggccatgaggtcatgggagat

SEQ ID NO: 7158632 - DNA, 22 bp, Homo sapiens
aggccatgtggccccagagtct

SEQ ID NO: 7158633 - DNA, 22 bp, Homo sapiens
aggcccaaaagaaaccactggg

SEQ ID NO: 7158634 - DNA, 22 bp, Homo sapiens
aggcccaaaagaaaccactggg

SEQ ID NO: 7158635 - DNA, 23 bp, Homo sapiens
aggcccaactctgtgagggctgc

SEQ ID NO: 7158636 - DNA, 23 bp, Homo sapiens
aggcccaactctgtgagggctgc

SEQ ID NO: 7158637 - DNA, 22 bp, Homo sapiens
aggcccagactcagcggggcgg

SEQ ID NO: 7158638 - DNA, 22 bp, Homo sapiens
aggcccagactcagcggggcgg

SEQ ID NO: 7158639 - DNA, 22 bp, Homo sapiens
aggcccagagagccagttagtg

SEQ ID NO: 7158640 - DNA, 19 bp, Homo sapiens
ccagcagctttgattctct

SEQ ID NO: 7158641 - DNA, 22 bp, Homo sapiens
ccagcaggaaagtgacgtttga

SEQ ID NO: 7158642 - DNA, 22 bp, Homo sapiens
ccagcaggactttggaaatatg

SEQ ID NO: 7158643 - DNA, 22 bp, Homo sapiens
ccagcaggactttggaaatatg

SEQ ID NO: 7158644 - DNA, 22 bp, Homo sapiens
ccagcaggagactagcaacata

SEQ ID NO: 7158645 - DNA, 22 bp, Homo sapiens
aggctgcttcttgtccttggca

SEQ ID NO: 7158646 - DNA, 22 bp, Homo sapiens
aggctgcttcttgtccttggca

SEQ ID NO: 7158647 - DNA, 22 bp, Homo sapiens
aggctgcttcttgtccttggca

SEQ ID NO: 7158648 - DNA, 22 bp, Homo sapiens
aggctgcttcttgtccttggca

SEQ ID NO: 7158649 - DNA, 22 bp, Homo sapiens
aggctgctttattcacaatagc

SEQ ID NO: 7158650 - DNA, 22 bp, Homo sapiens
aggctgctttcatggccgcccc

SEQ ID NO: 7158651 - DNA, 22 bp, Homo sapiens
aggctgctttttatttacaggt

SEQ ID NO: 7158652 - DNA, 22 bp, Homo sapiens
aggctgctttttatttacaggt

SEQ ID NO: 7158653 - DNA, 22 bp, Homo sapiens
aggctgctcagtagatggagct

SEQ ID NO: 7158654 - DNA, 22 bp, Homo sapiens
aggctgcttcagctgcagggag

SEQ ID NO: 7158655 - DNA, 22 bp, Homo sapiens
aggctgcttccttacgtggctg

SEQ ID NO: 7158656 - DNA, 22 bp, Homo sapiens
aggctgcttccttacgtggctg

SEQ ID NO: 7158657 - DNA, 22 bp, Homo sapiens
aggctgcttccttacgtggctg

SEQ ID NO: 7158658 - DNA, 19 bp, Homo sapiens
aggctggagacaccaggcc

SEQ ID NO: 7158659 - DNA, 22 bp, Homo sapiens
aggctggacccgacacctgccc

SEQ ID NO: 7158660 - DNA, 22 bp, Homo sapiens
aggctggaaatcactagattcc

SEQ ID NO: 7158661 - DNA, 22 bp, Homo sapiens
aggctggaaagggaccagagtg

SEQ ID NO: 7158662 - DNA, 22 bp, Homo sapiens
aggctggaaagggaccagagtg

SEQ ID NO: 7158663 - DNA, 22 bp, Homo sapiens
aggctggaaagggaccagagtg

SEQ ID NO: 7158664 - DNA, 22 bp, Homo sapiens
aggctggaaagggaccagagtg

SEQ ID NO: 7158665 - DNA, 22 bp, Homo sapiens
ccaggtgaggtaggtatggtag

SEQ ID NO: 7158666 - DNA, 22 bp, Homo sapiens
ccaggtctttgactaatatgct

SEQ ID NO: 7158667 - DNA, 22 bp, Homo sapiens
ccaggtctggcactggccagtc

SEQ ID NO: 7158668 - DNA, 19 bp, Homo sapiens
ccaggtctggggccagatt

SEQ ID NO: 7158669 - DNA, 22 bp, Homo sapiens
ccaggtctggaaccaccagggc

SEQ ID NO: 7158670 - DNA, 22 bp, Homo sapiens
ccaggtctggcactggccagtc

SEQ ID NO: 7158671 - DNA, 19 bp, Homo sapiens
ccaggtctggggccagatt

SEQ ID NO: 7158672 - DNA, 22 bp, Homo sapiens
ccaggtcttcactttactgaag

SEQ ID NO: 7158673 - DNA, 22 bp, Homo sapiens
ccaggtcttcactttactgaag

SEQ ID NO: 7158674 - DNA, 22 bp, Homo sapiens
ccaggtcttggcccccggacct

SEQ ID NO: 7158675 - DNA, 22 bp, Homo sapiens
aggctggagagtgcagtggcgt

SEQ ID NO: 7158676 - DNA, 22 bp, Homo sapiens
aggctggagagtgcagtggcgt

SEQ ID NO: 7158677 - DNA, 22 bp, Homo sapiens
aggctggagagtgcagtggcgt

SEQ ID NO: 7158678 - DNA, 22 bp, Homo sapiens
aggctggagacccgccaagaaa

SEQ ID NO: 7158679 - DNA, 22 bp, Homo sapiens
aggctggagacccgccaagaaa

SEQ ID NO: 7158680 - DNA, 22 bp, Homo sapiens
aggctggagacccgccaagaaa

SEQ ID NO: 7158681 - DNA, 22 bp, Homo sapiens
aggctggagacccgccaagaaa

SEQ ID NO: 7158682 - DNA, 19 bp, Homo sapiens
aggctggagacaccaggcc

SEQ ID NO: 7158683 - DNA, 22 bp, Homo sapiens
aggctggagcaagggggcatat

SEQ ID NO: 7158684 - DNA, 22 bp, Homo sapiens
aggctggagcaagggggcatat

SEQ ID NO: 7158685 - DNA, 22 bp, Homo sapiens
aggctggagcaagggggcatat

SEQ ID NO: 7158686 - DNA, 22 bp, Homo sapiens
aggctggagcaagggggcatat

SEQ ID NO: 7158687 - DNA, 22 bp, Homo sapiens
aggctggagagtgcagtggcgt

SEQ ID NO: 7158688 - DNA, 22 bp, Homo sapiens
aggctggagagtgcagtggcgt

SEQ ID NO: 7158689 - DNA, 22 bp, Homo sapiens
aggctggagggcaatggcaaga

SEQ ID NO: 7158690 - DNA, 22 bp, Homo sapiens
aggctggaggtttgttgcggct

SEQ ID NO: 7158691 - DNA, 22 bp, Homo sapiens
aggctggagtacagtggctatt

SEQ ID NO: 7158692 - DNA, 22 bp, Homo sapiens
aggctggagtgtgcagtggcgc

SEQ ID NO: 7158693 - DNA, 22 bp, Homo sapiens
aggctggagtgtagcagtgcag

SEQ ID NO: 7158694 - DNA, 22 bp, Homo sapiens
aggctggagtgtagcagtgcag

SEQ ID NO: 7158695 - DNA, 22 bp, Homo sapiens
aggctggagtgtagcagtgcag

SEQ ID NO: 7158696 - DNA, 22 bp, Homo sapiens
aggctggagtgtagcagtgcag

SEQ ID NO: 7158697 - DNA, 22 bp, Homo sapiens
aggctggagtgctggagtgctg

SEQ ID NO: 7158698 - DNA, 22 bp, Homo sapiens
aggctggagtgtagcagtgcag

SEQ ID NO: 7158699 - DNA, 22 bp, Homo sapiens
aggctggccagtgctgcagtgg

SEQ ID NO: 7158700 - DNA, 22 bp, Homo sapiens
aggctggccagtgctgcagtgg

SEQ ID NO: 7158701 - DNA, 22 bp, Homo sapiens
aggctggagtacagtggctatt

SEQ ID NO: 7158702 - DNA, 22 bp, Homo sapiens
aggctggagtgcaatggcgtga

SEQ ID NO: 7158703 - DNA, 22 bp, Homo sapiens
aggctggagtgcagtggtgtga

SEQ ID NO: 7158704 - DNA, 22 bp, Homo sapiens
aggctggagtgtagcagtgcag

SEQ ID NO: 7158705 - DNA, 22 bp, Homo sapiens
aggctggagtgctggagtgctg

SEQ ID NO: 7158706 - DNA, 22 bp, Homo sapiens
aggctggagtgctggagtgctg

SEQ ID NO: 7158707 - DNA, 22 bp, Homo sapiens
aggctggagtgcagttgcatga

SEQ ID NO: 7158708 - DNA, 22 bp, Homo sapiens
aggctggagtgctggagtgctg

SEQ ID NO: 7158709 - DNA, 22 bp, Homo sapiens
aggctggagtgctggagtgctg

SEQ ID NO: 7158710 - DNA, 22 bp, Homo sapiens
aggctggcggtgactgctctga

SEQ ID NO: 7158711 - DNA, 22 bp, Homo sapiens
aggctggcggtgactgctctga

SEQ ID NO: 7158712 - DNA, 22 bp, Homo sapiens
aggctggcgtcaggggctgtac

SEQ ID NO: 7158713 - DNA, 22 bp, Homo sapiens
ccatttaacacagagttttcca

SEQ ID NO: 7158714 - DNA, 22 bp, Homo sapiens
ccatttagtaaggaagaacagc

SEQ ID NO: 7158715 - DNA, 22 bp, Homo sapiens
ccatttatagatgtatttggct

SEQ ID NO: 7158716 - DNA, 22 bp, Homo sapiens
ccatttatagatgtatttggct

SEQ ID NO: 7158717 - DNA, 22 bp, Homo sapiens
ccatttcactgggtagttgtgg

SEQ ID NO: 7158718 - DNA, 18 bp, Homo sapiens
ccatttcatgattattac

SEQ ID NO: 7158719 - DNA, 22 bp, Homo sapiens
ccatttgaaatgaatgttttta

SEQ ID NO: 7158720 - DNA, 18 bp, Homo sapiens
ccatttgaccttgaccga

SEQ ID NO: 7158721 - DNA, 22 bp, Homo sapiens
ccatttggcaagaaagagtcat

SEQ ID NO: 7158722 - DNA, 22 bp, Homo sapiens
ccatttggtatagtgaaaagga

SEQ ID NO: 7158723 - DNA, 22 bp, Homo sapiens
aggctggcggtgactgctctga

SEQ ID NO: 7158724 - DNA, 22 bp, Homo sapiens
aggctggcggtgactgctctga

SEQ ID NO: 7158725 - DNA, 22 bp, Homo sapiens
aggctggcgacatctggcgggc

SEQ ID NO: 7158726 - DNA, 17 bp, Homo sapiens
aggctggccttcacagt

SEQ ID NO: 7158727 - DNA, 22 bp, Homo sapiens
aggctggcgacatctggcgggc

SEQ ID NO: 7158728 - DNA, 22 bp, Homo sapiens
aggctggcgacatctggcgggc

SEQ ID NO: 7158729 - DNA, 22 bp, Homo sapiens
aggctggcgacatctggcgggc

SEQ ID NO: 7158730 - DNA, 22 bp, Homo sapiens
aggctggccctactggctgcct

SEQ ID NO: 7158731 - DNA, 22 bp, Homo sapiens
aggctggccctactggctgcct

SEQ ID NO: 7158732 - DNA, 22 bp, Homo sapiens
aggctggccctactggctgcct

SEQ ID NO: 7158733 - DNA, 22 bp, Homo sapiens
aggctggccctactggctgcct

SEQ ID NO: 7158734 - DNA, 22 bp, Homo sapiens
aggctggccctactggctgcct

SEQ ID NO: 7158735 - DNA, 17 bp, Homo sapiens
aggctggccttcacagt

SEQ ID NO: 7158736 - DNA, 17 bp, Homo sapiens
aggctggccttcacagt

SEQ ID NO: 7158737 - DNA, 22 bp, Homo sapiens
aggctgggaaggtaaagttgta

SEQ ID NO: 7158738 - DNA, 22 bp, Homo sapiens
aggctgggaaggtaaagttgta

SEQ ID NO: 7158739 - DNA, 22 bp, Homo sapiens
aggctgggaaggtaaagttgta

SEQ ID NO: 7158740 - DNA, 22 bp, Homo sapiens
aggctgggaaggtaaagttgta

SEQ ID NO: 7158741 - DNA, 22 bp, Homo sapiens
aggctgggaaggtaaagttgta

SEQ ID NO: 7158742 - DNA, 22 bp, Homo sapiens
aggctgggaaggtaaagttgta

SEQ ID NO: 7158743 - DNA, 22 bp, Homo sapiens
aggctggctggggatgcgtctt

SEQ ID NO: 7158744 - DNA, 22 bp, Homo sapiens
ccattttattagtgacatttag

SEQ ID NO: 7158745 - DNA, 22 bp, Homo sapiens
ccatttgttttcgctaccatgg

SEQ ID NO: 7158746 - DNA, 22 bp, Homo sapiens
ccattttattagtgacatttag

SEQ ID NO: 7158747 - DNA, 22 bp, Homo sapiens
ccattttattagtgacatttag

SEQ ID NO: 7158748 - DNA, 22 bp, Homo sapiens
ccatttgtttcccttgggaaac

SEQ ID NO: 7158749 - DNA, 22 bp, Homo sapiens
ccatttgtgcttcttcaaagca

SEQ ID NO: 7158750 - DNA, 22 bp, Homo sapiens
ccatttgtggtttatttgctct

SEQ ID NO: 7158751 - DNA, 22 bp, Homo sapiens
ccatttgttcgcccagctccaa

SEQ ID NO: 7158752 - DNA, 22 bp, Homo sapiens
ccatttgttcgcccagctccaa

SEQ ID NO: 7158753 - DNA, 22 bp, Homo sapiens
ccatttgttgagaacgtgcctt

SEQ ID NO: 7158754 - DNA, 22 bp, Homo sapiens
ccatttgttgtgtattaatatt

SEQ ID NO: 7158755 - DNA, 22 bp, Homo sapiens
ccatttgtaaccttagagcaat

SEQ ID NO: 7158756 - DNA, 22 bp, Homo sapiens
ccatttgtaccatttctttgta

SEQ ID NO: 7158757 - DNA, 21 bp, Homo sapiens
ccatttgtaggtttccctctg

SEQ ID NO: 7158758 - DNA, 22 bp, Homo sapiens
ccatttgtattactgccccagg

SEQ ID NO: 7158759 - DNA, 22 bp, Homo sapiens
ccatttgtcacctctgcactcc

SEQ ID NO: 7158760 - DNA, 22 bp, Homo sapiens
ccatttgtcacctctgcactcc

SEQ ID NO: 7158761 - DNA, 22 bp, Homo sapiens
ccatttgtgatgtggcagcatc

SEQ ID NO: 7158762 - DNA, 22 bp, Homo sapiens
aggctgggctccgcccaactcc

SEQ ID NO: 7158763 - DNA, 22 bp, Homo sapiens
aggctggggaattgaatttgct

SEQ ID NO: 7158764 - DNA, 22 bp, Homo sapiens
aggctggggaattgaatttgct

SEQ ID NO: 7158765 - DNA, 22 bp, Homo sapiens
aggctggggaattgaatttgct

SEQ ID NO: 7158766 - DNA, 22 bp, Homo sapiens
aggctggggaattgaatttgct

SEQ ID NO: 7158767 - DNA, 22 bp, Homo sapiens
aggctgggctccgcccaactcc

SEQ ID NO: 7158768 - DNA, 22 bp, Homo sapiens
aggctgggctccgcccaactcc

SEQ ID NO: 7158769 - DNA, 22 bp, Homo sapiens
aggctgggctccgcccaactcc

SEQ ID NO: 7158770 - DNA, 22 bp, Homo sapiens
aggctgggctccgcccaactcc

SEQ ID NO: 7158771 - DNA, 22 bp, Homo sapiens
aggctgggcaccgttttgatcc

SEQ ID NO: 7158772 - DNA, 22 bp, Homo sapiens
aggctgggcaccgttttgatcc

SEQ ID NO: 7158773 - DNA, 22 bp, Homo sapiens
aggctgggcaccgttttgatcc

SEQ ID NO: 7158774 - DNA, 22 bp, Homo sapiens
aggctgggtacctgtcatatgc

SEQ ID NO: 7158775 - DNA, 22 bp, Homo sapiens
aggctgggtacctgtcatatgc

SEQ ID NO: 7158776 - DNA, 22 bp, Homo sapiens
aggctgggtacctgtcatatgc

SEQ ID NO: 7158777 - DNA, 22 bp, Homo sapiens
aggctgggtacctgtcatatgc

SEQ ID NO: 7158778 - DNA, 22 bp, Homo sapiens
aggctgggtacctgtcatatgc

SEQ ID NO: 7158779 - DNA, 22 bp, Homo sapiens
aggctggggaattgaatttgct

SEQ ID NO: 7158780 - DNA, 22 bp, Homo sapiens
aggctggggaattgaatttgct

SEQ ID NO: 7158781 - DNA, 22 bp, Homo sapiens
aggctggggaattgaatttgct

SEQ ID NO: 7158782 - DNA, 20 bp, Homo sapiens
aggctggggtgttttgccca

SEQ ID NO: 7158783 - DNA, 20 bp, Homo sapiens
aggctggggtgttttgccca

SEQ ID NO: 7158784 - DNA, 20 bp, Homo sapiens
aggctggggtgttttgccca

SEQ ID NO: 7158785 - DNA, 22 bp, Homo sapiens
ccaggctggtctgaatttctag

SEQ ID NO: 7158786 - DNA, 15 bp, Homo sapiens
ccaggctgggtgagc

SEQ ID NO: 7158787 - DNA, 22 bp, Homo sapiens
ccaggctgggctacaagttgag

SEQ ID NO: 7158788 - DNA, 22 bp, Homo sapiens
ccaggctgggctacaagttgag

SEQ ID NO: 7158789 - DNA, 22 bp, Homo sapiens
ccaggctgggctacaagttgag

SEQ ID NO: 7158790 - DNA, 22 bp, Homo sapiens
ccaggctgggcggggaacctgg

SEQ ID NO: 7158791 - DNA, 22 bp, Homo sapiens
ccaggctgggcggggaacctgg

SEQ ID NO: 7158792 - DNA, 21 bp, Homo sapiens
ccaggctgggagggcagttcc

SEQ ID NO: 7158793 - DNA, 21 bp, Homo sapiens
ccaggctgggagggcagttcc

SEQ ID NO: 7158794 - DNA, 22 bp, Homo sapiens
ccaggctggagtatagtggcgc

SEQ ID NO: 7158795 - DNA, 22 bp, Homo sapiens
ccaggctggagtatagtggcgc

SEQ ID NO: 7158796 - DNA, 22 bp, Homo sapiens
ccaggctggagtgcaatggcat

SEQ ID NO: 7158797 - DNA, 22 bp, Homo sapiens
ccaggctggagtgcaatggcat

SEQ ID NO: 7158798 - DNA, 22 bp, Homo sapiens
ccaggctggagtatagtggcgc

SEQ ID NO: 7158799 - DNA, 22 bp, Homo sapiens
ccaggctgctttattactctgt

SEQ ID NO: 7158800 - DNA, 22 bp, Homo sapiens
ccaggctggaatcaatattctg

SEQ ID NO: 7158801 - DNA, 22 bp, Homo sapiens
ccaggctggaatcaatattctg

SEQ ID NO: 7158802 - DNA, 22 bp, Homo sapiens
ccaggctgcttagccttatctt

SEQ ID NO: 7158803 - DNA, 22 bp, Homo sapiens
ccaggctgctttattactctgt

SEQ ID NO: 7158804 - DNA, 22 bp, Homo sapiens
ccaggctgcttagccttatctt

SEQ ID NO: 7158805 - DNA, 22 bp, Homo sapiens
ccaggctgcttagccttatctt

SEQ ID NO: 7158806 - DNA, 22 bp, Homo sapiens
ccaggctgctgttggtgtccgc

SEQ ID NO: 7158807 - DNA, 22 bp, Homo sapiens
ccaggctgctgttggtgtccgc

SEQ ID NO: 7158808 - DNA, 22 bp, Homo sapiens
ccaggctgctgttggtgtccgc

SEQ ID NO: 7158809 - DNA, 22 bp, Homo sapiens
ccaggctctgcgctggacatgg

SEQ ID NO: 7158810 - DNA, 22 bp, Homo sapiens
aggctacttctagagggacaat

SEQ ID NO: 7158811 - DNA, 22 bp, Homo sapiens
aggctagaggcttctggcttca

SEQ ID NO: 7158812 - DNA, 22 bp, Homo sapiens
aggctacaggagacgccaggag

SEQ ID NO: 7158813 - DNA, 22 bp, Homo sapiens
aggctacttctagagggacaat

SEQ ID NO: 7158814 - DNA, 22 bp, Homo sapiens
aggctacaataattcccatgca

SEQ ID NO: 7158815 - DNA, 22 bp, Homo sapiens
aggctacactgttttgatgtct

SEQ ID NO: 7158816 - DNA, 22 bp, Homo sapiens
aggctaagggatgactggagtg

SEQ ID NO: 7158817 - DNA, 22 bp, Homo sapiens
aggctaaggtgggaggatcgct

SEQ ID NO: 7158818 - DNA, 22 bp, Homo sapiens
aggctaaggtgggaggatcgct

SEQ ID NO: 7158819 - DNA, 22 bp, Homo sapiens
aggctaaggagtgtgatgctca

SEQ ID NO: 7158820 - DNA, 22 bp, Homo sapiens
aggctaagatgtggtctgagca

SEQ ID NO: 7158821 - DNA, 22 bp, Homo sapiens
aggctaagatgtggtctgagca

SEQ ID NO: 7158822 - DNA, 22 bp, Homo sapiens
aggctaaggaccaggagggcca

SEQ ID NO: 7158823 - DNA, 22 bp, Homo sapiens
aggctaagtgagtaaaatgtgg

SEQ ID NO: 7158824 - DNA, 22 bp, Homo sapiens
aggctaagtgattagtgacata

SEQ ID NO: 7158825 - DNA, 22 bp, Homo sapiens
aggctaagtgggtgtcagggcc

SEQ ID NO: 7158826 - DNA, 22 bp, Homo sapiens
aggctaagtgggtgtcagggcc

SEQ ID NO: 7158827 - DNA, 22 bp, Homo sapiens
aggctaagttgattaaattgtt

SEQ ID NO: 7158828 - DNA, 22 bp, Homo sapiens
aggctacaaataagcatgtaat

SEQ ID NO: 7158829 - DNA, 22 bp, Homo sapiens
aggctacaataattcccatgca

SEQ ID NO: 7158830 - DNA, 22 bp, Homo sapiens
aggctaagaggccttcagatac

SEQ ID NO: 7158831 - DNA, 22 bp, Homo sapiens
aggctaagatgactccaccccc

SEQ ID NO: 7158832 - DNA, 22 bp, Homo sapiens
aggctaagaaagattcattgca

SEQ ID NO: 7158833 - DNA, 22 bp, Homo sapiens
aggctaagaaggctttgttcct

SEQ ID NO: 7158834 - DNA, 22 bp, Homo sapiens
aggctaagaccctcctggggcc

SEQ ID NO: 7158835 - DNA, 22 bp, Homo sapiens
aggctaagagcatttgctgaag

SEQ ID NO: 7158836 - DNA, 19 bp, Homo sapiens
aggctaaagagtcttgcgt

SEQ ID NO: 7158837 - DNA, 19 bp, Homo sapiens
aggctaaagagtcttgcgt

SEQ ID NO: 7158838 - DNA, 22 bp, Homo sapiens
aggcgtggttgaggcgagcata

SEQ ID NO: 7158839 - DNA, 22 bp, Homo sapiens
aggcgtggttgaggcgagcata

SEQ ID NO: 7158840 - DNA, 22 bp, Homo sapiens
aggcgtggttgaggcgagcata

SEQ ID NO: 7158841 - DNA, 22 bp, Homo sapiens
aggcgtgggaggatctgaggcc

SEQ ID NO: 7158842 - DNA, 22 bp, Homo sapiens
aggcgtggttgaggcgagcata

SEQ ID NO: 7158843 - DNA, 22 bp, Homo sapiens
aggcgtggttgaggcgagcata

SEQ ID NO: 7158844 - DNA, 22 bp, Homo sapiens
aggcgtggttgaggcgagcata

SEQ ID NO: 7158845 - DNA, 22 bp, Homo sapiens
ccagggcctgccacttagcaag

SEQ ID NO: 7158846 - DNA, 22 bp, Homo sapiens
ccagggcctgagggcgacgccc

SEQ ID NO: 7158847 - DNA, 22 bp, Homo sapiens
ccagggcctgccacttagcaag

SEQ ID NO: 7158848 - DNA, 22 bp, Homo sapiens
ccagggcctgccacttagcaag

SEQ ID NO: 7158849 - DNA, 22 bp, Homo sapiens
ccagggcctcgtgttctgagtg

SEQ ID NO: 7158850 - DNA, 22 bp, Homo sapiens
ccagggcaggagaaagactcac

SEQ ID NO: 7158851 - DNA, 22 bp, Homo sapiens
ccagggcaggagaaagactcac

SEQ ID NO: 7158852 - DNA, 22 bp, Homo sapiens
ccagggcctcgtgttctgagtg

SEQ ID NO: 7158853 - DNA, 22 bp, Homo sapiens
ccagggcctgagggcgacgccc

SEQ ID NO: 7158854 - DNA, 22 bp, Homo sapiens
ccagggcctgagggcgacgccc

SEQ ID NO: 7158855 - DNA, 22 bp, Homo sapiens
ccagggcagcgcccctccacgc

SEQ ID NO: 7158856 - DNA, 22 bp, Homo sapiens
ccaggctggtctgaatttctag

SEQ ID NO: 7158857 - DNA, 22 bp, Homo sapiens
ccaggctgtaaacaccttcaaa

SEQ ID NO: 7158858 - DNA, 22 bp, Homo sapiens
ccagggctccattgctcatcct

SEQ ID NO: 7158859 - DNA, 22 bp, Homo sapiens
ccagggctccattgctcatcct

SEQ ID NO: 7158860 - DNA, 22 bp, Homo sapiens
ccagggctccattgctcatcct

SEQ ID NO: 7158861 - DNA, 19 bp, Homo sapiens
ccagggctccaagctgagt

SEQ ID NO: 7158862 - DNA, 22 bp, Homo sapiens
ccagggctcaggctcccagtgg

SEQ ID NO: 7158863 - DNA, 22 bp, Homo sapiens
ccagggctcaggctcccagtgg

SEQ ID NO: 7158864 - DNA, 22 bp, Homo sapiens
ccagggctcaggctcccagtgg

SEQ ID NO: 7158865 - DNA, 22 bp, Homo sapiens
ccagggctcaggctcccagtgg

SEQ ID NO: 7158866 - DNA, 20 bp, Homo sapiens
ccagggctggctcctgggat

SEQ ID NO: 7158867 - DNA, 20 bp, Homo sapiens
ccagggctggctcctgggat

SEQ ID NO: 7158868 - DNA, 22 bp, Homo sapiens
ccagggctggaccagtgcttgg

SEQ ID NO: 7158869 - DNA, 22 bp, Homo sapiens
ccagggctggaccagtgcttgg

SEQ ID NO: 7158870 - DNA, 20 bp, Homo sapiens
ccagggctggctcctgggat

SEQ ID NO: 7158871 - DNA, 22 bp, Homo sapiens
aggctgaggcaggtggatcacc

SEQ ID NO: 7158872 - DNA, 22 bp, Homo sapiens
aggctgaggcaggtggatcacc

SEQ ID NO: 7158873 - DNA, 22 bp, Homo sapiens
aggctgaggcaggtggatcacc

SEQ ID NO: 7158874 - DNA, 22 bp, Homo sapiens
aggctgaggcaggtggatcacc

SEQ ID NO: 7158875 - DNA, 22 bp, Homo sapiens
ccaggtctgcgggcggcaggca

SEQ ID NO: 7158876 - DNA, 22 bp, Homo sapiens
ccaggtctggaaccaccagggc

SEQ ID NO: 7158877 - DNA, 22 bp, Homo sapiens
ccaggtctggaaccaccagggc

SEQ ID NO: 7158878 - DNA, 22 bp, Homo sapiens
aggctgaggcaggtggatcacc

SEQ ID NO: 7158879 - DNA, 22 bp, Homo sapiens
aggctgaggcaagaggatcact

SEQ ID NO: 7158880 - DNA, 22 bp, Homo sapiens
aggctgaggcaagaggatcact

SEQ ID NO: 7158881 - DNA, 22 bp, Homo sapiens
aggctgaggcaagaggatcact

SEQ ID NO: 7158882 - DNA, 20 bp, Homo sapiens
ccagggctggctcctgggat

SEQ ID NO: 7158883 - DNA, 22 bp, Homo sapiens
ccagggctgggtttgtcggtgt

SEQ ID NO: 7158884 - DNA, 22 bp, Homo sapiens
ccagggctggtggctgcagagg

SEQ ID NO: 7158885 - DNA, 22 bp, Homo sapiens
ccagggctggtggctgcagagg

SEQ ID NO: 7158886 - DNA, 22 bp, Homo sapiens
ccagggctggtggctgcagagg

SEQ ID NO: 7158887 - DNA, 22 bp, Homo sapiens
ccagggctggtggctgcagagg

SEQ ID NO: 7158888 - DNA, 22 bp, Homo sapiens
ccagggctggtgggagatgctg

SEQ ID NO: 7158889 - DNA, 22 bp, Homo sapiens
ccagggctggtgggagatgctg

SEQ ID NO: 7158890 - DNA, 22 bp, Homo sapiens
aggctgagctgacctggtttgg

SEQ ID NO: 7158891 - DNA, 22 bp, Homo sapiens
aggctgagctgacctggtttgg

SEQ ID NO: 7158892 - DNA, 22 bp, Homo sapiens
aggctgaggatcgtactttcca

SEQ ID NO: 7158893 - DNA, 22 bp, Homo sapiens
aggctgaggatcgtactttcca

SEQ ID NO: 7158894 - DNA, 22 bp, Homo sapiens
agggctggagccacagctggga

SEQ ID NO: 7158895 - DNA, 22 bp, Homo sapiens
agggctggagccacagctggga

SEQ ID NO: 7158896 - DNA, 22 bp, Homo sapiens
agggctggagccacagctggga

SEQ ID NO: 7158897 - DNA, 22 bp, Homo sapiens
agggctggagggtactagttta

SEQ ID NO: 7158898 - DNA, 22 bp, Homo sapiens
agggctggagggtactagttta

SEQ ID NO: 7158899 - DNA, 22 bp, Homo sapiens
agggctggagggtactagttta

SEQ ID NO: 7158900 - DNA, 22 bp, Homo sapiens
agggctggagccacagctggga

SEQ ID NO: 7158901 - DNA, 22 bp, Homo sapiens
agggctggagccacagctggga

SEQ ID NO: 7158902 - DNA, 22 bp, Homo sapiens
agggctggcaagggattgaaat

SEQ ID NO: 7158903 - DNA, 22 bp, Homo sapiens
agggctggcaagggattgaaat

SEQ ID NO: 7158904 - DNA, 22 bp, Homo sapiens
agggctggcatctctaatgctg

SEQ ID NO: 7158905 - DNA, 22 bp, Homo sapiens
agggctggcatctctaatgctg

SEQ ID NO: 7158906 - DNA, 22 bp, Homo sapiens
agggctggcatctctaatgctg

SEQ ID NO: 7158907 - DNA, 22 bp, Homo sapiens
agggctggcaagggattgaaat

SEQ ID NO: 7158908 - DNA, 22 bp, Homo sapiens
agggctggagggtactagttta

SEQ ID NO: 7158909 - DNA, 22 bp, Homo sapiens
agggctggcaagggattgaaat

SEQ ID NO: 7158910 - DNA, 22 bp, Homo sapiens
agggctggcaagggattgaaat

SEQ ID NO: 7158911 - DNA, 22 bp, Homo sapiens
agggctggcaagggattgaaat

SEQ ID NO: 7158912 - DNA, 22 bp, Homo sapiens
agggctggcaagggattgaaat

SEQ ID NO: 7158913 - DNA, 22 bp, Homo sapiens
agggctgctttgctaaatatgg

SEQ ID NO: 7158914 - DNA, 22 bp, Homo sapiens
agggctgcttacctggaatggc

SEQ ID NO: 7158915 - DNA, 22 bp, Homo sapiens
agggctgcttacctggaatggc

SEQ ID NO: 7158916 - DNA, 22 bp, Homo sapiens
agggctggagccacagctggga

SEQ ID NO: 7158917 - DNA, 22 bp, Homo sapiens
agggctggagccacagctggga

SEQ ID NO: 7158918 - DNA, 22 bp, Homo sapiens
agggctggagccacagctggga

SEQ ID NO: 7158919 - DNA, 22 bp, Homo sapiens
agggctggagccacagctggga

SEQ ID NO: 7158920 - DNA, 22 bp, Homo sapiens
agggctggagccacagctggga

SEQ ID NO: 7158921 - DNA, 22 bp, Homo sapiens
agggctgctttgctaaatatgg

SEQ ID NO: 7158922 - DNA, 22 bp, Homo sapiens
agggctggagccacagctggga

SEQ ID NO: 7158923 - DNA, 22 bp, Homo sapiens
agggctggagccacagctggga

SEQ ID NO: 7158924 - DNA, 22 bp, Homo sapiens
agggctgcagtcctaaggtgct

SEQ ID NO: 7158925 - DNA, 22 bp, Homo sapiens
agggcgtggtggtgctggagca

SEQ ID NO: 7158926 - DNA, 22 bp, Homo sapiens
agggcgtggtggtgctggagca

SEQ ID NO: 7158927 - DNA, 22 bp, Homo sapiens
agggctgcatctgcctggtgaa

SEQ ID NO: 7158928 - DNA, 22 bp, Homo sapiens
agggctgcatctgcctggtgaa

SEQ ID NO: 7158929 - DNA, 22 bp, Homo sapiens
agggctgctgaggaagccttgc

SEQ ID NO: 7158930 - DNA, 22 bp, Homo sapiens
agggctgctgctccgggcccag

SEQ ID NO: 7158931 - DNA, 22 bp, Homo sapiens
agggcgaggagacggaggcaca

SEQ ID NO: 7158932 - DNA, 22 bp, Homo sapiens
agggcgaggagacggaggcaca

SEQ ID NO: 7158933 - DNA, 22 bp, Homo sapiens
agggcgaggagacggaggcaca

SEQ ID NO: 7158934 - DNA, 22 bp, Homo sapiens
agggcgaggagacggaggcaca

SEQ ID NO: 7158935 - DNA, 22 bp, Homo sapiens
agggcgcctgctgtggccaccg

SEQ ID NO: 7158936 - DNA, 22 bp, Homo sapiens
agggcgaggagacggaggcaca

SEQ ID NO: 7158937 - DNA, 22 bp, Homo sapiens
agggcgaggagacggaggcaca

SEQ ID NO: 7158938 - DNA, 22 bp, Homo sapiens
agggcgacaatggagagcgttt

SEQ ID NO: 7158939 - DNA, 22 bp, Homo sapiens
agggcgacaatggagagcgttt

SEQ ID NO: 7158940 - DNA, 19 bp, Homo sapiens
agggcggggcccaggcaca

SEQ ID NO: 7158941 - DNA, 19 bp, Homo sapiens
agggcggggcccaggcaca

SEQ ID NO: 7158942 - DNA, 19 bp, Homo sapiens
agggcgtggtggcacatgt

SEQ ID NO: 7158943 - DNA, 19 bp, Homo sapiens
agggcgtggtggcacatgt

SEQ ID NO: 7158944 - DNA, 22 bp, Homo sapiens
agggcgtggtggtgctggagca

SEQ ID NO: 7158945 - DNA, 22 bp, Homo sapiens
agggcgtggtggtgctggagca

SEQ ID NO: 7158946 - DNA, 22 bp, Homo sapiens
agggcgtggtggtgctggagca

SEQ ID NO: 7158947 - DNA, 22 bp, Homo sapiens
agggcgtggtggtgctggagca

SEQ ID NO: 7158948 - DNA, 22 bp, Homo sapiens
agggcgctgaaatactaacatg

SEQ ID NO: 7158949 - DNA, 22 bp, Homo sapiens
agggcgctgtctggccagcggt

SEQ ID NO: 7158950 - DNA, 22 bp, Homo sapiens
agggcgggctcatcacatgctc

SEQ ID NO: 7158951 - DNA, 22 bp, Homo sapiens
agggcgggctcatcacatgctc

SEQ ID NO: 7158952 - DNA, 22 bp, Homo sapiens
agggcgggctcatcacatgctc

SEQ ID NO: 7158953 - DNA, 19 bp, Homo sapiens
agggcggggcccaggcaca

SEQ ID NO: 7158954 - DNA, 19 bp, Homo sapiens
agggcggggcccaggcaca

SEQ ID NO: 7158955 - DNA, 22 bp, Homo sapiens
cctcaggccctgtccctgcgcc

SEQ ID NO: 7158956 - DNA, 22 bp, Homo sapiens
cctcaggcctctgcctcattgg

SEQ ID NO: 7158957 - DNA, 20 bp, Homo sapiens
agggcctgttgcaagcgttt

SEQ ID NO: 7158958 - DNA, 22 bp, Homo sapiens
cctcaggccctgtccctgcgcc

SEQ ID NO: 7158959 - DNA, 22 bp, Homo sapiens
cctcaggcaggaaactgtcccg

SEQ ID NO: 7158960 - DNA, 22 bp, Homo sapiens
cctcaggcagtggtatggatgg

SEQ ID NO: 7158961 - DNA, 22 bp, Homo sapiens
cctcaggcagtggtatggatgg

SEQ ID NO: 7158962 - DNA, 22 bp, Homo sapiens
cctcaggccagggggcggccag

SEQ ID NO: 7158963 - DNA, 22 bp, Homo sapiens
cctcaggccagggggcggccag

SEQ ID NO: 7158964 - DNA, 20 bp, Homo sapiens
cctcaggccagttttaaagt

SEQ ID NO: 7158965 - DNA, 22 bp, Homo sapiens
cctcaggatacaggagccacag

SEQ ID NO: 7158966 - DNA, 22 bp, Homo sapiens
cctcaggatacaggagccacag

SEQ ID NO: 7158967 - DNA, 22 bp, Homo sapiens
cctcaggatacaggagccacag

SEQ ID NO: 7158968 - DNA, 22 bp, Homo sapiens
cctcaggatccgcaggtgcagt

SEQ ID NO: 7158969 - DNA, 20 bp, Homo sapiens
cctcaggatgagggtgagca

SEQ ID NO: 7158970 - DNA, 22 bp, Homo sapiens
cctcaggcaagtcacttaacat

SEQ ID NO: 7158971 - DNA, 22 bp, Homo sapiens
cctcaggcaagtcacttaacat

SEQ ID NO: 7158972 - DNA, 22 bp, Homo sapiens
cctcaggcaggaaactgtcccg

SEQ ID NO: 7158973 - DNA, 22 bp, Homo sapiens
cctcaggcaggaaactgtcccg

SEQ ID NO: 7158974 - DNA, 22 bp, Homo sapiens
cctcaggcaggaaactgtcccg

SEQ ID NO: 7158975 - DNA, 22 bp, Homo sapiens
cctcaggcaggaaactgtcccg

SEQ ID NO: 7158976 - DNA, 22 bp, Homo sapiens
agggcctgaggctgacggggag

SEQ ID NO: 7158977 - DNA, 22 bp, Homo sapiens
agggcctgaggctgacggggag

SEQ ID NO: 7158978 - DNA, 23 bp, Homo sapiens
agggcctgatggctcccgctggc

SEQ ID NO: 7158979 - DNA, 22 bp, Homo sapiens
agggcctgaggctgacggggag

SEQ ID NO: 7158980 - DNA, 22 bp, Homo sapiens
agggcctgaggctgacggggag

SEQ ID NO: 7158981 - DNA, 22 bp, Homo sapiens
agggcctgagctggctgacctc

SEQ ID NO: 7158982 - DNA, 22 bp, Homo sapiens
agggcctgagctggctgacctc

SEQ ID NO: 7158983 - DNA, 22 bp, Homo sapiens
agggcctgagctggctgacctc

SEQ ID NO: 7158984 - DNA, 19 bp, Homo sapiens
agggcctgcagctcaagct

SEQ ID NO: 7158985 - DNA, 23 bp, Homo sapiens
agggcctgatggctcccgctggc

SEQ ID NO: 7158986 - DNA, 19 bp, Homo sapiens
agggcctgcagctcaagct

SEQ ID NO: 7158987 - DNA, 19 bp, Homo sapiens
agggcctgcagctcaagct

SEQ ID NO: 7158988 - DNA, 19 bp, Homo sapiens
agggcctgcagctcaagct

SEQ ID NO: 7158989 - DNA, 19 bp, Homo sapiens
agggcctgcagctcaagct

SEQ ID NO: 7158990 - DNA, 22 bp, Homo sapiens
agggcctgcatcaggagcttgg

SEQ ID NO: 7158991 - DNA, 22 bp, Homo sapiens
agggcctgcatcaggagcttgg

SEQ ID NO: 7158992 - DNA, 22 bp, Homo sapiens
agggcctgcatcaggagcttgg

SEQ ID NO: 7158993 - DNA, 22 bp, Homo sapiens
agggcctgcatcaggagcttgg

SEQ ID NO: 7158994 - DNA, 22 bp, Homo sapiens
ccctgctttgcacccaggctgg

SEQ ID NO: 7158995 - DNA, 22 bp, Homo sapiens
ccctgctttgcacccaggctgg

SEQ ID NO: 7158996 - DNA, 22 bp, Homo sapiens
ccctggaaatgaggcatgtgcg

SEQ ID NO: 7158997 - DNA, 22 bp, Homo sapiens
ccctggaaatgaggcatgtgcg

SEQ ID NO: 7158998 - DNA, 22 bp, Homo sapiens
ccctggaaatgaggcatgtgcg

SEQ ID NO: 7158999 - DNA, 22 bp, Homo sapiens
ccctggaaatgaggcatgtgcg

SEQ ID NO: 7159000 - DNA, 22 bp, Homo sapiens
ccctggaacccatggccagtgt

SEQ ID NO: 7159001 - DNA, 22 bp, Homo sapiens
ccctggaacccatggccagtgt

SEQ ID NO: 7159002 - DNA, 22 bp, Homo sapiens
ccctggaacccatggccagtgt

SEQ ID NO: 7159003 - DNA, 22 bp, Homo sapiens
ccctggaacccatggccagtgt

SEQ ID NO: 7159004 - DNA, 22 bp, Homo sapiens
ccctgcttgtcacccctgggtc

SEQ ID NO: 7159005 - DNA, 22 bp, Homo sapiens
ccctgctttcaaccttctagct

SEQ ID NO: 7159006 - DNA, 22 bp, Homo sapiens
ccctgctttcaaccttctagct

SEQ ID NO: 7159007 - DNA, 22 bp, Homo sapiens
ccctgctttcaaccttctagct

SEQ ID NO: 7159008 - DNA, 22 bp, Homo sapiens
ccctgcttagcacccttgcacc

SEQ ID NO: 7159009 - DNA, 22 bp, Homo sapiens
ccctgcttccctgggagaggcg

SEQ ID NO: 7159010 - DNA, 22 bp, Homo sapiens
ccctgcttccgctgttttctca

SEQ ID NO: 7159011 - DNA, 22 bp, Homo sapiens
ccctgcttccgctgttttctca

SEQ ID NO: 7159012 - DNA, 18 bp, Homo sapiens
agggcctccatcccctcc

SEQ ID NO: 7159013 - DNA, 22 bp, Homo sapiens
agggcctccagggcagcagtgg

SEQ ID NO: 7159014 - DNA, 22 bp, Homo sapiens
agggcctccagggcagcagtgg

SEQ ID NO: 7159015 - DNA, 22 bp, Homo sapiens
ccctggaactcctaggcaagca

SEQ ID NO: 7159016 - DNA, 22 bp, Homo sapiens
ccctggaactgccaagcctcag

SEQ ID NO: 7159017 - DNA, 23 bp, Homo sapiens
ccctggaacttcactcatgcaca

SEQ ID NO: 7159018 - DNA, 23 bp, Homo sapiens
ccctggaacttcactcatgcaca

SEQ ID NO: 7159019 - DNA, 22 bp, Homo sapiens
ccctggaagagcctgggcatgg

SEQ ID NO: 7159020 - DNA, 22 bp, Homo sapiens
ccctggaagagcctgggcatgg

SEQ ID NO: 7159021 - DNA, 22 bp, Homo sapiens
ccctggaaggagatgggacatg

SEQ ID NO: 7159022 - DNA, 22 bp, Homo sapiens
ccctggaaggagatgggacatg

SEQ ID NO: 7159023 - DNA, 22 bp, Homo sapiens
agggcctcagtgttctcatctg

SEQ ID NO: 7159024 - DNA, 22 bp, Homo sapiens
agggcctggcgcgtggccgccg

SEQ ID NO: 7159025 - DNA, 22 bp, Homo sapiens
agggcctggcgcgtggccgccg

SEQ ID NO: 7159026 - DNA, 20 bp, Homo sapiens
agggcctggagtacagcagg

SEQ ID NO: 7159027 - DNA, 20 bp, Homo sapiens
agggcctggagtacagcagg

SEQ ID NO: 7159028 - DNA, 22 bp, Homo sapiens
agggcctggcgcgtggccgccg

SEQ ID NO: 7159029 - DNA, 22 bp, Homo sapiens
cctcaggaaccacattgctgct

SEQ ID NO: 7159030 - DNA, 22 bp, Homo sapiens
cctcaggaaatgaataaatggc

SEQ ID NO: 7159031 - DNA, 22 bp, Homo sapiens
cctcagcttgatttctgcagag

SEQ ID NO: 7159032 - DNA, 22 bp, Homo sapiens
cctcagagcgcgtggcattatt

SEQ ID NO: 7159033 - DNA, 19 bp, Homo sapiens
cctcagagctagtgaacat

SEQ ID NO: 7159034 - DNA, 22 bp, Homo sapiens
agggcctggaactgtgggcagg

SEQ ID NO: 7159035 - DNA, 22 bp, Homo sapiens
agggcctggaactgtgggcagg

SEQ ID NO: 7159036 - DNA, 22 bp, Homo sapiens
agggcctggaactggagaccac

SEQ ID NO: 7159037 - DNA, 22 bp, Homo sapiens
agggcctggaactgtgggcagg

SEQ ID NO: 7159038 - DNA, 22 bp, Homo sapiens
agggcctggaactgtgggcagg

SEQ ID NO: 7159039 - DNA, 22 bp, Homo sapiens
agggcctggaactgtgggcagg

SEQ ID NO: 7159040 - DNA, 22 bp, Homo sapiens
agggcctggaactggagaccac

SEQ ID NO: 7159041 - DNA, 20 bp, Homo sapiens
agggcctgctctgtggtgtc

SEQ ID NO: 7159042 - DNA, 20 bp, Homo sapiens
agggcctgctctgtggtgtc

SEQ ID NO: 7159043 - DNA, 20 bp, Homo sapiens
agggcctgctctgtggtgtc

SEQ ID NO: 7159044 - DNA, 22 bp, Homo sapiens
agggcctggaactggagaccac

SEQ ID NO: 7159045 - DNA, 22 bp, Homo sapiens
agggcctggaactggagaccac

SEQ ID NO: 7159046 - DNA, 20 bp, Homo sapiens
agggcctgctctgtggtgtc

SEQ ID NO: 7159047 - DNA, 22 bp, Homo sapiens
agggtagggccgtagggccatg

SEQ ID NO: 7159048 - DNA, 22 bp, Homo sapiens
agggtagggccgtagggccatg

SEQ ID NO: 7159049 - DNA, 22 bp, Homo sapiens
agggtagggccgtagggccatg

SEQ ID NO: 7159050 - DNA, 22 bp, Homo sapiens
agggtagggtaaatgatgcatc

SEQ ID NO: 7159051 - DNA, 22 bp, Homo sapiens
agggtaggtgtaagatagccct

SEQ ID NO: 7159052 - DNA, 22 bp, Homo sapiens
agggtcaacatttcattgattc

SEQ ID NO: 7159053 - DNA, 22 bp, Homo sapiens
agggtcaagaataaagattaca

SEQ ID NO: 7159054 - DNA, 22 bp, Homo sapiens
agggtcaacactttaaacatat

SEQ ID NO: 7159055 - DNA, 22 bp, Homo sapiens
agggtcaacaggagtcaagatg

SEQ ID NO: 7159056 - DNA, 22 bp, Homo sapiens
agggtcaaaggaaaggcccaca

SEQ ID NO: 7159057 - DNA, 22 bp, Homo sapiens
agggtcaaatgggcaggaagag

SEQ ID NO: 7159058 - DNA, 22 bp, Homo sapiens
agggtagggccgtagggccatg

SEQ ID NO: 7159059 - DNA, 22 bp, Homo sapiens
agggtagggcccggagacagac

SEQ ID NO: 7159060 - DNA, 22 bp, Homo sapiens
agggtagggcccggagacagac

SEQ ID NO: 7159061 - DNA, 22 bp, Homo sapiens
agggtagggcccggagacagac

SEQ ID NO: 7159062 - DNA, 22 bp, Homo sapiens
agggtagggcccggagacagac

SEQ ID NO: 7159063 - DNA, 22 bp, Homo sapiens
agggtagggcccggagacagac

SEQ ID NO: 7159064 - DNA, 22 bp, Homo sapiens
agggtagggcccggagacagac

SEQ ID NO: 7159065 - DNA, 22 bp, Homo sapiens
agggtagggcccggagacagac

SEQ ID NO: 7159066 - DNA, 22 bp, Homo sapiens
agggtaggaactgagtggaagg

SEQ ID NO: 7159067 - DNA, 22 bp, Homo sapiens
aggggtgaaggcccgataggag

SEQ ID NO: 7159068 - DNA, 22 bp, Homo sapiens
cctgagagtgagtgcctcctta

SEQ ID NO: 7159069 - DNA, 22 bp, Homo sapiens
aggggtgacacatatcagtgca

SEQ ID NO: 7159070 - DNA, 22 bp, Homo sapiens
aggggtgaaggcccgataggag

SEQ ID NO: 7159071 - DNA, 22 bp, Homo sapiens
cctgagagtaggtgtctcttta

SEQ ID NO: 7159072 - DNA, 22 bp, Homo sapiens
cctgagagtgagggcctcctta

SEQ ID NO: 7159073 - DNA, 22 bp, Homo sapiens
cctgagagtgagtgccacctta

SEQ ID NO: 7159074 - DNA, 22 bp, Homo sapiens
cctgagagtgagtgccacctta

SEQ ID NO: 7159075 - DNA, 22 bp, Homo sapiens
cctgagaggccctctcactgtc

SEQ ID NO: 7159076 - DNA, 22 bp, Homo sapiens
cctgagagggggccctagaaat

SEQ ID NO: 7159077 - DNA, 22 bp, Homo sapiens
cctgagagggggccctagaaat

SEQ ID NO: 7159078 - DNA, 22 bp, Homo sapiens
cctgagaggttggcctgtccag

SEQ ID NO: 7159079 - DNA, 22 bp, Homo sapiens
cctgagagccctagccaggcgc

SEQ ID NO: 7159080 - DNA, 22 bp, Homo sapiens
cctgagagcgagtggcctcatg

SEQ ID NO: 7159081 - DNA, 22 bp, Homo sapiens
cctgagagcgagtggcctcatg

SEQ ID NO: 7159082 - DNA, 22 bp, Homo sapiens
cctgagaggccctctcactgtc

SEQ ID NO: 7159083 - DNA, 22 bp, Homo sapiens
cctgagaggccctctcactgtc

SEQ ID NO: 7159084 - DNA, 22 bp, Homo sapiens
cctgagaggccctctcactgtc

SEQ ID NO: 7159085 - DNA, 22 bp, Homo sapiens
cctgaagcaagggtaggcaggt

SEQ ID NO: 7159086 - DNA, 22 bp, Homo sapiens
cctgagagagtgagccctgaca

SEQ ID NO: 7159087 - DNA, 22 bp, Homo sapiens
cctgagagagtgagccctgaca

SEQ ID NO: 7159088 - DNA, 22 bp, Homo sapiens
cctgagagcagcttcctgctta

SEQ ID NO: 7159089 - DNA, 22 bp, Homo sapiens
cctgagagcattccacactgaa

SEQ ID NO: 7159090 - DNA, 22 bp, Homo sapiens
cctgagagcattccacactgaa

SEQ ID NO: 7159091 - DNA, 22 bp, Homo sapiens
cctgagagcattccacactgaa

SEQ ID NO: 7159092 - DNA, 22 bp, Homo sapiens
cctgagagccagtgcctgccca

SEQ ID NO: 7159093 - DNA, 22 bp, Homo sapiens
cctgagagccagtgcctgccca

SEQ ID NO: 7159094 - DNA, 22 bp, Homo sapiens
cctgagagccctagccaggcgc

SEQ ID NO: 7159095 - DNA, 22 bp, Homo sapiens
cctgagagccctagccaggcgc

SEQ ID NO: 7159096 - DNA, 22 bp, Homo sapiens
cctgagagccctagccaggcgc

SEQ ID NO: 7159097 - DNA, 22 bp, Homo sapiens
cctgaagacaacttttatcacc

SEQ ID NO: 7159098 - DNA, 22 bp, Homo sapiens
cctgaagacaacttttatcacc

SEQ ID NO: 7159099 - DNA, 22 bp, Homo sapiens
cctgaagagcactctagagttg

SEQ ID NO: 7159100 - DNA, 22 bp, Homo sapiens
cctgaagagcactctagagttg

SEQ ID NO: 7159101 - DNA, 22 bp, Homo sapiens
cctgaagagcactctagagttg

SEQ ID NO: 7159102 - DNA, 22 bp, Homo sapiens
cctgaagagtgaatgtggcagt

SEQ ID NO: 7159103 - DNA, 22 bp, Homo sapiens
cctgaagatccattatagacac

SEQ ID NO: 7159104 - DNA, 22 bp, Homo sapiens
cctgaagatgagggacagctaa

SEQ ID NO: 7159105 - DNA, 22 bp, Homo sapiens
cctgaagatgagggacagctaa

SEQ ID NO: 7159106 - DNA, 22 bp, Homo sapiens
cctgaagagtgaatgtggcagt

SEQ ID NO: 7159107 - DNA, 22 bp, Homo sapiens
cctgaagatccattatagacac

SEQ ID NO: 7159108 - DNA, 22 bp, Homo sapiens
cctgaagaacctcacgggcact

SEQ ID NO: 7159109 - DNA, 22 bp, Homo sapiens
cctgaaacatcttctgtaaata

SEQ ID NO: 7159110 - DNA, 22 bp, Homo sapiens
aggggatggagctggaaggcag

SEQ ID NO: 7159111 - DNA, 22 bp, Homo sapiens
aggggatggagctggaaggcag

SEQ ID NO: 7159112 - DNA, 22 bp, Homo sapiens
aggggatggagctggaaggcag

SEQ ID NO: 7159113 - DNA, 22 bp, Homo sapiens
aggggatggagctggaaggcag

SEQ ID NO: 7159114 - DNA, 22 bp, Homo sapiens
aggggatgcctgaggatctgta

SEQ ID NO: 7159115 - DNA, 22 bp, Homo sapiens
aggggatggagctggaaggcag

SEQ ID NO: 7159116 - DNA, 22 bp, Homo sapiens
aggggatggagctggaaggcag

SEQ ID NO: 7159117 - DNA, 22 bp, Homo sapiens
aggggatggagctggaaggcag

SEQ ID NO: 7159118 - DNA, 22 bp, Homo sapiens
aggggatgcctgaggatctgta

SEQ ID NO: 7159119 - DNA, 22 bp, Homo sapiens
aggggatgcctgaggatctgta

SEQ ID NO: 7159120 - DNA, 22 bp, Homo sapiens
aggggatgcctgaggatctgta

SEQ ID NO: 7159121 - DNA, 22 bp, Homo sapiens
aggggatgcctgaggatctgta

SEQ ID NO: 7159122 - DNA, 22 bp, Homo sapiens
aggggatgcctagtggagtctc

SEQ ID NO: 7159123 - DNA, 22 bp, Homo sapiens
aggggatgcctgaggatctgta

SEQ ID NO: 7159124 - DNA, 20 bp, Homo sapiens
aggggcacctgcgacggggc

SEQ ID NO: 7159125 - DNA, 20 bp, Homo sapiens
aggggcacctgcgacggggc

SEQ ID NO: 7159126 - DNA, 22 bp, Homo sapiens
aggggatggagctggaaggcag

SEQ ID NO: 7159127 - DNA, 22 bp, Homo sapiens
aggggatggagctggaaggcag

SEQ ID NO: 7159128 - DNA, 22 bp, Homo sapiens
aggggatggagctggaaggcag

SEQ ID NO: 7159129 - DNA, 22 bp, Homo sapiens
aggggcactagaatgggagact

SEQ ID NO: 7159130 - DNA, 22 bp, Homo sapiens
aggggcactagaatgggagact

SEQ ID NO: 7159131 - DNA, 22 bp, Homo sapiens
aggggcacgagtagagctctag

SEQ ID NO: 7159132 - DNA, 22 bp, Homo sapiens
aggggcacgagtagagctctag

SEQ ID NO: 7159133 - DNA, 22 bp, Homo sapiens
aggggcacggatgacctgttag

SEQ ID NO: 7159134 - DNA, 18 bp, Homo sapiens
aggggcagcttgtgtgga

SEQ ID NO: 7159135 - DNA, 18 bp, Homo sapiens
aggggcagcttgtgtgga

SEQ ID NO: 7159136 - DNA, 22 bp, Homo sapiens
aggggcagcctcacaatcctct

SEQ ID NO: 7159137 - DNA, 22 bp, Homo sapiens
aggggcagcctcacaatcctct

SEQ ID NO: 7159138 - DNA, 22 bp, Homo sapiens
aggggcagcctcacaatcctct

SEQ ID NO: 7159139 - DNA, 22 bp, Homo sapiens
aggggcagcctcacaatcctct

SEQ ID NO: 7159140 - DNA, 22 bp, Homo sapiens
cctcttccactgggccccatcc

SEQ ID NO: 7159141 - DNA, 22 bp, Homo sapiens
cctcttccactgggccccatcc

SEQ ID NO: 7159142 - DNA, 22 bp, Homo sapiens
cctcttccactgggccccatcc

SEQ ID NO: 7159143 - DNA, 22 bp, Homo sapiens
cctcttccactgggccccatcc

SEQ ID NO: 7159144 - DNA, 22 bp, Homo sapiens
cctgaaacagtccttgccctca

SEQ ID NO: 7159145 - DNA, 22 bp, Homo sapiens
aggggcacttctcaggctgtgg

SEQ ID NO: 7159146 - DNA, 23 bp, Homo sapiens
aggggcagcaagttttggtgtta

SEQ ID NO: 7159147 - DNA, 23 bp, Homo sapiens
aggggcagcaagttttggtgtta

SEQ ID NO: 7159148 - DNA, 22 bp, Homo sapiens
aggggcacttctcaggctgtgg

SEQ ID NO: 7159149 - DNA, 19 bp, Homo sapiens
aggggcactgtctctagag

SEQ ID NO: 7159150 - DNA, 19 bp, Homo sapiens
aggggcactgtctctagag

SEQ ID NO: 7159151 - DNA, 23 bp, Homo sapiens
aggggcagcaagttttggtgtta

SEQ ID NO: 7159152 - DNA, 23 bp, Homo sapiens
aggggcagcaagttttggtgtta

SEQ ID NO: 7159153 - DNA, 22 bp, Homo sapiens
agggctggcatctctaatgctg

SEQ ID NO: 7159154 - DNA, 22 bp, Homo sapiens
agggctggcatctctaatgctg

SEQ ID NO: 7159155 - DNA, 22 bp, Homo sapiens
agggctggccacatgatttggt

SEQ ID NO: 7159156 - DNA, 22 bp, Homo sapiens
agggctggccacatgatttggt

SEQ ID NO: 7159157 - DNA, 22 bp, Homo sapiens
agggctggccacatgatttggt

SEQ ID NO: 7159158 - DNA, 22 bp, Homo sapiens
agggctggccacatgatttggt

SEQ ID NO: 7159159 - DNA, 22 bp, Homo sapiens
agggctggctaggtgcgttccc

SEQ ID NO: 7159160 - DNA, 22 bp, Homo sapiens
agggctggctaggtgcgttccc

SEQ ID NO: 7159161 - DNA, 22 bp, Homo sapiens
agggctggctaggtgcgttccc

SEQ ID NO: 7159162 - DNA, 22 bp, Homo sapiens
agggctggctaggtgcgttccc

SEQ ID NO: 7159163 - DNA, 22 bp, Homo sapiens
aggggagagttaatgtgaatgt

SEQ ID NO: 7159164 - DNA, 22 bp, Homo sapiens
agggctggctccgttaccttga

SEQ ID NO: 7159165 - DNA, 22 bp, Homo sapiens
agggctggctccgttaccttga

SEQ ID NO: 7159166 - DNA, 22 bp, Homo sapiens
agggctggctccgttaccttga

SEQ ID NO: 7159167 - DNA, 22 bp, Homo sapiens
agggctggctaggtgcgttccc

SEQ ID NO: 7159168 - DNA, 22 bp, Homo sapiens
agggctggctaggtgcgttccc

SEQ ID NO: 7159169 - DNA, 22 bp, Homo sapiens
aggggaggtgtccccaaatctc

SEQ ID NO: 7159170 - DNA, 22 bp, Homo sapiens
aggggaggtgtccccaaatctc

SEQ ID NO: 7159171 - DNA, 22 bp, Homo sapiens
aggggaggtgtccccaaatctc

SEQ ID NO: 7159172 - DNA, 22 bp, Homo sapiens
aggggaggtgtccccaaatctc

SEQ ID NO: 7159173 - DNA, 22 bp, Homo sapiens
aggggaggtgtccccaaatctc

SEQ ID NO: 7159174 - DNA, 22 bp, Homo sapiens
aggggaggtgtccccaaatctc

SEQ ID NO: 7159175 - DNA, 22 bp, Homo sapiens
aggggatgatcctcccgcagcg

SEQ ID NO: 7159176 - DNA, 22 bp, Homo sapiens
aggggatgcctagtggagtctc

SEQ ID NO: 7159177 - DNA, 22 bp, Homo sapiens
aggggatgcctagtggagtctc

SEQ ID NO: 7159178 - DNA, 22 bp, Homo sapiens
aggggatgcctagtggagtctc

SEQ ID NO: 7159179 - DNA, 22 bp, Homo sapiens
aggggatgcctagtggagtctc

SEQ ID NO: 7159180 - DNA, 22 bp, Homo sapiens
aggggatgcctagtggagtctc

SEQ ID NO: 7159181 - DNA, 22 bp, Homo sapiens
aggggaggcagcgataaacctg

SEQ ID NO: 7159182 - DNA, 22 bp, Homo sapiens
aggggaggcagcgataaacctg

SEQ ID NO: 7159183 - DNA, 22 bp, Homo sapiens
aggggaggcagcgataaacctg

SEQ ID NO: 7159184 - DNA, 22 bp, Homo sapiens
aggggaggcagcgataaacctg

SEQ ID NO: 7159185 - DNA, 22 bp, Homo sapiens
aggggaggcagcgataaacctg

SEQ ID NO: 7159186 - DNA, 22 bp, Homo sapiens
aggggaggcagcgataaacctg

SEQ ID NO: 7159187 - DNA, 22 bp, Homo sapiens
aggggaggagcttttcttgcct

SEQ ID NO: 7159188 - DNA, 22 bp, Homo sapiens
aggggaggcagcgataaacctg

SEQ ID NO: 7159189 - DNA, 22 bp, Homo sapiens
aggggaggagcttttcttgcct

SEQ ID NO: 7159190 - DNA, 22 bp, Homo sapiens
aggggaggagcttttcttgcct

SEQ ID NO: 7159191 - DNA, 22 bp, Homo sapiens
aggggaggagcttttcttgcct

SEQ ID NO: 7159192 - DNA, 22 bp, Homo sapiens
aggggaggagcttttcttgcct

SEQ ID NO: 7159193 - DNA, 22 bp, Homo sapiens
cccaggagatggaggttgcagt

SEQ ID NO: 7159194 - DNA, 22 bp, Homo sapiens
cccaggagatggtgcgtggtct

SEQ ID NO: 7159195 - DNA, 22 bp, Homo sapiens
cccaggagatggaggttgcagt

SEQ ID NO: 7159196 - DNA, 22 bp, Homo sapiens
cccaggagatggaggttgcagt

SEQ ID NO: 7159197 - DNA, 22 bp, Homo sapiens
cccaggagatggtgcgtggtct

SEQ ID NO: 7159198 - DNA, 22 bp, Homo sapiens
cccaggagatggtgcgtggtct

SEQ ID NO: 7159199 - DNA, 22 bp, Homo sapiens
cccaggagccatctgtcttggc

SEQ ID NO: 7159200 - DNA, 22 bp, Homo sapiens
cccaggagccatctgtcttggc

SEQ ID NO: 7159201 - DNA, 19 bp, Homo sapiens
cccaggagcagtattgatg

SEQ ID NO: 7159202 - DNA, 19 bp, Homo sapiens
cccaggagcagtattgatg

SEQ ID NO: 7159203 - DNA, 22 bp, Homo sapiens
cccaggagatgcactccattgg

SEQ ID NO: 7159204 - DNA, 22 bp, Homo sapiens
cccaggagatgcactccattgg

SEQ ID NO: 7159205 - DNA, 22 bp, Homo sapiens
cccaggagatggaggttgcagt

SEQ ID NO: 7159206 - DNA, 22 bp, Homo sapiens
cccaggaatgggaaggaggaat

SEQ ID NO: 7159207 - DNA, 22 bp, Homo sapiens
cccaggaatgggaaggaggaat

SEQ ID NO: 7159208 - DNA, 22 bp, Homo sapiens
cccaggaatgggaaggaggaat

SEQ ID NO: 7159209 - DNA, 22 bp, Homo sapiens
cccaggaattcagggctcaagg

SEQ ID NO: 7159210 - DNA, 22 bp, Homo sapiens
cccaggaattcagggctcaagg

SEQ ID NO: 7159211 - DNA, 22 bp, Homo sapiens
cccaggagatctggatctcgtc

SEQ ID NO: 7159212 - DNA, 23 bp, Homo sapiens
cccaggagcctgagtcctctctg

SEQ ID NO: 7159213 - DNA, 23 bp, Homo sapiens
cccaggagcctgagtcctctctg

SEQ ID NO: 7159214 - DNA, 20 bp, Homo sapiens
cccaggagctgtgccccatc

SEQ ID NO: 7159215 - DNA, 20 bp, Homo sapiens
cccaggagctgtgccccatc

SEQ ID NO: 7159216 - DNA, 20 bp, Homo sapiens
cccaggagctgtgccccatc

SEQ ID NO: 7159217 - DNA, 20 bp, Homo sapiens
cccaggagctgtgccccatc

SEQ ID NO: 7159218 - DNA, 22 bp, Homo sapiens
cccaggagcttctctctgcctc

SEQ ID NO: 7159219 - DNA, 22 bp, Homo sapiens
cccaggagcttctctctgcctc

SEQ ID NO: 7159220 - DNA, 22 bp, Homo sapiens
cccaggagcttctctctgcctc

SEQ ID NO: 7159221 - DNA, 22 bp, Homo sapiens
cccaggagcttctctctgcctc

SEQ ID NO: 7159222 - DNA, 22 bp, Homo sapiens
cccaggaggtagaggttgcagt

SEQ ID NO: 7159223 - DNA, 22 bp, Homo sapiens
cccaggaggtcaaggctgcagt

SEQ ID NO: 7159224 - DNA, 22 bp, Homo sapiens
cccaggaggtcaaggctgcagt

SEQ ID NO: 7159225 - DNA, 22 bp, Homo sapiens
cccaggaggtcaaggctgcagt

SEQ ID NO: 7159226 - DNA, 22 bp, Homo sapiens
cccaggaggtcaaggctgcagt

SEQ ID NO: 7159227 - DNA, 22 bp, Homo sapiens
cccaggaggtagaggttgcagt

SEQ ID NO: 7159228 - DNA, 22 bp, Homo sapiens
cccaggaggtagaggttgcagt

SEQ ID NO: 7159229 - DNA, 22 bp, Homo sapiens
cccaggaggtagaggttgcagt

SEQ ID NO: 7159230 - DNA, 22 bp, Homo sapiens
aggctgtgaaggttaaagacga

SEQ ID NO: 7159231 - DNA, 22 bp, Homo sapiens
aggctgtgaaatgtggcaagga

SEQ ID NO: 7159232 - DNA, 22 bp, Homo sapiens
aggctgtgaactctatgctgaa

SEQ ID NO: 7159233 - DNA, 22 bp, Homo sapiens
aggctgtgaaatgtggcaagga

SEQ ID NO: 7159234 - DNA, 22 bp, Homo sapiens
aggctgtgaaatgtggcaagga

SEQ ID NO: 7159235 - DNA, 22 bp, Homo sapiens
aggctgtgaaatgtggcaagga

SEQ ID NO: 7159236 - DNA, 22 bp, Homo sapiens
aggctgtgacagggtcatggag

SEQ ID NO: 7159237 - DNA, 22 bp, Homo sapiens
aggctgtgacagggtcatggag

SEQ ID NO: 7159238 - DNA, 22 bp, Homo sapiens
aggctgtgacagggtcatggag

SEQ ID NO: 7159239 - DNA, 22 bp, Homo sapiens
cccaggaatgaggggcggaggc

SEQ ID NO: 7159240 - DNA, 22 bp, Homo sapiens
cccaggaatgaggggcggaggc

SEQ ID NO: 7159241 - DNA, 22 bp, Homo sapiens
aggctgtctcacctcaggaggg

SEQ ID NO: 7159242 - DNA, 22 bp, Homo sapiens
aggctgtctgaccccagagccc

SEQ ID NO: 7159243 - DNA, 22 bp, Homo sapiens
aggctgtctgaccccagagccc

SEQ ID NO: 7159244 - DNA, 21 bp, Homo sapiens
aggctgtcctttgccagccct

SEQ ID NO: 7159245 - DNA, 22 bp, Homo sapiens
aggctgtcctctcttgctcagt

SEQ ID NO: 7159246 - DNA, 20 bp, Homo sapiens
aggctgtcatttctggcagg

SEQ ID NO: 7159247 - DNA, 22 bp, Homo sapiens
aggctgtcatctttgcaggcag

SEQ ID NO: 7159248 - DNA, 22 bp, Homo sapiens
aggctgtcatctttgcaggcag

SEQ ID NO: 7159249 - DNA, 22 bp, Homo sapiens
aggctggtgtgtcctgaagcct

SEQ ID NO: 7159250 - DNA, 22 bp, Homo sapiens
aggctggtgtgtcctgaagcct

SEQ ID NO: 7159251 - DNA, 22 bp, Homo sapiens
aggctggtgcttcctagggcag

SEQ ID NO: 7159252 - DNA, 22 bp, Homo sapiens
aggctggtgcttcctagggcag

SEQ ID NO: 7159253 - DNA, 22 bp, Homo sapiens
aggctggtgcttcctagggcag

SEQ ID NO: 7159254 - DNA, 22 bp, Homo sapiens
aggctggtctgttggcattttt

SEQ ID NO: 7159255 - DNA, 22 bp, Homo sapiens
aggctggtctgttggcattttt

SEQ ID NO: 7159256 - DNA, 22 bp, Homo sapiens
aggctggtgattagaagcagcc

SEQ ID NO: 7159257 - DNA, 22 bp, Homo sapiens
aggctggtgattagaagcagcc

SEQ ID NO: 7159258 - DNA, 22 bp, Homo sapiens
aggctggtgattagaagcagcc

SEQ ID NO: 7159259 - DNA, 22 bp, Homo sapiens
aggctggtgcctgcagtgaatc

SEQ ID NO: 7159260 - DNA, 22 bp, Homo sapiens
aggctggtgcctgcagtgaatc

SEQ ID NO: 7159261 - DNA, 22 bp, Homo sapiens
aggctgggtacctgtcatatgc

SEQ ID NO: 7159262 - DNA, 22 bp, Homo sapiens
aggctggtagtatttagtcaca

SEQ ID NO: 7159263 - DNA, 22 bp, Homo sapiens
aggctggtcccagggagggaat

SEQ ID NO: 7159264 - DNA, 22 bp, Homo sapiens
cccaggctgatgttcagcgggt

SEQ ID NO: 7159265 - DNA, 22 bp, Homo sapiens
cccaggctgatgttcagcgggt

SEQ ID NO: 7159266 - DNA, 22 bp, Homo sapiens
cccaggctgatgttcagcgggt

SEQ ID NO: 7159267 - DNA, 22 bp, Homo sapiens
cccaggctgcatgagtccatgg

SEQ ID NO: 7159268 - DNA, 22 bp, Homo sapiens
cccaggctgcatgagtccatgg

SEQ ID NO: 7159269 - DNA, 22 bp, Homo sapiens
cccaggctgccacgattactgc

SEQ ID NO: 7159270 - DNA, 22 bp, Homo sapiens
cccaggctgccacgattactgc

SEQ ID NO: 7159271 - DNA, 22 bp, Homo sapiens
cccaggctgatgggatgggcca

SEQ ID NO: 7159272 - DNA, 22 bp, Homo sapiens
cccaggctgatgggatgggcca

SEQ ID NO: 7159273 - DNA, 22 bp, Homo sapiens
cccaggctgatgggatgggcca

SEQ ID NO: 7159274 - DNA, 22 bp, Homo sapiens
cccaggctgatgggatgggcca

SEQ ID NO: 7159275 - DNA, 22 bp, Homo sapiens
cccaggctgatgggatgggcca

SEQ ID NO: 7159276 - DNA, 22 bp, Homo sapiens
cccaggctgatgggatgggcca

SEQ ID NO: 7159277 - DNA, 22 bp, Homo sapiens
cccaggctgatgggatgggcca

SEQ ID NO: 7159278 - DNA, 22 bp, Homo sapiens
cccaggctgatgttcagcgggt

SEQ ID NO: 7159279 - DNA, 22 bp, Homo sapiens
cccaggctgatgttcagcgggt

SEQ ID NO: 7159280 - DNA, 22 bp, Homo sapiens
cccaggctgatgttcagcgggt

SEQ ID NO: 7159281 - DNA, 22 bp, Homo sapiens
cccaggctgatgttcagcgggt

SEQ ID NO: 7159282 - DNA, 22 bp, Homo sapiens
cccaggaggtcaaggctgcagt

SEQ ID NO: 7159283 - DNA, 22 bp, Homo sapiens
cccaggaggtcgaagctgcagt

SEQ ID NO: 7159284 - DNA, 22 bp, Homo sapiens
cccaggaggtcgaagctgcagt

SEQ ID NO: 7159285 - DNA, 22 bp, Homo sapiens
cccaggaggtcgaagctgcagt

SEQ ID NO: 7159286 - DNA, 22 bp, Homo sapiens
cccaggaggtcgaagctgcagt

SEQ ID NO: 7159287 - DNA, 22 bp, Homo sapiens
cccaggaggtcaaggctgcagt

SEQ ID NO: 7159288 - DNA, 22 bp, Homo sapiens
cccaggaggtcaaggctgcagt

SEQ ID NO: 7159289 - DNA, 22 bp, Homo sapiens
cccaggaggtcaaggctgcagt

SEQ ID NO: 7159290 - DNA, 22 bp, Homo sapiens
cccaggaggtcgaagctgcagt

SEQ ID NO: 7159291 - DNA, 22 bp, Homo sapiens
cccaggaggtcgaagctgcagt

SEQ ID NO: 7159292 - DNA, 22 bp, Homo sapiens
cccaggaggtcgaagctgcagt

SEQ ID NO: 7159293 - DNA, 22 bp, Homo sapiens
cccaggaggtcgaagctgcagt

SEQ ID NO: 7159294 - DNA, 22 bp, Homo sapiens
cccaggaggtggagcttgcagt

SEQ ID NO: 7159295 - DNA, 22 bp, Homo sapiens
cccaggaggtggagcttgcagt

SEQ ID NO: 7159296 - DNA, 22 bp, Homo sapiens
cccaggaggtggagcttgcagt

SEQ ID NO: 7159297 - DNA, 22 bp, Homo sapiens
cccaggaggtggagcttgcagt

SEQ ID NO: 7159298 - DNA, 22 bp, Homo sapiens
cccaggctgagttagaggtgtc

SEQ ID NO: 7159299 - DNA, 18 bp, Homo sapiens
cccaggctttgtgggtct

SEQ ID NO: 7159300 - DNA, 18 bp, Homo sapiens
cccaggctttgtgggtct

SEQ ID NO: 7159301 - DNA, 18 bp, Homo sapiens
cccaggctttgtgggtct

SEQ ID NO: 7159302 - DNA, 22 bp, Homo sapiens
cccaggctgtgcaaacttcaaa

SEQ ID NO: 7159303 - DNA, 22 bp, Homo sapiens
cccaggctgtgcaaacttcaaa

SEQ ID NO: 7159304 - DNA, 22 bp, Homo sapiens
cccaggcttcccaatcagaagg

SEQ ID NO: 7159305 - DNA, 22 bp, Homo sapiens
cccaggctgcgtatccacaata

SEQ ID NO: 7159306 - DNA, 22 bp, Homo sapiens
cccaggctggaattccaggcct

SEQ ID NO: 7159307 - DNA, 22 bp, Homo sapiens
cccaggctggaattccaggcct

SEQ ID NO: 7159308 - DNA, 22 bp, Homo sapiens
cccaggctggtcctgaactcct

SEQ ID NO: 7159309 - DNA, 22 bp, Homo sapiens
cccaggctgtctgtcctttgct

SEQ ID NO: 7159310 - DNA, 22 bp, Homo sapiens
cccaggctgtctgtcctttgct

SEQ ID NO: 7159311 - DNA, 22 bp, Homo sapiens
cccagtacctctgttccctgct

SEQ ID NO: 7159312 - DNA, 22 bp, Homo sapiens
cccagtcatcctgcaggtgaaa

SEQ ID NO: 7159313 - DNA, 22 bp, Homo sapiens
cccaggcttttctcttgcccca

SEQ ID NO: 7159314 - DNA, 22 bp, Homo sapiens
cccagggaagccatttctgact

SEQ ID NO: 7159315 - DNA, 22 bp, Homo sapiens
cccaggcttttaagttagacag

SEQ ID NO: 7159316 - DNA, 22 bp, Homo sapiens
cccaggcttttaagttagacag

SEQ ID NO: 7159317 - DNA, 22 bp, Homo sapiens
cccaggcttttctcttgcccca

SEQ ID NO: 7159318 - DNA, 22 bp, Homo sapiens
cccaggcttttctcttgcccca

SEQ ID NO: 7159319 - DNA, 22 bp, Homo sapiens
cccatctcagtcgtgctaaggg

SEQ ID NO: 7159320 - DNA, 22 bp, Homo sapiens
cccatccctgattttcactcgt

SEQ ID NO: 7159321 - DNA, 22 bp, Homo sapiens
cccatcaggaacccaggagccc

SEQ ID NO: 7159322 - DNA, 22 bp, Homo sapiens
cccatcaggaacccaggagccc

SEQ ID NO: 7159323 - DNA, 22 bp, Homo sapiens
cccagttttctgattgaagagc

SEQ ID NO: 7159324 - DNA, 22 bp, Homo sapiens
cccagtccaaaagtaggttcta

SEQ ID NO: 7159325 - DNA, 22 bp, Homo sapiens
cccagtttcaactttccagtgg

SEQ ID NO: 7159326 - DNA, 22 bp, Homo sapiens
ccctgctgtgcctgactgccat

SEQ ID NO: 7159327 - DNA, 22 bp, Homo sapiens
ccctgctgtccctcagtcctgc

SEQ ID NO: 7159328 - DNA, 22 bp, Homo sapiens
ccctgctgtccctcagtcctgc

SEQ ID NO: 7159329 - DNA, 22 bp, Homo sapiens
ccctgctgtccctcagtcctgc

SEQ ID NO: 7159330 - DNA, 22 bp, Homo sapiens
ccctgctgtgtcccacctggaa

SEQ ID NO: 7159331 - DNA, 22 bp, Homo sapiens
ccctgctgtgtcccacctggaa

SEQ ID NO: 7159332 - DNA, 22 bp, Homo sapiens
ccctgctgtgtagcggaggaac

SEQ ID NO: 7159333 - DNA, 22 bp, Homo sapiens
ccctgccctgggcagaagtggg

SEQ ID NO: 7159334 - DNA, 22 bp, Homo sapiens
ccctgctgcatggcctccacga

SEQ ID NO: 7159335 - DNA, 22 bp, Homo sapiens
ccctgctgcatggcctccacga

SEQ ID NO: 7159336 - DNA, 22 bp, Homo sapiens
ccctgctgcaggcttcaggagg

SEQ ID NO: 7159337 - DNA, 22 bp, Homo sapiens
ccctgccctgggcagaagtggg

SEQ ID NO: 7159338 - DNA, 22 bp, Homo sapiens
ccctgctgccttcacccaggac

SEQ ID NO: 7159339 - DNA, 22 bp, Homo sapiens
ccctgctgccttcacccaggac

SEQ ID NO: 7159340 - DNA, 22 bp, Homo sapiens
ccctgccagggtcctgacagac

SEQ ID NO: 7159341 - DNA, 18 bp, Homo sapiens
ccctgccagctcccagca

SEQ ID NO: 7159342 - DNA, 22 bp, Homo sapiens
ccctgccagggtcctgacagac

SEQ ID NO: 7159343 - DNA, 22 bp, Homo sapiens
ccctgccagggtcctgacagac

SEQ ID NO: 7159344 - DNA, 22 bp, Homo sapiens
ccctgcccaccacatgctggga

SEQ ID NO: 7159345 - DNA, 22 bp, Homo sapiens
ccctgcccaccacatgctggga

SEQ ID NO: 7159346 - DNA, 22 bp, Homo sapiens
ccctgcccaccacatgctggga

SEQ ID NO: 7159347 - DNA, 22 bp, Homo sapiens
ccctgcccatcggggcggcctg

SEQ ID NO: 7159348 - DNA, 22 bp, Homo sapiens
ccctgcccatcggggcggcctg

SEQ ID NO: 7159349 - DNA, 22 bp, Homo sapiens
ccctgcccatcggggcggcctg

SEQ ID NO: 7159350 - DNA, 21 bp, Homo sapiens
ccctgccctcaaggacagtgc

SEQ ID NO: 7159351 - DNA, 22 bp, Homo sapiens
ccctgccccaggcggcttcact

SEQ ID NO: 7159352 - DNA, 22 bp, Homo sapiens
ccctgccctggagacacttaaa

SEQ ID NO: 7159353 - DNA, 22 bp, Homo sapiens
ccctgccctggagacacttaaa

SEQ ID NO: 7159354 - DNA, 21 bp, Homo sapiens
ccctgccctcaaggacagtgc

SEQ ID NO: 7159355 - DNA, 23 bp, Homo sapiens
ccctgcccattgagcaggacgtc

SEQ ID NO: 7159356 - DNA, 23 bp, Homo sapiens
ccctgcccattgagcaggacgtc

SEQ ID NO: 7159357 - DNA, 23 bp, Homo sapiens
ccctgcccattgagcaggacgtc

SEQ ID NO: 7159358 - DNA, 22 bp, Homo sapiens
ccctgccccaggcggcttcact

SEQ ID NO: 7159359 - DNA, 22 bp, Homo sapiens
ccctgccaatcccgtctctctg

SEQ ID NO: 7159360 - DNA, 22 bp, Homo sapiens
ccctgccaatcccgtctctctg

SEQ ID NO: 7159361 - DNA, 22 bp, Homo sapiens
ccctgccaatcccgtctctctg

SEQ ID NO: 7159362 - DNA, 22 bp, Homo sapiens
ccctgccaatcccgtctctctg

SEQ ID NO: 7159363 - DNA, 22 bp, Homo sapiens
ccctgccaatcccgtctctctg

SEQ ID NO: 7159364 - DNA, 22 bp, Homo sapiens
ccctgccaatcccgtctctctg

SEQ ID NO: 7159365 - DNA, 22 bp, Homo sapiens
ccctgccagatgtgcttcagtt

SEQ ID NO: 7159366 - DNA, 22 bp, Homo sapiens
ccctgccagatgtgcttcagtt

SEQ ID NO: 7159367 - DNA, 22 bp, Homo sapiens
ccctgccagatgtgcttcagtt

SEQ ID NO: 7159368 - DNA, 22 bp, Homo sapiens
ccctgccagatgtgcttcagtt

SEQ ID NO: 7159369 - DNA, 18 bp, Homo sapiens
ccctgccagctcccagca

SEQ ID NO: 7159370 - DNA, 18 bp, Homo sapiens
ccctgccagctcccagca

SEQ ID NO: 7159371 - DNA, 18 bp, Homo sapiens
ccctgccagctcccagca

SEQ ID NO: 7159372 - DNA, 22 bp, Homo sapiens
ccctcccaggagtggccagaga

SEQ ID NO: 7159373 - DNA, 22 bp, Homo sapiens
ccctcccaggagtggccagaga

SEQ ID NO: 7159374 - DNA, 22 bp, Homo sapiens
ccctcccagatgggcttgaggt

SEQ ID NO: 7159375 - DNA, 22 bp, Homo sapiens
ccctcccagatgggcttgaggt

SEQ ID NO: 7159376 - DNA, 20 bp, Homo sapiens
ccctcccagatgcttcccaa

SEQ ID NO: 7159377 - DNA, 20 bp, Homo sapiens
ccctcccagatgcttcccaa

SEQ ID NO: 7159378 - DNA, 22 bp, Homo sapiens
ccctcccagatgggcttgaggt

SEQ ID NO: 7159379 - DNA, 22 bp, Homo sapiens
ccctcccaagcactctgacata

SEQ ID NO: 7159380 - DNA, 22 bp, Homo sapiens
ccctcccaagcactctgacata

SEQ ID NO: 7159381 - DNA, 20 bp, Homo sapiens
ccctcccagatgcttcccaa

SEQ ID NO: 7159382 - DNA, 20 bp, Homo sapiens
ccctcccagatgcttcccaa

SEQ ID NO: 7159383 - DNA, 22 bp, Homo sapiens
ccctcccaagcactctgacata

SEQ ID NO: 7159384 - DNA, 22 bp, Homo sapiens
ccctcagctccaccctcagcag

SEQ ID NO: 7159385 - DNA, 22 bp, Homo sapiens
ccctccattaaaacagacctat

SEQ ID NO: 7159386 - DNA, 22 bp, Homo sapiens
ccctccattaaaacagacctat

SEQ ID NO: 7159387 - DNA, 22 bp, Homo sapiens
cccatgagattctgaatttggc

SEQ ID NO: 7159388 - DNA, 22 bp, Homo sapiens
cccatgagacctggtttaaggc

SEQ ID NO: 7159389 - DNA, 22 bp, Homo sapiens
cccatgagattctgaatttggc

SEQ ID NO: 7159390 - DNA, 17 bp, Homo sapiens
cccatgagcccactccc

SEQ ID NO: 7159391 - DNA, 22 bp, Homo sapiens
cccatgaggtggaggttgcagt

SEQ ID NO: 7159392 - DNA, 22 bp, Homo sapiens
cccatgagtgctgctcagaggc

SEQ ID NO: 7159393 - DNA, 22 bp, Homo sapiens
cccatgcaccctctaagaagga

SEQ ID NO: 7159394 - DNA, 22 bp, Homo sapiens
cccatgcaccctctaagaagga

SEQ ID NO: 7159395 - DNA, 22 bp, Homo sapiens
cccatgcaccctctaagaagga

SEQ ID NO: 7159396 - DNA, 22 bp, Homo sapiens
cccatgcaccctctaagaagga

SEQ ID NO: 7159397 - DNA, 22 bp, Homo sapiens
cccatgcaccctctaagaagga

SEQ ID NO: 7159398 - DNA, 22 bp, Homo sapiens
cccatgcaccctctaagaagga

SEQ ID NO: 7159399 - DNA, 20 bp, Homo sapiens
cccatgcatcttcacaacct

SEQ ID NO: 7159400 - DNA, 22 bp, Homo sapiens
cccatgggttttcctccctgcc

SEQ ID NO: 7159401 - DNA, 22 bp, Homo sapiens
cccatgggttttcctccctgcc

SEQ ID NO: 7159402 - DNA, 22 bp, Homo sapiens
cccatggggacaccatgaagga

SEQ ID NO: 7159403 - DNA, 22 bp, Homo sapiens
cccatggcagtcagagataaga

SEQ ID NO: 7159404 - DNA, 22 bp, Homo sapiens
cccatggcaataaggtcacagg

SEQ ID NO: 7159405 - DNA, 22 bp, Homo sapiens
cccatgccttctgactcacagg

SEQ ID NO: 7159406 - DNA, 22 bp, Homo sapiens
cccatgctgtgcctagagagca

SEQ ID NO: 7159407 - DNA, 23 bp, Homo sapiens
cccatgctgggcgcagtgaatgg

SEQ ID NO: 7159408 - DNA, 22 bp, Homo sapiens
cccatgctgtgcctagagagca

SEQ ID NO: 7159409 - DNA, 22 bp, Homo sapiens
cccatggagtgcctgagggcca

SEQ ID NO: 7159410 - DNA, 22 bp, Homo sapiens
cccattcatcctcgcttccttc

SEQ ID NO: 7159411 - DNA, 22 bp, Homo sapiens
cccattcatcctcgcttccttc

SEQ ID NO: 7159412 - DNA, 19 bp, Homo sapiens
ccccacttccatgggctcc

SEQ ID NO: 7159413 - DNA, 22 bp, Homo sapiens
ccccacttgctcagcatgtcca

SEQ ID NO: 7159414 - DNA, 22 bp, Homo sapiens
ccccactttgagtagcacttga

SEQ ID NO: 7159415 - DNA, 22 bp, Homo sapiens
ccccagaaggggacagagggta

SEQ ID NO: 7159416 - DNA, 22 bp, Homo sapiens
ccccagaaggggacagagggta

SEQ ID NO: 7159417 - DNA, 22 bp, Homo sapiens
ccccagaagtttgcacaagaga

SEQ ID NO: 7159418 - DNA, 22 bp, Homo sapiens
ccccagaagtttgcacaagaga

SEQ ID NO: 7159419 - DNA, 22 bp, Homo sapiens
ccccagagaaagtcagcagcat

SEQ ID NO: 7159420 - DNA, 22 bp, Homo sapiens
ccccagagaaagtcagcagcat

SEQ ID NO: 7159421 - DNA, 22 bp, Homo sapiens
ccccagagaaagtcagcagcat

SEQ ID NO: 7159422 - DNA, 22 bp, Homo sapiens
ccccagagaaagtcagcagcat

SEQ ID NO: 7159423 - DNA, 22 bp, Homo sapiens
ccccagagagcaccatgaagcc

SEQ ID NO: 7159424 - DNA, 22 bp, Homo sapiens
ccccagagtgagggattgagtg

SEQ ID NO: 7159425 - DNA, 22 bp, Homo sapiens
ccccagagtgagggattgagtg

SEQ ID NO: 7159426 - DNA, 22 bp, Homo sapiens
ccccttccacagtgcttcctaa

SEQ ID NO: 7159427 - DNA, 22 bp, Homo sapiens
ccccagcacttggagtggggag

SEQ ID NO: 7159428 - DNA, 22 bp, Homo sapiens
ccctaggctgaggccagggtgc

SEQ ID NO: 7159429 - DNA, 22 bp, Homo sapiens
ccctaggctgaggccagggtgc

SEQ ID NO: 7159430 - DNA, 22 bp, Homo sapiens
ccctaggctgggctcttggctt

SEQ ID NO: 7159431 - DNA, 22 bp, Homo sapiens
ccccagcacaggctcctcagat

SEQ ID NO: 7159432 - DNA, 21 bp, Homo sapiens
ccccagcaccttgccagcctg

SEQ ID NO: 7159433 - DNA, 21 bp, Homo sapiens
ccccagcaccttgccagcctg

SEQ ID NO: 7159434 - DNA, 21 bp, Homo sapiens
ccccagcaccttgccagcctg

SEQ ID NO: 7159435 - DNA, 21 bp, Homo sapiens
ccccagcaccttgccagcctg

SEQ ID NO: 7159436 - DNA, 22 bp, Homo sapiens
ccccagcacaggctcctcagat

SEQ ID NO: 7159437 - DNA, 22 bp, Homo sapiens
ccccagcacaggctcctcagat

SEQ ID NO: 7159438 - DNA, 22 bp, Homo sapiens
ccccagcactaccagaagccag

SEQ ID NO: 7159439 - DNA, 22 bp, Homo sapiens
ccccagcactaccagaagccag

SEQ ID NO: 7159440 - DNA, 22 bp, Homo sapiens
ccccagcactaccagaagccag

SEQ ID NO: 7159441 - DNA, 22 bp, Homo sapiens
ccccagcactaccagaagccag

SEQ ID NO: 7159442 - DNA, 22 bp, Homo sapiens
ccccagcactctgactcttacc

SEQ ID NO: 7159443 - DNA, 22 bp, Homo sapiens
ccccagcactctgactcttacc

SEQ ID NO: 7159444 - DNA, 22 bp, Homo sapiens
ccctagggctaagcaggactgc

SEQ ID NO: 7159445 - DNA, 22 bp, Homo sapiens
ccctaggggcaatgatggtgct

SEQ ID NO: 7159446 - DNA, 19 bp, Homo sapiens
ccctaggggctcctgaggg

SEQ ID NO: 7159447 - DNA, 22 bp, Homo sapiens
ccctagggtttggccagagccc

SEQ ID NO: 7159448 - DNA, 22 bp, Homo sapiens
ccctagggtttggccagagccc

SEQ ID NO: 7159449 - DNA, 23 bp, Homo sapiens
ccctaggtgggcccgctctaggg

SEQ ID NO: 7159450 - DNA, 22 bp, Homo sapiens
ccctatcagaagctgagagaag

SEQ ID NO: 7159451 - DNA, 22 bp, Homo sapiens
ccctatcctgcaggcctgggct

SEQ ID NO: 7159452 - DNA, 17 bp, Homo sapiens
ccctcactcctgccggg

SEQ ID NO: 7159453 - DNA, 17 bp, Homo sapiens
ccctcactcctgccggg

SEQ ID NO: 7159454 - DNA, 22 bp, Homo sapiens
ccctcactctgcctcctggggt

SEQ ID NO: 7159455 - DNA, 22 bp, Homo sapiens
ccctcactgtccttgggccctt

SEQ ID NO: 7159456 - DNA, 22 bp, Homo sapiens
ccctcacttcacgctctgcaga

SEQ ID NO: 7159457 - DNA, 22 bp, Homo sapiens
ccctcacttcacgctctgcaga

SEQ ID NO: 7159458 - DNA, 22 bp, Homo sapiens
ccctcacttcacgctctgcaga

SEQ ID NO: 7159459 - DNA, 22 bp, Homo sapiens
caaaggcctgagaactgagggg

SEQ ID NO: 7159460 - DNA, 22 bp, Homo sapiens
caaaggctgccactgtggctgt

SEQ ID NO: 7159461 - DNA, 22 bp, Homo sapiens
caaaggctgccactgtggctgt

SEQ ID NO: 7159462 - DNA, 22 bp, Homo sapiens
caaaggctgccactgtggctgt

SEQ ID NO: 7159463 - DNA, 22 bp, Homo sapiens
caaaggctggtagaatgagcca

SEQ ID NO: 7159464 - DNA, 22 bp, Homo sapiens
caaaggcttcatctcagagcag

SEQ ID NO: 7159465 - DNA, 22 bp, Homo sapiens
caaaggctggtagaatgagcca

SEQ ID NO: 7159466 - DNA, 22 bp, Homo sapiens
caaaggcagttactgaatgaag

SEQ ID NO: 7159467 - DNA, 22 bp, Homo sapiens
caaaggcagttactgaatgaag

SEQ ID NO: 7159468 - DNA, 22 bp, Homo sapiens
caaaggcatcggcaattaggga

SEQ ID NO: 7159469 - DNA, 22 bp, Homo sapiens
caaaggcatcggcaattaggga

SEQ ID NO: 7159470 - DNA, 22 bp, Homo sapiens
caaaggcatgtgagtatatgtg

SEQ ID NO: 7159471 - DNA, 22 bp, Homo sapiens
caaaggcatgtgagtatatgtg

SEQ ID NO: 7159472 - DNA, 22 bp, Homo sapiens
caaagggaaaagccatgtgggc

SEQ ID NO: 7159473 - DNA, 22 bp, Homo sapiens
caaagggaaacgcagtgtcaag

SEQ ID NO: 7159474 - DNA, 22 bp, Homo sapiens
caaagggaaaagccatgtgggc

SEQ ID NO: 7159475 - DNA, 22 bp, Homo sapiens
caaaggctttgctatgatgcat

SEQ ID NO: 7159476 - DNA, 22 bp, Homo sapiens
caaaggctttgctatgatgcat

SEQ ID NO: 7159477 - DNA, 22 bp, Homo sapiens
caaaggcttcatctcagagcag

SEQ ID NO: 7159478 - DNA, 22 bp, Homo sapiens
caaaggcttccactgcatcctt

SEQ ID NO: 7159479 - DNA, 17 bp, Homo sapiens
agcacctgtccagtccc

SEQ ID NO: 7159480 - DNA, 17 bp, Homo sapiens
agcacctgtccagtccc

SEQ ID NO: 7159481 - DNA, 19 bp, Homo sapiens
agcacctgtgagagcctgg

SEQ ID NO: 7159482 - DNA, 23 bp, Homo sapiens
agcacctgtgatttcctagctct

SEQ ID NO: 7159483 - DNA, 22 bp, Homo sapiens
agcacctgtcacaagcagaagg

SEQ ID NO: 7159484 - DNA, 22 bp, Homo sapiens
agcacctgtcacaagcagaagg

SEQ ID NO: 7159485 - DNA, 20 bp, Homo sapiens
agcaccagtgggggcagccc

SEQ ID NO: 7159486 - DNA, 18 bp, Homo sapiens
agcaccagtcactaacag

SEQ ID NO: 7159487 - DNA, 22 bp, Homo sapiens
agcacctgcttaatgtgcagtg

SEQ ID NO: 7159488 - DNA, 22 bp, Homo sapiens
agcacctggagggctgggacct

SEQ ID NO: 7159489 - DNA, 22 bp, Homo sapiens
agcaccttgctcttggccttcc

SEQ ID NO: 7159490 - DNA, 22 bp, Homo sapiens
agcaccttgctcttggccttcc

SEQ ID NO: 7159491 - DNA, 22 bp, Homo sapiens
agcaccttgatcttggacttcc

SEQ ID NO: 7159492 - DNA, 21 bp, Homo sapiens
agcaccttcaattctattgtc

SEQ ID NO: 7159493 - DNA, 21 bp, Homo sapiens
agcaccttcaattctattgtc

SEQ ID NO: 7159494 - DNA, 22 bp, Homo sapiens
agcaccttcacaggctctcagg

SEQ ID NO: 7159495 - DNA, 22 bp, Homo sapiens
agcaccttcacaggctctcagg

SEQ ID NO: 7159496 - DNA, 22 bp, Homo sapiens
agcaccttcacaggctctcagg

SEQ ID NO: 7159497 - DNA, 22 bp, Homo sapiens
agcaccttgagatcaagcagtg

SEQ ID NO: 7159498 - DNA, 23 bp, Homo sapiens
agcacgggtacagcctggccagg

SEQ ID NO: 7159499 - DNA, 22 bp, Homo sapiens
agcacgttttactaaacctcca

SEQ ID NO: 7159500 - DNA, 17 bp, Homo sapiens
agcactaaaatgcttcc

SEQ ID NO: 7159501 - DNA, 22 bp, Homo sapiens
agcactagacatgtaagtgagc

SEQ ID NO: 7159502 - DNA, 22 bp, Homo sapiens
agcactagagccaaaatttggg

SEQ ID NO: 7159503 - DNA, 22 bp, Homo sapiens
agcacctgttgcacttcataat

SEQ ID NO: 7159504 - DNA, 22 bp, Homo sapiens
agcacctgtgttcatgcctcat

SEQ ID NO: 7159505 - DNA, 21 bp, Homo sapiens
agcaccttacagctataatgg

SEQ ID NO: 7159506 - DNA, 22 bp, Homo sapiens
agcacctgtgttcatgcctcat

SEQ ID NO: 7159507 - DNA, 22 bp, Homo sapiens
agcacctgtgtgagctagatgt

SEQ ID NO: 7159508 - DNA, 22 bp, Homo sapiens
agcacctgtggctcatgctcgt

SEQ ID NO: 7159509 - DNA, 22 bp, Homo sapiens
agcacctgtggctcatgctcgt

SEQ ID NO: 7159510 - DNA, 22 bp, Homo sapiens
agcacctgtggctcatgctcgt

SEQ ID NO: 7159511 - DNA, 20 bp, Homo sapiens
agcacctgtgtagaagcatc

SEQ ID NO: 7159512 - DNA, 22 bp, Homo sapiens
agcactgctttagagcctctgc

SEQ ID NO: 7159513 - DNA, 22 bp, Homo sapiens
agcactgattttgttgcactta

SEQ ID NO: 7159514 - DNA, 22 bp, Homo sapiens
agcactgcctctgagctccagc

SEQ ID NO: 7159515 - DNA, 22 bp, Homo sapiens
agcactggagtttagtgggatt

SEQ ID NO: 7159516 - DNA, 22 bp, Homo sapiens
agcactgggaacgcatggggcc

SEQ ID NO: 7159517 - DNA, 20 bp, Homo sapiens
agcactgtctgaccagtggc

SEQ ID NO: 7159518 - DNA, 22 bp, Homo sapiens
agcactagctttaagcattctg

SEQ ID NO: 7159519 - DNA, 22 bp, Homo sapiens
agcactagcctgttttgctgtg

SEQ ID NO: 7159520 - DNA, 22 bp, Homo sapiens
agcactagcctgttttgctgtg

SEQ ID NO: 7159521 - DNA, 22 bp, Homo sapiens
agcactagctttaagcattctg

SEQ ID NO: 7159522 - DNA, 20 bp, Homo sapiens
agcactaggtgtggcaggtg

SEQ ID NO: 7159523 - DNA, 20 bp, Homo sapiens
agcactataaggggaaaggg

SEQ ID NO: 7159524 - DNA, 22 bp, Homo sapiens
agcactatgcaacagggacagc

SEQ ID NO: 7159525 - DNA, 22 bp, Homo sapiens
agcactatgtaattagtaagta

SEQ ID NO: 7159526 - DNA, 22 bp, Homo sapiens
agcactattccaatgatccaat

SEQ ID NO: 7159527 - DNA, 22 bp, Homo sapiens
agcactattttccagaatgtag

SEQ ID NO: 7159528 - DNA, 22 bp, Homo sapiens
agcactcttctgtgatagttgt

SEQ ID NO: 7159529 - DNA, 22 bp, Homo sapiens
agcactcttctgtgatagttgt

SEQ ID NO: 7159530 - DNA, 19 bp, Homo sapiens
agcactccctgttctgtct

SEQ ID NO: 7159531 - DNA, 22 bp, Homo sapiens
agcactcctgtctttccccttt

SEQ ID NO: 7159532 - DNA, 22 bp, Homo sapiens
agcactctaagtgcaagacact

SEQ ID NO: 7159533 - DNA, 22 bp, Homo sapiens
agcagaggaggatttagttagg

SEQ ID NO: 7159534 - DNA, 22 bp, Homo sapiens
agcagaggaggatttagttagg

SEQ ID NO: 7159535 - DNA, 22 bp, Homo sapiens
agcagaggacagttcttaggaa

SEQ ID NO: 7159536 - DNA, 22 bp, Homo sapiens
agcagaggacagttcttaggaa

SEQ ID NO: 7159537 - DNA, 22 bp, Homo sapiens
agcagaggacagttcttaggaa

SEQ ID NO: 7159538 - DNA, 22 bp, Homo sapiens
agcagagctgggatcctgggtc

SEQ ID NO: 7159539 - DNA, 22 bp, Homo sapiens
agcagagctgggatcctgggtc

SEQ ID NO: 7159540 - DNA, 22 bp, Homo sapiens
agcagagctgggatcctgggtc

SEQ ID NO: 7159541 - DNA, 22 bp, Homo sapiens
agcagagctttttggactcaga

SEQ ID NO: 7159542 - DNA, 22 bp, Homo sapiens
agcagaggacagttcttaggaa

SEQ ID NO: 7159543 - DNA, 22 bp, Homo sapiens
agcagagctttttggactcaga

SEQ ID NO: 7159544 - DNA, 21 bp, Homo sapiens
agcagaggcagaatgtatgca

SEQ ID NO: 7159545 - DNA, 21 bp, Homo sapiens
agcagaggcagaatgtatgca

SEQ ID NO: 7159546 - DNA, 21 bp, Homo sapiens
agcagaggcagaatgtatgca

SEQ ID NO: 7159547 - DNA, 21 bp, Homo sapiens
agcagaggctgcctggtgact

SEQ ID NO: 7159548 - DNA, 21 bp, Homo sapiens
agcagaggctgcctggtgact

SEQ ID NO: 7159549 - DNA, 21 bp, Homo sapiens
agcagaggctgcctggtgact

SEQ ID NO: 7159550 - DNA, 21 bp, Homo sapiens
agcagaggcagaatgtatgca

SEQ ID NO: 7159551 - DNA, 21 bp, Homo sapiens
agcagaggcagaatgtatgca

SEQ ID NO: 7159552 - DNA, 22 bp, Homo sapiens
agcagagctgcagtggcctgct

SEQ ID NO: 7159553 - DNA, 22 bp, Homo sapiens
agcagagctgcagtggcctgct

SEQ ID NO: 7159554 - DNA, 22 bp, Homo sapiens
agcagagctgggatcctgggtc

SEQ ID NO: 7159555 - DNA, 22 bp, Homo sapiens
agcagagcggggcctccggaag

SEQ ID NO: 7159556 - DNA, 22 bp, Homo sapiens
agcagagcggggcctccggaag

SEQ ID NO: 7159557 - DNA, 22 bp, Homo sapiens
agcagagctattcttgtgcaat

SEQ ID NO: 7159558 - DNA, 22 bp, Homo sapiens
agcagagacctggttttgttga

SEQ ID NO: 7159559 - DNA, 22 bp, Homo sapiens
agcagagacctggttttgttga

SEQ ID NO: 7159560 - DNA, 22 bp, Homo sapiens
agcagagaggaggtggccctgt

SEQ ID NO: 7159561 - DNA, 22 bp, Homo sapiens
agcagagcgcctgctcagaggg

SEQ ID NO: 7159562 - DNA, 22 bp, Homo sapiens
agcagagaccatatagcccaga

SEQ ID NO: 7159563 - DNA, 22 bp, Homo sapiens
agcactgtgatttataacattt

SEQ ID NO: 7159564 - DNA, 22 bp, Homo sapiens
agcactgtgatttataacattt

SEQ ID NO: 7159565 - DNA, 20 bp, Homo sapiens
agcagagtgcccatcccgga

SEQ ID NO: 7159566 - DNA, 22 bp, Homo sapiens
agcagagtcttcaagggcaggc

SEQ ID NO: 7159567 - DNA, 20 bp, Homo sapiens
agcagagtgcccatcccgga

SEQ ID NO: 7159568 - DNA, 20 bp, Homo sapiens
agcagagtgcccatcccgga

SEQ ID NO: 7159569 - DNA, 22 bp, Homo sapiens
agcagagtcttcaagggcaggc

SEQ ID NO: 7159570 - DNA, 22 bp, Homo sapiens
agcagagtcttcaagggcaggc

SEQ ID NO: 7159571 - DNA, 20 bp, Homo sapiens
agcagagtgcccatcccgga

SEQ ID NO: 7159572 - DNA, 22 bp, Homo sapiens
agcagaggtttgttggaaacct

SEQ ID NO: 7159573 - DNA, 22 bp, Homo sapiens
agcagagtctgtgtgcacttta

SEQ ID NO: 7159574 - DNA, 22 bp, Homo sapiens
agcagaggtttgttggaaacct

SEQ ID NO: 7159575 - DNA, 22 bp, Homo sapiens
agcagaggtttgttggaaacct

SEQ ID NO: 7159576 - DNA, 22 bp, Homo sapiens
agcagaggtgtttattatggga

SEQ ID NO: 7159577 - DNA, 22 bp, Homo sapiens
agcagaggtgtttattatggga

SEQ ID NO: 7159578 - DNA, 16 bp, Homo sapiens
agcagaggtgagtgaa

SEQ ID NO: 7159579 - DNA, 22 bp, Homo sapiens
agcagaggtgtttattatggga

SEQ ID NO: 7159580 - DNA, 21 bp, Homo sapiens
agcagaggggacatgtttgat

SEQ ID NO: 7159581 - DNA, 16 bp, Homo sapiens
agcagaggtgagtgaa

SEQ ID NO: 7159582 - DNA, 21 bp, Homo sapiens
agcagaggggacatgtttgat

SEQ ID NO: 7159583 - DNA, 22 bp, Homo sapiens
caataatatcctgtgctgtttg

SEQ ID NO: 7159584 - DNA, 19 bp, Homo sapiens
caataagtcagtagtgggc

SEQ ID NO: 7159585 - DNA, 22 bp, Homo sapiens
caataatatcctgtgctgtttg

SEQ ID NO: 7159586 - DNA, 20 bp, Homo sapiens
agcagagtgcccatcccgga

SEQ ID NO: 7159587 - DNA, 20 bp, Homo sapiens
agcagagtgcccatcccgga

SEQ ID NO: 7159588 - DNA, 22 bp, Homo sapiens
caagtgactgtgctggcaacat

SEQ ID NO: 7159589 - DNA, 22 bp, Homo sapiens
caagtgagtgaccagagttggt

SEQ ID NO: 7159590 - DNA, 22 bp, Homo sapiens
caatacaattaccagttaatca

SEQ ID NO: 7159591 - DNA, 20 bp, Homo sapiens
caataatttacttccctatt

SEQ ID NO: 7159592 - DNA, 22 bp, Homo sapiens
caatacaattaccagttaatca

SEQ ID NO: 7159593 - DNA, 22 bp, Homo sapiens
caatacaattaccagttaatca

SEQ ID NO: 7159594 - DNA, 22 bp, Homo sapiens
caataatttacattggatacca

SEQ ID NO: 7159595 - DNA, 22 bp, Homo sapiens
caataattgctttccagagtta

SEQ ID NO: 7159596 - DNA, 22 bp, Homo sapiens
cacagagattagaattagacta

SEQ ID NO: 7159597 - DNA, 22 bp, Homo sapiens
cacagagattagaattagacta

SEQ ID NO: 7159598 - DNA, 22 bp, Homo sapiens
cacagagattagaattagacta

SEQ ID NO: 7159599 - DNA, 22 bp, Homo sapiens
cacagagattagaattagacta

SEQ ID NO: 7159600 - DNA, 22 bp, Homo sapiens
cacagagatggtctggcaggtg

SEQ ID NO: 7159601 - DNA, 22 bp, Homo sapiens
cacagagattagaattagacta

SEQ ID NO: 7159602 - DNA, 22 bp, Homo sapiens
cacagagatggtctggcaggtg

SEQ ID NO: 7159603 - DNA, 22 bp, Homo sapiens
cacagagatggtctggcaggtg

SEQ ID NO: 7159604 - DNA, 22 bp, Homo sapiens
cacagagatggtctggcaggtg

SEQ ID NO: 7159605 - DNA, 22 bp, Homo sapiens
cacagagatggtctggcaggtg

SEQ ID NO: 7159606 - DNA, 22 bp, Homo sapiens
cacagagatggccagggcacat

SEQ ID NO: 7159607 - DNA, 22 bp, Homo sapiens
cacagagatggccagggcacat

SEQ ID NO: 7159608 - DNA, 22 bp, Homo sapiens
cacagagatggccagggcacat

SEQ ID NO: 7159609 - DNA, 22 bp, Homo sapiens
cacagagcaggtgctgggaaga

SEQ ID NO: 7159610 - DNA, 22 bp, Homo sapiens
agcagctgcttttcttcattgg

SEQ ID NO: 7159611 - DNA, 22 bp, Homo sapiens
agcagctgcttttcttcattgg

SEQ ID NO: 7159612 - DNA, 22 bp, Homo sapiens
agcagctggaacatatgaagaa

SEQ ID NO: 7159613 - DNA, 22 bp, Homo sapiens
agcagctggaacatatgaagaa

SEQ ID NO: 7159614 - DNA, 19 bp, Homo sapiens
agcagctggaggtggagtg

SEQ ID NO: 7159615 - DNA, 19 bp, Homo sapiens
agcagctggaggtggagtg

SEQ ID NO: 7159616 - DNA, 19 bp, Homo sapiens
agcagctggaggtggagtg

SEQ ID NO: 7159617 - DNA, 19 bp, Homo sapiens
agcagctggaggtggagtg

SEQ ID NO: 7159618 - DNA, 17 bp, Homo sapiens
agcagctggcacaggag

SEQ ID NO: 7159619 - DNA, 17 bp, Homo sapiens
agcagctggcacaggag

SEQ ID NO: 7159620 - DNA, 17 bp, Homo sapiens
agcagctggcacaggag

SEQ ID NO: 7159621 - DNA, 17 bp, Homo sapiens
agcagctggcacaggag

SEQ ID NO: 7159622 - DNA, 22 bp, Homo sapiens
agcagctggcagcttcttctct

SEQ ID NO: 7159623 - DNA, 22 bp, Homo sapiens
agcagctggcagcttcttctct

SEQ ID NO: 7159624 - DNA, 22 bp, Homo sapiens
agcagctggcagcttcttctct

SEQ ID NO: 7159625 - DNA, 22 bp, Homo sapiens
agcagctggcagcttcttctct

SEQ ID NO: 7159626 - DNA, 21 bp, Homo sapiens
agcagctgggcaacatggagg

SEQ ID NO: 7159627 - DNA, 21 bp, Homo sapiens
agcagctgggcaacatggagg

SEQ ID NO: 7159628 - DNA, 22 bp, Homo sapiens
cacagagatcggaacagaagta

SEQ ID NO: 7159629 - DNA, 22 bp, Homo sapiens
cacagagatcggaacagaagta

SEQ ID NO: 7159630 - DNA, 22 bp, Homo sapiens
cacagagatcggaacagaagta

SEQ ID NO: 7159631 - DNA, 22 bp, Homo sapiens
cacagagatcggaacagaagta

SEQ ID NO: 7159632 - DNA, 22 bp, Homo sapiens
cacagagatcggaacagaagta

SEQ ID NO: 7159633 - DNA, 22 bp, Homo sapiens
cacagagatcggaacagaagta

SEQ ID NO: 7159634 - DNA, 22 bp, Homo sapiens
cacagagatggccagggcacat

SEQ ID NO: 7159635 - DNA, 21 bp, Homo sapiens
cacagagatattggtgagcct

SEQ ID NO: 7159636 - DNA, 21 bp, Homo sapiens
cacagagatattggtgagcct

SEQ ID NO: 7159637 - DNA, 21 bp, Homo sapiens
cacagagatattggtgagcct

SEQ ID NO: 7159638 - DNA, 21 bp, Homo sapiens
cacagagatattggtgagcct

SEQ ID NO: 7159639 - DNA, 21 bp, Homo sapiens
cacagagatattggtgagcct

SEQ ID NO: 7159640 - DNA, 22 bp, Homo sapiens
cacagagatcggaacagaagta

SEQ ID NO: 7159641 - DNA, 22 bp, Homo sapiens
cacagagatcggaacagaagta

SEQ ID NO: 7159642 - DNA, 22 bp, Homo sapiens
agcagctcccctcatgctccac

SEQ ID NO: 7159643 - DNA, 22 bp, Homo sapiens
agcagctcccctcatgctccac

SEQ ID NO: 7159644 - DNA, 22 bp, Homo sapiens
agcagctcccctcatgctccac

SEQ ID NO: 7159645 - DNA, 22 bp, Homo sapiens
cacagaacatccttagctcatg

SEQ ID NO: 7159646 - DNA, 22 bp, Homo sapiens
cacagagagctacgtgcagcgt

SEQ ID NO: 7159647 - DNA, 22 bp, Homo sapiens
cacagagagctacgtgcagcgt

SEQ ID NO: 7159648 - DNA, 22 bp, Homo sapiens
cacagagaggcttgtctccaag

SEQ ID NO: 7159649 - DNA, 22 bp, Homo sapiens
cacagagaggcttgtctccaag

SEQ ID NO: 7159650 - DNA, 22 bp, Homo sapiens
cacagagaggcttgtctccaag

SEQ ID NO: 7159651 - DNA, 21 bp, Homo sapiens
cacagagatattggtgagcct

SEQ ID NO: 7159652 - DNA, 22 bp, Homo sapiens
agcagctacttaacccatgaca

SEQ ID NO: 7159653 - DNA, 22 bp, Homo sapiens
agcagctacttaaccttgtaca

SEQ ID NO: 7159654 - DNA, 22 bp, Homo sapiens
agcagctagacttcagaatctg

SEQ ID NO: 7159655 - DNA, 21 bp, Homo sapiens
agcagccttgtgtgccaggca

SEQ ID NO: 7159656 - DNA, 22 bp, Homo sapiens
agcagcctttgatcatctggga

SEQ ID NO: 7159657 - DNA, 22 bp, Homo sapiens
agcagcctttgatcatctggga

SEQ ID NO: 7159658 - DNA, 22 bp, Homo sapiens
agcagctcaaagcctgcaagga

SEQ ID NO: 7159659 - DNA, 22 bp, Homo sapiens
agcagctcaaagcctgcaagga

SEQ ID NO: 7159660 - DNA, 22 bp, Homo sapiens
agcagctcaacagtgtctctat

SEQ ID NO: 7159661 - DNA, 22 bp, Homo sapiens
agcagctcaacagtgtctctat

SEQ ID NO: 7159662 - DNA, 22 bp, Homo sapiens
agcagctcaacagtgtctctat

SEQ ID NO: 7159663 - DNA, 22 bp, Homo sapiens
agcagctcacaggattcctgaa

SEQ ID NO: 7159664 - DNA, 19 bp, Homo sapiens
agcagctcagggaggcacc

SEQ ID NO: 7159665 - DNA, 22 bp, Homo sapiens
agcagctcatggagtaggcact

SEQ ID NO: 7159666 - DNA, 22 bp, Homo sapiens
agcagccttgtgactccggggt

SEQ ID NO: 7159667 - DNA, 22 bp, Homo sapiens
agcagccttgtgactccggggt

SEQ ID NO: 7159668 - DNA, 21 bp, Homo sapiens
agcagccttgtgtgccaggca

SEQ ID NO: 7159669 - DNA, 21 bp, Homo sapiens
agcagccttgtgtgccaggca

SEQ ID NO: 7159670 - DNA, 22 bp, Homo sapiens
agcagccttgcaggggtcgcac

SEQ ID NO: 7159671 - DNA, 22 bp, Homo sapiens
agcagcctggtctctcgccaat

SEQ ID NO: 7159672 - DNA, 22 bp, Homo sapiens
agcagcctggacttggatgtgg

SEQ ID NO: 7159673 - DNA, 22 bp, Homo sapiens
agcagcctggacttggatgtgg

SEQ ID NO: 7159674 - DNA, 22 bp, Homo sapiens
agcagcctggtctctcgccaat

SEQ ID NO: 7159675 - DNA, 22 bp, Homo sapiens
agcagcctggtctctcgccaat

SEQ ID NO: 7159676 - DNA, 22 bp, Homo sapiens
agcagcctctgtagaggtctcc

SEQ ID NO: 7159677 - DNA, 22 bp, Homo sapiens
agcagccctatgtaattggact

SEQ ID NO: 7159678 - DNA, 23 bp, Homo sapiens
agcagccctgggacctggcctgc

SEQ ID NO: 7159679 - DNA, 22 bp, Homo sapiens
agcagccgtattatggtggttt

SEQ ID NO: 7159680 - DNA, 22 bp, Homo sapiens
agcagcctattcttctcttgga

SEQ ID NO: 7159681 - DNA, 22 bp, Homo sapiens
agcagcctattcttctcttgga

SEQ ID NO: 7159682 - DNA, 22 bp, Homo sapiens
agcagcctattcttctcttgga

SEQ ID NO: 7159683 - DNA, 22 bp, Homo sapiens
agcagcctcccagggagcagcc

SEQ ID NO: 7159684 - DNA, 22 bp, Homo sapiens
agcagcctcccagggagcagcc

SEQ ID NO: 7159685 - DNA, 22 bp, Homo sapiens
agcagcctcccagggagcagcc

SEQ ID NO: 7159686 - DNA, 22 bp, Homo sapiens
agcagcctcccagggagcagcc

SEQ ID NO: 7159687 - DNA, 22 bp, Homo sapiens
agcagcctcccagggagcagcc

SEQ ID NO: 7159688 - DNA, 22 bp, Homo sapiens
agcagcctctgtagaggtctcc

SEQ ID NO: 7159689 - DNA, 21 bp, Homo sapiens
agcagcagatctggtgagggc

SEQ ID NO: 7159690 - DNA, 21 bp, Homo sapiens
agcagcagatctggtgagggc

SEQ ID NO: 7159691 - DNA, 20 bp, Homo sapiens
agcagcagatgttggaggtg

SEQ ID NO: 7159692 - DNA, 22 bp, Homo sapiens
agcagccagaaatccagaggtg

SEQ ID NO: 7159693 - DNA, 22 bp, Homo sapiens
agcagccagaaatccagaggtg

SEQ ID NO: 7159694 - DNA, 22 bp, Homo sapiens
agcagccagagaatgatgcagt

SEQ ID NO: 7159695 - DNA, 22 bp, Homo sapiens
agcagcccagttgtactgagtg

SEQ ID NO: 7159696 - DNA, 22 bp, Homo sapiens
agcagcccctcggcgggtgcgc

SEQ ID NO: 7159697 - DNA, 22 bp, Homo sapiens
agcagccctagggattgctgtt

SEQ ID NO: 7159698 - DNA, 22 bp, Homo sapiens
agcagccctagggattgctgtt

SEQ ID NO: 7159699 - DNA, 22 bp, Homo sapiens
agcagcagatcaaacaggcttg

SEQ ID NO: 7159700 - DNA, 22 bp, Homo sapiens
agcagcagaggtcagaaaggta

SEQ ID NO: 7159701 - DNA, 22 bp, Homo sapiens
agcagcagagctctggtctgca

SEQ ID NO: 7159702 - DNA, 22 bp, Homo sapiens
agcagcagagctctggtctgca

SEQ ID NO: 7159703 - DNA, 22 bp, Homo sapiens
agcagcagagctctggtctgca

SEQ ID NO: 7159704 - DNA, 22 bp, Homo sapiens
agcagcagaggtcagaaaggta

SEQ ID NO: 7159705 - DNA, 22 bp, Homo sapiens
agcagcagatcaaacaggcttg

SEQ ID NO: 7159706 - DNA, 22 bp, Homo sapiens
agcagcagatcaaacaggcttg

SEQ ID NO: 7159707 - DNA, 22 bp, Homo sapiens
agcagcagatccaaaaaatgtg

SEQ ID NO: 7159708 - DNA, 22 bp, Homo sapiens
agcagcagatccaaaaaatgtg

SEQ ID NO: 7159709 - DNA, 21 bp, Homo sapiens
agcagcagatctggtgagggc

SEQ ID NO: 7159710 - DNA, 21 bp, Homo sapiens
agcagcagatctggtgagggc

SEQ ID NO: 7159711 - DNA, 21 bp, Homo sapiens
agcagcagatctggtgagggc

SEQ ID NO: 7159712 - DNA, 21 bp, Homo sapiens
agcagcagatctggtgagggc

SEQ ID NO: 7159713 - DNA, 22 bp, Homo sapiens
caatacagcacacctgtatcag

SEQ ID NO: 7159714 - DNA, 22 bp, Homo sapiens
caatacatcaggtcaaaatgtg

SEQ ID NO: 7159715 - DNA, 22 bp, Homo sapiens
caatacatcaggtcaaaatgtg

SEQ ID NO: 7159716 - DNA, 22 bp, Homo sapiens
caatacatcaggtcaaaatgtg

SEQ ID NO: 7159717 - DNA, 22 bp, Homo sapiens
caatacatcaggtcaaaatgtg

SEQ ID NO: 7159718 - DNA, 22 bp, Homo sapiens
caatacatcaggtcaaaatgtg

SEQ ID NO: 7159719 - DNA, 22 bp, Homo sapiens
caatacaattaccagttaatca

SEQ ID NO: 7159720 - DNA, 22 bp, Homo sapiens
caatacaattaccagttaatca

SEQ ID NO: 7159721 - DNA, 22 bp, Homo sapiens
caatacactaaacttctctgaa

SEQ ID NO: 7159722 - DNA, 16 bp, Homo sapiens
caatacatggcatttc

SEQ ID NO: 7159723 - DNA, 18 bp, Homo sapiens
caatactgagaggtgggg

SEQ ID NO: 7159724 - DNA, 22 bp, Homo sapiens
caatactgagtttacattcatc

SEQ ID NO: 7159725 - DNA, 22 bp, Homo sapiens
caatactgagtttacattcatc

SEQ ID NO: 7159726 - DNA, 19 bp, Homo sapiens
agcagcagaagtgtgcctt

SEQ ID NO: 7159727 - DNA, 19 bp, Homo sapiens
agcagcagaagtgtgcctt

SEQ ID NO: 7159728 - DNA, 19 bp, Homo sapiens
agcagcagaagtgtgcctt

SEQ ID NO: 7159729 - DNA, 22 bp, Homo sapiens
agcagcagagctctggtctgca

SEQ ID NO: 7159730 - DNA, 22 bp, Homo sapiens
agcagcagagctctggtctgca

SEQ ID NO: 7159731 - DNA, 22 bp, Homo sapiens
agcatggccacgggggtaggta

SEQ ID NO: 7159732 - DNA, 22 bp, Homo sapiens
agcatggccacgggggtaggta

SEQ ID NO: 7159733 - DNA, 22 bp, Homo sapiens
agcatggcattattggaaggac

SEQ ID NO: 7159734 - DNA, 22 bp, Homo sapiens
agcatggcattattggaaggac

SEQ ID NO: 7159735 - DNA, 22 bp, Homo sapiens
agcatggcattattggaaggac

SEQ ID NO: 7159736 - DNA, 22 bp, Homo sapiens
agcatggcactcaaggctcctg

SEQ ID NO: 7159737 - DNA, 18 bp, Homo sapiens
agcatggcacaggctccc

SEQ ID NO: 7159738 - DNA, 23 bp, Homo sapiens
agcatggaataggaaagaggcag

SEQ ID NO: 7159739 - DNA, 22 bp, Homo sapiens
agcatggacagtggcagcagtg

SEQ ID NO: 7159740 - DNA, 22 bp, Homo sapiens
agcatggacagtggcagcagtg

SEQ ID NO: 7159741 - DNA, 18 bp, Homo sapiens
agcatggcacaggctccc

SEQ ID NO: 7159742 - DNA, 23 bp, Homo sapiens
agcatggaagaagctggactcct

SEQ ID NO: 7159743 - DNA, 23 bp, Homo sapiens
agcatggaagaagctggactcct

SEQ ID NO: 7159744 - DNA, 19 bp, Homo sapiens
agcatggaagctggtgcca

SEQ ID NO: 7159745 - DNA, 19 bp, Homo sapiens
agcatggaagctggtgcca

SEQ ID NO: 7159746 - DNA, 23 bp, Homo sapiens
agcatggaataggaaagaggcag

SEQ ID NO: 7159747 - DNA, 23 bp, Homo sapiens
agcatggaataggaaagaggcag

SEQ ID NO: 7159748 - DNA, 23 bp, Homo sapiens
agcatggaataggaaagaggcag

SEQ ID NO: 7159749 - DNA, 20 bp, Homo sapiens
agcatgcagccagagccaac

SEQ ID NO: 7159750 - DNA, 20 bp, Homo sapiens
agcatgcagccagagccaac

SEQ ID NO: 7159751 - DNA, 22 bp, Homo sapiens
agcatgcaggaaccacatggca

SEQ ID NO: 7159752 - DNA, 22 bp, Homo sapiens
agcatgcaggaaccacatggca

SEQ ID NO: 7159753 - DNA, 22 bp, Homo sapiens
agcatgcagtaaagcccatgtc

SEQ ID NO: 7159754 - DNA, 22 bp, Homo sapiens
agcatgcatgaagattcagcaa

SEQ ID NO: 7159755 - DNA, 22 bp, Homo sapiens
agcatgcatttttggactgtgc

SEQ ID NO: 7159756 - DNA, 22 bp, Homo sapiens
agcatgcgcttgatcagctcca

SEQ ID NO: 7159757 - DNA, 22 bp, Homo sapiens
agcatgctatattgattgtagt

SEQ ID NO: 7159758 - DNA, 22 bp, Homo sapiens
agcatgctggtgttcatggcag

SEQ ID NO: 7159759 - DNA, 22 bp, Homo sapiens
agcatgctggttacgtgtagca

SEQ ID NO: 7159760 - DNA, 22 bp, Homo sapiens
agcatgctggttacgtgtagca

SEQ ID NO: 7159761 - DNA, 22 bp, Homo sapiens
agcatgcttggcatttgtcaga

SEQ ID NO: 7159762 - DNA, 22 bp, Homo sapiens
agcatggcctcccgggcctggc

SEQ ID NO: 7159763 - DNA, 22 bp, Homo sapiens
agcatggcctgcagcggccacc

SEQ ID NO: 7159764 - DNA, 22 bp, Homo sapiens
agcatggcctgcagcggccacc

SEQ ID NO: 7159765 - DNA, 22 bp, Homo sapiens
agcatggcctcccgggcctggc

SEQ ID NO: 7159766 - DNA, 22 bp, Homo sapiens
agcatggcctcccgggcctggc

SEQ ID NO: 7159767 - DNA, 22 bp, Homo sapiens
agcatggccatctgggccgtcc

SEQ ID NO: 7159768 - DNA, 22 bp, Homo sapiens
agcatggccatctgggccgtcc

SEQ ID NO: 7159769 - DNA, 22 bp, Homo sapiens
agcatggccatctgggccgtcc

SEQ ID NO: 7159770 - DNA, 22 bp, Homo sapiens
agcatggctttggaggatagca

SEQ ID NO: 7159771 - DNA, 22 bp, Homo sapiens
agcatggctttggaggatagca

SEQ ID NO: 7159772 - DNA, 22 bp, Homo sapiens
agcatggctttggaggatagca

SEQ ID NO: 7159773 - DNA, 22 bp, Homo sapiens
agcatggggcaatgcatgtgct

SEQ ID NO: 7159774 - DNA, 22 bp, Homo sapiens
agcatggggcaatgcatgtgct

SEQ ID NO: 7159775 - DNA, 22 bp, Homo sapiens
agcatgtaaagctcttagcacc

SEQ ID NO: 7159776 - DNA, 22 bp, Homo sapiens
agcatgtctaactcttcagggt

SEQ ID NO: 7159777 - DNA, 21 bp, Homo sapiens
agcatgtctcagtcaacaagg

SEQ ID NO: 7159778 - DNA, 22 bp, Homo sapiens
agcatgtggctatctttggggg

SEQ ID NO: 7159779 - DNA, 22 bp, Homo sapiens
agcatgtgtaatctcaatacct

SEQ ID NO: 7159780 - DNA, 22 bp, Homo sapiens
agcatgttgggatgagaaggaa

SEQ ID NO: 7159781 - DNA, 22 bp, Homo sapiens
agcattaagagagactgaactg

SEQ ID NO: 7159782 - DNA, 22 bp, Homo sapiens
agcattaagcctggctcagagg

SEQ ID NO: 7159783 - DNA, 22 bp, Homo sapiens
cactgtgggcctgtcgtgggtg

SEQ ID NO: 7159784 - DNA, 22 bp, Homo sapiens
cactgtggggtttggctggaac

SEQ ID NO: 7159785 - DNA, 22 bp, Homo sapiens
cactggtgacttctgagctgga

SEQ ID NO: 7159786 - DNA, 22 bp, Homo sapiens
cactggtgagtccagaagtcat

SEQ ID NO: 7159787 - DNA, 22 bp, Homo sapiens
cactggtgagtccagaagtcat

SEQ ID NO: 7159788 - DNA, 22 bp, Homo sapiens
agcattaataagaaatggctcc

SEQ ID NO: 7159789 - DNA, 23 bp, Homo sapiens
agcattagagatgccagccctgt

SEQ ID NO: 7159790 - DNA, 22 bp, Homo sapiens
cactgtgggtcccagactggag

SEQ ID NO: 7159791 - DNA, 19 bp, Homo sapiens
cactgtggtccttcactgc

SEQ ID NO: 7159792 - DNA, 22 bp, Homo sapiens
cactgtggtgccaaacctggag

SEQ ID NO: 7159793 - DNA, 22 bp, Homo sapiens
cactgtgggtcccagactggag

SEQ ID NO: 7159794 - DNA, 22 bp, Homo sapiens
cactgtggttattatcactgtt

SEQ ID NO: 7159795 - DNA, 22 bp, Homo sapiens
cactgttctttttgtagtccaa

SEQ ID NO: 7159796 - DNA, 22 bp, Homo sapiens
cactgttctttttgtagtccaa

SEQ ID NO: 7159797 - DNA, 22 bp, Homo sapiens
cactgttgaagatacttcctct

SEQ ID NO: 7159798 - DNA, 22 bp, Homo sapiens
cactgttcatcaaaactgctct

SEQ ID NO: 7159799 - DNA, 22 bp, Homo sapiens
cactgttcatcaaaactgctct

SEQ ID NO: 7159800 - DNA, 22 bp, Homo sapiens
cactgttgagcaatgtacagtg

SEQ ID NO: 7159801 - DNA, 22 bp, Homo sapiens
cactgtttgaggccctagttga

SEQ ID NO: 7159802 - DNA, 22 bp, Homo sapiens
cactgtttgaggccctagttga

SEQ ID NO: 7159803 - DNA, 22 bp, Homo sapiens
cactgtttggctcctgtactta

SEQ ID NO: 7159804 - DNA, 22 bp, Homo sapiens
cactgtgtctggagtgagctgg

SEQ ID NO: 7159805 - DNA, 22 bp, Homo sapiens
cactgttattactactatacat

SEQ ID NO: 7159806 - DNA, 22 bp, Homo sapiens
cactgttcacattttagtctat

SEQ ID NO: 7159807 - DNA, 22 bp, Homo sapiens
cacttaaaactcctggaattgt

SEQ ID NO: 7159808 - DNA, 22 bp, Homo sapiens
cacttaaagtcttagcttacag

SEQ ID NO: 7159809 - DNA, 22 bp, Homo sapiens
cacttaaagtcttagcttacag

SEQ ID NO: 7159810 - DNA, 22 bp, Homo sapiens
cacttaaaactcctggaattgt

SEQ ID NO: 7159811 - DNA, 22 bp, Homo sapiens
cactgttttattccaacatagg

SEQ ID NO: 7159812 - DNA, 22 bp, Homo sapiens
cactgtttggctcctgtactta

SEQ ID NO: 7159813 - DNA, 22 bp, Homo sapiens
cactgttttcagtcagttctat

SEQ ID NO: 7159814 - DNA, 22 bp, Homo sapiens
cactgtttttatgtaatcagtg

SEQ ID NO: 7159815 - DNA, 22 bp, Homo sapiens
agcagtggcctggggctctgtg

SEQ ID NO: 7159816 - DNA, 22 bp, Homo sapiens
agcagtggcatacattttgagt

SEQ ID NO: 7159817 - DNA, 22 bp, Homo sapiens
agcagtggcatacattttgagt

SEQ ID NO: 7159818 - DNA, 22 bp, Homo sapiens
agcatattgtatgtctatatgt

SEQ ID NO: 7159819 - DNA, 22 bp, Homo sapiens
agcatattgtatgtctatatgt

SEQ ID NO: 7159820 - DNA, 22 bp, Homo sapiens
agcatattgtatgtctatatgt

SEQ ID NO: 7159821 - DNA, 22 bp, Homo sapiens
agcatcagcagactctcagcta

SEQ ID NO: 7159822 - DNA, 22 bp, Homo sapiens
agcatgaagacttcagagctag

SEQ ID NO: 7159823 - DNA, 22 bp, Homo sapiens
agcatgaaagcataggacagtc

SEQ ID NO: 7159824 - DNA, 22 bp, Homo sapiens
agcatgaaaggcgtgccaactt

SEQ ID NO: 7159825 - DNA, 18 bp, Homo sapiens
agcatgagtcaggggtgc

SEQ ID NO: 7159826 - DNA, 18 bp, Homo sapiens
agcatgagagaggctgtg

SEQ ID NO: 7159827 - DNA, 18 bp, Homo sapiens
agcatgagagaggctgtg

SEQ ID NO: 7159828 - DNA, 22 bp, Homo sapiens
agcatgatgtagaatcactgga

SEQ ID NO: 7159829 - DNA, 22 bp, Homo sapiens
agcatgatgtagaatcactgga

SEQ ID NO: 7159830 - DNA, 22 bp, Homo sapiens
agcatgcacatgactggcttaa

SEQ ID NO: 7159831 - DNA, 22 bp, Homo sapiens
agcagtgagccataagtgctag

SEQ ID NO: 7159832 - DNA, 22 bp, Homo sapiens
agcagtgagccataagtgctag

SEQ ID NO: 7159833 - DNA, 22 bp, Homo sapiens
agcagtcttgagggatgctaga

SEQ ID NO: 7159834 - DNA, 22 bp, Homo sapiens
agcagtgatgaaatgagcatcc

SEQ ID NO: 7159835 - DNA, 22 bp, Homo sapiens
agcagtgatgcatgacagccta

SEQ ID NO: 7159836 - DNA, 22 bp, Homo sapiens
agcagtgagtgggaggaccatg

SEQ ID NO: 7159837 - DNA, 22 bp, Homo sapiens
agcagtgagtgggaggaccatg

SEQ ID NO: 7159838 - DNA, 22 bp, Homo sapiens
agcagtgagtgggaggaccatg

SEQ ID NO: 7159839 - DNA, 22 bp, Homo sapiens
agcagtgagtaacacagaccag

SEQ ID NO: 7159840 - DNA, 23 bp, Homo sapiens
agcagtgagtaaacagataggat

SEQ ID NO: 7159841 - DNA, 22 bp, Homo sapiens
agcagtggacctcagtgctatt

SEQ ID NO: 7159842 - DNA, 22 bp, Homo sapiens
agcagtggacctcagtgctatt

SEQ ID NO: 7159843 - DNA, 19 bp, Homo sapiens
agcagtggagccatgcctg

SEQ ID NO: 7159844 - DNA, 22 bp, Homo sapiens
agcagtgatgcatgacagccta

SEQ ID NO: 7159845 - DNA, 22 bp, Homo sapiens
agcagtgatgcatgacagccta

SEQ ID NO: 7159846 - DNA, 22 bp, Homo sapiens
agcagtgatgcatgacagccta

SEQ ID NO: 7159847 - DNA, 22 bp, Homo sapiens
agcagtgcccattctgccccct

SEQ ID NO: 7159848 - DNA, 22 bp, Homo sapiens
agcagtgccgcatcttgtgacc

SEQ ID NO: 7159849 - DNA, 22 bp, Homo sapiens
agcagtgcctggcacatgtaag

SEQ ID NO: 7159850 - DNA, 22 bp, Homo sapiens
agcagtgcctggcacatgtaag

SEQ ID NO: 7159851 - DNA, 22 bp, Homo sapiens
agcagtgcctggcacatgtaag

SEQ ID NO: 7159852 - DNA, 22 bp, Homo sapiens
agcagtgctatggccaggctaa

SEQ ID NO: 7159853 - DNA, 22 bp, Homo sapiens
agcagtaagtgaagactagttt

SEQ ID NO: 7159854 - DNA, 22 bp, Homo sapiens
agcagtcagtcctgaatgaagg

SEQ ID NO: 7159855 - DNA, 22 bp, Homo sapiens
agcagtcctccagtgtgtttta

SEQ ID NO: 7159856 - DNA, 22 bp, Homo sapiens
agcagtccttctttagagagcc

SEQ ID NO: 7159857 - DNA, 22 bp, Homo sapiens
agcagtctggaacaagatatga

SEQ ID NO: 7159858 - DNA, 22 bp, Homo sapiens
agcaggttaccattgatttcct

SEQ ID NO: 7159859 - DNA, 18 bp, Homo sapiens
agcaggttctcacagcca

SEQ ID NO: 7159860 - DNA, 18 bp, Homo sapiens
agcaggttctcacagcca

SEQ ID NO: 7159861 - DNA, 22 bp, Homo sapiens
agcagtaagcaactgagcttgc

SEQ ID NO: 7159862 - DNA, 22 bp, Homo sapiens
agcagtaagcaactgagcttgc

SEQ ID NO: 7159863 - DNA, 22 bp, Homo sapiens
agcaggtgtttgtatcataagg

SEQ ID NO: 7159864 - DNA, 22 bp, Homo sapiens
agcaggtgttggctgggccatc

SEQ ID NO: 7159865 - DNA, 22 bp, Homo sapiens
agcaggtgttagggatccaatg

SEQ ID NO: 7159866 - DNA, 22 bp, Homo sapiens
agcaggtgttggctgggccatc

SEQ ID NO: 7159867 - DNA, 22 bp, Homo sapiens
agcaggtgttggctgggccatc

SEQ ID NO: 7159868 - DNA, 18 bp, Homo sapiens
agcaggtgtgcagaatgt

SEQ ID NO: 7159869 - DNA, 18 bp, Homo sapiens
agcaggtgtgcagaatgt

SEQ ID NO: 7159870 - DNA, 22 bp, Homo sapiens
agcaggtgttagggatccaatg

SEQ ID NO: 7159871 - DNA, 22 bp, Homo sapiens
agcaggtgttagggatccaatg

SEQ ID NO: 7159872 - DNA, 22 bp, Homo sapiens
agcaggtgtcggcgagggtctt

SEQ ID NO: 7159873 - DNA, 22 bp, Homo sapiens
agcaggtgtcggcgagggtctt

SEQ ID NO: 7159874 - DNA, 22 bp, Homo sapiens
agcagggctggggcacgagcca

SEQ ID NO: 7159875 - DNA, 22 bp, Homo sapiens
agcagggctggggcacgagcca

SEQ ID NO: 7159876 - DNA, 22 bp, Homo sapiens
agcagggctggggcacgagcca

SEQ ID NO: 7159877 - DNA, 22 bp, Homo sapiens
agcagggctggatttggcaaga

SEQ ID NO: 7159878 - DNA, 22 bp, Homo sapiens
agcagggctgcggccccaccac

SEQ ID NO: 7159879 - DNA, 22 bp, Homo sapiens
agcagggctggatttggcaaga

SEQ ID NO: 7159880 - DNA, 22 bp, Homo sapiens
agcagggctggatttggcaaga

SEQ ID NO: 7159881 - DNA, 22 bp, Homo sapiens
agcagggctggatttggcaaga

SEQ ID NO: 7159882 - DNA, 22 bp, Homo sapiens
agcagggctggggcacgagcca

SEQ ID NO: 7159883 - DNA, 22 bp, Homo sapiens
agcagggctggggcacgagcca

SEQ ID NO: 7159884 - DNA, 19 bp, Homo sapiens
agcaggtgggtaagaaaat

SEQ ID NO: 7159885 - DNA, 22 bp, Homo sapiens
agcagggcaggtaaggatcaga

SEQ ID NO: 7159886 - DNA, 22 bp, Homo sapiens
agcagggcaggtaaggatcaga

SEQ ID NO: 7159887 - DNA, 22 bp, Homo sapiens
agcagggcaggtaaggatcaga

SEQ ID NO: 7159888 - DNA, 22 bp, Homo sapiens
agcagggcagcttttttcagaa

SEQ ID NO: 7159889 - DNA, 22 bp, Homo sapiens
agcagggcagcttttttcagaa

SEQ ID NO: 7159890 - DNA, 22 bp, Homo sapiens
agcagggcaggtaaggatcaga

SEQ ID NO: 7159891 - DNA, 22 bp, Homo sapiens
agcagggcaggtaaggatcaga

SEQ ID NO: 7159892 - DNA, 22 bp, Homo sapiens
agcagggcagcttttttcagaa

SEQ ID NO: 7159893 - DNA, 22 bp, Homo sapiens
agcagggcaggtaaggatcaga

SEQ ID NO: 7159894 - DNA, 22 bp, Homo sapiens
cacatttaatcctttataagta

SEQ ID NO: 7159895 - DNA, 22 bp, Homo sapiens
agcagggcagtgatcagaaagg

SEQ ID NO: 7159896 - DNA, 22 bp, Homo sapiens
agcagggcagtgatcagaaagg

SEQ ID NO: 7159897 - DNA, 22 bp, Homo sapiens
agcagggcagtgatcagaaagg

SEQ ID NO: 7159898 - DNA, 22 bp, Homo sapiens
agcagggcaaagtcaggctaac

SEQ ID NO: 7159899 - DNA, 22 bp, Homo sapiens
agcagggcaaagtcaggctaac

SEQ ID NO: 7159900 - DNA, 22 bp, Homo sapiens
agcagggcaaagtcaggctaac

SEQ ID NO: 7159901 - DNA, 22 bp, Homo sapiens
agcagggcaaagtcaggctaac

SEQ ID NO: 7159902 - DNA, 17 bp, Homo sapiens
agcagggagtcaaggga

SEQ ID NO: 7159903 - DNA, 19 bp, Homo sapiens
agcagggagtggttgtggg

SEQ ID NO: 7159904 - DNA, 19 bp, Homo sapiens
agcagggagtggttgtggg

SEQ ID NO: 7159905 - DNA, 19 bp, Homo sapiens
agcagggagtggttgtggg

SEQ ID NO: 7159906 - DNA, 22 bp, Homo sapiens
agcagggcaaagtcaggctaac

SEQ ID NO: 7159907 - DNA, 22 bp, Homo sapiens
agcagggcactggaaggcactg

SEQ ID NO: 7159908 - DNA, 22 bp, Homo sapiens
agcagggcactggaaggcactg

SEQ ID NO: 7159909 - DNA, 22 bp, Homo sapiens
agcagggcactggaaggcactg

SEQ ID NO: 7159910 - DNA, 22 bp, Homo sapiens
agcagggcactggaaggcactg

SEQ ID NO: 7159911 - DNA, 22 bp, Homo sapiens
agcagggcagctgatgcgcacg

SEQ ID NO: 7159912 - DNA, 22 bp, Homo sapiens
agcagggcagctgatgcgcacg

SEQ ID NO: 7159913 - DNA, 22 bp, Homo sapiens
agcagggcagctgatgcgcacg

SEQ ID NO: 7159914 - DNA, 22 bp, Homo sapiens
agcagggcagctgatgcgcacg

SEQ ID NO: 7159915 - DNA, 22 bp, Homo sapiens
agcagggcagctgatgcgcacg

SEQ ID NO: 7159916 - DNA, 22 bp, Homo sapiens
agcagggcagctgatgcgcacg

SEQ ID NO: 7159917 - DNA, 22 bp, Homo sapiens
agcagggcagctgatgcgcacg

SEQ ID NO: 7159918 - DNA, 22 bp, Homo sapiens
agcagggctctgtggagggtgg

SEQ ID NO: 7159919 - DNA, 22 bp, Homo sapiens
agcagggctctgtggagggtgg

SEQ ID NO: 7159920 - DNA, 22 bp, Homo sapiens
caccagctaattaaaacagcag

SEQ ID NO: 7159921 - DNA, 22 bp, Homo sapiens
caccagctaattaaaacagcag

SEQ ID NO: 7159922 - DNA, 22 bp, Homo sapiens
caccagctacagactactgtgt

SEQ ID NO: 7159923 - DNA, 22 bp, Homo sapiens
caccagctacagactactgtgt

SEQ ID NO: 7159924 - DNA, 22 bp, Homo sapiens
caccagccagagtgacagctcc

SEQ ID NO: 7159925 - DNA, 22 bp, Homo sapiens
caccagccagagtgacagctcc

SEQ ID NO: 7159926 - DNA, 22 bp, Homo sapiens
caccagccccctcacgctgtca

SEQ ID NO: 7159927 - DNA, 22 bp, Homo sapiens
caccagccccctcacgctgtca

SEQ ID NO: 7159928 - DNA, 22 bp, Homo sapiens
caccagcgactgtgaccagcaa

SEQ ID NO: 7159929 - DNA, 22 bp, Homo sapiens
caccagctaattaaaacagcag

SEQ ID NO: 7159930 - DNA, 22 bp, Homo sapiens
caccagctaattaaaacagcag

SEQ ID NO: 7159931 - DNA, 22 bp, Homo sapiens
agcagggctctgtggagggtgg

SEQ ID NO: 7159932 - DNA, 22 bp, Homo sapiens
agcagggctctgtggagggtgg

SEQ ID NO: 7159933 - DNA, 22 bp, Homo sapiens
agcagggctctgtggagggtgg

SEQ ID NO: 7159934 - DNA, 22 bp, Homo sapiens
agcagggctctgtggagggtgg

SEQ ID NO: 7159935 - DNA, 22 bp, Homo sapiens
agcagggctgcagtgtgtcttt

SEQ ID NO: 7159936 - DNA, 22 bp, Homo sapiens
agcagggctgcagtgtgtcttt

SEQ ID NO: 7159937 - DNA, 22 bp, Homo sapiens
agcagggctgcagtgtgtcttt

SEQ ID NO: 7159938 - DNA, 22 bp, Homo sapiens
agcagggctgcggccccaccac

SEQ ID NO: 7159939 - DNA, 22 bp, Homo sapiens
caccagagttgtccaaatgatt

SEQ ID NO: 7159940 - DNA, 22 bp, Homo sapiens
caccagagttgtccaaatgatt

SEQ ID NO: 7159941 - DNA, 22 bp, Homo sapiens
caccagatgaaaggacatatca

SEQ ID NO: 7159942 - DNA, 22 bp, Homo sapiens
caccagagtgagtggactgtcg

SEQ ID NO: 7159943 - DNA, 22 bp, Homo sapiens
caccagaacaagacaggagaat

SEQ ID NO: 7159944 - DNA, 22 bp, Homo sapiens
caccagatgaatgtttgatgct

SEQ ID NO: 7159945 - DNA, 22 bp, Homo sapiens
caccagcaccagctctgtgcct

SEQ ID NO: 7159946 - DNA, 22 bp, Homo sapiens
caccagcaccagctctgtgcct

SEQ ID NO: 7159947 - DNA, 22 bp, Homo sapiens
caccagcaccagctctgtgcct

SEQ ID NO: 7159948 - DNA, 20 bp, Homo sapiens
caccagcagcagctgccacc

SEQ ID NO: 7159949 - DNA, 20 bp, Homo sapiens
caccagcagcagctgccacc

SEQ ID NO: 7159950 - DNA, 20 bp, Homo sapiens
caccagcagcagctgccacc

SEQ ID NO: 7159951 - DNA, 20 bp, Homo sapiens
caccagcagcagctgccacc

SEQ ID NO: 7159952 - DNA, 20 bp, Homo sapiens
caccagcagcagctgccacc

SEQ ID NO: 7159953 - DNA, 20 bp, Homo sapiens
caccagcagcagctgccacc

SEQ ID NO: 7159954 - DNA, 22 bp, Homo sapiens
caccagcagcggtgtgagggtg

SEQ ID NO: 7159955 - DNA, 22 bp, Homo sapiens
caccagccagagtgacagctcc

SEQ ID NO: 7159956 - DNA, 17 bp, Homo sapiens
agcagggagtcaaggga

SEQ ID NO: 7159957 - DNA, 17 bp, Homo sapiens
agcagggagtcaaggga

SEQ ID NO: 7159958 - DNA, 17 bp, Homo sapiens
agcagggagtcaaggga

SEQ ID NO: 7159959 - DNA, 17 bp, Homo sapiens
agcagggagtcaaggga

SEQ ID NO: 7159960 - DNA, 17 bp, Homo sapiens
agcagggagtcaaggga

SEQ ID NO: 7159961 - DNA, 22 bp, Homo sapiens
agcagggaggcggtgtgctggc

SEQ ID NO: 7159962 - DNA, 22 bp, Homo sapiens
agcagggaggtctagcacgtgg

SEQ ID NO: 7159963 - DNA, 22 bp, Homo sapiens
agcagggaggtctagcacgtgg

SEQ ID NO: 7159964 - DNA, 22 bp, Homo sapiens
agcaggcttatggttgaaggga

SEQ ID NO: 7159965 - DNA, 22 bp, Homo sapiens
agcaggcttactttctgattag

SEQ ID NO: 7159966 - DNA, 22 bp, Homo sapiens
agcaggcttggtccccagcctc

SEQ ID NO: 7159967 - DNA, 22 bp, Homo sapiens
agcagggagaccatctcttcct

SEQ ID NO: 7159968 - DNA, 22 bp, Homo sapiens
agcagggaggcccagggcactg

SEQ ID NO: 7159969 - DNA, 22 bp, Homo sapiens
agcagggaggcccagggcactg

SEQ ID NO: 7159970 - DNA, 22 bp, Homo sapiens
agcagggaggcccagggcactg

SEQ ID NO: 7159971 - DNA, 22 bp, Homo sapiens
agcagggaggcccagggcactg

SEQ ID NO: 7159972 - DNA, 22 bp, Homo sapiens
agcagggaggcccagggcactg

SEQ ID NO: 7159973 - DNA, 22 bp, Homo sapiens
agcagggaggcccagggcactg

SEQ ID NO: 7159974 - DNA, 22 bp, Homo sapiens
agcagggaggcccagggcactg

SEQ ID NO: 7159975 - DNA, 22 bp, Homo sapiens
agcagggaggcggtgtgctggc

SEQ ID NO: 7159976 - DNA, 22 bp, Homo sapiens
agcagggaggcggtgtgctggc

SEQ ID NO: 7159977 - DNA, 22 bp, Homo sapiens
cacagcagagggagccattgaa

SEQ ID NO: 7159978 - DNA, 22 bp, Homo sapiens
cacagcagatccaggggttgtg

SEQ ID NO: 7159979 - DNA, 22 bp, Homo sapiens
cacagcagcatcatttatctgg

SEQ ID NO: 7159980 - DNA, 22 bp, Homo sapiens
agcaggctgggcaatatgggca

SEQ ID NO: 7159981 - DNA, 22 bp, Homo sapiens
cacagcagacagggaggcggct

SEQ ID NO: 7159982 - DNA, 22 bp, Homo sapiens
cacagcagacagggaggcggct

SEQ ID NO: 7159983 - DNA, 22 bp, Homo sapiens
cacagcagacagggaggcggct

SEQ ID NO: 7159984 - DNA, 22 bp, Homo sapiens
cacagcagagggagccattgaa

SEQ ID NO: 7159985 - DNA, 22 bp, Homo sapiens
cacagcagagggagccattgaa

SEQ ID NO: 7159986 - DNA, 22 bp, Homo sapiens
cacagcagaacttaatttcaaa

SEQ ID NO: 7159987 - DNA, 22 bp, Homo sapiens
cacagcagaacttaatttcaaa

SEQ ID NO: 7159988 - DNA, 22 bp, Homo sapiens
cacagcagaacttaatttcaaa

SEQ ID NO: 7159989 - DNA, 22 bp, Homo sapiens
cacagcagaaatatgaaggcag

SEQ ID NO: 7159990 - DNA, 22 bp, Homo sapiens
cacagcagaaatatgaaggcag

SEQ ID NO: 7159991 - DNA, 22 bp, Homo sapiens
cacagcagaaatatgaaggcag

SEQ ID NO: 7159992 - DNA, 22 bp, Homo sapiens
cacagcagaaagtgtaggagga

SEQ ID NO: 7159993 - DNA, 22 bp, Homo sapiens
cacagcagaaagtgtaggagga

SEQ ID NO: 7159994 - DNA, 22 bp, Homo sapiens
cacagcagaaagtgtaggagga

SEQ ID NO: 7159995 - DNA, 22 bp, Homo sapiens
cacagcagaaagtgtaggagga

SEQ ID NO: 7159996 - DNA, 22 bp, Homo sapiens
cacagcagaaagtgtaggagga

SEQ ID NO: 7159997 - DNA, 22 bp, Homo sapiens
cacagcagaaatatgaaggcag

SEQ ID NO: 7159998 - DNA, 22 bp, Homo sapiens
cacagcagaaatatgaaggcag

SEQ ID NO: 7159999 - DNA, 22 bp, Homo sapiens
cacagcagaaatatgaaggcag

SEQ ID NO: 7160000 - DNA, 22 bp, Homo sapiens
cacagcagaaatatgaaggcag

SEQ ID NO: 7160001 - DNA, 22 bp, Homo sapiens
agcaggaagtagtctgtaagca

SEQ ID NO: 7160002 - DNA, 22 bp, Homo sapiens
agcaggaaggtctgtgtgagtc

SEQ ID NO: 7160003 - DNA, 22 bp, Homo sapiens
agcaggaaggtctgttagtcca

SEQ ID NO: 7160004 - DNA, 22 bp, Homo sapiens
agcaggaaggtctgtgtgagtc

SEQ ID NO: 7160005 - DNA, 22 bp, Homo sapiens
agcaggaaggtctgtgtgagtc

SEQ ID NO: 7160006 - DNA, 22 bp, Homo sapiens
agcaggaaggtctgtgtgagtc

SEQ ID NO: 7160007 - DNA, 22 bp, Homo sapiens
agcaggaaggtctgtgtgagtc

SEQ ID NO: 7160008 - DNA, 22 bp, Homo sapiens
agcaggaaggggcctagcctgg

SEQ ID NO: 7160009 - DNA, 22 bp, Homo sapiens
agcaggaaggctttgggggttc

SEQ ID NO: 7160010 - DNA, 22 bp, Homo sapiens
agcaggaaggggatgatgggca

SEQ ID NO: 7160011 - DNA, 22 bp, Homo sapiens
agcaggaaggctttgggggttc

SEQ ID NO: 7160012 - DNA, 22 bp, Homo sapiens
agcaggaactgacaccaagcca

SEQ ID NO: 7160013 - DNA, 22 bp, Homo sapiens
agcaggaactgacaccaagcca

SEQ ID NO: 7160014 - DNA, 22 bp, Homo sapiens
agcaggaactgacaccaagcca

SEQ ID NO: 7160015 - DNA, 22 bp, Homo sapiens
agcaggaactcagggagttctc

SEQ ID NO: 7160016 - DNA, 22 bp, Homo sapiens
agcaggaactcagggagttctc

SEQ ID NO: 7160017 - DNA, 22 bp, Homo sapiens
agcaggaactcagggagttctc

SEQ ID NO: 7160018 - DNA, 22 bp, Homo sapiens
agcaggaactcagggagttctc

SEQ ID NO: 7160019 - DNA, 22 bp, Homo sapiens
agcaggaactcagggagttctc

SEQ ID NO: 7160020 - DNA, 21 bp, Homo sapiens
agcagctgggcaacatggagg

SEQ ID NO: 7160021 - DNA, 22 bp, Homo sapiens
agcagcttctttcactcctgga

SEQ ID NO: 7160022 - DNA, 22 bp, Homo sapiens
agcagcttgagctggggctggc

SEQ ID NO: 7160023 - DNA, 22 bp, Homo sapiens
agcagcttgagctggggctggc

SEQ ID NO: 7160024 - DNA, 22 bp, Homo sapiens
agcagcttgaggctggattcca

SEQ ID NO: 7160025 - DNA, 20 bp, Homo sapiens
agcaggaatgatgctttcat

SEQ ID NO: 7160026 - DNA, 22 bp, Homo sapiens
agcaggacaatatgggatcagg

SEQ ID NO: 7160027 - DNA, 22 bp, Homo sapiens
agcaggaagtcctctcaggaga

SEQ ID NO: 7160028 - DNA, 22 bp, Homo sapiens
agcaggaagtcctctcaggaga

SEQ ID NO: 7160029 - DNA, 22 bp, Homo sapiens
agcaggaatctgttctgtataa

SEQ ID NO: 7160030 - DNA, 20 bp, Homo sapiens
agcaggaatgatgctttcat

SEQ ID NO: 7160031 - DNA, 22 bp, Homo sapiens
agcaggaagtagtctgtaagca

SEQ ID NO: 7160032 - DNA, 22 bp, Homo sapiens
agcaggaagtagtctgtaagca

SEQ ID NO: 7160033 - DNA, 22 bp, Homo sapiens
agcaggaagtcctctcaggaga

SEQ ID NO: 7160034 - DNA, 22 bp, Homo sapiens
agcaggaagtcctctcaggaga

SEQ ID NO: 7160035 - DNA, 22 bp, Homo sapiens
cacagcaagagctaaatgacca

SEQ ID NO: 7160036 - DNA, 22 bp, Homo sapiens
cacagcaagagctaaatgacca

SEQ ID NO: 7160037 - DNA, 22 bp, Homo sapiens
cacagcaagagctaaatgacca

SEQ ID NO: 7160038 - DNA, 22 bp, Homo sapiens
cacagcaatagctaactgatac

SEQ ID NO: 7160039 - DNA, 22 bp, Homo sapiens
cacagcaatagctaactgatac

SEQ ID NO: 7160040 - DNA, 22 bp, Homo sapiens
cagagaccctaggcaggtgaca

SEQ ID NO: 7160041 - DNA, 22 bp, Homo sapiens
cagagaccccgctgcccttctg

SEQ ID NO: 7160042 - DNA, 20 bp, Homo sapiens
cagagaccaggccaggtgtc

SEQ ID NO: 7160043 - DNA, 20 bp, Homo sapiens
cagagacccaggcttcagct

SEQ ID NO: 7160044 - DNA, 20 bp, Homo sapiens
cagagacccaggcttcagct

SEQ ID NO: 7160045 - DNA, 22 bp, Homo sapiens
cagagaccccgctgcccttctg

SEQ ID NO: 7160046 - DNA, 22 bp, Homo sapiens
agccaggccagactcacaccct

SEQ ID NO: 7160047 - DNA, 17 bp, Homo sapiens
agccaggcatatgaagt

SEQ ID NO: 7160048 - DNA, 22 bp, Homo sapiens
agccaggccagactcacaccct

SEQ ID NO: 7160049 - DNA, 22 bp, Homo sapiens
agccaggccagactcacaccct

SEQ ID NO: 7160050 - DNA, 17 bp, Homo sapiens
agccaggcatatgaagt

SEQ ID NO: 7160051 - DNA, 22 bp, Homo sapiens
agccaggcagggctctcgctct

SEQ ID NO: 7160052 - DNA, 17 bp, Homo sapiens
agccaggcatatgaagt

SEQ ID NO: 7160053 - DNA, 17 bp, Homo sapiens
agccaggcatatgaagt

SEQ ID NO: 7160054 - DNA, 17 bp, Homo sapiens
agccaggcatatgaagt

SEQ ID NO: 7160055 - DNA, 22 bp, Homo sapiens
cagagacccttctcagtggcca

SEQ ID NO: 7160056 - DNA, 22 bp, Homo sapiens
cagagacccttctcagtggcca

SEQ ID NO: 7160057 - DNA, 22 bp, Homo sapiens
cagagacctgcccatttacgct

SEQ ID NO: 7160058 - DNA, 22 bp, Homo sapiens
agccaggcagggctctcgctct

SEQ ID NO: 7160059 - DNA, 20 bp, Homo sapiens
cagagaccaggccaggtgtc

SEQ ID NO: 7160060 - DNA, 22 bp, Homo sapiens
cagagacattctccccattgga

SEQ ID NO: 7160061 - DNA, 22 bp, Homo sapiens
cagagacattctccccattgga

SEQ ID NO: 7160062 - DNA, 22 bp, Homo sapiens
cagagacattctccccattgga

SEQ ID NO: 7160063 - DNA, 22 bp, Homo sapiens
cagagacattcagtaaattatc

SEQ ID NO: 7160064 - DNA, 22 bp, Homo sapiens
cagagacattaagtgccatgat

SEQ ID NO: 7160065 - DNA, 22 bp, Homo sapiens
cagagacatgtggcctgcacgt

SEQ ID NO: 7160066 - DNA, 22 bp, Homo sapiens
cagagacatccattttatatgc

SEQ ID NO: 7160067 - DNA, 22 bp, Homo sapiens
cagagaacattcagagctgtag

SEQ ID NO: 7160068 - DNA, 22 bp, Homo sapiens
cagagaactccagtggctggcg

SEQ ID NO: 7160069 - DNA, 18 bp, Homo sapiens
cagagctcctggatgcag

SEQ ID NO: 7160070 - DNA, 22 bp, Homo sapiens
cagagctcagagcagggcactc

SEQ ID NO: 7160071 - DNA, 22 bp, Homo sapiens
cagagctcagagcagggcactc

SEQ ID NO: 7160072 - DNA, 22 bp, Homo sapiens
cagagcggccactagagggcgc

SEQ ID NO: 7160073 - DNA, 22 bp, Homo sapiens
cagagctcagagctgccaggca

SEQ ID NO: 7160074 - DNA, 22 bp, Homo sapiens
cagagccttcctagcagactct

SEQ ID NO: 7160075 - DNA, 22 bp, Homo sapiens
cagagccttagttctcctagaa

SEQ ID NO: 7160076 - DNA, 22 bp, Homo sapiens
cagagccttagttctcctagaa

SEQ ID NO: 7160077 - DNA, 21 bp, Homo sapiens
cagagcctgtgttgacagttg

SEQ ID NO: 7160078 - DNA, 22 bp, Homo sapiens
cagagccttagttctcctagaa

SEQ ID NO: 7160079 - DNA, 19 bp, Homo sapiens
cagagccttcagtgactcc

SEQ ID NO: 7160080 - DNA, 22 bp, Homo sapiens
cagagcccagggcctacgtccc

SEQ ID NO: 7160081 - DNA, 22 bp, Homo sapiens
cagagcctggcgatgtcatgga

SEQ ID NO: 7160082 - DNA, 21 bp, Homo sapiens
cagagcctgtgttgacagttg

SEQ ID NO: 7160083 - DNA, 21 bp, Homo sapiens
cagagcctgtgttgacagttg

SEQ ID NO: 7160084 - DNA, 21 bp, Homo sapiens
cagagcctgtgttgacagttg

SEQ ID NO: 7160085 - DNA, 22 bp, Homo sapiens
agccaggccttttctcaaggtt

SEQ ID NO: 7160086 - DNA, 22 bp, Homo sapiens
agccaggccttagggagaggca

SEQ ID NO: 7160087 - DNA, 22 bp, Homo sapiens
agccaggccttagggagaggca

SEQ ID NO: 7160088 - DNA, 22 bp, Homo sapiens
agccaggccttttctcaaggtt

SEQ ID NO: 7160089 - DNA, 22 bp, Homo sapiens
agccaggccttttctcaaggtt

SEQ ID NO: 7160090 - DNA, 22 bp, Homo sapiens
agccaggccttttctcaaggtt

SEQ ID NO: 7160091 - DNA, 22 bp, Homo sapiens
cagagcccaagagcaagccatg

SEQ ID NO: 7160092 - DNA, 22 bp, Homo sapiens
agccaggccttagggagaggca

SEQ ID NO: 7160093 - DNA, 20 bp, Homo sapiens
agccaggcctcaagttaagt

SEQ ID NO: 7160094 - DNA, 22 bp, Homo sapiens
agccaggccttagggagaggca

SEQ ID NO: 7160095 - DNA, 22 bp, Homo sapiens
agccaggccttagggagaggca

SEQ ID NO: 7160096 - DNA, 22 bp, Homo sapiens
agccaggccttagggagaggca

SEQ ID NO: 7160097 - DNA, 22 bp, Homo sapiens
agccaggccttagggagaggca

SEQ ID NO: 7160098 - DNA, 20 bp, Homo sapiens
agccaggcctcaagttaagt

SEQ ID NO: 7160099 - DNA, 22 bp, Homo sapiens
agccaggccagctgtcttgagt

SEQ ID NO: 7160100 - DNA, 20 bp, Homo sapiens
agccaggcctcaagttaagt

SEQ ID NO: 7160101 - DNA, 20 bp, Homo sapiens
agccaggcctcaagttaagt

SEQ ID NO: 7160102 - DNA, 22 bp, Homo sapiens
agccaggccagctgtcttgagt

SEQ ID NO: 7160103 - DNA, 22 bp, Homo sapiens
agccaggccagactcacaccct

SEQ ID NO: 7160104 - DNA, 22 bp, Homo sapiens
agccagagttgaatgtgagtct

SEQ ID NO: 7160105 - DNA, 22 bp, Homo sapiens
agccagagttgaatgtgagtct

SEQ ID NO: 7160106 - DNA, 19 bp, Homo sapiens
agccagagtggcccagggg

SEQ ID NO: 7160107 - DNA, 22 bp, Homo sapiens
agccagagttgaatgtgagtct

SEQ ID NO: 7160108 - DNA, 21 bp, Homo sapiens
agccagatccattttgcatgg

SEQ ID NO: 7160109 - DNA, 22 bp, Homo sapiens
agccagagagtgttggagatgt

SEQ ID NO: 7160110 - DNA, 22 bp, Homo sapiens
agccagagatccatccctagga

SEQ ID NO: 7160111 - DNA, 22 bp, Homo sapiens
agccagagatccatccctagga

SEQ ID NO: 7160112 - DNA, 22 bp, Homo sapiens
agccagagagtgttggagatgt

SEQ ID NO: 7160113 - DNA, 22 bp, Homo sapiens
agccagcacggcgccatggagt

SEQ ID NO: 7160114 - DNA, 22 bp, Homo sapiens
agccagcacggcgccatggagt

SEQ ID NO: 7160115 - DNA, 22 bp, Homo sapiens
agccagcacggcgccatggagt

SEQ ID NO: 7160116 - DNA, 22 bp, Homo sapiens
agccagcacggcgccatggagt

SEQ ID NO: 7160117 - DNA, 22 bp, Homo sapiens
agccagcacggcgccatggagt

SEQ ID NO: 7160118 - DNA, 22 bp, Homo sapiens
agccagcacggcgccatggagt

SEQ ID NO: 7160119 - DNA, 22 bp, Homo sapiens
agccagcactttttctctgggc

SEQ ID NO: 7160120 - DNA, 19 bp, Homo sapiens
agccagcagcgtagcatct

SEQ ID NO: 7160121 - DNA, 22 bp, Homo sapiens
agccagatgaagaggtccttaa

SEQ ID NO: 7160122 - DNA, 21 bp, Homo sapiens
agccagcaacacagcatctcc

SEQ ID NO: 7160123 - DNA, 22 bp, Homo sapiens
agccagcacggatttcccagga

SEQ ID NO: 7160124 - DNA, 22 bp, Homo sapiens
agccagcacggatttcccagga

SEQ ID NO: 7160125 - DNA, 22 bp, Homo sapiens
cactttcaagtttcagaggata

SEQ ID NO: 7160126 - DNA, 22 bp, Homo sapiens
cactttcaagtttcagaggata

SEQ ID NO: 7160127 - DNA, 19 bp, Homo sapiens
cactttatttctgttttgt

SEQ ID NO: 7160128 - DNA, 22 bp, Homo sapiens
cactttcaagtttcagaggata

SEQ ID NO: 7160129 - DNA, 22 bp, Homo sapiens
cactttcaagtttcagaggata

SEQ ID NO: 7160130 - DNA, 22 bp, Homo sapiens
cactttctcatgaatttggccc

SEQ ID NO: 7160131 - DNA, 22 bp, Homo sapiens
cactttctgtgtatcttccatt

SEQ ID NO: 7160132 - DNA, 22 bp, Homo sapiens
cactttctgtgtatcttccatt

SEQ ID NO: 7160133 - DNA, 22 bp, Homo sapiens
cactttctgtgtatcttccatt

SEQ ID NO: 7160134 - DNA, 22 bp, Homo sapiens
cactttattataaatttgagag

SEQ ID NO: 7160135 - DNA, 22 bp, Homo sapiens
cactttatgggaagcaaaaatt

SEQ ID NO: 7160136 - DNA, 22 bp, Homo sapiens
cactttataaaattggtgtgag

SEQ ID NO: 7160137 - DNA, 22 bp, Homo sapiens
agccagcaggaacgtctaggtt

SEQ ID NO: 7160138 - DNA, 22 bp, Homo sapiens
agccagcaggaacgtctaggtt

SEQ ID NO: 7160139 - DNA, 19 bp, Homo sapiens
agccagcagcgtagcatct

SEQ ID NO: 7160140 - DNA, 19 bp, Homo sapiens
agccagcagcgtagcatct

SEQ ID NO: 7160141 - DNA, 19 bp, Homo sapiens
agccagcagcgtagcatct

SEQ ID NO: 7160142 - DNA, 22 bp, Homo sapiens
agccagcaggaacgtctaggtt

SEQ ID NO: 7160143 - DNA, 22 bp, Homo sapiens
agccagcaggaacgtctaggtt

SEQ ID NO: 7160144 - DNA, 19 bp, Homo sapiens
agccagcaggcctctgagc

SEQ ID NO: 7160145 - DNA, 19 bp, Homo sapiens
agccagcaggcctctgagc

SEQ ID NO: 7160146 - DNA, 22 bp, Homo sapiens
agccagcaggtgagtgcagcct

SEQ ID NO: 7160147 - DNA, 22 bp, Homo sapiens
agccagcaggtgagtgcagcct

SEQ ID NO: 7160148 - DNA, 22 bp, Homo sapiens
agccagcaggtgagtgcagcct

SEQ ID NO: 7160149 - DNA, 22 bp, Homo sapiens
agccagcagggcttagaggaca

SEQ ID NO: 7160150 - DNA, 22 bp, Homo sapiens
agccagcagggcttagaggaca

SEQ ID NO: 7160151 - DNA, 22 bp, Homo sapiens
agccagcagggcttagaggaca

SEQ ID NO: 7160152 - DNA, 22 bp, Homo sapiens
agccagcagggcttagaggaca

SEQ ID NO: 7160153 - DNA, 22 bp, Homo sapiens
agccagcagggcttagaggaca

SEQ ID NO: 7160154 - DNA, 22 bp, Homo sapiens
agccagcaggtgagtgcagcct

SEQ ID NO: 7160155 - DNA, 22 bp, Homo sapiens
agccagcaggtgagtgcagcct

SEQ ID NO: 7160156 - DNA, 22 bp, Homo sapiens
agccagcaggtgcagaattcca

SEQ ID NO: 7160157 - DNA, 22 bp, Homo sapiens
agccagcaggtgcagaattcca

SEQ ID NO: 7160158 - DNA, 22 bp, Homo sapiens
agccagcaggtgcagaattcca

SEQ ID NO: 7160159 - DNA, 22 bp, Homo sapiens
agccagcaggtgcagaattcca

SEQ ID NO: 7160160 - DNA, 22 bp, Homo sapiens
agccagcaggtgggaaactgga

SEQ ID NO: 7160161 - DNA, 17 bp, Homo sapiens
agccagcagtagctggt

SEQ ID NO: 7160162 - DNA, 17 bp, Homo sapiens
agccagcagtagctggt

SEQ ID NO: 7160163 - DNA, 17 bp, Homo sapiens
agccagcagtagctggt

SEQ ID NO: 7160164 - DNA, 22 bp, Homo sapiens
agccagcatatatatagttgaa

SEQ ID NO: 7160165 - DNA, 22 bp, Homo sapiens
agccagcatcttgcttcttgag

SEQ ID NO: 7160166 - DNA, 22 bp, Homo sapiens
agccagcatcccttcagtctcc

SEQ ID NO: 7160167 - DNA, 22 bp, Homo sapiens
agccagcatgaagacagaggcc

SEQ ID NO: 7160168 - DNA, 22 bp, Homo sapiens
agccagcatgaagacagaggcc

SEQ ID NO: 7160169 - DNA, 22 bp, Homo sapiens
agccagcatgaagacagaggcc

SEQ ID NO: 7160170 - DNA, 22 bp, Homo sapiens
agccagcatgaagacagaggcc

SEQ ID NO: 7160171 - DNA, 20 bp, Homo sapiens
agccagccacttcctgctcc

SEQ ID NO: 7160172 - DNA, 22 bp, Homo sapiens
agccagcatgaagacagaggcc

SEQ ID NO: 7160173 - DNA, 19 bp, Homo sapiens
agccagccagcaggtatgc

SEQ ID NO: 7160174 - DNA, 22 bp, Homo sapiens
agccagccagttcactaggaaa

SEQ ID NO: 7160175 - DNA, 22 bp, Homo sapiens
agccagctaccggggctcctgg

SEQ ID NO: 7160176 - DNA, 22 bp, Homo sapiens
agccagctaccggggctcctgg

SEQ ID NO: 7160177 - DNA, 22 bp, Homo sapiens
agccagccgggggaccacagtg

SEQ ID NO: 7160178 - DNA, 22 bp, Homo sapiens
agccagcctgatctcttcttgc

SEQ ID NO: 7160179 - DNA, 22 bp, Homo sapiens
agccagctaagggaagcatgat

SEQ ID NO: 7160180 - DNA, 22 bp, Homo sapiens
agccagctaagggaagcatgat

SEQ ID NO: 7160181 - DNA, 22 bp, Homo sapiens
agccagccagttcactaggaaa

SEQ ID NO: 7160182 - DNA, 22 bp, Homo sapiens
agccagcccctgactgtgtcct

SEQ ID NO: 7160183 - DNA, 22 bp, Homo sapiens
agccagccgggggaccacagtg

SEQ ID NO: 7160184 - DNA, 22 bp, Homo sapiens
agccagccgggggaccacagtg

SEQ ID NO: 7160185 - DNA, 22 bp, Homo sapiens
agccagcctgatctcttcttgc

SEQ ID NO: 7160186 - DNA, 22 bp, Homo sapiens
agcccatgcaacaggcctagcg

SEQ ID NO: 7160187 - DNA, 22 bp, Homo sapiens
agcccatgcaaatactcggtga

SEQ ID NO: 7160188 - DNA, 22 bp, Homo sapiens
agcccatggtgtactctgtggc

SEQ ID NO: 7160189 - DNA, 22 bp, Homo sapiens
agcccatggtgtactctgtggc

SEQ ID NO: 7160190 - DNA, 22 bp, Homo sapiens
agcccatgcaacaggcctagcg

SEQ ID NO: 7160191 - DNA, 22 bp, Homo sapiens
agcccatgcagaccttcccaga

SEQ ID NO: 7160192 - DNA, 20 bp, Homo sapiens
agccccacccttgtcctggc

SEQ ID NO: 7160193 - DNA, 22 bp, Homo sapiens
agccccacactctctctgagaa

SEQ ID NO: 7160194 - DNA, 22 bp, Homo sapiens
agcccatggtgtactctgtggc

SEQ ID NO: 7160195 - DNA, 22 bp, Homo sapiens
agcccaggttgaggctgcagtg

SEQ ID NO: 7160196 - DNA, 22 bp, Homo sapiens
agcccaggttgaggctgcagtg

SEQ ID NO: 7160197 - DNA, 22 bp, Homo sapiens
agcccaggttgaggctgcagtg

SEQ ID NO: 7160198 - DNA, 22 bp, Homo sapiens
agcccagtgggccgaggcgggg

SEQ ID NO: 7160199 - DNA, 22 bp, Homo sapiens
agcccaggttgaggctgcagtg

SEQ ID NO: 7160200 - DNA, 22 bp, Homo sapiens
agccccaggatgggccgcagga

SEQ ID NO: 7160201 - DNA, 22 bp, Homo sapiens
agccccaggatgggccgcagga

SEQ ID NO: 7160202 - DNA, 22 bp, Homo sapiens
agccccaggcccggacgcctct

SEQ ID NO: 7160203 - DNA, 22 bp, Homo sapiens
agccccaggcccggacgcctct

SEQ ID NO: 7160204 - DNA, 22 bp, Homo sapiens
agccccaggcccggacgcctct

SEQ ID NO: 7160205 - DNA, 22 bp, Homo sapiens
agccccaggcccggacgcctct

SEQ ID NO: 7160206 - DNA, 22 bp, Homo sapiens
agccccaggcccggacgcctct

SEQ ID NO: 7160207 - DNA, 22 bp, Homo sapiens
agccccaggcccggacgcctct

SEQ ID NO: 7160208 - DNA, 22 bp, Homo sapiens
agccccaggcccggacgcctct

SEQ ID NO: 7160209 - DNA, 22 bp, Homo sapiens
agccccagtaagggagggcctg

SEQ ID NO: 7160210 - DNA, 22 bp, Homo sapiens
agccccagtaagggagggcctg

SEQ ID NO: 7160211 - DNA, 22 bp, Homo sapiens
agccccagtccgctgcgggcgg

SEQ ID NO: 7160212 - DNA, 22 bp, Homo sapiens
agccccagtccgctgcgggcgg

SEQ ID NO: 7160213 - DNA, 22 bp, Homo sapiens
agccccagcccctctctcacaa

SEQ ID NO: 7160214 - DNA, 22 bp, Homo sapiens
agccccagcccctctctcacaa

SEQ ID NO: 7160215 - DNA, 22 bp, Homo sapiens
agccccaggatgggccgcagga

SEQ ID NO: 7160216 - DNA, 22 bp, Homo sapiens
agccccaggatgggccgcagga

SEQ ID NO: 7160217 - DNA, 22 bp, Homo sapiens
agccccaggatgggccgcagga

SEQ ID NO: 7160218 - DNA, 22 bp, Homo sapiens
agccccaggatgggccgcagga

SEQ ID NO: 7160219 - DNA, 22 bp, Homo sapiens
agccccaggatgggccgcagga

SEQ ID NO: 7160220 - DNA, 22 bp, Homo sapiens
agccccacgttgtctagcacct

SEQ ID NO: 7160221 - DNA, 22 bp, Homo sapiens
agccccagcccctctctcacaa

SEQ ID NO: 7160222 - DNA, 22 bp, Homo sapiens
agccccagcccctctctcacaa

SEQ ID NO: 7160223 - DNA, 22 bp, Homo sapiens
agccccagcccctctctcacaa

SEQ ID NO: 7160224 - DNA, 22 bp, Homo sapiens
agccccacgttgtctagcacct

SEQ ID NO: 7160225 - DNA, 22 bp, Homo sapiens
agccccagcccctctctcacaa

SEQ ID NO: 7160226 - DNA, 22 bp, Homo sapiens
agcccaggttgaggctgcagtg

SEQ ID NO: 7160227 - DNA, 22 bp, Homo sapiens
agcccaggttgaggctgcagtg

SEQ ID NO: 7160228 - DNA, 22 bp, Homo sapiens
agcccaggttgaggctgcagtg

SEQ ID NO: 7160229 - DNA, 22 bp, Homo sapiens
agcccaggttgaggctgcagtg

SEQ ID NO: 7160230 - DNA, 22 bp, Homo sapiens
agcccaggttctaaagccaaac

SEQ ID NO: 7160231 - DNA, 22 bp, Homo sapiens
agcccagggacagggcggatgt

SEQ ID NO: 7160232 - DNA, 22 bp, Homo sapiens
agcccagggacagggcggatgt

SEQ ID NO: 7160233 - DNA, 22 bp, Homo sapiens
agcccagggagttgattagcat

SEQ ID NO: 7160234 - DNA, 22 bp, Homo sapiens
agcccagggagttgattagcat

SEQ ID NO: 7160235 - DNA, 22 bp, Homo sapiens
agccagtttccagatattaact

SEQ ID NO: 7160236 - DNA, 22 bp, Homo sapiens
agccagtttaagcaggaggggt

SEQ ID NO: 7160237 - DNA, 22 bp, Homo sapiens
agcccagggacagggcggatgt

SEQ ID NO: 7160238 - DNA, 23 bp, Homo sapiens
agccagttgtagccacagaactc

SEQ ID NO: 7160239 - DNA, 22 bp, Homo sapiens
agccagttggctatgaggagga

SEQ ID NO: 7160240 - DNA, 19 bp, Homo sapiens
agccagttggtaagaggct

SEQ ID NO: 7160241 - DNA, 22 bp, Homo sapiens
agccagtgttaagtgactggtt

SEQ ID NO: 7160242 - DNA, 22 bp, Homo sapiens
agccagtgttaagtgactggtt

SEQ ID NO: 7160243 - DNA, 22 bp, Homo sapiens
agccagtgttaagtgactggtt

SEQ ID NO: 7160244 - DNA, 22 bp, Homo sapiens
agccagtgggattagagcctct

SEQ ID NO: 7160245 - DNA, 22 bp, Homo sapiens
agccagtgtcgtgtgacatgag

SEQ ID NO: 7160246 - DNA, 22 bp, Homo sapiens
agccagtgtcgtgtgacatgag

SEQ ID NO: 7160247 - DNA, 22 bp, Homo sapiens
agccagtgtcgtgtgacatgag

SEQ ID NO: 7160248 - DNA, 22 bp, Homo sapiens
cagagctctatgttcatggagg

SEQ ID NO: 7160249 - DNA, 22 bp, Homo sapiens
cagagctctctttgctactaca

SEQ ID NO: 7160250 - DNA, 22 bp, Homo sapiens
agccagtgcagctggaaattca

SEQ ID NO: 7160251 - DNA, 22 bp, Homo sapiens
agccagtgccagtcatgcctgc

SEQ ID NO: 7160252 - DNA, 22 bp, Homo sapiens
agccagtgccagtcatgcctgc

SEQ ID NO: 7160253 - DNA, 22 bp, Homo sapiens
agccagtggaattcccaggggt

SEQ ID NO: 7160254 - DNA, 23 bp, Homo sapiens
agccctgctgagacccagctccc

SEQ ID NO: 7160255 - DNA, 22 bp, Homo sapiens
agccctgctcatctggatcccg

SEQ ID NO: 7160256 - DNA, 23 bp, Homo sapiens
agccctgctgagacccagctccc

SEQ ID NO: 7160257 - DNA, 23 bp, Homo sapiens
agccctgctgagacccagctccc

SEQ ID NO: 7160258 - DNA, 23 bp, Homo sapiens
agccctgctgagacccagctccc

SEQ ID NO: 7160259 - DNA, 23 bp, Homo sapiens
agccctgctgagacccagctccc

SEQ ID NO: 7160260 - DNA, 22 bp, Homo sapiens
agccctgcgtgccaggggactg

SEQ ID NO: 7160261 - DNA, 22 bp, Homo sapiens
agccctgctcatctggatcccg

SEQ ID NO: 7160262 - DNA, 22 bp, Homo sapiens
agccctgcacaggtctgtggct

SEQ ID NO: 7160263 - DNA, 22 bp, Homo sapiens
agccctgattaaccttggcttt

SEQ ID NO: 7160264 - DNA, 22 bp, Homo sapiens
agccccagttccctggaagtct

SEQ ID NO: 7160265 - DNA, 22 bp, Homo sapiens
agccccagttccctggaagtct

SEQ ID NO: 7160266 - DNA, 22 bp, Homo sapiens
agccccagttccctggaagtct

SEQ ID NO: 7160267 - DNA, 22 bp, Homo sapiens
agccccagttccctggaagtct

SEQ ID NO: 7160268 - DNA, 22 bp, Homo sapiens
agccccagttccctggaagtct

SEQ ID NO: 7160269 - DNA, 22 bp, Homo sapiens
agcccccaaaagtgcttatgat

SEQ ID NO: 7160270 - DNA, 22 bp, Homo sapiens
agcccccaaaagtgcttatgat

SEQ ID NO: 7160271 - DNA, 22 bp, Homo sapiens
agcccccacgtttcctgggtcc

SEQ ID NO: 7160272 - DNA, 17 bp, Homo sapiens
agcccccactcccaagt

SEQ ID NO: 7160273 - DNA, 22 bp, Homo sapiens
agccctgagctggcctgggctt

SEQ ID NO: 7160274 - DNA, 22 bp, Homo sapiens
agccctggcagagccaggtagt

SEQ ID NO: 7160275 - DNA, 22 bp, Homo sapiens
agccctggcagagccaggtagt

SEQ ID NO: 7160276 - DNA, 22 bp, Homo sapiens
agccctggcagagccaggtagt

SEQ ID NO: 7160277 - DNA, 22 bp, Homo sapiens
agccctggagcaaaggtgtctt

SEQ ID NO: 7160278 - DNA, 22 bp, Homo sapiens
agccctggatggacagtttccc

SEQ ID NO: 7160279 - DNA, 22 bp, Homo sapiens
agccctggattctgaggtccaa

SEQ ID NO: 7160280 - DNA, 22 bp, Homo sapiens
agccctggattctgaggtccaa

SEQ ID NO: 7160281 - DNA, 22 bp, Homo sapiens
agccctggattctgaggtccaa

SEQ ID NO: 7160282 - DNA, 22 bp, Homo sapiens
agccctggattctgaggtccaa

SEQ ID NO: 7160283 - DNA, 22 bp, Homo sapiens
agccctggattctgaggtccaa

SEQ ID NO: 7160284 - DNA, 22 bp, Homo sapiens
agccctggcagagccaggtagt

SEQ ID NO: 7160285 - DNA, 22 bp, Homo sapiens
agccctggaccttagcccccac

SEQ ID NO: 7160286 - DNA, 22 bp, Homo sapiens
agccctggagcaaaggtgtctt

SEQ ID NO: 7160287 - DNA, 22 bp, Homo sapiens
agccctggagcaaaggtgtctt

SEQ ID NO: 7160288 - DNA, 22 bp, Homo sapiens
agccctggagcaaaggtgtctt

SEQ ID NO: 7160289 - DNA, 22 bp, Homo sapiens
agccctggagcaaaggtgtctt

SEQ ID NO: 7160290 - DNA, 22 bp, Homo sapiens
agccctggagcaaaggtgtctt

SEQ ID NO: 7160291 - DNA, 22 bp, Homo sapiens
agccctgctgcctgaattagct

SEQ ID NO: 7160292 - DNA, 22 bp, Homo sapiens
agccctgctgcttcttgtattt

SEQ ID NO: 7160293 - DNA, 22 bp, Homo sapiens
agccctgcttcaccatttactt

SEQ ID NO: 7160294 - DNA, 22 bp, Homo sapiens
agccctggaagccacagtccta

SEQ ID NO: 7160295 - DNA, 22 bp, Homo sapiens
agccctggaagccacagtccta

SEQ ID NO: 7160296 - DNA, 22 bp, Homo sapiens
agccctggaagccacagtccta

SEQ ID NO: 7160297 - DNA, 22 bp, Homo sapiens
agccctggctcccagcagcgct

SEQ ID NO: 7160298 - DNA, 22 bp, Homo sapiens
agccctgggaggccagcttgta

SEQ ID NO: 7160299 - DNA, 22 bp, Homo sapiens
agccctgggaggccagcttgta

SEQ ID NO: 7160300 - DNA, 22 bp, Homo sapiens
agccctgggagattttctgggt

SEQ ID NO: 7160301 - DNA, 22 bp, Homo sapiens
agccctgggaggccagcttgta

SEQ ID NO: 7160302 - DNA, 22 bp, Homo sapiens
agccctgggaggccagcttgta

SEQ ID NO: 7160303 - DNA, 22 bp, Homo sapiens
agccctgggaggccagcttgta

SEQ ID NO: 7160304 - DNA, 22 bp, Homo sapiens
agccctgggatacagtaaaagc

SEQ ID NO: 7160305 - DNA, 22 bp, Homo sapiens
agccctgggcacctgtgagggg

SEQ ID NO: 7160306 - DNA, 22 bp, Homo sapiens
agccctgggcacctgtgagggg

SEQ ID NO: 7160307 - DNA, 22 bp, Homo sapiens
agccctgggcacctgtgagggg

SEQ ID NO: 7160308 - DNA, 22 bp, Homo sapiens
agccctggctcccagcagcgct

SEQ ID NO: 7160309 - DNA, 22 bp, Homo sapiens
agccctggctcccagcagcgct

SEQ ID NO: 7160310 - DNA, 22 bp, Homo sapiens
agccctggctcccagcagcgct

SEQ ID NO: 7160311 - DNA, 22 bp, Homo sapiens
agccctggcccggctgtgcttt

SEQ ID NO: 7160312 - DNA, 22 bp, Homo sapiens
agccctggctcccagcagcgct

SEQ ID NO: 7160313 - DNA, 22 bp, Homo sapiens
agccctggctcccagcagcgct

SEQ ID NO: 7160314 - DNA, 22 bp, Homo sapiens
agccctggctcccagcagcgct

SEQ ID NO: 7160315 - DNA, 22 bp, Homo sapiens
agccctggctcccagcagcgct

SEQ ID NO: 7160316 - DNA, 22 bp, Homo sapiens
agccctggcccggctgtgcttt

SEQ ID NO: 7160317 - DNA, 22 bp, Homo sapiens
agccctggcccggctgtgcttt

SEQ ID NO: 7160318 - DNA, 22 bp, Homo sapiens
agccctggcccggctgtgcttt

SEQ ID NO: 7160319 - DNA, 22 bp, Homo sapiens
agccctggcccggctgtgcttt

SEQ ID NO: 7160320 - DNA, 22 bp, Homo sapiens
agccctggcagagccaggtagt

SEQ ID NO: 7160321 - DNA, 22 bp, Homo sapiens
agccctggcccggctgtgcttt

SEQ ID NO: 7160322 - DNA, 22 bp, Homo sapiens
agccctggcccggctgtgcttt

SEQ ID NO: 7160323 - DNA, 22 bp, Homo sapiens
agccctgggcgttactgggatg

SEQ ID NO: 7160324 - DNA, 22 bp, Homo sapiens
agccctgggcgttactgggatg

SEQ ID NO: 7160325 - DNA, 22 bp, Homo sapiens
agccctgggcagccaaggaagc

SEQ ID NO: 7160326 - DNA, 22 bp, Homo sapiens
agccctgggcagccaaggaagc

SEQ ID NO: 7160327 - DNA, 22 bp, Homo sapiens
agccctgggcagccaaggaagc

SEQ ID NO: 7160328 - DNA, 22 bp, Homo sapiens
agccctgggcagccaaggaagc

SEQ ID NO: 7160329 - DNA, 22 bp, Homo sapiens
agccctgggctgtagataagca

SEQ ID NO: 7160330 - DNA, 22 bp, Homo sapiens
agccctgggcgttactgggatg

SEQ ID NO: 7160331 - DNA, 22 bp, Homo sapiens
agccctgggcgttactgggatg

SEQ ID NO: 7160332 - DNA, 22 bp, Homo sapiens
cagatgaagtaggtgacgagca

SEQ ID NO: 7160333 - DNA, 22 bp, Homo sapiens
cagatggcagggcagctctgca

SEQ ID NO: 7160334 - DNA, 22 bp, Homo sapiens
cagatggctgccaagatgggct

SEQ ID NO: 7160335 - DNA, 22 bp, Homo sapiens
cagatggctgccttcttgctgt

SEQ ID NO: 7160336 - DNA, 20 bp, Homo sapiens
cagatgggacgtggaggagt

SEQ ID NO: 7160337 - DNA, 20 bp, Homo sapiens
cagatgggacgtggaggagt

SEQ ID NO: 7160338 - DNA, 22 bp, Homo sapiens
agctccaggataagacaggtgc

SEQ ID NO: 7160339 - DNA, 22 bp, Homo sapiens
agctccaggataagacaggtgc

SEQ ID NO: 7160340 - DNA, 22 bp, Homo sapiens
agctccaggataagacaggtgc

SEQ ID NO: 7160341 - DNA, 22 bp, Homo sapiens
agctccaggccttgggccccgg

SEQ ID NO: 7160342 - DNA, 23 bp, Homo sapiens
agctccagctgacgtgggcagcc

SEQ ID NO: 7160343 - DNA, 23 bp, Homo sapiens
agctccagctgacgtgggcagcc

SEQ ID NO: 7160344 - DNA, 23 bp, Homo sapiens
agctccagctgacgtgggcagcc

SEQ ID NO: 7160345 - DNA, 23 bp, Homo sapiens
agctccagctgacgtgggcagcc

SEQ ID NO: 7160346 - DNA, 22 bp, Homo sapiens
agctccagcctcttctggaggt

SEQ ID NO: 7160347 - DNA, 22 bp, Homo sapiens
agctccagcctcttctggaggt

SEQ ID NO: 7160348 - DNA, 22 bp, Homo sapiens
agctccagcctcttctggaggt

SEQ ID NO: 7160349 - DNA, 22 bp, Homo sapiens
agctccaggccttgggccccgg

SEQ ID NO: 7160350 - DNA, 21 bp, Homo sapiens
agctccaggctcctggggttc

SEQ ID NO: 7160351 - DNA, 21 bp, Homo sapiens
agctccaggctcctggggttc

SEQ ID NO: 7160352 - DNA, 21 bp, Homo sapiens
agctccaggctcctggggttc

SEQ ID NO: 7160353 - DNA, 22 bp, Homo sapiens
agctccagggaaagagtggatc

SEQ ID NO: 7160354 - DNA, 22 bp, Homo sapiens
agctccagggaaagagtggatc

SEQ ID NO: 7160355 - DNA, 22 bp, Homo sapiens
agctccagggaaagagtggatc

SEQ ID NO: 7160356 - DNA, 19 bp, Homo sapiens
agctcctgattgtgcctcg

SEQ ID NO: 7160357 - DNA, 19 bp, Homo sapiens
agctcctgattgtgcctcg

SEQ ID NO: 7160358 - DNA, 19 bp, Homo sapiens
agctcctgattgtgcctcg

SEQ ID NO: 7160359 - DNA, 19 bp, Homo sapiens
agctcctgattgtgcctcg

SEQ ID NO: 7160360 - DNA, 22 bp, Homo sapiens
agctcctggacgaacagggagt

SEQ ID NO: 7160361 - DNA, 22 bp, Homo sapiens
agctcctggacgaacagggagt

SEQ ID NO: 7160362 - DNA, 20 bp, Homo sapiens
agctcctggactagagagtg

SEQ ID NO: 7160363 - DNA, 22 bp, Homo sapiens
agctcctggaggtgcgcactcg

SEQ ID NO: 7160364 - DNA, 22 bp, Homo sapiens
agctcctggaggtgcgcactcg

SEQ ID NO: 7160365 - DNA, 22 bp, Homo sapiens
agctcctggaggtgcgcactcg

SEQ ID NO: 7160366 - DNA, 22 bp, Homo sapiens
agctcctggcaaggtcatggtg

SEQ ID NO: 7160367 - DNA, 22 bp, Homo sapiens
agctcctggcaaggtcatggtg

SEQ ID NO: 7160368 - DNA, 22 bp, Homo sapiens
agctccagccgctgatgggttt

SEQ ID NO: 7160369 - DNA, 22 bp, Homo sapiens
agctccagccgctgatgggttt

SEQ ID NO: 7160370 - DNA, 22 bp, Homo sapiens
agctccagccctagtacagctg

SEQ ID NO: 7160371 - DNA, 22 bp, Homo sapiens
agctccagccctagtacagctg

SEQ ID NO: 7160372 - DNA, 22 bp, Homo sapiens
agctccagccgctgatgggttt

SEQ ID NO: 7160373 - DNA, 22 bp, Homo sapiens
agctccagattaattgtaggag

SEQ ID NO: 7160374 - DNA, 22 bp, Homo sapiens
agctccagattaattgtaggag

SEQ ID NO: 7160375 - DNA, 22 bp, Homo sapiens
agctccagcccatctgctcgtg

SEQ ID NO: 7160376 - DNA, 22 bp, Homo sapiens
agctccagccctagtacagctg

SEQ ID NO: 7160377 - DNA, 22 bp, Homo sapiens
agctccagccctagtacagctg

SEQ ID NO: 7160378 - DNA, 23 bp, Homo sapiens
agctccagaacatagcacaggaa

SEQ ID NO: 7160379 - DNA, 22 bp, Homo sapiens
agctccagaagcctgcaaggta

SEQ ID NO: 7160380 - DNA, 22 bp, Homo sapiens
agctccagaagcctgcaaggta

SEQ ID NO: 7160381 - DNA, 22 bp, Homo sapiens
agctccagaagcctgcaaggta

SEQ ID NO: 7160382 - DNA, 22 bp, Homo sapiens
agctccagagccacatccatca

SEQ ID NO: 7160383 - DNA, 22 bp, Homo sapiens
agctccagaggcagtgatgaag

SEQ ID NO: 7160384 - DNA, 22 bp, Homo sapiens
agctccagagtctgaactattc

SEQ ID NO: 7160385 - DNA, 22 bp, Homo sapiens
agctaggacaggtagagatggg

SEQ ID NO: 7160386 - DNA, 22 bp, Homo sapiens
agctagccatgtggctcctgtg

SEQ ID NO: 7160387 - DNA, 22 bp, Homo sapiens
agctagccatgtggctcctgtg

SEQ ID NO: 7160388 - DNA, 23 bp, Homo sapiens
agctagcataatgtctggctcct

SEQ ID NO: 7160389 - DNA, 20 bp, Homo sapiens
agctaggagaaagcatggag

SEQ ID NO: 7160390 - DNA, 20 bp, Homo sapiens
agctaggagaaagcatggag

SEQ ID NO: 7160391 - DNA, 22 bp, Homo sapiens
agctcaggcaactctgggcccc

SEQ ID NO: 7160392 - DNA, 19 bp, Homo sapiens
agctcaggcccatcgtccc

SEQ ID NO: 7160393 - DNA, 19 bp, Homo sapiens
agctcaggcccatcgtccc

SEQ ID NO: 7160394 - DNA, 19 bp, Homo sapiens
agctcaggcccatcgtccc

SEQ ID NO: 7160395 - DNA, 22 bp, Homo sapiens
agctcaggccggagctacaggc

SEQ ID NO: 7160396 - DNA, 22 bp, Homo sapiens
agctcaggccggagctacaggc

SEQ ID NO: 7160397 - DNA, 22 bp, Homo sapiens
agctcaggccggagctacaggc

SEQ ID NO: 7160398 - DNA, 23 bp, Homo sapiens
agctccagaacatagcacaggaa

SEQ ID NO: 7160399 - DNA, 23 bp, Homo sapiens
agctccagaacatagcacaggaa

SEQ ID NO: 7160400 - DNA, 23 bp, Homo sapiens
agctccagaacatagcacaggaa

SEQ ID NO: 7160401 - DNA, 19 bp, Homo sapiens
agctcctgggctctgggcc

SEQ ID NO: 7160402 - DNA, 19 bp, Homo sapiens
agctcctgggctctgggcc

SEQ ID NO: 7160403 - DNA, 19 bp, Homo sapiens
agctcctgggctctgggcc

SEQ ID NO: 7160404 - DNA, 19 bp, Homo sapiens
agctcctgggctctgggcc

SEQ ID NO: 7160405 - DNA, 19 bp, Homo sapiens
agctcctgggctctgggcc

SEQ ID NO: 7160406 - DNA, 22 bp, Homo sapiens
agctcctgggggttccaagcag

SEQ ID NO: 7160407 - DNA, 22 bp, Homo sapiens
agctcctgggccatcacaacca

SEQ ID NO: 7160408 - DNA, 22 bp, Homo sapiens
agctcctgggcacctctttcac

SEQ ID NO: 7160409 - DNA, 22 bp, Homo sapiens
agctcctgggcacctctttcac

SEQ ID NO: 7160410 - DNA, 22 bp, Homo sapiens
agctcctgggagcaggtggtac

SEQ ID NO: 7160411 - DNA, 22 bp, Homo sapiens
agctcctggcaaggtcatggtg

SEQ ID NO: 7160412 - DNA, 22 bp, Homo sapiens
agctcctggctttcctctcacc

SEQ ID NO: 7160413 - DNA, 18 bp, Homo sapiens
agctcctggtctcaggga

SEQ ID NO: 7160414 - DNA, 22 bp, Homo sapiens
agctcctggtctttgtccagag

SEQ ID NO: 7160415 - DNA, 18 bp, Homo sapiens
agctcctggtctcaggga

SEQ ID NO: 7160416 - DNA, 18 bp, Homo sapiens
agctcctggtctcaggga

SEQ ID NO: 7160417 - DNA, 18 bp, Homo sapiens
agctcctggtctcaggga

SEQ ID NO: 7160418 - DNA, 22 bp, Homo sapiens
agctcctgggggttccaagcag

SEQ ID NO: 7160419 - DNA, 20 bp, Homo sapiens
agctcctggtataggtgcct

SEQ ID NO: 7160420 - DNA, 17 bp, Homo sapiens
agctcctggggtcttta

SEQ ID NO: 7160421 - DNA, 22 bp, Homo sapiens
agctcctggtgcctcagccgaa

SEQ ID NO: 7160422 - DNA, 22 bp, Homo sapiens
agctcctggtgcctcagccgaa

SEQ ID NO: 7160423 - DNA, 23 bp, Homo sapiens
agctcctgtaaggtggtcgtcac

SEQ ID NO: 7160424 - DNA, 23 bp, Homo sapiens
agctcctgtaaggtggtcgtcac

SEQ ID NO: 7160425 - DNA, 22 bp, Homo sapiens
agctcctgtctcaagggagcct

SEQ ID NO: 7160426 - DNA, 22 bp, Homo sapiens
agctcctgtagtacatattatt

SEQ ID NO: 7160427 - DNA, 22 bp, Homo sapiens
agctcctgtctcaagggagcct

SEQ ID NO: 7160428 - DNA, 22 bp, Homo sapiens
agctcctgtctcaagggagcct

SEQ ID NO: 7160429 - DNA, 22 bp, Homo sapiens
agctcctgtctcaagggagcct

SEQ ID NO: 7160430 - DNA, 20 bp, Homo sapiens
agctcttactttgcagcagc

SEQ ID NO: 7160431 - DNA, 22 bp, Homo sapiens
agctcttacatttaggtctatg

SEQ ID NO: 7160432 - DNA, 22 bp, Homo sapiens
agctcttacatttaggtctatg

SEQ ID NO: 7160433 - DNA, 22 bp, Homo sapiens
agctcctgtggcagctcttctg

SEQ ID NO: 7160434 - DNA, 22 bp, Homo sapiens
agctcctgtggcagctcttctg

SEQ ID NO: 7160435 - DNA, 22 bp, Homo sapiens
agctcctgtggcagctcttctg

SEQ ID NO: 7160436 - DNA, 22 bp, Homo sapiens
agctcctgtggcagctcttctg

SEQ ID NO: 7160437 - DNA, 22 bp, Homo sapiens
agctcctgtggctgaaagagga

SEQ ID NO: 7160438 - DNA, 22 bp, Homo sapiens
agctctgggattctcaggccac

SEQ ID NO: 7160439 - DNA, 22 bp, Homo sapiens
agctctgggattctcaggccac

SEQ ID NO: 7160440 - DNA, 22 bp, Homo sapiens
agctctgggccaggaaccctaa

SEQ ID NO: 7160441 - DNA, 22 bp, Homo sapiens
agctctgggccaggaaccctaa

SEQ ID NO: 7160442 - DNA, 22 bp, Homo sapiens
agctctgggccaggaaccctaa

SEQ ID NO: 7160443 - DNA, 22 bp, Homo sapiens
agctctgggccaggaaccctaa

SEQ ID NO: 7160444 - DNA, 22 bp, Homo sapiens
agctctggttattgaagcaggg

SEQ ID NO: 7160445 - DNA, 22 bp, Homo sapiens
agctctggtttagaaggggaaa

SEQ ID NO: 7160446 - DNA, 22 bp, Homo sapiens
agctctggtttagaaggggaaa

SEQ ID NO: 7160447 - DNA, 22 bp, Homo sapiens
agctctgtaacccattccctgt

SEQ ID NO: 7160448 - DNA, 22 bp, Homo sapiens
agctctgtgaagccagcagttc

SEQ ID NO: 7160449 - DNA, 22 bp, Homo sapiens
agctctgtgaagccagcagttc

SEQ ID NO: 7160450 - DNA, 22 bp, Homo sapiens
agctctgtgcaggcagaggcat

SEQ ID NO: 7160451 - DNA, 22 bp, Homo sapiens
agctctgtgttcacagcactaa

SEQ ID NO: 7160452 - DNA, 20 bp, Homo sapiens
agctcttaagaagaagatga

SEQ ID NO: 7160453 - DNA, 22 bp, Homo sapiens
agctaagacttagtgacttagt

SEQ ID NO: 7160454 - DNA, 19 bp, Homo sapiens
agctaagacaagggacatc

SEQ ID NO: 7160455 - DNA, 22 bp, Homo sapiens
agctaacatgactagaagcttc

SEQ ID NO: 7160456 - DNA, 22 bp, Homo sapiens
agctaacatggaggaaaaagtt

SEQ ID NO: 7160457 - DNA, 22 bp, Homo sapiens
agctaagaacttgagctctgga

SEQ ID NO: 7160458 - DNA, 23 bp, Homo sapiens
agctaacagatcgacaaagtata

SEQ ID NO: 7160459 - DNA, 22 bp, Homo sapiens
agcctggtgatatcagtggttt

SEQ ID NO: 7160460 - DNA, 22 bp, Homo sapiens
agcctgggtttttattaaggag

SEQ ID NO: 7160461 - DNA, 22 bp, Homo sapiens
agcctgggtttttattaaggag

SEQ ID NO: 7160462 - DNA, 22 bp, Homo sapiens
agcctgggtttttattaaggag

SEQ ID NO: 7160463 - DNA, 22 bp, Homo sapiens
agcctggtttaagcattttata

SEQ ID NO: 7160464 - DNA, 22 bp, Homo sapiens
agcctgggtgggggttcggaga

SEQ ID NO: 7160465 - DNA, 22 bp, Homo sapiens
agcctgggttagggttcttccc

SEQ ID NO: 7160466 - DNA, 22 bp, Homo sapiens
agcctgggcatgggacgggagg

SEQ ID NO: 7160467 - DNA, 22 bp, Homo sapiens
agcctgggccctgcctcttctc

SEQ ID NO: 7160468 - DNA, 22 bp, Homo sapiens
agcctgggcctggcttcccgcc

SEQ ID NO: 7160469 - DNA, 22 bp, Homo sapiens
agcctgggcctggcttcccgcc

SEQ ID NO: 7160470 - DNA, 22 bp, Homo sapiens
agcctgggcctggcttcccgcc

SEQ ID NO: 7160471 - DNA, 18 bp, Homo sapiens
agcctgggctctgcctgg

SEQ ID NO: 7160472 - DNA, 20 bp, Homo sapiens
agcctggggaattccacccc

SEQ ID NO: 7160473 - DNA, 22 bp, Homo sapiens
agcctggggcacttctccaaac

SEQ ID NO: 7160474 - DNA, 22 bp, Homo sapiens
agcctggggcacttctccaaac

SEQ ID NO: 7160475 - DNA, 22 bp, Homo sapiens
agcctgggggcgcagaaaccgg

SEQ ID NO: 7160476 - DNA, 22 bp, Homo sapiens
agcctggggtttcagtttgcac

SEQ ID NO: 7160477 - DNA, 21 bp, Homo sapiens
agcctgggtatcctttgagga

SEQ ID NO: 7160478 - DNA, 22 bp, Homo sapiens
agctaaggaactctgtaacacc

SEQ ID NO: 7160479 - DNA, 22 bp, Homo sapiens
agctaaggacagttgatttaga

SEQ ID NO: 7160480 - DNA, 22 bp, Homo sapiens
agctaaggatgactagtacttc

SEQ ID NO: 7160481 - DNA, 22 bp, Homo sapiens
agctaattagaaatagattatt

SEQ ID NO: 7160482 - DNA, 22 bp, Homo sapiens
agctacaaatgtatgtgctgat

SEQ ID NO: 7160483 - DNA, 22 bp, Homo sapiens
agctacaaatgtatgtgctgat

SEQ ID NO: 7160484 - DNA, 22 bp, Homo sapiens
agctacaacttttccatgagca

SEQ ID NO: 7160485 - DNA, 22 bp, Homo sapiens
agctacaacttttccatgagca

SEQ ID NO: 7160486 - DNA, 22 bp, Homo sapiens
agctacaagtcatcagctatca

SEQ ID NO: 7160487 - DNA, 22 bp, Homo sapiens
agctacaatcaatgtacatcat

SEQ ID NO: 7160488 - DNA, 20 bp, Homo sapiens
agctacaatgcgaagctggc

SEQ ID NO: 7160489 - DNA, 22 bp, Homo sapiens
agctacagatgagcccagtatc

SEQ ID NO: 7160490 - DNA, 19 bp, Homo sapiens
agctacagcatggcgaggt

SEQ ID NO: 7160491 - DNA, 22 bp, Homo sapiens
agctacagctgtactctgcagg

SEQ ID NO: 7160492 - DNA, 22 bp, Homo sapiens
agctacagctgtactctgcagg

SEQ ID NO: 7160493 - DNA, 22 bp, Homo sapiens
agctagagaatgacagagtctg

SEQ ID NO: 7160494 - DNA, 22 bp, Homo sapiens
agctagaatattgatctgaaat

SEQ ID NO: 7160495 - DNA, 22 bp, Homo sapiens
agctagaatattgatctgaaat

SEQ ID NO: 7160496 - DNA, 22 bp, Homo sapiens
agctagaatgttccttttcatt

SEQ ID NO: 7160497 - DNA, 23 bp, Homo sapiens
agctactaggattcattcaccct

SEQ ID NO: 7160498 - DNA, 23 bp, Homo sapiens
agctactaggattcattcaccct

SEQ ID NO: 7160499 - DNA, 22 bp, Homo sapiens
agctactagggtgccagacatg

SEQ ID NO: 7160500 - DNA, 22 bp, Homo sapiens
agctactatgtgaaagccaggc

SEQ ID NO: 7160501 - DNA, 22 bp, Homo sapiens
agctactcagagttccactcta

SEQ ID NO: 7160502 - DNA, 22 bp, Homo sapiens
agctactctgcagtgcccatgg

SEQ ID NO: 7160503 - DNA, 22 bp, Homo sapiens
agctactctgcagtgcccatgg

SEQ ID NO: 7160504 - DNA, 22 bp, Homo sapiens
agctagaagtcctagataaagg

SEQ ID NO: 7160505 - DNA, 22 bp, Homo sapiens
agctacagtggacaagtgaact

SEQ ID NO: 7160506 - DNA, 22 bp, Homo sapiens
agctacagttgccctcagcagg

SEQ ID NO: 7160507 - DNA, 22 bp, Homo sapiens
agctacagttgccctcagcagg

SEQ ID NO: 7160508 - DNA, 22 bp, Homo sapiens
agctacagggaactaaaagcta

SEQ ID NO: 7160509 - DNA, 22 bp, Homo sapiens
agctactactaccaaactaaag

SEQ ID NO: 7160510 - DNA, 22 bp, Homo sapiens
agctacctggcttatcactgtc

SEQ ID NO: 7160511 - DNA, 22 bp, Homo sapiens
agctacatgaaattgctgatat

SEQ ID NO: 7160512 - DNA, 22 bp, Homo sapiens
agctacctataatgagacctgg

SEQ ID NO: 7160513 - DNA, 22 bp, Homo sapiens
agctacctataatgagacctgg

SEQ ID NO: 7160514 - DNA, 22 bp, Homo sapiens
agctacctcatctgttaaacgg

SEQ ID NO: 7160515 - DNA, 22 bp, Homo sapiens
agctacctgatccttcttctga

SEQ ID NO: 7160516 - DNA, 22 bp, Homo sapiens
agctacctgatccttcttctga

SEQ ID NO: 7160517 - DNA, 22 bp, Homo sapiens
agcctgggaatttagagttcgg

SEQ ID NO: 7160518 - DNA, 22 bp, Homo sapiens
agcctgggaatttagagttcgg

SEQ ID NO: 7160519 - DNA, 22 bp, Homo sapiens
agcctgggagacactaagttgt

SEQ ID NO: 7160520 - DNA, 21 bp, Homo sapiens
agcctgggaggcggaggttgc

SEQ ID NO: 7160521 - DNA, 21 bp, Homo sapiens
agcctgggaggcggaggttgc

SEQ ID NO: 7160522 - DNA, 21 bp, Homo sapiens
agcctgggaggcggaggttgc

SEQ ID NO: 7160523 - DNA, 22 bp, Homo sapiens
agcctgggcaacaacacagcga

SEQ ID NO: 7160524 - DNA, 22 bp, Homo sapiens
agcctgggcaacaacacagcga

SEQ ID NO: 7160525 - DNA, 22 bp, Homo sapiens
agcctgggcaacagagcaaaac

SEQ ID NO: 7160526 - DNA, 22 bp, Homo sapiens
agcctgggcaacagagcaaaac

SEQ ID NO: 7160527 - DNA, 22 bp, Homo sapiens
agcctgggcaactccattcact

SEQ ID NO: 7160528 - DNA, 22 bp, Homo sapiens
agcctgggcaactccattcact

SEQ ID NO: 7160529 - DNA, 22 bp, Homo sapiens
agcctgggcatgggacgggagg

SEQ ID NO: 7160530 - DNA, 22 bp, Homo sapiens
agcctgggcatgggacgggagg

SEQ ID NO: 7160531 - DNA, 17 bp, Homo sapiens
agcctgggaaggagtga

SEQ ID NO: 7160532 - DNA, 17 bp, Homo sapiens
agcctgggaaggagtga

SEQ ID NO: 7160533 - DNA, 17 bp, Homo sapiens
agcctgggaaggagtga

SEQ ID NO: 7160534 - DNA, 17 bp, Homo sapiens
agcctgggaaggagtga

SEQ ID NO: 7160535 - DNA, 22 bp, Homo sapiens
agcctggcttagctctctcact

SEQ ID NO: 7160536 - DNA, 22 bp, Homo sapiens
agcctggcttagctctctcact

SEQ ID NO: 7160537 - DNA, 22 bp, Homo sapiens
agcctggcttagctctctcact

SEQ ID NO: 7160538 - DNA, 19 bp, Homo sapiens
agcctggctttgctctgct

SEQ ID NO: 7160539 - DNA, 19 bp, Homo sapiens
agcctggctttgctctgct

SEQ ID NO: 7160540 - DNA, 20 bp, Homo sapiens
cagcaactttggactgagtt

SEQ ID NO: 7160541 - DNA, 22 bp, Homo sapiens
cagcaagaaaattcacatgctc

SEQ ID NO: 7160542 - DNA, 22 bp, Homo sapiens
cagcaagaaaattcacatgctc

SEQ ID NO: 7160543 - DNA, 22 bp, Homo sapiens
cagcaagaaaattcacatgctc

SEQ ID NO: 7160544 - DNA, 22 bp, Homo sapiens
agcctggccactcagggcctga

SEQ ID NO: 7160545 - DNA, 22 bp, Homo sapiens
agcctggccactcagggcctga

SEQ ID NO: 7160546 - DNA, 22 bp, Homo sapiens
cagatgtgcatgatgggaaggg

SEQ ID NO: 7160547 - DNA, 22 bp, Homo sapiens
cagatgtgcatgatgggaaggg

SEQ ID NO: 7160548 - DNA, 22 bp, Homo sapiens
cagatgtggaatgcagcaggct

SEQ ID NO: 7160549 - DNA, 22 bp, Homo sapiens
cagatgtggaatgcagcaggct

SEQ ID NO: 7160550 - DNA, 22 bp, Homo sapiens
cagatgtatatgcataaaaagt

SEQ ID NO: 7160551 - DNA, 22 bp, Homo sapiens
cagatgtgagctggggagagtg

SEQ ID NO: 7160552 - DNA, 22 bp, Homo sapiens
cagatgtgagctggggagagtg

SEQ ID NO: 7160553 - DNA, 22 bp, Homo sapiens
cagatgtgattcttccctcagc

SEQ ID NO: 7160554 - DNA, 22 bp, Homo sapiens
cagatgtacatgaagggcaatg

SEQ ID NO: 7160555 - DNA, 22 bp, Homo sapiens
cagatgtacatgaagggcaatg

SEQ ID NO: 7160556 - DNA, 22 bp, Homo sapiens
cagatgtacatgaagggcaatg

SEQ ID NO: 7160557 - DNA, 22 bp, Homo sapiens
cagatgtacatgaagggcaatg

SEQ ID NO: 7160558 - DNA, 18 bp, Homo sapiens
cagatggtggagttttta

SEQ ID NO: 7160559 - DNA, 22 bp, Homo sapiens
cagatgtaatctgacagctgga

SEQ ID NO: 7160560 - DNA, 22 bp, Homo sapiens
cagatgtaatctgacagctgga

SEQ ID NO: 7160561 - DNA, 20 bp, Homo sapiens
cagatgggacgtggaggagt

SEQ ID NO: 7160562 - DNA, 20 bp, Homo sapiens
cagatgggacgtggaggagt

SEQ ID NO: 7160563 - DNA, 22 bp, Homo sapiens
cagatggggcaaggccatctgt

SEQ ID NO: 7160564 - DNA, 22 bp, Homo sapiens
cagatggtagcagtagcttgct

SEQ ID NO: 7160565 - DNA, 18 bp, Homo sapiens
cagatggtggagttttta

SEQ ID NO: 7160566 - DNA, 22 bp, Homo sapiens
cagcaacatatatgaaactgtg

SEQ ID NO: 7160567 - DNA, 22 bp, Homo sapiens
cagcaacatatatgaaactgtg

SEQ ID NO: 7160568 - DNA, 22 bp, Homo sapiens
cagcaacctaaatccactaact

SEQ ID NO: 7160569 - DNA, 22 bp, Homo sapiens
cagcaacggaaaatacacatag

SEQ ID NO: 7160570 - DNA, 22 bp, Homo sapiens
cagcaactcctatattgaaagc

SEQ ID NO: 7160571 - DNA, 22 bp, Homo sapiens
cagcaacatatatgaaactgtg

SEQ ID NO: 7160572 - DNA, 22 bp, Homo sapiens
cagcaactctcctgtgctcaaa

SEQ ID NO: 7160573 - DNA, 22 bp, Homo sapiens
cagcaactctcctgtgctcaaa

SEQ ID NO: 7160574 - DNA, 22 bp, Homo sapiens
cagcaactcctatattgaaagc

SEQ ID NO: 7160575 - DNA, 22 bp, Homo sapiens
cagcaactggtcattgctctcc

SEQ ID NO: 7160576 - DNA, 22 bp, Homo sapiens
cagcaactggtcattgctctcc

SEQ ID NO: 7160577 - DNA, 20 bp, Homo sapiens
cagcaactttggactgagtt

SEQ ID NO: 7160578 - DNA, 22 bp, Homo sapiens
cagcaactgtgcctgacacaca

SEQ ID NO: 7160579 - DNA, 22 bp, Homo sapiens
cagcaacttaggcagaacatct

SEQ ID NO: 7160580 - DNA, 22 bp, Homo sapiens
cagcaacttggacagcagtctt

SEQ ID NO: 7160581 - DNA, 22 bp, Homo sapiens
atgaaggctgtgtggagccccc

SEQ ID NO: 7160582 - DNA, 22 bp, Homo sapiens
atgaaggccaggcttcagtgtg

SEQ ID NO: 7160583 - DNA, 22 bp, Homo sapiens
atgaagggtgtccctgtgagca

SEQ ID NO: 7160584 - DNA, 22 bp, Homo sapiens
atgaagggtgtccctgtgagca

SEQ ID NO: 7160585 - DNA, 22 bp, Homo sapiens
atgaagtcgttactaccaattg

SEQ ID NO: 7160586 - DNA, 19 bp, Homo sapiens
atgaaggcactgagtggga

SEQ ID NO: 7160587 - DNA, 22 bp, Homo sapiens
atgaagctctaaatgtacttag

SEQ ID NO: 7160588 - DNA, 22 bp, Homo sapiens
atgaagctgaccttgtcttgct

SEQ ID NO: 7160589 - DNA, 22 bp, Homo sapiens
atgaagctggttttggcttggg

SEQ ID NO: 7160590 - DNA, 22 bp, Homo sapiens
atgaagttctagtgagaaatgc

SEQ ID NO: 7160591 - DNA, 22 bp, Homo sapiens
atgaagttctagtgagaaatgc

SEQ ID NO: 7160592 - DNA, 22 bp, Homo sapiens
atgaagttccagtatatgcagt

SEQ ID NO: 7160593 - DNA, 22 bp, Homo sapiens
agaatatagttaccaaattctg

SEQ ID NO: 7160594 - DNA, 22 bp, Homo sapiens
agaatatatgactgcaagacta

SEQ ID NO: 7160595 - DNA, 22 bp, Homo sapiens
agaatatcgtagcatattatct

SEQ ID NO: 7160596 - DNA, 22 bp, Homo sapiens
agaatatatgactgcaagacta

SEQ ID NO: 7160597 - DNA, 22 bp, Homo sapiens
agaatatgaggaaactgtgaat

SEQ ID NO: 7160598 - DNA, 22 bp, Homo sapiens
agaatatgatcggaatacagat

SEQ ID NO: 7160599 - DNA, 22 bp, Homo sapiens
agaatatgatcggaatacagat

SEQ ID NO: 7160600 - DNA, 22 bp, Homo sapiens
agaatatgatggttggagaatt

SEQ ID NO: 7160601 - DNA, 22 bp, Homo sapiens
agaatatgattcagaccattag

SEQ ID NO: 7160602 - DNA, 22 bp, Homo sapiens
agaatattcatctgtattctta

SEQ ID NO: 7160603 - DNA, 22 bp, Homo sapiens
agaatattcatctgtattctta

SEQ ID NO: 7160604 - DNA, 22 bp, Homo sapiens
agaatattcatctgtattctta

SEQ ID NO: 7160605 - DNA, 22 bp, Homo sapiens
agaatattcatctgtattctta

SEQ ID NO: 7160606 - DNA, 22 bp, Homo sapiens
agaatattcatctgtattctta

SEQ ID NO: 7160607 - DNA, 22 bp, Homo sapiens
agaatattcatctgtattctta

SEQ ID NO: 7160608 - DNA, 22 bp, Homo sapiens
agaatattgaaagttcttgaca

SEQ ID NO: 7160609 - DNA, 22 bp, Homo sapiens
agaatattgaaagttcttgaca

SEQ ID NO: 7160610 - DNA, 22 bp, Homo sapiens
atgaacaatgactacatattga

SEQ ID NO: 7160611 - DNA, 22 bp, Homo sapiens
atctgcttgagtttgaagtcag

SEQ ID NO: 7160612 - DNA, 22 bp, Homo sapiens
atctgcttgaatgagcaacagg

SEQ ID NO: 7160613 - DNA, 22 bp, Homo sapiens
atctgcttgaatgagcaacagg

SEQ ID NO: 7160614 - DNA, 22 bp, Homo sapiens
atctgcttcctgggctccatga

SEQ ID NO: 7160615 - DNA, 22 bp, Homo sapiens
atgaacacatgtacacatttct

SEQ ID NO: 7160616 - DNA, 22 bp, Homo sapiens
atgaagcagttaaggtgcatga

SEQ ID NO: 7160617 - DNA, 22 bp, Homo sapiens
atgaagcatctcacaatctagt

SEQ ID NO: 7160618 - DNA, 22 bp, Homo sapiens
atgaagcatctcacaatctagt

SEQ ID NO: 7160619 - DNA, 22 bp, Homo sapiens
atgaagcattacaggatgacag

SEQ ID NO: 7160620 - DNA, 19 bp, Homo sapiens
atgaagcattgtttttgta

SEQ ID NO: 7160621 - DNA, 19 bp, Homo sapiens
atgaagcattgtttttgta

SEQ ID NO: 7160622 - DNA, 22 bp, Homo sapiens
atgaagcgttcgagataggtag

SEQ ID NO: 7160623 - DNA, 22 bp, Homo sapiens
atgaagctaaaccctgcagcca

SEQ ID NO: 7160624 - DNA, 19 bp, Homo sapiens
atctgccttagtgctgctg

SEQ ID NO: 7160625 - DNA, 19 bp, Homo sapiens
atctgcctgttatcacata

SEQ ID NO: 7160626 - DNA, 19 bp, Homo sapiens
atctgccttagtgctgctg

SEQ ID NO: 7160627 - DNA, 19 bp, Homo sapiens
atctgccttagtgctgctg

SEQ ID NO: 7160628 - DNA, 20 bp, Homo sapiens
atctgctgagaatgaaaggc

SEQ ID NO: 7160629 - DNA, 18 bp, Homo sapiens
atctgctggcaggtctgg

SEQ ID NO: 7160630 - DNA, 22 bp, Homo sapiens
atctgctgttcttcacagcttg

SEQ ID NO: 7160631 - DNA, 19 bp, Homo sapiens
atctgcctgttatcacata

SEQ ID NO: 7160632 - DNA, 22 bp, Homo sapiens
atctgcctgtatttaccatcat

SEQ ID NO: 7160633 - DNA, 22 bp, Homo sapiens
atctgcctgtatttaccatcat

SEQ ID NO: 7160634 - DNA, 22 bp, Homo sapiens
atctgcctggtctttgatgcag

SEQ ID NO: 7160635 - DNA, 22 bp, Homo sapiens
atctgcctggtctttgatgcag

SEQ ID NO: 7160636 - DNA, 22 bp, Homo sapiens
atctgcctggctccaggtgagc

SEQ ID NO: 7160637 - DNA, 22 bp, Homo sapiens
atctgcctggctccaggtgagc

SEQ ID NO: 7160638 - DNA, 22 bp, Homo sapiens
atctgcctgcttatgatgcctg

SEQ ID NO: 7160639 - DNA, 22 bp, Homo sapiens
atctgcctgcttatgatgcctg

SEQ ID NO: 7160640 - DNA, 22 bp, Homo sapiens
atctgcctgcttatgatgcctg

SEQ ID NO: 7160641 - DNA, 22 bp, Homo sapiens
atctgcctgagtctaggttttc

SEQ ID NO: 7160642 - DNA, 22 bp, Homo sapiens
atctgcctgcagtggaggtggg

SEQ ID NO: 7160643 - DNA, 22 bp, Homo sapiens
atctgcctgcagtggaggtggg

SEQ ID NO: 7160644 - DNA, 22 bp, Homo sapiens
atctgcctcttcttcattgcga

SEQ ID NO: 7160645 - DNA, 22 bp, Homo sapiens
atctgcctcttcttcattgcga

SEQ ID NO: 7160646 - DNA, 22 bp, Homo sapiens
atctgcctccaagtccatgtgt

SEQ ID NO: 7160647 - DNA, 22 bp, Homo sapiens
atgaggccagggtgccatgaaa

SEQ ID NO: 7160648 - DNA, 20 bp, Homo sapiens
atgaggccagcagggctcag

SEQ ID NO: 7160649 - DNA, 20 bp, Homo sapiens
atgaggccagcagggctcag

SEQ ID NO: 7160650 - DNA, 22 bp, Homo sapiens
atgaggcagaaaaaagtcggag

SEQ ID NO: 7160651 - DNA, 22 bp, Homo sapiens
atgaggccagaccactctgcat

SEQ ID NO: 7160652 - DNA, 22 bp, Homo sapiens
atgaggcacttaaaagtgaaga

SEQ ID NO: 7160653 - DNA, 22 bp, Homo sapiens
atgaggcacgtgttactggcct

SEQ ID NO: 7160654 - DNA, 22 bp, Homo sapiens
agaatattgaaagttcttgaca

SEQ ID NO: 7160655 - DNA, 22 bp, Homo sapiens
agaatattgaaagttcttgaca

SEQ ID NO: 7160656 - DNA, 22 bp, Homo sapiens
agaatcaattcactgctgcagc

SEQ ID NO: 7160657 - DNA, 22 bp, Homo sapiens
atgaggcctatcttggcagagg

SEQ ID NO: 7160658 - DNA, 22 bp, Homo sapiens
atgaggcctttcttcacccttt

SEQ ID NO: 7160659 - DNA, 22 bp, Homo sapiens
atgaggcctttcttcacccttt

SEQ ID NO: 7160660 - DNA, 22 bp, Homo sapiens
atgaggccatggctgtcactaa

SEQ ID NO: 7160661 - DNA, 22 bp, Homo sapiens
atgaggcccaaacattacaaat

SEQ ID NO: 7160662 - DNA, 22 bp, Homo sapiens
atgaggcccaggaatctgtatt

SEQ ID NO: 7160663 - DNA, 22 bp, Homo sapiens
atgagggaggcaaggagatgct

SEQ ID NO: 7160664 - DNA, 22 bp, Homo sapiens
atgagggaggcaaggagatgct

SEQ ID NO: 7160665 - DNA, 22 bp, Homo sapiens
atgaggcttaaactgctgcaac

SEQ ID NO: 7160666 - DNA, 22 bp, Homo sapiens
atgaggctgaaacacagaggct

SEQ ID NO: 7160667 - DNA, 22 bp, Homo sapiens
agacagaacagaataattgttg

SEQ ID NO: 7160668 - DNA, 22 bp, Homo sapiens
agacagaacagaataattgttg

SEQ ID NO: 7160669 - DNA, 21 bp, Homo sapiens
agacagaacaactgctctcca

SEQ ID NO: 7160670 - DNA, 22 bp, Homo sapiens
agacagaaataggagaaaccag

SEQ ID NO: 7160671 - DNA, 22 bp, Homo sapiens
agacacttggcagagagctgtt

SEQ ID NO: 7160672 - DNA, 22 bp, Homo sapiens
agacagaaataggagaaaccag

SEQ ID NO: 7160673 - DNA, 22 bp, Homo sapiens
agacagaaataggagaaaccag

SEQ ID NO: 7160674 - DNA, 22 bp, Homo sapiens
agacacttatttagtgggagtt

SEQ ID NO: 7160675 - DNA, 22 bp, Homo sapiens
agacacttcatgtaagtggaat

SEQ ID NO: 7160676 - DNA, 22 bp, Homo sapiens
agacactgtgtacagaaaaaga

SEQ ID NO: 7160677 - DNA, 22 bp, Homo sapiens
agacactgttctcacatgcttg

SEQ ID NO: 7160678 - DNA, 22 bp, Homo sapiens
agacactgttctcacatgcttg

SEQ ID NO: 7160679 - DNA, 22 bp, Homo sapiens
agacaccagaatctgttgagca

SEQ ID NO: 7160680 - DNA, 22 bp, Homo sapiens
agacacattttacattaactgt

SEQ ID NO: 7160681 - DNA, 22 bp, Homo sapiens
agacacattttacattaactgt

SEQ ID NO: 7160682 - DNA, 22 bp, Homo sapiens
agacaagtgtggtgagagcagt

SEQ ID NO: 7160683 - DNA, 22 bp, Homo sapiens
agacaagtgtggtgagagcagt

SEQ ID NO: 7160684 - DNA, 22 bp, Homo sapiens
agacaagagctgaggacatatt

SEQ ID NO: 7160685 - DNA, 22 bp, Homo sapiens
agacaaggaatgtagcttactc

SEQ ID NO: 7160686 - DNA, 22 bp, Homo sapiens
agacaagactaggcagttgttg

SEQ ID NO: 7160687 - DNA, 22 bp, Homo sapiens
agacaagaaactgggagtctct

SEQ ID NO: 7160688 - DNA, 22 bp, Homo sapiens
agacaactgcagagcaaagaat

SEQ ID NO: 7160689 - DNA, 22 bp, Homo sapiens
agacaactagaaaactagacag

SEQ ID NO: 7160690 - DNA, 22 bp, Homo sapiens
agacaacatgatcagcagtcct

SEQ ID NO: 7160691 - DNA, 22 bp, Homo sapiens
agacaacatgatcagcagtcct

SEQ ID NO: 7160692 - DNA, 22 bp, Homo sapiens
agacaacatgatcagcagtcct

SEQ ID NO: 7160693 - DNA, 22 bp, Homo sapiens
agacaacatctagtttggtgga

SEQ ID NO: 7160694 - DNA, 22 bp, Homo sapiens
agacaacatctagtttggtgga

SEQ ID NO: 7160695 - DNA, 22 bp, Homo sapiens
agacaacaccaaatgctagtgt

SEQ ID NO: 7160696 - DNA, 22 bp, Homo sapiens
agacaacaccaaatgctagtgt

SEQ ID NO: 7160697 - DNA, 22 bp, Homo sapiens
agacctgttgggttcattggct

SEQ ID NO: 7160698 - DNA, 22 bp, Homo sapiens
agacctgtgatcacatggaatg

SEQ ID NO: 7160699 - DNA, 22 bp, Homo sapiens
agacctggtttatcaccagcat

SEQ ID NO: 7160700 - DNA, 22 bp, Homo sapiens
agaccttagtagcttttaatgg

SEQ ID NO: 7160701 - DNA, 22 bp, Homo sapiens
agacctttatttcatgatagga

SEQ ID NO: 7160702 - DNA, 22 bp, Homo sapiens
agacctttgctgcttcttatag

SEQ ID NO: 7160703 - DNA, 22 bp, Homo sapiens
agacctttgctgcttcttatag

SEQ ID NO: 7160704 - DNA, 21 bp, Homo sapiens
agaccttttctcagataactt

SEQ ID NO: 7160705 - DNA, 22 bp, Homo sapiens
agacctggtttatcaccagcat

SEQ ID NO: 7160706 - DNA, 22 bp, Homo sapiens
agacctggtttatcaccagcat

SEQ ID NO: 7160707 - DNA, 22 bp, Homo sapiens
agacctggtttatcaccagcat

SEQ ID NO: 7160708 - DNA, 22 bp, Homo sapiens
agacctggtttatcaccagcat

SEQ ID NO: 7160709 - DNA, 22 bp, Homo sapiens
agacctggtaagcaggttgggc

SEQ ID NO: 7160710 - DNA, 22 bp, Homo sapiens
agacctgggttcgagtcctaac

SEQ ID NO: 7160711 - DNA, 22 bp, Homo sapiens
agacctgggttcgagtcctaac

SEQ ID NO: 7160712 - DNA, 22 bp, Homo sapiens
agacctgggtgccctgtgcttt

SEQ ID NO: 7160713 - DNA, 22 bp, Homo sapiens
agacctgggtgccctgtgcttt

SEQ ID NO: 7160714 - DNA, 22 bp, Homo sapiens
agacctgggtgccctgtgcttt

SEQ ID NO: 7160715 - DNA, 22 bp, Homo sapiens
agacctggatgtgagggaagta

SEQ ID NO: 7160716 - DNA, 22 bp, Homo sapiens
agacctggagtgaagagttccc

SEQ ID NO: 7160717 - DNA, 22 bp, Homo sapiens
agacctggagtggggcctcagg

SEQ ID NO: 7160718 - DNA, 22 bp, Homo sapiens
agacctggagtggggcctcagg

SEQ ID NO: 7160719 - DNA, 22 bp, Homo sapiens
agacctggattccaatcctacc

SEQ ID NO: 7160720 - DNA, 22 bp, Homo sapiens
agacctggaagttcaagagaaa

SEQ ID NO: 7160721 - DNA, 22 bp, Homo sapiens
agacctggagacctgagtggta

SEQ ID NO: 7160722 - DNA, 22 bp, Homo sapiens
agacctggagacctgagtggta

SEQ ID NO: 7160723 - DNA, 22 bp, Homo sapiens
agacctggagtgaagagttccc

SEQ ID NO: 7160724 - DNA, 22 bp, Homo sapiens
agacctggagtgaagagttccc

SEQ ID NO: 7160725 - DNA, 22 bp, Homo sapiens
agacctggagtggggcctcagg

SEQ ID NO: 7160726 - DNA, 22 bp, Homo sapiens
agacccaggattggggctgccg

SEQ ID NO: 7160727 - DNA, 22 bp, Homo sapiens
agacccaggattggggctgccg

SEQ ID NO: 7160728 - DNA, 22 bp, Homo sapiens
agacccaggattggggctgccg

SEQ ID NO: 7160729 - DNA, 22 bp, Homo sapiens
agacctggaagttcaagagaaa

SEQ ID NO: 7160730 - DNA, 22 bp, Homo sapiens
atgccaaatttctttctgttct

SEQ ID NO: 7160731 - DNA, 20 bp, Homo sapiens
atgccaagctatctagaatc

SEQ ID NO: 7160732 - DNA, 20 bp, Homo sapiens
atgccaagctatctagaatc

SEQ ID NO: 7160733 - DNA, 22 bp, Homo sapiens
atgccaagtacaggcactgctc

SEQ ID NO: 7160734 - DNA, 22 bp, Homo sapiens
atgccaagtacaggcactgctc

SEQ ID NO: 7160735 - DNA, 21 bp, Homo sapiens
atgccaagtcttaatgagggc

SEQ ID NO: 7160736 - DNA, 22 bp, Homo sapiens
atgccaataaatgttaatatct

SEQ ID NO: 7160737 - DNA, 22 bp, Homo sapiens
atgccaattgcaggaagaaaac

SEQ ID NO: 7160738 - DNA, 22 bp, Homo sapiens
atgccacataattacaaataga

SEQ ID NO: 7160739 - DNA, 22 bp, Homo sapiens
agactgggtttgagacttagca

SEQ ID NO: 7160740 - DNA, 22 bp, Homo sapiens
agactggtttttaacttcacct

SEQ ID NO: 7160741 - DNA, 19 bp, Homo sapiens
agactctgccactcttctc

SEQ ID NO: 7160742 - DNA, 22 bp, Homo sapiens
agactggggttctggcaaggag

SEQ ID NO: 7160743 - DNA, 22 bp, Homo sapiens
agactggggttctggcaaggag

SEQ ID NO: 7160744 - DNA, 22 bp, Homo sapiens
atgcggagccccaagcttgaag

SEQ ID NO: 7160745 - DNA, 22 bp, Homo sapiens
agactctgattccctcatgtca

SEQ ID NO: 7160746 - DNA, 22 bp, Homo sapiens
agactctgcatttctaataagc

SEQ ID NO: 7160747 - DNA, 20 bp, Homo sapiens
atgcctttgatagtcaggct

SEQ ID NO: 7160748 - DNA, 22 bp, Homo sapiens
atgcctttgccacagattagga

SEQ ID NO: 7160749 - DNA, 22 bp, Homo sapiens
atgcctttctggtgttcttcct

SEQ ID NO: 7160750 - DNA, 22 bp, Homo sapiens
atgcctttctctgtagaaagaa

SEQ ID NO: 7160751 - DNA, 22 bp, Homo sapiens
atgcgagtgatgcagagtggct

SEQ ID NO: 7160752 - DNA, 22 bp, Homo sapiens
atgccttttcgggtacttctct

SEQ ID NO: 7160753 - DNA, 22 bp, Homo sapiens
atgcctttttatcatggatgat

SEQ ID NO: 7160754 - DNA, 22 bp, Homo sapiens
atgccttttccatctcaggcag

SEQ ID NO: 7160755 - DNA, 22 bp, Homo sapiens
atgcctgtgggaaaaacttgtt

SEQ ID NO: 7160756 - DNA, 19 bp, Homo sapiens
atgcctgttgattagttac

SEQ ID NO: 7160757 - DNA, 19 bp, Homo sapiens
atgcctgttgattagttac

SEQ ID NO: 7160758 - DNA, 22 bp, Homo sapiens
atgcctgtttgaaattggacct

SEQ ID NO: 7160759 - DNA, 22 bp, Homo sapiens
atgcctgtttgaaattggacct

SEQ ID NO: 7160760 - DNA, 22 bp, Homo sapiens
atgccttaaggcgagatactta

SEQ ID NO: 7160761 - DNA, 22 bp, Homo sapiens
atgcctgtaatcccagtgcttt

SEQ ID NO: 7160762 - DNA, 22 bp, Homo sapiens
atgcctgtaattccagcatttt

SEQ ID NO: 7160763 - DNA, 22 bp, Homo sapiens
atgcctgtaattccagcatttt

SEQ ID NO: 7160764 - DNA, 22 bp, Homo sapiens
atgcctgtaattccagcatttt

SEQ ID NO: 7160765 - DNA, 22 bp, Homo sapiens
atgcctgtaattccagcatttt

SEQ ID NO: 7160766 - DNA, 22 bp, Homo sapiens
atgcctgtctcagggtctgttt

SEQ ID NO: 7160767 - DNA, 22 bp, Homo sapiens
atgcctgtctcagggtctgttt

SEQ ID NO: 7160768 - DNA, 22 bp, Homo sapiens
atgcctgtgctatattctcaca

SEQ ID NO: 7160769 - DNA, 22 bp, Homo sapiens
atgcctgtgctatattctcaca

SEQ ID NO: 7160770 - DNA, 22 bp, Homo sapiens
atgcctgtgctatattctcaca

SEQ ID NO: 7160771 - DNA, 22 bp, Homo sapiens
atgcctgtgctatattctcaca

SEQ ID NO: 7160772 - DNA, 22 bp, Homo sapiens
atgcctgtggagatatttaagg

SEQ ID NO: 7160773 - DNA, 22 bp, Homo sapiens
atgcctgtggagatatttaagg

SEQ ID NO: 7160774 - DNA, 22 bp, Homo sapiens
atgcctgtggagatatttaagg

SEQ ID NO: 7160775 - DNA, 22 bp, Homo sapiens
atgcctgtgggaaaaacttgtt

SEQ ID NO: 7160776 - DNA, 22 bp, Homo sapiens
atgcctggtcccacctctaggt

SEQ ID NO: 7160777 - DNA, 22 bp, Homo sapiens
atgcctggtcccacctctaggt

SEQ ID NO: 7160778 - DNA, 22 bp, Homo sapiens
atgcctggtcccacctctaggt

SEQ ID NO: 7160779 - DNA, 22 bp, Homo sapiens
atgcctggtcccacctctaggt

SEQ ID NO: 7160780 - DNA, 22 bp, Homo sapiens
atgcctgtaaaacagcacccag

SEQ ID NO: 7160781 - DNA, 22 bp, Homo sapiens
atgcctgtaaaacagcacccag

SEQ ID NO: 7160782 - DNA, 22 bp, Homo sapiens
atgcctgtaatcccagcacttt

SEQ ID NO: 7160783 - DNA, 22 bp, Homo sapiens
atgcctgtaatcccagcacttt

SEQ ID NO: 7160784 - DNA, 22 bp, Homo sapiens
atgcctgtaatcccagcacttt

SEQ ID NO: 7160785 - DNA, 22 bp, Homo sapiens
atgcctgtaatcccagtgcttt

SEQ ID NO: 7160786 - DNA, 22 bp, Homo sapiens
agacgagggcccccaggacagc

SEQ ID NO: 7160787 - DNA, 20 bp, Homo sapiens
agacctttataatacctcct

SEQ ID NO: 7160788 - DNA, 22 bp, Homo sapiens
agacgagggcccccaggacagc

SEQ ID NO: 7160789 - DNA, 22 bp, Homo sapiens
agacgagggcctggcacacagt

SEQ ID NO: 7160790 - DNA, 22 bp, Homo sapiens
atgcctggtatgaagcaaggaa

SEQ ID NO: 7160791 - DNA, 22 bp, Homo sapiens
atgcctggtatgaagcaaggaa

SEQ ID NO: 7160792 - DNA, 22 bp, Homo sapiens
atgcatattttctactatatcg

SEQ ID NO: 7160793 - DNA, 22 bp, Homo sapiens
atgcatattttctactatatcg

SEQ ID NO: 7160794 - DNA, 22 bp, Homo sapiens
atgcatattttctactatatcg

SEQ ID NO: 7160795 - DNA, 22 bp, Homo sapiens
atgcatattttctactatatcg

SEQ ID NO: 7160796 - DNA, 21 bp, Homo sapiens
atgcatattttaagttgtgtc

SEQ ID NO: 7160797 - DNA, 18 bp, Homo sapiens
atgcatattttaagttgt

SEQ ID NO: 7160798 - DNA, 21 bp, Homo sapiens
atgcatattttaagttgtgtc

SEQ ID NO: 7160799 - DNA, 21 bp, Homo sapiens
atgcatattttaagttgtgtc

SEQ ID NO: 7160800 - DNA, 18 bp, Homo sapiens
atgcatattttaagttgt

SEQ ID NO: 7160801 - DNA, 22 bp, Homo sapiens
atgcatatttcttgggcttacc

SEQ ID NO: 7160802 - DNA, 18 bp, Homo sapiens
atgcatattttaagttgt

SEQ ID NO: 7160803 - DNA, 18 bp, Homo sapiens
atgcatattttaagttgt

SEQ ID NO: 7160804 - DNA, 18 bp, Homo sapiens
atgcatattttaagttgt

SEQ ID NO: 7160805 - DNA, 18 bp, Homo sapiens
atgcatattttaagttgt

SEQ ID NO: 7160806 - DNA, 22 bp, Homo sapiens
atgcatatttcttgggcttacc

SEQ ID NO: 7160807 - DNA, 22 bp, Homo sapiens
atgcatatttcttggagcacct

SEQ ID NO: 7160808 - DNA, 22 bp, Homo sapiens
atgcatatttcttgggcttacc

SEQ ID NO: 7160809 - DNA, 22 bp, Homo sapiens
atgcatatttcttggagcacct

SEQ ID NO: 7160810 - DNA, 22 bp, Homo sapiens
atgcatatttcatgaatctttg

SEQ ID NO: 7160811 - DNA, 22 bp, Homo sapiens
atgcatatttcttggagcacct

SEQ ID NO: 7160812 - DNA, 22 bp, Homo sapiens
atgcatatttcatgaatctttg

SEQ ID NO: 7160813 - DNA, 22 bp, Homo sapiens
atgcatatttcatgaatctttg

SEQ ID NO: 7160814 - DNA, 22 bp, Homo sapiens
atgcatatttcatgaatctttg

SEQ ID NO: 7160815 - DNA, 22 bp, Homo sapiens
atgcatattgtcatttagtcct

SEQ ID NO: 7160816 - DNA, 22 bp, Homo sapiens
atgcatattggattagcagcca

SEQ ID NO: 7160817 - DNA, 22 bp, Homo sapiens
atgcatattgtcatttagtcct

SEQ ID NO: 7160818 - DNA, 22 bp, Homo sapiens
atgcatattgtcatttagtcct

SEQ ID NO: 7160819 - DNA, 22 bp, Homo sapiens
atgcatattgattatagattca

SEQ ID NO: 7160820 - DNA, 22 bp, Homo sapiens
atgcatattggattagcagcca

SEQ ID NO: 7160821 - DNA, 22 bp, Homo sapiens
atgcatattggattagcagcca

SEQ ID NO: 7160822 - DNA, 22 bp, Homo sapiens
atgcatattcttagcccctcct

SEQ ID NO: 7160823 - DNA, 22 bp, Homo sapiens
atgcatattcttagcccctcct

SEQ ID NO: 7160824 - DNA, 22 bp, Homo sapiens
atgcatattcttagcccctcct

SEQ ID NO: 7160825 - DNA, 22 bp, Homo sapiens
atgcatattgattatagattca

SEQ ID NO: 7160826 - DNA, 22 bp, Homo sapiens
atgcatattgattatagattca

SEQ ID NO: 7160827 - DNA, 22 bp, Homo sapiens
atgcatattgattatagattca

SEQ ID NO: 7160828 - DNA, 22 bp, Homo sapiens
atgcatattgattatagattca

SEQ ID NO: 7160829 - DNA, 22 bp, Homo sapiens
atgcatatgtgtgcacacgtgt

SEQ ID NO: 7160830 - DNA, 22 bp, Homo sapiens
atgcatatgtgtgcacacgtgt

SEQ ID NO: 7160831 - DNA, 22 bp, Homo sapiens
atgcatatgtacttgcatatgt

SEQ ID NO: 7160832 - DNA, 22 bp, Homo sapiens
atgcatatgtacttgcatatgt

SEQ ID NO: 7160833 - DNA, 22 bp, Homo sapiens
atgcatatgtgtgcacacgtgt

SEQ ID NO: 7160834 - DNA, 22 bp, Homo sapiens
atgcatatgtacccatgttctg

SEQ ID NO: 7160835 - DNA, 22 bp, Homo sapiens
atgcatatgtacccatgttctg

SEQ ID NO: 7160836 - DNA, 22 bp, Homo sapiens
atgcatatgtacccatgttctg

SEQ ID NO: 7160837 - DNA, 22 bp, Homo sapiens
atgcatatgtacccatgttctg

SEQ ID NO: 7160838 - DNA, 22 bp, Homo sapiens
atgcatatgtacttgcatatgt

SEQ ID NO: 7160839 - DNA, 22 bp, Homo sapiens
atgcatatgtacttgcatatgt

SEQ ID NO: 7160840 - DNA, 22 bp, Homo sapiens
atgcatatgtacttgcatatgt

SEQ ID NO: 7160841 - DNA, 22 bp, Homo sapiens
atgcatatgtacttgcatatgt

SEQ ID NO: 7160842 - DNA, 22 bp, Homo sapiens
atgcatcaccgagttgcccacc

SEQ ID NO: 7160843 - DNA, 22 bp, Homo sapiens
atgcatattttctgttggtgac

SEQ ID NO: 7160844 - DNA, 22 bp, Homo sapiens
atgcatattttctgttggtgac

SEQ ID NO: 7160845 - DNA, 22 bp, Homo sapiens
atgcatattttctactatatcg

SEQ ID NO: 7160846 - DNA, 22 bp, Homo sapiens
atgcatattttctactatatcg

SEQ ID NO: 7160847 - DNA, 22 bp, Homo sapiens
atgcatattttctgttggtgac

SEQ ID NO: 7160848 - DNA, 22 bp, Homo sapiens
atgcatttgtaaaatataatcg

SEQ ID NO: 7160849 - DNA, 23 bp, Homo sapiens
atgcatcatgaaaactagagagc

SEQ ID NO: 7160850 - DNA, 22 bp, Homo sapiens
atgcatttgtaaaatataatcg

SEQ ID NO: 7160851 - DNA, 22 bp, Homo sapiens
atgcatttgtaaaatataatcg

SEQ ID NO: 7160852 - DNA, 22 bp, Homo sapiens
atgcatttttgagtatgaatga

SEQ ID NO: 7160853 - DNA, 22 bp, Homo sapiens
atgcatttttgagtatgaatga

SEQ ID NO: 7160854 - DNA, 22 bp, Homo sapiens
atgccaaaatgttacatttctt

SEQ ID NO: 7160855 - DNA, 22 bp, Homo sapiens
atgccaaagcccaagttcatca

SEQ ID NO: 7160856 - DNA, 22 bp, Homo sapiens
atgccaaagggagcactttggg

SEQ ID NO: 7160857 - DNA, 22 bp, Homo sapiens
atgccaaattctactttcagca

SEQ ID NO: 7160858 - DNA, 22 bp, Homo sapiens
atgatacatcttcatgtcagtg

SEQ ID NO: 7160859 - DNA, 22 bp, Homo sapiens
agacagacatagaaattagtaa

SEQ ID NO: 7160860 - DNA, 22 bp, Homo sapiens
agacagacatagaaattagtaa

SEQ ID NO: 7160861 - DNA, 22 bp, Homo sapiens
agacagacagagaatttaaata

SEQ ID NO: 7160862 - DNA, 18 bp, Homo sapiens
agacagacaggtttgtgc

SEQ ID NO: 7160863 - DNA, 18 bp, Homo sapiens
agacagacaggtttgtgc

SEQ ID NO: 7160864 - DNA, 15 bp, Homo sapiens
agacagacagtggga

SEQ ID NO: 7160865 - DNA, 22 bp, Homo sapiens
atgatacattgcaaaattttaa

SEQ ID NO: 7160866 - DNA, 22 bp, Homo sapiens
atgatacattgcaaaattttaa

SEQ ID NO: 7160867 - DNA, 22 bp, Homo sapiens
atgatacatcttgtttatttca

SEQ ID NO: 7160868 - DNA, 20 bp, Homo sapiens
agacagaatcagagataaag

SEQ ID NO: 7160869 - DNA, 20 bp, Homo sapiens
agacagaatcagagataaag

SEQ ID NO: 7160870 - DNA, 20 bp, Homo sapiens
agacagaatcagagataaag

SEQ ID NO: 7160871 - DNA, 22 bp, Homo sapiens
agacagaatttgtcagataaat

SEQ ID NO: 7160872 - DNA, 22 bp, Homo sapiens
agacagaatttgtcagataaat

SEQ ID NO: 7160873 - DNA, 22 bp, Homo sapiens
agacagaatttgtcagataaat

SEQ ID NO: 7160874 - DNA, 22 bp, Homo sapiens
agacagaatttgtcagataaat

SEQ ID NO: 7160875 - DNA, 22 bp, Homo sapiens
agacagaatttgtcagataaat

SEQ ID NO: 7160876 - DNA, 22 bp, Homo sapiens
agacagaatttgtcagataaat

SEQ ID NO: 7160877 - DNA, 22 bp, Homo sapiens
agacagaatttgtcagataaat

SEQ ID NO: 7160878 - DNA, 22 bp, Homo sapiens
agacagacaaaattcctgcctg

SEQ ID NO: 7160879 - DNA, 22 bp, Homo sapiens
agacagacacatggtaacagat

SEQ ID NO: 7160880 - DNA, 22 bp, Homo sapiens
agacagacacatggtaacagat

SEQ ID NO: 7160881 - DNA, 22 bp, Homo sapiens
agacagacagagaatttaaata

SEQ ID NO: 7160882 - DNA, 22 bp, Homo sapiens
atgatatacttcctagaacagt

SEQ ID NO: 7160883 - DNA, 22 bp, Homo sapiens
atgatatacttcctagaacagt

SEQ ID NO: 7160884 - DNA, 22 bp, Homo sapiens
atgatatacttcctagaacagt

SEQ ID NO: 7160885 - DNA, 22 bp, Homo sapiens
atgatatacttcctagaacagt

SEQ ID NO: 7160886 - DNA, 22 bp, Homo sapiens
atgatacatttacctatggtct

SEQ ID NO: 7160887 - DNA, 22 bp, Homo sapiens
atgatactctaggtgatttaca

SEQ ID NO: 7160888 - DNA, 22 bp, Homo sapiens
atgatactctaggtgatttaca

SEQ ID NO: 7160889 - DNA, 21 bp, Homo sapiens
atgatactgaagcacaactat

SEQ ID NO: 7160890 - DNA, 22 bp, Homo sapiens
atgcatatgtacccatgttctg

SEQ ID NO: 7160891 - DNA, 22 bp, Homo sapiens
atgcatatggcttgagggaata

SEQ ID NO: 7160892 - DNA, 22 bp, Homo sapiens
atgcaggttgggcaagtgtggg

SEQ ID NO: 7160893 - DNA, 22 bp, Homo sapiens
atgcatatggcttgagggaata

SEQ ID NO: 7160894 - DNA, 22 bp, Homo sapiens
atgcatatggcttgagggaata

SEQ ID NO: 7160895 - DNA, 17 bp, Homo sapiens
atgcaggtgtgaggggc

SEQ ID NO: 7160896 - DNA, 22 bp, Homo sapiens
atgcaggtatattttattaaag

SEQ ID NO: 7160897 - DNA, 22 bp, Homo sapiens
atgatatagagagtagattaaa

SEQ ID NO: 7160898 - DNA, 22 bp, Homo sapiens
atgcagggttctgggctagaga

SEQ ID NO: 7160899 - DNA, 22 bp, Homo sapiens
atgcagggttctgggctagaga

SEQ ID NO: 7160900 - DNA, 22 bp, Homo sapiens
atgcagggttctgggctagaga

SEQ ID NO: 7160901 - DNA, 22 bp, Homo sapiens
agactttaatgtgcaaatgaaa

SEQ ID NO: 7160902 - DNA, 22 bp, Homo sapiens
agactttaatgtgcaaatgaaa

SEQ ID NO: 7160903 - DNA, 22 bp, Homo sapiens
agacttgggacctaggaatgga

SEQ ID NO: 7160904 - DNA, 22 bp, Homo sapiens
agacttctctccttgacttgca

SEQ ID NO: 7160905 - DNA, 22 bp, Homo sapiens
agacttctctccttgacttgca

SEQ ID NO: 7160906 - DNA, 22 bp, Homo sapiens
agacttctcttggctatattat

SEQ ID NO: 7160907 - DNA, 22 bp, Homo sapiens
agacttctcttggctatattat

SEQ ID NO: 7160908 - DNA, 22 bp, Homo sapiens
agacttctcttggctatattat

SEQ ID NO: 7160909 - DNA, 22 bp, Homo sapiens
agacttctcttggctatattat

SEQ ID NO: 7160910 - DNA, 22 bp, Homo sapiens
agacttcttgagctggcacttc

SEQ ID NO: 7160911 - DNA, 22 bp, Homo sapiens
agacttctttgtgagcattttc

SEQ ID NO: 7160912 - DNA, 22 bp, Homo sapiens
agacttctttgtgagcattttc

SEQ ID NO: 7160913 - DNA, 22 bp, Homo sapiens
agacttgatgttaaaagaaact

SEQ ID NO: 7160914 - DNA, 22 bp, Homo sapiens
agacttgatgttaaaagaaact

SEQ ID NO: 7160915 - DNA, 22 bp, Homo sapiens
agacttgggacctaggaatgga

SEQ ID NO: 7160916 - DNA, 22 bp, Homo sapiens
agactttagaatcagatagcct

SEQ ID NO: 7160917 - DNA, 22 bp, Homo sapiens
agactttataaatcttaatttc

SEQ ID NO: 7160918 - DNA, 22 bp, Homo sapiens
agactgtgagaagatggctgcg

SEQ ID NO: 7160919 - DNA, 22 bp, Homo sapiens
agactgtgagaagatggctgcg

SEQ ID NO: 7160920 - DNA, 22 bp, Homo sapiens
agactgtgagaagatggctgcg

SEQ ID NO: 7160921 - DNA, 22 bp, Homo sapiens
agactgtgccacacatgggagt

SEQ ID NO: 7160922 - DNA, 21 bp, Homo sapiens
agactgtggattttgacatgt

SEQ ID NO: 7160923 - DNA, 22 bp, Homo sapiens
agactgttgcctgaacttagcc

SEQ ID NO: 7160924 - DNA, 22 bp, Homo sapiens
agacttaatagaagcatgacat

SEQ ID NO: 7160925 - DNA, 20 bp, Homo sapiens
agacttaggcaatttaggct

SEQ ID NO: 7160926 - DNA, 22 bp, Homo sapiens
agacttcaaagcctttgttcat

SEQ ID NO: 7160927 - DNA, 22 bp, Homo sapiens
agacttcaaagcctttgttcat

SEQ ID NO: 7160928 - DNA, 22 bp, Homo sapiens
agacttcactcccagagattct

SEQ ID NO: 7160929 - DNA, 21 bp, Homo sapiens
agacttccatcctgagagagg

SEQ ID NO: 7160930 - DNA, 22 bp, Homo sapiens
agacttctaaatagcagcttct

SEQ ID NO: 7160931 - DNA, 21 bp, Homo sapiens
agacttctagaagtgagatag

SEQ ID NO: 7160932 - DNA, 22 bp, Homo sapiens
agacttctcagttttattagta

SEQ ID NO: 7160933 - DNA, 22 bp, Homo sapiens
agacttctataaatttgggaat

SEQ ID NO: 7160934 - DNA, 23 bp, Homo sapiens
agacttctccaacaagcttggct

SEQ ID NO: 7160935 - DNA, 22 bp, Homo sapiens
agagaagggtgtagcctgggcc

SEQ ID NO: 7160936 - DNA, 22 bp, Homo sapiens
agagaaggtcactaaggaccca

SEQ ID NO: 7160937 - DNA, 22 bp, Homo sapiens
agagaagggtgtagcctgggcc

SEQ ID NO: 7160938 - DNA, 22 bp, Homo sapiens
agagaagggtgtagcctgggcc

SEQ ID NO: 7160939 - DNA, 22 bp, Homo sapiens
agagaaggtcactaaggaccca

SEQ ID NO: 7160940 - DNA, 22 bp, Homo sapiens
agagaaggtcactaaggaccca

SEQ ID NO: 7160941 - DNA, 22 bp, Homo sapiens
agagaaggtcactaaggaccca

SEQ ID NO: 7160942 - DNA, 22 bp, Homo sapiens
agagaatcctctacatgttttt

SEQ ID NO: 7160943 - DNA, 23 bp, Homo sapiens
agagaatcatggaaactctttct

SEQ ID NO: 7160944 - DNA, 22 bp, Homo sapiens
agagaatccccagacagagtta

SEQ ID NO: 7160945 - DNA, 22 bp, Homo sapiens
agagaatacaaagaagatatgt

SEQ ID NO: 7160946 - DNA, 22 bp, Homo sapiens
agagaatacagggtaacaggaa

SEQ ID NO: 7160947 - DNA, 22 bp, Homo sapiens
agagaatacaaagaagatatgt

SEQ ID NO: 7160948 - DNA, 22 bp, Homo sapiens
agagaagtgagcttgttcactc

SEQ ID NO: 7160949 - DNA, 22 bp, Homo sapiens
agagaagtgagcttgttcactc

SEQ ID NO: 7160950 - DNA, 19 bp, Homo sapiens
agagaaggatcctatggtt

SEQ ID NO: 7160951 - DNA, 19 bp, Homo sapiens
agagaaggatcctatggtt

SEQ ID NO: 7160952 - DNA, 22 bp, Homo sapiens
agagaaaagagttcaggctttg

SEQ ID NO: 7160953 - DNA, 22 bp, Homo sapiens
agagaaaagagttcaggctttg

SEQ ID NO: 7160954 - DNA, 19 bp, Homo sapiens
agagaaggatcctatggtt

SEQ ID NO: 7160955 - DNA, 22 bp, Homo sapiens
agagaaggggtaaagagtcctg

SEQ ID NO: 7160956 - DNA, 22 bp, Homo sapiens
agagaaggggtaaagagtcctg

SEQ ID NO: 7160957 - DNA, 22 bp, Homo sapiens
agagaaggggtaaagagtcctg

SEQ ID NO: 7160958 - DNA, 22 bp, Homo sapiens
agagaagggtagcccattctcc

SEQ ID NO: 7160959 - DNA, 22 bp, Homo sapiens
agagaagggtagcccattctcc

SEQ ID NO: 7160960 - DNA, 22 bp, Homo sapiens
agagaagggtagcccattctcc

SEQ ID NO: 7160961 - DNA, 22 bp, Homo sapiens
agagaagggtagcccattctcc

SEQ ID NO: 7160962 - DNA, 22 bp, Homo sapiens
agagaagggtgtagcctgggcc

SEQ ID NO: 7160963 - DNA, 22 bp, Homo sapiens
agagaagggtgtagcctgggcc

SEQ ID NO: 7160964 - DNA, 22 bp, Homo sapiens
agagaagggtgtagcctgggcc

SEQ ID NO: 7160965 - DNA, 22 bp, Homo sapiens
agagaaaactcattgaggtgtc

SEQ ID NO: 7160966 - DNA, 22 bp, Homo sapiens
agagaaaactcattgaggtgtc

SEQ ID NO: 7160967 - DNA, 22 bp, Homo sapiens
agagaaaactcattgaggtgtc

SEQ ID NO: 7160968 - DNA, 22 bp, Homo sapiens
agagaaaactcattgaggtgtc

SEQ ID NO: 7160969 - DNA, 22 bp, Homo sapiens
agagaaaagagttcaggctttg

SEQ ID NO: 7160970 - DNA, 18 bp, Homo sapiens
agactttgagttagaggg

SEQ ID NO: 7160971 - DNA, 19 bp, Homo sapiens
agacttttgtaagttgaga

SEQ ID NO: 7160972 - DNA, 19 bp, Homo sapiens
agacttttgtaagttgaga

SEQ ID NO: 7160973 - DNA, 23 bp, Homo sapiens
agagaaaaatatctgggcacatt

SEQ ID NO: 7160974 - DNA, 23 bp, Homo sapiens
agagaaaaatatctgggcacatt

SEQ ID NO: 7160975 - DNA, 23 bp, Homo sapiens
agagaaaaatatctgggcacatt

SEQ ID NO: 7160976 - DNA, 23 bp, Homo sapiens
agagaaaaatatctgggcacatt

SEQ ID NO: 7160977 - DNA, 23 bp, Homo sapiens
agagaaaaatatctgggcacatt

SEQ ID NO: 7160978 - DNA, 21 bp, Homo sapiens
agagagaaggccatatggtcc

SEQ ID NO: 7160979 - DNA, 22 bp, Homo sapiens
agagagaagcaatcagtggcca

SEQ ID NO: 7160980 - DNA, 22 bp, Homo sapiens
agagagcatggcacagaggggt

SEQ ID NO: 7160981 - DNA, 22 bp, Homo sapiens
agagagcatggcacagaggggt

SEQ ID NO: 7160982 - DNA, 22 bp, Homo sapiens
agagagcatggcacagaggggt

SEQ ID NO: 7160983 - DNA, 22 bp, Homo sapiens
agagagcattgaggaaatcttc

SEQ ID NO: 7160984 - DNA, 22 bp, Homo sapiens
agagagcccgggccagggcaca

SEQ ID NO: 7160985 - DNA, 22 bp, Homo sapiens
agagagaagcaatcagtggcca

SEQ ID NO: 7160986 - DNA, 21 bp, Homo sapiens
agagacagagaaagtaacatt

SEQ ID NO: 7160987 - DNA, 21 bp, Homo sapiens
agagacagagaaagtaacatt

SEQ ID NO: 7160988 - DNA, 21 bp, Homo sapiens
agagacagagaaagtaacatt

SEQ ID NO: 7160989 - DNA, 21 bp, Homo sapiens
agagacagagaaagtaacatt

SEQ ID NO: 7160990 - DNA, 21 bp, Homo sapiens
agagacagagaaagtaacatt

SEQ ID NO: 7160991 - DNA, 21 bp, Homo sapiens
agagacagagaaagtaacatt

SEQ ID NO: 7160992 - DNA, 22 bp, Homo sapiens
agagacagacacatcgggctgc

SEQ ID NO: 7160993 - DNA, 22 bp, Homo sapiens
agagacagacacatcgggctgc

SEQ ID NO: 7160994 - DNA, 22 bp, Homo sapiens
agagacagacacatcgggctgc

SEQ ID NO: 7160995 - DNA, 22 bp, Homo sapiens
agagacaaacactgcaacttct

SEQ ID NO: 7160996 - DNA, 22 bp, Homo sapiens
agagacaagggacctctggaga

SEQ ID NO: 7160997 - DNA, 22 bp, Homo sapiens
agagacaatgccaatgcacacg

SEQ ID NO: 7160998 - DNA, 22 bp, Homo sapiens
agagacaatgccaatgcacacg

SEQ ID NO: 7160999 - DNA, 22 bp, Homo sapiens
agagacaatgccaatgcacacg

SEQ ID NO: 7161000 - DNA, 22 bp, Homo sapiens
agagacaatgccaatgcacacg

SEQ ID NO: 7161001 - DNA, 19 bp, Homo sapiens
agagacacaggtaagtagg

SEQ ID NO: 7161002 - DNA, 22 bp, Homo sapiens
agagacacatcatataagtata

SEQ ID NO: 7161003 - DNA, 22 bp, Homo sapiens
agagacacatcatataagtata

SEQ ID NO: 7161004 - DNA, 22 bp, Homo sapiens
agagacaccgcgcatcatggct

SEQ ID NO: 7161005 - DNA, 21 bp, Homo sapiens
agagaattgccttagatgttc

SEQ ID NO: 7161006 - DNA, 21 bp, Homo sapiens
agagaattgccttagatgttc

SEQ ID NO: 7161007 - DNA, 22 bp, Homo sapiens
agagaattggagcagtgacagg

SEQ ID NO: 7161008 - DNA, 22 bp, Homo sapiens
agagaattttaaaagccttgaa

SEQ ID NO: 7161009 - DNA, 22 bp, Homo sapiens
agagaattacagaagaatgtca

SEQ ID NO: 7161010 - DNA, 22 bp, Homo sapiens
agagaattacagaagaatgtca

SEQ ID NO: 7161011 - DNA, 22 bp, Homo sapiens
agagaattctggtgctaacaag

SEQ ID NO: 7161012 - DNA, 22 bp, Homo sapiens
agagagctgactttggagtcag

SEQ ID NO: 7161013 - DNA, 22 bp, Homo sapiens
agagagctgtcctgggacaccc

SEQ ID NO: 7161014 - DNA, 22 bp, Homo sapiens
agagagctgtcctgggacaccc

SEQ ID NO: 7161015 - DNA, 22 bp, Homo sapiens
agagagctctggctgggtgacc

SEQ ID NO: 7161016 - DNA, 22 bp, Homo sapiens
agagagctctggctgggtgacc

SEQ ID NO: 7161017 - DNA, 22 bp, Homo sapiens
agagagctgactttggagtcag

SEQ ID NO: 7161018 - DNA, 22 bp, Homo sapiens
agagagcccgggccagggcaca

SEQ ID NO: 7161019 - DNA, 22 bp, Homo sapiens
agagagcccgggccagggcaca

SEQ ID NO: 7161020 - DNA, 23 bp, Homo sapiens
agagagctcactatatagcattg

SEQ ID NO: 7161021 - DNA, 22 bp, Homo sapiens
agagagctctgatgggaggtga

SEQ ID NO: 7161022 - DNA, 22 bp, Homo sapiens
agagagctctgatgggaggtga

SEQ ID NO: 7161023 - DNA, 22 bp, Homo sapiens
agagagcttccattctagtgat

SEQ ID NO: 7161024 - DNA, 22 bp, Homo sapiens
agagaggatttgtttttctcct

SEQ ID NO: 7161025 - DNA, 22 bp, Homo sapiens
agagaggatttgtttttctcct

SEQ ID NO: 7161026 - DNA, 22 bp, Homo sapiens
agagaggcattcggtgatccca

SEQ ID NO: 7161027 - DNA, 22 bp, Homo sapiens
agagaggcgagttacctgtgct

SEQ ID NO: 7161028 - DNA, 22 bp, Homo sapiens
agagaggcgagttacctgtgct

SEQ ID NO: 7161029 - DNA, 22 bp, Homo sapiens
agagaggcgagttacctgtgct

SEQ ID NO: 7161030 - DNA, 22 bp, Homo sapiens
agagaggctgctggactatatg

SEQ ID NO: 7161031 - DNA, 22 bp, Homo sapiens
agagagggcatagaaaaaggga

SEQ ID NO: 7161032 - DNA, 22 bp, Homo sapiens
agagagggcatagaaaaaggga

SEQ ID NO: 7161033 - DNA, 22 bp, Homo sapiens
agagagggcatagaaaaaggga

SEQ ID NO: 7161034 - DNA, 22 bp, Homo sapiens
agagagggcatagaaaaaggga

SEQ ID NO: 7161035 - DNA, 22 bp, Homo sapiens
agagagggcatagaaaaaggga

SEQ ID NO: 7161036 - DNA, 22 bp, Homo sapiens
agagaggttggctaggatgttt

SEQ ID NO: 7161037 - DNA, 22 bp, Homo sapiens
agagaggttggctaggatgttt

SEQ ID NO: 7161038 - DNA, 21 bp, Homo sapiens
agagagggagatgaaacatcc

SEQ ID NO: 7161039 - DNA, 22 bp, Homo sapiens
agagagggcatagaaaaaggga

SEQ ID NO: 7161040 - DNA, 21 bp, Homo sapiens
agagagggagatgaaacatcc

SEQ ID NO: 7161041 - DNA, 21 bp, Homo sapiens
agagagggagatgaaacatcc

SEQ ID NO: 7161042 - DNA, 21 bp, Homo sapiens
agagagggagatgaaacatcc

SEQ ID NO: 7161043 - DNA, 22 bp, Homo sapiens
agagagggaatatttggggtat

SEQ ID NO: 7161044 - DNA, 21 bp, Homo sapiens
agagagggagatgaaacatcc

SEQ ID NO: 7161045 - DNA, 21 bp, Homo sapiens
agagagggagatgaaacatcc

SEQ ID NO: 7161046 - DNA, 21 bp, Homo sapiens
agagagggagatgaaacatcc

SEQ ID NO: 7161047 - DNA, 22 bp, Homo sapiens
agagagggaatatttggggtat

SEQ ID NO: 7161048 - DNA, 19 bp, Homo sapiens
agagaggctgtgtgaggga

SEQ ID NO: 7161049 - DNA, 19 bp, Homo sapiens
agagaggctgtgtgaggga

SEQ ID NO: 7161050 - DNA, 22 bp, Homo sapiens
agagagggaatatttggggtat

SEQ ID NO: 7161051 - DNA, 22 bp, Homo sapiens
agagagggaatatttggggtat

SEQ ID NO: 7161052 - DNA, 22 bp, Homo sapiens
agagaggctgctggactatatg

SEQ ID NO: 7161053 - DNA, 22 bp, Homo sapiens
agagaggctgggcgtagggctt

SEQ ID NO: 7161054 - DNA, 19 bp, Homo sapiens
agagaggctgtgtgaggga

SEQ ID NO: 7161055 - DNA, 19 bp, Homo sapiens
agagaggctgtgtgaggga

SEQ ID NO: 7161056 - DNA, 22 bp, Homo sapiens
agagctggcagcagcttctcct

SEQ ID NO: 7161057 - DNA, 22 bp, Homo sapiens
agagctggcagcagcttctcct

SEQ ID NO: 7161058 - DNA, 22 bp, Homo sapiens
agagctggcactgaccctcacc

SEQ ID NO: 7161059 - DNA, 22 bp, Homo sapiens
agagctggcagcagcttctcct

SEQ ID NO: 7161060 - DNA, 22 bp, Homo sapiens
agagctggatggtcaagatggc

SEQ ID NO: 7161061 - DNA, 22 bp, Homo sapiens
agagctggatggtcaagatggc

SEQ ID NO: 7161062 - DNA, 22 bp, Homo sapiens
agagctggaatcagacctcagg

SEQ ID NO: 7161063 - DNA, 22 bp, Homo sapiens
agagctgaattcaagtgctggc

SEQ ID NO: 7161064 - DNA, 22 bp, Homo sapiens
agagctggacgtctgagcccta

SEQ ID NO: 7161065 - DNA, 22 bp, Homo sapiens
agagctggagatgcaggtttcg

SEQ ID NO: 7161066 - DNA, 22 bp, Homo sapiens
agagctggagcagccccactgg

SEQ ID NO: 7161067 - DNA, 22 bp, Homo sapiens
agagctggccagggatcactct

SEQ ID NO: 7161068 - DNA, 22 bp, Homo sapiens
agagctggccagggatcactct

SEQ ID NO: 7161069 - DNA, 22 bp, Homo sapiens
agagctggccagggatcactct

SEQ ID NO: 7161070 - DNA, 21 bp, Homo sapiens
agagctggcctgccaggccct

SEQ ID NO: 7161071 - DNA, 22 bp, Homo sapiens
agagctggctgctgcggtgctt

SEQ ID NO: 7161072 - DNA, 21 bp, Homo sapiens
agagctggcctgccaggccct

SEQ ID NO: 7161073 - DNA, 22 bp, Homo sapiens
agagctggctgtgggtgacttt

SEQ ID NO: 7161074 - DNA, 22 bp, Homo sapiens
agagctggctggtagccctgat

SEQ ID NO: 7161075 - DNA, 22 bp, Homo sapiens
agagctggctggtagccctgat

SEQ ID NO: 7161076 - DNA, 22 bp, Homo sapiens
agagctggctggtagccctgat

SEQ ID NO: 7161077 - DNA, 22 bp, Homo sapiens
agagcctgaggccctgagaggg

SEQ ID NO: 7161078 - DNA, 22 bp, Homo sapiens
agagcctgaggccctgagaggg

SEQ ID NO: 7161079 - DNA, 22 bp, Homo sapiens
agagcctgaggccctgagaggg

SEQ ID NO: 7161080 - DNA, 22 bp, Homo sapiens
agagcctgaggccctgagaggg

SEQ ID NO: 7161081 - DNA, 22 bp, Homo sapiens
agagcctgaggccctgagaggg

SEQ ID NO: 7161082 - DNA, 22 bp, Homo sapiens
agagcctgaggtctaacagggg

SEQ ID NO: 7161083 - DNA, 22 bp, Homo sapiens
agagcctgcagctgtgaagaaa

SEQ ID NO: 7161084 - DNA, 22 bp, Homo sapiens
agagctctttgatttgcttctc

SEQ ID NO: 7161085 - DNA, 22 bp, Homo sapiens
agagctgaaaaagctgacccgg

SEQ ID NO: 7161086 - DNA, 22 bp, Homo sapiens
agagcctgagcctgaaagccct

SEQ ID NO: 7161087 - DNA, 22 bp, Homo sapiens
agagcctgagcctgatcttgaa

SEQ ID NO: 7161088 - DNA, 22 bp, Homo sapiens
agagcctgaggatgtcccagct

SEQ ID NO: 7161089 - DNA, 22 bp, Homo sapiens
agagcctgaggccaggaaaatg

SEQ ID NO: 7161090 - DNA, 21 bp, Homo sapiens
agagcctgagatcttccagca

SEQ ID NO: 7161091 - DNA, 22 bp, Homo sapiens
agagcctgagaggataatgggg

SEQ ID NO: 7161092 - DNA, 22 bp, Homo sapiens
agagcctgagaggataatgggg

SEQ ID NO: 7161093 - DNA, 22 bp, Homo sapiens
agagcctgagcctgaaagccct

SEQ ID NO: 7161094 - DNA, 22 bp, Homo sapiens
agagccctgtggttctggtaag

SEQ ID NO: 7161095 - DNA, 22 bp, Homo sapiens
agagccctgcagttcttcagga

SEQ ID NO: 7161096 - DNA, 22 bp, Homo sapiens
agagcctctgtcatggagagaa

SEQ ID NO: 7161097 - DNA, 23 bp, Homo sapiens
agagcctgaaagacttctggcac

SEQ ID NO: 7161098 - DNA, 22 bp, Homo sapiens
agagccctgacggggacagatg

SEQ ID NO: 7161099 - DNA, 22 bp, Homo sapiens
agagccctgacggggacagatg

SEQ ID NO: 7161100 - DNA, 22 bp, Homo sapiens
agagccctcttcactgcccctt

SEQ ID NO: 7161101 - DNA, 22 bp, Homo sapiens
agagccctgaagcagagctaaa

SEQ ID NO: 7161102 - DNA, 22 bp, Homo sapiens
agagccctctcattggcttatt

SEQ ID NO: 7161103 - DNA, 22 bp, Homo sapiens
agagccctaaaccctgccttgg

SEQ ID NO: 7161104 - DNA, 22 bp, Homo sapiens
agagccctctgcaatgcctcag

SEQ ID NO: 7161105 - DNA, 22 bp, Homo sapiens
agagcagagggctctgggacaa

SEQ ID NO: 7161106 - DNA, 22 bp, Homo sapiens
agagcagagggctctgggacaa

SEQ ID NO: 7161107 - DNA, 22 bp, Homo sapiens
agagcagaggcatggccgtggg

SEQ ID NO: 7161108 - DNA, 22 bp, Homo sapiens
agagcagagggctctgggacaa

SEQ ID NO: 7161109 - DNA, 22 bp, Homo sapiens
agagcagagtggctgtagcttg

SEQ ID NO: 7161110 - DNA, 22 bp, Homo sapiens
agagcagagtggctgtagcttg

SEQ ID NO: 7161111 - DNA, 22 bp, Homo sapiens
agagcagatggagctggaagag

SEQ ID NO: 7161112 - DNA, 22 bp, Homo sapiens
agagcagatggagctggaagag

SEQ ID NO: 7161113 - DNA, 22 bp, Homo sapiens
agagcaccccgggaagagcaag

SEQ ID NO: 7161114 - DNA, 22 bp, Homo sapiens
agagcaccccgggaagagcaag

SEQ ID NO: 7161115 - DNA, 22 bp, Homo sapiens
agagcaccccgggaagagcaag

SEQ ID NO: 7161116 - DNA, 22 bp, Homo sapiens
agagcacagtatctgcacatca

SEQ ID NO: 7161117 - DNA, 22 bp, Homo sapiens
agagcacatggttcctgtgtcc

SEQ ID NO: 7161118 - DNA, 22 bp, Homo sapiens
agagcacatggttcctgtgtcc

SEQ ID NO: 7161119 - DNA, 22 bp, Homo sapiens
agagcaccaaggtggtttggac

SEQ ID NO: 7161120 - DNA, 22 bp, Homo sapiens
agagcacctttagtatgttacc

SEQ ID NO: 7161121 - DNA, 22 bp, Homo sapiens
agagcactgagtgagcaaggcc

SEQ ID NO: 7161122 - DNA, 22 bp, Homo sapiens
agagcactgcgccggctcggaa

SEQ ID NO: 7161123 - DNA, 22 bp, Homo sapiens
agagcactttcgagagccggag

SEQ ID NO: 7161124 - DNA, 22 bp, Homo sapiens
agagcagacatccttgtcttgt

SEQ ID NO: 7161125 - DNA, 22 bp, Homo sapiens
agagaggtttgctggaagattc

SEQ ID NO: 7161126 - DNA, 22 bp, Homo sapiens
agagagttctttctagttgaag

SEQ ID NO: 7161127 - DNA, 22 bp, Homo sapiens
agagagttgaggaagcaacact

SEQ ID NO: 7161128 - DNA, 22 bp, Homo sapiens
agagattggggatgaatctttc

SEQ ID NO: 7161129 - DNA, 22 bp, Homo sapiens
agagcacagccaccatttacaa

SEQ ID NO: 7161130 - DNA, 22 bp, Homo sapiens
agagcacaggctcaccattgtt

SEQ ID NO: 7161131 - DNA, 22 bp, Homo sapiens
agagcacaggctcaccattgtt

SEQ ID NO: 7161132 - DNA, 22 bp, Homo sapiens
agagcacaggctctggagtcta

SEQ ID NO: 7161133 - DNA, 22 bp, Homo sapiens
agagcacaggctctggagtcta

SEQ ID NO: 7161134 - DNA, 22 bp, Homo sapiens
agagcacaggctctggagtcta

SEQ ID NO: 7161135 - DNA, 22 bp, Homo sapiens
agagcacagggttttgtgccgg

SEQ ID NO: 7161136 - DNA, 22 bp, Homo sapiens
agagcacagggttttgtgccgg

SEQ ID NO: 7161137 - DNA, 22 bp, Homo sapiens
agagcacaggtgctggagccca

SEQ ID NO: 7161138 - DNA, 22 bp, Homo sapiens
agagcacaggtgctggagccca

SEQ ID NO: 7161139 - DNA, 21 bp, Homo sapiens
agagcacaggtggacaatgct

SEQ ID NO: 7161140 - DNA, 21 bp, Homo sapiens
agagcacaggtggacaatgct

SEQ ID NO: 7161141 - DNA, 21 bp, Homo sapiens
agagcacaggtggacaatgct

SEQ ID NO: 7161142 - DNA, 21 bp, Homo sapiens
agagcacaggtggacaatgct

SEQ ID NO: 7161143 - DNA, 22 bp, Homo sapiens
agagcacagtatctgcacatca

SEQ ID NO: 7161144 - DNA, 21 bp, Homo sapiens
agagcacaggtggacaatgct

SEQ ID NO: 7161145 - DNA, 22 bp, Homo sapiens
agagcacagtatctgcacatca

SEQ ID NO: 7161146 - DNA, 22 bp, Homo sapiens
agagcacagtatctgcacatca

SEQ ID NO: 7161147 - DNA, 22 bp, Homo sapiens
agagcacagtgcaggatccccg

SEQ ID NO: 7161148 - DNA, 22 bp, Homo sapiens
agagcagatggagctggaagag

SEQ ID NO: 7161149 - DNA, 22 bp, Homo sapiens
agagcagatggagctggaagag

SEQ ID NO: 7161150 - DNA, 22 bp, Homo sapiens
agagcagatggagctggaagag

SEQ ID NO: 7161151 - DNA, 22 bp, Homo sapiens
agagcagatggccagggggcct

SEQ ID NO: 7161152 - DNA, 22 bp, Homo sapiens
agagcagatttcaaatattggc

SEQ ID NO: 7161153 - DNA, 22 bp, Homo sapiens
agagcagatttcaaatattggc

SEQ ID NO: 7161154 - DNA, 20 bp, Homo sapiens
agagcagcagttggtgaggt

SEQ ID NO: 7161155 - DNA, 22 bp, Homo sapiens
agagcagcctcagctccctgtg

SEQ ID NO: 7161156 - DNA, 22 bp, Homo sapiens
agagccaggcaggcaatgttga

SEQ ID NO: 7161157 - DNA, 22 bp, Homo sapiens
agagcccctggtggagtgagaa

SEQ ID NO: 7161158 - DNA, 22 bp, Homo sapiens
agagcccctgggtcacacagcc

SEQ ID NO: 7161159 - DNA, 22 bp, Homo sapiens
agagcccctggtggagtgagaa

SEQ ID NO: 7161160 - DNA, 22 bp, Homo sapiens
agagcccatcagtggcagtgga

SEQ ID NO: 7161161 - DNA, 22 bp, Homo sapiens
agagcccatcagtggcagtgga

SEQ ID NO: 7161162 - DNA, 22 bp, Homo sapiens
agagcccatcagtggcagtgga

SEQ ID NO: 7161163 - DNA, 22 bp, Homo sapiens
agagcccatcagtggcagtgga

SEQ ID NO: 7161164 - DNA, 22 bp, Homo sapiens
agagcccagtctttgtgtgaag

SEQ ID NO: 7161165 - DNA, 22 bp, Homo sapiens
agagcccagtgacatcagcaca

SEQ ID NO: 7161166 - DNA, 22 bp, Homo sapiens
agagcccagtgacatcagcaca

SEQ ID NO: 7161167 - DNA, 22 bp, Homo sapiens
agagccaggccaggccggggca

SEQ ID NO: 7161168 - DNA, 22 bp, Homo sapiens
agagccaggccaggccggggca

SEQ ID NO: 7161169 - DNA, 22 bp, Homo sapiens
agagccaggccaggccggggca

SEQ ID NO: 7161170 - DNA, 22 bp, Homo sapiens
agagcccagaaagtatgtcata

SEQ ID NO: 7161171 - DNA, 22 bp, Homo sapiens
agagcccagaaagtatgtcata

SEQ ID NO: 7161172 - DNA, 20 bp, Homo sapiens
agagcccagatgtctgtatt

SEQ ID NO: 7161173 - DNA, 20 bp, Homo sapiens
agagcccagatgtctgtatt

SEQ ID NO: 7161174 - DNA, 22 bp, Homo sapiens
agagcccaggtcctggagaggg

SEQ ID NO: 7161175 - DNA, 22 bp, Homo sapiens
agagcccaggtcctggagaggg

SEQ ID NO: 7161176 - DNA, 22 bp, Homo sapiens
agagcccaggtcctggagaggg

SEQ ID NO: 7161177 - DNA, 22 bp, Homo sapiens
caaagcaagggctgaagactcc

SEQ ID NO: 7161178 - DNA, 22 bp, Homo sapiens
caaagcagacgcagtaagggta

SEQ ID NO: 7161179 - DNA, 22 bp, Homo sapiens
caaagcagacgcagtaagggta

SEQ ID NO: 7161180 - DNA, 22 bp, Homo sapiens
caaaggcaggtcatggccactt

SEQ ID NO: 7161181 - DNA, 22 bp, Homo sapiens
caaaggcaggtcatggccactt

SEQ ID NO: 7161182 - DNA, 22 bp, Homo sapiens
caaaggcaggtgctgaatattc

SEQ ID NO: 7161183 - DNA, 22 bp, Homo sapiens
caaagcaaggctcagtttgaac

SEQ ID NO: 7161184 - DNA, 22 bp, Homo sapiens
caaagcaaggctcagtttgaac

SEQ ID NO: 7161185 - DNA, 22 bp, Homo sapiens
caaagcaaggctcagtttgaac

SEQ ID NO: 7161186 - DNA, 22 bp, Homo sapiens
caaagcaaggctcagtttgaac

SEQ ID NO: 7161187 - DNA, 22 bp, Homo sapiens
caaagcaaggctcagtttgaac

SEQ ID NO: 7161188 - DNA, 22 bp, Homo sapiens
caaagcaagggctgaagactcc

SEQ ID NO: 7161189 - DNA, 22 bp, Homo sapiens
caaagcaagggctgaagactcc

SEQ ID NO: 7161190 - DNA, 22 bp, Homo sapiens
caaagcaagggctgaagactcc

SEQ ID NO: 7161191 - DNA, 22 bp, Homo sapiens
caaagcaagggctgaagactcc

SEQ ID NO: 7161192 - DNA, 17 bp, Homo sapiens
caaaccagtaagactgc

SEQ ID NO: 7161193 - DNA, 22 bp, Homo sapiens
caaaccagtaggaagtctatta

SEQ ID NO: 7161194 - DNA, 20 bp, Homo sapiens
agcaagagtaaggacagcga

SEQ ID NO: 7161195 - DNA, 20 bp, Homo sapiens
agcaagagtaaggacagcga

SEQ ID NO: 7161196 - DNA, 20 bp, Homo sapiens
agcaagagtgtacctggcca

SEQ ID NO: 7161197 - DNA, 22 bp, Homo sapiens
caaagataatcacagaataccc

SEQ ID NO: 7161198 - DNA, 22 bp, Homo sapiens
caaagataatcacagaataccc

SEQ ID NO: 7161199 - DNA, 22 bp, Homo sapiens
caaagataatcacagaataccc

SEQ ID NO: 7161200 - DNA, 22 bp, Homo sapiens
caaagataatcacagaataccc

SEQ ID NO: 7161201 - DNA, 22 bp, Homo sapiens
caaagatatgacatggaaaatg

SEQ ID NO: 7161202 - DNA, 22 bp, Homo sapiens
caaagatatgacatggaaaatg

SEQ ID NO: 7161203 - DNA, 22 bp, Homo sapiens
caaagatatgacatggaaaatg

SEQ ID NO: 7161204 - DNA, 23 bp, Homo sapiens
caaagatgattggaacatggctt

SEQ ID NO: 7161205 - DNA, 23 bp, Homo sapiens
caaagatgattggaacatggctt

SEQ ID NO: 7161206 - DNA, 22 bp, Homo sapiens
caaagatgccaaaaggaagaca

SEQ ID NO: 7161207 - DNA, 22 bp, Homo sapiens
caaagatgccaaaaggaagaca

SEQ ID NO: 7161208 - DNA, 22 bp, Homo sapiens
caaagatgccaaaaggaagaca

SEQ ID NO: 7161209 - DNA, 22 bp, Homo sapiens
caaagatgctgatgttggatca

SEQ ID NO: 7161210 - DNA, 22 bp, Homo sapiens
caaagatgctgatgttggatca

SEQ ID NO: 7161211 - DNA, 22 bp, Homo sapiens
caaagatgtcattggtaagaca

SEQ ID NO: 7161212 - DNA, 22 bp, Homo sapiens
agcaacttttctagacatggtc

SEQ ID NO: 7161213 - DNA, 22 bp, Homo sapiens
agcaagaaatcttcagtgttct

SEQ ID NO: 7161214 - DNA, 22 bp, Homo sapiens
agcaagaaatcttcagtgttct

SEQ ID NO: 7161215 - DNA, 22 bp, Homo sapiens
agcaactttggatagttgcagg

SEQ ID NO: 7161216 - DNA, 22 bp, Homo sapiens
agcaagaaatcttcagtgttct

SEQ ID NO: 7161217 - DNA, 20 bp, Homo sapiens
agcaagaacgttctgaggga

SEQ ID NO: 7161218 - DNA, 22 bp, Homo sapiens
agcaagaagctttgctgtgata

SEQ ID NO: 7161219 - DNA, 22 bp, Homo sapiens
agcaagaagctttgctgtgata

SEQ ID NO: 7161220 - DNA, 22 bp, Homo sapiens
agcaagaagctttgctgtgata

SEQ ID NO: 7161221 - DNA, 22 bp, Homo sapiens
agcaagaagctttgctgtgata

SEQ ID NO: 7161222 - DNA, 22 bp, Homo sapiens
agcaagaagggcaaggaagttt

SEQ ID NO: 7161223 - DNA, 22 bp, Homo sapiens
agcaagaatatttctgccactg

SEQ ID NO: 7161224 - DNA, 21 bp, Homo sapiens
agcaagaatcaggaaggctct

SEQ ID NO: 7161225 - DNA, 20 bp, Homo sapiens
agcaagagtaaggacagcga

SEQ ID NO: 7161226 - DNA, 20 bp, Homo sapiens
agcaagagtaaggacagcga

SEQ ID NO: 7161227 - DNA, 20 bp, Homo sapiens
agcaagagtaaggacagcga

SEQ ID NO: 7161228 - DNA, 20 bp, Homo sapiens
agcaagagtaaggacagcga

SEQ ID NO: 7161229 - DNA, 22 bp, Homo sapiens
agcaagagatttccctacctcc

SEQ ID NO: 7161230 - DNA, 22 bp, Homo sapiens
agcaagagatttccctacctcc

SEQ ID NO: 7161231 - DNA, 22 bp, Homo sapiens
agcaagagcatgtcggcctggt

SEQ ID NO: 7161232 - DNA, 22 bp, Homo sapiens
agcaagagcatgtcggcctggt

SEQ ID NO: 7161233 - DNA, 19 bp, Homo sapiens
agcaacctgggccaatgta

SEQ ID NO: 7161234 - DNA, 19 bp, Homo sapiens
agcaacctgggccaatgta

SEQ ID NO: 7161235 - DNA, 22 bp, Homo sapiens
agcaacctgccagtcactcagt

SEQ ID NO: 7161236 - DNA, 22 bp, Homo sapiens
agcaacctggatcatggtgaaa

SEQ ID NO: 7161237 - DNA, 19 bp, Homo sapiens
agcaacctgtcagagatgc

SEQ ID NO: 7161238 - DNA, 19 bp, Homo sapiens
agcaacctgtcagagatgc

SEQ ID NO: 7161239 - DNA, 19 bp, Homo sapiens
agcaacctgtcagagatgc

SEQ ID NO: 7161240 - DNA, 22 bp, Homo sapiens
agcaactagccaggatgcagag

SEQ ID NO: 7161241 - DNA, 22 bp, Homo sapiens
agcaactatattgaaagccacc

SEQ ID NO: 7161242 - DNA, 22 bp, Homo sapiens
agcaacctcatgagagtgaaat

SEQ ID NO: 7161243 - DNA, 17 bp, Homo sapiens
agcaacctcctcttcct

SEQ ID NO: 7161244 - DNA, 22 bp, Homo sapiens
agcaacctgccaccacaggcaa

SEQ ID NO: 7161245 - DNA, 22 bp, Homo sapiens
agcaacagtgtatatcataggc

SEQ ID NO: 7161246 - DNA, 22 bp, Homo sapiens
agcaacatatatcaatgcctga

SEQ ID NO: 7161247 - DNA, 22 bp, Homo sapiens
agcaacaggaccatggagccca

SEQ ID NO: 7161248 - DNA, 22 bp, Homo sapiens
agcaacaggaccatggagccca

SEQ ID NO: 7161249 - DNA, 22 bp, Homo sapiens
agcaacaggaccatggagccca

SEQ ID NO: 7161250 - DNA, 22 bp, Homo sapiens
agcaacagggggatggccactg

SEQ ID NO: 7161251 - DNA, 22 bp, Homo sapiens
agcaacagggggatggccactg

SEQ ID NO: 7161252 - DNA, 22 bp, Homo sapiens
agcaacagggggatggccactg

SEQ ID NO: 7161253 - DNA, 22 bp, Homo sapiens
agcaacagggtggtcttcagaa

SEQ ID NO: 7161254 - DNA, 22 bp, Homo sapiens
agcaacaggtttattatcttat

SEQ ID NO: 7161255 - DNA, 23 bp, Homo sapiens
agcaacagtgggtgagtgttgct

SEQ ID NO: 7161256 - DNA, 22 bp, Homo sapiens
agatgtggcctttgggagatta

SEQ ID NO: 7161257 - DNA, 22 bp, Homo sapiens
agatgtggcctttgggagatta

SEQ ID NO: 7161258 - DNA, 22 bp, Homo sapiens
agatgtggccggctagggagag

SEQ ID NO: 7161259 - DNA, 22 bp, Homo sapiens
agatgtggcctttgggagatta

SEQ ID NO: 7161260 - DNA, 22 bp, Homo sapiens
agatgtggcctttgggagatta

SEQ ID NO: 7161261 - DNA, 22 bp, Homo sapiens
agatgtggctgcacccaccgct

SEQ ID NO: 7161262 - DNA, 22 bp, Homo sapiens
agatgtgggagatgcttctgca

SEQ ID NO: 7161263 - DNA, 22 bp, Homo sapiens
agatgtggatcctagggtagaa

SEQ ID NO: 7161264 - DNA, 22 bp, Homo sapiens
agatgtggatcctagggtagaa

SEQ ID NO: 7161265 - DNA, 22 bp, Homo sapiens
agatgtggatcctagggtagaa

SEQ ID NO: 7161266 - DNA, 22 bp, Homo sapiens
agatgtggatgagtcgccgacc

SEQ ID NO: 7161267 - DNA, 22 bp, Homo sapiens
agatgtggccggctagggagag

SEQ ID NO: 7161268 - DNA, 22 bp, Homo sapiens
agatgtggccggctagggagag

SEQ ID NO: 7161269 - DNA, 22 bp, Homo sapiens
attttcaccctgaatatattga

SEQ ID NO: 7161270 - DNA, 22 bp, Homo sapiens
attttcaagggagaggcctctg

SEQ ID NO: 7161271 - DNA, 22 bp, Homo sapiens
attttcaccctgaatatattga

SEQ ID NO: 7161272 - DNA, 22 bp, Homo sapiens
attttcagcccccactcgtggc

SEQ ID NO: 7161273 - DNA, 22 bp, Homo sapiens
attttcagaacattcattcact

SEQ ID NO: 7161274 - DNA, 22 bp, Homo sapiens
attttcaccctgaatatattga

SEQ ID NO: 7161275 - DNA, 22 bp, Homo sapiens
attttcaaaacatctgctgtgt

SEQ ID NO: 7161276 - DNA, 22 bp, Homo sapiens
attttatctgcttactttcagg

SEQ ID NO: 7161277 - DNA, 22 bp, Homo sapiens
attttatgacacgattcttcca

SEQ ID NO: 7161278 - DNA, 22 bp, Homo sapiens
attttatccccactggattaca

SEQ ID NO: 7161279 - DNA, 22 bp, Homo sapiens
attttagttttagcatccatgc

SEQ ID NO: 7161280 - DNA, 22 bp, Homo sapiens
attttaaccctcttatatatac

SEQ ID NO: 7161281 - DNA, 22 bp, Homo sapiens
attttaaccctcttatatatac

SEQ ID NO: 7161282 - DNA, 22 bp, Homo sapiens
agatgggcgccctggactgagg

SEQ ID NO: 7161283 - DNA, 22 bp, Homo sapiens
attttagcaaatgcaagatgga

SEQ ID NO: 7161284 - DNA, 23 bp, Homo sapiens
attttagctgaatgacttcttta

SEQ ID NO: 7161285 - DNA, 22 bp, Homo sapiens
attttagtacctcaagtatcca

SEQ ID NO: 7161286 - DNA, 22 bp, Homo sapiens
attttagtacctcaagtatcca

SEQ ID NO: 7161287 - DNA, 22 bp, Homo sapiens
agatgtgggtgtcaggcagtga

SEQ ID NO: 7161288 - DNA, 22 bp, Homo sapiens
agatgtgggtgtcaggcagtga

SEQ ID NO: 7161289 - DNA, 22 bp, Homo sapiens
agatgtggtagttgaagggaag

SEQ ID NO: 7161290 - DNA, 22 bp, Homo sapiens
agatgtggttattctcttcctt

SEQ ID NO: 7161291 - DNA, 22 bp, Homo sapiens
agatgtgggagatgcttctgca

SEQ ID NO: 7161292 - DNA, 22 bp, Homo sapiens
agatgtgggcaaaaggcttagc

SEQ ID NO: 7161293 - DNA, 22 bp, Homo sapiens
agatgtgggcaatggaatggag

SEQ ID NO: 7161294 - DNA, 22 bp, Homo sapiens
agatgtgggcaatggaatggag

SEQ ID NO: 7161295 - DNA, 22 bp, Homo sapiens
agatgtgggcaatggaatggag

SEQ ID NO: 7161296 - DNA, 22 bp, Homo sapiens
agatgtgggtgtcaggcagtga

SEQ ID NO: 7161297 - DNA, 22 bp, Homo sapiens
agatgtgtttctagttcctgca

SEQ ID NO: 7161298 - DNA, 22 bp, Homo sapiens
agatgtgtttctagttcctgca

SEQ ID NO: 7161299 - DNA, 22 bp, Homo sapiens
agatgttatcattcagagtagc

SEQ ID NO: 7161300 - DNA, 18 bp, Homo sapiens
agatgttcaatatttctc

SEQ ID NO: 7161301 - DNA, 22 bp, Homo sapiens
agatgttccagccaatgggaat

SEQ ID NO: 7161302 - DNA, 22 bp, Homo sapiens
agatgttcctagatgcgtgggc

SEQ ID NO: 7161303 - DNA, 22 bp, Homo sapiens
agcaaagctgattaagagcaca

SEQ ID NO: 7161304 - DNA, 22 bp, Homo sapiens
agcaaatattttgttgaagtgc

SEQ ID NO: 7161305 - DNA, 22 bp, Homo sapiens
agcaaatcagctgctcaggaaa

SEQ ID NO: 7161306 - DNA, 19 bp, Homo sapiens
agcaacaccgtttatttcc

SEQ ID NO: 7161307 - DNA, 18 bp, Homo sapiens
agcaacagaaacatatgg

SEQ ID NO: 7161308 - DNA, 20 bp, Homo sapiens
agcaacaataaaatgtcctg

SEQ ID NO: 7161309 - DNA, 20 bp, Homo sapiens
agcaacaataaaatgtcctg

SEQ ID NO: 7161310 - DNA, 22 bp, Homo sapiens
agcaaattaggtcaaggagatg

SEQ ID NO: 7161311 - DNA, 22 bp, Homo sapiens
agcaaattcagaagcagaatgg

SEQ ID NO: 7161312 - DNA, 22 bp, Homo sapiens
agcaaatcagctgctcaggaaa

SEQ ID NO: 7161313 - DNA, 22 bp, Homo sapiens
agcaaatctatgaatgtatatt

SEQ ID NO: 7161314 - DNA, 22 bp, Homo sapiens
agcaaatggatttctgaaccta

SEQ ID NO: 7161315 - DNA, 22 bp, Homo sapiens
agcaaatgggtttatatttgac

SEQ ID NO: 7161316 - DNA, 22 bp, Homo sapiens
agcaacagaagatagagtgaat

SEQ ID NO: 7161317 - DNA, 22 bp, Homo sapiens
agcaacagcaacgacatttctc

SEQ ID NO: 7161318 - DNA, 22 bp, Homo sapiens
agcaacagcaggtttgcactcc

SEQ ID NO: 7161319 - DNA, 22 bp, Homo sapiens
agcaacagccctgaggttcatg

SEQ ID NO: 7161320 - DNA, 22 bp, Homo sapiens
agcaacaggaaatagctgatta

SEQ ID NO: 7161321 - DNA, 22 bp, Homo sapiens
agcaacaggaaatagctgatta

SEQ ID NO: 7161322 - DNA, 22 bp, Homo sapiens
agcaacaggaaatagctgatta

SEQ ID NO: 7161323 - DNA, 22 bp, Homo sapiens
agcaacaggaaatagctgatta

SEQ ID NO: 7161324 - DNA, 22 bp, Homo sapiens
agagtggagagaaacaactctg

SEQ ID NO: 7161325 - DNA, 22 bp, Homo sapiens
agagtgcttagtagtgacatgg

SEQ ID NO: 7161326 - DNA, 21 bp, Homo sapiens
agagtggcaaagtgtccaaga

SEQ ID NO: 7161327 - DNA, 22 bp, Homo sapiens
agagtggcagcaaaaagtgtgc

SEQ ID NO: 7161328 - DNA, 22 bp, Homo sapiens
agagtggcagcaagtcaggtag

SEQ ID NO: 7161329 - DNA, 22 bp, Homo sapiens
agagtggcagcaagtcaggtag

SEQ ID NO: 7161330 - DNA, 22 bp, Homo sapiens
attggcataggttaaacagcgg

SEQ ID NO: 7161331 - DNA, 22 bp, Homo sapiens
attggcatagtaggacagatca

SEQ ID NO: 7161332 - DNA, 22 bp, Homo sapiens
attggcatatccacgacaatgc

SEQ ID NO: 7161333 - DNA, 22 bp, Homo sapiens
attggcatattggctactttca

SEQ ID NO: 7161334 - DNA, 22 bp, Homo sapiens
attggcatgacagatttgaggc

SEQ ID NO: 7161335 - DNA, 22 bp, Homo sapiens
attggccagacttatccttcag

SEQ ID NO: 7161336 - DNA, 22 bp, Homo sapiens
attggccatttgcatgtattat

SEQ ID NO: 7161337 - DNA, 22 bp, Homo sapiens
attggccatttgcatgtattat

SEQ ID NO: 7161338 - DNA, 22 bp, Homo sapiens
attggcctaaagaaatgacaga

SEQ ID NO: 7161339 - DNA, 22 bp, Homo sapiens
attggcctattttggaagactt

SEQ ID NO: 7161340 - DNA, 21 bp, Homo sapiens
attggcctgtttacagagtga

SEQ ID NO: 7161341 - DNA, 21 bp, Homo sapiens
attggcctgtttacagagtga

SEQ ID NO: 7161342 - DNA, 22 bp, Homo sapiens
attgggctctactgaagggagg

SEQ ID NO: 7161343 - DNA, 22 bp, Homo sapiens
attgggctgatgttacacaggc

SEQ ID NO: 7161344 - DNA, 22 bp, Homo sapiens
attgggctgcaccccagagttt

SEQ ID NO: 7161345 - DNA, 22 bp, Homo sapiens
attgggctggattaggactgtt

SEQ ID NO: 7161346 - DNA, 22 bp, Homo sapiens
attgggctggccttctggagag

SEQ ID NO: 7161347 - DNA, 22 bp, Homo sapiens
attgggctttatgtaggggaag

SEQ ID NO: 7161348 - DNA, 22 bp, Homo sapiens
attggggagagctaatatttta

SEQ ID NO: 7161349 - DNA, 22 bp, Homo sapiens
attggtaagcaagatggcaata

SEQ ID NO: 7161350 - DNA, 22 bp, Homo sapiens
attggtagttttgtatttctct

SEQ ID NO: 7161351 - DNA, 22 bp, Homo sapiens
attggtagttttgtatttctct

SEQ ID NO: 7161352 - DNA, 22 bp, Homo sapiens
attggtatataaaatgtgtact

SEQ ID NO: 7161353 - DNA, 22 bp, Homo sapiens
attggtcagagtaaatttattt

SEQ ID NO: 7161354 - DNA, 22 bp, Homo sapiens
attggtccatttaccctctctt

SEQ ID NO: 7161355 - DNA, 22 bp, Homo sapiens
attggtcccctcctatgtgcca

SEQ ID NO: 7161356 - DNA, 18 bp, Homo sapiens
attggtcctgtccaccca

SEQ ID NO: 7161357 - DNA, 22 bp, Homo sapiens
attggtctaaagttaagaagat

SEQ ID NO: 7161358 - DNA, 22 bp, Homo sapiens
attggtctctgctaaagggagg

SEQ ID NO: 7161359 - DNA, 22 bp, Homo sapiens
attggtctggggaaatgaagag

SEQ ID NO: 7161360 - DNA, 22 bp, Homo sapiens
agatataataatttacaagtgt

SEQ ID NO: 7161361 - DNA, 22 bp, Homo sapiens
agatataataatttacaagtgt

SEQ ID NO: 7161362 - DNA, 22 bp, Homo sapiens
agatataataatttacaagtgt

SEQ ID NO: 7161363 - DNA, 23 bp, Homo sapiens
agatcacatagttatcagatgac

SEQ ID NO: 7161364 - DNA, 23 bp, Homo sapiens
agatcacatgctgatggaaaatg

SEQ ID NO: 7161365 - DNA, 22 bp, Homo sapiens
agatcactggttacttaatgaa

SEQ ID NO: 7161366 - DNA, 22 bp, Homo sapiens
agatcactggttacttaatgaa

SEQ ID NO: 7161367 - DNA, 22 bp, Homo sapiens
agatcacataatttcctgtgac

SEQ ID NO: 7161368 - DNA, 22 bp, Homo sapiens
agatcacagtggcaactccctt

SEQ ID NO: 7161369 - DNA, 22 bp, Homo sapiens
agatcacagtggcaactccctt

SEQ ID NO: 7161370 - DNA, 22 bp, Homo sapiens
agatcacagcccccagatgcca

SEQ ID NO: 7161371 - DNA, 22 bp, Homo sapiens
agatcacagcccccagatgcca

SEQ ID NO: 7161372 - DNA, 22 bp, Homo sapiens
agatcaaatctgggatttctaa

SEQ ID NO: 7161373 - DNA, 22 bp, Homo sapiens
agatcaaagccatgagagattt

SEQ ID NO: 7161374 - DNA, 22 bp, Homo sapiens
agatattttgtgtgatgtttca

SEQ ID NO: 7161375 - DNA, 22 bp, Homo sapiens
agatcaaaaacttaatggcttt

SEQ ID NO: 7161376 - DNA, 22 bp, Homo sapiens
agatattttgtgtgatgtttca

SEQ ID NO: 7161377 - DNA, 22 bp, Homo sapiens
agatattttgtgtgatgtttca

SEQ ID NO: 7161378 - DNA, 22 bp, Homo sapiens
agatattttgtgtgatgtttca

SEQ ID NO: 7161379 - DNA, 22 bp, Homo sapiens
agatatttgtatcttgctattg

SEQ ID NO: 7161380 - DNA, 22 bp, Homo sapiens
agatatttgtatcttgctattg

SEQ ID NO: 7161381 - DNA, 22 bp, Homo sapiens
agatatttaaatcagacaaaga

SEQ ID NO: 7161382 - DNA, 22 bp, Homo sapiens
agatatttgtatcttgctattg

SEQ ID NO: 7161383 - DNA, 22 bp, Homo sapiens
agatattgtgcatactgctgtt

SEQ ID NO: 7161384 - DNA, 22 bp, Homo sapiens
agatattgtttgtttcaccaat

SEQ ID NO: 7161385 - DNA, 22 bp, Homo sapiens
agatatttaaatcagacaaaga

SEQ ID NO: 7161386 - DNA, 22 bp, Homo sapiens
agatatttaaatcagacaaaga

SEQ ID NO: 7161387 - DNA, 22 bp, Homo sapiens
agatatttaaatcagacaaaga

SEQ ID NO: 7161388 - DNA, 22 bp, Homo sapiens
agatatttaaatcagacaaaga

SEQ ID NO: 7161389 - DNA, 22 bp, Homo sapiens
agatattaccagcagtctatgc

SEQ ID NO: 7161390 - DNA, 22 bp, Homo sapiens
agatattaatcgtacataaggt

SEQ ID NO: 7161391 - DNA, 22 bp, Homo sapiens
agatattctgcctaacaggttt

SEQ ID NO: 7161392 - DNA, 22 bp, Homo sapiens
agatattctgcctaacaggttt

SEQ ID NO: 7161393 - DNA, 22 bp, Homo sapiens
agatattctagaacctagtaga

SEQ ID NO: 7161394 - DNA, 22 bp, Homo sapiens
agatattaccagcagtctatgc

SEQ ID NO: 7161395 - DNA, 22 bp, Homo sapiens
agatattaggaggattcataat

SEQ ID NO: 7161396 - DNA, 22 bp, Homo sapiens
agatattaggaggattcataat

SEQ ID NO: 7161397 - DNA, 22 bp, Homo sapiens
agatattaggaggattcataat

SEQ ID NO: 7161398 - DNA, 22 bp, Homo sapiens
agatattaggaggattcataat

SEQ ID NO: 7161399 - DNA, 22 bp, Homo sapiens
agatattaggaggattcataat

SEQ ID NO: 7161400 - DNA, 22 bp, Homo sapiens
agatgggccttcgagcatgccc

SEQ ID NO: 7161401 - DNA, 22 bp, Homo sapiens
agatggcttccttctcactgtg

SEQ ID NO: 7161402 - DNA, 22 bp, Homo sapiens
agatggctgatggcaggagcca

SEQ ID NO: 7161403 - DNA, 22 bp, Homo sapiens
agatggctgatggcaggagcca

SEQ ID NO: 7161404 - DNA, 22 bp, Homo sapiens
agatggctgattaactccatgg

SEQ ID NO: 7161405 - DNA, 22 bp, Homo sapiens
agatggcaggggtacctggaag

SEQ ID NO: 7161406 - DNA, 22 bp, Homo sapiens
agatggccccaggtgcccaggg

SEQ ID NO: 7161407 - DNA, 22 bp, Homo sapiens
agatggctccagtgtccagagg

SEQ ID NO: 7161408 - DNA, 17 bp, Homo sapiens
agatggcaggaggcaga

SEQ ID NO: 7161409 - DNA, 17 bp, Homo sapiens
agatggcaggaggcaga

SEQ ID NO: 7161410 - DNA, 17 bp, Homo sapiens
agatggcaggaggcaga

SEQ ID NO: 7161411 - DNA, 17 bp, Homo sapiens
agatggcaggaggcaga

SEQ ID NO: 7161412 - DNA, 22 bp, Homo sapiens
agatggcagcagaacaaacagg

SEQ ID NO: 7161413 - DNA, 22 bp, Homo sapiens
agatggatttcttccagtgaga

SEQ ID NO: 7161414 - DNA, 19 bp, Homo sapiens
agatggcaaaatgcaaaga

SEQ ID NO: 7161415 - DNA, 22 bp, Homo sapiens
agatggagttgtagcagtgact

SEQ ID NO: 7161416 - DNA, 22 bp, Homo sapiens
agatggagttgtagcagtgact

SEQ ID NO: 7161417 - DNA, 22 bp, Homo sapiens
agatggagttgtagcagtgact

SEQ ID NO: 7161418 - DNA, 22 bp, Homo sapiens
agatggagttagtaccagagtc

SEQ ID NO: 7161419 - DNA, 22 bp, Homo sapiens
agatggagttagtaccagagtc

SEQ ID NO: 7161420 - DNA, 22 bp, Homo sapiens
agatggagtggagatgagtaaa

SEQ ID NO: 7161421 - DNA, 22 bp, Homo sapiens
agatggagaccttggatgaact

SEQ ID NO: 7161422 - DNA, 22 bp, Homo sapiens
agatggagaccttggatgaact

SEQ ID NO: 7161423 - DNA, 22 bp, Homo sapiens
agatgcagaaaaactaagtgat

SEQ ID NO: 7161424 - DNA, 22 bp, Homo sapiens
agatgcagaaaaactaagtgat

SEQ ID NO: 7161425 - DNA, 22 bp, Homo sapiens
agatgcagaaaaactaagtgat

SEQ ID NO: 7161426 - DNA, 22 bp, Homo sapiens
agatgctgggaggctgagtgca

SEQ ID NO: 7161427 - DNA, 22 bp, Homo sapiens
agatgctggggcccctcggatg

SEQ ID NO: 7161428 - DNA, 22 bp, Homo sapiens
agatgctgtcacacacactgtt

SEQ ID NO: 7161429 - DNA, 22 bp, Homo sapiens
agatgctgtcttgctggctttg

SEQ ID NO: 7161430 - DNA, 22 bp, Homo sapiens
agatgctgtgaggaagctagga

SEQ ID NO: 7161431 - DNA, 21 bp, Homo sapiens
agatgctgtgctccaggagca

SEQ ID NO: 7161432 - DNA, 22 bp, Homo sapiens
agatgcttaagttttcagtgta

SEQ ID NO: 7161433 - DNA, 22 bp, Homo sapiens
agatgcttaagttttcagtgta

SEQ ID NO: 7161434 - DNA, 22 bp, Homo sapiens
agatgcttcagtgtttaattta

SEQ ID NO: 7161435 - DNA, 22 bp, Homo sapiens
agatgcttcagtgtttaattta

SEQ ID NO: 7161436 - DNA, 22 bp, Homo sapiens
agatgctttcctgatatttatg

SEQ ID NO: 7161437 - DNA, 22 bp, Homo sapiens
agatgctttcctgatatttatg

SEQ ID NO: 7161438 - DNA, 22 bp, Homo sapiens
agatggaaaatatagacagaga

SEQ ID NO: 7161439 - DNA, 22 bp, Homo sapiens
agatggaaaatatagacagaga

SEQ ID NO: 7161440 - DNA, 22 bp, Homo sapiens
agatgattatgatagcactgtt

SEQ ID NO: 7161441 - DNA, 22 bp, Homo sapiens
agatgattatgatagcactgtt

SEQ ID NO: 7161442 - DNA, 22 bp, Homo sapiens
agatccactatggtgctgatga

SEQ ID NO: 7161443 - DNA, 22 bp, Homo sapiens
agatccaggatgtcccaaaata

SEQ ID NO: 7161444 - DNA, 22 bp, Homo sapiens
agatcatatgcagtaatgaact

SEQ ID NO: 7161445 - DNA, 21 bp, Homo sapiens
agatcattcttctgagcactt

SEQ ID NO: 7161446 - DNA, 21 bp, Homo sapiens
agatcattcttctgagcactt

SEQ ID NO: 7161447 - DNA, 22 bp, Homo sapiens
agatcattaaccacctgttctg

SEQ ID NO: 7161448 - DNA, 22 bp, Homo sapiens
agatcatttggcagaagcaacg

SEQ ID NO: 7161449 - DNA, 22 bp, Homo sapiens
agatcagttagatagcttgatg

SEQ ID NO: 7161450 - DNA, 22 bp, Homo sapiens
agatcagatctccttttgcatt

SEQ ID NO: 7161451 - DNA, 22 bp, Homo sapiens
agatcagtaagaggaagaatgg

SEQ ID NO: 7161452 - DNA, 22 bp, Homo sapiens
agatcagttagatagcttgatg

SEQ ID NO: 7161453 - DNA, 22 bp, Homo sapiens
agatcagactttgtgactagga

SEQ ID NO: 7161454 - DNA, 22 bp, Homo sapiens
agatcagagatgctaaaagagc

SEQ ID NO: 7161455 - DNA, 22 bp, Homo sapiens
agatcagacacggcttgtgacg

SEQ ID NO: 7161456 - DNA, 22 bp, Homo sapiens
agatcactttgatgctacctgg

SEQ ID NO: 7161457 - DNA, 22 bp, Homo sapiens
agatcactttgatgctacctgg

SEQ ID NO: 7161458 - DNA, 22 bp, Homo sapiens
agagggcagtctcagattggga

SEQ ID NO: 7161459 - DNA, 22 bp, Homo sapiens
agaggctgtctcatattttgta

SEQ ID NO: 7161460 - DNA, 22 bp, Homo sapiens
agaggctgtctcatattttgta

SEQ ID NO: 7161461 - DNA, 22 bp, Homo sapiens
agagggcataaaatagagcacg

SEQ ID NO: 7161462 - DNA, 22 bp, Homo sapiens
agagggctgggatgtgctgtgt

SEQ ID NO: 7161463 - DNA, 22 bp, Homo sapiens
agagggcttccctaggagtgag

SEQ ID NO: 7161464 - DNA, 22 bp, Homo sapiens
agaggggaaggatgtgatgtga

SEQ ID NO: 7161465 - DNA, 22 bp, Homo sapiens
agaggggaaggatgtgatgtga

SEQ ID NO: 7161466 - DNA, 22 bp, Homo sapiens
agagggcttccctaggagtgag

SEQ ID NO: 7161467 - DNA, 22 bp, Homo sapiens
agagggcttccctaggagtgag

SEQ ID NO: 7161468 - DNA, 22 bp, Homo sapiens
agagggcttccctaggagtgag

SEQ ID NO: 7161469 - DNA, 22 bp, Homo sapiens
agagggcttccctaggagtgag

SEQ ID NO: 7161470 - DNA, 22 bp, Homo sapiens
agagggctttgattctcagttc

SEQ ID NO: 7161471 - DNA, 22 bp, Homo sapiens
agaggctgtcccttgctattcc

SEQ ID NO: 7161472 - DNA, 22 bp, Homo sapiens
agaggctgtcccttgctattcc

SEQ ID NO: 7161473 - DNA, 22 bp, Homo sapiens
agaggctgtcccttgctattcc

SEQ ID NO: 7161474 - DNA, 22 bp, Homo sapiens
agaggctgtcccttgctattcc

SEQ ID NO: 7161475 - DNA, 19 bp, Homo sapiens
agaggctgtcacctgtagc

SEQ ID NO: 7161476 - DNA, 19 bp, Homo sapiens
agaggctgtcacctgtagc

SEQ ID NO: 7161477 - DNA, 19 bp, Homo sapiens
agaggctgtcacctgtagc

SEQ ID NO: 7161478 - DNA, 16 bp, Homo sapiens
agaggctgtaatggaa

SEQ ID NO: 7161479 - DNA, 16 bp, Homo sapiens
agaggctgtaatggaa

SEQ ID NO: 7161480 - DNA, 16 bp, Homo sapiens
agaggctgtaatggaa

SEQ ID NO: 7161481 - DNA, 22 bp, Homo sapiens
agaggctgggcaggacccacag

SEQ ID NO: 7161482 - DNA, 22 bp, Homo sapiens
agaggctgggcaggacccacag

SEQ ID NO: 7161483 - DNA, 22 bp, Homo sapiens
agaggctgggaagggtccccgg

SEQ ID NO: 7161484 - DNA, 22 bp, Homo sapiens
agaggctgggtacgggccacct

SEQ ID NO: 7161485 - DNA, 22 bp, Homo sapiens
agaggctgggtacgggccacct

SEQ ID NO: 7161486 - DNA, 22 bp, Homo sapiens
agaggctgggtacgggccacct

SEQ ID NO: 7161487 - DNA, 22 bp, Homo sapiens
agaggctgggtacgggccacct

SEQ ID NO: 7161488 - DNA, 22 bp, Homo sapiens
agaggggctcaagcagtggtct

SEQ ID NO: 7161489 - DNA, 22 bp, Homo sapiens
agaggtgacataggagaggctc

SEQ ID NO: 7161490 - DNA, 22 bp, Homo sapiens
agaggggctcaagcagtggtct

SEQ ID NO: 7161491 - DNA, 22 bp, Homo sapiens
agaggggctcaagcagtggtct

SEQ ID NO: 7161492 - DNA, 22 bp, Homo sapiens
agaggggcagggtctccggatt

SEQ ID NO: 7161493 - DNA, 22 bp, Homo sapiens
agaggggcagggtctccggatt

SEQ ID NO: 7161494 - DNA, 22 bp, Homo sapiens
agaggggcagggtctccggatt

SEQ ID NO: 7161495 - DNA, 22 bp, Homo sapiens
agaggggcccggttctccgtct

SEQ ID NO: 7161496 - DNA, 22 bp, Homo sapiens
agaggggcccggttctccgtct

SEQ ID NO: 7161497 - DNA, 22 bp, Homo sapiens
agaggggcccggttctccgtct

SEQ ID NO: 7161498 - DNA, 22 bp, Homo sapiens
agaggggcgggaactcaacctc

SEQ ID NO: 7161499 - DNA, 22 bp, Homo sapiens
agaggggcgggaactcaacctc

SEQ ID NO: 7161500 - DNA, 22 bp, Homo sapiens
agaggggcgggaactcaacctc

SEQ ID NO: 7161501 - DNA, 22 bp, Homo sapiens
agaggggcaagtaaagagtctt

SEQ ID NO: 7161502 - DNA, 22 bp, Homo sapiens
agaggggagtcctaatctgatt

SEQ ID NO: 7161503 - DNA, 22 bp, Homo sapiens
agaggggagtcctaatctgatt

SEQ ID NO: 7161504 - DNA, 22 bp, Homo sapiens
agaggggcaagtaaagagtctt

SEQ ID NO: 7161505 - DNA, 22 bp, Homo sapiens
agaggggcaagtaaagagtctt

SEQ ID NO: 7161506 - DNA, 22 bp, Homo sapiens
agaggggcaagtaaagagtctt

SEQ ID NO: 7161507 - DNA, 18 bp, Homo sapiens
agaggggaggtaagtctg

SEQ ID NO: 7161508 - DNA, 18 bp, Homo sapiens
agaggggaggtaagtctg

SEQ ID NO: 7161509 - DNA, 18 bp, Homo sapiens
agaggggaggtaagtctg

SEQ ID NO: 7161510 - DNA, 22 bp, Homo sapiens
agaggggagtcctaatctgatt

SEQ ID NO: 7161511 - DNA, 22 bp, Homo sapiens
agaggggacagccacctgcccg

SEQ ID NO: 7161512 - DNA, 22 bp, Homo sapiens
agaggggacagccacctgcccg

SEQ ID NO: 7161513 - DNA, 22 bp, Homo sapiens
agaggggaagtaatgaatgata

SEQ ID NO: 7161514 - DNA, 22 bp, Homo sapiens
agaggggaagtaatgaatgata

SEQ ID NO: 7161515 - DNA, 23 bp, Homo sapiens
agaggggagcatctgctggctga

SEQ ID NO: 7161516 - DNA, 22 bp, Homo sapiens
agaggggagagctaagcaattc

SEQ ID NO: 7161517 - DNA, 22 bp, Homo sapiens
agaggggaggcgaaccagagtc

SEQ ID NO: 7161518 - DNA, 22 bp, Homo sapiens
agaggggaggcgaaccagagtc

SEQ ID NO: 7161519 - DNA, 22 bp, Homo sapiens
agaggggaggcgaaccagagtc

SEQ ID NO: 7161520 - DNA, 22 bp, Homo sapiens
agaggggaggcgaaccagagtc

SEQ ID NO: 7161521 - DNA, 23 bp, Homo sapiens
agaggggagcatctgctggctga

SEQ ID NO: 7161522 - DNA, 22 bp, Homo sapiens
agagtgcaaccgaaacaagcag

SEQ ID NO: 7161523 - DNA, 22 bp, Homo sapiens
agagtgatcctaattgatttgg

SEQ ID NO: 7161524 - DNA, 20 bp, Homo sapiens
agagtgagactccatctcag

SEQ ID NO: 7161525 - DNA, 22 bp, Homo sapiens
agagtgagggggcactgagacg

SEQ ID NO: 7161526 - DNA, 22 bp, Homo sapiens
agagtgagggggcactgagacg

SEQ ID NO: 7161527 - DNA, 22 bp, Homo sapiens
agagtgcagaggtcaaagaaca

SEQ ID NO: 7161528 - DNA, 22 bp, Homo sapiens
agagtgcagataagagaatgtt

SEQ ID NO: 7161529 - DNA, 22 bp, Homo sapiens
agagtgcatgttttatctttgt

SEQ ID NO: 7161530 - DNA, 22 bp, Homo sapiens
agagtgcccaagcctggcaggg

SEQ ID NO: 7161531 - DNA, 22 bp, Homo sapiens
agagtgccctgctctgagctct

SEQ ID NO: 7161532 - DNA, 22 bp, Homo sapiens
agagtgctaaaatcttatcttt

SEQ ID NO: 7161533 - DNA, 22 bp, Homo sapiens
agagtgctagcctgagggaggt

SEQ ID NO: 7161534 - DNA, 22 bp, Homo sapiens
agagtgcttaaagctggctttg

SEQ ID NO: 7161535 - DNA, 22 bp, Homo sapiens
agagtgcttagtagtgacatgg

SEQ ID NO: 7161536 - DNA, 22 bp, Homo sapiens
agagtctgaggcagctgcagcc

SEQ ID NO: 7161537 - DNA, 22 bp, Homo sapiens
agagtctgaatgctcagagttg

SEQ ID NO: 7161538 - DNA, 22 bp, Homo sapiens
agagtctgaggcagctgcagcc

SEQ ID NO: 7161539 - DNA, 22 bp, Homo sapiens
agagtctgaggcagctgcagcc

SEQ ID NO: 7161540 - DNA, 22 bp, Homo sapiens
agagtctgaggcagctgcagcc

SEQ ID NO: 7161541 - DNA, 22 bp, Homo sapiens
agagtccagaaaacagtgtgct

SEQ ID NO: 7161542 - DNA, 22 bp, Homo sapiens
agagtccagaaaacagtgtgct

SEQ ID NO: 7161543 - DNA, 18 bp, Homo sapiens
agagtccagggtgaggtg

SEQ ID NO: 7161544 - DNA, 22 bp, Homo sapiens
agagtccaggtgggctggaggc

SEQ ID NO: 7161545 - DNA, 22 bp, Homo sapiens
agagtccaggtgggctggaggc

SEQ ID NO: 7161546 - DNA, 22 bp, Homo sapiens
agagtccatatgtgggaggagt

SEQ ID NO: 7161547 - DNA, 22 bp, Homo sapiens
agagtccatatgtgggaggagt

SEQ ID NO: 7161548 - DNA, 22 bp, Homo sapiens
agagtccatatgtgggaggagt

SEQ ID NO: 7161549 - DNA, 22 bp, Homo sapiens
agagtccatgaagacagctgag

SEQ ID NO: 7161550 - DNA, 22 bp, Homo sapiens
agagtccatgaagacagctgag

SEQ ID NO: 7161551 - DNA, 22 bp, Homo sapiens
agagtccctcttcccaggaggc

SEQ ID NO: 7161552 - DNA, 22 bp, Homo sapiens
agagtcatagtttaacttttgt

SEQ ID NO: 7161553 - DNA, 22 bp, Homo sapiens
agagtcatagtttaacttttgt

SEQ ID NO: 7161554 - DNA, 22 bp, Homo sapiens
agagtccaaatgtgcagttatg

SEQ ID NO: 7161555 - DNA, 23 bp, Homo sapiens
agagtccacaagattttccagtg

SEQ ID NO: 7161556 - DNA, 22 bp, Homo sapiens
agagtccaccctggggtcaggc

SEQ ID NO: 7161557 - DNA, 22 bp, Homo sapiens
agagtccagaaaacagtgtgct

SEQ ID NO: 7161558 - DNA, 22 bp, Homo sapiens
agagtcagactaagccatggtg

SEQ ID NO: 7161559 - DNA, 22 bp, Homo sapiens
agagtcagactaagccatggtg

SEQ ID NO: 7161560 - DNA, 22 bp, Homo sapiens
agagtcagcttatgacacagtc

SEQ ID NO: 7161561 - DNA, 22 bp, Homo sapiens
agagtactgcctcagttatgaa

SEQ ID NO: 7161562 - DNA, 22 bp, Homo sapiens
agaggtggagctcttggcatca

SEQ ID NO: 7161563 - DNA, 22 bp, Homo sapiens
agagtactgcctcagttatgaa

SEQ ID NO: 7161564 - DNA, 22 bp, Homo sapiens
agagtactgcctcagttatgaa

SEQ ID NO: 7161565 - DNA, 22 bp, Homo sapiens
agaggtgacataggagaggctc

SEQ ID NO: 7161566 - DNA, 22 bp, Homo sapiens
agaggtgagtcattacctagtg

SEQ ID NO: 7161567 - DNA, 18 bp, Homo sapiens
agagtatacagacaacaa

SEQ ID NO: 7161568 - DNA, 18 bp, Homo sapiens
agagtatacagacaacaa

SEQ ID NO: 7161569 - DNA, 22 bp, Homo sapiens
agagtataggcaggatgccagt

SEQ ID NO: 7161570 - DNA, 22 bp, Homo sapiens
agagtactgcctcagttatgaa

SEQ ID NO: 7161571 - DNA, 22 bp, Homo sapiens
agagtagttctttgcagagtgg

SEQ ID NO: 7161572 - DNA, 21 bp, Homo sapiens
agagtataataaaggcatgtc

SEQ ID NO: 7161573 - DNA, 22 bp, Homo sapiens
agagtatgctacaaagccagcc

SEQ ID NO: 7161574 - DNA, 19 bp, Homo sapiens
agagtattgaatttgccct

SEQ ID NO: 7161575 - DNA, 22 bp, Homo sapiens
agagtcaacatcgagccactgg

SEQ ID NO: 7161576 - DNA, 21 bp, Homo sapiens
agagctgggacttgcctgaga

SEQ ID NO: 7161577 - DNA, 22 bp, Homo sapiens
agagctgggaccgtctggaagt

SEQ ID NO: 7161578 - DNA, 22 bp, Homo sapiens
agagctgggaccgtctggaagt

SEQ ID NO: 7161579 - DNA, 22 bp, Homo sapiens
agaggcaagattatcagggcat

SEQ ID NO: 7161580 - DNA, 22 bp, Homo sapiens
agaggcaagattatcagggcat

SEQ ID NO: 7161581 - DNA, 22 bp, Homo sapiens
agaggaggctgggtccagataa

SEQ ID NO: 7161582 - DNA, 22 bp, Homo sapiens
agaggaggctgggtccagataa

SEQ ID NO: 7161583 - DNA, 22 bp, Homo sapiens
agagctggctgtgggtgacttt

SEQ ID NO: 7161584 - DNA, 20 bp, Homo sapiens
agagctgggaagctccctat

SEQ ID NO: 7161585 - DNA, 20 bp, Homo sapiens
agagctgggaagctccctat

SEQ ID NO: 7161586 - DNA, 20 bp, Homo sapiens
agagctgggaagctccctat

SEQ ID NO: 7161587 - DNA, 22 bp, Homo sapiens
agagctgggaccgtctggaagt

SEQ ID NO: 7161588 - DNA, 22 bp, Homo sapiens
agaggcaatgaaagcagtctct

SEQ ID NO: 7161589 - DNA, 22 bp, Homo sapiens
agaggcaatgaaagcagtctct

SEQ ID NO: 7161590 - DNA, 22 bp, Homo sapiens
agaggcaatgaaagcagtctct

SEQ ID NO: 7161591 - DNA, 22 bp, Homo sapiens
agaggcacagaggcagtcccct

SEQ ID NO: 7161592 - DNA, 23 bp, Homo sapiens
agaggcacagcacttggctggcc

SEQ ID NO: 7161593 - DNA, 23 bp, Homo sapiens
agaggcacagcacttggctggcc

SEQ ID NO: 7161594 - DNA, 22 bp, Homo sapiens
agaggcacatggagggtggaag

SEQ ID NO: 7161595 - DNA, 22 bp, Homo sapiens
agaggcaccatctggaacagcc

SEQ ID NO: 7161596 - DNA, 19 bp, Homo sapiens
agaggcaagggtggaagta

SEQ ID NO: 7161597 - DNA, 22 bp, Homo sapiens
agaggcaagttcagagctagga

SEQ ID NO: 7161598 - DNA, 22 bp, Homo sapiens
agaggcaagttcagagctagga

SEQ ID NO: 7161599 - DNA, 19 bp, Homo sapiens
agaggcaagggctcatgac

SEQ ID NO: 7161600 - DNA, 19 bp, Homo sapiens
agaggcaagggctcatgac

SEQ ID NO: 7161601 - DNA, 22 bp, Homo sapiens
agaggcaaggcaggattcttct

SEQ ID NO: 7161602 - DNA, 22 bp, Homo sapiens
agaggcaaggcaggattcttct

SEQ ID NO: 7161603 - DNA, 22 bp, Homo sapiens
attacacagcggttactactag

SEQ ID NO: 7161604 - DNA, 22 bp, Homo sapiens
agaggcacccgcgcgcggccat

SEQ ID NO: 7161605 - DNA, 22 bp, Homo sapiens
agaggcacccgcgcgcggccat

SEQ ID NO: 7161606 - DNA, 22 bp, Homo sapiens
agaggcaccgtctgcagcgtgc

SEQ ID NO: 7161607 - DNA, 22 bp, Homo sapiens
agaggcactaagggaagagcag

SEQ ID NO: 7161608 - DNA, 22 bp, Homo sapiens
agaggcactaagggaagagcag

SEQ ID NO: 7161609 - DNA, 22 bp, Homo sapiens
attacagaaagcaatattgagt

SEQ ID NO: 7161610 - DNA, 22 bp, Homo sapiens
attacagaaagcaatattgagt

SEQ ID NO: 7161611 - DNA, 22 bp, Homo sapiens
attacagaaagcaatattgagt

SEQ ID NO: 7161612 - DNA, 22 bp, Homo sapiens
attacagaatgcagttccttat

SEQ ID NO: 7161613 - DNA, 22 bp, Homo sapiens
attacagagggtcggtcgtttt

SEQ ID NO: 7161614 - DNA, 22 bp, Homo sapiens
attacagagtcttgggaggtca

SEQ ID NO: 7161615 - DNA, 22 bp, Homo sapiens
attacagatagactttgaagct

SEQ ID NO: 7161616 - DNA, 21 bp, Homo sapiens
attacagcagtggccaaatgc

SEQ ID NO: 7161617 - DNA, 21 bp, Homo sapiens
attacagcagtggccaaatgc

SEQ ID NO: 7161618 - DNA, 22 bp, Homo sapiens
attacagcttgctcagtttgca

SEQ ID NO: 7161619 - DNA, 22 bp, Homo sapiens
attacagcttgctcagtttgca

SEQ ID NO: 7161620 - DNA, 23 bp, Homo sapiens
agaggcaggagtggcttgcccgg

SEQ ID NO: 7161621 - DNA, 22 bp, Homo sapiens
agaggctgggaagggtccccgg

SEQ ID NO: 7161622 - DNA, 22 bp, Homo sapiens
agaggctggattgagcatagac

SEQ ID NO: 7161623 - DNA, 22 bp, Homo sapiens
agaggctggattgagcatagac

SEQ ID NO: 7161624 - DNA, 22 bp, Homo sapiens
agaggctggattgagcatagac

SEQ ID NO: 7161625 - DNA, 22 bp, Homo sapiens
agaggctggattgagcatagac

SEQ ID NO: 7161626 - DNA, 22 bp, Homo sapiens
agaggctggattgagcatagac

SEQ ID NO: 7161627 - DNA, 18 bp, Homo sapiens
agaggctggacaggggat

SEQ ID NO: 7161628 - DNA, 18 bp, Homo sapiens
agaggctggacaggggat

SEQ ID NO: 7161629 - DNA, 22 bp, Homo sapiens
agaggctggattgagcatagac

SEQ ID NO: 7161630 - DNA, 22 bp, Homo sapiens
agaggctggattgagcatagac

SEQ ID NO: 7161631 - DNA, 18 bp, Homo sapiens
agaggctggacaggggat

SEQ ID NO: 7161632 - DNA, 18 bp, Homo sapiens
agaggctggacaggggat

SEQ ID NO: 7161633 - DNA, 23 bp, Homo sapiens
agaggctgcagggtattgagaat

SEQ ID NO: 7161634 - DNA, 23 bp, Homo sapiens
agaggctgcagggtattgagaat

SEQ ID NO: 7161635 - DNA, 18 bp, Homo sapiens
agaggctggacaggggat

SEQ ID NO: 7161636 - DNA, 18 bp, Homo sapiens
agaggctggacaggggat

SEQ ID NO: 7161637 - DNA, 23 bp, Homo sapiens
agaggctgcagggtattgagaat

SEQ ID NO: 7161638 - DNA, 22 bp, Homo sapiens
agaggctgcaggctggaaatca

SEQ ID NO: 7161639 - DNA, 22 bp, Homo sapiens
agaggctgcaggctggaaatca

SEQ ID NO: 7161640 - DNA, 22 bp, Homo sapiens
agaggctgcaggctggaaatca

SEQ ID NO: 7161641 - DNA, 22 bp, Homo sapiens
agaggctgcaggctggaaatca

SEQ ID NO: 7161642 - DNA, 22 bp, Homo sapiens
agaggctgcacttgctcatgat

SEQ ID NO: 7161643 - DNA, 22 bp, Homo sapiens
agaggctgcaggctggaaatca

SEQ ID NO: 7161644 - DNA, 22 bp, Homo sapiens
agaggccaggcagcccaaggtg

SEQ ID NO: 7161645 - DNA, 22 bp, Homo sapiens
agaggccaggcagcccaaggtg

SEQ ID NO: 7161646 - DNA, 23 bp, Homo sapiens
agaggccagcctttggagacacc

SEQ ID NO: 7161647 - DNA, 22 bp, Homo sapiens
agaggccagctagcgggccatc

SEQ ID NO: 7161648 - DNA, 22 bp, Homo sapiens
agaggccagctagcgggccatc

SEQ ID NO: 7161649 - DNA, 22 bp, Homo sapiens
agaggctccttcactctggcac

SEQ ID NO: 7161650 - DNA, 22 bp, Homo sapiens
agaggccaggctgcagagggat

SEQ ID NO: 7161651 - DNA, 22 bp, Homo sapiens
agaggccaggctgcagagggat

SEQ ID NO: 7161652 - DNA, 22 bp, Homo sapiens
agaggctgcacttgctcatgat

SEQ ID NO: 7161653 - DNA, 22 bp, Homo sapiens
agaggctgcacttgctcatgat

SEQ ID NO: 7161654 - DNA, 22 bp, Homo sapiens
agaggctgcacttgctcatgat

SEQ ID NO: 7161655 - DNA, 22 bp, Homo sapiens
agaggctgcacttgctcatgat

SEQ ID NO: 7161656 - DNA, 22 bp, Homo sapiens
agaggctgcacttgctcatgat

SEQ ID NO: 7161657 - DNA, 22 bp, Homo sapiens
agaggctgcacttgctcatgat

SEQ ID NO: 7161658 - DNA, 22 bp, Homo sapiens
agaggctgatggagtagtgtct

SEQ ID NO: 7161659 - DNA, 22 bp, Homo sapiens
agaggctccttcactctggcac

SEQ ID NO: 7161660 - DNA, 16 bp, Homo sapiens
agaggccacagacaga

SEQ ID NO: 7161661 - DNA, 16 bp, Homo sapiens
agaggccacagacaga

SEQ ID NO: 7161662 - DNA, 22 bp, Homo sapiens
agaggccaccactgtcagggac

SEQ ID NO: 7161663 - DNA, 22 bp, Homo sapiens
agaggccaccactgtcagggac

SEQ ID NO: 7161664 - DNA, 22 bp, Homo sapiens
agaggccaccagaggtggtgcc

SEQ ID NO: 7161665 - DNA, 22 bp, Homo sapiens
agaggccaccttctcttgagaa

SEQ ID NO: 7161666 - DNA, 22 bp, Homo sapiens
agaggccaccttctcttgagaa

SEQ ID NO: 7161667 - DNA, 22 bp, Homo sapiens
agaggccaccttctcttgagaa

SEQ ID NO: 7161668 - DNA, 22 bp, Homo sapiens
agaggccaccttctcttgagaa

SEQ ID NO: 7161669 - DNA, 22 bp, Homo sapiens
agaggccactttgcctgtgatg

SEQ ID NO: 7161670 - DNA, 22 bp, Homo sapiens
agaggccactttgcctgtgatg

SEQ ID NO: 7161671 - DNA, 22 bp, Homo sapiens
agaggccagaaagtatgccacc

SEQ ID NO: 7161672 - DNA, 22 bp, Homo sapiens
agaggccagaaagtatgccacc

SEQ ID NO: 7161673 - DNA, 22 bp, Homo sapiens
agaggccagaaagtatgccacc

SEQ ID NO: 7161674 - DNA, 22 bp, Homo sapiens
agaggccagaaggcgcaccccg

SEQ ID NO: 7161675 - DNA, 22 bp, Homo sapiens
agaggccagaaggcgcaccccg

SEQ ID NO: 7161676 - DNA, 22 bp, Homo sapiens
agaggccagaaggcgcaccccg

SEQ ID NO: 7161677 - DNA, 22 bp, Homo sapiens
agaggccagatcatcatagatg

SEQ ID NO: 7161678 - DNA, 22 bp, Homo sapiens
agaggccagatcatcatagatg

SEQ ID NO: 7161679 - DNA, 22 bp, Homo sapiens
agaggccagatcatcatagatg

SEQ ID NO: 7161680 - DNA, 22 bp, Homo sapiens
agaggccagcaaccacagtaaa

SEQ ID NO: 7161681 - DNA, 22 bp, Homo sapiens
agaggccagcactgcagggaag

SEQ ID NO: 7161682 - DNA, 22 bp, Homo sapiens
agaggccagcactgcagggaag

SEQ ID NO: 7161683 - DNA, 22 bp, Homo sapiens
agaggccagcactgcagggaag

SEQ ID NO: 7161684 - DNA, 22 bp, Homo sapiens
agaggccagcactgcagggaag

SEQ ID NO: 7161685 - DNA, 22 bp, Homo sapiens
agaggccagcagtgcctatctg

SEQ ID NO: 7161686 - DNA, 22 bp, Homo sapiens
agaggccagcagtgcctatctg

SEQ ID NO: 7161687 - DNA, 22 bp, Homo sapiens
agaggccagcccaggccaccga

SEQ ID NO: 7161688 - DNA, 22 bp, Homo sapiens
agaggccagcccaggccaccga

SEQ ID NO: 7161689 - DNA, 23 bp, Homo sapiens
agaggccagcctttggagacacc

SEQ ID NO: 7161690 - DNA, 23 bp, Homo sapiens
agaggccagcctttggagacacc

SEQ ID NO: 7161691 - DNA, 22 bp, Homo sapiens
agaaagcacgggccccaggctc

SEQ ID NO: 7161692 - DNA, 22 bp, Homo sapiens
agaaagcactctgtcttttacc

SEQ ID NO: 7161693 - DNA, 22 bp, Homo sapiens
agaaagcacgggccccaggctc

SEQ ID NO: 7161694 - DNA, 22 bp, Homo sapiens
agaaagcactctgtcttttacc

SEQ ID NO: 7161695 - DNA, 22 bp, Homo sapiens
agaaagcacagcgggtccattt

SEQ ID NO: 7161696 - DNA, 22 bp, Homo sapiens
agaaagcaccctgcactttctg

SEQ ID NO: 7161697 - DNA, 20 bp, Homo sapiens
atcaaaatcctattgaggtt

SEQ ID NO: 7161698 - DNA, 22 bp, Homo sapiens
atcaaaatgctccagtgatggt

SEQ ID NO: 7161699 - DNA, 22 bp, Homo sapiens
atcaaaacttctttagagttta

SEQ ID NO: 7161700 - DNA, 22 bp, Homo sapiens
atcaaaacttctttagagttta

SEQ ID NO: 7161701 - DNA, 20 bp, Homo sapiens
atcaaaatcctattgaggtt

SEQ ID NO: 7161702 - DNA, 20 bp, Homo sapiens
atcaaaatcctattgaggtt

SEQ ID NO: 7161703 - DNA, 20 bp, Homo sapiens
atcaaaatcctattgaggtt

SEQ ID NO: 7161704 - DNA, 22 bp, Homo sapiens
agaaagattttcaacaggaggt

SEQ ID NO: 7161705 - DNA, 22 bp, Homo sapiens
agaaagattttcaacaggaggt

SEQ ID NO: 7161706 - DNA, 22 bp, Homo sapiens
agaaagattttcaacaggaggt

SEQ ID NO: 7161707 - DNA, 22 bp, Homo sapiens
agaaagcagcatttatgatctc

SEQ ID NO: 7161708 - DNA, 22 bp, Homo sapiens
agaaagcagcatttatgatctc

SEQ ID NO: 7161709 - DNA, 22 bp, Homo sapiens
agaaagcatctccattgtaggt

SEQ ID NO: 7161710 - DNA, 22 bp, Homo sapiens
agaaagccaatctgtaaagtct

SEQ ID NO: 7161711 - DNA, 22 bp, Homo sapiens
agaaagcccacccagaagatgt

SEQ ID NO: 7161712 - DNA, 22 bp, Homo sapiens
agaaagcccacccagaagatgt

SEQ ID NO: 7161713 - DNA, 22 bp, Homo sapiens
agaaagcccaggagaacagatt

SEQ ID NO: 7161714 - DNA, 22 bp, Homo sapiens
agaaagcccaggagaacagatt

SEQ ID NO: 7161715 - DNA, 22 bp, Homo sapiens
agaaagcctcaatcttcaggcc

SEQ ID NO: 7161716 - DNA, 22 bp, Homo sapiens
agaaagccttatgtacagaggc

SEQ ID NO: 7161717 - DNA, 22 bp, Homo sapiens
agaaagctccccatgagatgat

SEQ ID NO: 7161718 - DNA, 22 bp, Homo sapiens
atcagcaatcaaattgcagagt

SEQ ID NO: 7161719 - DNA, 22 bp, Homo sapiens
atcagcaatctcgtgtattagg

SEQ ID NO: 7161720 - DNA, 20 bp, Homo sapiens
atcaggtgtattccttatct

SEQ ID NO: 7161721 - DNA, 22 bp, Homo sapiens
atcaggtgtggtccaatcagca

SEQ ID NO: 7161722 - DNA, 22 bp, Homo sapiens
agaaatcatgtcttatttctat

SEQ ID NO: 7161723 - DNA, 22 bp, Homo sapiens
agaaatcattcccaaacccata

SEQ ID NO: 7161724 - DNA, 22 bp, Homo sapiens
agaaatcattgaattatttgct

SEQ ID NO: 7161725 - DNA, 22 bp, Homo sapiens
agaaatcattgaattatttgct

SEQ ID NO: 7161726 - DNA, 22 bp, Homo sapiens
agaaatcatgactaagagcagt

SEQ ID NO: 7161727 - DNA, 22 bp, Homo sapiens
agaaatcatgactaagagcagt

SEQ ID NO: 7161728 - DNA, 22 bp, Homo sapiens
agaaatcatgtcttatttctat

SEQ ID NO: 7161729 - DNA, 22 bp, Homo sapiens
agaaatcatgtcttatttctat

SEQ ID NO: 7161730 - DNA, 22 bp, Homo sapiens
atcagttatttttaagctataa

SEQ ID NO: 7161731 - DNA, 22 bp, Homo sapiens
atcagttatttttaagctataa

SEQ ID NO: 7161732 - DNA, 22 bp, Homo sapiens
atcagtgtttcaaatgtaatct

SEQ ID NO: 7161733 - DNA, 22 bp, Homo sapiens
atcagtgtttgcatgggagctt

SEQ ID NO: 7161734 - DNA, 22 bp, Homo sapiens
atcagttatttttaagctataa

SEQ ID NO: 7161735 - DNA, 22 bp, Homo sapiens
agaaatcaggaacagtaaggag

SEQ ID NO: 7161736 - DNA, 22 bp, Homo sapiens
agaaatcaggaacagtaaggag

SEQ ID NO: 7161737 - DNA, 22 bp, Homo sapiens
agaaatcaggaacagtaaggag

SEQ ID NO: 7161738 - DNA, 23 bp, Homo sapiens
agaaatcatctccaccccatgtc

SEQ ID NO: 7161739 - DNA, 22 bp, Homo sapiens
agaaatcatgactaagagcagt

SEQ ID NO: 7161740 - DNA, 22 bp, Homo sapiens
agaaatcatgactaagagcagt

SEQ ID NO: 7161741 - DNA, 22 bp, Homo sapiens
agaaatcatgactaagagcagt

SEQ ID NO: 7161742 - DNA, 22 bp, Homo sapiens
atcagtaaatattcattgtgca

SEQ ID NO: 7161743 - DNA, 22 bp, Homo sapiens
atcagtaaatattcattgtgca

SEQ ID NO: 7161744 - DNA, 17 bp, Homo sapiens
atcagtagcatatcaga

SEQ ID NO: 7161745 - DNA, 17 bp, Homo sapiens
atcagtagcatatcaga

SEQ ID NO: 7161746 - DNA, 22 bp, Homo sapiens
atcagtatcctgcagtttctat

SEQ ID NO: 7161747 - DNA, 22 bp, Homo sapiens
atcagtcatatccaaattagca

SEQ ID NO: 7161748 - DNA, 22 bp, Homo sapiens
atcagtccaccatactcatctt

SEQ ID NO: 7161749 - DNA, 22 bp, Homo sapiens
atcagtccacttgatgaaatcg

SEQ ID NO: 7161750 - DNA, 18 bp, Homo sapiens
atcagtcctgggagggta

SEQ ID NO: 7161751 - DNA, 22 bp, Homo sapiens
atcagtctgttggaatatcgct

SEQ ID NO: 7161752 - DNA, 23 bp, Homo sapiens
atcagtcttggtagctgtgccca

SEQ ID NO: 7161753 - DNA, 22 bp, Homo sapiens
atcagtgacctgaaatgttttt

SEQ ID NO: 7161754 - DNA, 22 bp, Homo sapiens
atcagtgacctgaaatgttttt

SEQ ID NO: 7161755 - DNA, 22 bp, Homo sapiens
atcagtgatcttgtttgccaga

SEQ ID NO: 7161756 - DNA, 22 bp, Homo sapiens
atcagtgacttcttccaaagtt

SEQ ID NO: 7161757 - DNA, 19 bp, Homo sapiens
atcagtgcatgagtgctgt

SEQ ID NO: 7161758 - DNA, 19 bp, Homo sapiens
atcagtgcatgagtgctgt

SEQ ID NO: 7161759 - DNA, 22 bp, Homo sapiens
atcagtgccccatggctaatgc

SEQ ID NO: 7161760 - DNA, 22 bp, Homo sapiens
atcagtgcttcatagccctggt

SEQ ID NO: 7161761 - DNA, 22 bp, Homo sapiens
atcagtgtattcatagggaata

SEQ ID NO: 7161762 - DNA, 22 bp, Homo sapiens
atcagtgttccttgagactgcc

SEQ ID NO: 7161763 - DNA, 23 bp, Homo sapiens
acttttcaattagctatgcttaa

SEQ ID NO: 7161764 - DNA, 23 bp, Homo sapiens
acttttcaattagctatgcttaa

SEQ ID NO: 7161765 - DNA, 22 bp, Homo sapiens
acttttctccctcctgccttca

SEQ ID NO: 7161766 - DNA, 22 bp, Homo sapiens
actttttacagggtgtatacca

SEQ ID NO: 7161767 - DNA, 22 bp, Homo sapiens
actttttacagggtgtatacca

SEQ ID NO: 7161768 - DNA, 22 bp, Homo sapiens
actttttacagggtgtatacca

SEQ ID NO: 7161769 - DNA, 22 bp, Homo sapiens
acttttgaagaattatgcaaaa

SEQ ID NO: 7161770 - DNA, 22 bp, Homo sapiens
acttttgaggactttattgtat

SEQ ID NO: 7161771 - DNA, 22 bp, Homo sapiens
actttttctcagaaggattggt

SEQ ID NO: 7161772 - DNA, 22 bp, Homo sapiens
actttttagtttcctcaaacat

SEQ ID NO: 7161773 - DNA, 22 bp, Homo sapiens
actttttagtttcctcaaacat

SEQ ID NO: 7161774 - DNA, 22 bp, Homo sapiens
acttttttataaggaagaagat

SEQ ID NO: 7161775 - DNA, 22 bp, Homo sapiens
agaaaaacacaatcgggcctcc

SEQ ID NO: 7161776 - DNA, 21 bp, Homo sapiens
agaaaaacacgatataagccc

SEQ ID NO: 7161777 - DNA, 21 bp, Homo sapiens
agaaaaacacgatataagccc

SEQ ID NO: 7161778 - DNA, 21 bp, Homo sapiens
agaaaaacacgatataagccc

SEQ ID NO: 7161779 - DNA, 21 bp, Homo sapiens
agaaaaacacgatataagccc

SEQ ID NO: 7161780 - DNA, 23 bp, Homo sapiens
agaaaaacaggattgtgttccta

SEQ ID NO: 7161781 - DNA, 21 bp, Homo sapiens
agaaaaaccagcatgttttca

SEQ ID NO: 7161782 - DNA, 22 bp, Homo sapiens
atattttggggtgatgtgcatc

SEQ ID NO: 7161783 - DNA, 22 bp, Homo sapiens
atattttggtagctctcaatga

SEQ ID NO: 7161784 - DNA, 22 bp, Homo sapiens
agaaaaagtcaaggaattggac

SEQ ID NO: 7161785 - DNA, 22 bp, Homo sapiens
agaaaaactaagagtgggtggt

SEQ ID NO: 7161786 - DNA, 19 bp, Homo sapiens
agaaaaactggtactgctg

SEQ ID NO: 7161787 - DNA, 22 bp, Homo sapiens
agaaaaagaaagtggatttgtc

SEQ ID NO: 7161788 - DNA, 22 bp, Homo sapiens
agaaaaagtcaaggaattggac

SEQ ID NO: 7161789 - DNA, 22 bp, Homo sapiens
agaaaaagtcaaggaattggac

SEQ ID NO: 7161790 - DNA, 22 bp, Homo sapiens
atattttggtagctctcaatga

SEQ ID NO: 7161791 - DNA, 22 bp, Homo sapiens
atattttggtagctctcaatga

SEQ ID NO: 7161792 - DNA, 22 bp, Homo sapiens
atattttgtaacttggaatagg

SEQ ID NO: 7161793 - DNA, 22 bp, Homo sapiens
atatttttccatgtgggactct

SEQ ID NO: 7161794 - DNA, 22 bp, Homo sapiens
atatttttccatgtgggactct

SEQ ID NO: 7161795 - DNA, 22 bp, Homo sapiens
atcaaaaccttgacttttaatg

SEQ ID NO: 7161796 - DNA, 22 bp, Homo sapiens
atcaaaaccttgacttttaatg

SEQ ID NO: 7161797 - DNA, 22 bp, Homo sapiens
atcaaaaccttgacttttaatg

SEQ ID NO: 7161798 - DNA, 21 bp, Homo sapiens
atatttttgtttggactgtca

SEQ ID NO: 7161799 - DNA, 22 bp, Homo sapiens
atcaaaaccacctggagggctc

SEQ ID NO: 7161800 - DNA, 22 bp, Homo sapiens
atcaaaacccagacaggctgga

SEQ ID NO: 7161801 - DNA, 21 bp, Homo sapiens
agaaggcaccagcaaggactg

SEQ ID NO: 7161802 - DNA, 21 bp, Homo sapiens
agaaggcaccagcaaggactg

SEQ ID NO: 7161803 - DNA, 22 bp, Homo sapiens
agaaggcacagtgctgctaaga

SEQ ID NO: 7161804 - DNA, 22 bp, Homo sapiens
agaaggcacagtgctgctaaga

SEQ ID NO: 7161805 - DNA, 22 bp, Homo sapiens
agaagccaccagctgaggaaga

SEQ ID NO: 7161806 - DNA, 23 bp, Homo sapiens
agaagctgggagcctggggatgg

SEQ ID NO: 7161807 - DNA, 22 bp, Homo sapiens
agaagccacaggcctcgtctgg

SEQ ID NO: 7161808 - DNA, 23 bp, Homo sapiens
agaagctgggagcctggggatgg

SEQ ID NO: 7161809 - DNA, 19 bp, Homo sapiens
agaagctgtgaaatgaagg

SEQ ID NO: 7161810 - DNA, 19 bp, Homo sapiens
agaagctgtgaaatgaagg

SEQ ID NO: 7161811 - DNA, 22 bp, Homo sapiens
agaagctgtggtatgaaatgtg

SEQ ID NO: 7161812 - DNA, 22 bp, Homo sapiens
agaaggagtgtacaggtcatgc

SEQ ID NO: 7161813 - DNA, 22 bp, Homo sapiens
agaaggagtgtacaggtcatgc

SEQ ID NO: 7161814 - DNA, 22 bp, Homo sapiens
agaaggagtgtacaggtcatgc

SEQ ID NO: 7161815 - DNA, 22 bp, Homo sapiens
agaaggagtgtacaggtcatgc

SEQ ID NO: 7161816 - DNA, 22 bp, Homo sapiens
agaaggagtgtacaggtcatgc

SEQ ID NO: 7161817 - DNA, 22 bp, Homo sapiens
agaaggcagatgggacggagca

SEQ ID NO: 7161818 - DNA, 22 bp, Homo sapiens
agaaggcagatgggacggagca

SEQ ID NO: 7161819 - DNA, 22 bp, Homo sapiens
agaaggcagatgggacggagca

SEQ ID NO: 7161820 - DNA, 22 bp, Homo sapiens
agaaggcagatgggacggagca

SEQ ID NO: 7161821 - DNA, 22 bp, Homo sapiens
agaaggcactcacactggcacg

SEQ ID NO: 7161822 - DNA, 22 bp, Homo sapiens
agaaggcactcacactggcacg

SEQ ID NO: 7161823 - DNA, 22 bp, Homo sapiens
agaaggcagaaagtccaggtat

SEQ ID NO: 7161824 - DNA, 22 bp, Homo sapiens
agaaggcatcagaagtgtgtag

SEQ ID NO: 7161825 - DNA, 20 bp, Homo sapiens
agaaggcaggagacaaaagg

SEQ ID NO: 7161826 - DNA, 20 bp, Homo sapiens
agaaggcaggagacaaaagg

SEQ ID NO: 7161827 - DNA, 22 bp, Homo sapiens
agaaggcaggttttaaaatgtc

SEQ ID NO: 7161828 - DNA, 22 bp, Homo sapiens
agaaggcatcagaagtgtgtag

SEQ ID NO: 7161829 - DNA, 22 bp, Homo sapiens
agaaggcatcagaagtgtgtag

SEQ ID NO: 7161830 - DNA, 22 bp, Homo sapiens
agaaggcatcagaagtgtgtag

SEQ ID NO: 7161831 - DNA, 22 bp, Homo sapiens
agaagccaattctgtgtgagtc

SEQ ID NO: 7161832 - DNA, 22 bp, Homo sapiens
agaagccaattctgtgtgagtc

SEQ ID NO: 7161833 - DNA, 22 bp, Homo sapiens
agaagccaattctgtgtgagtc

SEQ ID NO: 7161834 - DNA, 22 bp, Homo sapiens
agaagccaatccttgtctctct

SEQ ID NO: 7161835 - DNA, 22 bp, Homo sapiens
agaagccaatccttgtctctct

SEQ ID NO: 7161836 - DNA, 22 bp, Homo sapiens
agaagccacaggcctcgtctgg

SEQ ID NO: 7161837 - DNA, 22 bp, Homo sapiens
agaagccacaggaaagcagctt

SEQ ID NO: 7161838 - DNA, 22 bp, Homo sapiens
agaagccacaggaaagcagctt

SEQ ID NO: 7161839 - DNA, 22 bp, Homo sapiens
agaagccaatcagctctctgct

SEQ ID NO: 7161840 - DNA, 22 bp, Homo sapiens
agaagccaatcagctctctgct

SEQ ID NO: 7161841 - DNA, 20 bp, Homo sapiens
agaagccaagtgacatgttt

SEQ ID NO: 7161842 - DNA, 20 bp, Homo sapiens
agaagccaagtgacatgttt

SEQ ID NO: 7161843 - DNA, 22 bp, Homo sapiens
atctctttgatggctcctgtga

SEQ ID NO: 7161844 - DNA, 22 bp, Homo sapiens
agaagccaacagggcaggagag

SEQ ID NO: 7161845 - DNA, 22 bp, Homo sapiens
atctcttcccaactccacattc

SEQ ID NO: 7161846 - DNA, 22 bp, Homo sapiens
atctcttctcccaacacctggc

SEQ ID NO: 7161847 - DNA, 22 bp, Homo sapiens
atctctttgatggctcctgtga

SEQ ID NO: 7161848 - DNA, 22 bp, Homo sapiens
atctctgtaattacatgatatt

SEQ ID NO: 7161849 - DNA, 22 bp, Homo sapiens
atctctgttagatctgcttaaa

SEQ ID NO: 7161850 - DNA, 22 bp, Homo sapiens
atctctgttagatctgcttaaa

SEQ ID NO: 7161851 - DNA, 22 bp, Homo sapiens
atctctgggtccatagaagaga

SEQ ID NO: 7161852 - DNA, 22 bp, Homo sapiens
atctctggtccaaatgttacct

SEQ ID NO: 7161853 - DNA, 22 bp, Homo sapiens
atctctggttgttttgctccca

SEQ ID NO: 7161854 - DNA, 22 bp, Homo sapiens
atctctgggctttgagtttgtt

SEQ ID NO: 7161855 - DNA, 22 bp, Homo sapiens
atctctggccttccttttccaa

SEQ ID NO: 7161856 - DNA, 22 bp, Homo sapiens
atctctggccttccttttccaa

SEQ ID NO: 7161857 - DNA, 22 bp, Homo sapiens
atctctggcaatgcagcatcgt

SEQ ID NO: 7161858 - DNA, 20 bp, Homo sapiens
agaacctaagttaaaacaca

SEQ ID NO: 7161859 - DNA, 22 bp, Homo sapiens
atctctgctagccttcttcagg

SEQ ID NO: 7161860 - DNA, 22 bp, Homo sapiens
agaacatctgaagatacaaagt

SEQ ID NO: 7161861 - DNA, 22 bp, Homo sapiens
agaacatggattgtcaaaggta

SEQ ID NO: 7161862 - DNA, 22 bp, Homo sapiens
agaacattaatgcgaggtatta

SEQ ID NO: 7161863 - DNA, 22 bp, Homo sapiens
agaacattaatgcgaggtatta

SEQ ID NO: 7161864 - DNA, 22 bp, Homo sapiens
agaacattaatgcgaggtatta

SEQ ID NO: 7161865 - DNA, 22 bp, Homo sapiens
agaacatttgtcaaaaagccaa

SEQ ID NO: 7161866 - DNA, 22 bp, Homo sapiens
agaacatttgtcgatcaatttg

SEQ ID NO: 7161867 - DNA, 22 bp, Homo sapiens
agaacatttgtcgatcaatttg

SEQ ID NO: 7161868 - DNA, 22 bp, Homo sapiens
agaaccagtttaagatttgggt

SEQ ID NO: 7161869 - DNA, 22 bp, Homo sapiens
agaaccctaatacaatggacat

SEQ ID NO: 7161870 - DNA, 22 bp, Homo sapiens
atccccagaaaataggtgccta

SEQ ID NO: 7161871 - DNA, 22 bp, Homo sapiens
atccccacgatatagccaaagc

SEQ ID NO: 7161872 - DNA, 22 bp, Homo sapiens
atccccaagccaaggcctgagg

SEQ ID NO: 7161873 - DNA, 22 bp, Homo sapiens
atccccagaaagaccgatgtac

SEQ ID NO: 7161874 - DNA, 22 bp, Homo sapiens
atccccagactttagatttctc

SEQ ID NO: 7161875 - DNA, 22 bp, Homo sapiens
atccccagactttagatttctc

SEQ ID NO: 7161876 - DNA, 22 bp, Homo sapiens
atccccagaaagaccgatgtac

SEQ ID NO: 7161877 - DNA, 22 bp, Homo sapiens
agaacagggactggaggcttca

SEQ ID NO: 7161878 - DNA, 22 bp, Homo sapiens
agaacagtcgtggtgagagaaa

SEQ ID NO: 7161879 - DNA, 22 bp, Homo sapiens
agaacagtcgtggtgagagaaa

SEQ ID NO: 7161880 - DNA, 22 bp, Homo sapiens
agaacaggttcagggtataaaa

SEQ ID NO: 7161881 - DNA, 22 bp, Homo sapiens
agaacagtcgtggtgagagaaa

SEQ ID NO: 7161882 - DNA, 22 bp, Homo sapiens
agaacatctaaatatctgagac

SEQ ID NO: 7161883 - DNA, 22 bp, Homo sapiens
agaacagtcgtggtgagagaaa

SEQ ID NO: 7161884 - DNA, 22 bp, Homo sapiens
agaacagtttgttggagactgt

SEQ ID NO: 7161885 - DNA, 22 bp, Homo sapiens
agaacataattatcataaactg

SEQ ID NO: 7161886 - DNA, 22 bp, Homo sapiens
atccattttccttggcagcagg

SEQ ID NO: 7161887 - DNA, 22 bp, Homo sapiens
atccaggcattctgacttcaag

SEQ ID NO: 7161888 - DNA, 16 bp, Homo sapiens
atccaggcaggaaaga

SEQ ID NO: 7161889 - DNA, 22 bp, Homo sapiens
agaaatcattgaattatttgct

SEQ ID NO: 7161890 - DNA, 22 bp, Homo sapiens
agaaatctaagatgctcaagga

SEQ ID NO: 7161891 - DNA, 22 bp, Homo sapiens
agaaatctattatttcagagtt

SEQ ID NO: 7161892 - DNA, 19 bp, Homo sapiens
agaaatctcgagatttgtt

SEQ ID NO: 7161893 - DNA, 22 bp, Homo sapiens
atccattttccttggcagcagg

SEQ ID NO: 7161894 - DNA, 22 bp, Homo sapiens
atccattttttcagaatgctct

SEQ ID NO: 7161895 - DNA, 22 bp, Homo sapiens
atccattttttcagaatgctct

SEQ ID NO: 7161896 - DNA, 22 bp, Homo sapiens
atccaggcattctgacttcaag

SEQ ID NO: 7161897 - DNA, 22 bp, Homo sapiens
atccatttttgcaaagttgttc

SEQ ID NO: 7161898 - DNA, 22 bp, Homo sapiens
atccatttttgcaaagttgttc

SEQ ID NO: 7161899 - DNA, 19 bp, Homo sapiens
atcccaaggagctgggact

SEQ ID NO: 7161900 - DNA, 22 bp, Homo sapiens
atcccacacccctacaacatat

SEQ ID NO: 7161901 - DNA, 22 bp, Homo sapiens
atcccagagaataatgatcagg

SEQ ID NO: 7161902 - DNA, 22 bp, Homo sapiens
atcccagatagtgaccctcagg

SEQ ID NO: 7161903 - DNA, 22 bp, Homo sapiens
atcccagatagtgaccctcagg

SEQ ID NO: 7161904 - DNA, 22 bp, Homo sapiens
atcccagatggaggctggtcac

SEQ ID NO: 7161905 - DNA, 21 bp, Homo sapiens
atcccagcacccaggagtgca

SEQ ID NO: 7161906 - DNA, 21 bp, Homo sapiens
atcccagcacccaggagtgca

SEQ ID NO: 7161907 - DNA, 22 bp, Homo sapiens
atcccaggaggctgcgcagtta

SEQ ID NO: 7161908 - DNA, 22 bp, Homo sapiens
atcccaggcggcacaggttgca

SEQ ID NO: 7161909 - DNA, 22 bp, Homo sapiens
atcccaggggttgtatcttccc

SEQ ID NO: 7161910 - DNA, 22 bp, Homo sapiens
atcccaggggttgtatcttccc

SEQ ID NO: 7161911 - DNA, 21 bp, Homo sapiens
actttacaatttacatagtga

SEQ ID NO: 7161912 - DNA, 21 bp, Homo sapiens
actttacaatttacatagtga

SEQ ID NO: 7161913 - DNA, 21 bp, Homo sapiens
actttacaatttacatagtga

SEQ ID NO: 7161914 - DNA, 21 bp, Homo sapiens
actttacaatttacatagtga

SEQ ID NO: 7161915 - DNA, 21 bp, Homo sapiens
actttacaatttacatagtga

SEQ ID NO: 7161916 - DNA, 22 bp, Homo sapiens
actttacaagcttatagcctag

SEQ ID NO: 7161917 - DNA, 22 bp, Homo sapiens
actttacaagcttatagcctag

SEQ ID NO: 7161918 - DNA, 22 bp, Homo sapiens
actttacaaactcctcactgtt

SEQ ID NO: 7161919 - DNA, 22 bp, Homo sapiens
actttaaagcagaatggctatg

SEQ ID NO: 7161920 - DNA, 22 bp, Homo sapiens
actttaaagcagaatggctatg

SEQ ID NO: 7161921 - DNA, 22 bp, Homo sapiens
actttaaagcagaatggctatg

SEQ ID NO: 7161922 - DNA, 21 bp, Homo sapiens
actttaatatacatgaggagg

SEQ ID NO: 7161923 - DNA, 21 bp, Homo sapiens
actttaatatacatgaggagg

SEQ ID NO: 7161924 - DNA, 21 bp, Homo sapiens
actttaatatacatgaggagg

SEQ ID NO: 7161925 - DNA, 22 bp, Homo sapiens
actttacacatcttttctcatt

SEQ ID NO: 7161926 - DNA, 22 bp, Homo sapiens
actttacacatcttttctcatt

SEQ ID NO: 7161927 - DNA, 22 bp, Homo sapiens
atacatatccacaggagataaa

SEQ ID NO: 7161928 - DNA, 22 bp, Homo sapiens
atacatatccacaggagataaa

SEQ ID NO: 7161929 - DNA, 20 bp, Homo sapiens
actttacagagaagactgac

SEQ ID NO: 7161930 - DNA, 20 bp, Homo sapiens
actttacagagaagactgac

SEQ ID NO: 7161931 - DNA, 22 bp, Homo sapiens
atacatatccacaggagataaa

SEQ ID NO: 7161932 - DNA, 22 bp, Homo sapiens
atacatatgaatgatttggctc

SEQ ID NO: 7161933 - DNA, 22 bp, Homo sapiens
atacatatgaatgatttggctc

SEQ ID NO: 7161934 - DNA, 22 bp, Homo sapiens
atacatcacctatatattcaca

SEQ ID NO: 7161935 - DNA, 22 bp, Homo sapiens
atacatcacctatatattcaca

SEQ ID NO: 7161936 - DNA, 22 bp, Homo sapiens
atacatcacctatatattcaca

SEQ ID NO: 7161937 - DNA, 22 bp, Homo sapiens
atacatcacctatatattcaca

SEQ ID NO: 7161938 - DNA, 22 bp, Homo sapiens
atacatcacctatatattcaca

SEQ ID NO: 7161939 - DNA, 22 bp, Homo sapiens
atacatcatgctccatatattt

SEQ ID NO: 7161940 - DNA, 22 bp, Homo sapiens
atacatcatgctccatatattt

SEQ ID NO: 7161941 - DNA, 22 bp, Homo sapiens
atacatcatgctccatatattt

SEQ ID NO: 7161942 - DNA, 22 bp, Homo sapiens
acttctctggttgaggtccaat

SEQ ID NO: 7161943 - DNA, 22 bp, Homo sapiens
acttctctggttgaggtccaat

SEQ ID NO: 7161944 - DNA, 22 bp, Homo sapiens
acttctcttcataggtggcaat

SEQ ID NO: 7161945 - DNA, 22 bp, Homo sapiens
ataatttttgtttgatgtccaa

SEQ ID NO: 7161946 - DNA, 22 bp, Homo sapiens
acttctctcattcagacatagc

SEQ ID NO: 7161947 - DNA, 22 bp, Homo sapiens
acttctctccacccaagtccct

SEQ ID NO: 7161948 - DNA, 22 bp, Homo sapiens
acttctctccacccaagtccct

SEQ ID NO: 7161949 - DNA, 22 bp, Homo sapiens
acttctctgctacctgcaaaga

SEQ ID NO: 7161950 - DNA, 22 bp, Homo sapiens
acttctctgctacctgcaaaga

SEQ ID NO: 7161951 - DNA, 22 bp, Homo sapiens
acttctctgctacctgcaaaga

SEQ ID NO: 7161952 - DNA, 22 bp, Homo sapiens
atacaaaaattagccgggagta

SEQ ID NO: 7161953 - DNA, 22 bp, Homo sapiens
atacaaaaattagccgggagta

SEQ ID NO: 7161954 - DNA, 22 bp, Homo sapiens
atacaaaaattagccgggagta

SEQ ID NO: 7161955 - DNA, 22 bp, Homo sapiens
atacaaaatatatactggagac

SEQ ID NO: 7161956 - DNA, 22 bp, Homo sapiens
atacaaaatatatactggagac

SEQ ID NO: 7161957 - DNA, 22 bp, Homo sapiens
atacaaaatatatactggagac

SEQ ID NO: 7161958 - DNA, 22 bp, Homo sapiens
atacaaaaattagccgggagta

SEQ ID NO: 7161959 - DNA, 22 bp, Homo sapiens
atacaaaaattagccgggagta

SEQ ID NO: 7161960 - DNA, 22 bp, Homo sapiens
acttggttggtctcaccctgtt

SEQ ID NO: 7161961 - DNA, 22 bp, Homo sapiens
actttaaaactgatcatcagag

SEQ ID NO: 7161962 - DNA, 22 bp, Homo sapiens
actttaaagcagaatggctatg

SEQ ID NO: 7161963 - DNA, 22 bp, Homo sapiens
atacaaagacaaatctcaatct

SEQ ID NO: 7161964 - DNA, 22 bp, Homo sapiens
atacaaaatatatactggagac

SEQ ID NO: 7161965 - DNA, 22 bp, Homo sapiens
atacaaaatatatactggagac

SEQ ID NO: 7161966 - DNA, 22 bp, Homo sapiens
atacaaaatatatactggagac

SEQ ID NO: 7161967 - DNA, 22 bp, Homo sapiens
atacaaaatatatactggagac

SEQ ID NO: 7161968 - DNA, 22 bp, Homo sapiens
atacaaaatatatactggagac

SEQ ID NO: 7161969 - DNA, 22 bp, Homo sapiens
atacaaaatatatactggagac

SEQ ID NO: 7161970 - DNA, 22 bp, Homo sapiens
atacaaaatatatactggagac

SEQ ID NO: 7161971 - DNA, 22 bp, Homo sapiens
atacatcatgctccatatattt

SEQ ID NO: 7161972 - DNA, 22 bp, Homo sapiens
atacatcatttatgatgtgtgt

SEQ ID NO: 7161973 - DNA, 22 bp, Homo sapiens
atacatcatttatgatgtgtgt

SEQ ID NO: 7161974 - DNA, 22 bp, Homo sapiens
atacatcatgctccatatattt

SEQ ID NO: 7161975 - DNA, 22 bp, Homo sapiens
atacatcatgctccatatattt

SEQ ID NO: 7161976 - DNA, 22 bp, Homo sapiens
atacatcatttcccatcaatcg

SEQ ID NO: 7161977 - DNA, 22 bp, Homo sapiens
atacatcatttcccatcaatcg

SEQ ID NO: 7161978 - DNA, 22 bp, Homo sapiens
atacatcatttcccatcaatcg

SEQ ID NO: 7161979 - DNA, 22 bp, Homo sapiens
atacatcatttcccatcaatcg

SEQ ID NO: 7161980 - DNA, 22 bp, Homo sapiens
actttgcaatacttaatacaaa

SEQ ID NO: 7161981 - DNA, 22 bp, Homo sapiens
atacatctagagtcataaaaac

SEQ ID NO: 7161982 - DNA, 22 bp, Homo sapiens
actttctgtcatctagacaagt

SEQ ID NO: 7161983 - DNA, 23 bp, Homo sapiens
actttgcagagccccttgaaaca

SEQ ID NO: 7161984 - DNA, 22 bp, Homo sapiens
actttgcagggcttgatatcca

SEQ ID NO: 7161985 - DNA, 22 bp, Homo sapiens
actttgctgcaggtttaaagag

SEQ ID NO: 7161986 - DNA, 22 bp, Homo sapiens
actttggaaattgtctataaga

SEQ ID NO: 7161987 - DNA, 22 bp, Homo sapiens
actttggaagatggctgtattt

SEQ ID NO: 7161988 - DNA, 22 bp, Homo sapiens
actttggacaatttattactgt

SEQ ID NO: 7161989 - DNA, 20 bp, Homo sapiens
atagatatcatctttagaag

SEQ ID NO: 7161990 - DNA, 22 bp, Homo sapiens
atagatactgggtatggagatg

SEQ ID NO: 7161991 - DNA, 22 bp, Homo sapiens
atagatacttataacaattgtg

SEQ ID NO: 7161992 - DNA, 22 bp, Homo sapiens
atagatacttataacaattgtg

SEQ ID NO: 7161993 - DNA, 20 bp, Homo sapiens
atagatatcatctttagaag

SEQ ID NO: 7161994 - DNA, 20 bp, Homo sapiens
atagatatcatctttagaag

SEQ ID NO: 7161995 - DNA, 20 bp, Homo sapiens
atagatatcatctttagaag

SEQ ID NO: 7161996 - DNA, 22 bp, Homo sapiens
atagatattagcaaaattttat

SEQ ID NO: 7161997 - DNA, 22 bp, Homo sapiens
actttgtgcccaacagaaagaa

SEQ ID NO: 7161998 - DNA, 22 bp, Homo sapiens
atagatcatgttaaaagctcca

SEQ ID NO: 7161999 - DNA, 22 bp, Homo sapiens
atagatcattgatacttgcatc

SEQ ID NO: 7162000 - DNA, 22 bp, Homo sapiens
atagatcatttgcattggtcgt

SEQ ID NO: 7162001 - DNA, 22 bp, Homo sapiens
actttgttcctttcacaaagaa

SEQ ID NO: 7162002 - DNA, 20 bp, Homo sapiens
atagatcagtgagactaaag

SEQ ID NO: 7162003 - DNA, 22 bp, Homo sapiens
atagatcacaatggttcacttt

SEQ ID NO: 7162004 - DNA, 22 bp, Homo sapiens
atagatcacaatggttcacttt

SEQ ID NO: 7162005 - DNA, 22 bp, Homo sapiens
atagatcaatatttagaaactt

SEQ ID NO: 7162006 - DNA, 22 bp, Homo sapiens
atagatcaatgagcaatttaat

SEQ ID NO: 7162007 - DNA, 22 bp, Homo sapiens
actttgttcctttcacaaagaa

SEQ ID NO: 7162008 - DNA, 22 bp, Homo sapiens
actttgttcctttcacaaagaa

SEQ ID NO: 7162009 - DNA, 23 bp, Homo sapiens
acttttcaattagctatgcttaa

SEQ ID NO: 7162010 - DNA, 23 bp, Homo sapiens
acttttcaattagctatgcttaa

SEQ ID NO: 7162011 - DNA, 23 bp, Homo sapiens
acttttcaattagctatgcttaa

SEQ ID NO: 7162012 - DNA, 22 bp, Homo sapiens
atagagtgatgtaaggtatgtg

SEQ ID NO: 7162013 - DNA, 22 bp, Homo sapiens
atagagttttattttccaataa

SEQ ID NO: 7162014 - DNA, 22 bp, Homo sapiens
atagataatgtgtagcagtgat

SEQ ID NO: 7162015 - DNA, 22 bp, Homo sapiens
actttgggacccagccaaccct

SEQ ID NO: 7162016 - DNA, 19 bp, Homo sapiens
atagagtagagtatctgtt

SEQ ID NO: 7162017 - DNA, 22 bp, Homo sapiens
atagagtgatgtaaggtatgtg

SEQ ID NO: 7162018 - DNA, 22 bp, Homo sapiens
atagagtgatgtaaggtatgtg

SEQ ID NO: 7162019 - DNA, 22 bp, Homo sapiens
actttggacgccatgctgtttg

SEQ ID NO: 7162020 - DNA, 22 bp, Homo sapiens
actttggacgccatgctgtttg

SEQ ID NO: 7162021 - DNA, 17 bp, Homo sapiens
actttggaggcagctgt

SEQ ID NO: 7162022 - DNA, 22 bp, Homo sapiens
actttggatctgatgtaatcag

SEQ ID NO: 7162023 - DNA, 22 bp, Homo sapiens
actttggatctgatgtaatcag

SEQ ID NO: 7162024 - DNA, 22 bp, Homo sapiens
actttggattgggtccctccca

SEQ ID NO: 7162025 - DNA, 22 bp, Homo sapiens
actttgggaagctgcaattgcc

SEQ ID NO: 7162026 - DNA, 19 bp, Homo sapiens
ataaataaaaagtgggaga

SEQ ID NO: 7162027 - DNA, 22 bp, Homo sapiens
acttccagatggccccatctaa

SEQ ID NO: 7162028 - DNA, 22 bp, Homo sapiens
acttccagcaacttggtgctat

SEQ ID NO: 7162029 - DNA, 19 bp, Homo sapiens
ataaataaaaagtgggaga

SEQ ID NO: 7162030 - DNA, 22 bp, Homo sapiens
acttccagcccctgtcagcaaa

SEQ ID NO: 7162031 - DNA, 22 bp, Homo sapiens
acttccagctaggttctgctaa

SEQ ID NO: 7162032 - DNA, 22 bp, Homo sapiens
acttcctggctgggtgacctgg

SEQ ID NO: 7162033 - DNA, 22 bp, Homo sapiens
acttcctggctgggtgacctgg

SEQ ID NO: 7162034 - DNA, 22 bp, Homo sapiens
acttcctggctgggtgacctgg

SEQ ID NO: 7162035 - DNA, 22 bp, Homo sapiens
acttcctggctgggtgacctgg

SEQ ID NO: 7162036 - DNA, 22 bp, Homo sapiens
ataaagttctgctggcatatat

SEQ ID NO: 7162037 - DNA, 22 bp, Homo sapiens
ataaagtggaagtgttaaaggg

SEQ ID NO: 7162038 - DNA, 21 bp, Homo sapiens
ataaagttttacaggaatgca

SEQ ID NO: 7162039 - DNA, 21 bp, Homo sapiens
ataaagttttacaggaatgca

SEQ ID NO: 7162040 - DNA, 19 bp, Homo sapiens
ataaataaaaagtgggaga

SEQ ID NO: 7162041 - DNA, 19 bp, Homo sapiens
ataaataaaaagtgggaga

SEQ ID NO: 7162042 - DNA, 19 bp, Homo sapiens
ataaataaaaagtgggaga

SEQ ID NO: 7162043 - DNA, 19 bp, Homo sapiens
ataaataaaaagtgggaga

SEQ ID NO: 7162044 - DNA, 19 bp, Homo sapiens
ataaataaaaagtgggaga

SEQ ID NO: 7162045 - DNA, 19 bp, Homo sapiens
ataaataaaaagtgggaga

SEQ ID NO: 7162046 - DNA, 22 bp, Homo sapiens
acttcctgtgttggtcttgctg

SEQ ID NO: 7162047 - DNA, 22 bp, Homo sapiens
acttcctgttatgtgtgcctct

SEQ ID NO: 7162048 - DNA, 22 bp, Homo sapiens
acttcctgttatgtgtgcctct

SEQ ID NO: 7162049 - DNA, 22 bp, Homo sapiens
acttcctgtatttatccatagc

SEQ ID NO: 7162050 - DNA, 22 bp, Homo sapiens
acttcctgtgttggtcttgctg

SEQ ID NO: 7162051 - DNA, 22 bp, Homo sapiens
acttcctgtgttggtcttgctg

SEQ ID NO: 7162052 - DNA, 22 bp, Homo sapiens
acttcctgtgttggtcttgctg

SEQ ID NO: 7162053 - DNA, 22 bp, Homo sapiens
acttcctgttatgtgtgcctct

SEQ ID NO: 7162054 - DNA, 22 bp, Homo sapiens
acttcctgttatgtgtgcctct

SEQ ID NO: 7162055 - DNA, 22 bp, Homo sapiens
acttccttccaaacattcattt

SEQ ID NO: 7162056 - DNA, 22 bp, Homo sapiens
acttccttccaaacattcattt

SEQ ID NO: 7162057 - DNA, 22 bp, Homo sapiens
acttcctgggcatgcagagtcc

SEQ ID NO: 7162058 - DNA, 22 bp, Homo sapiens
acttcctgggcatgcagagtcc

SEQ ID NO: 7162059 - DNA, 22 bp, Homo sapiens
acttcctgggtgttgtaaggtc

SEQ ID NO: 7162060 - DNA, 22 bp, Homo sapiens
acttcctgggtgttgtaaggtc

SEQ ID NO: 7162061 - DNA, 22 bp, Homo sapiens
acttcctgggtgttgtaaggtc

SEQ ID NO: 7162062 - DNA, 22 bp, Homo sapiens
acttcctgtaaatagaattcca

SEQ ID NO: 7162063 - DNA, 22 bp, Homo sapiens
acttcctgtaaatagaattcca

SEQ ID NO: 7162064 - DNA, 22 bp, Homo sapiens
acttcctgtaaatagaattcca

SEQ ID NO: 7162065 - DNA, 22 bp, Homo sapiens
acttcctgtaaatagaattcca

SEQ ID NO: 7162066 - DNA, 22 bp, Homo sapiens
acttctaagctcaaattggtat

SEQ ID NO: 7162067 - DNA, 22 bp, Homo sapiens
acttcgtcataatttactgttc

SEQ ID NO: 7162068 - DNA, 22 bp, Homo sapiens
acttctcagattgttgaacatc

SEQ ID NO: 7162069 - DNA, 18 bp, Homo sapiens
acttctcatttctctgca

SEQ ID NO: 7162070 - DNA, 18 bp, Homo sapiens
acttctcatttctctgca

SEQ ID NO: 7162071 - DNA, 22 bp, Homo sapiens
acttctctcattcagacatagc

SEQ ID NO: 7162072 - DNA, 22 bp, Homo sapiens
acttctctcattcagacatagc

SEQ ID NO: 7162073 - DNA, 22 bp, Homo sapiens
acttccttttcaaccatacagc

SEQ ID NO: 7162074 - DNA, 22 bp, Homo sapiens
acttccttgtcaggtgcatcat

SEQ ID NO: 7162075 - DNA, 22 bp, Homo sapiens
acttccttgtactgactccatt

SEQ ID NO: 7162076 - DNA, 22 bp, Homo sapiens
ataaagtcatggcagctagaat

SEQ ID NO: 7162077 - DNA, 22 bp, Homo sapiens
ataaagtcatggcagctagaat

SEQ ID NO: 7162078 - DNA, 22 bp, Homo sapiens
ataaagtcaaggcattttatga

SEQ ID NO: 7162079 - DNA, 22 bp, Homo sapiens
ataaagtcaaggcattttatga

SEQ ID NO: 7162080 - DNA, 22 bp, Homo sapiens
ataaagtcaaggcattttatga

SEQ ID NO: 7162081 - DNA, 22 bp, Homo sapiens
ataaagtcatggcagctagaat

SEQ ID NO: 7162082 - DNA, 22 bp, Homo sapiens
ataaagtcattatgaagatcta

SEQ ID NO: 7162083 - DNA, 22 bp, Homo sapiens
ataaagtcatttcaaaagttga

SEQ ID NO: 7162084 - DNA, 22 bp, Homo sapiens
ataaagtctaccgtattaaaga

SEQ ID NO: 7162085 - DNA, 22 bp, Homo sapiens
ataaagtctaccgtattaaaga

SEQ ID NO: 7162086 - DNA, 22 bp, Homo sapiens
ataaagtctcatgggtaaatgt

SEQ ID NO: 7162087 - DNA, 22 bp, Homo sapiens
ataaagtctgggccaggcatgg

SEQ ID NO: 7162088 - DNA, 18 bp, Homo sapiens
ataaagtgctaataatgg

SEQ ID NO: 7162089 - DNA, 22 bp, Homo sapiens
ataaagtggaagtgttaaaggg

SEQ ID NO: 7162090 - DNA, 22 bp, Homo sapiens
ataaagtcaaggcattttatga

SEQ ID NO: 7162091 - DNA, 22 bp, Homo sapiens
ataaagtagctttcagtgccaa

SEQ ID NO: 7162092 - DNA, 22 bp, Homo sapiens
acttaaagtagttttactgtgg

SEQ ID NO: 7162093 - DNA, 22 bp, Homo sapiens
ataaagtagctttcagtgccaa

SEQ ID NO: 7162094 - DNA, 19 bp, Homo sapiens
acttaaacctagaaaatgc

SEQ ID NO: 7162095 - DNA, 22 bp, Homo sapiens
acttaaagaggctacttttggt

SEQ ID NO: 7162096 - DNA, 22 bp, Homo sapiens
acttaaaaagaatcttttcacg

SEQ ID NO: 7162097 - DNA, 22 bp, Homo sapiens
actgttttctgtaaagggccag

SEQ ID NO: 7162098 - DNA, 22 bp, Homo sapiens
actgttttctgtaaagggccag

SEQ ID NO: 7162099 - DNA, 22 bp, Homo sapiens
actgttttcttagctccctgct

SEQ ID NO: 7162100 - DNA, 22 bp, Homo sapiens
actgttttgtgccttagtttcc

SEQ ID NO: 7162101 - DNA, 22 bp, Homo sapiens
actgttttgtgccttagtttcc

SEQ ID NO: 7162102 - DNA, 22 bp, Homo sapiens
actgttttgtgccttagtttcc

SEQ ID NO: 7162103 - DNA, 22 bp, Homo sapiens
acttaaaaacagatccagcagg

SEQ ID NO: 7162104 - DNA, 22 bp, Homo sapiens
actgtttatagttttgagctga

SEQ ID NO: 7162105 - DNA, 22 bp, Homo sapiens
actgtttcaggcaaggcaggcc

SEQ ID NO: 7162106 - DNA, 22 bp, Homo sapiens
actgtttcagtttctgaagttt

SEQ ID NO: 7162107 - DNA, 22 bp, Homo sapiens
actgtttgctgatagatattta

SEQ ID NO: 7162108 - DNA, 22 bp, Homo sapiens
actgttttcctaatgagcaaga

SEQ ID NO: 7162109 - DNA, 22 bp, Homo sapiens
actgttttctaaagaacagatg

SEQ ID NO: 7162110 - DNA, 22 bp, Homo sapiens
agttttaaatgatggtggtggt

SEQ ID NO: 7162111 - DNA, 22 bp, Homo sapiens
agtttctagcaaggattgttga

SEQ ID NO: 7162112 - DNA, 22 bp, Homo sapiens
agtttctaccggtacattcagg

SEQ ID NO: 7162113 - DNA, 22 bp, Homo sapiens
actgggctcataatgtcataga

SEQ ID NO: 7162114 - DNA, 22 bp, Homo sapiens
actgggctccaaggacctggag

SEQ ID NO: 7162115 - DNA, 22 bp, Homo sapiens
actgggccttgtgtgtctcatc

SEQ ID NO: 7162116 - DNA, 22 bp, Homo sapiens
actgggccttgtgtgtctcatc

SEQ ID NO: 7162117 - DNA, 22 bp, Homo sapiens
actgggctagagtggaagctgg

SEQ ID NO: 7162118 - DNA, 22 bp, Homo sapiens
actgggctagagtggaagctgg

SEQ ID NO: 7162119 - DNA, 22 bp, Homo sapiens
agttttatatcttccattggtt

SEQ ID NO: 7162120 - DNA, 22 bp, Homo sapiens
agttttataaaggcacctcagt

SEQ ID NO: 7162121 - DNA, 22 bp, Homo sapiens
agttttataaaggcacctcagt

SEQ ID NO: 7162122 - DNA, 22 bp, Homo sapiens
agttttagagtaagaattactg

SEQ ID NO: 7162123 - DNA, 22 bp, Homo sapiens
agttttataaaggcacctcagt

SEQ ID NO: 7162124 - DNA, 22 bp, Homo sapiens
agttttatatcttccattggtt

SEQ ID NO: 7162125 - DNA, 21 bp, Homo sapiens
agttttatattataagctaaa

SEQ ID NO: 7162126 - DNA, 22 bp, Homo sapiens
agttttatatcttccattggtt

SEQ ID NO: 7162127 - DNA, 21 bp, Homo sapiens
agttttatattataagctaaa

SEQ ID NO: 7162128 - DNA, 22 bp, Homo sapiens
agttttatctgtaagctgttca

SEQ ID NO: 7162129 - DNA, 22 bp, Homo sapiens
agttttatctgtaagctgttca

SEQ ID NO: 7162130 - DNA, 22 bp, Homo sapiens
agttttatctgtaagctgttca

SEQ ID NO: 7162131 - DNA, 21 bp, Homo sapiens
agttttatattataagctaaa

SEQ ID NO: 7162132 - DNA, 22 bp, Homo sapiens
agttttatgcagtgttctgata

SEQ ID NO: 7162133 - DNA, 22 bp, Homo sapiens
agttttatgcagtgttctgata

SEQ ID NO: 7162134 - DNA, 22 bp, Homo sapiens
agttttatgcagtgttctgata

SEQ ID NO: 7162135 - DNA, 22 bp, Homo sapiens
agttttatctgtaagctgttca

SEQ ID NO: 7162136 - DNA, 22 bp, Homo sapiens
agttttatgcagtgttctgata

SEQ ID NO: 7162137 - DNA, 22 bp, Homo sapiens
agttttatgcagtgttctgata

SEQ ID NO: 7162138 - DNA, 22 bp, Homo sapiens
agttttatgcagtgttctgata

SEQ ID NO: 7162139 - DNA, 22 bp, Homo sapiens
agttttatggctcaacctaata

SEQ ID NO: 7162140 - DNA, 22 bp, Homo sapiens
agttttatggctcaacctaata

SEQ ID NO: 7162141 - DNA, 22 bp, Homo sapiens
agttttatggctcaacctaata

SEQ ID NO: 7162142 - DNA, 22 bp, Homo sapiens
agttttatgttcacagaaggat

SEQ ID NO: 7162143 - DNA, 22 bp, Homo sapiens
agttttatgtagacaattcatt

SEQ ID NO: 7162144 - DNA, 22 bp, Homo sapiens
agttttatgtagacaattcatt

SEQ ID NO: 7162145 - DNA, 22 bp, Homo sapiens
agttttatgtagacaattcatt

SEQ ID NO: 7162146 - DNA, 22 bp, Homo sapiens
agttttatgtagacaattcatt

SEQ ID NO: 7162147 - DNA, 23 bp, Homo sapiens
agtttttaatggtcatagctgag

SEQ ID NO: 7162148 - DNA, 23 bp, Homo sapiens
agtttttaatggtcatagctgag

SEQ ID NO: 7162149 - DNA, 21 bp, Homo sapiens
agtttttactcttaactgtgg

SEQ ID NO: 7162150 - DNA, 21 bp, Homo sapiens
agtttttactcttaactgtgg

SEQ ID NO: 7162151 - DNA, 21 bp, Homo sapiens
agtttttactcttaactgtgg

SEQ ID NO: 7162152 - DNA, 21 bp, Homo sapiens
agtttttactcttaactgtgg

SEQ ID NO: 7162153 - DNA, 22 bp, Homo sapiens
agtttttcctgattttacagaa

SEQ ID NO: 7162154 - DNA, 22 bp, Homo sapiens
ataaaaactgacccatcctttg

SEQ ID NO: 7162155 - DNA, 22 bp, Homo sapiens
ataaaaactgacccatcctttg

SEQ ID NO: 7162156 - DNA, 22 bp, Homo sapiens
actgttatttgtaatccattat

SEQ ID NO: 7162157 - DNA, 22 bp, Homo sapiens
actgttatttgtaatccattat

SEQ ID NO: 7162158 - DNA, 22 bp, Homo sapiens
actgttcaagcaaatgacattg

SEQ ID NO: 7162159 - DNA, 22 bp, Homo sapiens
actgtttagtaaattgaaatgg

SEQ ID NO: 7162160 - DNA, 22 bp, Homo sapiens
agtttttgagaatttactatgt

SEQ ID NO: 7162161 - DNA, 22 bp, Homo sapiens
agtttttgagaatttactatgt

SEQ ID NO: 7162162 - DNA, 22 bp, Homo sapiens
agtttttgagaatttactatgt

SEQ ID NO: 7162163 - DNA, 22 bp, Homo sapiens
agtttttgctgatagcatgctt

SEQ ID NO: 7162164 - DNA, 19 bp, Homo sapiens
agtttttggaaatcctgct

SEQ ID NO: 7162165 - DNA, 22 bp, Homo sapiens
ataaaaactgacccatcctttg

SEQ ID NO: 7162166 - DNA, 22 bp, Homo sapiens
agtgaagctggagaaaggcagt

SEQ ID NO: 7162167 - DNA, 22 bp, Homo sapiens
agtgaagctaacctgctgattt

SEQ ID NO: 7162168 - DNA, 22 bp, Homo sapiens
agtgaaggaaacaattggttga

SEQ ID NO: 7162169 - DNA, 22 bp, Homo sapiens
agtgaaggaagtttgtcttggg

SEQ ID NO: 7162170 - DNA, 22 bp, Homo sapiens
agtgaaggtttacagggcccct

SEQ ID NO: 7162171 - DNA, 22 bp, Homo sapiens
agtgaagtaaaagatgtgcatc

SEQ ID NO: 7162172 - DNA, 22 bp, Homo sapiens
agtgaagaggaagtggggcaca

SEQ ID NO: 7162173 - DNA, 21 bp, Homo sapiens
agtgaagagtgaaacacatgg

SEQ ID NO: 7162174 - DNA, 22 bp, Homo sapiens
agtgaagcccatttttagctgt

SEQ ID NO: 7162175 - DNA, 22 bp, Homo sapiens
agtgaagccccgatgcgttttg

SEQ ID NO: 7162176 - DNA, 22 bp, Homo sapiens
agtgaagcggcagatattagaa

SEQ ID NO: 7162177 - DNA, 20 bp, Homo sapiens
agtgaatagagacattgccc

SEQ ID NO: 7162178 - DNA, 20 bp, Homo sapiens
agtgaatagagacattgccc

SEQ ID NO: 7162179 - DNA, 22 bp, Homo sapiens
agtgaatacatgtcactcagca

SEQ ID NO: 7162180 - DNA, 20 bp, Homo sapiens
agtgaatagagacattgccc

SEQ ID NO: 7162181 - DNA, 22 bp, Homo sapiens
agtgaatatgcagcaagaagtt

SEQ ID NO: 7162182 - DNA, 22 bp, Homo sapiens
agtgaatatttttagacaccca

SEQ ID NO: 7162183 - DNA, 22 bp, Homo sapiens
actgcactccaacctgggtgac

SEQ ID NO: 7162184 - DNA, 22 bp, Homo sapiens
actgcacatagtgggctggcct

SEQ ID NO: 7162185 - DNA, 22 bp, Homo sapiens
agtgaatgagaggtgagtattg

SEQ ID NO: 7162186 - DNA, 22 bp, Homo sapiens
actgcacagattaagttagatt

SEQ ID NO: 7162187 - DNA, 22 bp, Homo sapiens
actgcacagtcccagaggatgc

SEQ ID NO: 7162188 - DNA, 22 bp, Homo sapiens
actgcacagtcccagaggatgc

SEQ ID NO: 7162189 - DNA, 22 bp, Homo sapiens
actgcacagtcccagaggatgc

SEQ ID NO: 7162190 - DNA, 22 bp, Homo sapiens
actgcacttcaccctgggtgac

SEQ ID NO: 7162191 - DNA, 22 bp, Homo sapiens
actgcactcctgcctgggtaac

SEQ ID NO: 7162192 - DNA, 22 bp, Homo sapiens
actgcactcctgcctgggtaac

SEQ ID NO: 7162193 - DNA, 22 bp, Homo sapiens
actgcactcctgcctgggtaac

SEQ ID NO: 7162194 - DNA, 22 bp, Homo sapiens
actgcactcctgcctgggtaac

SEQ ID NO: 7162195 - DNA, 22 bp, Homo sapiens
actgcactcctgcctgggtaac

SEQ ID NO: 7162196 - DNA, 22 bp, Homo sapiens
actgcactcctgcctgggtaac

SEQ ID NO: 7162197 - DNA, 22 bp, Homo sapiens
actgcactccagcctgggtgat

SEQ ID NO: 7162198 - DNA, 22 bp, Homo sapiens
actgcactccagcctgggtgat

SEQ ID NO: 7162199 - DNA, 22 bp, Homo sapiens
actgcactccagcctgggtgat

SEQ ID NO: 7162200 - DNA, 22 bp, Homo sapiens
actgcactccagcctgggtgat

SEQ ID NO: 7162201 - DNA, 22 bp, Homo sapiens
actgcactccagcctgggtgat

SEQ ID NO: 7162202 - DNA, 22 bp, Homo sapiens
agtgctctcatgctgactatta

SEQ ID NO: 7162203 - DNA, 22 bp, Homo sapiens
agtgctcctttcattgctgccc

SEQ ID NO: 7162204 - DNA, 22 bp, Homo sapiens
agtgctcctttcattgctgccc

SEQ ID NO: 7162205 - DNA, 22 bp, Homo sapiens
agtgctcctttcattgctgccc

SEQ ID NO: 7162206 - DNA, 22 bp, Homo sapiens
agtgctctctccccagtgctac

SEQ ID NO: 7162207 - DNA, 22 bp, Homo sapiens
agtgctctgatctccttgggtt

SEQ ID NO: 7162208 - DNA, 22 bp, Homo sapiens
agtgctctgggtccactccaga

SEQ ID NO: 7162209 - DNA, 22 bp, Homo sapiens
agtgctccctagagttgtgcaa

SEQ ID NO: 7162210 - DNA, 22 bp, Homo sapiens
agtgctcctatggatcagttgt

SEQ ID NO: 7162211 - DNA, 22 bp, Homo sapiens
agtgctcctcagaagagttgga

SEQ ID NO: 7162212 - DNA, 22 bp, Homo sapiens
agtgctcctcagaagagttgga

SEQ ID NO: 7162213 - DNA, 22 bp, Homo sapiens
agtgctcctgaagcttgaggca

SEQ ID NO: 7162214 - DNA, 22 bp, Homo sapiens
agtgctcctgaagcttgaggca

SEQ ID NO: 7162215 - DNA, 22 bp, Homo sapiens
agtgctcctgccagctttctgg

SEQ ID NO: 7162216 - DNA, 22 bp, Homo sapiens
agtgctcctgccagctttctgg

SEQ ID NO: 7162217 - DNA, 22 bp, Homo sapiens
agtgctcctttcattgctgccc

SEQ ID NO: 7162218 - DNA, 22 bp, Homo sapiens
agtgctctgtcattggtgggat

SEQ ID NO: 7162219 - DNA, 21 bp, Homo sapiens
agtgctgaaaaagcatgtctc

SEQ ID NO: 7162220 - DNA, 22 bp, Homo sapiens
agtgctgaacatagaatggaca

SEQ ID NO: 7162221 - DNA, 22 bp, Homo sapiens
actgcagcaaagcccgtgtctt

SEQ ID NO: 7162222 - DNA, 23 bp, Homo sapiens
actgcagcctccgcctgccgggt

SEQ ID NO: 7162223 - DNA, 22 bp, Homo sapiens
agtgctcataaaaatgtgaaac

SEQ ID NO: 7162224 - DNA, 22 bp, Homo sapiens
agtgctccaaaggttggtcatt

SEQ ID NO: 7162225 - DNA, 22 bp, Homo sapiens
agtgctccaaaggttggtcatt

SEQ ID NO: 7162226 - DNA, 22 bp, Homo sapiens
agtgctccacattgcactattc

SEQ ID NO: 7162227 - DNA, 22 bp, Homo sapiens
agtgctccacattgcactattc

SEQ ID NO: 7162228 - DNA, 23 bp, Homo sapiens
agtgctcccaggacctggggcag

SEQ ID NO: 7162229 - DNA, 22 bp, Homo sapiens
agtgctcactctccacagtgcc

SEQ ID NO: 7162230 - DNA, 22 bp, Homo sapiens
actgcacttcagcctgggtgac

SEQ ID NO: 7162231 - DNA, 22 bp, Homo sapiens
agtgctatcgagttctaatgct

SEQ ID NO: 7162232 - DNA, 22 bp, Homo sapiens
actgcacttcagcctgggtgac

SEQ ID NO: 7162233 - DNA, 22 bp, Homo sapiens
actgcacttcaccctgggtgac

SEQ ID NO: 7162234 - DNA, 22 bp, Homo sapiens
actgcacttcaccctgggtgac

SEQ ID NO: 7162235 - DNA, 22 bp, Homo sapiens
actgcacttcaccctgggtgac

SEQ ID NO: 7162236 - DNA, 22 bp, Homo sapiens
actgcacttcaccctgggtgac

SEQ ID NO: 7162237 - DNA, 22 bp, Homo sapiens
agtgaagaggaagtggggcaca

SEQ ID NO: 7162238 - DNA, 22 bp, Homo sapiens
agtgaagaggaagtggggcaca

SEQ ID NO: 7162239 - DNA, 22 bp, Homo sapiens
agtgaagaggaagtggggcaca

SEQ ID NO: 7162240 - DNA, 19 bp, Homo sapiens
agtgaactccatatcaggt

SEQ ID NO: 7162241 - DNA, 22 bp, Homo sapiens
agtgaactctcagtaaataaat

SEQ ID NO: 7162242 - DNA, 22 bp, Homo sapiens
agtgaactgtggcccgtgaact

SEQ ID NO: 7162243 - DNA, 19 bp, Homo sapiens
agtgaactccatatcaggt

SEQ ID NO: 7162244 - DNA, 22 bp, Homo sapiens
agtgaacaaaggtagtgagcat

SEQ ID NO: 7162245 - DNA, 22 bp, Homo sapiens
agtgaacaaaggtagtgagcat

SEQ ID NO: 7162246 - DNA, 22 bp, Homo sapiens
agtgaacaaaggtagtgagcat

SEQ ID NO: 7162247 - DNA, 22 bp, Homo sapiens
agtgaacaagtcgcgatgtttt

SEQ ID NO: 7162248 - DNA, 22 bp, Homo sapiens
agtgaacaagttaagaacacta

SEQ ID NO: 7162249 - DNA, 19 bp, Homo sapiens
agtgaacacaaagagaagg

SEQ ID NO: 7162250 - DNA, 22 bp, Homo sapiens
agtgaaatttgtttagataggt

SEQ ID NO: 7162251 - DNA, 22 bp, Homo sapiens
agtgaaatttgtttagataggt

SEQ ID NO: 7162252 - DNA, 22 bp, Homo sapiens
agtgaaatttgtttagataggt

SEQ ID NO: 7162253 - DNA, 22 bp, Homo sapiens
actgagccttgaagctagatag

SEQ ID NO: 7162254 - DNA, 22 bp, Homo sapiens
actgagctccaagcctggaatc

SEQ ID NO: 7162255 - DNA, 22 bp, Homo sapiens
actgagctccctgagggcaggc

SEQ ID NO: 7162256 - DNA, 22 bp, Homo sapiens
actgagcataaatatgtgtcca

SEQ ID NO: 7162257 - DNA, 22 bp, Homo sapiens
actgagcataaatatgtgtcca

SEQ ID NO: 7162258 - DNA, 22 bp, Homo sapiens
actgagcatcagggctgggaac

SEQ ID NO: 7162259 - DNA, 22 bp, Homo sapiens
actgagcatcagggctgggaac

SEQ ID NO: 7162260 - DNA, 22 bp, Homo sapiens
actgagcatggctcacagagag

SEQ ID NO: 7162261 - DNA, 22 bp, Homo sapiens
actgagcctctcttcccacctc

SEQ ID NO: 7162262 - DNA, 22 bp, Homo sapiens
actgagcctgtgccctcatcag

SEQ ID NO: 7162263 - DNA, 22 bp, Homo sapiens
actgagagagctgggtatctcc

SEQ ID NO: 7162264 - DNA, 21 bp, Homo sapiens
actgagagatgttggatcata

SEQ ID NO: 7162265 - DNA, 21 bp, Homo sapiens
actgagagatgttggatcata

SEQ ID NO: 7162266 - DNA, 22 bp, Homo sapiens
actgagagcgtgtacaaactta

SEQ ID NO: 7162267 - DNA, 22 bp, Homo sapiens
actgagagcgtgtacaaactta

SEQ ID NO: 7162268 - DNA, 22 bp, Homo sapiens
actgagaggaaattgagactat

SEQ ID NO: 7162269 - DNA, 22 bp, Homo sapiens
actgagaggaaattgagactat

SEQ ID NO: 7162270 - DNA, 22 bp, Homo sapiens
actgagagggaggctgtccggt

SEQ ID NO: 7162271 - DNA, 22 bp, Homo sapiens
actgagagggaggctgtccggt

SEQ ID NO: 7162272 - DNA, 22 bp, Homo sapiens
actgagaggtgatagtgacatt

SEQ ID NO: 7162273 - DNA, 22 bp, Homo sapiens
actgagaggtgatagtgacatt

SEQ ID NO: 7162274 - DNA, 22 bp, Homo sapiens
actgagaggtgatagtgacatt

SEQ ID NO: 7162275 - DNA, 22 bp, Homo sapiens
actgagagtcaagatagcatgg

SEQ ID NO: 7162276 - DNA, 22 bp, Homo sapiens
actgagagtcaagatagcatgg

SEQ ID NO: 7162277 - DNA, 22 bp, Homo sapiens
actgagagtcttagaaacacat

SEQ ID NO: 7162278 - DNA, 22 bp, Homo sapiens
actgagagtcttagaaacacat

SEQ ID NO: 7162279 - DNA, 22 bp, Homo sapiens
actgagagttgaaaagggagga

SEQ ID NO: 7162280 - DNA, 22 bp, Homo sapiens
actgagagttgaaaagggagga

SEQ ID NO: 7162281 - DNA, 22 bp, Homo sapiens
actgagagttgaaaagggagga

SEQ ID NO: 7162282 - DNA, 22 bp, Homo sapiens
actgagagttgtgcattcatgc

SEQ ID NO: 7162283 - DNA, 22 bp, Homo sapiens
actgagagttgtgcattcatgc

SEQ ID NO: 7162284 - DNA, 22 bp, Homo sapiens
actgagcagaacaatgggagcc

SEQ ID NO: 7162285 - DNA, 22 bp, Homo sapiens
actgagcagggttccgcatgga

SEQ ID NO: 7162286 - DNA, 22 bp, Homo sapiens
actctgcctttcagcagatgaa

SEQ ID NO: 7162287 - DNA, 18 bp, Homo sapiens
actctgcggaggccccag

SEQ ID NO: 7162288 - DNA, 22 bp, Homo sapiens
actctgctaaatgtaagttggt

SEQ ID NO: 7162289 - DNA, 21 bp, Homo sapiens
actctgccagtctcctgcact

SEQ ID NO: 7162290 - DNA, 18 bp, Homo sapiens
actctgagtccacttaag

SEQ ID NO: 7162291 - DNA, 22 bp, Homo sapiens
actctgagttcctacttgctcc

SEQ ID NO: 7162292 - DNA, 22 bp, Homo sapiens
actctgcaatgtggcaagaaca

SEQ ID NO: 7162293 - DNA, 22 bp, Homo sapiens
actctcttgggggagagcagag

SEQ ID NO: 7162294 - DNA, 21 bp, Homo sapiens
actctgaaaattaatagttat

SEQ ID NO: 7162295 - DNA, 22 bp, Homo sapiens
actctgaactccaggaggctca

SEQ ID NO: 7162296 - DNA, 22 bp, Homo sapiens
actctgaagaagacttccagac

SEQ ID NO: 7162297 - DNA, 22 bp, Homo sapiens
actctgaatgtgcatgtaaatc

SEQ ID NO: 7162298 - DNA, 22 bp, Homo sapiens
actctgacatttaaaaagcaat

SEQ ID NO: 7162299 - DNA, 22 bp, Homo sapiens
actctgacatttaaaaagcaat

SEQ ID NO: 7162300 - DNA, 22 bp, Homo sapiens
actctgactggagtgagagagg

SEQ ID NO: 7162301 - DNA, 22 bp, Homo sapiens
actctgactggagtgagagagg

SEQ ID NO: 7162302 - DNA, 23 bp, Homo sapiens
actctgacttagttatagctatt

SEQ ID NO: 7162303 - DNA, 22 bp, Homo sapiens
actctgagaaaacactatgctg

SEQ ID NO: 7162304 - DNA, 22 bp, Homo sapiens
actctgagaatccctggacttt

SEQ ID NO: 7162305 - DNA, 19 bp, Homo sapiens
actctgagcttgctctatc

SEQ ID NO: 7162306 - DNA, 22 bp, Homo sapiens
actctgaggaatgtacaggacc

SEQ ID NO: 7162307 - DNA, 22 bp, Homo sapiens
actctgaggagtgactagaggt

SEQ ID NO: 7162308 - DNA, 19 bp, Homo sapiens
actctgaggctgagacaag

SEQ ID NO: 7162309 - DNA, 22 bp, Homo sapiens
actggctgcgttcctgtgagac

SEQ ID NO: 7162310 - DNA, 22 bp, Homo sapiens
actggctgcgttcctgtgagac

SEQ ID NO: 7162311 - DNA, 22 bp, Homo sapiens
actggctgcggggtggaagaag

SEQ ID NO: 7162312 - DNA, 22 bp, Homo sapiens
actggctggactctgacctctt

SEQ ID NO: 7162313 - DNA, 22 bp, Homo sapiens
actggctggagttgccaaggct

SEQ ID NO: 7162314 - DNA, 22 bp, Homo sapiens
actgcctgtagctcttcatctc

SEQ ID NO: 7162315 - DNA, 21 bp, Homo sapiens
actggccaccactggcagggg

SEQ ID NO: 7162316 - DNA, 21 bp, Homo sapiens
actggctgccatgatccaggg

SEQ ID NO: 7162317 - DNA, 21 bp, Homo sapiens
actggctgccatgatccaggg

SEQ ID NO: 7162318 - DNA, 22 bp, Homo sapiens
actgcctgctcataacattgct

SEQ ID NO: 7162319 - DNA, 22 bp, Homo sapiens
actgcctgctcctggctccaca

SEQ ID NO: 7162320 - DNA, 22 bp, Homo sapiens
actgcctggcctggcctcactg

SEQ ID NO: 7162321 - DNA, 22 bp, Homo sapiens
actgcctgtagccctgagatgt

SEQ ID NO: 7162322 - DNA, 22 bp, Homo sapiens
actgcctgcctctgattctgca

SEQ ID NO: 7162323 - DNA, 22 bp, Homo sapiens
actgcctgccttccaggtactg

SEQ ID NO: 7162324 - DNA, 22 bp, Homo sapiens
actgcctgccttccaggtactg

SEQ ID NO: 7162325 - DNA, 23 bp, Homo sapiens
actgcctgctactatgcccacgg

SEQ ID NO: 7162326 - DNA, 22 bp, Homo sapiens
actgcctgatgtggttctaaat

SEQ ID NO: 7162327 - DNA, 19 bp, Homo sapiens
actgcctgaggctcacagg

SEQ ID NO: 7162328 - DNA, 19 bp, Homo sapiens
actgcctgaggctcacagg

SEQ ID NO: 7162329 - DNA, 23 bp, Homo sapiens
actgccagttttaccacagacgg

SEQ ID NO: 7162330 - DNA, 22 bp, Homo sapiens
actgcccacagtgaatggttgg

SEQ ID NO: 7162331 - DNA, 22 bp, Homo sapiens
actgcccacatctctttccgct

SEQ ID NO: 7162332 - DNA, 22 bp, Homo sapiens
actgcccacatctctttccgct

SEQ ID NO: 7162333 - DNA, 21 bp, Homo sapiens
actgcccaccagttaacgctg

SEQ ID NO: 7162334 - DNA, 22 bp, Homo sapiens
actgccaggtgctccatctgaa

SEQ ID NO: 7162335 - DNA, 22 bp, Homo sapiens
actgccaggtaagtgctcctgc

SEQ ID NO: 7162336 - DNA, 22 bp, Homo sapiens
actgccaggtaagtgctcctgc

SEQ ID NO: 7162337 - DNA, 22 bp, Homo sapiens
actgccaggccagtagaacata

SEQ ID NO: 7162338 - DNA, 22 bp, Homo sapiens
actgccaggatggcactagagg

SEQ ID NO: 7162339 - DNA, 22 bp, Homo sapiens
actgccaggatggcactagagg

SEQ ID NO: 7162340 - DNA, 23 bp, Homo sapiens
actgccagattgaaggtttctta

SEQ ID NO: 7162341 - DNA, 22 bp, Homo sapiens
actgccagcaatgtgaaagaaa

SEQ ID NO: 7162342 - DNA, 22 bp, Homo sapiens
actgccagaggaggtatctgaa

SEQ ID NO: 7162343 - DNA, 22 bp, Homo sapiens
actgccaatggtagtttgatgg

SEQ ID NO: 7162344 - DNA, 22 bp, Homo sapiens
actgccacgttccaggcttagc

SEQ ID NO: 7162345 - DNA, 19 bp, Homo sapiens
actgcctgaggctcacagg

SEQ ID NO: 7162346 - DNA, 22 bp, Homo sapiens
actgcctgagctattggaaaag

SEQ ID NO: 7162347 - DNA, 22 bp, Homo sapiens
actgcctcttggtgctgagaga

SEQ ID NO: 7162348 - DNA, 22 bp, Homo sapiens
actgcccttgtcctggcacacc

SEQ ID NO: 7162349 - DNA, 22 bp, Homo sapiens
actgcctcttggtgctgagaga

SEQ ID NO: 7162350 - DNA, 22 bp, Homo sapiens
actgcccttgtcctggcacacc

SEQ ID NO: 7162351 - DNA, 22 bp, Homo sapiens
actgccctgtaactgccaggta

SEQ ID NO: 7162352 - DNA, 22 bp, Homo sapiens
actgcccattaaaggtgctttg

SEQ ID NO: 7162353 - DNA, 22 bp, Homo sapiens
actgcccattatggtagtcact

SEQ ID NO: 7162354 - DNA, 22 bp, Homo sapiens
actgcccagtgattggtggtta

SEQ ID NO: 7162355 - DNA, 22 bp, Homo sapiens
actgcccatgtgcatcaagtag

SEQ ID NO: 7162356 - DNA, 22 bp, Homo sapiens
actgcccagtgattggtggtta

SEQ ID NO: 7162357 - DNA, 22 bp, Homo sapiens
actgcccatgtgcatcaagtag

SEQ ID NO: 7162358 - DNA, 22 bp, Homo sapiens
actgcccatgtgcatcaagtag

SEQ ID NO: 7162359 - DNA, 22 bp, Homo sapiens
actgcccattaaaggtgctttg

SEQ ID NO: 7162360 - DNA, 22 bp, Homo sapiens
actgcccagaagagatgaaagt

SEQ ID NO: 7162361 - DNA, 22 bp, Homo sapiens
actgcccagaagagatgaaagt

SEQ ID NO: 7162362 - DNA, 22 bp, Homo sapiens
actgcccaggaatctcaaagaa

SEQ ID NO: 7162363 - DNA, 22 bp, Homo sapiens
agtgtcctggcaagggtttcag

SEQ ID NO: 7162364 - DNA, 22 bp, Homo sapiens
agtgtcctggggccctaaggcc

SEQ ID NO: 7162365 - DNA, 22 bp, Homo sapiens
agtgtcctgtgtcccagactgt

SEQ ID NO: 7162366 - DNA, 22 bp, Homo sapiens
actggctgtgcccatagagctc

SEQ ID NO: 7162367 - DNA, 22 bp, Homo sapiens
actggctgtggccacggctgct

SEQ ID NO: 7162368 - DNA, 22 bp, Homo sapiens
actggctgtgtaacctcaggca

SEQ ID NO: 7162369 - DNA, 22 bp, Homo sapiens
actggcttcagggggaaagtcc

SEQ ID NO: 7162370 - DNA, 22 bp, Homo sapiens
actggctggccacaccctggta

SEQ ID NO: 7162371 - DNA, 22 bp, Homo sapiens
actggctggccgcgctcttcgc

SEQ ID NO: 7162372 - DNA, 22 bp, Homo sapiens
actggctgtgcagagggcagta

SEQ ID NO: 7162373 - DNA, 22 bp, Homo sapiens
actgggcagggaaggagaccga

SEQ ID NO: 7162374 - DNA, 22 bp, Homo sapiens
actgggcagcagctcgagccgc

SEQ ID NO: 7162375 - DNA, 22 bp, Homo sapiens
actgggcagggaaggagaccga

SEQ ID NO: 7162376 - DNA, 22 bp, Homo sapiens
actgggcagggaaggagaccga

SEQ ID NO: 7162377 - DNA, 22 bp, Homo sapiens
actgggcagggaaggagaccga

SEQ ID NO: 7162378 - DNA, 22 bp, Homo sapiens
actgggaggcaaagagcaagga

SEQ ID NO: 7162379 - DNA, 22 bp, Homo sapiens
actgggaggcaaagagcaagga

SEQ ID NO: 7162380 - DNA, 21 bp, Homo sapiens
agtgtccttttactgtgaata

SEQ ID NO: 7162381 - DNA, 22 bp, Homo sapiens
agtgtctcagccccaactagag

SEQ ID NO: 7162382 - DNA, 22 bp, Homo sapiens
agtgtctcagccccaactagag

SEQ ID NO: 7162383 - DNA, 21 bp, Homo sapiens
agtgtctctggaagcacgtgt

SEQ ID NO: 7162384 - DNA, 22 bp, Homo sapiens
actgggaggcaaagagcaagga

SEQ ID NO: 7162385 - DNA, 22 bp, Homo sapiens
agtgtcctgtgtcccagactgt

SEQ ID NO: 7162386 - DNA, 22 bp, Homo sapiens
agtgtccttagttagctttggg

SEQ ID NO: 7162387 - DNA, 22 bp, Homo sapiens
agtgtccttagttagctttggg

SEQ ID NO: 7162388 - DNA, 22 bp, Homo sapiens
agtgtccttgaggttcctagga

SEQ ID NO: 7162389 - DNA, 21 bp, Homo sapiens
agtgtccttgatcttgccttg

SEQ ID NO: 7162390 - DNA, 22 bp, Homo sapiens
agtgtccttgattcctgttgtt

SEQ ID NO: 7162391 - DNA, 22 bp, Homo sapiens
agtgtccttgttattactgctc

SEQ ID NO: 7162392 - DNA, 22 bp, Homo sapiens
agtgtccttgttattactgctc

SEQ ID NO: 7162393 - DNA, 22 bp, Homo sapiens
agtgtcctttctgttccagcca

SEQ ID NO: 7162394 - DNA, 22 bp, Homo sapiens
actgggcatgatgagtcaccta

SEQ ID NO: 7162395 - DNA, 22 bp, Homo sapiens
actgggcatcccatggcagagc

SEQ ID NO: 7162396 - DNA, 22 bp, Homo sapiens
actgggcatcccatggcagagc

SEQ ID NO: 7162397 - DNA, 22 bp, Homo sapiens
actgggcatcccatggcagagc

SEQ ID NO: 7162398 - DNA, 20 bp, Homo sapiens
actgggcatacctgtcctgt

SEQ ID NO: 7162399 - DNA, 20 bp, Homo sapiens
actgggcatacctgtcctgt

SEQ ID NO: 7162400 - DNA, 22 bp, Homo sapiens
actgggccagatcagagcaact

SEQ ID NO: 7162401 - DNA, 22 bp, Homo sapiens
actgggccagacactgattccc

SEQ ID NO: 7162402 - DNA, 22 bp, Homo sapiens
actgggccagacactgattccc

SEQ ID NO: 7162403 - DNA, 22 bp, Homo sapiens
actgggccaactatttgttcta

SEQ ID NO: 7162404 - DNA, 22 bp, Homo sapiens
actgggccaactatttgttcta

SEQ ID NO: 7162405 - DNA, 22 bp, Homo sapiens
actgggccacatagacctgctg

SEQ ID NO: 7162406 - DNA, 22 bp, Homo sapiens
actgggccacatagacctgctg

SEQ ID NO: 7162407 - DNA, 22 bp, Homo sapiens
actgggccacatagacctgctg

SEQ ID NO: 7162408 - DNA, 22 bp, Homo sapiens
actgggccagatcagagcaact

SEQ ID NO: 7162409 - DNA, 18 bp, Homo sapiens
actgggccagcaggcagg

SEQ ID NO: 7162410 - DNA, 23 bp, Homo sapiens
actgggccagctacttagcactg

SEQ ID NO: 7162411 - DNA, 23 bp, Homo sapiens
actgggccagctacttagcactg

SEQ ID NO: 7162412 - DNA, 22 bp, Homo sapiens
actgggccaggggctttggagc

SEQ ID NO: 7162413 - DNA, 22 bp, Homo sapiens
actgggccaggggctttggagc

SEQ ID NO: 7162414 - DNA, 22 bp, Homo sapiens
actgggccaggggctttggagc

SEQ ID NO: 7162415 - DNA, 22 bp, Homo sapiens
actgggccaggtgtgggtgagt

SEQ ID NO: 7162416 - DNA, 22 bp, Homo sapiens
actgggccaggtgtgggtgagt

SEQ ID NO: 7162417 - DNA, 22 bp, Homo sapiens
actgggcccagtggtgtggctg

SEQ ID NO: 7162418 - DNA, 22 bp, Homo sapiens
actgggcccagtggtgtggctg

SEQ ID NO: 7162419 - DNA, 22 bp, Homo sapiens
actgggcctgtacagagaaaac

SEQ ID NO: 7162420 - DNA, 22 bp, Homo sapiens
actgggcctgtacagagaaaac

SEQ ID NO: 7162421 - DNA, 22 bp, Homo sapiens
actgggcctggattggcgtgtc

SEQ ID NO: 7162422 - DNA, 22 bp, Homo sapiens
actgggccttgccatggcagcc

SEQ ID NO: 7162423 - DNA, 22 bp, Homo sapiens
actgggcctgattgggtcggag

SEQ ID NO: 7162424 - DNA, 22 bp, Homo sapiens
actgggcctgattgggtcggag

SEQ ID NO: 7162425 - DNA, 22 bp, Homo sapiens
actgggcctggattggcgtgtc

SEQ ID NO: 7162426 - DNA, 22 bp, Homo sapiens
actgggcctggattggcgtgtc

SEQ ID NO: 7162427 - DNA, 22 bp, Homo sapiens
actgggcccagtggtgtggctg

SEQ ID NO: 7162428 - DNA, 22 bp, Homo sapiens
actgggcccatatactcagtct

SEQ ID NO: 7162429 - DNA, 22 bp, Homo sapiens
actgggccgaaatggacagaat

SEQ ID NO: 7162430 - DNA, 22 bp, Homo sapiens
actgggccgcgctgcagagggc

SEQ ID NO: 7162431 - DNA, 22 bp, Homo sapiens
actgggccggtgcagagtagtt

SEQ ID NO: 7162432 - DNA, 22 bp, Homo sapiens
actgggccggtgcagagtagtt

SEQ ID NO: 7162433 - DNA, 22 bp, Homo sapiens
actgggcctacccagattggca

SEQ ID NO: 7162434 - DNA, 22 bp, Homo sapiens
actgggcctacccagattggca

SEQ ID NO: 7162435 - DNA, 22 bp, Homo sapiens
actgggcctacccagattggca

SEQ ID NO: 7162436 - DNA, 20 bp, Homo sapiens
actgggcctaggggaggcat

SEQ ID NO: 7162437 - DNA, 22 bp, Homo sapiens
agtacccttttcactgtcacaa

SEQ ID NO: 7162438 - DNA, 22 bp, Homo sapiens
agtaccattccgttggagctgg

SEQ ID NO: 7162439 - DNA, 22 bp, Homo sapiens
agtaccctagggtgggagctca

SEQ ID NO: 7162440 - DNA, 23 bp, Homo sapiens
agtaccatgtgttccttctcgtt

SEQ ID NO: 7162441 - DNA, 22 bp, Homo sapiens
agtaccattactcacttatttt

SEQ ID NO: 7162442 - DNA, 22 bp, Homo sapiens
agtaccattactcacttatttt

SEQ ID NO: 7162443 - DNA, 22 bp, Homo sapiens
agtaccatctctgcctctgcct

SEQ ID NO: 7162444 - DNA, 22 bp, Homo sapiens
agtaccatgcttcctgactggt

SEQ ID NO: 7162445 - DNA, 22 bp, Homo sapiens
agtaataatttatattagggag

SEQ ID NO: 7162446 - DNA, 22 bp, Homo sapiens
agtaataatagtagccggcatt

SEQ ID NO: 7162447 - DNA, 22 bp, Homo sapiens
agtaataatagctgtaaagtgc

SEQ ID NO: 7162448 - DNA, 21 bp, Homo sapiens
agtacatctcaaatgtaaatc

SEQ ID NO: 7162449 - DNA, 21 bp, Homo sapiens
agtacatctcaaatgtaaatc

SEQ ID NO: 7162450 - DNA, 21 bp, Homo sapiens
agtacatctcaaatgtaaatc

SEQ ID NO: 7162451 - DNA, 21 bp, Homo sapiens
agtacatctcaaatgtaaatc

SEQ ID NO: 7162452 - DNA, 22 bp, Homo sapiens
agtacatttagtttatgaacat

SEQ ID NO: 7162453 - DNA, 22 bp, Homo sapiens
agtacatgcagaactaacagat

SEQ ID NO: 7162454 - DNA, 23 bp, Homo sapiens
agtacattcgaaaaattctgtga

SEQ ID NO: 7162455 - DNA, 22 bp, Homo sapiens
agtacatttattaatggtaaaa

SEQ ID NO: 7162456 - DNA, 22 bp, Homo sapiens
agtacatttattaatggtaaaa

SEQ ID NO: 7162457 - DNA, 22 bp, Homo sapiens
agtacatttattaatggtaaaa

SEQ ID NO: 7162458 - DNA, 23 bp, Homo sapiens
agtacatttgacccaaataagct

SEQ ID NO: 7162459 - DNA, 22 bp, Homo sapiens
aggtgggcggattcatgaggtc

SEQ ID NO: 7162460 - DNA, 22 bp, Homo sapiens
aggtgggcggatcacaaggtca

SEQ ID NO: 7162461 - DNA, 22 bp, Homo sapiens
aggtgggcggatcacaaggtca

SEQ ID NO: 7162462 - DNA, 22 bp, Homo sapiens
aggtgggcggatcacaaggtca

SEQ ID NO: 7162463 - DNA, 22 bp, Homo sapiens
aggtgggcccagtgggctccag

SEQ ID NO: 7162464 - DNA, 22 bp, Homo sapiens
aggtgggcgctgctcccgctgg

SEQ ID NO: 7162465 - DNA, 21 bp, Homo sapiens
aggtgggcaggtggagtggcc

SEQ ID NO: 7162466 - DNA, 21 bp, Homo sapiens
aggtgggcaggtggagtggcc

SEQ ID NO: 7162467 - DNA, 21 bp, Homo sapiens
aggtgggcaggtggagtggcc

SEQ ID NO: 7162468 - DNA, 22 bp, Homo sapiens
aggtgggcatagctagaatatt

SEQ ID NO: 7162469 - DNA, 22 bp, Homo sapiens
aggtgggcatagctagaatatt

SEQ ID NO: 7162470 - DNA, 22 bp, Homo sapiens
aggtgggcccagtgggctccag

SEQ ID NO: 7162471 - DNA, 22 bp, Homo sapiens
aggtgggcttggtgccaacatg

SEQ ID NO: 7162472 - DNA, 22 bp, Homo sapiens
aggtggggaaaccagcgatccc

SEQ ID NO: 7162473 - DNA, 22 bp, Homo sapiens
aggtgggcttggtgccaacatg

SEQ ID NO: 7162474 - DNA, 22 bp, Homo sapiens
aggtgggcttggtgccaacatg

SEQ ID NO: 7162475 - DNA, 22 bp, Homo sapiens
aggtgggcggattcatgaggtc

SEQ ID NO: 7162476 - DNA, 22 bp, Homo sapiens
aggtgggcggattcatgaggtc

SEQ ID NO: 7162477 - DNA, 22 bp, Homo sapiens
aggtgggcggattcatgaggtc

SEQ ID NO: 7162478 - DNA, 22 bp, Homo sapiens
aggtgggcttggtgccaacatg

SEQ ID NO: 7162479 - DNA, 22 bp, Homo sapiens
aggtggggaaaccagcgatccc

SEQ ID NO: 7162480 - DNA, 22 bp, Homo sapiens
aggtggggaaaccagcgatccc

SEQ ID NO: 7162481 - DNA, 22 bp, Homo sapiens
aggtggggaaaccagcgatccc

SEQ ID NO: 7162482 - DNA, 22 bp, Homo sapiens
aggtggggaaaccagcgatccc

SEQ ID NO: 7162483 - DNA, 22 bp, Homo sapiens
agtataattagatatcaaaagt

SEQ ID NO: 7162484 - DNA, 22 bp, Homo sapiens
agtataattagatatcaaaagt

SEQ ID NO: 7162485 - DNA, 22 bp, Homo sapiens
agtataatttacatttggtatt

SEQ ID NO: 7162486 - DNA, 22 bp, Homo sapiens
agtataaagtggttttcagcac

SEQ ID NO: 7162487 - DNA, 22 bp, Homo sapiens
agtataaagtggttttcagcac

SEQ ID NO: 7162488 - DNA, 21 bp, Homo sapiens
agtagtttagcacagggtttg

SEQ ID NO: 7162489 - DNA, 21 bp, Homo sapiens
agtagtttagcacagggtttg

SEQ ID NO: 7162490 - DNA, 21 bp, Homo sapiens
agtagtttagcacagggtttg

SEQ ID NO: 7162491 - DNA, 22 bp, Homo sapiens
agtagtttttaagaggtataaa

SEQ ID NO: 7162492 - DNA, 22 bp, Homo sapiens
agtatacaaataaatgtgtaat

SEQ ID NO: 7162493 - DNA, 22 bp, Homo sapiens
agtatacaaataaatgtgtaat

SEQ ID NO: 7162494 - DNA, 22 bp, Homo sapiens
agtatacagtaatgacatatct

SEQ ID NO: 7162495 - DNA, 22 bp, Homo sapiens
agtatacatagagatggctgtt

SEQ ID NO: 7162496 - DNA, 22 bp, Homo sapiens
agtatacatatattagccttcg

SEQ ID NO: 7162497 - DNA, 22 bp, Homo sapiens
actccaggggttgctatttaca

SEQ ID NO: 7162498 - DNA, 22 bp, Homo sapiens
agtagaaagttgcaggaggaat

SEQ ID NO: 7162499 - DNA, 22 bp, Homo sapiens
agtagaaagttgcaggaggaat

SEQ ID NO: 7162500 - DNA, 22 bp, Homo sapiens
agtacttttttgatatctgagt

SEQ ID NO: 7162501 - DNA, 22 bp, Homo sapiens
agtacttttttgatatctgagt

SEQ ID NO: 7162502 - DNA, 22 bp, Homo sapiens
agtagtgaagaatttgttctac

SEQ ID NO: 7162503 - DNA, 22 bp, Homo sapiens
agtagtggcttcctggagtgct

SEQ ID NO: 7162504 - DNA, 22 bp, Homo sapiens
agtagtggcttcctggagtgct

SEQ ID NO: 7162505 - DNA, 22 bp, Homo sapiens
agtagtggggccagggtttgaa

SEQ ID NO: 7162506 - DNA, 22 bp, Homo sapiens
agtagtggcttcctggagtgct

SEQ ID NO: 7162507 - DNA, 22 bp, Homo sapiens
agtactcaggaaatgctgagta

SEQ ID NO: 7162508 - DNA, 22 bp, Homo sapiens
agtactgtcagcagggtgttga

SEQ ID NO: 7162509 - DNA, 22 bp, Homo sapiens
agtacttagaaagttaatataa

SEQ ID NO: 7162510 - DNA, 22 bp, Homo sapiens
agtacttagaaagttaatataa

SEQ ID NO: 7162511 - DNA, 22 bp, Homo sapiens
agtacttcagaggctgcccagg

SEQ ID NO: 7162512 - DNA, 22 bp, Homo sapiens
agtactttagcataaagcagtt

SEQ ID NO: 7162513 - DNA, 22 bp, Homo sapiens
agtactttcttccgagagagaa

SEQ ID NO: 7162514 - DNA, 22 bp, Homo sapiens
agtactttttgttcaattgtgc

SEQ ID NO: 7162515 - DNA, 22 bp, Homo sapiens
agtactttttgttcaattgtgc

SEQ ID NO: 7162516 - DNA, 22 bp, Homo sapiens
agtcaccatctgtggcagcctg

SEQ ID NO: 7162517 - DNA, 22 bp, Homo sapiens
agtcaccatctgtggcagcctg

SEQ ID NO: 7162518 - DNA, 22 bp, Homo sapiens
agtcaccattttcacctgcctc

SEQ ID NO: 7162519 - DNA, 22 bp, Homo sapiens
agtcaccattttcacctgcctc

SEQ ID NO: 7162520 - DNA, 22 bp, Homo sapiens
agtcaccttgaaatgtcttgaa

SEQ ID NO: 7162521 - DNA, 22 bp, Homo sapiens
agtcaccttgtttatgcccagg

SEQ ID NO: 7162522 - DNA, 22 bp, Homo sapiens
actcctgggtgctgaccagcgt

SEQ ID NO: 7162523 - DNA, 22 bp, Homo sapiens
actcctgggtgctgaccagcgt

SEQ ID NO: 7162524 - DNA, 22 bp, Homo sapiens
actcctgggttccggagattct

SEQ ID NO: 7162525 - DNA, 22 bp, Homo sapiens
agtcaccagggtttgctgggtt

SEQ ID NO: 7162526 - DNA, 22 bp, Homo sapiens
agtcaccaggttttagagacct

SEQ ID NO: 7162527 - DNA, 22 bp, Homo sapiens
actcctggaaaagaacgcaggg

SEQ ID NO: 7162528 - DNA, 22 bp, Homo sapiens
actcctggaaaagaacgcaggg

SEQ ID NO: 7162529 - DNA, 22 bp, Homo sapiens
actcctggggctgccatcacag

SEQ ID NO: 7162530 - DNA, 22 bp, Homo sapiens
actcctgggtgctgaccagcgt

SEQ ID NO: 7162531 - DNA, 22 bp, Homo sapiens
actcctgggtgctgaccagcgt

SEQ ID NO: 7162532 - DNA, 22 bp, Homo sapiens
actcctcagccagcatcaggga

SEQ ID NO: 7162533 - DNA, 22 bp, Homo sapiens
actccgactctgagtctacatt

SEQ ID NO: 7162534 - DNA, 22 bp, Homo sapiens
actccgggagccaggagaggct

SEQ ID NO: 7162535 - DNA, 22 bp, Homo sapiens
actcccttggtggagaatgcaa

SEQ ID NO: 7162536 - DNA, 22 bp, Homo sapiens
actcccttgtgaactcattctt

SEQ ID NO: 7162537 - DNA, 22 bp, Homo sapiens
actcctgccacacagatgctgt

SEQ ID NO: 7162538 - DNA, 22 bp, Homo sapiens
actcctgccacacagatgctgt

SEQ ID NO: 7162539 - DNA, 22 bp, Homo sapiens
actcctgccacacagatgctgt

SEQ ID NO: 7162540 - DNA, 22 bp, Homo sapiens
actcctgctgtcactgcagttc

SEQ ID NO: 7162541 - DNA, 22 bp, Homo sapiens
actcctgctgtcactgcagttc

SEQ ID NO: 7162542 - DNA, 22 bp, Homo sapiens
actcctgcttcttccctgagga

SEQ ID NO: 7162543 - DNA, 22 bp, Homo sapiens
actcctgcttcttccctgagga

SEQ ID NO: 7162544 - DNA, 22 bp, Homo sapiens
actcctgcttcttccctgagga

SEQ ID NO: 7162545 - DNA, 21 bp, Homo sapiens
actccctgcataagtgattta

SEQ ID NO: 7162546 - DNA, 22 bp, Homo sapiens
actccctccaaatctgcacagt

SEQ ID NO: 7162547 - DNA, 22 bp, Homo sapiens
actccctccaaatctgcacagt

SEQ ID NO: 7162548 - DNA, 22 bp, Homo sapiens
actccctccaaatctgcacagt

SEQ ID NO: 7162549 - DNA, 22 bp, Homo sapiens
actccctctctagtccttgcaa

SEQ ID NO: 7162550 - DNA, 22 bp, Homo sapiens
actccagggtgactctgtctga

SEQ ID NO: 7162551 - DNA, 22 bp, Homo sapiens
actccagggtgactctgtctga

SEQ ID NO: 7162552 - DNA, 22 bp, Homo sapiens
actccagggttttgcacctgga

SEQ ID NO: 7162553 - DNA, 22 bp, Homo sapiens
actccagggttttgcacctgga

SEQ ID NO: 7162554 - DNA, 22 bp, Homo sapiens
actccagggttttgcacctgga

SEQ ID NO: 7162555 - DNA, 22 bp, Homo sapiens
actccctccaaatctgcacagt

SEQ ID NO: 7162556 - DNA, 22 bp, Homo sapiens
agtcactgtttaatctagctaa

SEQ ID NO: 7162557 - DNA, 22 bp, Homo sapiens
agtcactgtcttgcaaaggtca

SEQ ID NO: 7162558 - DNA, 22 bp, Homo sapiens
agtcactgtcaaagccacacac

SEQ ID NO: 7162559 - DNA, 22 bp, Homo sapiens
agtcactggttctgtaattaat

SEQ ID NO: 7162560 - DNA, 22 bp, Homo sapiens
agtcactgagatggtgaggcta

SEQ ID NO: 7162561 - DNA, 22 bp, Homo sapiens
agtcactgaataccttaatgtt

SEQ ID NO: 7162562 - DNA, 22 bp, Homo sapiens
agtcactgctttgtccctgtgt

SEQ ID NO: 7162563 - DNA, 22 bp, Homo sapiens
agtcactgggctgcttcctata

SEQ ID NO: 7162564 - DNA, 22 bp, Homo sapiens
agtcactgtttcagaactgagt

SEQ ID NO: 7162565 - DNA, 22 bp, Homo sapiens
agtcacttaataggttcatctg

SEQ ID NO: 7162566 - DNA, 22 bp, Homo sapiens
agtcacttaatctaagtctcag

SEQ ID NO: 7162567 - DNA, 22 bp, Homo sapiens
agtcacttcatggtttcttgga

SEQ ID NO: 7162568 - DNA, 22 bp, Homo sapiens
agtcacttcatggtttcttgga

SEQ ID NO: 7162569 - DNA, 22 bp, Homo sapiens
agtcacttccagacacctgcct

SEQ ID NO: 7162570 - DNA, 22 bp, Homo sapiens
agtcacttccagctgtgtttca

SEQ ID NO: 7162571 - DNA, 22 bp, Homo sapiens
actctaaaccccactctgctgg

SEQ ID NO: 7162572 - DNA, 22 bp, Homo sapiens
actctaaaccccactctgctgg

SEQ ID NO: 7162573 - DNA, 22 bp, Homo sapiens
actctaaatagataaccatgca

SEQ ID NO: 7162574 - DNA, 22 bp, Homo sapiens
actctaaatagcctcttaaaca

SEQ ID NO: 7162575 - DNA, 22 bp, Homo sapiens
actctctgtggttctactttgc

SEQ ID NO: 7162576 - DNA, 22 bp, Homo sapiens
actctctgtgatggaggccagc

SEQ ID NO: 7162577 - DNA, 22 bp, Homo sapiens
actctctgtctaaatgcagttt

SEQ ID NO: 7162578 - DNA, 22 bp, Homo sapiens
actctctggtgtagaaagacct

SEQ ID NO: 7162579 - DNA, 22 bp, Homo sapiens
actctctggtgtagaaagacct

SEQ ID NO: 7162580 - DNA, 22 bp, Homo sapiens
actctctggtattggcaagttt

SEQ ID NO: 7162581 - DNA, 22 bp, Homo sapiens
actctctgggcatgccccacca

SEQ ID NO: 7162582 - DNA, 22 bp, Homo sapiens
actctctctgatggaactttag

SEQ ID NO: 7162583 - DNA, 22 bp, Homo sapiens
actctctgagctaccaggtgag

SEQ ID NO: 7162584 - DNA, 22 bp, Homo sapiens
actctctgagctaccaggtgag

SEQ ID NO: 7162585 - DNA, 22 bp, Homo sapiens
actctctctgatggaactttag

SEQ ID NO: 7162586 - DNA, 22 bp, Homo sapiens
actctctctgatggaactttag

SEQ ID NO: 7162587 - DNA, 22 bp, Homo sapiens
actctctctgatggaactttag

SEQ ID NO: 7162588 - DNA, 22 bp, Homo sapiens
actctctcacacacgcctatat

SEQ ID NO: 7162589 - DNA, 22 bp, Homo sapiens
actctctcacagcttggctgat

SEQ ID NO: 7162590 - DNA, 22 bp, Homo sapiens
actctctcacagcttggctgat

SEQ ID NO: 7162591 - DNA, 22 bp, Homo sapiens
actctctcacagcttggctgat

SEQ ID NO: 7162592 - DNA, 22 bp, Homo sapiens
actctcgtcctgctgtcctgac

SEQ ID NO: 7162593 - DNA, 23 bp, Homo sapiens
actctctaaggatttgatgcaaa

SEQ ID NO: 7162594 - DNA, 22 bp, Homo sapiens
actctccttttgatcttcagaa

SEQ ID NO: 7162595 - DNA, 22 bp, Homo sapiens
actctcccttggagcctcaggc

SEQ ID NO: 7162596 - DNA, 22 bp, Homo sapiens
actctccttttgatcttcagaa

SEQ ID NO: 7162597 - DNA, 22 bp, Homo sapiens
actctccttttgatcttcagaa

SEQ ID NO: 7162598 - DNA, 22 bp, Homo sapiens
actctaaatagcctcttaaaca

SEQ ID NO: 7162599 - DNA, 22 bp, Homo sapiens
actctcccttggagcctcaggc

SEQ ID NO: 7162600 - DNA, 22 bp, Homo sapiens
actctcccttggagcctcaggc

SEQ ID NO: 7162601 - DNA, 22 bp, Homo sapiens
aggtcatttttgccttctattt

SEQ ID NO: 7162602 - DNA, 22 bp, Homo sapiens
aggtcatttccttagaggcaga

SEQ ID NO: 7162603 - DNA, 22 bp, Homo sapiens
aggtcatttttgccttctattt

SEQ ID NO: 7162604 - DNA, 22 bp, Homo sapiens
aggtcaagtttagatagagtta

SEQ ID NO: 7162605 - DNA, 22 bp, Homo sapiens
aggtcaaggctgcagtgagctg

SEQ ID NO: 7162606 - DNA, 22 bp, Homo sapiens
aggtcaagggcaagagtgaggt

SEQ ID NO: 7162607 - DNA, 22 bp, Homo sapiens
aggtcaaaccacagctctaggc

SEQ ID NO: 7162608 - DNA, 22 bp, Homo sapiens
aggtcaaagaacctagctatag

SEQ ID NO: 7162609 - DNA, 22 bp, Homo sapiens
aggtcaaagaacctagctatag

SEQ ID NO: 7162610 - DNA, 20 bp, Homo sapiens
aggtcaacacctagtaagtg

SEQ ID NO: 7162611 - DNA, 23 bp, Homo sapiens
aggtcaaccacaagctgacaaac

SEQ ID NO: 7162612 - DNA, 22 bp, Homo sapiens
aggtcaagagtaaatttgggta

SEQ ID NO: 7162613 - DNA, 22 bp, Homo sapiens
aggtcaagagtaaatttgggta

SEQ ID NO: 7162614 - DNA, 22 bp, Homo sapiens
aggtcaaggccaaaagagtggt

SEQ ID NO: 7162615 - DNA, 22 bp, Homo sapiens
aggtattttatagataagtaaa

SEQ ID NO: 7162616 - DNA, 22 bp, Homo sapiens
aggtattttatagataagtaaa

SEQ ID NO: 7162617 - DNA, 22 bp, Homo sapiens
aggtatttgttatttgagagtg

SEQ ID NO: 7162618 - DNA, 22 bp, Homo sapiens
aggtatttgttatttgagagtg

SEQ ID NO: 7162619 - DNA, 22 bp, Homo sapiens
aggtatttgtctcagattgggt

SEQ ID NO: 7162620 - DNA, 22 bp, Homo sapiens
aggtatttgtctcagattgggt

SEQ ID NO: 7162621 - DNA, 22 bp, Homo sapiens
aggtatttgttacagcagcacc

SEQ ID NO: 7162622 - DNA, 22 bp, Homo sapiens
aggtatttgttacagcagcacc

SEQ ID NO: 7162623 - DNA, 22 bp, Homo sapiens
aggtatttcatggagcaagcag

SEQ ID NO: 7162624 - DNA, 22 bp, Homo sapiens
aggtatttcccaaagtggcatg

SEQ ID NO: 7162625 - DNA, 22 bp, Homo sapiens
aggtatttcccaaagtggcatg

SEQ ID NO: 7162626 - DNA, 22 bp, Homo sapiens
aggtatttcctttaaagaaact

SEQ ID NO: 7162627 - DNA, 22 bp, Homo sapiens
aggtatttcctttaaagaaact

SEQ ID NO: 7162628 - DNA, 19 bp, Homo sapiens
aggtatttgggagatatat

SEQ ID NO: 7162629 - DNA, 22 bp, Homo sapiens
acccttccaaatgagcttatta

SEQ ID NO: 7162630 - DNA, 22 bp, Homo sapiens
acccttctgtgacctgcctgtc

SEQ ID NO: 7162631 - DNA, 22 bp, Homo sapiens
accctttaggttggatgaggat

SEQ ID NO: 7162632 - DNA, 19 bp, Homo sapiens
aggtagctcagactcaaag

SEQ ID NO: 7162633 - DNA, 22 bp, Homo sapiens
aggtaggaaagtctccttgtat

SEQ ID NO: 7162634 - DNA, 22 bp, Homo sapiens
aggtaggaaagtctccttgtat

SEQ ID NO: 7162635 - DNA, 22 bp, Homo sapiens
aggtaggagttgatggatgttc

SEQ ID NO: 7162636 - DNA, 20 bp, Homo sapiens
aggtccactgaggctgcctc

SEQ ID NO: 7162637 - DNA, 22 bp, Homo sapiens
aggtccagaggttgaacggtgg

SEQ ID NO: 7162638 - DNA, 22 bp, Homo sapiens
aggtccagagttgagatacaga

SEQ ID NO: 7162639 - DNA, 22 bp, Homo sapiens
aggtccagctgttgcagcctcc

SEQ ID NO: 7162640 - DNA, 22 bp, Homo sapiens
aggtccaggagatttggcaatt

SEQ ID NO: 7162641 - DNA, 22 bp, Homo sapiens
aggtccaggatttgtggggtct

SEQ ID NO: 7162642 - DNA, 22 bp, Homo sapiens
aggtccaggcatttgggttggg

SEQ ID NO: 7162643 - DNA, 22 bp, Homo sapiens
aggtccaggcatttgggttggg

SEQ ID NO: 7162644 - DNA, 22 bp, Homo sapiens
aggtccaggttccgtttctgcg

SEQ ID NO: 7162645 - DNA, 21 bp, Homo sapiens
acctttgagagcccctagtga

SEQ ID NO: 7162646 - DNA, 22 bp, Homo sapiens
acctttgagtgtattgtctttc

SEQ ID NO: 7162647 - DNA, 22 bp, Homo sapiens
acctttgctaggtaggtattgg

SEQ ID NO: 7162648 - DNA, 19 bp, Homo sapiens
acctttcctttctcagatg

SEQ ID NO: 7162649 - DNA, 22 bp, Homo sapiens
acctttcattaaagtctgtagt

SEQ ID NO: 7162650 - DNA, 22 bp, Homo sapiens
acctttgacgctatttaatttg

SEQ ID NO: 7162651 - DNA, 22 bp, Homo sapiens
acctttcagtgccctttctgtc

SEQ ID NO: 7162652 - DNA, 22 bp, Homo sapiens
acctttccaagtatcaggtggt

SEQ ID NO: 7162653 - DNA, 22 bp, Homo sapiens
acctttcctggctgaccgagga

SEQ ID NO: 7162654 - DNA, 22 bp, Homo sapiens
acctttcacggtatcagacatc

SEQ ID NO: 7162655 - DNA, 22 bp, Homo sapiens
acctttcaggtagtggtgagga

SEQ ID NO: 7162656 - DNA, 20 bp, Homo sapiens
acctttcaaatgattcagca

SEQ ID NO: 7162657 - DNA, 22 bp, Homo sapiens
acctttcacctcccatcctgtt

SEQ ID NO: 7162658 - DNA, 22 bp, Homo sapiens
acctttcacggtatcagacatc

SEQ ID NO: 7162659 - DNA, 22 bp, Homo sapiens
acctttcaaagtggctatcact

SEQ ID NO: 7162660 - DNA, 22 bp, Homo sapiens
aggtccagtgctcttggtggtt

SEQ ID NO: 7162661 - DNA, 22 bp, Homo sapiens
acctttttgttctgttctcagc

SEQ ID NO: 7162662 - DNA, 22 bp, Homo sapiens
acctttttccaaagcttcttac

SEQ ID NO: 7162663 - DNA, 22 bp, Homo sapiens
acctttttccaatgagggaagt

SEQ ID NO: 7162664 - DNA, 22 bp, Homo sapiens
acctttttccaatgagggaagt

SEQ ID NO: 7162665 - DNA, 22 bp, Homo sapiens
accttttcatctgaaactttta

SEQ ID NO: 7162666 - DNA, 22 bp, Homo sapiens
accttttcatctgaaactttta

SEQ ID NO: 7162667 - DNA, 22 bp, Homo sapiens
acctttggataatttgagtttg

SEQ ID NO: 7162668 - DNA, 22 bp, Homo sapiens
accttttatgtaaatatatgtt

SEQ ID NO: 7162669 - DNA, 22 bp, Homo sapiens
accttttttcagaactctaaag

SEQ ID NO: 7162670 - DNA, 22 bp, Homo sapiens
acgaaggaatgtgcttgagcat

SEQ ID NO: 7162671 - DNA, 22 bp, Homo sapiens
acgaagacgccgttcttgccga

SEQ ID NO: 7162672 - DNA, 22 bp, Homo sapiens
acgacagcacaacagcatcctc

SEQ ID NO: 7162673 - DNA, 22 bp, Homo sapiens
acgatgagatggggctggaagg

SEQ ID NO: 7162674 - DNA, 22 bp, Homo sapiens
acgaggagcctgtggcctggta

SEQ ID NO: 7162675 - DNA, 22 bp, Homo sapiens
acgaggagcctgtggcctggta

SEQ ID NO: 7162676 - DNA, 22 bp, Homo sapiens
acgaggtatcacattgcatctc

SEQ ID NO: 7162677 - DNA, 22 bp, Homo sapiens
aggtgacatcccggcagcagag

SEQ ID NO: 7162678 - DNA, 22 bp, Homo sapiens
aggtgacatgaaaaatgttgag

SEQ ID NO: 7162679 - DNA, 19 bp, Homo sapiens
aggtgacatgtgacagcct

SEQ ID NO: 7162680 - DNA, 22 bp, Homo sapiens
aggtgacaggacaggagctggt

SEQ ID NO: 7162681 - DNA, 22 bp, Homo sapiens
aggtgacaggacaggagctggt

SEQ ID NO: 7162682 - DNA, 22 bp, Homo sapiens
aggtgacaggacaggagctggt

SEQ ID NO: 7162683 - DNA, 19 bp, Homo sapiens
aggtgacaggtgcacttgc

SEQ ID NO: 7162684 - DNA, 22 bp, Homo sapiens
aggtgacatcccggcagcagag

SEQ ID NO: 7162685 - DNA, 22 bp, Homo sapiens
aggtgaatgctcacattctaat

SEQ ID NO: 7162686 - DNA, 22 bp, Homo sapiens
aggtgaagttgaggaggcagaa

SEQ ID NO: 7162687 - DNA, 22 bp, Homo sapiens
aggtgaatgcctgaggcctctg

SEQ ID NO: 7162688 - DNA, 22 bp, Homo sapiens
aggtgaagttgaggaggcagaa

SEQ ID NO: 7162689 - DNA, 22 bp, Homo sapiens
aggtgaagttgaggaggcagaa

SEQ ID NO: 7162690 - DNA, 22 bp, Homo sapiens
aggtgaagttgaggaggcagaa

SEQ ID NO: 7162691 - DNA, 22 bp, Homo sapiens
aggtgaagttgaggaggcagaa

SEQ ID NO: 7162692 - DNA, 22 bp, Homo sapiens
aggtgaagttgaggaggcagaa

SEQ ID NO: 7162693 - DNA, 20 bp, Homo sapiens
aggtcttccaatcagctcct

SEQ ID NO: 7162694 - DNA, 22 bp, Homo sapiens
aggtgaagttaaaaaccagtct

SEQ ID NO: 7162695 - DNA, 22 bp, Homo sapiens
aggtgaagttaaaaaccagtct

SEQ ID NO: 7162696 - DNA, 22 bp, Homo sapiens
aggtgaagttaaaaaccagtct

SEQ ID NO: 7162697 - DNA, 22 bp, Homo sapiens
aggtgactggtttatctggcag

SEQ ID NO: 7162698 - DNA, 22 bp, Homo sapiens
actaaatatttgagaggtgtag

SEQ ID NO: 7162699 - DNA, 22 bp, Homo sapiens
aggtgagaaaacgagggttgca

SEQ ID NO: 7162700 - DNA, 22 bp, Homo sapiens
aggtgagaaaacgagggttgca

SEQ ID NO: 7162701 - DNA, 22 bp, Homo sapiens
aggtgacttaggctgtggctcg

SEQ ID NO: 7162702 - DNA, 22 bp, Homo sapiens
actaaatgaactattaatactt

SEQ ID NO: 7162703 - DNA, 23 bp, Homo sapiens
actacagatactcctgctgtttg

SEQ ID NO: 7162704 - DNA, 22 bp, Homo sapiens
actacagtaagggaggcagcat

SEQ ID NO: 7162705 - DNA, 22 bp, Homo sapiens
actacagtactatatctatagg

SEQ ID NO: 7162706 - DNA, 22 bp, Homo sapiens
actacagtactatatctatagg

SEQ ID NO: 7162707 - DNA, 22 bp, Homo sapiens
actacagtccctcatatgttgg

SEQ ID NO: 7162708 - DNA, 22 bp, Homo sapiens
actacatcttgcatatctataa

SEQ ID NO: 7162709 - DNA, 22 bp, Homo sapiens
actacagtgtgataagaggggc

SEQ ID NO: 7162710 - DNA, 21 bp, Homo sapiens
actacatcatggtcacctact

SEQ ID NO: 7162711 - DNA, 22 bp, Homo sapiens
actactacaagtgagtacaaag

SEQ ID NO: 7162712 - DNA, 22 bp, Homo sapiens
actacttgtgagagattatctc

SEQ ID NO: 7162713 - DNA, 22 bp, Homo sapiens
actacttgagctgaggctagca

SEQ ID NO: 7162714 - DNA, 23 bp, Homo sapiens
actagaaaatgactttctccctg

SEQ ID NO: 7162715 - DNA, 23 bp, Homo sapiens
actagaaaatgactttctccctg

SEQ ID NO: 7162716 - DNA, 22 bp, Homo sapiens
actactgaatattagttctgaa

SEQ ID NO: 7162717 - DNA, 22 bp, Homo sapiens
actactgatgtaaaggagcaat

SEQ ID NO: 7162718 - DNA, 22 bp, Homo sapiens
actagaaattactcagaataaa

SEQ ID NO: 7162719 - DNA, 22 bp, Homo sapiens
aggtgggcacagatggagaagt

SEQ ID NO: 7162720 - DNA, 22 bp, Homo sapiens
actagaaattactcagaataaa

SEQ ID NO: 7162721 - DNA, 22 bp, Homo sapiens
actagaaagtttccagagttat

SEQ ID NO: 7162722 - DNA, 22 bp, Homo sapiens
actagaaagtttccagagttat

SEQ ID NO: 7162723 - DNA, 22 bp, Homo sapiens
actagaaatgtattggtagctg

SEQ ID NO: 7162724 - DNA, 22 bp, Homo sapiens
actagaaattactcagaataaa

SEQ ID NO: 7162725 - DNA, 22 bp, Homo sapiens
aggtgggcactccgctcgaggt

SEQ ID NO: 7162726 - DNA, 21 bp, Homo sapiens
aggtgggcaggtggagtggcc

SEQ ID NO: 7162727 - DNA, 22 bp, Homo sapiens
aggtgggcactccgctcgaggt

SEQ ID NO: 7162728 - DNA, 22 bp, Homo sapiens
aggtgggcaccaggcttgtggt

SEQ ID NO: 7162729 - DNA, 22 bp, Homo sapiens
aggtgggcaccaggcttgtggt

SEQ ID NO: 7162730 - DNA, 22 bp, Homo sapiens
aggtgggcactccgctcgaggt

SEQ ID NO: 7162731 - DNA, 22 bp, Homo sapiens
aggtgggcactccgctcgaggt

SEQ ID NO: 7162732 - DNA, 22 bp, Homo sapiens
aggtgggcactccgctcgaggt

SEQ ID NO: 7162733 - DNA, 22 bp, Homo sapiens
actagaaaattcctagaaacta

SEQ ID NO: 7162734 - DNA, 22 bp, Homo sapiens
actagaaaattcctagaaacta

SEQ ID NO: 7162735 - DNA, 22 bp, Homo sapiens
actagaaaattcctagaaacta

SEQ ID NO: 7162736 - DNA, 22 bp, Homo sapiens
actagaaaattcctagaaacta

SEQ ID NO: 7162737 - DNA, 22 bp, Homo sapiens
actagaaaattcctagaaacta

SEQ ID NO: 7162738 - DNA, 22 bp, Homo sapiens
actagaaactaatggattatta

SEQ ID NO: 7162739 - DNA, 22 bp, Homo sapiens
actagaaagaagttttttgaga

SEQ ID NO: 7162740 - DNA, 22 bp, Homo sapiens
actagaaagaagttttttgaga

SEQ ID NO: 7162741 - DNA, 22 bp, Homo sapiens
actagaaagcaaaagccatttc

SEQ ID NO: 7162742 - DNA, 22 bp, Homo sapiens
actagaaagcaaaagccatttc

SEQ ID NO: 7162743 - DNA, 22 bp, Homo sapiens
actagaaagcactaagctaggc

SEQ ID NO: 7162744 - DNA, 22 bp, Homo sapiens
actagaaagcactaagctaggc

SEQ ID NO: 7162745 - DNA, 20 bp, Homo sapiens
actagaaagtcactgggggg

SEQ ID NO: 7162746 - DNA, 22 bp, Homo sapiens
actagaaagtttccagagttat

SEQ ID NO: 7162747 - DNA, 20 bp, Homo sapiens
actagaaagtcactgggggg

SEQ ID NO: 7162748 - DNA, 22 bp, Homo sapiens
aggagcagaccgtagtcctgca

SEQ ID NO: 7162749 - DNA, 22 bp, Homo sapiens
aggagccatgagtgacatcaca

SEQ ID NO: 7162750 - DNA, 22 bp, Homo sapiens
aggagccatggaggtgaggcgg

SEQ ID NO: 7162751 - DNA, 22 bp, Homo sapiens
aggagccatggaggtgaggcgg

SEQ ID NO: 7162752 - DNA, 22 bp, Homo sapiens
aggagccatggaggtgaggcgg

SEQ ID NO: 7162753 - DNA, 22 bp, Homo sapiens
aggagccatgagtgacatcaca

SEQ ID NO: 7162754 - DNA, 23 bp, Homo sapiens
aggagccatgagttggatatgtt

SEQ ID NO: 7162755 - DNA, 23 bp, Homo sapiens
aggagccatgagttggatatgtt

SEQ ID NO: 7162756 - DNA, 22 bp, Homo sapiens
aggagccatggaggtgaggcgg

SEQ ID NO: 7162757 - DNA, 21 bp, Homo sapiens
aggagccatgtggtctgatgg

SEQ ID NO: 7162758 - DNA, 22 bp, Homo sapiens
aggagccattttccaagggcga

SEQ ID NO: 7162759 - DNA, 22 bp, Homo sapiens
aggagccattgcaggatggcag

SEQ ID NO: 7162760 - DNA, 22 bp, Homo sapiens
acagggtgactttgtgacagat

SEQ ID NO: 7162761 - DNA, 22 bp, Homo sapiens
acagggtgactttgtgacagat

SEQ ID NO: 7162762 - DNA, 22 bp, Homo sapiens
acagggtgactttgtgacagat

SEQ ID NO: 7162763 - DNA, 22 bp, Homo sapiens
acagggtgaatgtgacattatc

SEQ ID NO: 7162764 - DNA, 22 bp, Homo sapiens
acagggtggggatggtgagctt

SEQ ID NO: 7162765 - DNA, 22 bp, Homo sapiens
acagggtggggatggtgagctt

SEQ ID NO: 7162766 - DNA, 22 bp, Homo sapiens
acagggtggggatggtgagctt

SEQ ID NO: 7162767 - DNA, 22 bp, Homo sapiens
acagggtgactttgtgacagat

SEQ ID NO: 7162768 - DNA, 22 bp, Homo sapiens
acagggtgactttgtgacagat

SEQ ID NO: 7162769 - DNA, 22 bp, Homo sapiens
acagggtgactttgtgacagat

SEQ ID NO: 7162770 - DNA, 22 bp, Homo sapiens
acagggtgactttgtgacagat

SEQ ID NO: 7162771 - DNA, 22 bp, Homo sapiens
acaggggctccgaaggtgaggg

SEQ ID NO: 7162772 - DNA, 22 bp, Homo sapiens
acagggggtcccatggcctgga

SEQ ID NO: 7162773 - DNA, 22 bp, Homo sapiens
acaggggctccgaaggtgaggg

SEQ ID NO: 7162774 - DNA, 22 bp, Homo sapiens
acagggtcttagagatcacctg

SEQ ID NO: 7162775 - DNA, 22 bp, Homo sapiens
acagggtcttagagatcacctg

SEQ ID NO: 7162776 - DNA, 22 bp, Homo sapiens
acagggtcattttatgatctgt

SEQ ID NO: 7162777 - DNA, 22 bp, Homo sapiens
acagggtcaagggtgctacaag

SEQ ID NO: 7162778 - DNA, 22 bp, Homo sapiens
acagggtcaagggtgctacaag

SEQ ID NO: 7162779 - DNA, 22 bp, Homo sapiens
aggagctgctttggtgcggttt

SEQ ID NO: 7162780 - DNA, 22 bp, Homo sapiens
aggagctgcttaaatggttggt

SEQ ID NO: 7162781 - DNA, 22 bp, Homo sapiens
aggagctgcttaaatggttggt

SEQ ID NO: 7162782 - DNA, 22 bp, Homo sapiens
aggagctggaatggtccttttg

SEQ ID NO: 7162783 - DNA, 22 bp, Homo sapiens
aggagctgcactgggagttttt

SEQ ID NO: 7162784 - DNA, 22 bp, Homo sapiens
aggagctgcactgggagttttt

SEQ ID NO: 7162785 - DNA, 22 bp, Homo sapiens
aggagctgcagattctgccttg

SEQ ID NO: 7162786 - DNA, 22 bp, Homo sapiens
aggagctgcagattctgccttg

SEQ ID NO: 7162787 - DNA, 22 bp, Homo sapiens
aggagctgcatggatacctggt

SEQ ID NO: 7162788 - DNA, 22 bp, Homo sapiens
aggagccctgcgggaggcagag

SEQ ID NO: 7162789 - DNA, 22 bp, Homo sapiens
aggagcccctcttcagtcctgg

SEQ ID NO: 7162790 - DNA, 22 bp, Homo sapiens
aggagcccctcttcagtcctgg

SEQ ID NO: 7162791 - DNA, 23 bp, Homo sapiens
aggagcccctaattctgggcagc

SEQ ID NO: 7162792 - DNA, 22 bp, Homo sapiens
aggagcctccttctcatgtgca

SEQ ID NO: 7162793 - DNA, 22 bp, Homo sapiens
aggagcctgaatcagagggtga

SEQ ID NO: 7162794 - DNA, 22 bp, Homo sapiens
aggagcctggctggcccacagg

SEQ ID NO: 7162795 - DNA, 19 bp, Homo sapiens
aggaaggcggcggctgccc

SEQ ID NO: 7162796 - DNA, 22 bp, Homo sapiens
aggaaggctgatcactgcttgt

SEQ ID NO: 7162797 - DNA, 22 bp, Homo sapiens
aggaagggatacataggatagt

SEQ ID NO: 7162798 - DNA, 22 bp, Homo sapiens
aggaagggatacataggatagt

SEQ ID NO: 7162799 - DNA, 22 bp, Homo sapiens
aggaagggagcagtttgttgtt

SEQ ID NO: 7162800 - DNA, 22 bp, Homo sapiens
aggaagggatacataggatagt

SEQ ID NO: 7162801 - DNA, 22 bp, Homo sapiens
aggaagggatacataggatagt

SEQ ID NO: 7162802 - DNA, 23 bp, Homo sapiens
aggaaggaggtcctaacagtatc

SEQ ID NO: 7162803 - DNA, 22 bp, Homo sapiens
aggaaggagggcagatattaag

SEQ ID NO: 7162804 - DNA, 20 bp, Homo sapiens
aggaaggagaatctgagcaa

SEQ ID NO: 7162805 - DNA, 23 bp, Homo sapiens
aggaaggaggtcctaacagtatc

SEQ ID NO: 7162806 - DNA, 23 bp, Homo sapiens
aggaaggaggtcctaacagtatc

SEQ ID NO: 7162807 - DNA, 22 bp, Homo sapiens
aggaagctagagccaccggact

SEQ ID NO: 7162808 - DNA, 22 bp, Homo sapiens
aggaagcgtgggtctggctgga

SEQ ID NO: 7162809 - DNA, 22 bp, Homo sapiens
aggaagctaaccagggagtgag

SEQ ID NO: 7162810 - DNA, 23 bp, Homo sapiens
aggaagctaagtgtggctgcgga

SEQ ID NO: 7162811 - DNA, 17 bp, Homo sapiens
aggaagcgagctggcct

SEQ ID NO: 7162812 - DNA, 22 bp, Homo sapiens
aggaagcctggggctgccctcg

SEQ ID NO: 7162813 - DNA, 22 bp, Homo sapiens
aggaagcccaagtctcatcttc

SEQ ID NO: 7162814 - DNA, 22 bp, Homo sapiens
aggaagccatggtggacgtcta

SEQ ID NO: 7162815 - DNA, 22 bp, Homo sapiens
aggaagcctggcattaaaaagc

SEQ ID NO: 7162816 - DNA, 23 bp, Homo sapiens
aggaagcccattttagtctacct

SEQ ID NO: 7162817 - DNA, 22 bp, Homo sapiens
aggagacatggaatagtgaggc

SEQ ID NO: 7162818 - DNA, 22 bp, Homo sapiens
aggagacatggaatagtgaggc

SEQ ID NO: 7162819 - DNA, 22 bp, Homo sapiens
aggagacatctaactgtaggtt

SEQ ID NO: 7162820 - DNA, 22 bp, Homo sapiens
aggagacatctaactgtaggtt

SEQ ID NO: 7162821 - DNA, 22 bp, Homo sapiens
aggagacatactataggaatat

SEQ ID NO: 7162822 - DNA, 22 bp, Homo sapiens
aggagacatactataggaatat

SEQ ID NO: 7162823 - DNA, 22 bp, Homo sapiens
aggagaccttcaccacttccac

SEQ ID NO: 7162824 - DNA, 22 bp, Homo sapiens
acaggggctccgaaggtgaggg

SEQ ID NO: 7162825 - DNA, 22 bp, Homo sapiens
aggagactcagagacctggccg

SEQ ID NO: 7162826 - DNA, 22 bp, Homo sapiens
acaggggctccgaaggtgaggg

SEQ ID NO: 7162827 - DNA, 22 bp, Homo sapiens
aggacttctccgataagtcaga

SEQ ID NO: 7162828 - DNA, 17 bp, Homo sapiens
aggaagggcaagtttct

SEQ ID NO: 7162829 - DNA, 17 bp, Homo sapiens
aggaagggcaagtttct

SEQ ID NO: 7162830 - DNA, 22 bp, Homo sapiens
aggaagggatacataggatagt

SEQ ID NO: 7162831 - DNA, 22 bp, Homo sapiens
aggaagggatacataggatagt

SEQ ID NO: 7162832 - DNA, 17 bp, Homo sapiens
aggaagggcaagtttct

SEQ ID NO: 7162833 - DNA, 17 bp, Homo sapiens
aggaagggcaagtttct

SEQ ID NO: 7162834 - DNA, 22 bp, Homo sapiens
aggaagggatacataggatagt

SEQ ID NO: 7162835 - DNA, 23 bp, Homo sapiens
aggagacagggaagtgcctggct

SEQ ID NO: 7162836 - DNA, 18 bp, Homo sapiens
aggagacagcctcacctg

SEQ ID NO: 7162837 - DNA, 22 bp, Homo sapiens
aggagacagccaggggcctgag

SEQ ID NO: 7162838 - DNA, 22 bp, Homo sapiens
aggagacagccaggggcctgag

SEQ ID NO: 7162839 - DNA, 22 bp, Homo sapiens
aggagacagccaggggcctgag

SEQ ID NO: 7162840 - DNA, 22 bp, Homo sapiens
aggagacataactatgatgaga

SEQ ID NO: 7162841 - DNA, 22 bp, Homo sapiens
aggagacataactatgatgaga

SEQ ID NO: 7162842 - DNA, 22 bp, Homo sapiens
aggagacataactatgatgaga

SEQ ID NO: 7162843 - DNA, 22 bp, Homo sapiens
aggagacagtttggacgtgtag

SEQ ID NO: 7162844 - DNA, 23 bp, Homo sapiens
aggagacagggaagtgcctggct

SEQ ID NO: 7162845 - DNA, 23 bp, Homo sapiens
aggagacagggaagtgcctggct

SEQ ID NO: 7162846 - DNA, 20 bp, Homo sapiens
aggagggacctggattggcg

SEQ ID NO: 7162847 - DNA, 20 bp, Homo sapiens
aggagggacctggattggcg

SEQ ID NO: 7162848 - DNA, 22 bp, Homo sapiens
aggagggagatgcccatcctgg

SEQ ID NO: 7162849 - DNA, 22 bp, Homo sapiens
aggagggacaccaatatatgtt

SEQ ID NO: 7162850 - DNA, 22 bp, Homo sapiens
aggagggacctaggaatattgc

SEQ ID NO: 7162851 - DNA, 22 bp, Homo sapiens
aggagggacctaggaatattgc

SEQ ID NO: 7162852 - DNA, 22 bp, Homo sapiens
aggaggggcatagaaatgtaat

SEQ ID NO: 7162853 - DNA, 22 bp, Homo sapiens
aggaggggcatagaaatgtaat

SEQ ID NO: 7162854 - DNA, 22 bp, Homo sapiens
aggaggggcatagaaatgtaat

SEQ ID NO: 7162855 - DNA, 22 bp, Homo sapiens
aggagggagatgcccatcctgg

SEQ ID NO: 7162856 - DNA, 22 bp, Homo sapiens
aggagggagatgcccatcctgg

SEQ ID NO: 7162857 - DNA, 22 bp, Homo sapiens
aggagggaataagaaagagtca

SEQ ID NO: 7162858 - DNA, 22 bp, Homo sapiens
aggagggaataagaaagagtca

SEQ ID NO: 7162859 - DNA, 17 bp, Homo sapiens
aggagggaaatagcttg

SEQ ID NO: 7162860 - DNA, 22 bp, Homo sapiens
aggagggaataagaaagagtca

SEQ ID NO: 7162861 - DNA, 22 bp, Homo sapiens
aggagggacaccaatatatgtt

SEQ ID NO: 7162862 - DNA, 22 bp, Homo sapiens
aggagctggagtccaggcaagt

SEQ ID NO: 7162863 - DNA, 22 bp, Homo sapiens
aggagctggagtccaggcaagt

SEQ ID NO: 7162864 - DNA, 22 bp, Homo sapiens
aggaggccgatttcagaggtcg

SEQ ID NO: 7162865 - DNA, 22 bp, Homo sapiens
aggaggccgctgatgggctccc

SEQ ID NO: 7162866 - DNA, 22 bp, Homo sapiens
aggaggctgtggagcactccat

SEQ ID NO: 7162867 - DNA, 22 bp, Homo sapiens
aggaggctgtggagcactccat

SEQ ID NO: 7162868 - DNA, 22 bp, Homo sapiens
aggaggccgctgatgggctccc

SEQ ID NO: 7162869 - DNA, 22 bp, Homo sapiens
aggaggctgtggagcactccat

SEQ ID NO: 7162870 - DNA, 22 bp, Homo sapiens
aggaggcttttgcaggtgccac

SEQ ID NO: 7162871 - DNA, 22 bp, Homo sapiens
aggaggcttttgcaggtgccac

SEQ ID NO: 7162872 - DNA, 22 bp, Homo sapiens
aggaggcttttgcaggtgccac

SEQ ID NO: 7162873 - DNA, 22 bp, Homo sapiens
aggagggtacaatgggtggaaa

SEQ ID NO: 7162874 - DNA, 22 bp, Homo sapiens
aggaggggttctcgggtgctga

SEQ ID NO: 7162875 - DNA, 22 bp, Homo sapiens
aggaggggttctcgggtgctga

SEQ ID NO: 7162876 - DNA, 22 bp, Homo sapiens
aggaggggttctcgggtgctga

SEQ ID NO: 7162877 - DNA, 22 bp, Homo sapiens
aggaggggttctcgggtgctga

SEQ ID NO: 7162878 - DNA, 22 bp, Homo sapiens
aggaggggttctcgggtgctga

SEQ ID NO: 7162879 - DNA, 22 bp, Homo sapiens
aggaggggttctcgggtgctga

SEQ ID NO: 7162880 - DNA, 22 bp, Homo sapiens
aggaggggttctcgggtgctga

SEQ ID NO: 7162881 - DNA, 21 bp, Homo sapiens
aggaggggtctttcccactga

SEQ ID NO: 7162882 - DNA, 22 bp, Homo sapiens
aggaggggttctcgggtgctga

SEQ ID NO: 7162883 - DNA, 22 bp, Homo sapiens
aggaggggttctcgggtgctga

SEQ ID NO: 7162884 - DNA, 21 bp, Homo sapiens
aggaggggtctttcccactga

SEQ ID NO: 7162885 - DNA, 21 bp, Homo sapiens
aggaggggtctttcccactga

SEQ ID NO: 7162886 - DNA, 22 bp, Homo sapiens
aggatggcttgcaggaggctgt

SEQ ID NO: 7162887 - DNA, 21 bp, Homo sapiens
aggattttgttgaagtttctg

SEQ ID NO: 7162888 - DNA, 22 bp, Homo sapiens
aggcaaaagaatgtcataaatg

SEQ ID NO: 7162889 - DNA, 22 bp, Homo sapiens
aggcaaaattacaaagttatta

SEQ ID NO: 7162890 - DNA, 22 bp, Homo sapiens
aggcaaatagatagtccataca

SEQ ID NO: 7162891 - DNA, 22 bp, Homo sapiens
aggcaaatccagatttttccac

SEQ ID NO: 7162892 - DNA, 22 bp, Homo sapiens
aggcaaattattgtatgcagtt

SEQ ID NO: 7162893 - DNA, 22 bp, Homo sapiens
aggcaaattattgtatgcagtt

SEQ ID NO: 7162894 - DNA, 22 bp, Homo sapiens
aggcaacatgggccaggcagaa

SEQ ID NO: 7162895 - DNA, 22 bp, Homo sapiens
aggcaacatgggccaggcagaa

SEQ ID NO: 7162896 - DNA, 22 bp, Homo sapiens
aggcaacatgggccaggcagaa

SEQ ID NO: 7162897 - DNA, 22 bp, Homo sapiens
aggcaacatgggccaggcagaa

SEQ ID NO: 7162898 - DNA, 22 bp, Homo sapiens
aggcaacaggaaaccacatgat

SEQ ID NO: 7162899 - DNA, 22 bp, Homo sapiens
aggcaacataacacgaaagtct

SEQ ID NO: 7162900 - DNA, 22 bp, Homo sapiens
aggcaacataacacgaaagtct

SEQ ID NO: 7162901 - DNA, 22 bp, Homo sapiens
aggcaacatgactcacttgcac

SEQ ID NO: 7162902 - DNA, 22 bp, Homo sapiens
aggcaacaagggtagtcagtga

SEQ ID NO: 7162903 - DNA, 22 bp, Homo sapiens
aggcaacaagggtagtcagtga

SEQ ID NO: 7162904 - DNA, 22 bp, Homo sapiens
aggcaaattattgtatgcagtt

SEQ ID NO: 7162905 - DNA, 22 bp, Homo sapiens
aggcaacaagggtagtcagtga

SEQ ID NO: 7162906 - DNA, 22 bp, Homo sapiens
aggcaacacttgcattttttag

SEQ ID NO: 7162907 - DNA, 22 bp, Homo sapiens
aggcaacacttgcattttttag

SEQ ID NO: 7162908 - DNA, 22 bp, Homo sapiens
aggcaacaggaaaccacatgat

SEQ ID NO: 7162909 - DNA, 22 bp, Homo sapiens
aggcacacagcttgcataaatc

SEQ ID NO: 7162910 - DNA, 22 bp, Homo sapiens
aggcacacccagtgacctcccg

SEQ ID NO: 7162911 - DNA, 19 bp, Homo sapiens
aggcacaattctgagaagc

SEQ ID NO: 7162912 - DNA, 22 bp, Homo sapiens
aggcacacagaccccagcaagt

SEQ ID NO: 7162913 - DNA, 19 bp, Homo sapiens
aggcaaccaatgaggcaaa

SEQ ID NO: 7162914 - DNA, 22 bp, Homo sapiens
aggcaacatgggccaggcagaa

SEQ ID NO: 7162915 - DNA, 22 bp, Homo sapiens
aggcacaagaaactgctcccca

SEQ ID NO: 7162916 - DNA, 22 bp, Homo sapiens
aggcacagatttggggaaagca

SEQ ID NO: 7162917 - DNA, 22 bp, Homo sapiens
aggcacagatttggggaaagca

SEQ ID NO: 7162918 - DNA, 22 bp, Homo sapiens
aggcacagatttggggaaagca

SEQ ID NO: 7162919 - DNA, 22 bp, Homo sapiens
aggcacagatttggggaaagca

SEQ ID NO: 7162920 - DNA, 22 bp, Homo sapiens
acataaatttcactgttccgtg

SEQ ID NO: 7162921 - DNA, 18 bp, Homo sapiens
aggcacagagcatacata

SEQ ID NO: 7162922 - DNA, 18 bp, Homo sapiens
aggcacagagcatacata

SEQ ID NO: 7162923 - DNA, 22 bp, Homo sapiens
aggcacagatttggggaaagca

SEQ ID NO: 7162924 - DNA, 22 bp, Homo sapiens
aggcacagatttggggaaagca

SEQ ID NO: 7162925 - DNA, 22 bp, Homo sapiens
aggcacagatttggggaaagca

SEQ ID NO: 7162926 - DNA, 18 bp, Homo sapiens
aggcacagagcatacata

SEQ ID NO: 7162927 - DNA, 18 bp, Homo sapiens
aggcacagagcatacata

SEQ ID NO: 7162928 - DNA, 18 bp, Homo sapiens
aggcacagagcatacata

SEQ ID NO: 7162929 - DNA, 22 bp, Homo sapiens
aggcacagagaggttaaatgca

SEQ ID NO: 7162930 - DNA, 22 bp, Homo sapiens
aggcacagagaagtaaagtatc

SEQ ID NO: 7162931 - DNA, 22 bp, Homo sapiens
aggcacagagaatgccctccat

SEQ ID NO: 7162932 - DNA, 22 bp, Homo sapiens
aggcacagagaatgccctccat

SEQ ID NO: 7162933 - DNA, 22 bp, Homo sapiens
aggcacagaatggcattcagtg

SEQ ID NO: 7162934 - DNA, 22 bp, Homo sapiens
aggcacagaatggcattcagtg

SEQ ID NO: 7162935 - DNA, 22 bp, Homo sapiens
aggcacagaatggcattcagtg

SEQ ID NO: 7162936 - DNA, 22 bp, Homo sapiens
aggcacagaatggcattcagtg

SEQ ID NO: 7162937 - DNA, 22 bp, Homo sapiens
acatacatcaagtatcacaaga

SEQ ID NO: 7162938 - DNA, 22 bp, Homo sapiens
acatacatcaagtatcacaaga

SEQ ID NO: 7162939 - DNA, 22 bp, Homo sapiens
acatacatcaagtatcacaaga

SEQ ID NO: 7162940 - DNA, 23 bp, Homo sapiens
acatacatggagataaagtgatg

SEQ ID NO: 7162941 - DNA, 23 bp, Homo sapiens
acatacatggagataaagtgatg

SEQ ID NO: 7162942 - DNA, 23 bp, Homo sapiens
acatacatggagataaagtgatg

SEQ ID NO: 7162943 - DNA, 21 bp, Homo sapiens
acatacataccttaccacctt

SEQ ID NO: 7162944 - DNA, 21 bp, Homo sapiens
acatacataccttaccacctt

SEQ ID NO: 7162945 - DNA, 21 bp, Homo sapiens
acatacataccttaccacctt

SEQ ID NO: 7162946 - DNA, 21 bp, Homo sapiens
acatacataccttaccacctt

SEQ ID NO: 7162947 - DNA, 22 bp, Homo sapiens
acatacatatgacaactttcct

SEQ ID NO: 7162948 - DNA, 22 bp, Homo sapiens
acatacatatgacaactttcct

SEQ ID NO: 7162949 - DNA, 22 bp, Homo sapiens
acatacatatgtttaaatgcat

SEQ ID NO: 7162950 - DNA, 22 bp, Homo sapiens
acatacatatgtttaaatgcat

SEQ ID NO: 7162951 - DNA, 22 bp, Homo sapiens
acatacatatgtttaaatgcat

SEQ ID NO: 7162952 - DNA, 22 bp, Homo sapiens
acatacatatgtttaaatgcat

SEQ ID NO: 7162953 - DNA, 22 bp, Homo sapiens
acatacatcaagtatcacaaga

SEQ ID NO: 7162954 - DNA, 22 bp, Homo sapiens
acatacatcaagtatcacaaga

SEQ ID NO: 7162955 - DNA, 22 bp, Homo sapiens
acatacatatgtttaaatgcat

SEQ ID NO: 7162956 - DNA, 22 bp, Homo sapiens
acatacatcaagtatcacaaga

SEQ ID NO: 7162957 - DNA, 22 bp, Homo sapiens
acatacatcaagtatcacaaga

SEQ ID NO: 7162958 - DNA, 22 bp, Homo sapiens
acatacacatgaatatattttt

SEQ ID NO: 7162959 - DNA, 22 bp, Homo sapiens
acataacaatcataggacatag

SEQ ID NO: 7162960 - DNA, 22 bp, Homo sapiens
acataacaatcataggacatag

SEQ ID NO: 7162961 - DNA, 22 bp, Homo sapiens
acatacacaagcgtacatgaac

SEQ ID NO: 7162962 - DNA, 23 bp, Homo sapiens
acatacataagcaccacattttg

SEQ ID NO: 7162963 - DNA, 23 bp, Homo sapiens
acatacataagcaccacattttg

SEQ ID NO: 7162964 - DNA, 23 bp, Homo sapiens
acatacataagcaccacattttg

SEQ ID NO: 7162965 - DNA, 17 bp, Homo sapiens
acatacactggtgaaca

SEQ ID NO: 7162966 - DNA, 22 bp, Homo sapiens
acatacagacctgcagggcagc

SEQ ID NO: 7162967 - DNA, 22 bp, Homo sapiens
acatacagacctgcagggcagc

SEQ ID NO: 7162968 - DNA, 22 bp, Homo sapiens
agctggcctgttagagctgagt

SEQ ID NO: 7162969 - DNA, 22 bp, Homo sapiens
agctggcaggtgaagatgattt

SEQ ID NO: 7162970 - DNA, 20 bp, Homo sapiens
agctggcctgtcctaggcct

SEQ ID NO: 7162971 - DNA, 22 bp, Homo sapiens
acagcctgcagccccaggtcgc

SEQ ID NO: 7162972 - DNA, 22 bp, Homo sapiens
agctggcaggggttcacactgc

SEQ ID NO: 7162973 - DNA, 22 bp, Homo sapiens
agctggcaggggttcacactgc

SEQ ID NO: 7162974 - DNA, 22 bp, Homo sapiens
acagcctgacttttgttgtcac

SEQ ID NO: 7162975 - DNA, 22 bp, Homo sapiens
acagcctgacttttgttgtcac

SEQ ID NO: 7162976 - DNA, 22 bp, Homo sapiens
acagcctgacttttgttgtcac

SEQ ID NO: 7162977 - DNA, 22 bp, Homo sapiens
acagcctgacttttgttgtcac

SEQ ID NO: 7162978 - DNA, 22 bp, Homo sapiens
acagcctgagagtggagctggc

SEQ ID NO: 7162979 - DNA, 22 bp, Homo sapiens
acagcctgagagtggagctggc

SEQ ID NO: 7162980 - DNA, 22 bp, Homo sapiens
acagcctgagagtggagctggc

SEQ ID NO: 7162981 - DNA, 22 bp, Homo sapiens
acagcctgatttatggagcagt

SEQ ID NO: 7162982 - DNA, 22 bp, Homo sapiens
acagcctgatttatggagcagt

SEQ ID NO: 7162983 - DNA, 22 bp, Homo sapiens
acagcctgatttatggagcagt

SEQ ID NO: 7162984 - DNA, 22 bp, Homo sapiens
acagcctgatttatggagcagt

SEQ ID NO: 7162985 - DNA, 22 bp, Homo sapiens
acagcctgcagccccaggtcgc

SEQ ID NO: 7162986 - DNA, 21 bp, Homo sapiens
agctggctctctctggagaga

SEQ ID NO: 7162987 - DNA, 21 bp, Homo sapiens
agctggctctctctggagaga

SEQ ID NO: 7162988 - DNA, 21 bp, Homo sapiens
agctggctctctctggagaga

SEQ ID NO: 7162989 - DNA, 22 bp, Homo sapiens
agctggctatacttgaaaagtc

SEQ ID NO: 7162990 - DNA, 22 bp, Homo sapiens
agctggccttcggtgtcactgg

SEQ ID NO: 7162991 - DNA, 22 bp, Homo sapiens
agctggccttcggtgtcactgg

SEQ ID NO: 7162992 - DNA, 22 bp, Homo sapiens
agctggccttagtgagcacctg

SEQ ID NO: 7162993 - DNA, 22 bp, Homo sapiens
agctggcctgttagagctgagt

SEQ ID NO: 7162994 - DNA, 22 bp, Homo sapiens
agctggctatacttgaaaagtc

SEQ ID NO: 7162995 - DNA, 22 bp, Homo sapiens
acagcccgtgtcatcagctgct

SEQ ID NO: 7162996 - DNA, 22 bp, Homo sapiens
acagcccgttctctggcacaca

SEQ ID NO: 7162997 - DNA, 21 bp, Homo sapiens
acagcctccatctcctgggct

SEQ ID NO: 7162998 - DNA, 21 bp, Homo sapiens
acagcctccatctcctgggct

SEQ ID NO: 7162999 - DNA, 22 bp, Homo sapiens
acagcccaggactccagtgggc

SEQ ID NO: 7163000 - DNA, 22 bp, Homo sapiens
acagcccaggactccagtgggc

SEQ ID NO: 7163001 - DNA, 22 bp, Homo sapiens
agctgcttgggaaccatcaatt

SEQ ID NO: 7163002 - DNA, 22 bp, Homo sapiens
acagcccagaaagcctaagggg

SEQ ID NO: 7163003 - DNA, 22 bp, Homo sapiens
acagcccagctctttctctgca

SEQ ID NO: 7163004 - DNA, 22 bp, Homo sapiens
agctgcttagagtcctcaggat

SEQ ID NO: 7163005 - DNA, 22 bp, Homo sapiens
agctgctgtttggtgagtcttg

SEQ ID NO: 7163006 - DNA, 21 bp, Homo sapiens
agctgctgtggccagaatcca

SEQ ID NO: 7163007 - DNA, 21 bp, Homo sapiens
agctgctgtggccagaatcca

SEQ ID NO: 7163008 - DNA, 22 bp, Homo sapiens
agctgctgtggggctcggcctg

SEQ ID NO: 7163009 - DNA, 22 bp, Homo sapiens
agctgctgtggggctcggcctg

SEQ ID NO: 7163010 - DNA, 23 bp, Homo sapiens
agctgctgggcctgccgtggcct

SEQ ID NO: 7163011 - DNA, 22 bp, Homo sapiens
agctgctggggagggcagacac

SEQ ID NO: 7163012 - DNA, 22 bp, Homo sapiens
agctgctggtttaagggatggg

SEQ ID NO: 7163013 - DNA, 22 bp, Homo sapiens
agctgctggtttaagggatggg

SEQ ID NO: 7163014 - DNA, 22 bp, Homo sapiens
agctgctgtcctaggcactgta

SEQ ID NO: 7163015 - DNA, 22 bp, Homo sapiens
agctgctgtcctaggcactgta

SEQ ID NO: 7163016 - DNA, 22 bp, Homo sapiens
agctgctgtcctaggcactgta

SEQ ID NO: 7163017 - DNA, 22 bp, Homo sapiens
agctgctgtcctaggcactgta

SEQ ID NO: 7163018 - DNA, 22 bp, Homo sapiens
agctgctgtggccacatctggc

SEQ ID NO: 7163019 - DNA, 22 bp, Homo sapiens
acagccagtcatctcagcaggg

SEQ ID NO: 7163020 - DNA, 22 bp, Homo sapiens
acagccagtaatctacccctgt

SEQ ID NO: 7163021 - DNA, 22 bp, Homo sapiens
acagccagtaatctacccctgt

SEQ ID NO: 7163022 - DNA, 22 bp, Homo sapiens
acagccagtaatctacccctgt

SEQ ID NO: 7163023 - DNA, 22 bp, Homo sapiens
acagccagtcatctcagcaggg

SEQ ID NO: 7163024 - DNA, 22 bp, Homo sapiens
acagccagtcctcccacagggt

SEQ ID NO: 7163025 - DNA, 22 bp, Homo sapiens
acagccagtgactgcagaccct

SEQ ID NO: 7163026 - DNA, 22 bp, Homo sapiens
acagccagtcatctcagcaggg

SEQ ID NO: 7163027 - DNA, 22 bp, Homo sapiens
acagccagtcctcccacagggt

SEQ ID NO: 7163028 - DNA, 22 bp, Homo sapiens
acagccagtcctcccacagggt

SEQ ID NO: 7163029 - DNA, 22 bp, Homo sapiens
acagccagatctgagagatctt

SEQ ID NO: 7163030 - DNA, 22 bp, Homo sapiens
acagccagggtctcaggaggcg

SEQ ID NO: 7163031 - DNA, 22 bp, Homo sapiens
acagccagggtctcaggaggcg

SEQ ID NO: 7163032 - DNA, 22 bp, Homo sapiens
acagccaggtaaaggcatggca

SEQ ID NO: 7163033 - DNA, 22 bp, Homo sapiens
acagccaggtaaaggcatggca

SEQ ID NO: 7163034 - DNA, 22 bp, Homo sapiens
acagccaggtaaaggcatggca

SEQ ID NO: 7163035 - DNA, 22 bp, Homo sapiens
acagccaggtaaaggcatggca

SEQ ID NO: 7163036 - DNA, 22 bp, Homo sapiens
acagccaggtaaaggcatggca

SEQ ID NO: 7163037 - DNA, 22 bp, Homo sapiens
acagccagtaaggaaagaccca

SEQ ID NO: 7163038 - DNA, 22 bp, Homo sapiens
acagccagtaaggaaagaccca

SEQ ID NO: 7163039 - DNA, 22 bp, Homo sapiens
agctccaggtgcaagtcatggt

SEQ ID NO: 7163040 - DNA, 22 bp, Homo sapiens
agctccaggtgcaagtcatggt

SEQ ID NO: 7163041 - DNA, 22 bp, Homo sapiens
agctccaggtgcaagtcatggt

SEQ ID NO: 7163042 - DNA, 20 bp, Homo sapiens
agctccagtgctgacgcttc

SEQ ID NO: 7163043 - DNA, 22 bp, Homo sapiens
agctccagtttcctgactgagc

SEQ ID NO: 7163044 - DNA, 22 bp, Homo sapiens
agctcccagaagccagagtcgg

SEQ ID NO: 7163045 - DNA, 22 bp, Homo sapiens
agctcccagaagccagagtcgg

SEQ ID NO: 7163046 - DNA, 22 bp, Homo sapiens
agctcccagaagccagagtcgg

SEQ ID NO: 7163047 - DNA, 22 bp, Homo sapiens
agctcccagaaggccctgcgcc

SEQ ID NO: 7163048 - DNA, 22 bp, Homo sapiens
acagccagaggtggtcctgggt

SEQ ID NO: 7163049 - DNA, 23 bp, Homo sapiens
acagccagttcacctctccttgg

SEQ ID NO: 7163050 - DNA, 23 bp, Homo sapiens
acagccagttcacctctccttgg

SEQ ID NO: 7163051 - DNA, 22 bp, Homo sapiens
acagccatagatgcttatgtaa

SEQ ID NO: 7163052 - DNA, 22 bp, Homo sapiens
acagcccaagtcacctgcagga

SEQ ID NO: 7163053 - DNA, 22 bp, Homo sapiens
acagcccaagtcacctgcagga

SEQ ID NO: 7163054 - DNA, 22 bp, Homo sapiens
acagccagtgactggacaagct

SEQ ID NO: 7163055 - DNA, 22 bp, Homo sapiens
acagccagtgactggacaagct

SEQ ID NO: 7163056 - DNA, 22 bp, Homo sapiens
acagccagtgctccgtgaggac

SEQ ID NO: 7163057 - DNA, 22 bp, Homo sapiens
acagccagtgactggacaagct

SEQ ID NO: 7163058 - DNA, 22 bp, Homo sapiens
acagccagtgctccgtgaggac

SEQ ID NO: 7163059 - DNA, 22 bp, Homo sapiens
acagccagtgctccgtgaggac

SEQ ID NO: 7163060 - DNA, 22 bp, Homo sapiens
agctgcagcctcatgattcggt

SEQ ID NO: 7163061 - DNA, 22 bp, Homo sapiens
agctgcagccgcagctgtggcc

SEQ ID NO: 7163062 - DNA, 22 bp, Homo sapiens
agctgcagccgcagctgtggcc

SEQ ID NO: 7163063 - DNA, 22 bp, Homo sapiens
agctgcagccctcctgcatggc

SEQ ID NO: 7163064 - DNA, 22 bp, Homo sapiens
acagcccaagtcacctgcagga

SEQ ID NO: 7163065 - DNA, 22 bp, Homo sapiens
acagcccagaaagcctaagggg

SEQ ID NO: 7163066 - DNA, 22 bp, Homo sapiens
agctgctcattactttctgttg

SEQ ID NO: 7163067 - DNA, 22 bp, Homo sapiens
agctgctcattactttctgttg

SEQ ID NO: 7163068 - DNA, 22 bp, Homo sapiens
agctgcaggcccatgctcagtc

SEQ ID NO: 7163069 - DNA, 22 bp, Homo sapiens
agctgctcaggagagccaggtc

SEQ ID NO: 7163070 - DNA, 22 bp, Homo sapiens
agctgcaggcccatgctcagtc

SEQ ID NO: 7163071 - DNA, 22 bp, Homo sapiens
agctgcaggattatggaatgga

SEQ ID NO: 7163072 - DNA, 22 bp, Homo sapiens
agctgcaggattatggaatgga

SEQ ID NO: 7163073 - DNA, 22 bp, Homo sapiens
agctgcaggagtcgcctaggat

SEQ ID NO: 7163074 - DNA, 22 bp, Homo sapiens
agctgcaggagtcgcctaggat

SEQ ID NO: 7163075 - DNA, 22 bp, Homo sapiens
agctgcaggaagtagaagcgga

SEQ ID NO: 7163076 - DNA, 22 bp, Homo sapiens
agctgcaggagtcgcctaggat

SEQ ID NO: 7163077 - DNA, 22 bp, Homo sapiens
agctgcaggagtcgcctaggat

SEQ ID NO: 7163078 - DNA, 22 bp, Homo sapiens
agctgcagcttcctagtccagc

SEQ ID NO: 7163079 - DNA, 22 bp, Homo sapiens
agctgcagctacagtgttggtt

SEQ ID NO: 7163080 - DNA, 22 bp, Homo sapiens
agctgcagctacagtgttggtt

SEQ ID NO: 7163081 - DNA, 22 bp, Homo sapiens
agctgcagctacagtgttggtt

SEQ ID NO: 7163082 - DNA, 23 bp, Homo sapiens
agctgggcaaggatccgggctcc

SEQ ID NO: 7163083 - DNA, 22 bp, Homo sapiens
agctggttaagggtggagttaa

SEQ ID NO: 7163084 - DNA, 20 bp, Homo sapiens
agctggttatcttaattctt

SEQ ID NO: 7163085 - DNA, 22 bp, Homo sapiens
agctgggcaaaatgtgaggttg

SEQ ID NO: 7163086 - DNA, 22 bp, Homo sapiens
agctgggcaaaatgtgaggttg

SEQ ID NO: 7163087 - DNA, 22 bp, Homo sapiens
agctgggcaaaatgtgaggttg

SEQ ID NO: 7163088 - DNA, 22 bp, Homo sapiens
agctgggatgataacctcagtc

SEQ ID NO: 7163089 - DNA, 22 bp, Homo sapiens
agctgggatgataacctcagtc

SEQ ID NO: 7163090 - DNA, 22 bp, Homo sapiens
agctgggatgataacctcagtc

SEQ ID NO: 7163091 - DNA, 22 bp, Homo sapiens
agctgggatgataacctcagtc

SEQ ID NO: 7163092 - DNA, 22 bp, Homo sapiens
agctgggcaaaatgtgaggttg

SEQ ID NO: 7163093 - DNA, 22 bp, Homo sapiens
agctgggcaaaatgtgaggttg

SEQ ID NO: 7163094 - DNA, 22 bp, Homo sapiens
agctgtgggagaatctctgggt

SEQ ID NO: 7163095 - DNA, 21 bp, Homo sapiens
agctgtggcgaggggaacatg

SEQ ID NO: 7163096 - DNA, 22 bp, Homo sapiens
agctggttagcaatctaagtga

SEQ ID NO: 7163097 - DNA, 22 bp, Homo sapiens
agctgtggccagatgtgagcgg

SEQ ID NO: 7163098 - DNA, 22 bp, Homo sapiens
agctgtgggatttgggtgtgcc

SEQ ID NO: 7163099 - DNA, 22 bp, Homo sapiens
agctgtgggagaatctctgggt

SEQ ID NO: 7163100 - DNA, 22 bp, Homo sapiens
agctgggaggctcctctgtgac

SEQ ID NO: 7163101 - DNA, 22 bp, Homo sapiens
agctgggaggctcctctgtgac

SEQ ID NO: 7163102 - DNA, 22 bp, Homo sapiens
agctgggaggctcctctgtgac

SEQ ID NO: 7163103 - DNA, 22 bp, Homo sapiens
agctgggaggtgggcagtgaga

SEQ ID NO: 7163104 - DNA, 22 bp, Homo sapiens
agctgggaggtgggcagtgaga

SEQ ID NO: 7163105 - DNA, 22 bp, Homo sapiens
agctgggaggtgggcagtgaga

SEQ ID NO: 7163106 - DNA, 22 bp, Homo sapiens
agctgggaggtgggcagtgaga

SEQ ID NO: 7163107 - DNA, 22 bp, Homo sapiens
agctgggaggtgggcagtgaga

SEQ ID NO: 7163108 - DNA, 22 bp, Homo sapiens
agctgggatgaggagcatcctt

SEQ ID NO: 7163109 - DNA, 22 bp, Homo sapiens
agctgggatgaggagcatcctt

SEQ ID NO: 7163110 - DNA, 22 bp, Homo sapiens
agctgggatgaggagcatcctt

SEQ ID NO: 7163111 - DNA, 22 bp, Homo sapiens
agctgggatgaggagcatcctt

SEQ ID NO: 7163112 - DNA, 22 bp, Homo sapiens
agctgggagctgaaggctgatt

SEQ ID NO: 7163113 - DNA, 22 bp, Homo sapiens
agctgggagctgaaggctgatt

SEQ ID NO: 7163114 - DNA, 22 bp, Homo sapiens
agctgggagctgaaggctgatt

SEQ ID NO: 7163115 - DNA, 22 bp, Homo sapiens
agctgggagctgaaggctgatt

SEQ ID NO: 7163116 - DNA, 19 bp, Homo sapiens
agctggctcttctttgtct

SEQ ID NO: 7163117 - DNA, 22 bp, Homo sapiens
agctgggagcagagccacagcc

SEQ ID NO: 7163118 - DNA, 22 bp, Homo sapiens
agctgggagcagagccacagcc

SEQ ID NO: 7163119 - DNA, 22 bp, Homo sapiens
agctgggagcagagccacagcc

SEQ ID NO: 7163120 - DNA, 22 bp, Homo sapiens
agctgggagcagagccacagcc

SEQ ID NO: 7163121 - DNA, 22 bp, Homo sapiens
agctgggagcagagccacagcc

SEQ ID NO: 7163122 - DNA, 22 bp, Homo sapiens
agctgggagcagagccacagcc

SEQ ID NO: 7163123 - DNA, 22 bp, Homo sapiens
agctgggagcagagccacagcc

SEQ ID NO: 7163124 - DNA, 22 bp, Homo sapiens
agctgtgtaagtcatgtaggtg

SEQ ID NO: 7163125 - DNA, 21 bp, Homo sapiens
agctgtggttttacatctttt

SEQ ID NO: 7163126 - DNA, 22 bp, Homo sapiens
agctgtggttctgggcagcgac

SEQ ID NO: 7163127 - DNA, 22 bp, Homo sapiens
agctgtggttagatagagtcct

SEQ ID NO: 7163128 - DNA, 22 bp, Homo sapiens
agctgtggttctgggcagcgac

SEQ ID NO: 7163129 - DNA, 22 bp, Homo sapiens
agctgtggtgttttcaagccct

SEQ ID NO: 7163130 - DNA, 22 bp, Homo sapiens
agctgtggttagatagagtcct

SEQ ID NO: 7163131 - DNA, 22 bp, Homo sapiens
agctgtggggcaggcagcgagg

SEQ ID NO: 7163132 - DNA, 22 bp, Homo sapiens
agctgtggggaggaggctagca

SEQ ID NO: 7163133 - DNA, 22 bp, Homo sapiens
agctgtgggcctgggagagctg

SEQ ID NO: 7163134 - DNA, 22 bp, Homo sapiens
agcttcagcttgcagctgtgat

SEQ ID NO: 7163135 - DNA, 22 bp, Homo sapiens
agcttcagcttgcagctgtgat

SEQ ID NO: 7163136 - DNA, 20 bp, Homo sapiens
agcttcagccctaggattgc

SEQ ID NO: 7163137 - DNA, 22 bp, Homo sapiens
agcttcaggaacaggcagcctg

SEQ ID NO: 7163138 - DNA, 20 bp, Homo sapiens
agcttcaggctcaagagaac

SEQ ID NO: 7163139 - DNA, 22 bp, Homo sapiens
agcttcagggacttgtggcaga

SEQ ID NO: 7163140 - DNA, 22 bp, Homo sapiens
agcttcagatttatctttctgt

SEQ ID NO: 7163141 - DNA, 22 bp, Homo sapiens
agcttcagatttatctttctgt

SEQ ID NO: 7163142 - DNA, 22 bp, Homo sapiens
agcttcactttgtactttgtca

SEQ ID NO: 7163143 - DNA, 22 bp, Homo sapiens
agcttattatcttatcaagctt

SEQ ID NO: 7163144 - DNA, 22 bp, Homo sapiens
agcttcaaagctaggaagatct

SEQ ID NO: 7163145 - DNA, 22 bp, Homo sapiens
agcttagcacacacaggcaggt

SEQ ID NO: 7163146 - DNA, 22 bp, Homo sapiens
agcttagcacacacaggcaggt

SEQ ID NO: 7163147 - DNA, 22 bp, Homo sapiens
agcttagtgaggtgcaagacac

SEQ ID NO: 7163148 - DNA, 22 bp, Homo sapiens
agcttagtggttgtatgagtta

SEQ ID NO: 7163149 - DNA, 22 bp, Homo sapiens
agcttagtggttgtatgagtta

SEQ ID NO: 7163150 - DNA, 22 bp, Homo sapiens
agcttataatgtaactaaggac

SEQ ID NO: 7163151 - DNA, 22 bp, Homo sapiens
agcttatagatctctctgatat

SEQ ID NO: 7163152 - DNA, 22 bp, Homo sapiens
agcttatattctagtgatgcca

SEQ ID NO: 7163153 - DNA, 22 bp, Homo sapiens
agcttatcttgttagtttcatt

SEQ ID NO: 7163154 - DNA, 22 bp, Homo sapiens
agctttattaactctccaggtg

SEQ ID NO: 7163155 - DNA, 23 bp, Homo sapiens
agctttgtgaaagcagacatggg

SEQ ID NO: 7163156 - DNA, 23 bp, Homo sapiens
agctttgtgaaagcagacatggg

SEQ ID NO: 7163157 - DNA, 23 bp, Homo sapiens
agctttgtgaaagcagacatggg

SEQ ID NO: 7163158 - DNA, 22 bp, Homo sapiens
agctttgtgactttgagctagt

SEQ ID NO: 7163159 - DNA, 22 bp, Homo sapiens
agctttgtggctttgcaagact

SEQ ID NO: 7163160 - DNA, 22 bp, Homo sapiens
agctttgtggctttgcaagact

SEQ ID NO: 7163161 - DNA, 22 bp, Homo sapiens
agctttgtttcacatacacctt

SEQ ID NO: 7163162 - DNA, 22 bp, Homo sapiens
agctttgtttgctcacccgccg

SEQ ID NO: 7163163 - DNA, 17 bp, Homo sapiens
agcttcagttgcaaaac

SEQ ID NO: 7163164 - DNA, 22 bp, Homo sapiens
agcttcagttttctattgttaa

SEQ ID NO: 7163165 - DNA, 22 bp, Homo sapiens
agcttcatctttatgtacagga

SEQ ID NO: 7163166 - DNA, 22 bp, Homo sapiens
agcttcaggtggtcttgtttct

SEQ ID NO: 7163167 - DNA, 22 bp, Homo sapiens
agcttcaggtggtcttgtttct

SEQ ID NO: 7163168 - DNA, 22 bp, Homo sapiens
agcttcagtgtcaggcccgtgg

SEQ ID NO: 7163169 - DNA, 22 bp, Homo sapiens
agcttcagtgtcaggcccgtgg

SEQ ID NO: 7163170 - DNA, 22 bp, Homo sapiens
agcttcatggaacctgaggcta

SEQ ID NO: 7163171 - DNA, 22 bp, Homo sapiens
agcttcatggaacctgaggcta

SEQ ID NO: 7163172 - DNA, 22 bp, Homo sapiens
agcttccaatttctccaagaga

SEQ ID NO: 7163173 - DNA, 22 bp, Homo sapiens
agctttatggtgcctcacttga

SEQ ID NO: 7163174 - DNA, 22 bp, Homo sapiens
agctttatggtgcctcacttga

SEQ ID NO: 7163175 - DNA, 22 bp, Homo sapiens
agcttttacataatgatcttga

SEQ ID NO: 7163176 - DNA, 19 bp, Homo sapiens
agcttttactaacagcaga

SEQ ID NO: 7163177 - DNA, 19 bp, Homo sapiens
agcttttactaacagcaga

SEQ ID NO: 7163178 - DNA, 19 bp, Homo sapiens
agcttttactaacagcaga

SEQ ID NO: 7163179 - DNA, 23 bp, Homo sapiens
agcttttaggtggaaatggcact

SEQ ID NO: 7163180 - DNA, 22 bp, Homo sapiens
agcttttattggctgtcatttg

SEQ ID NO: 7163181 - DNA, 22 bp, Homo sapiens
agcttttagtacgttaaaattg

SEQ ID NO: 7163182 - DNA, 22 bp, Homo sapiens
agcttttattggctgtcatttg

SEQ ID NO: 7163183 - DNA, 22 bp, Homo sapiens
agcttttagtacgttaaaattg

SEQ ID NO: 7163184 - DNA, 22 bp, Homo sapiens
aggaaaaagagttgctgccttc

SEQ ID NO: 7163185 - DNA, 22 bp, Homo sapiens
aggaaaaaagtctgtgattata

SEQ ID NO: 7163186 - DNA, 22 bp, Homo sapiens
aggaaaaaagtctgtgattata

SEQ ID NO: 7163187 - DNA, 22 bp, Homo sapiens
aggaaaaacctgttaatggtag

SEQ ID NO: 7163188 - DNA, 22 bp, Homo sapiens
aggaagccatggtggacgtcta

SEQ ID NO: 7163189 - DNA, 22 bp, Homo sapiens
aggaagccaggcccttgggtgg

SEQ ID NO: 7163190 - DNA, 22 bp, Homo sapiens
aggaagccactgaatgaaagtt

SEQ ID NO: 7163191 - DNA, 22 bp, Homo sapiens
aggaagccactgaatgaaagtt

SEQ ID NO: 7163192 - DNA, 22 bp, Homo sapiens
aggaagccacgagtggcacggg

SEQ ID NO: 7163193 - DNA, 22 bp, Homo sapiens
aggaagccaggcccttgggtgg

SEQ ID NO: 7163194 - DNA, 20 bp, Homo sapiens
aggaagccaaaggctgtctt

SEQ ID NO: 7163195 - DNA, 22 bp, Homo sapiens
aggaagccaagcctgacactca

SEQ ID NO: 7163196 - DNA, 18 bp, Homo sapiens
aggaagcaggaggaaggc

SEQ ID NO: 7163197 - DNA, 22 bp, Homo sapiens
aggaagagcattcacatggtag

SEQ ID NO: 7163198 - DNA, 22 bp, Homo sapiens
aggaagcagtttataatgcatt

SEQ ID NO: 7163199 - DNA, 22 bp, Homo sapiens
aggaagagcattcacatggtag

SEQ ID NO: 7163200 - DNA, 18 bp, Homo sapiens
aggaaagaaaggcaggtg

SEQ ID NO: 7163201 - DNA, 22 bp, Homo sapiens
aggaagagcattcacatggtag

SEQ ID NO: 7163202 - DNA, 22 bp, Homo sapiens
aggaagagcattcacatggtag

SEQ ID NO: 7163203 - DNA, 18 bp, Homo sapiens
aggaaagaaaggcaggtg

SEQ ID NO: 7163204 - DNA, 18 bp, Homo sapiens
aggaaagaaaggcaggtg

SEQ ID NO: 7163205 - DNA, 18 bp, Homo sapiens
aggaaagaaaggcaggtg

SEQ ID NO: 7163206 - DNA, 18 bp, Homo sapiens
aggaaagaaaggcaggtg

SEQ ID NO: 7163207 - DNA, 22 bp, Homo sapiens
aggaaactcaaagtgtcaggta

SEQ ID NO: 7163208 - DNA, 22 bp, Homo sapiens
aggaaaaataaggcagcagggc

SEQ ID NO: 7163209 - DNA, 22 bp, Homo sapiens
aggaaaaataaggcagcagggc

SEQ ID NO: 7163210 - DNA, 22 bp, Homo sapiens
aggaaaaataaggcagcagggc

SEQ ID NO: 7163211 - DNA, 22 bp, Homo sapiens
aggaaactaacttatctttata

SEQ ID NO: 7163212 - DNA, 22 bp, Homo sapiens
aggaaacttcagagttttggtc

SEQ ID NO: 7163213 - DNA, 22 bp, Homo sapiens
aggaaactttcttttgcttcat

SEQ ID NO: 7163214 - DNA, 22 bp, Homo sapiens
aggaaagaaaggaggtgcattt

SEQ ID NO: 7163215 - DNA, 22 bp, Homo sapiens
aggaaactgatgttttttacaa

SEQ ID NO: 7163216 - DNA, 22 bp, Homo sapiens
aggaaactgatgttttttacaa

SEQ ID NO: 7163217 - DNA, 22 bp, Homo sapiens
aggaaactgggcctcaggttag

SEQ ID NO: 7163218 - DNA, 22 bp, Homo sapiens
aggaaactgggtatggttatac

SEQ ID NO: 7163219 - DNA, 22 bp, Homo sapiens
aggcatggctttaggcaggcgt

SEQ ID NO: 7163220 - DNA, 22 bp, Homo sapiens
aggcatggctttaggcaggcgt

SEQ ID NO: 7163221 - DNA, 22 bp, Homo sapiens
aggcatggctttaggcaggcgt

SEQ ID NO: 7163222 - DNA, 22 bp, Homo sapiens
aggcatggctttaggcaggcgt

SEQ ID NO: 7163223 - DNA, 22 bp, Homo sapiens
aggcatggctttaggcaggcgt

SEQ ID NO: 7163224 - DNA, 22 bp, Homo sapiens
aggcatggctttaggcaggcgt

SEQ ID NO: 7163225 - DNA, 22 bp, Homo sapiens
aggcatggctttaggcaggcgt

SEQ ID NO: 7163226 - DNA, 22 bp, Homo sapiens
aggcatggctttaggcaggcgt

SEQ ID NO: 7163227 - DNA, 19 bp, Homo sapiens
aggcatgggaagagaagtc

SEQ ID NO: 7163228 - DNA, 22 bp, Homo sapiens
aggcatggctttaggcaggcgt

SEQ ID NO: 7163229 - DNA, 19 bp, Homo sapiens
aggcatgggaagagaagtc

SEQ ID NO: 7163230 - DNA, 19 bp, Homo sapiens
aggcatgggaagagaagtc

SEQ ID NO: 7163231 - DNA, 19 bp, Homo sapiens
aggcatgggaagagaagtc

SEQ ID NO: 7163232 - DNA, 22 bp, Homo sapiens
aggcatggggctgcagtcaggt

SEQ ID NO: 7163233 - DNA, 22 bp, Homo sapiens
aggcatggggctgcagtcaggt

SEQ ID NO: 7163234 - DNA, 22 bp, Homo sapiens
aggcatggggctgcagtcaggt

SEQ ID NO: 7163235 - DNA, 20 bp, Homo sapiens
aggcatgggatgcccagatt

SEQ ID NO: 7163236 - DNA, 20 bp, Homo sapiens
aggcatgggatgcccagatt

SEQ ID NO: 7163237 - DNA, 22 bp, Homo sapiens
aggcatgggtagaagagaagcc

SEQ ID NO: 7163238 - DNA, 22 bp, Homo sapiens
aggcatgggtagaagagaagcc

SEQ ID NO: 7163239 - DNA, 22 bp, Homo sapiens
aggcatgggtagaagagaagcc

SEQ ID NO: 7163240 - DNA, 22 bp, Homo sapiens
aggcatggggctgcagtcaggt

SEQ ID NO: 7163241 - DNA, 22 bp, Homo sapiens
aggcatggggctgcagtcaggt

SEQ ID NO: 7163242 - DNA, 22 bp, Homo sapiens
aggcatggggctgcagtcaggt

SEQ ID NO: 7163243 - DNA, 22 bp, Homo sapiens
aggcatggcatggggcagatgt

SEQ ID NO: 7163244 - DNA, 20 bp, Homo sapiens
aggcagttagaaggagatga

SEQ ID NO: 7163245 - DNA, 22 bp, Homo sapiens
aggcagtgttcttctaagggca

SEQ ID NO: 7163246 - DNA, 22 bp, Homo sapiens
aggcagtgttcttctaagggca

SEQ ID NO: 7163247 - DNA, 22 bp, Homo sapiens
acatacatggtgctttcttggt

SEQ ID NO: 7163248 - DNA, 22 bp, Homo sapiens
acatacatggtgctttcttggt

SEQ ID NO: 7163249 - DNA, 22 bp, Homo sapiens
acatacatggttctcagccctt

SEQ ID NO: 7163250 - DNA, 22 bp, Homo sapiens
acatacatggttctcagccctt

SEQ ID NO: 7163251 - DNA, 22 bp, Homo sapiens
acatacatgtaaaggaaattat

SEQ ID NO: 7163252 - DNA, 22 bp, Homo sapiens
acatacatgtaaaggaaattat

SEQ ID NO: 7163253 - DNA, 22 bp, Homo sapiens
acatacatgtaaaggaaattat

SEQ ID NO: 7163254 - DNA, 21 bp, Homo sapiens
acatacattatctttttaaaa

SEQ ID NO: 7163255 - DNA, 21 bp, Homo sapiens
acatacattatctttttaaaa

SEQ ID NO: 7163256 - DNA, 22 bp, Homo sapiens
acatacatggattcatggattc

SEQ ID NO: 7163257 - DNA, 22 bp, Homo sapiens
acatacatggattcatggattc

SEQ ID NO: 7163258 - DNA, 22 bp, Homo sapiens
acatacatggattcatggattc

SEQ ID NO: 7163259 - DNA, 22 bp, Homo sapiens
acatacatggattcatggattc

SEQ ID NO: 7163260 - DNA, 22 bp, Homo sapiens
acatacatgggattaaaaaatt

SEQ ID NO: 7163261 - DNA, 22 bp, Homo sapiens
acatacatgggattaaaaaatt

SEQ ID NO: 7163262 - DNA, 22 bp, Homo sapiens
aggccagcacgacagccgcagg

SEQ ID NO: 7163263 - DNA, 22 bp, Homo sapiens
aggccagcagacgtgggactga

SEQ ID NO: 7163264 - DNA, 22 bp, Homo sapiens
aggccagcacgacagccgcagg

SEQ ID NO: 7163265 - DNA, 22 bp, Homo sapiens
aggccacaggcaccctgtgttc

SEQ ID NO: 7163266 - DNA, 22 bp, Homo sapiens
aggccacaggcaccctgtgttc

SEQ ID NO: 7163267 - DNA, 22 bp, Homo sapiens
aggccacaggtggaagccagag

SEQ ID NO: 7163268 - DNA, 22 bp, Homo sapiens
aggccacaggtggaagccagag

SEQ ID NO: 7163269 - DNA, 22 bp, Homo sapiens
aggccacaggcaccctgtgttc

SEQ ID NO: 7163270 - DNA, 22 bp, Homo sapiens
aggccacaggagtactgtcggt

SEQ ID NO: 7163271 - DNA, 22 bp, Homo sapiens
aggccacaggattgcacagcat

SEQ ID NO: 7163272 - DNA, 22 bp, Homo sapiens
aggccacaggattgcacagcat

SEQ ID NO: 7163273 - DNA, 22 bp, Homo sapiens
aggccacagcctgggaggtgac

SEQ ID NO: 7163274 - DNA, 22 bp, Homo sapiens
aggccacagcctgggaggtgac

SEQ ID NO: 7163275 - DNA, 22 bp, Homo sapiens
aggccacagcctgggaggtgac

SEQ ID NO: 7163276 - DNA, 22 bp, Homo sapiens
aggccacagcctgggaggtgac

SEQ ID NO: 7163277 - DNA, 18 bp, Homo sapiens
aggcatggtggtgcgcac

SEQ ID NO: 7163278 - DNA, 18 bp, Homo sapiens
aggcatggtggtgcgcac

SEQ ID NO: 7163279 - DNA, 18 bp, Homo sapiens
aggcatggtggtgcgcac

SEQ ID NO: 7163280 - DNA, 17 bp, Homo sapiens
aggcatggtctggggtg

SEQ ID NO: 7163281 - DNA, 22 bp, Homo sapiens
aggcatgggtagaagagaagcc

SEQ ID NO: 7163282 - DNA, 22 bp, Homo sapiens
aggccacaatttgatttggttt

SEQ ID NO: 7163283 - DNA, 22 bp, Homo sapiens
aggccacaatttgatttggttt

SEQ ID NO: 7163284 - DNA, 22 bp, Homo sapiens
aggccacacaactcttagagat

SEQ ID NO: 7163285 - DNA, 22 bp, Homo sapiens
aggccacacaactcttagagat

SEQ ID NO: 7163286 - DNA, 22 bp, Homo sapiens
aggccacacaactcttagagat

SEQ ID NO: 7163287 - DNA, 18 bp, Homo sapiens
aggccacactccagaaca

SEQ ID NO: 7163288 - DNA, 18 bp, Homo sapiens
aggccacactccagaaca

SEQ ID NO: 7163289 - DNA, 22 bp, Homo sapiens
aggccacagagagtgcatgtgc

SEQ ID NO: 7163290 - DNA, 22 bp, Homo sapiens
aggccacagagagtgcatgtgc

SEQ ID NO: 7163291 - DNA, 22 bp, Homo sapiens
aggccacagagagtgcatgtgc

SEQ ID NO: 7163292 - DNA, 22 bp, Homo sapiens
aggccacagatactgtgaagta

SEQ ID NO: 7163293 - DNA, 22 bp, Homo sapiens
aggccacagatactgtgaagta

SEQ ID NO: 7163294 - DNA, 22 bp, Homo sapiens
aggccagcattctctctccagg

SEQ ID NO: 7163295 - DNA, 22 bp, Homo sapiens
aggccagcattctctctccagg

SEQ ID NO: 7163296 - DNA, 22 bp, Homo sapiens
aggccagcattctctctccagg

SEQ ID NO: 7163297 - DNA, 22 bp, Homo sapiens
aggccagcattctctctccagg

SEQ ID NO: 7163298 - DNA, 22 bp, Homo sapiens
aggccagcagcatgacggcatc

SEQ ID NO: 7163299 - DNA, 22 bp, Homo sapiens
aggccagcagcatgacggcatc

SEQ ID NO: 7163300 - DNA, 22 bp, Homo sapiens
aggccagcagacgtgggactga

SEQ ID NO: 7163301 - DNA, 22 bp, Homo sapiens
aggccagcattctctctccagg

SEQ ID NO: 7163302 - DNA, 22 bp, Homo sapiens
aggccagccctcacctgtgttc

SEQ ID NO: 7163303 - DNA, 22 bp, Homo sapiens
aggccagccctcacctgtgttc

SEQ ID NO: 7163304 - DNA, 18 bp, Homo sapiens
aggccagccctgctactg

SEQ ID NO: 7163305 - DNA, 22 bp, Homo sapiens
aggccagccctgggctgagaga

SEQ ID NO: 7163306 - DNA, 22 bp, Homo sapiens
aggccagccctgggctgagaga

SEQ ID NO: 7163307 - DNA, 22 bp, Homo sapiens
acatgaaaactggttccttcag

SEQ ID NO: 7163308 - DNA, 22 bp, Homo sapiens
acatgaaaactggttccttcag

SEQ ID NO: 7163309 - DNA, 22 bp, Homo sapiens
acatgaaaaatgtttgcagttt

SEQ ID NO: 7163310 - DNA, 22 bp, Homo sapiens
acatgaaaaatgtttgcagttt

SEQ ID NO: 7163311 - DNA, 22 bp, Homo sapiens
acatgaaacccagccgtggtcc

SEQ ID NO: 7163312 - DNA, 22 bp, Homo sapiens
acatgaaaagactatctgatta

SEQ ID NO: 7163313 - DNA, 22 bp, Homo sapiens
acatgaaaagactatctgatta

SEQ ID NO: 7163314 - DNA, 22 bp, Homo sapiens
aggccagccctgggctgagaga

SEQ ID NO: 7163315 - DNA, 22 bp, Homo sapiens
aggccagcctcaggcagggacc

SEQ ID NO: 7163316 - DNA, 22 bp, Homo sapiens
aggccagcctcaggcagggacc

SEQ ID NO: 7163317 - DNA, 22 bp, Homo sapiens
aggccagcctcaggcagggacc

SEQ ID NO: 7163318 - DNA, 22 bp, Homo sapiens
acatctttgtttcttagtgtat

SEQ ID NO: 7163319 - DNA, 22 bp, Homo sapiens
acatctttttggaaacggctga

SEQ ID NO: 7163320 - DNA, 22 bp, Homo sapiens
acatcttttttctctaattgtg

SEQ ID NO: 7163321 - DNA, 22 bp, Homo sapiens
acatgaaactgttgcattagaa

SEQ ID NO: 7163322 - DNA, 22 bp, Homo sapiens
aggccaggtggtcatgcttgct

SEQ ID NO: 7163323 - DNA, 22 bp, Homo sapiens
aggccaggtggtcatgcttgct

SEQ ID NO: 7163324 - DNA, 22 bp, Homo sapiens
aggcccagcttgaagtgggaag

SEQ ID NO: 7163325 - DNA, 22 bp, Homo sapiens
aggcccagcttgaagtgggaag

SEQ ID NO: 7163326 - DNA, 22 bp, Homo sapiens
aggcccagcttgaagtgggaag

SEQ ID NO: 7163327 - DNA, 22 bp, Homo sapiens
aggcccagcttgaagtgggaag

SEQ ID NO: 7163328 - DNA, 22 bp, Homo sapiens
aggccaggtggtcatgcttgct

SEQ ID NO: 7163329 - DNA, 22 bp, Homo sapiens
aggcccagcttgaagtgggaag

SEQ ID NO: 7163330 - DNA, 21 bp, Homo sapiens
aggcccagctttcctcttgct

SEQ ID NO: 7163331 - DNA, 21 bp, Homo sapiens
aggcccagctttcctcttgct

SEQ ID NO: 7163332 - DNA, 21 bp, Homo sapiens
aggcccagctttcctcttgct

SEQ ID NO: 7163333 - DNA, 22 bp, Homo sapiens
aggcccagggctgctctctgaa

SEQ ID NO: 7163334 - DNA, 22 bp, Homo sapiens
aggcccagggctgctctctgaa

SEQ ID NO: 7163335 - DNA, 21 bp, Homo sapiens
aggcccaggaatatgcatttt

SEQ ID NO: 7163336 - DNA, 21 bp, Homo sapiens
aggcccaggaatatgcatttt

SEQ ID NO: 7163337 - DNA, 22 bp, Homo sapiens
aggcccagggctgctctctgaa

SEQ ID NO: 7163338 - DNA, 22 bp, Homo sapiens
aggcccagggctgctctctgaa

SEQ ID NO: 7163339 - DNA, 22 bp, Homo sapiens
aggcccagggctgctctctgaa

SEQ ID NO: 7163340 - DNA, 22 bp, Homo sapiens
aggccctgagcatccgagggca

SEQ ID NO: 7163341 - DNA, 22 bp, Homo sapiens
aggccctgagcatccgagggca

SEQ ID NO: 7163342 - DNA, 22 bp, Homo sapiens
aggccctgagcatccgagggca

SEQ ID NO: 7163343 - DNA, 22 bp, Homo sapiens
aggccctgagcatccgagggca

SEQ ID NO: 7163344 - DNA, 22 bp, Homo sapiens
aggccctgatccgaatccagat

SEQ ID NO: 7163345 - DNA, 22 bp, Homo sapiens
aggccctgatccgaatccagat

SEQ ID NO: 7163346 - DNA, 22 bp, Homo sapiens
aggccctgagaaaatccctgca

SEQ ID NO: 7163347 - DNA, 22 bp, Homo sapiens
aggccctgagaaaatccctgca

SEQ ID NO: 7163348 - DNA, 22 bp, Homo sapiens
aggcccagtagtcgacggcgct

SEQ ID NO: 7163349 - DNA, 23 bp, Homo sapiens
aggcccaggtatgtttgttttgg

SEQ ID NO: 7163350 - DNA, 22 bp, Homo sapiens
aggcccagtagtcgacggcgct

SEQ ID NO: 7163351 - DNA, 22 bp, Homo sapiens
acattcattccaggtcagtcag

SEQ ID NO: 7163352 - DNA, 22 bp, Homo sapiens
acattcattccaggtcagtcag

SEQ ID NO: 7163353 - DNA, 22 bp, Homo sapiens
acattcatgtcccacttctagc

SEQ ID NO: 7163354 - DNA, 22 bp, Homo sapiens
acattcatgtcccacttctagc

SEQ ID NO: 7163355 - DNA, 22 bp, Homo sapiens
acattcaggccacagtggagtc

SEQ ID NO: 7163356 - DNA, 22 bp, Homo sapiens
acattcaggccacagtggagtc

SEQ ID NO: 7163357 - DNA, 22 bp, Homo sapiens
acattcaccacacttatagggc

SEQ ID NO: 7163358 - DNA, 22 bp, Homo sapiens
acattcactatgtccaaactct

SEQ ID NO: 7163359 - DNA, 22 bp, Homo sapiens
acattcaggccacagtggagtc

SEQ ID NO: 7163360 - DNA, 22 bp, Homo sapiens
acattcatgcaccttcctatcc

SEQ ID NO: 7163361 - DNA, 22 bp, Homo sapiens
acattcatgggttttacattat

SEQ ID NO: 7163362 - DNA, 22 bp, Homo sapiens
acattcatgggttttacattat

SEQ ID NO: 7163363 - DNA, 21 bp, Homo sapiens
acattcacaggatattatcat

SEQ ID NO: 7163364 - DNA, 21 bp, Homo sapiens
acattcacaggatattatcat

SEQ ID NO: 7163365 - DNA, 22 bp, Homo sapiens
acattcacgctctcaaagctga

SEQ ID NO: 7163366 - DNA, 22 bp, Homo sapiens
acattcaagtttctgctcatgg

SEQ ID NO: 7163367 - DNA, 22 bp, Homo sapiens
acattcaagtttctgctcatgg

SEQ ID NO: 7163368 - DNA, 22 bp, Homo sapiens
acattcaaggcagcactgagtg

SEQ ID NO: 7163369 - DNA, 22 bp, Homo sapiens
acattcaaggcagcactgagtg

SEQ ID NO: 7163370 - DNA, 22 bp, Homo sapiens
acattcaaggccttctgacaca

SEQ ID NO: 7163371 - DNA, 22 bp, Homo sapiens
acattcaaggccttctgacaca

SEQ ID NO: 7163372 - DNA, 22 bp, Homo sapiens
acattcaaggccttctgacaca

SEQ ID NO: 7163373 - DNA, 22 bp, Homo sapiens
acattcaaggccttctgacaca

SEQ ID NO: 7163374 - DNA, 22 bp, Homo sapiens
aggccctgcattgtactgaggg

SEQ ID NO: 7163375 - DNA, 22 bp, Homo sapiens
aggccctgcattgtactgaggg

SEQ ID NO: 7163376 - DNA, 22 bp, Homo sapiens
aggccctgcattgtactgaggg

SEQ ID NO: 7163377 - DNA, 20 bp, Homo sapiens
aggccctgccagggacggag

SEQ ID NO: 7163378 - DNA, 20 bp, Homo sapiens
aggccctgccagggacggag

SEQ ID NO: 7163379 - DNA, 22 bp, Homo sapiens
acattaagaaacgagagagcaa

SEQ ID NO: 7163380 - DNA, 23 bp, Homo sapiens
acattacacgcagtaattgcccc

SEQ ID NO: 7163381 - DNA, 22 bp, Homo sapiens
acattcaagatgcattcactta

SEQ ID NO: 7163382 - DNA, 22 bp, Homo sapiens
aggccctgcaggaagcaggatg

SEQ ID NO: 7163383 - DNA, 22 bp, Homo sapiens
aggccctgcaggaagcaggatg

SEQ ID NO: 7163384 - DNA, 22 bp, Homo sapiens
aggccctgatccgaatccagat

SEQ ID NO: 7163385 - DNA, 22 bp, Homo sapiens
aggccctgcaggaagcaggatg

SEQ ID NO: 7163386 - DNA, 22 bp, Homo sapiens
aggccctgcaggaagcaggatg

SEQ ID NO: 7163387 - DNA, 22 bp, Homo sapiens
aggccctgcaggaagcaggatg

SEQ ID NO: 7163388 - DNA, 22 bp, Homo sapiens
aggccctgcaggaagcaggatg

SEQ ID NO: 7163389 - DNA, 22 bp, Homo sapiens
aggccctgcaggagtggggaca

SEQ ID NO: 7163390 - DNA, 22 bp, Homo sapiens
aggccctgcaggagtggggaca

SEQ ID NO: 7163391 - DNA, 22 bp, Homo sapiens
aggccctgcaggagtggggaca

SEQ ID NO: 7163392 - DNA, 22 bp, Homo sapiens
aggccctgcaggagtggggaca

SEQ ID NO: 7163393 - DNA, 22 bp, Homo sapiens
aggccctgcaggagtggggaca

SEQ ID NO: 7163394 - DNA, 22 bp, Homo sapiens
aggccctgcattgtactgaggg

SEQ ID NO: 7163395 - DNA, 22 bp, Homo sapiens
aggccctgcattgtactgaggg

SEQ ID NO: 7163396 - DNA, 22 bp, Homo sapiens
acattcccaccaacagtgtaaa

SEQ ID NO: 7163397 - DNA, 19 bp, Homo sapiens
acattcccatcagcaatgt

SEQ ID NO: 7163398 - DNA, 22 bp, Homo sapiens
acattcctgaatgggcacattt

SEQ ID NO: 7163399 - DNA, 22 bp, Homo sapiens
acattcccttggcttgaagcag

SEQ ID NO: 7163400 - DNA, 22 bp, Homo sapiens
acattcctacctgctcgggtgt

SEQ ID NO: 7163401 - DNA, 22 bp, Homo sapiens
acattcctcagtgccagttgag

SEQ ID NO: 7163402 - DNA, 22 bp, Homo sapiens
acattcctgaggaaatacattc

SEQ ID NO: 7163403 - DNA, 22 bp, Homo sapiens
acattcctgaggaaatacattc

SEQ ID NO: 7163404 - DNA, 22 bp, Homo sapiens
acattcctgccataaatttttt

SEQ ID NO: 7163405 - DNA, 22 bp, Homo sapiens
acattcctgcctccccggagat

SEQ ID NO: 7163406 - DNA, 22 bp, Homo sapiens
acattcctttcttgagcacagt

SEQ ID NO: 7163407 - DNA, 22 bp, Homo sapiens
acattctaaagcatgctcagga

SEQ ID NO: 7163408 - DNA, 22 bp, Homo sapiens
acattctaaagcatgctcagga

SEQ ID NO: 7163409 - DNA, 22 bp, Homo sapiens
acattctaacattgtacagata

SEQ ID NO: 7163410 - DNA, 22 bp, Homo sapiens
acattctaacattgtacagata

SEQ ID NO: 7163411 - DNA, 22 bp, Homo sapiens
acattctatgaagataatttta

SEQ ID NO: 7163412 - DNA, 22 bp, Homo sapiens
acattctatggttgatgagttg

SEQ ID NO: 7163413 - DNA, 22 bp, Homo sapiens
acattctagatatgttatattt

SEQ ID NO: 7163414 - DNA, 22 bp, Homo sapiens
acattctatagcaagctgatct

SEQ ID NO: 7163415 - DNA, 22 bp, Homo sapiens
acattctatagcaagctgatct

SEQ ID NO: 7163416 - DNA, 22 bp, Homo sapiens
acattctagatatgttatattt

SEQ ID NO: 7163417 - DNA, 22 bp, Homo sapiens
acattctagatatgttatattt

SEQ ID NO: 7163418 - DNA, 22 bp, Homo sapiens
acattctagatatgttatattt

SEQ ID NO: 7163419 - DNA, 22 bp, Homo sapiens
acattctagaagagcttcactt

SEQ ID NO: 7163420 - DNA, 22 bp, Homo sapiens
acattctttgagttttgttaaa

SEQ ID NO: 7163421 - DNA, 22 bp, Homo sapiens
acattgaaagcatattatctcc

SEQ ID NO: 7163422 - DNA, 22 bp, Homo sapiens
acattctttgagttttgttaaa

SEQ ID NO: 7163423 - DNA, 22 bp, Homo sapiens
acattctttcaccttgtgtcca

SEQ ID NO: 7163424 - DNA, 22 bp, Homo sapiens
acattctttcaccttgtgtcca

SEQ ID NO: 7163425 - DNA, 22 bp, Homo sapiens
acattcttgaagtgaagtttat

SEQ ID NO: 7163426 - DNA, 22 bp, Homo sapiens
acattctattctgcaggacaag

SEQ ID NO: 7163427 - DNA, 22 bp, Homo sapiens
acattcttggactccactctag

SEQ ID NO: 7163428 - DNA, 22 bp, Homo sapiens
aggctccagcagccagaggaag

SEQ ID NO: 7163429 - DNA, 22 bp, Homo sapiens
aggctccagcagccagaggaag

SEQ ID NO: 7163430 - DNA, 22 bp, Homo sapiens
aggctccagcagccagaggaag

SEQ ID NO: 7163431 - DNA, 22 bp, Homo sapiens
aggctccagcagccagaggaag

SEQ ID NO: 7163432 - DNA, 22 bp, Homo sapiens
aggctccagcagccagaggaag

SEQ ID NO: 7163433 - DNA, 22 bp, Homo sapiens
aggctccagcagccagaggaag

SEQ ID NO: 7163434 - DNA, 22 bp, Homo sapiens
aggctccagcccaaggctgcag

SEQ ID NO: 7163435 - DNA, 22 bp, Homo sapiens
aggctccagcccaaggctgcag

SEQ ID NO: 7163436 - DNA, 22 bp, Homo sapiens
aggctccagcccaaggctgcag

SEQ ID NO: 7163437 - DNA, 23 bp, Homo sapiens
aggctccactccctgggatgtgg

SEQ ID NO: 7163438 - DNA, 23 bp, Homo sapiens
aggctccactccctgggatgtgg

SEQ ID NO: 7163439 - DNA, 22 bp, Homo sapiens
acattgatatttcaaatacagg

SEQ ID NO: 7163440 - DNA, 22 bp, Homo sapiens
acattgagtgctccataaatca

SEQ ID NO: 7163441 - DNA, 22 bp, Homo sapiens
acattgacttggatgggtagca

SEQ ID NO: 7163442 - DNA, 22 bp, Homo sapiens
acattgagagttttgaagagta

SEQ ID NO: 7163443 - DNA, 22 bp, Homo sapiens
acattgagcctcacctagatgc

SEQ ID NO: 7163444 - DNA, 19 bp, Homo sapiens
acattgaattttcttcttt

SEQ ID NO: 7163445 - DNA, 19 bp, Homo sapiens
acattgaattttcttcttt

SEQ ID NO: 7163446 - DNA, 22 bp, Homo sapiens
acattgacctgattttgaagac

SEQ ID NO: 7163447 - DNA, 22 bp, Homo sapiens
acattgaaagcatattatctcc

SEQ ID NO: 7163448 - DNA, 22 bp, Homo sapiens
acattgaacagtacaaatgatc

SEQ ID NO: 7163449 - DNA, 22 bp, Homo sapiens
acattgaacagtacaaatgatc

SEQ ID NO: 7163450 - DNA, 22 bp, Homo sapiens
acattgaacagtacaaatgatc

SEQ ID NO: 7163451 - DNA, 22 bp, Homo sapiens
acattgaacatggcaggacatt

SEQ ID NO: 7163452 - DNA, 22 bp, Homo sapiens
acattgaaccagtagacacaaa

SEQ ID NO: 7163453 - DNA, 22 bp, Homo sapiens
acattgaactacttgtaatgag

SEQ ID NO: 7163454 - DNA, 22 bp, Homo sapiens
acattgaactacttgtaatgag

SEQ ID NO: 7163455 - DNA, 22 bp, Homo sapiens
acattgaagctgtgaaatcaaa

SEQ ID NO: 7163456 - DNA, 22 bp, Homo sapiens
acattgaagggaatgcaaagat

SEQ ID NO: 7163457 - DNA, 22 bp, Homo sapiens
acattgaagggaatgcaaagat

SEQ ID NO: 7163458 - DNA, 22 bp, Homo sapiens
acattgaagggaatgcaaagat

SEQ ID NO: 7163459 - DNA, 22 bp, Homo sapiens
acattgaagggctatccaatag

SEQ ID NO: 7163460 - DNA, 22 bp, Homo sapiens
acattgaagggctatccaatag

SEQ ID NO: 7163461 - DNA, 22 bp, Homo sapiens
acattgaagtgtctggcctcct

SEQ ID NO: 7163462 - DNA, 22 bp, Homo sapiens
acattgaatgtatgtgatgaaa

SEQ ID NO: 7163463 - DNA, 22 bp, Homo sapiens
acattgaattcaaaattactga

SEQ ID NO: 7163464 - DNA, 22 bp, Homo sapiens
acattgaattcaaaattactga

SEQ ID NO: 7163465 - DNA, 22 bp, Homo sapiens
acattgaattcaaaattactga

SEQ ID NO: 7163466 - DNA, 22 bp, Homo sapiens
acattgaatttcacttttgtac

SEQ ID NO: 7163467 - DNA, 19 bp, Homo sapiens
acattgaattttcttcttt

SEQ ID NO: 7163468 - DNA, 22 bp, Homo sapiens
aggcttcattgtggcatcagga

SEQ ID NO: 7163469 - DNA, 22 bp, Homo sapiens
aggcttcccagctgagctcagc

SEQ ID NO: 7163470 - DNA, 22 bp, Homo sapiens
aggcttcccagctgagctcagc

SEQ ID NO: 7163471 - DNA, 18 bp, Homo sapiens
aggcttcccaggcaggcc

SEQ ID NO: 7163472 - DNA, 22 bp, Homo sapiens
aggcttcccttcctctgggggt

SEQ ID NO: 7163473 - DNA, 22 bp, Homo sapiens
aggcttccgagtagctgggact

SEQ ID NO: 7163474 - DNA, 22 bp, Homo sapiens
aggcttcaggaaatatacattt

SEQ ID NO: 7163475 - DNA, 22 bp, Homo sapiens
aggctgtgcaattagggtaaga

SEQ ID NO: 7163476 - DNA, 22 bp, Homo sapiens
aggctgtgcaattagggtaaga

SEQ ID NO: 7163477 - DNA, 22 bp, Homo sapiens
aggctccaggcaaaatttcgga

SEQ ID NO: 7163478 - DNA, 22 bp, Homo sapiens
aggctccaggcccttcaccagc

SEQ ID NO: 7163479 - DNA, 22 bp, Homo sapiens
aggctccaggcccttcaccagc

SEQ ID NO: 7163480 - DNA, 22 bp, Homo sapiens
aggctgtgcaattagggtaaga

SEQ ID NO: 7163481 - DNA, 22 bp, Homo sapiens
aggctgtgattccaccactctc

SEQ ID NO: 7163482 - DNA, 22 bp, Homo sapiens
aggctccagtctcctctggcag

SEQ ID NO: 7163483 - DNA, 22 bp, Homo sapiens
aggctccagtctcctctggcag

SEQ ID NO: 7163484 - DNA, 22 bp, Homo sapiens
aggctccaggcctccctgcatg

SEQ ID NO: 7163485 - DNA, 23 bp, Homo sapiens
accagtccattcccctcatgatt

SEQ ID NO: 7163486 - DNA, 23 bp, Homo sapiens
accagtccattcccctcatgatt

SEQ ID NO: 7163487 - DNA, 21 bp, Homo sapiens
accagtccctagtcttatcct

SEQ ID NO: 7163488 - DNA, 22 bp, Homo sapiens
accagtccgcggagctccgggg

SEQ ID NO: 7163489 - DNA, 22 bp, Homo sapiens
accagtccgcggagctccgggg

SEQ ID NO: 7163490 - DNA, 20 bp, Homo sapiens
accaggtggctgatgacacc

SEQ ID NO: 7163491 - DNA, 22 bp, Homo sapiens
accaggtggccccagcgtggtt

SEQ ID NO: 7163492 - DNA, 20 bp, Homo sapiens
accaggtggctgatgacacc

SEQ ID NO: 7163493 - DNA, 22 bp, Homo sapiens
accaggttggtgtccttctggc

SEQ ID NO: 7163494 - DNA, 22 bp, Homo sapiens
accagtaagatcctgtacatac

SEQ ID NO: 7163495 - DNA, 22 bp, Homo sapiens
accagtgcttcctgctggagct

SEQ ID NO: 7163496 - DNA, 22 bp, Homo sapiens
accagtggatactgcttgcttt

SEQ ID NO: 7163497 - DNA, 22 bp, Homo sapiens
accagtcttgttgccatgtctg

SEQ ID NO: 7163498 - DNA, 22 bp, Homo sapiens
accagtcttgttgccatgtctg

SEQ ID NO: 7163499 - DNA, 22 bp, Homo sapiens
accagtgtcaccccaaccagga

SEQ ID NO: 7163500 - DNA, 22 bp, Homo sapiens
accagttctactcacctcgccc

SEQ ID NO: 7163501 - DNA, 22 bp, Homo sapiens
accagttacatcttagcaagca

SEQ ID NO: 7163502 - DNA, 22 bp, Homo sapiens
accagttctttctctgtttctg

SEQ ID NO: 7163503 - DNA, 22 bp, Homo sapiens
accagtttatagcgatctgtca

SEQ ID NO: 7163504 - DNA, 20 bp, Homo sapiens
accataatgttaattacaaa

SEQ ID NO: 7163505 - DNA, 22 bp, Homo sapiens
accataattacttggctttttc

SEQ ID NO: 7163506 - DNA, 22 bp, Homo sapiens
accatagactggaggatctcct

SEQ ID NO: 7163507 - DNA, 22 bp, Homo sapiens
accatataacaagtttaggaga

SEQ ID NO: 7163508 - DNA, 22 bp, Homo sapiens
agggccagttctacctctgaat

SEQ ID NO: 7163509 - DNA, 23 bp, Homo sapiens
agggcccaagcctggacagcagg

SEQ ID NO: 7163510 - DNA, 23 bp, Homo sapiens
agggcccaagcctggacagcagg

SEQ ID NO: 7163511 - DNA, 23 bp, Homo sapiens
agggcccaagcctggacagcagg

SEQ ID NO: 7163512 - DNA, 22 bp, Homo sapiens
agggcctcctaatttcctcata

SEQ ID NO: 7163513 - DNA, 22 bp, Homo sapiens
agggcctcgaaggcagagggat

SEQ ID NO: 7163514 - DNA, 22 bp, Homo sapiens
agggcctcgggctcagtgggtc

SEQ ID NO: 7163515 - DNA, 22 bp, Homo sapiens
agggcctcgggctcagtgggtc

SEQ ID NO: 7163516 - DNA, 22 bp, Homo sapiens
agggcctcgggctcagtgggtc

SEQ ID NO: 7163517 - DNA, 22 bp, Homo sapiens
agggcctcgggctcagtgggtc

SEQ ID NO: 7163518 - DNA, 22 bp, Homo sapiens
agggcctcgggctcagtgggtc

SEQ ID NO: 7163519 - DNA, 21 bp, Homo sapiens
agggcctctcatttgtgccag

SEQ ID NO: 7163520 - DNA, 22 bp, Homo sapiens
accagggcttacagcagtagct

SEQ ID NO: 7163521 - DNA, 22 bp, Homo sapiens
accagggcttacagcagtagct

SEQ ID NO: 7163522 - DNA, 22 bp, Homo sapiens
accagggcttacagcagtagct

SEQ ID NO: 7163523 - DNA, 22 bp, Homo sapiens
accagggctgggataggtcagg

SEQ ID NO: 7163524 - DNA, 22 bp, Homo sapiens
accagggctgacaatctgatgg

SEQ ID NO: 7163525 - DNA, 22 bp, Homo sapiens
accagggctgacaatctgatgg

SEQ ID NO: 7163526 - DNA, 22 bp, Homo sapiens
accagggcttacagcagtagct

SEQ ID NO: 7163527 - DNA, 22 bp, Homo sapiens
accaggggtgtcaacagcattt

SEQ ID NO: 7163528 - DNA, 22 bp, Homo sapiens
accaggggtgtcaacagcattt

SEQ ID NO: 7163529 - DNA, 22 bp, Homo sapiens
accaggggtgtcaacagcattt

SEQ ID NO: 7163530 - DNA, 22 bp, Homo sapiens
accagggttgagtcagctgcgt

SEQ ID NO: 7163531 - DNA, 22 bp, Homo sapiens
accagggttgagtcagctgcgt

SEQ ID NO: 7163532 - DNA, 22 bp, Homo sapiens
accagggcggcttgaggaggca

SEQ ID NO: 7163533 - DNA, 22 bp, Homo sapiens
accagggcggcttgaggaggca

SEQ ID NO: 7163534 - DNA, 22 bp, Homo sapiens
accagggccgcgggcgactagc

SEQ ID NO: 7163535 - DNA, 22 bp, Homo sapiens
accagggcccgggagagctctc

SEQ ID NO: 7163536 - DNA, 22 bp, Homo sapiens
accagggcccgggagagctctc

SEQ ID NO: 7163537 - DNA, 22 bp, Homo sapiens
accagggcccgggagagctctc

SEQ ID NO: 7163538 - DNA, 22 bp, Homo sapiens
accagggcccgggagagctctc

SEQ ID NO: 7163539 - DNA, 22 bp, Homo sapiens
accaggaggtgtttgctcaagt

SEQ ID NO: 7163540 - DNA, 22 bp, Homo sapiens
accaggagggaccctggtggcc

SEQ ID NO: 7163541 - DNA, 19 bp, Homo sapiens
accaggagtatcagagctg

SEQ ID NO: 7163542 - DNA, 19 bp, Homo sapiens
accaggagtatcagagctg

SEQ ID NO: 7163543 - DNA, 22 bp, Homo sapiens
accaggagtagaatatctgtga

SEQ ID NO: 7163544 - DNA, 22 bp, Homo sapiens
accagggcagccgaggtgtgtc

SEQ ID NO: 7163545 - DNA, 22 bp, Homo sapiens
accagggcacattccggccaga

SEQ ID NO: 7163546 - DNA, 22 bp, Homo sapiens
accaggagtctagcctagtcaa

SEQ ID NO: 7163547 - DNA, 22 bp, Homo sapiens
accaggagtctagcctagtcaa

SEQ ID NO: 7163548 - DNA, 22 bp, Homo sapiens
accaggctgtgaagtgagacta

SEQ ID NO: 7163549 - DNA, 22 bp, Homo sapiens
accaggctgtgaagtgagacta

SEQ ID NO: 7163550 - DNA, 22 bp, Homo sapiens
accaggagttgggggtgggacc

SEQ ID NO: 7163551 - DNA, 22 bp, Homo sapiens
accaagatttaacatgcctttt

SEQ ID NO: 7163552 - DNA, 22 bp, Homo sapiens
accaagagtccaagtgaggttg

SEQ ID NO: 7163553 - DNA, 22 bp, Homo sapiens
accaagaaacaaccctcttctg

SEQ ID NO: 7163554 - DNA, 22 bp, Homo sapiens
accaagctagaacattacaggc

SEQ ID NO: 7163555 - DNA, 22 bp, Homo sapiens
accaagctctcttcccggctct

SEQ ID NO: 7163556 - DNA, 22 bp, Homo sapiens
accaaggaagagattctcagtt

SEQ ID NO: 7163557 - DNA, 22 bp, Homo sapiens
accaaggagaaggtgcaagctt

SEQ ID NO: 7163558 - DNA, 22 bp, Homo sapiens
accaaaggcagagctgaacact

SEQ ID NO: 7163559 - DNA, 22 bp, Homo sapiens
accaaaggcagagctgaacact

SEQ ID NO: 7163560 - DNA, 22 bp, Homo sapiens
accaaaggcagagctgaacact

SEQ ID NO: 7163561 - DNA, 22 bp, Homo sapiens
accaaaggctatgggacctgcc

SEQ ID NO: 7163562 - DNA, 22 bp, Homo sapiens
accaaaggctcctgaagaactg

SEQ ID NO: 7163563 - DNA, 22 bp, Homo sapiens
accaaaggctcctgaagaactg

SEQ ID NO: 7163564 - DNA, 22 bp, Homo sapiens
accaaagggcagaacatgagca

SEQ ID NO: 7163565 - DNA, 22 bp, Homo sapiens
accaaaggctcctgaagaactg

SEQ ID NO: 7163566 - DNA, 22 bp, Homo sapiens
accaaagggcagaacatgagca

SEQ ID NO: 7163567 - DNA, 22 bp, Homo sapiens
accaaagggcagaacatgagca

SEQ ID NO: 7163568 - DNA, 22 bp, Homo sapiens
accaaaggtgatcaggatcacc

SEQ ID NO: 7163569 - DNA, 22 bp, Homo sapiens
accaaaggtgatcaggatcacc

SEQ ID NO: 7163570 - DNA, 22 bp, Homo sapiens
accaaatgtttttccagaaatg

SEQ ID NO: 7163571 - DNA, 22 bp, Homo sapiens
accaaggctaaaataacatgtt

SEQ ID NO: 7163572 - DNA, 22 bp, Homo sapiens
accaatgcatgattttgtctgg

SEQ ID NO: 7163573 - DNA, 22 bp, Homo sapiens
accaatgccattttctacacat

SEQ ID NO: 7163574 - DNA, 22 bp, Homo sapiens
accaatgccattttctacacat

SEQ ID NO: 7163575 - DNA, 20 bp, Homo sapiens
accaatttcagaggtgcaga

SEQ ID NO: 7163576 - DNA, 20 bp, Homo sapiens
accaatttcagaggtgcaga

SEQ ID NO: 7163577 - DNA, 22 bp, Homo sapiens
accaatttcttggcttccaaat

SEQ ID NO: 7163578 - DNA, 22 bp, Homo sapiens
accaatttcttggcttccaaat

SEQ ID NO: 7163579 - DNA, 22 bp, Homo sapiens
accaattttagagcaccaagaa

SEQ ID NO: 7163580 - DNA, 22 bp, Homo sapiens
accaatttttacagctgtggtt

SEQ ID NO: 7163581 - DNA, 22 bp, Homo sapiens
accaatttttcctgaagggcat

SEQ ID NO: 7163582 - DNA, 22 bp, Homo sapiens
accacaaacttagtggtgcaaa

SEQ ID NO: 7163583 - DNA, 22 bp, Homo sapiens
accacactggctagtgaagaag

SEQ ID NO: 7163584 - DNA, 22 bp, Homo sapiens
accacactggctagtgaagaag

SEQ ID NO: 7163585 - DNA, 22 bp, Homo sapiens
accacaggaattgctctgtggt

SEQ ID NO: 7163586 - DNA, 22 bp, Homo sapiens
accacaggaattgctctgtggt

SEQ ID NO: 7163587 - DNA, 22 bp, Homo sapiens
accacaggaattgctctgtggt

SEQ ID NO: 7163588 - DNA, 22 bp, Homo sapiens
accacaggaattgctctgtggt

SEQ ID NO: 7163589 - DNA, 22 bp, Homo sapiens
accagctcttctgctctagttg

SEQ ID NO: 7163590 - DNA, 22 bp, Homo sapiens
accagctcttctgctctagttg

SEQ ID NO: 7163591 - DNA, 22 bp, Homo sapiens
accagctctttcttttcactat

SEQ ID NO: 7163592 - DNA, 22 bp, Homo sapiens
accagctctttcttttcactat

SEQ ID NO: 7163593 - DNA, 22 bp, Homo sapiens
accagctctttcttttcactat

SEQ ID NO: 7163594 - DNA, 22 bp, Homo sapiens
accagctctttcttttcactat

SEQ ID NO: 7163595 - DNA, 22 bp, Homo sapiens
accagctctttcttttcactat

SEQ ID NO: 7163596 - DNA, 22 bp, Homo sapiens
accagctctttcttttcactat

SEQ ID NO: 7163597 - DNA, 22 bp, Homo sapiens
accagctgaactgcagcccagg

SEQ ID NO: 7163598 - DNA, 22 bp, Homo sapiens
accagctgagtaggggagggcc

SEQ ID NO: 7163599 - DNA, 22 bp, Homo sapiens
accagctgagtaggggagggcc

SEQ ID NO: 7163600 - DNA, 20 bp, Homo sapiens
accaggagatggaggcaggg

SEQ ID NO: 7163601 - DNA, 22 bp, Homo sapiens
accaggagacatgaccaatgag

SEQ ID NO: 7163602 - DNA, 19 bp, Homo sapiens
accaggagacagtgagctt

SEQ ID NO: 7163603 - DNA, 19 bp, Homo sapiens
accaggagacagtgagctt

SEQ ID NO: 7163604 - DNA, 19 bp, Homo sapiens
accaggaacttccctaggc

SEQ ID NO: 7163605 - DNA, 22 bp, Homo sapiens
accaggaagctgtgagaccttt

SEQ ID NO: 7163606 - DNA, 18 bp, Homo sapiens
accaggaagcttcttgtc

SEQ ID NO: 7163607 - DNA, 22 bp, Homo sapiens
accaggagccacaggaggagcc

SEQ ID NO: 7163608 - DNA, 22 bp, Homo sapiens
accaggagccacaggaggagcc

SEQ ID NO: 7163609 - DNA, 22 bp, Homo sapiens
accaggagccacaggaggagcc

SEQ ID NO: 7163610 - DNA, 22 bp, Homo sapiens
accaggagccacaggaggagcc

SEQ ID NO: 7163611 - DNA, 22 bp, Homo sapiens
accaggagccacaggaggagcc

SEQ ID NO: 7163612 - DNA, 20 bp, Homo sapiens
accaggagatggaggcaggg

SEQ ID NO: 7163613 - DNA, 20 bp, Homo sapiens
accaggagatggaggcaggg

SEQ ID NO: 7163614 - DNA, 20 bp, Homo sapiens
accaggagatggaggcaggg

SEQ ID NO: 7163615 - DNA, 20 bp, Homo sapiens
accaggagatggaggcaggg

SEQ ID NO: 7163616 - DNA, 22 bp, Homo sapiens
accaggaggcctggagcacaaa

SEQ ID NO: 7163617 - DNA, 22 bp, Homo sapiens
accaggagccatagagtcaggc

SEQ ID NO: 7163618 - DNA, 22 bp, Homo sapiens
accaggagccatagagtcaggc

SEQ ID NO: 7163619 - DNA, 22 bp, Homo sapiens
accaggaggccttggttctgag

SEQ ID NO: 7163620 - DNA, 22 bp, Homo sapiens
accaggaggcctggagcacaaa

SEQ ID NO: 7163621 - DNA, 22 bp, Homo sapiens
accctgcttctggattaatcca

SEQ ID NO: 7163622 - DNA, 22 bp, Homo sapiens
accctgcctgacaacagaggat

SEQ ID NO: 7163623 - DNA, 22 bp, Homo sapiens
accctgcttggccccacttcta

SEQ ID NO: 7163624 - DNA, 22 bp, Homo sapiens
accctgcctctgcttcctgtag

SEQ ID NO: 7163625 - DNA, 22 bp, Homo sapiens
accctgctgacctgaaagaggg

SEQ ID NO: 7163626 - DNA, 22 bp, Homo sapiens
accctggactggggctgaggct

SEQ ID NO: 7163627 - DNA, 22 bp, Homo sapiens
accctgctttatgccgtcctct

SEQ ID NO: 7163628 - DNA, 21 bp, Homo sapiens
accctgctttatgccgtcctc

SEQ ID NO: 7163629 - DNA, 22 bp, Homo sapiens
accctggacatcttgtcatagc

SEQ ID NO: 7163630 - DNA, 22 bp, Homo sapiens
accccagcgcatatggtctgcg

SEQ ID NO: 7163631 - DNA, 22 bp, Homo sapiens
accccagctctgagccacacca

SEQ ID NO: 7163632 - DNA, 20 bp, Homo sapiens
accccagcccctctatctga

SEQ ID NO: 7163633 - DNA, 22 bp, Homo sapiens
accccagccctgcttctgggag

SEQ ID NO: 7163634 - DNA, 22 bp, Homo sapiens
accccagccctgcttctgggag

SEQ ID NO: 7163635 - DNA, 22 bp, Homo sapiens
accccacagcatacaaaggcac

SEQ ID NO: 7163636 - DNA, 22 bp, Homo sapiens
accccactaccccggcagatgg

SEQ ID NO: 7163637 - DNA, 22 bp, Homo sapiens
accccactcacacatggacctg

SEQ ID NO: 7163638 - DNA, 22 bp, Homo sapiens
accccactcacacatggacctg

SEQ ID NO: 7163639 - DNA, 22 bp, Homo sapiens
accccactaccccggcagatgg

SEQ ID NO: 7163640 - DNA, 22 bp, Homo sapiens
accccactcctctgttttaact

SEQ ID NO: 7163641 - DNA, 22 bp, Homo sapiens
accccactcctctgttttaact

SEQ ID NO: 7163642 - DNA, 22 bp, Homo sapiens
acccatttttaaatataacttg

SEQ ID NO: 7163643 - DNA, 22 bp, Homo sapiens
accccaaaagagtaatagaatt

SEQ ID NO: 7163644 - DNA, 22 bp, Homo sapiens
accccaaaagagtaatagaatt

SEQ ID NO: 7163645 - DNA, 22 bp, Homo sapiens
accccacagcatacaaaggcac

SEQ ID NO: 7163646 - DNA, 22 bp, Homo sapiens
acccattcctctcctgagggat

SEQ ID NO: 7163647 - DNA, 22 bp, Homo sapiens
acccattcctttacttcatctg

SEQ ID NO: 7163648 - DNA, 22 bp, Homo sapiens
acccatttcataaacatgcttt

SEQ ID NO: 7163649 - DNA, 22 bp, Homo sapiens
acccatttgtccagcaaagata

SEQ ID NO: 7163650 - DNA, 19 bp, Homo sapiens
acccattttcagtattggc

SEQ ID NO: 7163651 - DNA, 17 bp, Homo sapiens
acccattttgcacaggc

SEQ ID NO: 7163652 - DNA, 23 bp, Homo sapiens
acccatctctcctgtcatgcaga

SEQ ID NO: 7163653 - DNA, 22 bp, Homo sapiens
acccatgagctgcttgggatgc

SEQ ID NO: 7163654 - DNA, 22 bp, Homo sapiens
acccatgagtgtatctttaaaa

SEQ ID NO: 7163655 - DNA, 22 bp, Homo sapiens
acccatccagtgtccctgctag

SEQ ID NO: 7163656 - DNA, 22 bp, Homo sapiens
accctgggttcccgcagcacca

SEQ ID NO: 7163657 - DNA, 22 bp, Homo sapiens
accctgggttcccgcagcacca

SEQ ID NO: 7163658 - DNA, 21 bp, Homo sapiens
accctgggttctccataccct

SEQ ID NO: 7163659 - DNA, 22 bp, Homo sapiens
accctgggtctcaatcatccta

SEQ ID NO: 7163660 - DNA, 22 bp, Homo sapiens
accctgggtgagaggcaaacag

SEQ ID NO: 7163661 - DNA, 22 bp, Homo sapiens
accctgggtgagaggcaaacag

SEQ ID NO: 7163662 - DNA, 22 bp, Homo sapiens
accctgggttcccgcagcacca

SEQ ID NO: 7163663 - DNA, 22 bp, Homo sapiens
accctgggggtggccagtgcca

SEQ ID NO: 7163664 - DNA, 22 bp, Homo sapiens
accctgggggtggccagtgcca

SEQ ID NO: 7163665 - DNA, 22 bp, Homo sapiens
accctgggggtggccagtgcca

SEQ ID NO: 7163666 - DNA, 22 bp, Homo sapiens
accctgggcttggcctgctcag

SEQ ID NO: 7163667 - DNA, 22 bp, Homo sapiens
accctggggtcacccttctctg

SEQ ID NO: 7163668 - DNA, 16 bp, Homo sapiens
accctgggtagtcctg

SEQ ID NO: 7163669 - DNA, 22 bp, Homo sapiens
accctgggtatttcccaaactt

SEQ ID NO: 7163670 - DNA, 22 bp, Homo sapiens
accctgggtatttcccaaactt

SEQ ID NO: 7163671 - DNA, 22 bp, Homo sapiens
accctgggtcatatacagtgtg

SEQ ID NO: 7163672 - DNA, 22 bp, Homo sapiens
accctgggtcatatacagtgtg

SEQ ID NO: 7163673 - DNA, 22 bp, Homo sapiens
accctgggtcatatacagtgtg

SEQ ID NO: 7163674 - DNA, 22 bp, Homo sapiens
accctgggcacaccatttcccc

SEQ ID NO: 7163675 - DNA, 22 bp, Homo sapiens
accctgggagggagaaatcaga

SEQ ID NO: 7163676 - DNA, 23 bp, Homo sapiens
accctgggcaagtcacctaacct

SEQ ID NO: 7163677 - DNA, 18 bp, Homo sapiens
accctgggcaattcactc

SEQ ID NO: 7163678 - DNA, 22 bp, Homo sapiens
accctggctctctggccaccgc

SEQ ID NO: 7163679 - DNA, 22 bp, Homo sapiens
accctgggaactggaaactgga

SEQ ID NO: 7163680 - DNA, 22 bp, Homo sapiens
accctgggacctggaggtggat

SEQ ID NO: 7163681 - DNA, 22 bp, Homo sapiens
accctgggacctggaggtggat

SEQ ID NO: 7163682 - DNA, 22 bp, Homo sapiens
accctgggacttccgagttgag

SEQ ID NO: 7163683 - DNA, 22 bp, Homo sapiens
accctggaggtggaggtgcagt

SEQ ID NO: 7163684 - DNA, 22 bp, Homo sapiens
accctggcagccttctgtcctg

SEQ ID NO: 7163685 - DNA, 22 bp, Homo sapiens
accctggcagccttctgtcctg

SEQ ID NO: 7163686 - DNA, 22 bp, Homo sapiens
accctggcccattgctgtgcct

SEQ ID NO: 7163687 - DNA, 18 bp, Homo sapiens
accctggcatgctcttcc

SEQ ID NO: 7163688 - DNA, 22 bp, Homo sapiens
accctggcctggttcatgtgat

SEQ ID NO: 7163689 - DNA, 22 bp, Homo sapiens
acccacgaagatgagcggcatg

SEQ ID NO: 7163690 - DNA, 22 bp, Homo sapiens
acccaccctactagcagtgtcc

SEQ ID NO: 7163691 - DNA, 22 bp, Homo sapiens
acccacgaagatgagcggcatg

SEQ ID NO: 7163692 - DNA, 22 bp, Homo sapiens
acccactgtagccactctgggt

SEQ ID NO: 7163693 - DNA, 22 bp, Homo sapiens
acccactgtagccactctgggt

SEQ ID NO: 7163694 - DNA, 22 bp, Homo sapiens
acccactgtcatctctgaccac

SEQ ID NO: 7163695 - DNA, 22 bp, Homo sapiens
acccagagaactgaggcatgaa

SEQ ID NO: 7163696 - DNA, 22 bp, Homo sapiens
acccagagaactgaggcatgaa

SEQ ID NO: 7163697 - DNA, 22 bp, Homo sapiens
acccacagccgctgtgcgtccc

SEQ ID NO: 7163698 - DNA, 22 bp, Homo sapiens
acccaccctactagcagtgtcc

SEQ ID NO: 7163699 - DNA, 22 bp, Homo sapiens
acccaccctactagcagtgtcc

SEQ ID NO: 7163700 - DNA, 22 bp, Homo sapiens
acccaccctactagcagtgtcc

SEQ ID NO: 7163701 - DNA, 19 bp, Homo sapiens
agggcctgagcagatgttg

SEQ ID NO: 7163702 - DNA, 22 bp, Homo sapiens
agggcctgagctctcctccagt

SEQ ID NO: 7163703 - DNA, 22 bp, Homo sapiens
agggcctgacacccttgccagc

SEQ ID NO: 7163704 - DNA, 21 bp, Homo sapiens
agggcctctgtgtactggggg

SEQ ID NO: 7163705 - DNA, 21 bp, Homo sapiens
agggcctctgtgtactggggg

SEQ ID NO: 7163706 - DNA, 22 bp, Homo sapiens
agggcctgacacccttgccagc

SEQ ID NO: 7163707 - DNA, 22 bp, Homo sapiens
agggcctgacacccttgccagc

SEQ ID NO: 7163708 - DNA, 22 bp, Homo sapiens
agggcctgagaccgtggcttga

SEQ ID NO: 7163709 - DNA, 22 bp, Homo sapiens
agggcctgagaccgtggcttga

SEQ ID NO: 7163710 - DNA, 22 bp, Homo sapiens
agggcctgagaccgtggcttga

SEQ ID NO: 7163711 - DNA, 19 bp, Homo sapiens
agggcctgagcagatgttg

SEQ ID NO: 7163712 - DNA, 19 bp, Homo sapiens
agggcctgagcagatgttg

SEQ ID NO: 7163713 - DNA, 19 bp, Homo sapiens
agggcctgagcagatgttg

SEQ ID NO: 7163714 - DNA, 22 bp, Homo sapiens
agggcctctgagccagttctgg

SEQ ID NO: 7163715 - DNA, 22 bp, Homo sapiens
agggcctctggaacactgaggg

SEQ ID NO: 7163716 - DNA, 22 bp, Homo sapiens
agggcctctggaacactgaggg

SEQ ID NO: 7163717 - DNA, 22 bp, Homo sapiens
agggcctctggaacactgaggg

SEQ ID NO: 7163718 - DNA, 23 bp, Homo sapiens
agggcctctgtcccccagcactc

SEQ ID NO: 7163719 - DNA, 23 bp, Homo sapiens
agggcctctgtcccccagcactc

SEQ ID NO: 7163720 - DNA, 22 bp, Homo sapiens
acccagggtagagtgcagtggc

SEQ ID NO: 7163721 - DNA, 22 bp, Homo sapiens
acccagggtagagtgcagtggc

SEQ ID NO: 7163722 - DNA, 22 bp, Homo sapiens
acccagggtagaacctcagagc

SEQ ID NO: 7163723 - DNA, 22 bp, Homo sapiens
acccagggtagagtgcagtggc

SEQ ID NO: 7163724 - DNA, 22 bp, Homo sapiens
acccagggaccccgctgacgcc

SEQ ID NO: 7163725 - DNA, 22 bp, Homo sapiens
acccagggaccccgctgacgcc

SEQ ID NO: 7163726 - DNA, 22 bp, Homo sapiens
acccagggaccccgctgacgcc

SEQ ID NO: 7163727 - DNA, 22 bp, Homo sapiens
acccagagcacagatgcaacgt

SEQ ID NO: 7163728 - DNA, 22 bp, Homo sapiens
acccagagcacagatgcaacgt

SEQ ID NO: 7163729 - DNA, 17 bp, Homo sapiens
acccagagaaggaggtc

SEQ ID NO: 7163730 - DNA, 22 bp, Homo sapiens
acccagagatggacctggctgc

SEQ ID NO: 7163731 - DNA, 22 bp, Homo sapiens
acccagagcacagatgcaacgt

SEQ ID NO: 7163732 - DNA, 22 bp, Homo sapiens
acccagggtttgagctctgcag

SEQ ID NO: 7163733 - DNA, 22 bp, Homo sapiens
acccagggtttgagctctgcag

SEQ ID NO: 7163734 - DNA, 19 bp, Homo sapiens
acccagggttgatgtccag

SEQ ID NO: 7163735 - DNA, 19 bp, Homo sapiens
acccagggttgatgtccag

SEQ ID NO: 7163736 - DNA, 19 bp, Homo sapiens
acccagggttgatgtccag

SEQ ID NO: 7163737 - DNA, 19 bp, Homo sapiens
acccagggttgatgtccag

SEQ ID NO: 7163738 - DNA, 22 bp, Homo sapiens
acccagggttcctgggtcccag

SEQ ID NO: 7163739 - DNA, 22 bp, Homo sapiens
acccagggttcctgggtcccag

SEQ ID NO: 7163740 - DNA, 22 bp, Homo sapiens
acccagggttcctgggtcccag

SEQ ID NO: 7163741 - DNA, 22 bp, Homo sapiens
acccagggtagagtgcagtggc

SEQ ID NO: 7163742 - DNA, 22 bp, Homo sapiens
acccagggtcaccccgtagggt

SEQ ID NO: 7163743 - DNA, 22 bp, Homo sapiens
acccagggtcaccccgtagggt

SEQ ID NO: 7163744 - DNA, 22 bp, Homo sapiens
acccagggtttgagctctgcag

SEQ ID NO: 7163745 - DNA, 22 bp, Homo sapiens
acccagtcatcctggtgtgaga

SEQ ID NO: 7163746 - DNA, 22 bp, Homo sapiens
acccagtcatcctggtgtgaga

SEQ ID NO: 7163747 - DNA, 22 bp, Homo sapiens
acccagtctggagtgcagtgac

SEQ ID NO: 7163748 - DNA, 18 bp, Homo sapiens
acccagtttgaaggaaag

SEQ ID NO: 7163749 - DNA, 22 bp, Homo sapiens
aaacacagcatgtccttgggga

SEQ ID NO: 7163750 - DNA, 22 bp, Homo sapiens
aaacacagatttctttgtccca

SEQ ID NO: 7163751 - DNA, 19 bp, Homo sapiens
aaacacagatttcttacca

SEQ ID NO: 7163752 - DNA, 22 bp, Homo sapiens
aaacacagatttctttgtccca

SEQ ID NO: 7163753 - DNA, 22 bp, Homo sapiens
aaacacagatttctttgtccca

SEQ ID NO: 7163754 - DNA, 19 bp, Homo sapiens
aaacacagatttcttacca

SEQ ID NO: 7163755 - DNA, 19 bp, Homo sapiens
aaacacagatttcttacca

SEQ ID NO: 7163756 - DNA, 22 bp, Homo sapiens
aaacacagggatatatattcca

SEQ ID NO: 7163757 - DNA, 22 bp, Homo sapiens
aaacacagggatatatattcca

SEQ ID NO: 7163758 - DNA, 22 bp, Homo sapiens
aaacacagggatatatattcca

SEQ ID NO: 7163759 - DNA, 22 bp, Homo sapiens
aaacacagggatatatattcca

SEQ ID NO: 7163760 - DNA, 22 bp, Homo sapiens
aaacacagggatatatattcca

SEQ ID NO: 7163761 - DNA, 20 bp, Homo sapiens
aaacacagcctctctttaca

SEQ ID NO: 7163762 - DNA, 22 bp, Homo sapiens
aaacacaggtactgcagaagtg

SEQ ID NO: 7163763 - DNA, 22 bp, Homo sapiens
aaacagtcctctttatttagtc

SEQ ID NO: 7163764 - DNA, 22 bp, Homo sapiens
aaacacagggatatatattcca

SEQ ID NO: 7163765 - DNA, 22 bp, Homo sapiens
aaacacagggatatatattcca

SEQ ID NO: 7163766 - DNA, 22 bp, Homo sapiens
aaacagtctgatgccatctgcc

SEQ ID NO: 7163767 - DNA, 22 bp, Homo sapiens
aaacagtctgatgccatctgcc

SEQ ID NO: 7163768 - DNA, 21 bp, Homo sapiens
aaacatctctgcttttgtgtc

SEQ ID NO: 7163769 - DNA, 22 bp, Homo sapiens
aaacatctgacttgctttttca

SEQ ID NO: 7163770 - DNA, 22 bp, Homo sapiens
aaacatctgacttgctttttca

SEQ ID NO: 7163771 - DNA, 22 bp, Homo sapiens
aaacatgagcatctcttcaagc

SEQ ID NO: 7163772 - DNA, 22 bp, Homo sapiens
aaacatgagcatctcttcaagc

SEQ ID NO: 7163773 - DNA, 22 bp, Homo sapiens
aaacatgagcatctcttcaagc

SEQ ID NO: 7163774 - DNA, 22 bp, Homo sapiens
aaacatgagcacttgcttcata

SEQ ID NO: 7163775 - DNA, 22 bp, Homo sapiens
aaacatgagcacttgcttcata

SEQ ID NO: 7163776 - DNA, 22 bp, Homo sapiens
aaacatgaatagatattaaaca

SEQ ID NO: 7163777 - DNA, 22 bp, Homo sapiens
aaacatgagcacttgcttcata

SEQ ID NO: 7163778 - DNA, 22 bp, Homo sapiens
aaacatgagcacttgcttcata

SEQ ID NO: 7163779 - DNA, 22 bp, Homo sapiens
aaacatcttctcttgattcttt

SEQ ID NO: 7163780 - DNA, 22 bp, Homo sapiens
aaacatcttctcttgattcttt

SEQ ID NO: 7163781 - DNA, 22 bp, Homo sapiens
aaacatctggttacctagggtc

SEQ ID NO: 7163782 - DNA, 22 bp, Homo sapiens
aaacatcttctcttgattcttt

SEQ ID NO: 7163783 - DNA, 22 bp, Homo sapiens
aaacatctggaggccccgtttg

SEQ ID NO: 7163784 - DNA, 22 bp, Homo sapiens
aaacatctggttacctagggtc

SEQ ID NO: 7163785 - DNA, 22 bp, Homo sapiens
aaacatcttgctctgattggta

SEQ ID NO: 7163786 - DNA, 22 bp, Homo sapiens
aaacatctttctattgcaagtt

SEQ ID NO: 7163787 - DNA, 22 bp, Homo sapiens
aaacatctttctattgcaagtt

SEQ ID NO: 7163788 - DNA, 22 bp, Homo sapiens
aaacatgaatagatattaaaca

SEQ ID NO: 7163789 - DNA, 22 bp, Homo sapiens
aaacatgaatagatattaaaca

SEQ ID NO: 7163790 - DNA, 22 bp, Homo sapiens
aaacatttgcaactcggtttgg

SEQ ID NO: 7163791 - DNA, 22 bp, Homo sapiens
aaacatttgcaactcggtttgg

SEQ ID NO: 7163792 - DNA, 22 bp, Homo sapiens
aaacatttgcaactcggtttgg

SEQ ID NO: 7163793 - DNA, 23 bp, Homo sapiens
aaacatttctcttttcctgcctc

SEQ ID NO: 7163794 - DNA, 22 bp, Homo sapiens
aaacatttttctaggtcttggt

SEQ ID NO: 7163795 - DNA, 22 bp, Homo sapiens
aaacatttttctaggtcttggt

SEQ ID NO: 7163796 - DNA, 22 bp, Homo sapiens
aaacatttttcttcatcatcct

SEQ ID NO: 7163797 - DNA, 22 bp, Homo sapiens
aaacatgagcatctcttcaagc

SEQ ID NO: 7163798 - DNA, 22 bp, Homo sapiens
aaacatgagcatctcttcaagc

SEQ ID NO: 7163799 - DNA, 22 bp, Homo sapiens
aaacatgagcatttctgtttaa

SEQ ID NO: 7163800 - DNA, 22 bp, Homo sapiens
aaacatgagttaaaagtaactg

SEQ ID NO: 7163801 - DNA, 22 bp, Homo sapiens
aaacatgatgcctgtactaaga

SEQ ID NO: 7163802 - DNA, 22 bp, Homo sapiens
aaacatgatgcctgtactaaga

SEQ ID NO: 7163803 - DNA, 22 bp, Homo sapiens
aaactgtaaacacagcagtaca

SEQ ID NO: 7163804 - DNA, 22 bp, Homo sapiens
aaactggtttctgagatggaac

SEQ ID NO: 7163805 - DNA, 22 bp, Homo sapiens
aaactggtgtcactgagggctg

SEQ ID NO: 7163806 - DNA, 22 bp, Homo sapiens
aaaccattgcatctttcttaat

SEQ ID NO: 7163807 - DNA, 22 bp, Homo sapiens
aaaccatttgaattattactga

SEQ ID NO: 7163808 - DNA, 22 bp, Homo sapiens
aaaccatgctttgatgatttta

SEQ ID NO: 7163809 - DNA, 22 bp, Homo sapiens
aaaccatggctcattggagatg

SEQ ID NO: 7163810 - DNA, 22 bp, Homo sapiens
aaaccattaggttttatctact

SEQ ID NO: 7163811 - DNA, 22 bp, Homo sapiens
aaaccattaggttttatctact

SEQ ID NO: 7163812 - DNA, 22 bp, Homo sapiens
aaacatttttcttcatcatcct

SEQ ID NO: 7163813 - DNA, 22 bp, Homo sapiens
aaaccaaacatttgcggtggtg

SEQ ID NO: 7163814 - DNA, 22 bp, Homo sapiens
aaaccaaacatttgcggtggtg

SEQ ID NO: 7163815 - DNA, 22 bp, Homo sapiens
aaaccaaacatttgcggtggtg

SEQ ID NO: 7163816 - DNA, 22 bp, Homo sapiens
aaaccaaccctggctggcctag

SEQ ID NO: 7163817 - DNA, 22 bp, Homo sapiens
aaaccacacttagcagtttcgt

SEQ ID NO: 7163818 - DNA, 22 bp, Homo sapiens
aaaccacacttagcagtttcgt

SEQ ID NO: 7163819 - DNA, 22 bp, Homo sapiens
aaaccacagttcagtgcttttg

SEQ ID NO: 7163820 - DNA, 22 bp, Homo sapiens
aaaccacagttcagtgcttttg

SEQ ID NO: 7163821 - DNA, 22 bp, Homo sapiens
aaaccacatgccttcaaatgct

SEQ ID NO: 7163822 - DNA, 22 bp, Homo sapiens
aaaccacatgccttcaaatgct

SEQ ID NO: 7163823 - DNA, 22 bp, Homo sapiens
aaaccacatgccttcaaatgct

SEQ ID NO: 7163824 - DNA, 22 bp, Homo sapiens
aaaccacatgccttcaaatgct

SEQ ID NO: 7163825 - DNA, 22 bp, Homo sapiens
aaaccacctccccagctgctgt

SEQ ID NO: 7163826 - DNA, 22 bp, Homo sapiens
aaaccacctccccagctgctgt

SEQ ID NO: 7163827 - DNA, 22 bp, Homo sapiens
aaaccactcctgattcacttca

SEQ ID NO: 7163828 - DNA, 23 bp, Homo sapiens
aaacttgctatggctgaaatcat

SEQ ID NO: 7163829 - DNA, 23 bp, Homo sapiens
aaacttgctatggctgaaatcat

SEQ ID NO: 7163830 - DNA, 22 bp, Homo sapiens
aaacttgagccaagggcttggg

SEQ ID NO: 7163831 - DNA, 22 bp, Homo sapiens
aaacttgagccaagggcttggg

SEQ ID NO: 7163832 - DNA, 22 bp, Homo sapiens
aaacttgaaaggtactgttggt

SEQ ID NO: 7163833 - DNA, 22 bp, Homo sapiens
aaacttgaaaggtactgttggt

SEQ ID NO: 7163834 - DNA, 22 bp, Homo sapiens
aaacttgaacccagctcaggct

SEQ ID NO: 7163835 - DNA, 22 bp, Homo sapiens
aaacttgacagtagacagatta

SEQ ID NO: 7163836 - DNA, 22 bp, Homo sapiens
aaacttcttgctgcattttctg

SEQ ID NO: 7163837 - DNA, 22 bp, Homo sapiens
aaactgtaaacacagcagtaca

SEQ ID NO: 7163838 - DNA, 22 bp, Homo sapiens
aaagaactattaacgaggaagc

SEQ ID NO: 7163839 - DNA, 22 bp, Homo sapiens
aaagaactacctgtatgatatt

SEQ ID NO: 7163840 - DNA, 22 bp, Homo sapiens
aaagaactacctgtatgatatt

SEQ ID NO: 7163841 - DNA, 22 bp, Homo sapiens
aaactttaggaaggaatttaca

SEQ ID NO: 7163842 - DNA, 22 bp, Homo sapiens
aaagaactattaacgaggaagc

SEQ ID NO: 7163843 - DNA, 22 bp, Homo sapiens
aaagaactcagagaggatttta

SEQ ID NO: 7163844 - DNA, 22 bp, Homo sapiens
aaagaacttaagaaattaggct

SEQ ID NO: 7163845 - DNA, 22 bp, Homo sapiens
aaagaacttatcctagaatttg

SEQ ID NO: 7163846 - DNA, 19 bp, Homo sapiens
aaagaactttgggctaggc

SEQ ID NO: 7163847 - DNA, 19 bp, Homo sapiens
aaagaactttgggctaggc

SEQ ID NO: 7163848 - DNA, 19 bp, Homo sapiens
aaagaactttgggctaggc

SEQ ID NO: 7163849 - DNA, 22 bp, Homo sapiens
aaacttgtggtggagaagccta

SEQ ID NO: 7163850 - DNA, 22 bp, Homo sapiens
aaacttgtgtatgtatatgcaa

SEQ ID NO: 7163851 - DNA, 23 bp, Homo sapiens
aaacttgttaatgaggcaacagg

SEQ ID NO: 7163852 - DNA, 22 bp, Homo sapiens
aaacttgttctcatgttgcaga

SEQ ID NO: 7163853 - DNA, 22 bp, Homo sapiens
aaacttgttctcttgtgcctat

SEQ ID NO: 7163854 - DNA, 22 bp, Homo sapiens
aaacttgtcattgtaatggtat

SEQ ID NO: 7163855 - DNA, 22 bp, Homo sapiens
aaacttgtgagctaaataaatg

SEQ ID NO: 7163856 - DNA, 22 bp, Homo sapiens
aaacttgttctcttgtgcctat

SEQ ID NO: 7163857 - DNA, 20 bp, Homo sapiens
aaacttgttggtggatgagg

SEQ ID NO: 7163858 - DNA, 20 bp, Homo sapiens
aaacttgttggtggatgagg

SEQ ID NO: 7163859 - DNA, 22 bp, Homo sapiens
aaagaagggacagactgcctct

SEQ ID NO: 7163860 - DNA, 22 bp, Homo sapiens
aaagaagggacagactgcctct

SEQ ID NO: 7163861 - DNA, 17 bp, Homo sapiens
aaagagcttggagtgtt

SEQ ID NO: 7163862 - DNA, 22 bp, Homo sapiens
aaagagctttagaaatctcaga

SEQ ID NO: 7163863 - DNA, 22 bp, Homo sapiens
aaagagctttagaaatctcaga

SEQ ID NO: 7163864 - DNA, 18 bp, Homo sapiens
aaagaaggattggagagc

SEQ ID NO: 7163865 - DNA, 22 bp, Homo sapiens
aaagaagcataggctagacttc

SEQ ID NO: 7163866 - DNA, 22 bp, Homo sapiens
aaagaagctgtggctctgggag

SEQ ID NO: 7163867 - DNA, 22 bp, Homo sapiens
aaagaacttatcctagaatttg

SEQ ID NO: 7163868 - DNA, 22 bp, Homo sapiens
aaagaagacagacatttctttc

SEQ ID NO: 7163869 - DNA, 22 bp, Homo sapiens
aaagaagagcaaatttgttgta

SEQ ID NO: 7163870 - DNA, 22 bp, Homo sapiens
aaagaagagcaaatttgttgta

SEQ ID NO: 7163871 - DNA, 22 bp, Homo sapiens
aaagaagagctggaaggagtct

SEQ ID NO: 7163872 - DNA, 22 bp, Homo sapiens
aaagaagagctggaaggagtct

SEQ ID NO: 7163873 - DNA, 22 bp, Homo sapiens
aaagaagatggagacctgacta

SEQ ID NO: 7163874 - DNA, 22 bp, Homo sapiens
aaagaagatggagacctgacta

SEQ ID NO: 7163875 - DNA, 22 bp, Homo sapiens
aaagaagcataggctagacttc

SEQ ID NO: 7163876 - DNA, 22 bp, Homo sapiens
aaagatgtcagtcagataggat

SEQ ID NO: 7163877 - DNA, 22 bp, Homo sapiens
aaagatgtcacaagatgtgatg

SEQ ID NO: 7163878 - DNA, 22 bp, Homo sapiens
aaagatgcataaatgccaatgg

SEQ ID NO: 7163879 - DNA, 22 bp, Homo sapiens
aaagatgcctaactcagaagat

SEQ ID NO: 7163880 - DNA, 22 bp, Homo sapiens
aaagatgcctaactcagaagat

SEQ ID NO: 7163881 - DNA, 22 bp, Homo sapiens
aaagatggcccatgatctcttg

SEQ ID NO: 7163882 - DNA, 22 bp, Homo sapiens
aaagatggcccatgatctcttg

SEQ ID NO: 7163883 - DNA, 21 bp, Homo sapiens
aaagatgagaactggatggct

SEQ ID NO: 7163884 - DNA, 22 bp, Homo sapiens
aaagatgagtccggcagacata

SEQ ID NO: 7163885 - DNA, 22 bp, Homo sapiens
aaagatgagtccggcagacata

SEQ ID NO: 7163886 - DNA, 22 bp, Homo sapiens
aaagatgagtccggcagacata

SEQ ID NO: 7163887 - DNA, 22 bp, Homo sapiens
aaagatgatctacaagttcatt

SEQ ID NO: 7163888 - DNA, 22 bp, Homo sapiens
aaagatgatctacaagttcatt

SEQ ID NO: 7163889 - DNA, 22 bp, Homo sapiens
aaagatgatctacaagttcatt

SEQ ID NO: 7163890 - DNA, 22 bp, Homo sapiens
aaagagctttagaaatctcaga

SEQ ID NO: 7163891 - DNA, 22 bp, Homo sapiens
aaagagctttccacactagtca

SEQ ID NO: 7163892 - DNA, 22 bp, Homo sapiens
aaagagctttccacactagtca

SEQ ID NO: 7163893 - DNA, 22 bp, Homo sapiens
aaagatcattctctggtccaga

SEQ ID NO: 7163894 - DNA, 22 bp, Homo sapiens
aaagatcattctctggtccaga

SEQ ID NO: 7163895 - DNA, 22 bp, Homo sapiens
aaagatcattctctggtccaga

SEQ ID NO: 7163896 - DNA, 22 bp, Homo sapiens
aaagatctccccttcaaagagt

SEQ ID NO: 7163897 - DNA, 22 bp, Homo sapiens
aaagatctgacttagacacaga

SEQ ID NO: 7163898 - DNA, 22 bp, Homo sapiens
aaagatgaccgtatgtcagagc

SEQ ID NO: 7163899 - DNA, 22 bp, Homo sapiens
aaaatagctatggaatgtcact

SEQ ID NO: 7163900 - DNA, 22 bp, Homo sapiens
aaaatagctatggaatgtcact

SEQ ID NO: 7163901 - DNA, 22 bp, Homo sapiens
aaaatagctatggaatgtcact

SEQ ID NO: 7163902 - DNA, 22 bp, Homo sapiens
aaaattcattcctcagactgcc

SEQ ID NO: 7163903 - DNA, 22 bp, Homo sapiens
aaaattcattcctcagactgcc

SEQ ID NO: 7163904 - DNA, 22 bp, Homo sapiens
aaaattcattcctcagactgcc

SEQ ID NO: 7163905 - DNA, 22 bp, Homo sapiens
aaaattcattcctcagactgcc

SEQ ID NO: 7163906 - DNA, 22 bp, Homo sapiens
aaaattcattcctcagactgcc

SEQ ID NO: 7163907 - DNA, 22 bp, Homo sapiens
aaaattcattcctcagactgcc

SEQ ID NO: 7163908 - DNA, 22 bp, Homo sapiens
aaaataggtacggattagaatg

SEQ ID NO: 7163909 - DNA, 22 bp, Homo sapiens
aaaatagttaacgttcagagta

SEQ ID NO: 7163910 - DNA, 22 bp, Homo sapiens
aaaataggtacggattagaatg

SEQ ID NO: 7163911 - DNA, 22 bp, Homo sapiens
aaaatagcatgaaaggcctttg

SEQ ID NO: 7163912 - DNA, 22 bp, Homo sapiens
aaaagtcttgtcaaggttccca

SEQ ID NO: 7163913 - DNA, 22 bp, Homo sapiens
aaaagtgaggcagcccaaggga

SEQ ID NO: 7163914 - DNA, 22 bp, Homo sapiens
aaaagtcttggggaaggccagg

SEQ ID NO: 7163915 - DNA, 22 bp, Homo sapiens
aaaagtcttggggaaggccagg

SEQ ID NO: 7163916 - DNA, 22 bp, Homo sapiens
aaaagtgaggcagcccaaggga

SEQ ID NO: 7163917 - DNA, 22 bp, Homo sapiens
aaaagtgatgggatggcacttc

SEQ ID NO: 7163918 - DNA, 22 bp, Homo sapiens
aaaagtgtccagattatgaaga

SEQ ID NO: 7163919 - DNA, 22 bp, Homo sapiens
aaaagtgtccagattatgaaga

SEQ ID NO: 7163920 - DNA, 22 bp, Homo sapiens
aaaatactgtggagtgttgaaa

SEQ ID NO: 7163921 - DNA, 22 bp, Homo sapiens
aaaatagataatgccagggtca

SEQ ID NO: 7163922 - DNA, 22 bp, Homo sapiens
aaaatagattctaggatgtctt

SEQ ID NO: 7163923 - DNA, 22 bp, Homo sapiens
aaaatagattctaggatgtctt

SEQ ID NO: 7163924 - DNA, 22 bp, Homo sapiens
aaaatagataatgccagggtca

SEQ ID NO: 7163925 - DNA, 22 bp, Homo sapiens
aaaatagataatgccagggtca

SEQ ID NO: 7163926 - DNA, 22 bp, Homo sapiens
aaaatagataatgccagggtca

SEQ ID NO: 7163927 - DNA, 22 bp, Homo sapiens
aaaatagatgaaaggaagtctg

SEQ ID NO: 7163928 - DNA, 22 bp, Homo sapiens
aaacaacaatccaatgggagct

SEQ ID NO: 7163929 - DNA, 22 bp, Homo sapiens
aaacaacaatccaatgggagct

SEQ ID NO: 7163930 - DNA, 22 bp, Homo sapiens
aaacaacaatccaatgggagct

SEQ ID NO: 7163931 - DNA, 22 bp, Homo sapiens
aaacaaatttcaagctgtgaca

SEQ ID NO: 7163932 - DNA, 22 bp, Homo sapiens
aaacaaatagtgcatgggaatt

SEQ ID NO: 7163933 - DNA, 22 bp, Homo sapiens
aaacaaatagtgcatgggaatt

SEQ ID NO: 7163934 - DNA, 22 bp, Homo sapiens
aaacaaagccagggaagttatg

SEQ ID NO: 7163935 - DNA, 22 bp, Homo sapiens
aaacaaagccagggaagttatg

SEQ ID NO: 7163936 - DNA, 22 bp, Homo sapiens
aaaattcattcctcagactgcc

SEQ ID NO: 7163937 - DNA, 22 bp, Homo sapiens
aaacaaacataggtttgaaagt

SEQ ID NO: 7163938 - DNA, 22 bp, Homo sapiens
aaacaaacataggtttgaaagt

SEQ ID NO: 7163939 - DNA, 22 bp, Homo sapiens
aaacaaagcatcttgctatgca

SEQ ID NO: 7163940 - DNA, 22 bp, Homo sapiens
aaacaaagcatcttgctatgca

SEQ ID NO: 7163941 - DNA, 22 bp, Homo sapiens
aaacaaagcatcttgctatgca

SEQ ID NO: 7163942 - DNA, 22 bp, Homo sapiens
aaacaaagcatcttgctatgca

SEQ ID NO: 7163943 - DNA, 22 bp, Homo sapiens
aaacaaagcatcttgctatgca

SEQ ID NO: 7163944 - DNA, 22 bp, Homo sapiens
aaacaaagccagggaagttatg

SEQ ID NO: 7163945 - DNA, 22 bp, Homo sapiens
aaacaaagccagggaagttatg

SEQ ID NO: 7163946 - DNA, 22 bp, Homo sapiens
aaacaaagccagggaagttatg

SEQ ID NO: 7163947 - DNA, 22 bp, Homo sapiens
aaacaacatggtgggtgtgtag

SEQ ID NO: 7163948 - DNA, 22 bp, Homo sapiens
aaacaacatggtgggtgtgtag

SEQ ID NO: 7163949 - DNA, 22 bp, Homo sapiens
aaacaacatggtgggtgtgtag

SEQ ID NO: 7163950 - DNA, 22 bp, Homo sapiens
aaacaacctaaagttactgatc

SEQ ID NO: 7163951 - DNA, 22 bp, Homo sapiens
aaacaactcggcaactgctttt

SEQ ID NO: 7163952 - DNA, 22 bp, Homo sapiens
aaacaactcggcaactgctttt

SEQ ID NO: 7163953 - DNA, 22 bp, Homo sapiens
aaacacacctttggaactgtga

SEQ ID NO: 7163954 - DNA, 22 bp, Homo sapiens
aaacacacctttggaactgtga

SEQ ID NO: 7163955 - DNA, 22 bp, Homo sapiens
aaacacacctttggaactgtga

SEQ ID NO: 7163956 - DNA, 22 bp, Homo sapiens
aaacacacctttggaactgtga

SEQ ID NO: 7163957 - DNA, 22 bp, Homo sapiens
aaacacacctttggaactgtga

SEQ ID NO: 7163958 - DNA, 19 bp, Homo sapiens
aaacacagatttcttacca

SEQ ID NO: 7163959 - DNA, 19 bp, Homo sapiens
aaacacagatttcttacca

SEQ ID NO: 7163960 - DNA, 19 bp, Homo sapiens
aaacacagatttcttacca

SEQ ID NO: 7163961 - DNA, 22 bp, Homo sapiens
aaacacacagaaatgaatgagg

SEQ ID NO: 7163962 - DNA, 22 bp, Homo sapiens
aaacacacagaaatgaatgagg

SEQ ID NO: 7163963 - DNA, 22 bp, Homo sapiens
aaaaactgtaattacttttgca

SEQ ID NO: 7163964 - DNA, 20 bp, Homo sapiens
aaaaagacaaaacgagttgg

SEQ ID NO: 7163965 - DNA, 22 bp, Homo sapiens
aaaaagacagaggatgaggcag

SEQ ID NO: 7163966 - DNA, 22 bp, Homo sapiens
aaaaagactagtcgagtgcagt

SEQ ID NO: 7163967 - DNA, 22 bp, Homo sapiens
aaaaagacttccaactcaggag

SEQ ID NO: 7163968 - DNA, 22 bp, Homo sapiens
aaaaagacttccaactcaggag

SEQ ID NO: 7163969 - DNA, 22 bp, Homo sapiens
aaaaatgaattcttcagtggca

SEQ ID NO: 7163970 - DNA, 22 bp, Homo sapiens
aaaaatgaattcttcagtggca

SEQ ID NO: 7163971 - DNA, 21 bp, Homo sapiens
aaaaatgaagttgttcaggaa

SEQ ID NO: 7163972 - DNA, 21 bp, Homo sapiens
aaaaatgaagttgttcaggaa

SEQ ID NO: 7163973 - DNA, 21 bp, Homo sapiens
aaaaatgaagttgttcaggaa

SEQ ID NO: 7163974 - DNA, 22 bp, Homo sapiens
aaaaagatgtcctgaagtttag

SEQ ID NO: 7163975 - DNA, 22 bp, Homo sapiens
aaaaagatgtcctgaagtttag

SEQ ID NO: 7163976 - DNA, 22 bp, Homo sapiens
aaaaagatgtcctgaagtttag

SEQ ID NO: 7163977 - DNA, 22 bp, Homo sapiens
aaaaagacttccaactcaggag

SEQ ID NO: 7163978 - DNA, 19 bp, Homo sapiens
aaaaagaggctataatatt

SEQ ID NO: 7163979 - DNA, 19 bp, Homo sapiens
aaaaagaggctataatatt

SEQ ID NO: 7163980 - DNA, 19 bp, Homo sapiens
aaaaagaggctataatatt

SEQ ID NO: 7163981 - DNA, 22 bp, Homo sapiens
aaaaatgtgaccacagggtgtt

SEQ ID NO: 7163982 - DNA, 22 bp, Homo sapiens
aaaaggctcttcaaaatggaag

SEQ ID NO: 7163983 - DNA, 22 bp, Homo sapiens
aaaaatgtcattatggaactga

SEQ ID NO: 7163984 - DNA, 22 bp, Homo sapiens
aaaaatgtcattatggaactga

SEQ ID NO: 7163985 - DNA, 22 bp, Homo sapiens
aaaaatgtcattatggaactga

SEQ ID NO: 7163986 - DNA, 22 bp, Homo sapiens
aaaaatgaattcttcagtggca

SEQ ID NO: 7163987 - DNA, 22 bp, Homo sapiens
aaaaatgcttggacttaataaa

SEQ ID NO: 7163988 - DNA, 22 bp, Homo sapiens
aaaagtattttggatctcagat

SEQ ID NO: 7163989 - DNA, 22 bp, Homo sapiens
aaaagtattttggatctcagat

SEQ ID NO: 7163990 - DNA, 22 bp, Homo sapiens
aaaagggaaagcagaatgactt

SEQ ID NO: 7163991 - DNA, 22 bp, Homo sapiens
aaaagtattttggatctcagat

SEQ ID NO: 7163992 - DNA, 22 bp, Homo sapiens
aaaagtcagtctctcctagctc

SEQ ID NO: 7163993 - DNA, 19 bp, Homo sapiens
aaaagtctattcaattaca

SEQ ID NO: 7163994 - DNA, 22 bp, Homo sapiens
aaaagtctctctgagtaaaagt

SEQ ID NO: 7163995 - DNA, 22 bp, Homo sapiens
aaaagtctgctctcatttcaga

SEQ ID NO: 7163996 - DNA, 22 bp, Homo sapiens
aaaagtctgctctcatttcaga

SEQ ID NO: 7163997 - DNA, 22 bp, Homo sapiens
aaagtccaattttgttcaggct

SEQ ID NO: 7163998 - DNA, 22 bp, Homo sapiens
aaagtccaattttgttcaggct

SEQ ID NO: 7163999 - DNA, 22 bp, Homo sapiens
aaagtgcagtccatgaaattaa

SEQ ID NO: 7164000 - DNA, 23 bp, Homo sapiens
aaagtgcagttgaggaatcatag

SEQ ID NO: 7164001 - DNA, 23 bp, Homo sapiens
aaagtgcagttgaggaatcatag

SEQ ID NO: 7164002 - DNA, 22 bp, Homo sapiens
aaagtcatttagccttatctcc

SEQ ID NO: 7164003 - DNA, 22 bp, Homo sapiens
aaacactgtctctggtattgaa

SEQ ID NO: 7164004 - DNA, 23 bp, Homo sapiens
aaagtgcagttgaggaatcatag

SEQ ID NO: 7164005 - DNA, 23 bp, Homo sapiens
aaagtgcagttgaggaatcatag

SEQ ID NO: 7164006 - DNA, 22 bp, Homo sapiens
aaagtgcatagagtagtgccta

SEQ ID NO: 7164007 - DNA, 22 bp, Homo sapiens
aaagtgcatcaaatgacttccc

SEQ ID NO: 7164008 - DNA, 22 bp, Homo sapiens
aaagtgcattgtttgtgttcct

SEQ ID NO: 7164009 - DNA, 22 bp, Homo sapiens
aaagtgcctgactcatagttag

SEQ ID NO: 7164010 - DNA, 22 bp, Homo sapiens
aaacactggtatgatgtatagt

SEQ ID NO: 7164011 - DNA, 22 bp, Homo sapiens
aaacactggtatgatgtatagt

SEQ ID NO: 7164012 - DNA, 22 bp, Homo sapiens
aaacactgtacaatctgcaggg

SEQ ID NO: 7164013 - DNA, 22 bp, Homo sapiens
aaacactgtacaatctgcaggg

SEQ ID NO: 7164014 - DNA, 22 bp, Homo sapiens
aaacactgtctctggtattgaa

SEQ ID NO: 7164015 - DNA, 22 bp, Homo sapiens
aaacactggtatgatgtatagt

SEQ ID NO: 7164016 - DNA, 22 bp, Homo sapiens
aaacactggtatgatgtatagt

SEQ ID NO: 7164017 - DNA, 22 bp, Homo sapiens
aaacactggtatgatgtatagt

SEQ ID NO: 7164018 - DNA, 22 bp, Homo sapiens
aaacactggcaatttcatgcac

SEQ ID NO: 7164019 - DNA, 20 bp, Homo sapiens
aaacactggctggggcacag

SEQ ID NO: 7164020 - DNA, 22 bp, Homo sapiens
aaacactggcaatttcatgcac

SEQ ID NO: 7164021 - DNA, 22 bp, Homo sapiens
aaacactggcaatttcatgcac

SEQ ID NO: 7164022 - DNA, 22 bp, Homo sapiens
aaacactggcaatttcatgcac

SEQ ID NO: 7164023 - DNA, 22 bp, Homo sapiens
aaacactgcagggtttacttga

SEQ ID NO: 7164024 - DNA, 22 bp, Homo sapiens
aaacactgcagggtttacttga

SEQ ID NO: 7164025 - DNA, 22 bp, Homo sapiens
aaacactgcgtggtggcaactc

SEQ ID NO: 7164026 - DNA, 22 bp, Homo sapiens
aaacactgcgtggtggcaactc

SEQ ID NO: 7164027 - DNA, 22 bp, Homo sapiens
aaacagttttctcatttagtgt

SEQ ID NO: 7164028 - DNA, 22 bp, Homo sapiens
aaagtgctgggattataggcat

SEQ ID NO: 7164029 - DNA, 22 bp, Homo sapiens
aaacagttttctcatttagtgt

SEQ ID NO: 7164030 - DNA, 22 bp, Homo sapiens
aaagtgctaggattacaagcgt

SEQ ID NO: 7164031 - DNA, 22 bp, Homo sapiens
aaagtgctcggcgctggtccca

SEQ ID NO: 7164032 - DNA, 22 bp, Homo sapiens
aaagtgctgagattacaagcgt

SEQ ID NO: 7164033 - DNA, 22 bp, Homo sapiens
aaagtgctgcgacatttgagcg

SEQ ID NO: 7164034 - DNA, 22 bp, Homo sapiens
aaagtgctgggattacaagcgt

SEQ ID NO: 7164035 - DNA, 22 bp, Homo sapiens
aaacatagataatagatagatg

SEQ ID NO: 7164036 - DNA, 22 bp, Homo sapiens
aaacatagataatagatagatg

SEQ ID NO: 7164037 - DNA, 20 bp, Homo sapiens
aaacatagtggataccacag

SEQ ID NO: 7164038 - DNA, 20 bp, Homo sapiens
aaacatagtggataccacag

SEQ ID NO: 7164039 - DNA, 22 bp, Homo sapiens
aaacatcaattgcatctcccaa

SEQ ID NO: 7164040 - DNA, 22 bp, Homo sapiens
aaacatcaattgcatctcccaa

SEQ ID NO: 7164041 - DNA, 22 bp, Homo sapiens
aaacatcaccattttacctaat

SEQ ID NO: 7164042 - DNA, 22 bp, Homo sapiens
aaacatcaccattttacctaat

SEQ ID NO: 7164043 - DNA, 22 bp, Homo sapiens
aaacatcaccattttacctaat

SEQ ID NO: 7164044 - DNA, 22 bp, Homo sapiens
aaacatcataggcatgcatgat

SEQ ID NO: 7164045 - DNA, 22 bp, Homo sapiens
aaacatcataggcatgcatgat

SEQ ID NO: 7164046 - DNA, 22 bp, Homo sapiens
aaacatcataggcatgcatgat

SEQ ID NO: 7164047 - DNA, 22 bp, Homo sapiens
aaacatctactgtaggctggag

SEQ ID NO: 7164048 - DNA, 22 bp, Homo sapiens
aaacatctatcagcatttttta

SEQ ID NO: 7164049 - DNA, 22 bp, Homo sapiens
aaacatctatcagcatttttta

SEQ ID NO: 7164050 - DNA, 22 bp, Homo sapiens
aaacatctattatgtgctgagc

SEQ ID NO: 7164051 - DNA, 22 bp, Homo sapiens
aaaggccacacagagcagggag

SEQ ID NO: 7164052 - DNA, 22 bp, Homo sapiens
aaaggccacacagagcagggag

SEQ ID NO: 7164053 - DNA, 22 bp, Homo sapiens
aaaggccaataaagacaagctg

SEQ ID NO: 7164054 - DNA, 22 bp, Homo sapiens
aaaggccaagcatgaggtggac

SEQ ID NO: 7164055 - DNA, 22 bp, Homo sapiens
aaaggccaagcatgaggtggac

SEQ ID NO: 7164056 - DNA, 22 bp, Homo sapiens
aaaggcattttaattctaaaga

SEQ ID NO: 7164057 - DNA, 22 bp, Homo sapiens
aaaggcatgtgcaactacaaat

SEQ ID NO: 7164058 - DNA, 22 bp, Homo sapiens
aaaggcatgtgcaactacaaat

SEQ ID NO: 7164059 - DNA, 22 bp, Homo sapiens
aaaggcatggaacagattctcc

SEQ ID NO: 7164060 - DNA, 22 bp, Homo sapiens
aaaggaggaatggagagatgct

SEQ ID NO: 7164061 - DNA, 22 bp, Homo sapiens
aaaggaggaatggagagatgct

SEQ ID NO: 7164062 - DNA, 22 bp, Homo sapiens
aaagcaatgcttgtggaatgta

SEQ ID NO: 7164063 - DNA, 22 bp, Homo sapiens
aaagcaatgcttgtggaatgta

SEQ ID NO: 7164064 - DNA, 22 bp, Homo sapiens
aaagcaatgcttgtggaatgta

SEQ ID NO: 7164065 - DNA, 22 bp, Homo sapiens
aaagcaatggatgagaatctgt

SEQ ID NO: 7164066 - DNA, 22 bp, Homo sapiens
aaaggccatggttggagtgttt

SEQ ID NO: 7164067 - DNA, 21 bp, Homo sapiens
aaaggccataatcacggagca

SEQ ID NO: 7164068 - DNA, 22 bp, Homo sapiens
aaaggccaggttggctggtatt

SEQ ID NO: 7164069 - DNA, 22 bp, Homo sapiens
aaaggccacactgctctttctc

SEQ ID NO: 7164070 - DNA, 22 bp, Homo sapiens
aaaggccaccaacatgaagcat

SEQ ID NO: 7164071 - DNA, 22 bp, Homo sapiens
aaaggccactgcaagggaaggt

SEQ ID NO: 7164072 - DNA, 22 bp, Homo sapiens
aaaggccactgcaagggaaggt

SEQ ID NO: 7164073 - DNA, 22 bp, Homo sapiens
aaaggccactgcaagggaaggt

SEQ ID NO: 7164074 - DNA, 22 bp, Homo sapiens
aaaggccacttgaaggattttt

SEQ ID NO: 7164075 - DNA, 22 bp, Homo sapiens
aaaggctacgggggccgtgtgc

SEQ ID NO: 7164076 - DNA, 22 bp, Homo sapiens
aaaggcccacagtcagtctacc

SEQ ID NO: 7164077 - DNA, 22 bp, Homo sapiens
aaaggcctgtgcttctaatgtg

SEQ ID NO: 7164078 - DNA, 22 bp, Homo sapiens
aaagcaatcagattcagatgtc

SEQ ID NO: 7164079 - DNA, 22 bp, Homo sapiens
aaagcaatagtaatggtaatag

SEQ ID NO: 7164080 - DNA, 22 bp, Homo sapiens
aaagcaatagtaatggtaatag

SEQ ID NO: 7164081 - DNA, 22 bp, Homo sapiens
aaagcaatcagattcagatgtc

SEQ ID NO: 7164082 - DNA, 22 bp, Homo sapiens
aaagcaatcagattcagatgtc

SEQ ID NO: 7164083 - DNA, 22 bp, Homo sapiens
aaagcaatcagattcagatgtc

SEQ ID NO: 7164084 - DNA, 22 bp, Homo sapiens
aaagcaatctagttccaattct

SEQ ID NO: 7164085 - DNA, 22 bp, Homo sapiens
aaagcaatctagttccaattct

SEQ ID NO: 7164086 - DNA, 22 bp, Homo sapiens
aaagcaatctagttccaattct

SEQ ID NO: 7164087 - DNA, 22 bp, Homo sapiens
aaagcaatctagttccaattct

SEQ ID NO: 7164088 - DNA, 22 bp, Homo sapiens
aaagcaatgatggtagacacgt

SEQ ID NO: 7164089 - DNA, 22 bp, Homo sapiens
aaagcaatgatggtagacacgt

SEQ ID NO: 7164090 - DNA, 22 bp, Homo sapiens
aaagcaatgcccgttcattatc

SEQ ID NO: 7164091 - DNA, 22 bp, Homo sapiens
aaagcaatgcccgttcattatc

SEQ ID NO: 7164092 - DNA, 22 bp, Homo sapiens
aaagcaatgcccgttcattatc

SEQ ID NO: 7164093 - DNA, 22 bp, Homo sapiens
aaagatgtgcctgtttcatagt

SEQ ID NO: 7164094 - DNA, 23 bp, Homo sapiens
aaagatgtgagtattcatatggc

SEQ ID NO: 7164095 - DNA, 22 bp, Homo sapiens
aaagatgtgtaagaaataaaca

SEQ ID NO: 7164096 - DNA, 22 bp, Homo sapiens
aaagcaataggttaggtcaaga

SEQ ID NO: 7164097 - DNA, 22 bp, Homo sapiens
aaagcaataggttaggtcaaga

SEQ ID NO: 7164098 - DNA, 19 bp, Homo sapiens
aaagatgtccttttgggct

SEQ ID NO: 7164099 - DNA, 19 bp, Homo sapiens
aaagatgtccttttgggct

SEQ ID NO: 7164100 - DNA, 22 bp, Homo sapiens
aaagatgtccaagtaaagttaa

SEQ ID NO: 7164101 - DNA, 22 bp, Homo sapiens
aaagatgtcatacacattaaga

SEQ ID NO: 7164102 - DNA, 22 bp, Homo sapiens
aaagatgtcagtttgaaataac

SEQ ID NO: 7164103 - DNA, 22 bp, Homo sapiens
aaagatgtcagtttgaaataac

SEQ ID NO: 7164104 - DNA, 22 bp, Homo sapiens
aaagatgtcagtttgaaataac

SEQ ID NO: 7164105 - DNA, 22 bp, Homo sapiens
aaagatgtcatacacattaaga

SEQ ID NO: 7164106 - DNA, 22 bp, Homo sapiens
aaagatgtcagtttgaaataac

SEQ ID NO: 7164107 - DNA, 22 bp, Homo sapiens
aaatcagtaaatgttcattaac

SEQ ID NO: 7164108 - DNA, 22 bp, Homo sapiens
aaatcagtgctcatttgaaagg

SEQ ID NO: 7164109 - DNA, 22 bp, Homo sapiens
aaatcagttggaacacaagcag

SEQ ID NO: 7164110 - DNA, 22 bp, Homo sapiens
aaatcagttgttatattaaaga

SEQ ID NO: 7164111 - DNA, 22 bp, Homo sapiens
aaatcagttgttatattaaaga

SEQ ID NO: 7164112 - DNA, 22 bp, Homo sapiens
aaatcagttgttatattaaaga

SEQ ID NO: 7164113 - DNA, 22 bp, Homo sapiens
aaatcatagcccccatccgatt

SEQ ID NO: 7164114 - DNA, 22 bp, Homo sapiens
aaatattattgcttaaggggag

SEQ ID NO: 7164115 - DNA, 22 bp, Homo sapiens
aaatatgttttccagttgtcat

SEQ ID NO: 7164116 - DNA, 22 bp, Homo sapiens
aaatatgtgatcagtgaataaa

SEQ ID NO: 7164117 - DNA, 22 bp, Homo sapiens
aaatcatggtggaagaaacaga

SEQ ID NO: 7164118 - DNA, 22 bp, Homo sapiens
aaatcatctctgcatccttagc

SEQ ID NO: 7164119 - DNA, 22 bp, Homo sapiens
aaatcattatttacagttctga

SEQ ID NO: 7164120 - DNA, 22 bp, Homo sapiens
aaatcattatttacagttctga

SEQ ID NO: 7164121 - DNA, 22 bp, Homo sapiens
aaatgcagctgggcatgagagg

SEQ ID NO: 7164122 - DNA, 22 bp, Homo sapiens
aaatccaggagaatttccactt

SEQ ID NO: 7164123 - DNA, 22 bp, Homo sapiens
aaatgctctccaaaatgaaagt

SEQ ID NO: 7164124 - DNA, 22 bp, Homo sapiens
aaatgctctccaaaatgaaagt

SEQ ID NO: 7164125 - DNA, 22 bp, Homo sapiens
aaatgctctctaatgtaataca

SEQ ID NO: 7164126 - DNA, 22 bp, Homo sapiens
aaatgctctggatgaccttgga

SEQ ID NO: 7164127 - DNA, 22 bp, Homo sapiens
aaatgctctggggataagactg

SEQ ID NO: 7164128 - DNA, 18 bp, Homo sapiens
aaatgctaggctacatga

SEQ ID NO: 7164129 - DNA, 22 bp, Homo sapiens
aaatgctatttgggaacaacat

SEQ ID NO: 7164130 - DNA, 22 bp, Homo sapiens
aaatgctctggggataagactg

SEQ ID NO: 7164131 - DNA, 20 bp, Homo sapiens
aaatgctgagaagtccttaa

SEQ ID NO: 7164132 - DNA, 23 bp, Homo sapiens
aaatgctgaatctttactgttta

SEQ ID NO: 7164133 - DNA, 22 bp, Homo sapiens
aaatgctgagtgtttagagatc

SEQ ID NO: 7164134 - DNA, 22 bp, Homo sapiens
aaatggcaggctctttgctagt

SEQ ID NO: 7164135 - DNA, 22 bp, Homo sapiens
aaatggcagtagaaaagaatcc

SEQ ID NO: 7164136 - DNA, 22 bp, Homo sapiens
aaatgctgagtgtttagagatc

SEQ ID NO: 7164137 - DNA, 22 bp, Homo sapiens
aaatggcagtagaaaagaatcc

SEQ ID NO: 7164138 - DNA, 22 bp, Homo sapiens
aaatggcagtgtcataaggctc

SEQ ID NO: 7164139 - DNA, 22 bp, Homo sapiens
aaatggcatagaggtgaaggta

SEQ ID NO: 7164140 - DNA, 22 bp, Homo sapiens
aaatggcatagaggtgaaggta

SEQ ID NO: 7164141 - DNA, 22 bp, Homo sapiens
aaatggcattcagcaacctttc

SEQ ID NO: 7164142 - DNA, 23 bp, Homo sapiens
aaatggccaaggttaaaaataca

SEQ ID NO: 7164143 - DNA, 22 bp, Homo sapiens
aaatgcctgtgtaaattctagc

SEQ ID NO: 7164144 - DNA, 22 bp, Homo sapiens
aaatgcctgtgtaaattctagc

SEQ ID NO: 7164145 - DNA, 22 bp, Homo sapiens
aaatgcctgtgtaaattctagc

SEQ ID NO: 7164146 - DNA, 22 bp, Homo sapiens
aaatgccttcaaacacttaagg

SEQ ID NO: 7164147 - DNA, 18 bp, Homo sapiens
aaatgctaggctacatga

SEQ ID NO: 7164148 - DNA, 18 bp, Homo sapiens
aaatgctaggctacatga

SEQ ID NO: 7164149 - DNA, 22 bp, Homo sapiens
aaatgcagctgggcatgagagg

SEQ ID NO: 7164150 - DNA, 22 bp, Homo sapiens
aaatgcctagaaatcacgcaga

SEQ ID NO: 7164151 - DNA, 22 bp, Homo sapiens
aaatgcctcattttctctcact

SEQ ID NO: 7164152 - DNA, 22 bp, Homo sapiens
aaatgcctcccaaacagcacaa

SEQ ID NO: 7164153 - DNA, 22 bp, Homo sapiens
aaatgcctcccaaacagcacaa

SEQ ID NO: 7164154 - DNA, 22 bp, Homo sapiens
aaatgcctcccattctactgac

SEQ ID NO: 7164155 - DNA, 22 bp, Homo sapiens
aaatgcctctgctgtacacaat

SEQ ID NO: 7164156 - DNA, 22 bp, Homo sapiens
aaatgcctctgctgtacacaat

SEQ ID NO: 7164157 - DNA, 22 bp, Homo sapiens
aaatgcctctgggttattctag

SEQ ID NO: 7164158 - DNA, 22 bp, Homo sapiens
aaatgcctgaatggtatttggt

SEQ ID NO: 7164159 - DNA, 23 bp, Homo sapiens
aaactacatttatagtttttctc

SEQ ID NO: 7164160 - DNA, 23 bp, Homo sapiens
aaactacatttatagtttttctc

SEQ ID NO: 7164161 - DNA, 23 bp, Homo sapiens
aaactacatttatagtttttctc

SEQ ID NO: 7164162 - DNA, 22 bp, Homo sapiens
aaactacatctcatggatgagg

SEQ ID NO: 7164163 - DNA, 22 bp, Homo sapiens
aaactacactttgggaccagca

SEQ ID NO: 7164164 - DNA, 22 bp, Homo sapiens
aaactacatctcatggatgagg

SEQ ID NO: 7164165 - DNA, 22 bp, Homo sapiens
aaactagaaatcagcaagatag

SEQ ID NO: 7164166 - DNA, 22 bp, Homo sapiens
aaactacactttgggaccagca

SEQ ID NO: 7164167 - DNA, 23 bp, Homo sapiens
aaactacaacgccaggcactgag

SEQ ID NO: 7164168 - DNA, 23 bp, Homo sapiens
aaactacaacgccaggcactgag

SEQ ID NO: 7164169 - DNA, 19 bp, Homo sapiens
aaactaaggggaaatgttt

SEQ ID NO: 7164170 - DNA, 22 bp, Homo sapiens
aaactaaggtgctgtggactga

SEQ ID NO: 7164171 - DNA, 22 bp, Homo sapiens
aaactaaggtgctgtggactga

SEQ ID NO: 7164172 - DNA, 19 bp, Homo sapiens
aaactaaggggaaatgttt

SEQ ID NO: 7164173 - DNA, 22 bp, Homo sapiens
aaactaagactaatgaagaact

SEQ ID NO: 7164174 - DNA, 22 bp, Homo sapiens
aaactaagggagatgtgggctg

SEQ ID NO: 7164175 - DNA, 22 bp, Homo sapiens
aaactaagggagatgtgggctg

SEQ ID NO: 7164176 - DNA, 20 bp, Homo sapiens
aaactaaaggtgtttggttt

SEQ ID NO: 7164177 - DNA, 22 bp, Homo sapiens
aaactaagactaatgaagaact

SEQ ID NO: 7164178 - DNA, 22 bp, Homo sapiens
aaatatgtaaccaaggtgaagt

SEQ ID NO: 7164179 - DNA, 22 bp, Homo sapiens
aaatatgagggtgatgcccaga

SEQ ID NO: 7164180 - DNA, 22 bp, Homo sapiens
aaatatgtaaccaaggtgaagt

SEQ ID NO: 7164181 - DNA, 22 bp, Homo sapiens
aaatatgtatggagttcatgaa

SEQ ID NO: 7164182 - DNA, 23 bp, Homo sapiens
aaatatgtctgagggcaaagaat

SEQ ID NO: 7164183 - DNA, 23 bp, Homo sapiens
aaatatgtctgagggcaaagaat

SEQ ID NO: 7164184 - DNA, 22 bp, Homo sapiens
aaatatgtgatcagtgaataaa

SEQ ID NO: 7164185 - DNA, 22 bp, Homo sapiens
aaactaaacctggcttagtaag

SEQ ID NO: 7164186 - DNA, 22 bp, Homo sapiens
aaactaaacctggcttagtaag

SEQ ID NO: 7164187 - DNA, 20 bp, Homo sapiens
aaacgagccatcattctggt

SEQ ID NO: 7164188 - DNA, 22 bp, Homo sapiens
aaacgctttgccatgtttatgt

SEQ ID NO: 7164189 - DNA, 23 bp, Homo sapiens
aaaccttttgtagaacaattgct

SEQ ID NO: 7164190 - DNA, 23 bp, Homo sapiens
aaaccttttgtagaacaattgct

SEQ ID NO: 7164191 - DNA, 22 bp, Homo sapiens
aaatagaaaccaacaaggtcag

SEQ ID NO: 7164192 - DNA, 22 bp, Homo sapiens
aaatagaattaactagctactg

SEQ ID NO: 7164193 - DNA, 22 bp, Homo sapiens
aaatagaattaactagctactg

SEQ ID NO: 7164194 - DNA, 22 bp, Homo sapiens
aaatagaattggaagcagagtt

SEQ ID NO: 7164195 - DNA, 22 bp, Homo sapiens
aaatagaattggaagcagagtt

SEQ ID NO: 7164196 - DNA, 22 bp, Homo sapiens
aaatagaattggaagcagagtt

SEQ ID NO: 7164197 - DNA, 22 bp, Homo sapiens
aaatagaattggaagcagagtt

SEQ ID NO: 7164198 - DNA, 22 bp, Homo sapiens
aaatagaattggaagcagagtt

SEQ ID NO: 7164199 - DNA, 22 bp, Homo sapiens
aaatagaattggaagcagagtt

SEQ ID NO: 7164200 - DNA, 22 bp, Homo sapiens
aaatagaattggaagcagagtt

SEQ ID NO: 7164201 - DNA, 22 bp, Homo sapiens
aaatactgttgaatgaagtaag

SEQ ID NO: 7164202 - DNA, 22 bp, Homo sapiens
aaatactgttgaatgaagtaag

SEQ ID NO: 7164203 - DNA, 22 bp, Homo sapiens
aaatactgttttattccatgat

SEQ ID NO: 7164204 - DNA, 22 bp, Homo sapiens
aaatactgttttattccatgat

SEQ ID NO: 7164205 - DNA, 22 bp, Homo sapiens
aaatagaaaccaacaaggtcag

SEQ ID NO: 7164206 - DNA, 22 bp, Homo sapiens
aaatagaaaccaacaaggtcag

SEQ ID NO: 7164207 - DNA, 22 bp, Homo sapiens
aaatagaaaccaacaaggtcag

SEQ ID NO: 7164208 - DNA, 22 bp, Homo sapiens
aaatagaaaccaacaaggtcag

SEQ ID NO: 7164209 - DNA, 22 bp, Homo sapiens
aaatacagattctgactcagag

SEQ ID NO: 7164210 - DNA, 22 bp, Homo sapiens
aaatacagattctgactcagag

SEQ ID NO: 7164211 - DNA, 21 bp, Homo sapiens
aaatactgtcaaatggtgggt

SEQ ID NO: 7164212 - DNA, 22 bp, Homo sapiens
aaatactgtccaccatggagca

SEQ ID NO: 7164213 - DNA, 22 bp, Homo sapiens
aaatactgtccaccatggagca

SEQ ID NO: 7164214 - DNA, 22 bp, Homo sapiens
aaatactgtctctgagagagcc

SEQ ID NO: 7164215 - DNA, 22 bp, Homo sapiens
aaatactgtgaataaaggtttt

SEQ ID NO: 7164216 - DNA, 22 bp, Homo sapiens
aaatactgtgaataaaggtttt

SEQ ID NO: 7164217 - DNA, 20 bp, Homo sapiens
aagaatgctgtggttggaag

SEQ ID NO: 7164218 - DNA, 22 bp, Homo sapiens
aagaatgtcgttggtattttaa

SEQ ID NO: 7164219 - DNA, 22 bp, Homo sapiens
aagaatgtcgttggtattttaa

SEQ ID NO: 7164220 - DNA, 22 bp, Homo sapiens
aagaatgtctctggtgaggcgc

SEQ ID NO: 7164221 - DNA, 22 bp, Homo sapiens
aagaatgtggcatttatttata

SEQ ID NO: 7164222 - DNA, 22 bp, Homo sapiens
aagaatgtgggtggatatgatg

SEQ ID NO: 7164223 - DNA, 22 bp, Homo sapiens
aagaatgtgggtggatatgatg

SEQ ID NO: 7164224 - DNA, 22 bp, Homo sapiens
aagaatgtgggtggatatgatg

SEQ ID NO: 7164225 - DNA, 22 bp, Homo sapiens
aagaatgagctcaaagatctta

SEQ ID NO: 7164226 - DNA, 22 bp, Homo sapiens
aagaatgagctcaaagatctta

SEQ ID NO: 7164227 - DNA, 22 bp, Homo sapiens
aagaatgagctcaaagatctta

SEQ ID NO: 7164228 - DNA, 22 bp, Homo sapiens
aagaatgagctcaaagatctta

SEQ ID NO: 7164229 - DNA, 22 bp, Homo sapiens
aagaatgattacaaagcaacga

SEQ ID NO: 7164230 - DNA, 22 bp, Homo sapiens
aagaatgattacaaagcaacga

SEQ ID NO: 7164231 - DNA, 22 bp, Homo sapiens
aagaatgattacaaagcaacga

SEQ ID NO: 7164232 - DNA, 22 bp, Homo sapiens
aagaatgattacaaagcaacga

SEQ ID NO: 7164233 - DNA, 22 bp, Homo sapiens
aagaatgattacaaagcaacga

SEQ ID NO: 7164234 - DNA, 22 bp, Homo sapiens
aagaaagtgctttgtaaattat

SEQ ID NO: 7164235 - DNA, 22 bp, Homo sapiens
aagaaagtgatgagctacagat

SEQ ID NO: 7164236 - DNA, 22 bp, Homo sapiens
aagaaagtgatgagctacagat

SEQ ID NO: 7164237 - DNA, 22 bp, Homo sapiens
aagaaagggctattgttctcca

SEQ ID NO: 7164238 - DNA, 22 bp, Homo sapiens
aagaaagggctattgttctcca

SEQ ID NO: 7164239 - DNA, 22 bp, Homo sapiens
aagaaaggtctctgcccgctat

SEQ ID NO: 7164240 - DNA, 22 bp, Homo sapiens
aagaaaggtgtgtttgcagatg

SEQ ID NO: 7164241 - DNA, 22 bp, Homo sapiens
aagaaaggtgtgtttgcagatg

SEQ ID NO: 7164242 - DNA, 22 bp, Homo sapiens
aagaaagtgtggagagcctagc

SEQ ID NO: 7164243 - DNA, 22 bp, Homo sapiens
aagaaagtgggtaatatgattt

SEQ ID NO: 7164244 - DNA, 22 bp, Homo sapiens
aagaaagtgggtaatatgattt

SEQ ID NO: 7164245 - DNA, 22 bp, Homo sapiens
aagaaagtgtggagagcctagc

SEQ ID NO: 7164246 - DNA, 22 bp, Homo sapiens
aagaaagtgggtaatatgattt

SEQ ID NO: 7164247 - DNA, 22 bp, Homo sapiens
aagaaagtgggtaatatgattt

SEQ ID NO: 7164248 - DNA, 22 bp, Homo sapiens
aagaaagtgtggagagcctagc

SEQ ID NO: 7164249 - DNA, 22 bp, Homo sapiens
aagaaataagacttctctgtcc

SEQ ID NO: 7164250 - DNA, 22 bp, Homo sapiens
aagaaataagacttctctgtcc

SEQ ID NO: 7164251 - DNA, 22 bp, Homo sapiens
aagaaataagacttctctgtcc

SEQ ID NO: 7164252 - DNA, 22 bp, Homo sapiens
aagaagttaataatggtgagaa

SEQ ID NO: 7164253 - DNA, 22 bp, Homo sapiens
aactttctttgcatctaagttt

SEQ ID NO: 7164254 - DNA, 22 bp, Homo sapiens
aactttcttgtgacatttgggg

SEQ ID NO: 7164255 - DNA, 19 bp, Homo sapiens
aacttgctttaaaaccata

SEQ ID NO: 7164256 - DNA, 22 bp, Homo sapiens
aacttggcttgcatggctgaaa

SEQ ID NO: 7164257 - DNA, 22 bp, Homo sapiens
aactttggtcagagaaattgtg

SEQ ID NO: 7164258 - DNA, 22 bp, Homo sapiens
aactttggtaatttactgggaa

SEQ ID NO: 7164259 - DNA, 22 bp, Homo sapiens
aactttggtattcgacagctct

SEQ ID NO: 7164260 - DNA, 22 bp, Homo sapiens
aactttgtgtgtttaatatggc

SEQ ID NO: 7164261 - DNA, 22 bp, Homo sapiens
aactttgttttattcactgctg

SEQ ID NO: 7164262 - DNA, 22 bp, Homo sapiens
aactttggcaagtcagacttct

SEQ ID NO: 7164263 - DNA, 22 bp, Homo sapiens
aactttggccacaagtaccctg

SEQ ID NO: 7164264 - DNA, 22 bp, Homo sapiens
aactttgggcctaagtactgtt

SEQ ID NO: 7164265 - DNA, 22 bp, Homo sapiens
aacttttaaaatacacagacaa

SEQ ID NO: 7164266 - DNA, 22 bp, Homo sapiens
aacttttacaaattgtcatcat

SEQ ID NO: 7164267 - DNA, 22 bp, Homo sapiens
aacttttagacttgggtataaa

SEQ ID NO: 7164268 - DNA, 23 bp, Homo sapiens
aacttttagagtttaacagtgtt

SEQ ID NO: 7164269 - DNA, 23 bp, Homo sapiens
aacttttagagtttaacagtgtt

SEQ ID NO: 7164270 - DNA, 23 bp, Homo sapiens
aacttttagagtttaacagtgtt

SEQ ID NO: 7164271 - DNA, 22 bp, Homo sapiens
aacttttcataagggcaaattt

SEQ ID NO: 7164272 - DNA, 22 bp, Homo sapiens
aacttttcataagggcaaattt

SEQ ID NO: 7164273 - DNA, 22 bp, Homo sapiens
aacttttcattgaatcatgtca

SEQ ID NO: 7164274 - DNA, 22 bp, Homo sapiens
aagaaagctgaatattctgtgt

SEQ ID NO: 7164275 - DNA, 22 bp, Homo sapiens
aagaaagctgaatattctgtgt

SEQ ID NO: 7164276 - DNA, 22 bp, Homo sapiens
aagaaaggatatatgggaggta

SEQ ID NO: 7164277 - DNA, 22 bp, Homo sapiens
aagaaaggatatatgggaggta

SEQ ID NO: 7164278 - DNA, 22 bp, Homo sapiens
aagaaaggatatatgggaggta

SEQ ID NO: 7164279 - DNA, 22 bp, Homo sapiens
aagaaagggagaaggatggtgt

SEQ ID NO: 7164280 - DNA, 22 bp, Homo sapiens
aagaaagggagaaggatggtgt

SEQ ID NO: 7164281 - DNA, 22 bp, Homo sapiens
aagaaagggctattgttctcca

SEQ ID NO: 7164282 - DNA, 22 bp, Homo sapiens
aagaatgttagtttctgataca

SEQ ID NO: 7164283 - DNA, 22 bp, Homo sapiens
aagaatgttagtttctgataca

SEQ ID NO: 7164284 - DNA, 22 bp, Homo sapiens
aagaatgttcaacgcttttttg

SEQ ID NO: 7164285 - DNA, 21 bp, Homo sapiens
aagaatgttccaggtcttgcc

SEQ ID NO: 7164286 - DNA, 22 bp, Homo sapiens
aagaatgttcttgtagtcatga

SEQ ID NO: 7164287 - DNA, 22 bp, Homo sapiens
aagacactaagctttcaggata

SEQ ID NO: 7164288 - DNA, 22 bp, Homo sapiens
aagacactaagctttcaggata

SEQ ID NO: 7164289 - DNA, 22 bp, Homo sapiens
aagacactcattatcactggtt

SEQ ID NO: 7164290 - DNA, 22 bp, Homo sapiens
aagacactcattatcactggtt

SEQ ID NO: 7164291 - DNA, 22 bp, Homo sapiens
aagacactgatactctgtgatt

SEQ ID NO: 7164292 - DNA, 22 bp, Homo sapiens
aagacactgatactctgtgatt

SEQ ID NO: 7164293 - DNA, 22 bp, Homo sapiens
aagacactgggggctgcagcca

SEQ ID NO: 7164294 - DNA, 22 bp, Homo sapiens
aagacactgggggctgcagcca

SEQ ID NO: 7164295 - DNA, 22 bp, Homo sapiens
aagacactgggttaggcacgtg

SEQ ID NO: 7164296 - DNA, 22 bp, Homo sapiens
aagacactttctaaatagaagt

SEQ ID NO: 7164297 - DNA, 22 bp, Homo sapiens
aagacactttctaaatagaagt

SEQ ID NO: 7164298 - DNA, 22 bp, Homo sapiens
aagacactttctaaatagaagt

SEQ ID NO: 7164299 - DNA, 21 bp, Homo sapiens
aagacagaaaagcctattttc

SEQ ID NO: 7164300 - DNA, 17 bp, Homo sapiens
aagacagaagccatgag

SEQ ID NO: 7164301 - DNA, 20 bp, Homo sapiens
aagagcatagtacaggaaga

SEQ ID NO: 7164302 - DNA, 22 bp, Homo sapiens
aagagcatatatgtatgtttgt

SEQ ID NO: 7164303 - DNA, 22 bp, Homo sapiens
aagagcatatggttctcaaagc

SEQ ID NO: 7164304 - DNA, 20 bp, Homo sapiens
aagagaggaagttatactag

SEQ ID NO: 7164305 - DNA, 22 bp, Homo sapiens
aagagcagtgttttactcagct

SEQ ID NO: 7164306 - DNA, 22 bp, Homo sapiens
aagacagagggaagcaatgatg

SEQ ID NO: 7164307 - DNA, 22 bp, Homo sapiens
aagacagagggaagcaatgatg

SEQ ID NO: 7164308 - DNA, 22 bp, Homo sapiens
aagagagagttcctaggcaaaa

SEQ ID NO: 7164309 - DNA, 22 bp, Homo sapiens
aagagagagttcctaggcaaaa

SEQ ID NO: 7164310 - DNA, 22 bp, Homo sapiens
aagagagagttcctaggcaaaa

SEQ ID NO: 7164311 - DNA, 17 bp, Homo sapiens
aagacagaagccatgag

SEQ ID NO: 7164312 - DNA, 17 bp, Homo sapiens
aagacagaagccatgag

SEQ ID NO: 7164313 - DNA, 17 bp, Homo sapiens
aagacagaagccatgag

SEQ ID NO: 7164314 - DNA, 22 bp, Homo sapiens
aagacagaagtgatttgatgtg

SEQ ID NO: 7164315 - DNA, 22 bp, Homo sapiens
aagacagaagtgatttgatgtg

SEQ ID NO: 7164316 - DNA, 22 bp, Homo sapiens
aagacagaccacgtgacagggc

SEQ ID NO: 7164317 - DNA, 22 bp, Homo sapiens
aagacagagactctgcaacagg

SEQ ID NO: 7164318 - DNA, 22 bp, Homo sapiens
aagacagagactctgcaacagg

SEQ ID NO: 7164319 - DNA, 22 bp, Homo sapiens
aagacagagactctgcaacagg

SEQ ID NO: 7164320 - DNA, 22 bp, Homo sapiens
aagagccagtgggaaagtcttg

SEQ ID NO: 7164321 - DNA, 22 bp, Homo sapiens
aagagccaggacagatccagct

SEQ ID NO: 7164322 - DNA, 22 bp, Homo sapiens
aagagccagtgggaaagtcttg

SEQ ID NO: 7164323 - DNA, 22 bp, Homo sapiens
aagagccagtgggaaagtcttg

SEQ ID NO: 7164324 - DNA, 22 bp, Homo sapiens
aagagccagtgggaaagtcttg

SEQ ID NO: 7164325 - DNA, 22 bp, Homo sapiens
aagagccagctagtgaagaggc

SEQ ID NO: 7164326 - DNA, 22 bp, Homo sapiens
aagagccagctagtgaagaggc

SEQ ID NO: 7164327 - DNA, 22 bp, Homo sapiens
aagagccaagcagtcatcaata

SEQ ID NO: 7164328 - DNA, 22 bp, Homo sapiens
aagagcatttggtgagatttga

SEQ ID NO: 7164329 - DNA, 22 bp, Homo sapiens
aagagcattttagtctcccttt

SEQ ID NO: 7164330 - DNA, 22 bp, Homo sapiens
aagagcattttgtaaaatcctt

SEQ ID NO: 7164331 - DNA, 22 bp, Homo sapiens
aagagcatttccactggcactg

SEQ ID NO: 7164332 - DNA, 22 bp, Homo sapiens
aagagcatttccactggcactg

SEQ ID NO: 7164333 - DNA, 22 bp, Homo sapiens
aagagcattccgttctgattct

SEQ ID NO: 7164334 - DNA, 22 bp, Homo sapiens
aagagcattcctaaaggaccat

SEQ ID NO: 7164335 - DNA, 22 bp, Homo sapiens
aagagcatttaattaggagagt

SEQ ID NO: 7164336 - DNA, 22 bp, Homo sapiens
aagagcatctatttcacagtgg

SEQ ID NO: 7164337 - DNA, 22 bp, Homo sapiens
aagagcatggaatggagatcca

SEQ ID NO: 7164338 - DNA, 22 bp, Homo sapiens
aagagcatggagttcccctaaa

SEQ ID NO: 7164339 - DNA, 22 bp, Homo sapiens
aagagcatggcaagaaaagggt

SEQ ID NO: 7164340 - DNA, 22 bp, Homo sapiens
aagagcatgtaattggatttct

SEQ ID NO: 7164341 - DNA, 22 bp, Homo sapiens
aagagcatgttaattctaggac

SEQ ID NO: 7164342 - DNA, 22 bp, Homo sapiens
aagagcatgtaattggatttct

SEQ ID NO: 7164343 - DNA, 22 bp, Homo sapiens
aagagcatgttaattctaggac

SEQ ID NO: 7164344 - DNA, 22 bp, Homo sapiens
aagagcattccgttctgattct

SEQ ID NO: 7164345 - DNA, 22 bp, Homo sapiens
aagagcatatggttctcaaagc

SEQ ID NO: 7164346 - DNA, 22 bp, Homo sapiens
aagagcatattaatagtggaga

SEQ ID NO: 7164347 - DNA, 22 bp, Homo sapiens
aagagcatcaatgactcgcagt

SEQ ID NO: 7164348 - DNA, 22 bp, Homo sapiens
aagagcatctatttcacagtgg

SEQ ID NO: 7164349 - DNA, 22 bp, Homo sapiens
aagagcatcggtggagccccca

SEQ ID NO: 7164350 - DNA, 22 bp, Homo sapiens
aagagcatctatttcacagtgg

SEQ ID NO: 7164351 - DNA, 22 bp, Homo sapiens
aagaggaagtctccatggagag

SEQ ID NO: 7164352 - DNA, 22 bp, Homo sapiens
aagaggaagtctccatggagag

SEQ ID NO: 7164353 - DNA, 22 bp, Homo sapiens
aagaggaatgggtgtgtttatg

SEQ ID NO: 7164354 - DNA, 22 bp, Homo sapiens
aagaggacagtattcaatatga

SEQ ID NO: 7164355 - DNA, 22 bp, Homo sapiens
aagaggaccagtagataaattt

SEQ ID NO: 7164356 - DNA, 22 bp, Homo sapiens
aagaggagaaaggctggctttg

SEQ ID NO: 7164357 - DNA, 22 bp, Homo sapiens
aagaggagaaaggctggctttg

SEQ ID NO: 7164358 - DNA, 22 bp, Homo sapiens
aagaggagaaaggctggctttg

SEQ ID NO: 7164359 - DNA, 22 bp, Homo sapiens
aagaggacttgtgaagatgtac

SEQ ID NO: 7164360 - DNA, 22 bp, Homo sapiens
aagagcccttgttcataattat

SEQ ID NO: 7164361 - DNA, 22 bp, Homo sapiens
aagagcccttgttcataattat

SEQ ID NO: 7164362 - DNA, 22 bp, Homo sapiens
aagagccctggttgaaaataac

SEQ ID NO: 7164363 - DNA, 22 bp, Homo sapiens
aagagccatttcatatcatctc

SEQ ID NO: 7164364 - DNA, 22 bp, Homo sapiens
aagagccatacaagtaaaagca

SEQ ID NO: 7164365 - DNA, 22 bp, Homo sapiens
aagccagatcaaagtgtccagg

SEQ ID NO: 7164366 - DNA, 22 bp, Homo sapiens
aagccagattccttaagcacag

SEQ ID NO: 7164367 - DNA, 22 bp, Homo sapiens
aagccagatagaagaactcatt

SEQ ID NO: 7164368 - DNA, 22 bp, Homo sapiens
aagccactttcagctgtctcag

SEQ ID NO: 7164369 - DNA, 22 bp, Homo sapiens
aagccactttcagctgtctcag

SEQ ID NO: 7164370 - DNA, 22 bp, Homo sapiens
aagccactttcagctgtctcag

SEQ ID NO: 7164371 - DNA, 22 bp, Homo sapiens
aagccacttggggaaagatgga

SEQ ID NO: 7164372 - DNA, 22 bp, Homo sapiens
aagccacttggggaaagatgga

SEQ ID NO: 7164373 - DNA, 22 bp, Homo sapiens
aagccagagtttttgagaactt

SEQ ID NO: 7164374 - DNA, 22 bp, Homo sapiens
aagccagagtttttgagaactt

SEQ ID NO: 7164375 - DNA, 22 bp, Homo sapiens
aagccactatggtgattctcaa

SEQ ID NO: 7164376 - DNA, 22 bp, Homo sapiens
aagccacagatcgttctgtcac

SEQ ID NO: 7164377 - DNA, 22 bp, Homo sapiens
aagccaatgttgcctgggtttc

SEQ ID NO: 7164378 - DNA, 22 bp, Homo sapiens
aagccaatggattggttgcttt

SEQ ID NO: 7164379 - DNA, 22 bp, Homo sapiens
aagccacaatctgcatcagcat

SEQ ID NO: 7164380 - DNA, 22 bp, Homo sapiens
aagccactgagatttcactgca

SEQ ID NO: 7164381 - DNA, 22 bp, Homo sapiens
aagccactcacaataactgtcc

SEQ ID NO: 7164382 - DNA, 22 bp, Homo sapiens
aagccactcacaataactgtcc

SEQ ID NO: 7164383 - DNA, 22 bp, Homo sapiens
aagccactattaaataatgatt

SEQ ID NO: 7164384 - DNA, 22 bp, Homo sapiens
aagccactgagatttcactgca

SEQ ID NO: 7164385 - DNA, 22 bp, Homo sapiens
aagccactgcggtttcccatcc

SEQ ID NO: 7164386 - DNA, 22 bp, Homo sapiens
aagccactcacaataactgtcc

SEQ ID NO: 7164387 - DNA, 22 bp, Homo sapiens
aagccaatgctagcccacatgc

SEQ ID NO: 7164388 - DNA, 22 bp, Homo sapiens
aagccaatggattggttgcttt

SEQ ID NO: 7164389 - DNA, 22 bp, Homo sapiens
aagccaatgatacgggtgatct

SEQ ID NO: 7164390 - DNA, 23 bp, Homo sapiens
aagcatggttcacagttagtact

SEQ ID NO: 7164391 - DNA, 22 bp, Homo sapiens
aagccaatgagagaggcctcag

SEQ ID NO: 7164392 - DNA, 23 bp, Homo sapiens
aagcatggttcacagttagtact

SEQ ID NO: 7164393 - DNA, 22 bp, Homo sapiens
aagcagcagccatcccccaagg

SEQ ID NO: 7164394 - DNA, 22 bp, Homo sapiens
aagcagcagcctgaagtacgtc

SEQ ID NO: 7164395 - DNA, 22 bp, Homo sapiens
aagcagcagcctgaagtacgtc

SEQ ID NO: 7164396 - DNA, 22 bp, Homo sapiens
aagcagcataattgctatttta

SEQ ID NO: 7164397 - DNA, 22 bp, Homo sapiens
aagcagcataattgctatttta

SEQ ID NO: 7164398 - DNA, 22 bp, Homo sapiens
aagcagcataattgctatttta

SEQ ID NO: 7164399 - DNA, 22 bp, Homo sapiens
aagcagcataattgctatttta

SEQ ID NO: 7164400 - DNA, 22 bp, Homo sapiens
aagcagcataattgctatttta

SEQ ID NO: 7164401 - DNA, 22 bp, Homo sapiens
aagcagcatagctcccttagtt

SEQ ID NO: 7164402 - DNA, 22 bp, Homo sapiens
aagcagcatagctcccttagtt

SEQ ID NO: 7164403 - DNA, 22 bp, Homo sapiens
aagcatggtggatgatacagtg

SEQ ID NO: 7164404 - DNA, 15 bp, Homo sapiens
aagcagcaatatata

SEQ ID NO: 7164405 - DNA, 22 bp, Homo sapiens
aagcagcacagcaatgactcta

SEQ ID NO: 7164406 - DNA, 22 bp, Homo sapiens
aagcagcacagcaatgactcta

SEQ ID NO: 7164407 - DNA, 22 bp, Homo sapiens
aagcagcacagtaatattggtg

SEQ ID NO: 7164408 - DNA, 22 bp, Homo sapiens
aagcagcacagtaatattggtg

SEQ ID NO: 7164409 - DNA, 22 bp, Homo sapiens
aagcagcacagtaatattggtg

SEQ ID NO: 7164410 - DNA, 22 bp, Homo sapiens
aagcagcacgctttgccaacaa

SEQ ID NO: 7164411 - DNA, 22 bp, Homo sapiens
aagcagcacgctttgccaacaa

SEQ ID NO: 7164412 - DNA, 22 bp, Homo sapiens
aagcagcacgctttgccaacaa

SEQ ID NO: 7164413 - DNA, 22 bp, Homo sapiens
aagcagcagacctgattttgaa

SEQ ID NO: 7164414 - DNA, 22 bp, Homo sapiens
aagcagcagacctgattttgaa

SEQ ID NO: 7164415 - DNA, 22 bp, Homo sapiens
aagcagcagacctgattttgaa

SEQ ID NO: 7164416 - DNA, 22 bp, Homo sapiens
aagcagcagacctgattttgaa

SEQ ID NO: 7164417 - DNA, 22 bp, Homo sapiens
aagcagcagacctgattttgaa

SEQ ID NO: 7164418 - DNA, 22 bp, Homo sapiens
aagcagcagcaggattaaagag

SEQ ID NO: 7164419 - DNA, 22 bp, Homo sapiens
aagcagcagcaggattaaagag

SEQ ID NO: 7164420 - DNA, 22 bp, Homo sapiens
aagcagcagcaggattaaagag

SEQ ID NO: 7164421 - DNA, 22 bp, Homo sapiens
aagcagcagcaggattaaagag

SEQ ID NO: 7164422 - DNA, 22 bp, Homo sapiens
aagcagatgggactccaaggca

SEQ ID NO: 7164423 - DNA, 22 bp, Homo sapiens
aagcagatgggactccaaggca

SEQ ID NO: 7164424 - DNA, 22 bp, Homo sapiens
aagcagatgccaagatttacca

SEQ ID NO: 7164425 - DNA, 22 bp, Homo sapiens
aagcagatctgatagggccctg

SEQ ID NO: 7164426 - DNA, 22 bp, Homo sapiens
aagcagattggggatttccatg

SEQ ID NO: 7164427 - DNA, 22 bp, Homo sapiens
aagcagattggggatttccatg

SEQ ID NO: 7164428 - DNA, 22 bp, Homo sapiens
aagcagcaacaaactggataaa

SEQ ID NO: 7164429 - DNA, 22 bp, Homo sapiens
aagcagcaacaaactggataaa

SEQ ID NO: 7164430 - DNA, 22 bp, Homo sapiens
aagcagcaagtttatttctatc

SEQ ID NO: 7164431 - DNA, 22 bp, Homo sapiens
aagcagcaagtttatttctatc

SEQ ID NO: 7164432 - DNA, 22 bp, Homo sapiens
aagcagcaagtttatttctatc

SEQ ID NO: 7164433 - DNA, 22 bp, Homo sapiens
aagcagcaagtttatttctatc

SEQ ID NO: 7164434 - DNA, 22 bp, Homo sapiens
aagcagagttagcttgtcacct

SEQ ID NO: 7164435 - DNA, 22 bp, Homo sapiens
aagcagaaagaacaactgagtg

SEQ ID NO: 7164436 - DNA, 22 bp, Homo sapiens
aagcagaaagaacaactgagtg

SEQ ID NO: 7164437 - DNA, 22 bp, Homo sapiens
aagcagaactgggaagtagtgg

SEQ ID NO: 7164438 - DNA, 22 bp, Homo sapiens
aagcagaactgggaagtagtgg

SEQ ID NO: 7164439 - DNA, 22 bp, Homo sapiens
aagcactttatgtcaatgtcct

SEQ ID NO: 7164440 - DNA, 22 bp, Homo sapiens
aagcagaaaaactgagctccaa

SEQ ID NO: 7164441 - DNA, 22 bp, Homo sapiens
aagcagaaagaacaactgagtg

SEQ ID NO: 7164442 - DNA, 22 bp, Homo sapiens
aagcagaaagaacaactgagtg

SEQ ID NO: 7164443 - DNA, 22 bp, Homo sapiens
aagcactgggtatagcaatgat

SEQ ID NO: 7164444 - DNA, 22 bp, Homo sapiens
aagcactgtacaaatgtcactt

SEQ ID NO: 7164445 - DNA, 22 bp, Homo sapiens
aagcactgtgcctcatatctga

SEQ ID NO: 7164446 - DNA, 20 bp, Homo sapiens
aagcactgtggtggcatgga

SEQ ID NO: 7164447 - DNA, 22 bp, Homo sapiens
aagcacttagaagagtgcctgc

SEQ ID NO: 7164448 - DNA, 22 bp, Homo sapiens
aagcactttagtgagaataagg

SEQ ID NO: 7164449 - DNA, 22 bp, Homo sapiens
aagcactttagtgagaataagg

SEQ ID NO: 7164450 - DNA, 22 bp, Homo sapiens
aagcactttatgtcaatgtcct

SEQ ID NO: 7164451 - DNA, 22 bp, Homo sapiens
aagcactgagcacagtggctga

SEQ ID NO: 7164452 - DNA, 22 bp, Homo sapiens
aagcaccttccagatttgcacg

SEQ ID NO: 7164453 - DNA, 22 bp, Homo sapiens
aagcactaggtcacacaagtta

SEQ ID NO: 7164454 - DNA, 22 bp, Homo sapiens
aagcactggagatgccagagtg

SEQ ID NO: 7164455 - DNA, 22 bp, Homo sapiens
aagcactgggaggaggctgaga

SEQ ID NO: 7164456 - DNA, 22 bp, Homo sapiens
aagcaaatgtgggtgcagaatt

SEQ ID NO: 7164457 - DNA, 22 bp, Homo sapiens
aagcaaatgtgggtgcagaatt

SEQ ID NO: 7164458 - DNA, 22 bp, Homo sapiens
aagcaaatgaaccagaggtaat

SEQ ID NO: 7164459 - DNA, 22 bp, Homo sapiens
aagcaaatatttctagagactg

SEQ ID NO: 7164460 - DNA, 22 bp, Homo sapiens
aagcaaatatttctagagactg

SEQ ID NO: 7164461 - DNA, 22 bp, Homo sapiens
aagcaaatgaaccagaggtaat

SEQ ID NO: 7164462 - DNA, 22 bp, Homo sapiens
aagcaaatgaaccagaggtaat

SEQ ID NO: 7164463 - DNA, 22 bp, Homo sapiens
aagcaaatgtgggtgcagaatt

SEQ ID NO: 7164464 - DNA, 22 bp, Homo sapiens
aagcaaattctggaggtgaggt

SEQ ID NO: 7164465 - DNA, 22 bp, Homo sapiens
aagcaaattctggaggtgaggt

SEQ ID NO: 7164466 - DNA, 22 bp, Homo sapiens
aagcaaattctggaggtgaggt

SEQ ID NO: 7164467 - DNA, 22 bp, Homo sapiens
aagcaaattggatgtctgtgag

SEQ ID NO: 7164468 - DNA, 22 bp, Homo sapiens
aagcaaattggatgtctgtgag

SEQ ID NO: 7164469 - DNA, 22 bp, Homo sapiens
aagcaacagaaacattctaata

SEQ ID NO: 7164470 - DNA, 22 bp, Homo sapiens
aagcaaagagataaccttttgg

SEQ ID NO: 7164471 - DNA, 22 bp, Homo sapiens
aagcaaagagtttagtgggtga

SEQ ID NO: 7164472 - DNA, 22 bp, Homo sapiens
aagcaaaggaaagctgactttt

SEQ ID NO: 7164473 - DNA, 22 bp, Homo sapiens
aagcaaaggaaagctgactttt

SEQ ID NO: 7164474 - DNA, 22 bp, Homo sapiens
aagcaaaggcaggagcttgtga

SEQ ID NO: 7164475 - DNA, 22 bp, Homo sapiens
aagcaaagtgaattttgccaag

SEQ ID NO: 7164476 - DNA, 22 bp, Homo sapiens
aagcaaagtgaattttgccaag

SEQ ID NO: 7164477 - DNA, 22 bp, Homo sapiens
aagcaaagtgctttgcctccag

SEQ ID NO: 7164478 - DNA, 22 bp, Homo sapiens
aagaggagacttcagcaacttg

SEQ ID NO: 7164479 - DNA, 22 bp, Homo sapiens
aagaggagacttcagcaacttg

SEQ ID NO: 7164480 - DNA, 22 bp, Homo sapiens
aagaggagacttcagcaacttg

SEQ ID NO: 7164481 - DNA, 22 bp, Homo sapiens
aagaggagacttcagcaacttg

SEQ ID NO: 7164482 - DNA, 18 bp, Homo sapiens
aagaggaggaaacccagg

SEQ ID NO: 7164483 - DNA, 18 bp, Homo sapiens
aagaggaggaaacccagg

SEQ ID NO: 7164484 - DNA, 18 bp, Homo sapiens
aagaggaggaaacccagg

SEQ ID NO: 7164485 - DNA, 22 bp, Homo sapiens
aagaggaggacggttcccagaa

SEQ ID NO: 7164486 - DNA, 22 bp, Homo sapiens
aagaggaggacggttcccagaa

SEQ ID NO: 7164487 - DNA, 22 bp, Homo sapiens
aagattctccctgagatattta

SEQ ID NO: 7164488 - DNA, 22 bp, Homo sapiens
aagattctcagagtgaaagaat

SEQ ID NO: 7164489 - DNA, 22 bp, Homo sapiens
aagattctcagagtgaaagaat

SEQ ID NO: 7164490 - DNA, 18 bp, Homo sapiens
aagaggaggagcaggttg

SEQ ID NO: 7164491 - DNA, 18 bp, Homo sapiens
aagaggaggagcaggttg

SEQ ID NO: 7164492 - DNA, 18 bp, Homo sapiens
aagaggaggagcaggttg

SEQ ID NO: 7164493 - DNA, 22 bp, Homo sapiens
aaatatcatttataacttttaa

SEQ ID NO: 7164494 - DNA, 22 bp, Homo sapiens
aaatatcattctggtgcacaga

SEQ ID NO: 7164495 - DNA, 22 bp, Homo sapiens
aaatatcattctggtgcacaga

SEQ ID NO: 7164496 - DNA, 22 bp, Homo sapiens
aaatatcattctggtgcacaga

SEQ ID NO: 7164497 - DNA, 22 bp, Homo sapiens
aaatatcattctggtgcacaga

SEQ ID NO: 7164498 - DNA, 22 bp, Homo sapiens
aaatatcattctggtgcacaga

SEQ ID NO: 7164499 - DNA, 22 bp, Homo sapiens
aaatatcattctggtgcacaga

SEQ ID NO: 7164500 - DNA, 22 bp, Homo sapiens
aaatatcattctggtgcacaga

SEQ ID NO: 7164501 - DNA, 22 bp, Homo sapiens
aagcaactccctcctcattttt

SEQ ID NO: 7164502 - DNA, 22 bp, Homo sapiens
aagcaactaaggcaaggaaatg

SEQ ID NO: 7164503 - DNA, 22 bp, Homo sapiens
aagcaactcctaggaggaaagg

SEQ ID NO: 7164504 - DNA, 22 bp, Homo sapiens
aagcaacattctctgtggcatt

SEQ ID NO: 7164505 - DNA, 22 bp, Homo sapiens
aagcaactaaggcaaggaaatg

SEQ ID NO: 7164506 - DNA, 19 bp, Homo sapiens
aaatatcagagagatgata

SEQ ID NO: 7164507 - DNA, 22 bp, Homo sapiens
aagcaagacagaagttactgcc

SEQ ID NO: 7164508 - DNA, 22 bp, Homo sapiens
aagcacctgggttatatcttag

SEQ ID NO: 7164509 - DNA, 22 bp, Homo sapiens
aagcaccttccagatttgcacg

SEQ ID NO: 7164510 - DNA, 22 bp, Homo sapiens
aagcacctgggttatatcttag

SEQ ID NO: 7164511 - DNA, 22 bp, Homo sapiens
aagcacctgggttatatcttag

SEQ ID NO: 7164512 - DNA, 22 bp, Homo sapiens
aagcacctgcaccggtcgcctt

SEQ ID NO: 7164513 - DNA, 22 bp, Homo sapiens
aagcacctgcagttgacaaaaa

SEQ ID NO: 7164514 - DNA, 22 bp, Homo sapiens
aagcacctgcagttgacaaaaa

SEQ ID NO: 7164515 - DNA, 22 bp, Homo sapiens
aagcacctgcagttgacaaaaa

SEQ ID NO: 7164516 - DNA, 22 bp, Homo sapiens
aagcacagctggaacagcagga

SEQ ID NO: 7164517 - DNA, 22 bp, Homo sapiens
aaatatgactagaatgccaggt

SEQ ID NO: 7164518 - DNA, 22 bp, Homo sapiens
aaatatgactagaatgccaggt

SEQ ID NO: 7164519 - DNA, 22 bp, Homo sapiens
aaatatgaatgataagagttat

SEQ ID NO: 7164520 - DNA, 17 bp, Homo sapiens
aaatatgacctcaaagt

SEQ ID NO: 7164521 - DNA, 22 bp, Homo sapiens
aaatatgaatgataagagttat

SEQ ID NO: 7164522 - DNA, 22 bp, Homo sapiens
aaatatgaatgataagagttat

SEQ ID NO: 7164523 - DNA, 22 bp, Homo sapiens
aaatatgaatgataagagttat

SEQ ID NO: 7164524 - DNA, 22 bp, Homo sapiens
aaatatcttaggagtatatgag

SEQ ID NO: 7164525 - DNA, 22 bp, Homo sapiens
aaatatcatttataacttttaa

SEQ ID NO: 7164526 - DNA, 22 bp, Homo sapiens
aaatatcctcagggcagaggtg

SEQ ID NO: 7164527 - DNA, 22 bp, Homo sapiens
aaatatcttaggagtatatgag

SEQ ID NO: 7164528 - DNA, 22 bp, Homo sapiens
aactcagtgtgtttcttagtat

SEQ ID NO: 7164529 - DNA, 22 bp, Homo sapiens
aactcaggagaatggagggtat

SEQ ID NO: 7164530 - DNA, 22 bp, Homo sapiens
aactcagcatcagtgtccagaa

SEQ ID NO: 7164531 - DNA, 22 bp, Homo sapiens
aactcagcatcctgcacagaga

SEQ ID NO: 7164532 - DNA, 22 bp, Homo sapiens
aactcactttgtggcttctgaa

SEQ ID NO: 7164533 - DNA, 22 bp, Homo sapiens
aactcagacatgtataaagact

SEQ ID NO: 7164534 - DNA, 20 bp, Homo sapiens
aactcagagatgaaaaagac

SEQ ID NO: 7164535 - DNA, 22 bp, Homo sapiens
aactgaaagtttcacctgaggt

SEQ ID NO: 7164536 - DNA, 22 bp, Homo sapiens
aactgaaatcaatcagtgattc

SEQ ID NO: 7164537 - DNA, 22 bp, Homo sapiens
aactgaaatcaatcagtgattc

SEQ ID NO: 7164538 - DNA, 22 bp, Homo sapiens
aactgacagcaggaaccattcc

SEQ ID NO: 7164539 - DNA, 22 bp, Homo sapiens
aactgagacacgaactatgatt

SEQ ID NO: 7164540 - DNA, 22 bp, Homo sapiens
aacttgctggcacgtgtatgga

SEQ ID NO: 7164541 - DNA, 22 bp, Homo sapiens
aacttgcttatattattacatt

SEQ ID NO: 7164542 - DNA, 22 bp, Homo sapiens
aacttgcttcaacttatttcac

SEQ ID NO: 7164543 - DNA, 22 bp, Homo sapiens
aacttgcttcaacttatttcac

SEQ ID NO: 7164544 - DNA, 22 bp, Homo sapiens
aactgatttcaagttcagtttc

SEQ ID NO: 7164545 - DNA, 22 bp, Homo sapiens
aacttgatcctgctgggtacta

SEQ ID NO: 7164546 - DNA, 22 bp, Homo sapiens
aactgattgttggatgatagtg

SEQ ID NO: 7164547 - DNA, 22 bp, Homo sapiens
aactgagttataactagaggta

SEQ ID NO: 7164548 - DNA, 22 bp, Homo sapiens
aactgataatggacacataaaa

SEQ ID NO: 7164549 - DNA, 22 bp, Homo sapiens
aactgaggccaagtgaggaaag

SEQ ID NO: 7164550 - DNA, 22 bp, Homo sapiens
aactgaggccaagtgaggaaag

SEQ ID NO: 7164551 - DNA, 22 bp, Homo sapiens
aactgagattacaagagacatt

SEQ ID NO: 7164552 - DNA, 22 bp, Homo sapiens
aactgagcccctgcacttgtga

SEQ ID NO: 7164553 - DNA, 20 bp, Homo sapiens
aactgagagttcaggaggag

SEQ ID NO: 7164554 - DNA, 22 bp, Homo sapiens
aactgagattacaagagacatt

SEQ ID NO: 7164555 - DNA, 22 bp, Homo sapiens
aactgagattacaagagacatt

SEQ ID NO: 7164556 - DNA, 22 bp, Homo sapiens
aactaatacattaatacatgtg

SEQ ID NO: 7164557 - DNA, 22 bp, Homo sapiens
aacatttgtgtttgctaaaaat

SEQ ID NO: 7164558 - DNA, 21 bp, Homo sapiens
aacatttggctggcttttgtg

SEQ ID NO: 7164559 - DNA, 23 bp, Homo sapiens
aacatttgtaaggtgattttgtt

SEQ ID NO: 7164560 - DNA, 22 bp, Homo sapiens
aacatttgtactaaagaagttc

SEQ ID NO: 7164561 - DNA, 20 bp, Homo sapiens
aacatttgtagtcaggcaca

SEQ ID NO: 7164562 - DNA, 22 bp, Homo sapiens
aacatttgtgaagtacttagat

SEQ ID NO: 7164563 - DNA, 22 bp, Homo sapiens
aacatttgaaaatcaagaatct

SEQ ID NO: 7164564 - DNA, 22 bp, Homo sapiens
aacatttgagaaaaatactctt

SEQ ID NO: 7164565 - DNA, 22 bp, Homo sapiens
aacatttgcagaggaaagctat

SEQ ID NO: 7164566 - DNA, 22 bp, Homo sapiens
aacatttgcagaggaaagctat

SEQ ID NO: 7164567 - DNA, 22 bp, Homo sapiens
aacatttgcatgctttattaga

SEQ ID NO: 7164568 - DNA, 22 bp, Homo sapiens
aacatttgcgagtgggtttggg

SEQ ID NO: 7164569 - DNA, 22 bp, Homo sapiens
aactcactttgtggcttctgaa

SEQ ID NO: 7164570 - DNA, 22 bp, Homo sapiens
aactcactttgtggcttctgaa

SEQ ID NO: 7164571 - DNA, 22 bp, Homo sapiens
aactcactttgtggcttctgaa

SEQ ID NO: 7164572 - DNA, 22 bp, Homo sapiens
aactcactttgtggcttctgaa

SEQ ID NO: 7164573 - DNA, 22 bp, Homo sapiens
aactcactttgtggcttctgaa

SEQ ID NO: 7164574 - DNA, 22 bp, Homo sapiens
aactcacacaagtattgcctgc

SEQ ID NO: 7164575 - DNA, 22 bp, Homo sapiens
aactcacacaagtattgcctgc

SEQ ID NO: 7164576 - DNA, 22 bp, Homo sapiens
aactcacagctgtttggattag

SEQ ID NO: 7164577 - DNA, 22 bp, Homo sapiens
aactcacagctgtttggattag

SEQ ID NO: 7164578 - DNA, 22 bp, Homo sapiens
aactcaaagatgcatgacgctt

SEQ ID NO: 7164579 - DNA, 22 bp, Homo sapiens
aactcaaagatgcatgacgctt

SEQ ID NO: 7164580 - DNA, 22 bp, Homo sapiens
aactcaaagatgcatgacgctt

SEQ ID NO: 7164581 - DNA, 22 bp, Homo sapiens
aactcaaagatgcatgacgctt

SEQ ID NO: 7164582 - DNA, 22 bp, Homo sapiens
aactattcaccaccttgtggta

SEQ ID NO: 7164583 - DNA, 22 bp, Homo sapiens
aactatgttaataagtttcatt

SEQ ID NO: 7164584 - DNA, 22 bp, Homo sapiens
aactatgttaataagtttcatt

SEQ ID NO: 7164585 - DNA, 20 bp, Homo sapiens
aactatgaatagaagagatt

SEQ ID NO: 7164586 - DNA, 22 bp, Homo sapiens
aactatgagagcccagcgaagg

SEQ ID NO: 7164587 - DNA, 22 bp, Homo sapiens
aactatataatctgaaagtgaa

SEQ ID NO: 7164588 - DNA, 22 bp, Homo sapiens
aacattcaagttctggtttatg

SEQ ID NO: 7164589 - DNA, 22 bp, Homo sapiens
aacattcaattgaggaagttaa

SEQ ID NO: 7164590 - DNA, 22 bp, Homo sapiens
aacattcaattgaggaagttaa

SEQ ID NO: 7164591 - DNA, 22 bp, Homo sapiens
aacattcacctctacctccttc

SEQ ID NO: 7164592 - DNA, 22 bp, Homo sapiens
aacattcacctctacctccttc

SEQ ID NO: 7164593 - DNA, 22 bp, Homo sapiens
aacattcacctctacctccttc

SEQ ID NO: 7164594 - DNA, 22 bp, Homo sapiens
aacattcaaaacccagttcagt

SEQ ID NO: 7164595 - DNA, 22 bp, Homo sapiens
aacattcaaaacccagttcagt

SEQ ID NO: 7164596 - DNA, 22 bp, Homo sapiens
aacattcaaaacccagttcagt

SEQ ID NO: 7164597 - DNA, 21 bp, Homo sapiens
aacattagtaatttgactttt

SEQ ID NO: 7164598 - DNA, 22 bp, Homo sapiens
aacatgcaaagctatgatgtat

SEQ ID NO: 7164599 - DNA, 22 bp, Homo sapiens
aacatgcaatgtctgaaaatcc

SEQ ID NO: 7164600 - DNA, 22 bp, Homo sapiens
aacatgcaatgtctgaaaatcc

SEQ ID NO: 7164601 - DNA, 22 bp, Homo sapiens
aacatgcaatgtctgaaaatcc

SEQ ID NO: 7164602 - DNA, 22 bp, Homo sapiens
aacatgcacaattttaggcctg

SEQ ID NO: 7164603 - DNA, 22 bp, Homo sapiens
aacatgcacatcatagctcgtg

SEQ ID NO: 7164604 - DNA, 22 bp, Homo sapiens
aacattagatttgtttttctag

SEQ ID NO: 7164605 - DNA, 22 bp, Homo sapiens
aacattcagctgggtggagcag

SEQ ID NO: 7164606 - DNA, 22 bp, Homo sapiens
aacattctactgtactgcattg

SEQ ID NO: 7164607 - DNA, 22 bp, Homo sapiens
aacattctatgtgcattcagaa

SEQ ID NO: 7164608 - DNA, 22 bp, Homo sapiens
aacattctattttgctaaaaca

SEQ ID NO: 7164609 - DNA, 22 bp, Homo sapiens
aacattctggttctaaaaacct

SEQ ID NO: 7164610 - DNA, 22 bp, Homo sapiens
aacagtcctgtgctctttcatt

SEQ ID NO: 7164611 - DNA, 22 bp, Homo sapiens
aacagtcacattgttcaacttt

SEQ ID NO: 7164612 - DNA, 22 bp, Homo sapiens
aacagtcttacagaagtagcca

SEQ ID NO: 7164613 - DNA, 22 bp, Homo sapiens
aacagtcttacagaagtagcca

SEQ ID NO: 7164614 - DNA, 22 bp, Homo sapiens
aacagtcttcctacggccatta

SEQ ID NO: 7164615 - DNA, 22 bp, Homo sapiens
aacagtcttggaagtcttgtta

SEQ ID NO: 7164616 - DNA, 22 bp, Homo sapiens
aacagtcttggaagtcttgtta

SEQ ID NO: 7164617 - DNA, 22 bp, Homo sapiens
aacagtgagaaggtggacagga

SEQ ID NO: 7164618 - DNA, 22 bp, Homo sapiens
aacagtgagaaggtggacagga

SEQ ID NO: 7164619 - DNA, 22 bp, Homo sapiens
aacagtatggaagccattagga

SEQ ID NO: 7164620 - DNA, 22 bp, Homo sapiens
aacagtatgtgagatttacaca

SEQ ID NO: 7164621 - DNA, 22 bp, Homo sapiens
aacagtatgtgagatttacaca

SEQ ID NO: 7164622 - DNA, 22 bp, Homo sapiens
aacagtcaaagtttggttcctt

SEQ ID NO: 7164623 - DNA, 22 bp, Homo sapiens
aacagtatcttttatcagaaat

SEQ ID NO: 7164624 - DNA, 22 bp, Homo sapiens
aacagtatcttttatcagaaat

SEQ ID NO: 7164625 - DNA, 22 bp, Homo sapiens
aacaggaaaacagcacaatagc

SEQ ID NO: 7164626 - DNA, 22 bp, Homo sapiens
aacaggaactatttgtattcca

SEQ ID NO: 7164627 - DNA, 22 bp, Homo sapiens
aacaggaactatttgtattcca

SEQ ID NO: 7164628 - DNA, 22 bp, Homo sapiens
aacaggaatgaggagaaaaggt

SEQ ID NO: 7164629 - DNA, 22 bp, Homo sapiens
aacagtaatggcattgccatga

SEQ ID NO: 7164630 - DNA, 22 bp, Homo sapiens
aacagtaatggcattgccatga

SEQ ID NO: 7164631 - DNA, 22 bp, Homo sapiens
aacagtaatgtggtgttgggtt

SEQ ID NO: 7164632 - DNA, 22 bp, Homo sapiens
aacagtaatttgcggtttttgc

SEQ ID NO: 7164633 - DNA, 22 bp, Homo sapiens
aacagtacaactccacaagact

SEQ ID NO: 7164634 - DNA, 22 bp, Homo sapiens
aacagtactggacaaggagtca

SEQ ID NO: 7164635 - DNA, 22 bp, Homo sapiens
aacagtactggacaaggagtca

SEQ ID NO: 7164636 - DNA, 22 bp, Homo sapiens
aacagtagtggtcaatatgcca

SEQ ID NO: 7164637 - DNA, 22 bp, Homo sapiens
aacagtatatgaaatgttagga

SEQ ID NO: 7164638 - DNA, 22 bp, Homo sapiens
aacagtatatgaaatgttagga

SEQ ID NO: 7164639 - DNA, 22 bp, Homo sapiens
aacagtatatgaaatgttagga

SEQ ID NO: 7164640 - DNA, 22 bp, Homo sapiens
aacaagaagggaaggcatgatt

SEQ ID NO: 7164641 - DNA, 22 bp, Homo sapiens
aacaagaataagtggtttctgg

SEQ ID NO: 7164642 - DNA, 22 bp, Homo sapiens
aacaagaataagtggtttctgg

SEQ ID NO: 7164643 - DNA, 22 bp, Homo sapiens
aacaagaagggaaggcatgatt

SEQ ID NO: 7164644 - DNA, 22 bp, Homo sapiens
aacaacttgcgttcagagatgt

SEQ ID NO: 7164645 - DNA, 22 bp, Homo sapiens
aacaacttgcgttcagagatgt

SEQ ID NO: 7164646 - DNA, 22 bp, Homo sapiens
aacaagaacacctacagttcta

SEQ ID NO: 7164647 - DNA, 22 bp, Homo sapiens
aacaagaacacctacagttcta

SEQ ID NO: 7164648 - DNA, 22 bp, Homo sapiens
aacaagaacacctacagttcta

SEQ ID NO: 7164649 - DNA, 22 bp, Homo sapiens
aacaagaacacctacagttcta

SEQ ID NO: 7164650 - DNA, 22 bp, Homo sapiens
aacaagaagagagggacgtaat

SEQ ID NO: 7164651 - DNA, 23 bp, Homo sapiens
aacacaaagctgattccagtggc

SEQ ID NO: 7164652 - DNA, 23 bp, Homo sapiens
aacacaaagctgattccagtggc

SEQ ID NO: 7164653 - DNA, 22 bp, Homo sapiens
aacacaaagaagctgcaggatc

SEQ ID NO: 7164654 - DNA, 22 bp, Homo sapiens
aacacaaagaagctgcaggatc

SEQ ID NO: 7164655 - DNA, 22 bp, Homo sapiens
aacacaaagaagctgcaggatc

SEQ ID NO: 7164656 - DNA, 23 bp, Homo sapiens
aacacaaagctgattccagtggc

SEQ ID NO: 7164657 - DNA, 22 bp, Homo sapiens
aacacataggcagagcatgaca

SEQ ID NO: 7164658 - DNA, 22 bp, Homo sapiens
aacacataggcagagcatgaca

SEQ ID NO: 7164659 - DNA, 22 bp, Homo sapiens
aacacaaagaagctgcaggatc

SEQ ID NO: 7164660 - DNA, 22 bp, Homo sapiens
aacacaaaaattctcaggggca

SEQ ID NO: 7164661 - DNA, 22 bp, Homo sapiens
aacacaaagaagctgcaggatc

SEQ ID NO: 7164662 - DNA, 22 bp, Homo sapiens
aacacaaagaagctgcaggatc

SEQ ID NO: 7164663 - DNA, 22 bp, Homo sapiens
aacacaaagaagctgcaggatc

SEQ ID NO: 7164664 - DNA, 22 bp, Homo sapiens
aacaattatcatatacattgca

SEQ ID NO: 7164665 - DNA, 22 bp, Homo sapiens
aacaattatcatatacattgca

SEQ ID NO: 7164666 - DNA, 22 bp, Homo sapiens
aacaattatcatatacattgca

SEQ ID NO: 7164667 - DNA, 22 bp, Homo sapiens
aacacaaaaattctcaggggca

SEQ ID NO: 7164668 - DNA, 22 bp, Homo sapiens
aacagcttttttggtcagcatt

SEQ ID NO: 7164669 - DNA, 22 bp, Homo sapiens
aacagcttttttggtcagcatt

SEQ ID NO: 7164670 - DNA, 22 bp, Homo sapiens
aacagctttgtgctcagatttg

SEQ ID NO: 7164671 - DNA, 22 bp, Homo sapiens
aacagctttgtatacagtaact

SEQ ID NO: 7164672 - DNA, 22 bp, Homo sapiens
aacagctttgtatacagtaact

SEQ ID NO: 7164673 - DNA, 22 bp, Homo sapiens
aacagctttgtatacagtaact

SEQ ID NO: 7164674 - DNA, 22 bp, Homo sapiens
aacagctttgtatacagtaact

SEQ ID NO: 7164675 - DNA, 22 bp, Homo sapiens
aacagctttgcttctggagaca

SEQ ID NO: 7164676 - DNA, 22 bp, Homo sapiens
aacagctttgcttctggagaca

SEQ ID NO: 7164677 - DNA, 22 bp, Homo sapiens
aacagctttgagcagttctgta

SEQ ID NO: 7164678 - DNA, 22 bp, Homo sapiens
aacagctttgagcagttctgta

SEQ ID NO: 7164679 - DNA, 22 bp, Homo sapiens
aacagctttagaggataatagt

SEQ ID NO: 7164680 - DNA, 22 bp, Homo sapiens
aacagcttgctgcaccttaata

SEQ ID NO: 7164681 - DNA, 22 bp, Homo sapiens
aacagcagctgaggagctgggc

SEQ ID NO: 7164682 - DNA, 22 bp, Homo sapiens
aacagcagcatgacagctgggt

SEQ ID NO: 7164683 - DNA, 22 bp, Homo sapiens
aacagcagctgaggagctgggc

SEQ ID NO: 7164684 - DNA, 22 bp, Homo sapiens
aacagcagctgaggagctgggc

SEQ ID NO: 7164685 - DNA, 22 bp, Homo sapiens
aacagcagctgaggagctgggc

SEQ ID NO: 7164686 - DNA, 22 bp, Homo sapiens
aacacatatttatatatgcaca

SEQ ID NO: 7164687 - DNA, 22 bp, Homo sapiens
aacacatatttatatatgcaca

SEQ ID NO: 7164688 - DNA, 22 bp, Homo sapiens
aacacatatttatatatgcaca

SEQ ID NO: 7164689 - DNA, 22 bp, Homo sapiens
aacacatatttatatatgcaca

SEQ ID NO: 7164690 - DNA, 22 bp, Homo sapiens
aacacatatttatatatgcaca

SEQ ID NO: 7164691 - DNA, 22 bp, Homo sapiens
aacacatatttttgctgagcat

SEQ ID NO: 7164692 - DNA, 21 bp, Homo sapiens
aacacatccagagtatttgac

SEQ ID NO: 7164693 - DNA, 22 bp, Homo sapiens
aacacatgaaagttggtgagta

SEQ ID NO: 7164694 - DNA, 22 bp, Homo sapiens
aacacatgaaagttggtgagta

SEQ ID NO: 7164695 - DNA, 22 bp, Homo sapiens
aacacatgccttaagaataagt

SEQ ID NO: 7164696 - DNA, 22 bp, Homo sapiens
aacacatgccttaagaataagt

SEQ ID NO: 7164697 - DNA, 22 bp, Homo sapiens
aacacatgccttaagaataagt

SEQ ID NO: 7164698 - DNA, 22 bp, Homo sapiens
aacacatggcaagagcaggaaa

SEQ ID NO: 7164699 - DNA, 22 bp, Homo sapiens
aacacatggcaagagcaggaaa

SEQ ID NO: 7164700 - DNA, 22 bp, Homo sapiens
aacacatggcaagagcaggaaa

SEQ ID NO: 7164701 - DNA, 22 bp, Homo sapiens
aacacatgggtgtttattgtac

SEQ ID NO: 7164702 - DNA, 22 bp, Homo sapiens
aacacatgggtgtttattgtac

SEQ ID NO: 7164703 - DNA, 22 bp, Homo sapiens
aacacatgggtgtttattgtac

SEQ ID NO: 7164704 - DNA, 23 bp, Homo sapiens
aacacattgctaattacattcaa

SEQ ID NO: 7164705 - DNA, 23 bp, Homo sapiens
aacacattgctaattacattcaa

SEQ ID NO: 7164706 - DNA, 22 bp, Homo sapiens
aaagcaatgggtctaaggtaaa

SEQ ID NO: 7164707 - DNA, 22 bp, Homo sapiens
aaagcaatggcacatgatggta

SEQ ID NO: 7164708 - DNA, 22 bp, Homo sapiens
aaagcaatggcacatgatggta

SEQ ID NO: 7164709 - DNA, 22 bp, Homo sapiens
aaagcaatggcacatgatggta

SEQ ID NO: 7164710 - DNA, 22 bp, Homo sapiens
aaagcaatagagggtaagactg

SEQ ID NO: 7164711 - DNA, 22 bp, Homo sapiens
aaagcaatagagggtaagactg

SEQ ID NO: 7164712 - DNA, 21 bp, Homo sapiens
aaatggtctcaagtgtttcat

SEQ ID NO: 7164713 - DNA, 22 bp, Homo sapiens
aaatggtgaagtgtaatttagc

SEQ ID NO: 7164714 - DNA, 22 bp, Homo sapiens
aaatggtgagggaattgaacag

SEQ ID NO: 7164715 - DNA, 22 bp, Homo sapiens
aaatggtgagggaattgaacag

SEQ ID NO: 7164716 - DNA, 22 bp, Homo sapiens
aaatggtgctactaggagtcag

SEQ ID NO: 7164717 - DNA, 22 bp, Homo sapiens
aaatggtgctactaggagtcag

SEQ ID NO: 7164718 - DNA, 22 bp, Homo sapiens
aaagcaagtctctacaaagtac

SEQ ID NO: 7164719 - DNA, 22 bp, Homo sapiens
aaagcaagtctctacaaagtac

SEQ ID NO: 7164720 - DNA, 22 bp, Homo sapiens
aaagcaagtctctacaaagtac

SEQ ID NO: 7164721 - DNA, 22 bp, Homo sapiens
aaagcaatagagggtaagactg

SEQ ID NO: 7164722 - DNA, 22 bp, Homo sapiens
aaagcaatgggtctaaggtaaa

SEQ ID NO: 7164723 - DNA, 22 bp, Homo sapiens
aaagcaatgggtctaaggtaaa

SEQ ID NO: 7164724 - DNA, 22 bp, Homo sapiens
aaagcaatgtctctgcctggtt

SEQ ID NO: 7164725 - DNA, 22 bp, Homo sapiens
aaagcaatgtctctgcctggtt

SEQ ID NO: 7164726 - DNA, 22 bp, Homo sapiens
aaagcaatgtctctgcctggtt

SEQ ID NO: 7164727 - DNA, 22 bp, Homo sapiens
aaagcaattacaaaagggataa

SEQ ID NO: 7164728 - DNA, 22 bp, Homo sapiens
aaagcaattacaaaagggataa

SEQ ID NO: 7164729 - DNA, 22 bp, Homo sapiens
aaagcaattgtggtttttgcca

SEQ ID NO: 7164730 - DNA, 22 bp, Homo sapiens
aaagcaattgtggtttttgcca

SEQ ID NO: 7164731 - DNA, 22 bp, Homo sapiens
aaagcaattgtggtttttgtca

SEQ ID NO: 7164732 - DNA, 22 bp, Homo sapiens
aaatgggtttgattctcagcca

SEQ ID NO: 7164733 - DNA, 22 bp, Homo sapiens
aaatgggcctggaaagaggatg

SEQ ID NO: 7164734 - DNA, 22 bp, Homo sapiens
aaatggctttgagggtaggaca

SEQ ID NO: 7164735 - DNA, 22 bp, Homo sapiens
aaatggctgcatttgtgtaaat

SEQ ID NO: 7164736 - DNA, 16 bp, Homo sapiens
aaatggcttaggctta

SEQ ID NO: 7164737 - DNA, 23 bp, Homo sapiens
aaatggcttgccctctcgtttgg

SEQ ID NO: 7164738 - DNA, 23 bp, Homo sapiens
aaatggctttagacgtgccttat

SEQ ID NO: 7164739 - DNA, 23 bp, Homo sapiens
aaatggctttagacgtgccttat

SEQ ID NO: 7164740 - DNA, 19 bp, Homo sapiens
aaatggctttctacttaat

SEQ ID NO: 7164741 - DNA, 19 bp, Homo sapiens
aaatggctttctacttaat

SEQ ID NO: 7164742 - DNA, 20 bp, Homo sapiens
aaatggcctcagataagcag

SEQ ID NO: 7164743 - DNA, 22 bp, Homo sapiens
aaatggctacaagatgtgctct

SEQ ID NO: 7164744 - DNA, 18 bp, Homo sapiens
aaatggctacctttgtca

SEQ ID NO: 7164745 - DNA, 18 bp, Homo sapiens
aaatggctacctttgtca

SEQ ID NO: 7164746 - DNA, 22 bp, Homo sapiens
aaatggctccagttgacttttt

SEQ ID NO: 7164747 - DNA, 22 bp, Homo sapiens
aaatggctccagttgacttttt

SEQ ID NO: 7164748 - DNA, 22 bp, Homo sapiens
aaatggctgactaaattaaatt

SEQ ID NO: 7164749 - DNA, 22 bp, Homo sapiens
aaatggctgacttttcatggga

SEQ ID NO: 7164750 - DNA, 22 bp, Homo sapiens
aaatggtaagacaacacattat

SEQ ID NO: 7164751 - DNA, 22 bp, Homo sapiens
aaatggtaccctaatggccaga

SEQ ID NO: 7164752 - DNA, 22 bp, Homo sapiens
aaatggtaccctaatggccaga

SEQ ID NO: 7164753 - DNA, 22 bp, Homo sapiens
aaatggtagtagcattccatat

SEQ ID NO: 7164754 - DNA, 22 bp, Homo sapiens
aaatggtataatgtcatgtatt

SEQ ID NO: 7164755 - DNA, 22 bp, Homo sapiens
aaatggtatgaaaagagatttc

SEQ ID NO: 7164756 - DNA, 22 bp, Homo sapiens
aaatggtccatcctaaagaagt

SEQ ID NO: 7164757 - DNA, 22 bp, Homo sapiens
aacaaatttagctctgagtgct

SEQ ID NO: 7164758 - DNA, 22 bp, Homo sapiens
aaagcactcggcttcatccagg

SEQ ID NO: 7164759 - DNA, 22 bp, Homo sapiens
aacaaatgtgttttgtaattaa

SEQ ID NO: 7164760 - DNA, 22 bp, Homo sapiens
aacaaatgtgttttgtaattaa

SEQ ID NO: 7164761 - DNA, 22 bp, Homo sapiens
aacaaatgtgttttgtaattaa

SEQ ID NO: 7164762 - DNA, 22 bp, Homo sapiens
aacaaattagttgcaagactgg

SEQ ID NO: 7164763 - DNA, 22 bp, Homo sapiens
aacaaattagttgcaagactgg

SEQ ID NO: 7164764 - DNA, 22 bp, Homo sapiens
aacaacaacggagaaagggttg

SEQ ID NO: 7164765 - DNA, 22 bp, Homo sapiens
aacaacagctgctaaagagttg

SEQ ID NO: 7164766 - DNA, 22 bp, Homo sapiens
aacaacagctgctaaagagttg

SEQ ID NO: 7164767 - DNA, 22 bp, Homo sapiens
aacaacagctgctaaagagttg

SEQ ID NO: 7164768 - DNA, 22 bp, Homo sapiens
aacaacagctgctaaagagttg

SEQ ID NO: 7164769 - DNA, 22 bp, Homo sapiens
aacaaccaaaaagatgaatgta

SEQ ID NO: 7164770 - DNA, 22 bp, Homo sapiens
aacaacttgcgttcagagatgt

SEQ ID NO: 7164771 - DNA, 22 bp, Homo sapiens
aaagcacatagtagaaggattt

SEQ ID NO: 7164772 - DNA, 22 bp, Homo sapiens
aaagcacatgagtagtgtagta

SEQ ID NO: 7164773 - DNA, 22 bp, Homo sapiens
aaagcacatgagtagtgtagta

SEQ ID NO: 7164774 - DNA, 22 bp, Homo sapiens
aaagcacatgagtagtgtagta

SEQ ID NO: 7164775 - DNA, 22 bp, Homo sapiens
aaagcacatgagtagtgtagta

SEQ ID NO: 7164776 - DNA, 22 bp, Homo sapiens
aaagcacattacaagctcagtc

SEQ ID NO: 7164777 - DNA, 22 bp, Homo sapiens
aaagcacattacaagctcagtc

SEQ ID NO: 7164778 - DNA, 22 bp, Homo sapiens
aaagcactatagccaaatagcc

SEQ ID NO: 7164779 - DNA, 22 bp, Homo sapiens
aaagcaattgtggtttttgtca

SEQ ID NO: 7164780 - DNA, 22 bp, Homo sapiens
aaagcaattgtggtttttgtca

SEQ ID NO: 7164781 - DNA, 22 bp, Homo sapiens
aaagcaatttaatggaccatga

SEQ ID NO: 7164782 - DNA, 22 bp, Homo sapiens
aaagcaatttaatggaccatga

SEQ ID NO: 7164783 - DNA, 22 bp, Homo sapiens
aaagcacagagctcccacagga

SEQ ID NO: 7164784 - DNA, 22 bp, Homo sapiens
aaagcacagagctcccacagga

SEQ ID NO: 7164785 - DNA, 22 bp, Homo sapiens
aaagcacaggagagttcagtaa

SEQ ID NO: 7164786 - DNA, 22 bp, Homo sapiens
aaagcacagggtgctagagagt

SEQ ID NO: 7164787 - DNA, 22 bp, Homo sapiens
aaagcacagggtgctagagagt

SEQ ID NO: 7164788 - DNA, 22 bp, Homo sapiens
aaagcacagggtgctagagagt

SEQ ID NO: 7164789 - DNA, 22 bp, Homo sapiens
aaagcacagggtgctagagagt

SEQ ID NO: 7164790 - DNA, 22 bp, Homo sapiens
aaagcacagggtgctagagagt

SEQ ID NO: 7164791 - DNA, 22 bp, Homo sapiens
aaagcacatagtagaaggattt

SEQ ID NO: 7164792 - DNA, 22 bp, Homo sapiens
aaagcacatagtagaaggattt

SEQ ID NO: 7164793 - DNA, 22 bp, Homo sapiens
aaggggcatgcttttgccagga

SEQ ID NO: 7164794 - DNA, 22 bp, Homo sapiens
aaggggcatgcttttgccagga

SEQ ID NO: 7164795 - DNA, 22 bp, Homo sapiens
aaggggcctcacagatgggctt

SEQ ID NO: 7164796 - DNA, 22 bp, Homo sapiens
aaggggctcttgtcaggcgcag

SEQ ID NO: 7164797 - DNA, 22 bp, Homo sapiens
aaggggcctcacagatgggctt

SEQ ID NO: 7164798 - DNA, 21 bp, Homo sapiens
aaggggcaaacccaggacacc

SEQ ID NO: 7164799 - DNA, 21 bp, Homo sapiens
aaggggcaaacccaggacacc

SEQ ID NO: 7164800 - DNA, 21 bp, Homo sapiens
aaggggcaaacccaggacacc

SEQ ID NO: 7164801 - DNA, 22 bp, Homo sapiens
aaggggagatgtcatgggccct

SEQ ID NO: 7164802 - DNA, 22 bp, Homo sapiens
aaggggagttagtgataaaacc

SEQ ID NO: 7164803 - DNA, 22 bp, Homo sapiens
aaggggaatagagtgggttgtg

SEQ ID NO: 7164804 - DNA, 22 bp, Homo sapiens
aaggggaatagagtgggttgtg

SEQ ID NO: 7164805 - DNA, 22 bp, Homo sapiens
aaggggaagtagcaccagaggt

SEQ ID NO: 7164806 - DNA, 22 bp, Homo sapiens
aaggggaagtagcaccagaggt

SEQ ID NO: 7164807 - DNA, 22 bp, Homo sapiens
aaggggaagtagcaccagaggt

SEQ ID NO: 7164808 - DNA, 22 bp, Homo sapiens
aagggagatagttcgccatggg

SEQ ID NO: 7164809 - DNA, 22 bp, Homo sapiens
aagggagatagttcgccatggg

SEQ ID NO: 7164810 - DNA, 22 bp, Homo sapiens
aagggagaggagggtcttgttg

SEQ ID NO: 7164811 - DNA, 21 bp, Homo sapiens
aagggagataggaatcaggcc

SEQ ID NO: 7164812 - DNA, 22 bp, Homo sapiens
aagggagaggagggtcttgttg

SEQ ID NO: 7164813 - DNA, 22 bp, Homo sapiens
aagggagaggagggtcttgttg

SEQ ID NO: 7164814 - DNA, 21 bp, Homo sapiens
aagggagataggaatcaggcc

SEQ ID NO: 7164815 - DNA, 21 bp, Homo sapiens
aagggagataggaatcaggcc

SEQ ID NO: 7164816 - DNA, 21 bp, Homo sapiens
aagggagataggaatcaggcc

SEQ ID NO: 7164817 - DNA, 22 bp, Homo sapiens
aagggaggaggatttattgtac

SEQ ID NO: 7164818 - DNA, 22 bp, Homo sapiens
aaggggaagtagcaccagaggt

SEQ ID NO: 7164819 - DNA, 22 bp, Homo sapiens
aagggctggagactgggtcttc

SEQ ID NO: 7164820 - DNA, 22 bp, Homo sapiens
aagggctggagactgggtcttc

SEQ ID NO: 7164821 - DNA, 22 bp, Homo sapiens
aagggctggagactgggtcttc

SEQ ID NO: 7164822 - DNA, 22 bp, Homo sapiens
aagggaggaggatttattgtac

SEQ ID NO: 7164823 - DNA, 22 bp, Homo sapiens
aagggaggccagaggttttgca

SEQ ID NO: 7164824 - DNA, 22 bp, Homo sapiens
aagtatgctattacagtgtcat

SEQ ID NO: 7164825 - DNA, 22 bp, Homo sapiens
aagtatgtcaatcatacttcaa

SEQ ID NO: 7164826 - DNA, 22 bp, Homo sapiens
aagtatgtgatacatgttaatt

SEQ ID NO: 7164827 - DNA, 22 bp, Homo sapiens
aagtacagaaatagcaggtgca

SEQ ID NO: 7164828 - DNA, 22 bp, Homo sapiens
aagtacacctttggagtccacg

SEQ ID NO: 7164829 - DNA, 22 bp, Homo sapiens
aagtacagaaggagcgaacaat

SEQ ID NO: 7164830 - DNA, 22 bp, Homo sapiens
aagtacagaaggagcgaacaat

SEQ ID NO: 7164831 - DNA, 22 bp, Homo sapiens
aagtacagaaggagcgaacaat

SEQ ID NO: 7164832 - DNA, 22 bp, Homo sapiens
aacaatgatatagggattggca

SEQ ID NO: 7164833 - DNA, 22 bp, Homo sapiens
aacaatgcactatcgtaagtgg

SEQ ID NO: 7164834 - DNA, 22 bp, Homo sapiens
aacaatgcactatcgtaagtgg

SEQ ID NO: 7164835 - DNA, 22 bp, Homo sapiens
aacaatgcactatcgtaagtgg

SEQ ID NO: 7164836 - DNA, 22 bp, Homo sapiens
aacaatgcagttaatgggaaga

SEQ ID NO: 7164837 - DNA, 22 bp, Homo sapiens
aacaatgcagttaatgggaaga

SEQ ID NO: 7164838 - DNA, 22 bp, Homo sapiens
aacaatgcagttaatgggaaga

SEQ ID NO: 7164839 - DNA, 22 bp, Homo sapiens
aacaatgccaacagcatgctgg

SEQ ID NO: 7164840 - DNA, 22 bp, Homo sapiens
aacaatgccaacagcatgctgg

SEQ ID NO: 7164841 - DNA, 22 bp, Homo sapiens
aacaatgccaacagcatgctgg

SEQ ID NO: 7164842 - DNA, 16 bp, Homo sapiens
aacaatgccaatccag

SEQ ID NO: 7164843 - DNA, 16 bp, Homo sapiens
aacaatgccaatccag

SEQ ID NO: 7164844 - DNA, 16 bp, Homo sapiens
aacaatgccaatccag

SEQ ID NO: 7164845 - DNA, 22 bp, Homo sapiens
aacaatgccacattaagtgtat

SEQ ID NO: 7164846 - DNA, 22 bp, Homo sapiens
aacaatgccacattaagtgtat

SEQ ID NO: 7164847 - DNA, 22 bp, Homo sapiens
aacaatgccacattaagtgtat

SEQ ID NO: 7164848 - DNA, 22 bp, Homo sapiens
aacaatgcctgatgacctcctg

SEQ ID NO: 7164849 - DNA, 22 bp, Homo sapiens
aacaatgcctgatgacctcctg

SEQ ID NO: 7164850 - DNA, 22 bp, Homo sapiens
aacaatgcctgatgacctcctg

SEQ ID NO: 7164851 - DNA, 22 bp, Homo sapiens
aacaatgcctgatgacctcctg

SEQ ID NO: 7164852 - DNA, 22 bp, Homo sapiens
aacaatgctgaactgaggaaag

SEQ ID NO: 7164853 - DNA, 22 bp, Homo sapiens
aacaatgctgaactgaggaaag

SEQ ID NO: 7164854 - DNA, 22 bp, Homo sapiens
aacaatgctgaactgaggaaag

SEQ ID NO: 7164855 - DNA, 22 bp, Homo sapiens
aacaatgcttgccaagtgtgat

SEQ ID NO: 7164856 - DNA, 23 bp, Homo sapiens
aacaataggttttggcagaatag

SEQ ID NO: 7164857 - DNA, 22 bp, Homo sapiens
aacaatcaagtttctaaatgac

SEQ ID NO: 7164858 - DNA, 17 bp, Homo sapiens
aacaataggatgtgtat

SEQ ID NO: 7164859 - DNA, 23 bp, Homo sapiens
aacaatagagataaagtgagatc

SEQ ID NO: 7164860 - DNA, 22 bp, Homo sapiens
aaggggctcttgtcaggcgcag

SEQ ID NO: 7164861 - DNA, 22 bp, Homo sapiens
aaggggctcttgtcaggcgcag

SEQ ID NO: 7164862 - DNA, 22 bp, Homo sapiens
aaggggctcttgtcaggcgcag

SEQ ID NO: 7164863 - DNA, 22 bp, Homo sapiens
aacaataggctatatgctaggc

SEQ ID NO: 7164864 - DNA, 22 bp, Homo sapiens
aacaatcaagtttctaaatgac

SEQ ID NO: 7164865 - DNA, 22 bp, Homo sapiens
aacaatgaccacacaatgtact

SEQ ID NO: 7164866 - DNA, 22 bp, Homo sapiens
aacaatgaccacacaatgtact

SEQ ID NO: 7164867 - DNA, 22 bp, Homo sapiens
aacaatgaccacacaatgtact

SEQ ID NO: 7164868 - DNA, 22 bp, Homo sapiens
aaatttcaagcaaagtagctat

SEQ ID NO: 7164869 - DNA, 20 bp, Homo sapiens
aaatttaggaaattttacgc

SEQ ID NO: 7164870 - DNA, 20 bp, Homo sapiens
aaatttaggaaattttacgc

SEQ ID NO: 7164871 - DNA, 22 bp, Homo sapiens
aaatttcaagcaaagtagctat

SEQ ID NO: 7164872 - DNA, 22 bp, Homo sapiens
aaatttcagttggaatgagctc

SEQ ID NO: 7164873 - DNA, 22 bp, Homo sapiens
aaatttcagttacctttacgtt

SEQ ID NO: 7164874 - DNA, 22 bp, Homo sapiens
aaatttcagttacctttacgtt

SEQ ID NO: 7164875 - DNA, 22 bp, Homo sapiens
aaatttcagttacctttacgtt

SEQ ID NO: 7164876 - DNA, 22 bp, Homo sapiens
aaatttcagttggaatgagctc

SEQ ID NO: 7164877 - DNA, 22 bp, Homo sapiens
aaatttctaagcagccacttcc

SEQ ID NO: 7164878 - DNA, 22 bp, Homo sapiens
aaatttctaagcagccacttcc

SEQ ID NO: 7164879 - DNA, 22 bp, Homo sapiens
aaatttcagttggaatgagctc

SEQ ID NO: 7164880 - DNA, 22 bp, Homo sapiens
aaatttctaagcagccacttcc

SEQ ID NO: 7164881 - DNA, 23 bp, Homo sapiens
aaggcattggcttctctcatttc

SEQ ID NO: 7164882 - DNA, 23 bp, Homo sapiens
aaggcattggcttctctcatttc

SEQ ID NO: 7164883 - DNA, 23 bp, Homo sapiens
aaggcattggcttctctcatttc

SEQ ID NO: 7164884 - DNA, 22 bp, Homo sapiens
aaggccaaagacacctacacag

SEQ ID NO: 7164885 - DNA, 22 bp, Homo sapiens
aaggccaaagttttcaggctaa

SEQ ID NO: 7164886 - DNA, 22 bp, Homo sapiens
aaggccaaagacacctacacag

SEQ ID NO: 7164887 - DNA, 22 bp, Homo sapiens
aaggccaaagttttcaggctaa

SEQ ID NO: 7164888 - DNA, 22 bp, Homo sapiens
aaggccaactaggatgagctag

SEQ ID NO: 7164889 - DNA, 22 bp, Homo sapiens
aaggccacacttgctggccagc

SEQ ID NO: 7164890 - DNA, 22 bp, Homo sapiens
aaggccacacttgctggccagc

SEQ ID NO: 7164891 - DNA, 22 bp, Homo sapiens
aaggccacagagcctcagagag

SEQ ID NO: 7164892 - DNA, 22 bp, Homo sapiens
aaggccaccaccagcgaggggg

SEQ ID NO: 7164893 - DNA, 22 bp, Homo sapiens
aaggccacgtctccttccagag

SEQ ID NO: 7164894 - DNA, 22 bp, Homo sapiens
aaggccactgaagaaatcacaa

SEQ ID NO: 7164895 - DNA, 22 bp, Homo sapiens
aaggccactgaagaaatcacaa

SEQ ID NO: 7164896 - DNA, 22 bp, Homo sapiens
aaggccactttaccttaaatcc

SEQ ID NO: 7164897 - DNA, 22 bp, Homo sapiens
aaggccactttaccttaaatcc

SEQ ID NO: 7164898 - DNA, 23 bp, Homo sapiens
aaggccagaatttcaatggtgcc

SEQ ID NO: 7164899 - DNA, 23 bp, Homo sapiens
aaggccagaatttcaatggtgcc

SEQ ID NO: 7164900 - DNA, 22 bp, Homo sapiens
aaggccagacaggaccacatct

SEQ ID NO: 7164901 - DNA, 22 bp, Homo sapiens
aaggccagactctggaatgaca

SEQ ID NO: 7164902 - DNA, 22 bp, Homo sapiens
aacaaatgtgtggcagtgtggg

SEQ ID NO: 7164903 - DNA, 22 bp, Homo sapiens
aacaaatgtgtggcagtgtggg

SEQ ID NO: 7164904 - DNA, 22 bp, Homo sapiens
aacaaatgtgtggcagtgtggg

SEQ ID NO: 7164905 - DNA, 22 bp, Homo sapiens
aacaaatgtgttttgtaattaa

SEQ ID NO: 7164906 - DNA, 22 bp, Homo sapiens
aagggagacccaccgtcctgga

SEQ ID NO: 7164907 - DNA, 22 bp, Homo sapiens
aagggagacccaccgtcctgga

SEQ ID NO: 7164908 - DNA, 22 bp, Homo sapiens
aagggagacagttgtgtgagga

SEQ ID NO: 7164909 - DNA, 22 bp, Homo sapiens
aagggagacagttgtgtgagga

SEQ ID NO: 7164910 - DNA, 22 bp, Homo sapiens
aagggagacagttgtgtgagga

SEQ ID NO: 7164911 - DNA, 22 bp, Homo sapiens
aagggagacagttgtgtgagga

SEQ ID NO: 7164912 - DNA, 22 bp, Homo sapiens
aagggagacagttgtgtgagga

SEQ ID NO: 7164913 - DNA, 22 bp, Homo sapiens
aacaataattgcggttctctat

SEQ ID NO: 7164914 - DNA, 22 bp, Homo sapiens
aagggagacagttgtgtgagga

SEQ ID NO: 7164915 - DNA, 22 bp, Homo sapiens
aacaataattgcggttctctat

SEQ ID NO: 7164916 - DNA, 22 bp, Homo sapiens
aacaataattgcggttctctat

SEQ ID NO: 7164917 - DNA, 22 bp, Homo sapiens
aacaataactagacatgccatg

SEQ ID NO: 7164918 - DNA, 22 bp, Homo sapiens
aacaataactagacatgccatg

SEQ ID NO: 7164919 - DNA, 22 bp, Homo sapiens
aacaataactagacatgccatg

SEQ ID NO: 7164920 - DNA, 22 bp, Homo sapiens
aacaataactagacatgccatg

SEQ ID NO: 7164921 - DNA, 22 bp, Homo sapiens
aacaagttgttgaaaataatta

SEQ ID NO: 7164922 - DNA, 22 bp, Homo sapiens
aacaataactagacatgccatg

SEQ ID NO: 7164923 - DNA, 22 bp, Homo sapiens
aacaataactagacatgccatg

SEQ ID NO: 7164924 - DNA, 22 bp, Homo sapiens
aacaagttgttgaaaataatta

SEQ ID NO: 7164925 - DNA, 22 bp, Homo sapiens
aacaagatagatatcacttagg

SEQ ID NO: 7164926 - DNA, 22 bp, Homo sapiens
aacaagatgttttgatatatgt

SEQ ID NO: 7164927 - DNA, 22 bp, Homo sapiens
aacaagcagatgcaatgcactt

SEQ ID NO: 7164928 - DNA, 22 bp, Homo sapiens
aacaagcagatgcaatgcactt

SEQ ID NO: 7164929 - DNA, 22 bp, Homo sapiens
aacaagcagatgcaatgcactt

SEQ ID NO: 7164930 - DNA, 22 bp, Homo sapiens
aacaaggcacaagctggctgtt

SEQ ID NO: 7164931 - DNA, 22 bp, Homo sapiens
aacaagtaagtttatatatatt

SEQ ID NO: 7164932 - DNA, 22 bp, Homo sapiens
aacaagtcattccatttgacag

SEQ ID NO: 7164933 - DNA, 22 bp, Homo sapiens
aacaagtctaagagaatggcag

SEQ ID NO: 7164934 - DNA, 22 bp, Homo sapiens
aacaagtctttggttttggcta

SEQ ID NO: 7164935 - DNA, 22 bp, Homo sapiens
aacaagtgtattaatggaaata

SEQ ID NO: 7164936 - DNA, 22 bp, Homo sapiens
aaattaactatcacttttgtga

SEQ ID NO: 7164937 - DNA, 22 bp, Homo sapiens
aaattaagagtaactctgtaga

SEQ ID NO: 7164938 - DNA, 22 bp, Homo sapiens
aaattagatcagtggattttct

SEQ ID NO: 7164939 - DNA, 22 bp, Homo sapiens
aaattaagagtaactctgtaga

SEQ ID NO: 7164940 - DNA, 21 bp, Homo sapiens
aaattagcttcaagttctgca

SEQ ID NO: 7164941 - DNA, 22 bp, Homo sapiens
aaattagtacattgcaaagtcc

SEQ ID NO: 7164942 - DNA, 22 bp, Homo sapiens
aaattagtacattgcaaagtcc

SEQ ID NO: 7164943 - DNA, 22 bp, Homo sapiens
aaattataggtgccaccttgga

SEQ ID NO: 7164944 - DNA, 22 bp, Homo sapiens
aaattagtacattgcaaagtcc

SEQ ID NO: 7164945 - DNA, 22 bp, Homo sapiens
aaattattacaagctagttggc

SEQ ID NO: 7164946 - DNA, 22 bp, Homo sapiens
aaattattaaacagtgggatgc

SEQ ID NO: 7164947 - DNA, 22 bp, Homo sapiens
aaattattaaacagtgggatgc

SEQ ID NO: 7164948 - DNA, 22 bp, Homo sapiens
aaattattataggcagagctga

SEQ ID NO: 7164949 - DNA, 22 bp, Homo sapiens
aaattattataggcagagctga

SEQ ID NO: 7164950 - DNA, 22 bp, Homo sapiens
aaattattatgcccctctataa

SEQ ID NO: 7164951 - DNA, 22 bp, Homo sapiens
aaggacagggatggttgattgt

SEQ ID NO: 7164952 - DNA, 22 bp, Homo sapiens
aaggacagggatggttgattgt

SEQ ID NO: 7164953 - DNA, 22 bp, Homo sapiens
aaggacagggatggttgattgt

SEQ ID NO: 7164954 - DNA, 22 bp, Homo sapiens
aaggacaggttggggcttcagg

SEQ ID NO: 7164955 - DNA, 22 bp, Homo sapiens
aaggacaggttggggcttcagg

SEQ ID NO: 7164956 - DNA, 22 bp, Homo sapiens
aaggacaggttggggcttcagg

SEQ ID NO: 7164957 - DNA, 22 bp, Homo sapiens
aaggacaggttggggcttcagg

SEQ ID NO: 7164958 - DNA, 22 bp, Homo sapiens
aaggacatgttttggtaaatgc

SEQ ID NO: 7164959 - DNA, 17 bp, Homo sapiens
aaggaccaacaggaaat

SEQ ID NO: 7164960 - DNA, 22 bp, Homo sapiens
aaggaccacctagggtgggggt

SEQ ID NO: 7164961 - DNA, 22 bp, Homo sapiens
aaggagaaatggtagatgtgca

SEQ ID NO: 7164962 - DNA, 22 bp, Homo sapiens
aaggagaaatggtagatgtgca

SEQ ID NO: 7164963 - DNA, 22 bp, Homo sapiens
aaggagaaatggtagatgtgca

SEQ ID NO: 7164964 - DNA, 22 bp, Homo sapiens
aaggactgtctaaggcctccaa

SEQ ID NO: 7164965 - DNA, 22 bp, Homo sapiens
aaggacctatattgtcagagga

SEQ ID NO: 7164966 - DNA, 22 bp, Homo sapiens
aaggaccagattatccttaata

SEQ ID NO: 7164967 - DNA, 22 bp, Homo sapiens
aaggaccagattatccttaata

SEQ ID NO: 7164968 - DNA, 22 bp, Homo sapiens
aaggaccagttgagtgatctta

SEQ ID NO: 7164969 - DNA, 22 bp, Homo sapiens
aaggaccagttttgcagaattg

SEQ ID NO: 7164970 - DNA, 22 bp, Homo sapiens
aaggactagatattcatacatg

SEQ ID NO: 7164971 - DNA, 22 bp, Homo sapiens
aaggactccaattctttcatct

SEQ ID NO: 7164972 - DNA, 22 bp, Homo sapiens
aaggactccaattctttcatct

SEQ ID NO: 7164973 - DNA, 22 bp, Homo sapiens
aaggactctccagctagcaaat

SEQ ID NO: 7164974 - DNA, 22 bp, Homo sapiens
aaatttaaaaagcagcattgca

SEQ ID NO: 7164975 - DNA, 22 bp, Homo sapiens
aaatttaaaaagcagcattgca

SEQ ID NO: 7164976 - DNA, 22 bp, Homo sapiens
aaatttaaaaagcagcattgca

SEQ ID NO: 7164977 - DNA, 22 bp, Homo sapiens
aaattgttgatctacagtaagg

SEQ ID NO: 7164978 - DNA, 22 bp, Homo sapiens
aaattgttgatctacagtaagg

SEQ ID NO: 7164979 - DNA, 22 bp, Homo sapiens
aaattgttgatctacagtaagg

SEQ ID NO: 7164980 - DNA, 22 bp, Homo sapiens
aaattgttgatctacagtaagg

SEQ ID NO: 7164981 - DNA, 22 bp, Homo sapiens
aaattgttgatctacagtaagg

SEQ ID NO: 7164982 - DNA, 22 bp, Homo sapiens
aaattgcattttaaaggtagat

SEQ ID NO: 7164983 - DNA, 22 bp, Homo sapiens
aaatttaaaaagcagcattgca

SEQ ID NO: 7164984 - DNA, 22 bp, Homo sapiens
aaatttaagaagtgtgtgcgtg

SEQ ID NO: 7164985 - DNA, 22 bp, Homo sapiens
aaatttaagaagtgtgtgcgtg

SEQ ID NO: 7164986 - DNA, 22 bp, Homo sapiens
aaatttaaggaggtgctcactt

SEQ ID NO: 7164987 - DNA, 22 bp, Homo sapiens
aaatttaaggaggtgctcactt

SEQ ID NO: 7164988 - DNA, 22 bp, Homo sapiens
aagccagcattttcccattcct

SEQ ID NO: 7164989 - DNA, 21 bp, Homo sapiens
aagccagcccacagtggtttg

SEQ ID NO: 7164990 - DNA, 22 bp, Homo sapiens
aagccagtgtccagaatgggca

SEQ ID NO: 7164991 - DNA, 22 bp, Homo sapiens
aagccagtcctctactgggcac

SEQ ID NO: 7164992 - DNA, 22 bp, Homo sapiens
aagccagtgtttttgagagttg

SEQ ID NO: 7164993 - DNA, 22 bp, Homo sapiens
aagccatcgaactgtacactta

SEQ ID NO: 7164994 - DNA, 22 bp, Homo sapiens
aagccatcgaactgtacactta

SEQ ID NO: 7164995 - DNA, 22 bp, Homo sapiens
aagccatcttgtttatatgtta

SEQ ID NO: 7164996 - DNA, 22 bp, Homo sapiens
aagccatggctgcatcagcctg

SEQ ID NO: 7164997 - DNA, 22 bp, Homo sapiens
aagccattcatctaatgtcctg

SEQ ID NO: 7164998 - DNA, 22 bp, Homo sapiens
aagccattcccatagacttcag

SEQ ID NO: 7164999 - DNA, 22 bp, Homo sapiens
aagctgattctaaaatttatta

SEQ ID NO: 7165000 - DNA, 22 bp, Homo sapiens
aagctgattctaaaatttatta

SEQ ID NO: 7165001 - DNA, 22 bp, Homo sapiens
aagctgatgtcccagtttgaag

SEQ ID NO: 7165002 - DNA, 22 bp, Homo sapiens
aagctgatgtcccagtttgaag

SEQ ID NO: 7165003 - DNA, 22 bp, Homo sapiens
aagctgattccactttttccac

SEQ ID NO: 7165004 - DNA, 22 bp, Homo sapiens
aagccatttcctgatacaccta

SEQ ID NO: 7165005 - DNA, 22 bp, Homo sapiens
aagccatttgttgtccttcagg

SEQ ID NO: 7165006 - DNA, 22 bp, Homo sapiens
aagccatttgttgtccttcagg

SEQ ID NO: 7165007 - DNA, 22 bp, Homo sapiens
aagcccaatgtacaaataactc

SEQ ID NO: 7165008 - DNA, 22 bp, Homo sapiens
aagcccaatgtacaaataactc

SEQ ID NO: 7165009 - DNA, 22 bp, Homo sapiens
aagcccagaatcaagtctactg

SEQ ID NO: 7165010 - DNA, 22 bp, Homo sapiens
aagcccagaatcaagtctactg

SEQ ID NO: 7165011 - DNA, 22 bp, Homo sapiens
aagcccagatgagatccctgga

SEQ ID NO: 7165012 - DNA, 22 bp, Homo sapiens
aagcccagatgagatccctgga

SEQ ID NO: 7165013 - DNA, 22 bp, Homo sapiens
aagctgatcatccttccaggtt

SEQ ID NO: 7165014 - DNA, 22 bp, Homo sapiens
aagctggcatgtcacctgagaa

SEQ ID NO: 7165015 - DNA, 23 bp, Homo sapiens
aagctggctgggagcagaaggga

SEQ ID NO: 7165016 - DNA, 22 bp, Homo sapiens
aagctggctaaataaaaggtcc

SEQ ID NO: 7165017 - DNA, 22 bp, Homo sapiens
aagctggctctgatgtcagaat

SEQ ID NO: 7165018 - DNA, 19 bp, Homo sapiens
aagctgtcctgttggccct

SEQ ID NO: 7165019 - DNA, 22 bp, Homo sapiens
aagctgtgaaatctctagtgca

SEQ ID NO: 7165020 - DNA, 22 bp, Homo sapiens
aagctttagagatgagttcctt

SEQ ID NO: 7165021 - DNA, 22 bp, Homo sapiens
aagctttatgacttggagacag

SEQ ID NO: 7165022 - DNA, 22 bp, Homo sapiens
aagctgtatgttaccactgtca

SEQ ID NO: 7165023 - DNA, 22 bp, Homo sapiens
aagctgtcaatgtatctagtct

SEQ ID NO: 7165024 - DNA, 22 bp, Homo sapiens
aagctgtcaatgtatctagtct

SEQ ID NO: 7165025 - DNA, 20 bp, Homo sapiens
aagctgtcagaggtggacag

SEQ ID NO: 7165026 - DNA, 22 bp, Homo sapiens
aagctgtcaggaggttaccttt

SEQ ID NO: 7165027 - DNA, 22 bp, Homo sapiens
aagctgtcagtgtcaggctaaa

SEQ ID NO: 7165028 - DNA, 22 bp, Homo sapiens
aagctgggacttagcgcagata

SEQ ID NO: 7165029 - DNA, 20 bp, Homo sapiens
aagctgggtaggagaggagc

SEQ ID NO: 7165030 - DNA, 20 bp, Homo sapiens
aagctgggtaggagaggagc

SEQ ID NO: 7165031 - DNA, 22 bp, Homo sapiens
aagctttatgatctctcagcta

SEQ ID NO: 7165032 - DNA, 22 bp, Homo sapiens
aagctttgactactgcctcttg

SEQ ID NO: 7165033 - DNA, 22 bp, Homo sapiens
aagctttgactactgcctcttg

SEQ ID NO: 7165034 - DNA, 22 bp, Homo sapiens
aagctttgataattggattact

SEQ ID NO: 7165035 - DNA, 22 bp, Homo sapiens
aagctttgcaatgcttcattat

SEQ ID NO: 7165036 - DNA, 22 bp, Homo sapiens
aagctttgcaccggtggctgga

SEQ ID NO: 7165037 - DNA, 22 bp, Homo sapiens
aagctttggaagggcagggttg

SEQ ID NO: 7165038 - DNA, 22 bp, Homo sapiens
aagctttggagaggcgggcagg

SEQ ID NO: 7165039 - DNA, 22 bp, Homo sapiens
aagctttgggcagaagaggatt

SEQ ID NO: 7165040 - DNA, 22 bp, Homo sapiens
aagctttgtccaaggccatgca

SEQ ID NO: 7165041 - DNA, 22 bp, Homo sapiens
aagctttgttcttcacagagtg

SEQ ID NO: 7165042 - DNA, 22 bp, Homo sapiens
aagcttttctctgtattacctg

SEQ ID NO: 7165043 - DNA, 21 bp, Homo sapiens
aaggaaaagcttggtctctga

SEQ ID NO: 7165044 - DNA, 21 bp, Homo sapiens
aaggaaaagcttggtctctga

SEQ ID NO: 7165045 - DNA, 21 bp, Homo sapiens
aaggaaaagcttggtctctga

SEQ ID NO: 7165046 - DNA, 20 bp, Homo sapiens
aacactgcttctatattttc

SEQ ID NO: 7165047 - DNA, 22 bp, Homo sapiens
aacactggaagggacatcaagt

SEQ ID NO: 7165048 - DNA, 22 bp, Homo sapiens
aacactggaagggacatcaagt

SEQ ID NO: 7165049 - DNA, 22 bp, Homo sapiens
aacactggacaggaggctaggt

SEQ ID NO: 7165050 - DNA, 22 bp, Homo sapiens
aacactggacaggaggctaggt

SEQ ID NO: 7165051 - DNA, 22 bp, Homo sapiens
aacactggacaggaggctaggt

SEQ ID NO: 7165052 - DNA, 22 bp, Homo sapiens
aacactgagtatcagagttggg

SEQ ID NO: 7165053 - DNA, 22 bp, Homo sapiens
aacactgctccaaaaaaggctt

SEQ ID NO: 7165054 - DNA, 22 bp, Homo sapiens
aacactgctgctgggttctgtg

SEQ ID NO: 7165055 - DNA, 22 bp, Homo sapiens
aacactgctgctgggttctgtg

SEQ ID NO: 7165056 - DNA, 22 bp, Homo sapiens
aacactgctgctgggttctgtg

SEQ ID NO: 7165057 - DNA, 22 bp, Homo sapiens
aacactgctgctgggttctgtg

SEQ ID NO: 7165058 - DNA, 22 bp, Homo sapiens
aagtcaatcaagggtgtaggca

SEQ ID NO: 7165059 - DNA, 22 bp, Homo sapiens
aacactgagggaaaagagatag

SEQ ID NO: 7165060 - DNA, 22 bp, Homo sapiens
aagtatttctggcctgtgaaag

SEQ ID NO: 7165061 - DNA, 22 bp, Homo sapiens
aagtatttctggcctgtgaaag

SEQ ID NO: 7165062 - DNA, 22 bp, Homo sapiens
aagtatttctggcctgtgaaag

SEQ ID NO: 7165063 - DNA, 22 bp, Homo sapiens
aagtatttctggcctgtgaaag

SEQ ID NO: 7165064 - DNA, 22 bp, Homo sapiens
aagtatttggaatggcattttt

SEQ ID NO: 7165065 - DNA, 22 bp, Homo sapiens
aagtcaaaccttgctcacagga

SEQ ID NO: 7165066 - DNA, 22 bp, Homo sapiens
aagtatttcgttctgaaaaagt

SEQ ID NO: 7165067 - DNA, 22 bp, Homo sapiens
aagtatttctggcctgtgaaag

SEQ ID NO: 7165068 - DNA, 22 bp, Homo sapiens
aagtatttcgttctgaaaaagt

SEQ ID NO: 7165069 - DNA, 22 bp, Homo sapiens
aagtatttcgttctgaaaaagt

SEQ ID NO: 7165070 - DNA, 22 bp, Homo sapiens
aagtatttcgttctgaaaaagt

SEQ ID NO: 7165071 - DNA, 22 bp, Homo sapiens
aagtatttcgttctgaaaaagt

SEQ ID NO: 7165072 - DNA, 22 bp, Homo sapiens
aagtatttcagcggttctttgt

SEQ ID NO: 7165073 - DNA, 22 bp, Homo sapiens
aagtatttcagcggttctttgt

SEQ ID NO: 7165074 - DNA, 22 bp, Homo sapiens
aacactgtaacagcatcatttt

SEQ ID NO: 7165075 - DNA, 22 bp, Homo sapiens
aacactgtactggaagatggac

SEQ ID NO: 7165076 - DNA, 22 bp, Homo sapiens
aacactgggataggtgatagac

SEQ ID NO: 7165077 - DNA, 17 bp, Homo sapiens
aacactgggtgagcctc

SEQ ID NO: 7165078 - DNA, 17 bp, Homo sapiens
aacactgggtgagcctc

SEQ ID NO: 7165079 - DNA, 17 bp, Homo sapiens
aacactgggtgagcctc

SEQ ID NO: 7165080 - DNA, 22 bp, Homo sapiens
aacactggttctgactacacag

SEQ ID NO: 7165081 - DNA, 22 bp, Homo sapiens
aacactgggataggtgatagac

SEQ ID NO: 7165082 - DNA, 22 bp, Homo sapiens
aacactggttctgactacacag

SEQ ID NO: 7165083 - DNA, 22 bp, Homo sapiens
aacactggttctgactacacag

SEQ ID NO: 7165084 - DNA, 22 bp, Homo sapiens
aacactggtttggcattagatg

SEQ ID NO: 7165085 - DNA, 22 bp, Homo sapiens
aacactggtttggcattagatg

SEQ ID NO: 7165086 - DNA, 22 bp, Homo sapiens
aagttacattttggtctaattg

SEQ ID NO: 7165087 - DNA, 22 bp, Homo sapiens
aagttacattttggtctaattg

SEQ ID NO: 7165088 - DNA, 20 bp, Homo sapiens
aagttacattgtattgtacc

SEQ ID NO: 7165089 - DNA, 22 bp, Homo sapiens
aacactgtactggaagatggac

SEQ ID NO: 7165090 - DNA, 22 bp, Homo sapiens
aagttctatatctgcctcacca

SEQ ID NO: 7165091 - DNA, 22 bp, Homo sapiens
aagttctgaagggttctgcaga

SEQ ID NO: 7165092 - DNA, 22 bp, Homo sapiens
aagttctgccaggctgtggcag

SEQ ID NO: 7165093 - DNA, 22 bp, Homo sapiens
aagttgaatcagtaacacagtt

SEQ ID NO: 7165094 - DNA, 22 bp, Homo sapiens
aagttgagagaaagcccgtgtt

SEQ ID NO: 7165095 - DNA, 22 bp, Homo sapiens
aagttgagatgtcataggagac

SEQ ID NO: 7165096 - DNA, 22 bp, Homo sapiens
aagttgattaatctttcgagaa

SEQ ID NO: 7165097 - DNA, 22 bp, Homo sapiens
aagttgatggcgtctttgagat

SEQ ID NO: 7165098 - DNA, 22 bp, Homo sapiens
aagttgatagcatgttaagctc

SEQ ID NO: 7165099 - DNA, 19 bp, Homo sapiens
aagttgatcattttgacag

SEQ ID NO: 7165100 - DNA, 19 bp, Homo sapiens
aagttgatcattttgacag

SEQ ID NO: 7165101 - DNA, 22 bp, Homo sapiens
aagttgatttaaactactagtc

SEQ ID NO: 7165102 - DNA, 22 bp, Homo sapiens
aagttgattgcttcaaatttct

SEQ ID NO: 7165103 - DNA, 22 bp, Homo sapiens
aagttctttcatatcttaatta

SEQ ID NO: 7165104 - DNA, 22 bp, Homo sapiens
aagttcttggaggatgaagagt

SEQ ID NO: 7165105 - DNA, 22 bp, Homo sapiens
aagttcttgagccctattctag

SEQ ID NO: 7165106 - DNA, 22 bp, Homo sapiens
aagttcttagacaagcttgtgg

SEQ ID NO: 7165107 - DNA, 23 bp, Homo sapiens
aagttcttaggttgatactaatg

SEQ ID NO: 7165108 - DNA, 22 bp, Homo sapiens
aagtttgacagaagtttctaat

SEQ ID NO: 7165109 - DNA, 22 bp, Homo sapiens
aagtttctttattagcttgtcc

SEQ ID NO: 7165110 - DNA, 22 bp, Homo sapiens
aagtttctgttcatatctctga

SEQ ID NO: 7165111 - DNA, 20 bp, Homo sapiens
aagtttctggtttatatctt

SEQ ID NO: 7165112 - DNA, 22 bp, Homo sapiens
aagtttctgatattgttaaagc

SEQ ID NO: 7165113 - DNA, 22 bp, Homo sapiens
aagttggaatctggaactgatc

SEQ ID NO: 7165114 - DNA, 22 bp, Homo sapiens
aagttgctaaaggagttctttg

SEQ ID NO: 7165115 - DNA, 22 bp, Homo sapiens
aagttgctagtgcttttctgag

SEQ ID NO: 7165116 - DNA, 22 bp, Homo sapiens
aagtttctgccatactgtggtg

SEQ ID NO: 7165117 - DNA, 22 bp, Homo sapiens
aataaaatggtcagttttctca

SEQ ID NO: 7165118 - DNA, 22 bp, Homo sapiens
aagtttgggatgctccttggac

SEQ ID NO: 7165119 - DNA, 22 bp, Homo sapiens
aagtttgggcataaggctgtct

SEQ ID NO: 7165120 - DNA, 22 bp, Homo sapiens
aataaaatggtcagttttctca

SEQ ID NO: 7165121 - DNA, 22 bp, Homo sapiens
aataaacaaaggacaaggaggt

SEQ ID NO: 7165122 - DNA, 20 bp, Homo sapiens
aagtttggagtcaggagacc

SEQ ID NO: 7165123 - DNA, 22 bp, Homo sapiens
aagtttggaggtcactggtctt

SEQ ID NO: 7165124 - DNA, 21 bp, Homo sapiens
aagtttgggattcagtttcca

SEQ ID NO: 7165125 - DNA, 22 bp, Homo sapiens
aagtttggaatgatagagacct

SEQ ID NO: 7165126 - DNA, 22 bp, Homo sapiens
aagtttggaagccgtctgcaaa

SEQ ID NO: 7165127 - DNA, 21 bp, Homo sapiens
aagtttggaagaaagcaaggg

SEQ ID NO: 7165128 - DNA, 20 bp, Homo sapiens
aagtttgccccaggaaattg

SEQ ID NO: 7165129 - DNA, 22 bp, Homo sapiens
aagtttgagaagcttatagata

SEQ ID NO: 7165130 - DNA, 20 bp, Homo sapiens
aataaactactgagagatgt

SEQ ID NO: 7165131 - DNA, 20 bp, Homo sapiens
aataaactactgagagatgt

SEQ ID NO: 7165132 - DNA, 22 bp, Homo sapiens
aataaactgctcaattgcatca

SEQ ID NO: 7165133 - DNA, 22 bp, Homo sapiens
aataaacaaatctttcctgtgg

SEQ ID NO: 7165134 - DNA, 22 bp, Homo sapiens
aataaacaaatctttcctgtgg

SEQ ID NO: 7165135 - DNA, 22 bp, Homo sapiens
aataaacaaatctttcctgtgg

SEQ ID NO: 7165136 - DNA, 22 bp, Homo sapiens
aataaacaaatctttcctgtgg

SEQ ID NO: 7165137 - DNA, 22 bp, Homo sapiens
aataaacaaaggacaaggaggt

SEQ ID NO: 7165138 - DNA, 22 bp, Homo sapiens
aataaacaaatccttccttccc

SEQ ID NO: 7165139 - DNA, 22 bp, Homo sapiens
aataaacaaatccttccttccc

SEQ ID NO: 7165140 - DNA, 18 bp, Homo sapiens
aacagtttccagattctc

SEQ ID NO: 7165141 - DNA, 18 bp, Homo sapiens
aacagtttccagattctc

SEQ ID NO: 7165142 - DNA, 22 bp, Homo sapiens
aacagtttcagttactgatgag

SEQ ID NO: 7165143 - DNA, 22 bp, Homo sapiens
aacagtttcctgactcctatga

SEQ ID NO: 7165144 - DNA, 22 bp, Homo sapiens
aacagtttcctgactcctatga

SEQ ID NO: 7165145 - DNA, 22 bp, Homo sapiens
aacagtttatgtaaatgtccag

SEQ ID NO: 7165146 - DNA, 22 bp, Homo sapiens
aataaacttccactgtgttttt

SEQ ID NO: 7165147 - DNA, 22 bp, Homo sapiens
aataaacttccactgtgttttt

SEQ ID NO: 7165148 - DNA, 22 bp, Homo sapiens
aacagtttgagctttgaatttc

SEQ ID NO: 7165149 - DNA, 22 bp, Homo sapiens
aacagtttgagctttgaatttc

SEQ ID NO: 7165150 - DNA, 22 bp, Homo sapiens
aacagtttgagctttgaatttc

SEQ ID NO: 7165151 - DNA, 22 bp, Homo sapiens
aacagtttctatgttagtggtt

SEQ ID NO: 7165152 - DNA, 22 bp, Homo sapiens
aacagtttgcctgaaatgtatt

SEQ ID NO: 7165153 - DNA, 22 bp, Homo sapiens
aacagtttgctttaagaggcac

SEQ ID NO: 7165154 - DNA, 22 bp, Homo sapiens
aacagtttgctttaagaggcac

SEQ ID NO: 7165155 - DNA, 22 bp, Homo sapiens
aacagtttgcctgaaatgtatt

SEQ ID NO: 7165156 - DNA, 22 bp, Homo sapiens
aacagtttgcctgaaatgtatt

SEQ ID NO: 7165157 - DNA, 22 bp, Homo sapiens
aatcacatgtgctcaattttaa

SEQ ID NO: 7165158 - DNA, 22 bp, Homo sapiens
aatcacatgtgggtcttgtagc

SEQ ID NO: 7165159 - DNA, 22 bp, Homo sapiens
aatcacattaagccctgttcag

SEQ ID NO: 7165160 - DNA, 22 bp, Homo sapiens
aatcacatgtgctcaattttaa

SEQ ID NO: 7165161 - DNA, 22 bp, Homo sapiens
aatatttgttagtgttttaatg

SEQ ID NO: 7165162 - DNA, 22 bp, Homo sapiens
aatcacatgcagggcctccacc

SEQ ID NO: 7165163 - DNA, 22 bp, Homo sapiens
aatcacatgtgctcaattttaa

SEQ ID NO: 7165164 - DNA, 22 bp, Homo sapiens
aacatttcagcacctgattcct

SEQ ID NO: 7165165 - DNA, 22 bp, Homo sapiens
aacatttattgagcacctactg

SEQ ID NO: 7165166 - DNA, 22 bp, Homo sapiens
aacatttattgagcacctactg

SEQ ID NO: 7165167 - DNA, 22 bp, Homo sapiens
aacatttattctaattctggga

SEQ ID NO: 7165168 - DNA, 22 bp, Homo sapiens
aacatttattctaattctggga

SEQ ID NO: 7165169 - DNA, 22 bp, Homo sapiens
aacatttattgagcacctactg

SEQ ID NO: 7165170 - DNA, 22 bp, Homo sapiens
aacatttatggtagtcattgca

SEQ ID NO: 7165171 - DNA, 22 bp, Homo sapiens
aacatttatggtagtcattgca

SEQ ID NO: 7165172 - DNA, 22 bp, Homo sapiens
aacatttatgattgaggtaaat

SEQ ID NO: 7165173 - DNA, 22 bp, Homo sapiens
aacatttatatgggttcatgaa

SEQ ID NO: 7165174 - DNA, 22 bp, Homo sapiens
aacatttatatgggttcatgaa

SEQ ID NO: 7165175 - DNA, 22 bp, Homo sapiens
aacatttacaaatccttctgca

SEQ ID NO: 7165176 - DNA, 22 bp, Homo sapiens
aacatttaggaaggacctcctc

SEQ ID NO: 7165177 - DNA, 22 bp, Homo sapiens
aacatttatatgggttcatgaa

SEQ ID NO: 7165178 - DNA, 22 bp, Homo sapiens
aacatttatatgggttcatgaa

SEQ ID NO: 7165179 - DNA, 20 bp, Homo sapiens
aacattgaaagtctagaaga

SEQ ID NO: 7165180 - DNA, 22 bp, Homo sapiens
aacattgaaatatttgcaatag

SEQ ID NO: 7165181 - DNA, 22 bp, Homo sapiens
aacattgaacttggcacaccca

SEQ ID NO: 7165182 - DNA, 22 bp, Homo sapiens
aacattctttggaggattattc

SEQ ID NO: 7165183 - DNA, 20 bp, Homo sapiens
aacattgaaagtctagaaga

SEQ ID NO: 7165184 - DNA, 20 bp, Homo sapiens
aacattgaaagtctagaaga

SEQ ID NO: 7165185 - DNA, 22 bp, Homo sapiens
aacattgagttctacttccatt

SEQ ID NO: 7165186 - DNA, 22 bp, Homo sapiens
aacattgattgcatctgttcac

SEQ ID NO: 7165187 - DNA, 22 bp, Homo sapiens
aacatttacaaatccttctgca

SEQ ID NO: 7165188 - DNA, 22 bp, Homo sapiens
aacatttacaaatccttctgca

SEQ ID NO: 7165189 - DNA, 22 bp, Homo sapiens
aacattaagatggcggaacagt

SEQ ID NO: 7165190 - DNA, 22 bp, Homo sapiens
aacattaagatggcggaacagt

SEQ ID NO: 7165191 - DNA, 22 bp, Homo sapiens
aacattcttcaaatatcactct

SEQ ID NO: 7165192 - DNA, 22 bp, Homo sapiens
aacattcttcaaatatcactct

SEQ ID NO: 7165193 - DNA, 22 bp, Homo sapiens
aacattctttagctcttcctgc

SEQ ID NO: 7165194 - DNA, 22 bp, Homo sapiens
aacataaatttgaagtggcaaa

SEQ ID NO: 7165195 - DNA, 22 bp, Homo sapiens
aacagtttttaaagctggcttc

SEQ ID NO: 7165196 - DNA, 22 bp, Homo sapiens
aacataaatttgaagtggcaaa

SEQ ID NO: 7165197 - DNA, 22 bp, Homo sapiens
aacagtttgggtaggtatgtag

SEQ ID NO: 7165198 - DNA, 22 bp, Homo sapiens
aacagtttgggtaggtatgtag

SEQ ID NO: 7165199 - DNA, 22 bp, Homo sapiens
aacagtttgtggatagcttgta

SEQ ID NO: 7165200 - DNA, 22 bp, Homo sapiens
aaccagctgagaatgcttctgc

SEQ ID NO: 7165201 - DNA, 22 bp, Homo sapiens
aaccagctctgcaaaatgtcat

SEQ ID NO: 7165202 - DNA, 22 bp, Homo sapiens
aaccagctctgcaaaatgtcat

SEQ ID NO: 7165203 - DNA, 22 bp, Homo sapiens
aaccagctccagcctccattca

SEQ ID NO: 7165204 - DNA, 22 bp, Homo sapiens
aaccagctcctcaccccattgt

SEQ ID NO: 7165205 - DNA, 22 bp, Homo sapiens
aaccagctctgcaaaatgtcat

SEQ ID NO: 7165206 - DNA, 22 bp, Homo sapiens
aaccagctgagaatgcttctgc

SEQ ID NO: 7165207 - DNA, 22 bp, Homo sapiens
aaccagctgagaatgcttctgc

SEQ ID NO: 7165208 - DNA, 17 bp, Homo sapiens
aaccagctgtcccctcc

SEQ ID NO: 7165209 - DNA, 17 bp, Homo sapiens
aaccagctgtcccctcc

SEQ ID NO: 7165210 - DNA, 22 bp, Homo sapiens
aaccagctttgatacgcattat

SEQ ID NO: 7165211 - DNA, 22 bp, Homo sapiens
aaccagctttgatacgcattat

SEQ ID NO: 7165212 - DNA, 22 bp, Homo sapiens
aaccagctttgatacgcattat

SEQ ID NO: 7165213 - DNA, 22 bp, Homo sapiens
aaccaggaattgcagggctgca

SEQ ID NO: 7165214 - DNA, 22 bp, Homo sapiens
aaccaggaattgcagggctgca

SEQ ID NO: 7165215 - DNA, 19 bp, Homo sapiens
aaccaggacaaggggctgg

SEQ ID NO: 7165216 - DNA, 19 bp, Homo sapiens
aaccaggacaaggggctgg

SEQ ID NO: 7165217 - DNA, 22 bp, Homo sapiens
aaccaggacaatttgaatagaa

SEQ ID NO: 7165218 - DNA, 22 bp, Homo sapiens
aaccaggacaattttgaaagta

SEQ ID NO: 7165219 - DNA, 22 bp, Homo sapiens
aatcactttgcactcttatttg

SEQ ID NO: 7165220 - DNA, 20 bp, Homo sapiens
aatcactttgtacaggaagc

SEQ ID NO: 7165221 - DNA, 20 bp, Homo sapiens
aatcactttgtacaggaagc

SEQ ID NO: 7165222 - DNA, 22 bp, Homo sapiens
aatcacttttctctaatgtagc

SEQ ID NO: 7165223 - DNA, 22 bp, Homo sapiens
aatcagaaaattcagtggaatt

SEQ ID NO: 7165224 - DNA, 22 bp, Homo sapiens
aatcagaaaattcagtggaatt

SEQ ID NO: 7165225 - DNA, 22 bp, Homo sapiens
aatcagaaaattcagtggaatt

SEQ ID NO: 7165226 - DNA, 23 bp, Homo sapiens
aaccagataaatggctccagggc

SEQ ID NO: 7165227 - DNA, 22 bp, Homo sapiens
aaccagctaaactttgctcgaa

SEQ ID NO: 7165228 - DNA, 22 bp, Homo sapiens
aaccagctaacatgtggaatga

SEQ ID NO: 7165229 - DNA, 22 bp, Homo sapiens
aaccagctccagcctccattca

SEQ ID NO: 7165230 - DNA, 22 bp, Homo sapiens
aaccagctccagcctccattca

SEQ ID NO: 7165231 - DNA, 22 bp, Homo sapiens
aatcacattgaatctgctacct

SEQ ID NO: 7165232 - DNA, 22 bp, Homo sapiens
aatcacattagtgaaacactga

SEQ ID NO: 7165233 - DNA, 22 bp, Homo sapiens
aatcacattgaatctgctacct

SEQ ID NO: 7165234 - DNA, 22 bp, Homo sapiens
aatcacattacagcatatctgt

SEQ ID NO: 7165235 - DNA, 22 bp, Homo sapiens
aatcacattagtgaaacactga

SEQ ID NO: 7165236 - DNA, 22 bp, Homo sapiens
aatcacattagtgaaacactga

SEQ ID NO: 7165237 - DNA, 22 bp, Homo sapiens
aatcacattagtgaaacactga

SEQ ID NO: 7165238 - DNA, 22 bp, Homo sapiens
aatcacattagtgaaacactga

SEQ ID NO: 7165239 - DNA, 22 bp, Homo sapiens
aatcacatttgcccccatattc

SEQ ID NO: 7165240 - DNA, 23 bp, Homo sapiens
aatcaccagcagccaatgtgcag

SEQ ID NO: 7165241 - DNA, 22 bp, Homo sapiens
aatcacttaatagctacactgg

SEQ ID NO: 7165242 - DNA, 22 bp, Homo sapiens
aatcacttagaacccaggaagt

SEQ ID NO: 7165243 - DNA, 22 bp, Homo sapiens
aatcacttcagtttttggacag

SEQ ID NO: 7165244 - DNA, 22 bp, Homo sapiens
aatcacttcagtttttggacag

SEQ ID NO: 7165245 - DNA, 23 bp, Homo sapiens
aatcacttccctccaaatggatt

SEQ ID NO: 7165246 - DNA, 23 bp, Homo sapiens
aatcacttccctccaaatggatt

SEQ ID NO: 7165247 - DNA, 22 bp, Homo sapiens
aatcacttgtaaggaattcaat

SEQ ID NO: 7165248 - DNA, 22 bp, Homo sapiens
aatcacttgtaaggaattcaat

SEQ ID NO: 7165249 - DNA, 22 bp, Homo sapiens
aatcacttgtaaggaattcaat

SEQ ID NO: 7165250 - DNA, 22 bp, Homo sapiens
aatcacttgtgccatgggtacc

SEQ ID NO: 7165251 - DNA, 22 bp, Homo sapiens
aatcacttgtgccatgggtacc

SEQ ID NO: 7165252 - DNA, 22 bp, Homo sapiens
aatcactttgcactcttatttg

SEQ ID NO: 7165253 - DNA, 22 bp, Homo sapiens
aactcagttacatattagaata

SEQ ID NO: 7165254 - DNA, 22 bp, Homo sapiens
aactcagtgtgtttcttagtat

SEQ ID NO: 7165255 - DNA, 22 bp, Homo sapiens
aactatacatatttacatagac

SEQ ID NO: 7165256 - DNA, 22 bp, Homo sapiens
aactcagttacatattagaata

SEQ ID NO: 7165257 - DNA, 22 bp, Homo sapiens
aactcagttacatattagaata

SEQ ID NO: 7165258 - DNA, 22 bp, Homo sapiens
aaccattcactgaacagttcaa

SEQ ID NO: 7165259 - DNA, 22 bp, Homo sapiens
aactataatggggttaggaaat

SEQ ID NO: 7165260 - DNA, 22 bp, Homo sapiens
aactatacatatttacatagac

SEQ ID NO: 7165261 - DNA, 22 bp, Homo sapiens
aaccattcacagtgtagccaaa

SEQ ID NO: 7165262 - DNA, 22 bp, Homo sapiens
aaccaggagattaaagaaaggt

SEQ ID NO: 7165263 - DNA, 22 bp, Homo sapiens
aaccaggtgactcatggtgagc

SEQ ID NO: 7165264 - DNA, 22 bp, Homo sapiens
aaccagtactttacacagctct

SEQ ID NO: 7165265 - DNA, 22 bp, Homo sapiens
aaccagttgtatgtcctccagc

SEQ ID NO: 7165266 - DNA, 22 bp, Homo sapiens
aaccagtttagtcatgctgtaa

SEQ ID NO: 7165267 - DNA, 22 bp, Homo sapiens
aaccagtttagtcatgctgtaa

SEQ ID NO: 7165268 - DNA, 22 bp, Homo sapiens
aaccatgacaaaccatagacat

SEQ ID NO: 7165269 - DNA, 20 bp, Homo sapiens
aactcctagcctcaagtgat

SEQ ID NO: 7165270 - DNA, 20 bp, Homo sapiens
aactcctagcctcaagtgat

SEQ ID NO: 7165271 - DNA, 22 bp, Homo sapiens
aactcccactcagcttcttaat

SEQ ID NO: 7165272 - DNA, 22 bp, Homo sapiens
aactcccactcagcttcttaat

SEQ ID NO: 7165273 - DNA, 21 bp, Homo sapiens
aactcccagtgccttcccagc

SEQ ID NO: 7165274 - DNA, 22 bp, Homo sapiens
aactccagggtcaccattcaca

SEQ ID NO: 7165275 - DNA, 22 bp, Homo sapiens
aactccatggttctcagattct

SEQ ID NO: 7165276 - DNA, 22 bp, Homo sapiens
aactccatggttctcagattct

SEQ ID NO: 7165277 - DNA, 22 bp, Homo sapiens
aactcatttgcatttttcctgt

SEQ ID NO: 7165278 - DNA, 22 bp, Homo sapiens
aactccagcaggaaggtgagaa

SEQ ID NO: 7165279 - DNA, 22 bp, Homo sapiens
aactccagctcacacagtgacc

SEQ ID NO: 7165280 - DNA, 22 bp, Homo sapiens
aagaggcagcccgctgaggctg

SEQ ID NO: 7165281 - DNA, 22 bp, Homo sapiens
aagaggcagcccgctgaggctg

SEQ ID NO: 7165282 - DNA, 22 bp, Homo sapiens
aagaggcagaaatatcgctgaa

SEQ ID NO: 7165283 - DNA, 22 bp, Homo sapiens
aagaggcagaaatatcgctgaa

SEQ ID NO: 7165284 - DNA, 22 bp, Homo sapiens
aagaggcagtggtgatgaatgg

SEQ ID NO: 7165285 - DNA, 22 bp, Homo sapiens
aagaggcagtggtgatgaatgg

SEQ ID NO: 7165286 - DNA, 22 bp, Homo sapiens
aagaggcataaaatttatatgg

SEQ ID NO: 7165287 - DNA, 22 bp, Homo sapiens
aagaggagggcagattcaaggc

SEQ ID NO: 7165288 - DNA, 23 bp, Homo sapiens
aagaggaggccctgctcccgtcc

SEQ ID NO: 7165289 - DNA, 22 bp, Homo sapiens
aagaggagggcagattcaaggc

SEQ ID NO: 7165290 - DNA, 22 bp, Homo sapiens
aagaggagggcagattcaaggc

SEQ ID NO: 7165291 - DNA, 19 bp, Homo sapiens
aagaggcaaccctcgagcc

SEQ ID NO: 7165292 - DNA, 22 bp, Homo sapiens
aagaggagtagatgtggttggt

SEQ ID NO: 7165293 - DNA, 19 bp, Homo sapiens
aagaggcaaccctcgagcc

SEQ ID NO: 7165294 - DNA, 22 bp, Homo sapiens
aagaggagtagatgtggttggt

SEQ ID NO: 7165295 - DNA, 22 bp, Homo sapiens
aagaccagggtgggtacgttcc

SEQ ID NO: 7165296 - DNA, 22 bp, Homo sapiens
aagacattttgaaattggaagc

SEQ ID NO: 7165297 - DNA, 22 bp, Homo sapiens
aagacattttagagatagggaa

SEQ ID NO: 7165298 - DNA, 22 bp, Homo sapiens
aagacatttatgaaaagtgctg

SEQ ID NO: 7165299 - DNA, 22 bp, Homo sapiens
aagacatttatgaaaagtgctg

SEQ ID NO: 7165300 - DNA, 22 bp, Homo sapiens
aagacatttatttgaatcaatt

SEQ ID NO: 7165301 - DNA, 22 bp, Homo sapiens
aagacatttatttgaatcaatt

SEQ ID NO: 7165302 - DNA, 22 bp, Homo sapiens
aagaggaagtctccatggagag

SEQ ID NO: 7165303 - DNA, 22 bp, Homo sapiens
aagaggaactgggggctgagtc

SEQ ID NO: 7165304 - DNA, 23 bp, Homo sapiens
aagaggaggccctgctcccgtcc

SEQ ID NO: 7165305 - DNA, 22 bp, Homo sapiens
aagaggaggattgatgtgggag

SEQ ID NO: 7165306 - DNA, 22 bp, Homo sapiens
aagaggaggattgatgtgggag

SEQ ID NO: 7165307 - DNA, 22 bp, Homo sapiens
aagaggaggattgatgtgggag

SEQ ID NO: 7165308 - DNA, 22 bp, Homo sapiens
aagaggaggattgatgtgggag

SEQ ID NO: 7165309 - DNA, 22 bp, Homo sapiens
acacacaggtaaaggagcctgg

SEQ ID NO: 7165310 - DNA, 22 bp, Homo sapiens
acacacagcgcctaccatgtgc

SEQ ID NO: 7165311 - DNA, 22 bp, Homo sapiens
acacacagagtttatacaggca

SEQ ID NO: 7165312 - DNA, 22 bp, Homo sapiens
acacacagagtttatacaggca

SEQ ID NO: 7165313 - DNA, 22 bp, Homo sapiens
acacacagcgcctaccatgtgc

SEQ ID NO: 7165314 - DNA, 22 bp, Homo sapiens
acacacagcgcctaccatgtgc

SEQ ID NO: 7165315 - DNA, 20 bp, Homo sapiens
acacacagagacatgcgcat

SEQ ID NO: 7165316 - DNA, 22 bp, Homo sapiens
acacacagagtttatacaggca

SEQ ID NO: 7165317 - DNA, 22 bp, Homo sapiens
acacacagagtttatacaggca

SEQ ID NO: 7165318 - DNA, 22 bp, Homo sapiens
acacacagagtttatacaggca

SEQ ID NO: 7165319 - DNA, 22 bp, Homo sapiens
acacacagagtttatacaggca

SEQ ID NO: 7165320 - DNA, 20 bp, Homo sapiens
acacacagagacatgcgcat

SEQ ID NO: 7165321 - DNA, 22 bp, Homo sapiens
acacacagaaggaagccccact

SEQ ID NO: 7165322 - DNA, 22 bp, Homo sapiens
aagaggcatctcagcttcctct

SEQ ID NO: 7165323 - DNA, 22 bp, Homo sapiens
aagaggcatctcagcttcctct

SEQ ID NO: 7165324 - DNA, 22 bp, Homo sapiens
aagaggttctaatttaactatc

SEQ ID NO: 7165325 - DNA, 22 bp, Homo sapiens
aagaggtgggttggacagatac

SEQ ID NO: 7165326 - DNA, 22 bp, Homo sapiens
aagaggttattgttcccagctt

SEQ ID NO: 7165327 - DNA, 22 bp, Homo sapiens
aagaggtggaacagcaattcgt

SEQ ID NO: 7165328 - DNA, 22 bp, Homo sapiens
aagaggtgccaggggttttgta

SEQ ID NO: 7165329 - DNA, 20 bp, Homo sapiens
aagaggtgataacaggtgag

SEQ ID NO: 7165330 - DNA, 22 bp, Homo sapiens
aagaggtgagaagctacactta

SEQ ID NO: 7165331 - DNA, 22 bp, Homo sapiens
acacacatgcatgcttgccatt

SEQ ID NO: 7165332 - DNA, 22 bp, Homo sapiens
acacacatgcatgcttgccatt

SEQ ID NO: 7165333 - DNA, 22 bp, Homo sapiens
acacacaggtaaaggagcctgg

SEQ ID NO: 7165334 - DNA, 22 bp, Homo sapiens
aagaggctttcagtgaacttgt

SEQ ID NO: 7165335 - DNA, 19 bp, Homo sapiens
aagagggaaagtgctatgc

SEQ ID NO: 7165336 - DNA, 21 bp, Homo sapiens
aagaggtcaaattataaatgg

SEQ ID NO: 7165337 - DNA, 22 bp, Homo sapiens
aagaggttgtctgtgatgagtt

SEQ ID NO: 7165338 - DNA, 22 bp, Homo sapiens
aagaggttgtctgtgatgagtt

SEQ ID NO: 7165339 - DNA, 22 bp, Homo sapiens
aagaggttctccttggagtggg

SEQ ID NO: 7165340 - DNA, 22 bp, Homo sapiens
aagaggtttcatgattttctta

SEQ ID NO: 7165341 - DNA, 22 bp, Homo sapiens
aagaggtttaactgactcacag

SEQ ID NO: 7165342 - DNA, 22 bp, Homo sapiens
aagaggtttaactgactcacag

SEQ ID NO: 7165343 - DNA, 22 bp, Homo sapiens
aagaggttgtctgtgatgagtt

SEQ ID NO: 7165344 - DNA, 22 bp, Homo sapiens
aagaggttgtctgtgatgagtt

SEQ ID NO: 7165345 - DNA, 22 bp, Homo sapiens
aagaggtttcatgattttctta

SEQ ID NO: 7165346 - DNA, 22 bp, Homo sapiens
aagaggtttcatgattttctta

SEQ ID NO: 7165347 - DNA, 22 bp, Homo sapiens
aagagtaaagcaaagcacttgt

SEQ ID NO: 7165348 - DNA, 22 bp, Homo sapiens
aagagtaaatgtctaattagga

SEQ ID NO: 7165349 - DNA, 22 bp, Homo sapiens
aagagtctattggaactagaca

SEQ ID NO: 7165350 - DNA, 22 bp, Homo sapiens
aagagtatgcatgcatgtttgt

SEQ ID NO: 7165351 - DNA, 22 bp, Homo sapiens
aagagtacttgcagccagggcc

SEQ ID NO: 7165352 - DNA, 22 bp, Homo sapiens
aagagtatagctttaggattga

SEQ ID NO: 7165353 - DNA, 22 bp, Homo sapiens
aagagtaaattcaggactttaa

SEQ ID NO: 7165354 - DNA, 22 bp, Homo sapiens
aagagtttaccagtgctgcttc

SEQ ID NO: 7165355 - DNA, 23 bp, Homo sapiens
aagagtttagagtcttgcagagt

SEQ ID NO: 7165356 - DNA, 22 bp, Homo sapiens
aagagttctcagaaacgtgggt

SEQ ID NO: 7165357 - DNA, 22 bp, Homo sapiens
aagagttctcagaaacgtgggt

SEQ ID NO: 7165358 - DNA, 22 bp, Homo sapiens
aagagtttaattttgtctagac

SEQ ID NO: 7165359 - DNA, 22 bp, Homo sapiens
aagagttaagcaacagatacca

SEQ ID NO: 7165360 - DNA, 22 bp, Homo sapiens
aagagttatagttggtatgtgg

SEQ ID NO: 7165361 - DNA, 22 bp, Homo sapiens
aagagttatataatgtgtagtt

SEQ ID NO: 7165362 - DNA, 22 bp, Homo sapiens
aagagttatgaaagcaaggcat

SEQ ID NO: 7165363 - DNA, 20 bp, Homo sapiens
aagagtctttactgagctaa

SEQ ID NO: 7165364 - DNA, 22 bp, Homo sapiens
aagagtgacttttcagctgtga

SEQ ID NO: 7165365 - DNA, 22 bp, Homo sapiens
aagagtgacttttcagctgtga

SEQ ID NO: 7165366 - DNA, 22 bp, Homo sapiens
aagagtgagtatttcctgatta

SEQ ID NO: 7165367 - DNA, 22 bp, Homo sapiens
aagagtggagctggaaagtggg

SEQ ID NO: 7165368 - DNA, 22 bp, Homo sapiens
aagagtggagctggaaagtggg

SEQ ID NO: 7165369 - DNA, 22 bp, Homo sapiens
aagagtggagctggaaagtggg

SEQ ID NO: 7165370 - DNA, 21 bp, Homo sapiens
aagagtggctgaggaggtgat

SEQ ID NO: 7165371 - DNA, 22 bp, Homo sapiens
aagagttaaatgaatgagtggg

SEQ ID NO: 7165372 - DNA, 22 bp, Homo sapiens
acacatttctctttttgtaagt

SEQ ID NO: 7165373 - DNA, 22 bp, Homo sapiens
acacccaggctggcgtgcagtg

SEQ ID NO: 7165374 - DNA, 22 bp, Homo sapiens
acacccatgcttctgaggctct

SEQ ID NO: 7165375 - DNA, 22 bp, Homo sapiens
acaccccaccagtaactgaggg

SEQ ID NO: 7165376 - DNA, 22 bp, Homo sapiens
aagagtttatgatataacatgt

SEQ ID NO: 7165377 - DNA, 23 bp, Homo sapiens
aagagtttagagtcttgcagagt

SEQ ID NO: 7165378 - DNA, 22 bp, Homo sapiens
acacctttgccccaagtcatag

SEQ ID NO: 7165379 - DNA, 22 bp, Homo sapiens
acacgcatagaaaattgcacta

SEQ ID NO: 7165380 - DNA, 22 bp, Homo sapiens
acacctttgtgaagtgatgatg

SEQ ID NO: 7165381 - DNA, 22 bp, Homo sapiens
acaccttttattcgccaggcac

SEQ ID NO: 7165382 - DNA, 22 bp, Homo sapiens
acacccttgtccatagcagatg

SEQ ID NO: 7165383 - DNA, 22 bp, Homo sapiens
acacctggtctttgcatgagca

SEQ ID NO: 7165384 - DNA, 22 bp, Homo sapiens
acacctggtctttgcatgagca

SEQ ID NO: 7165385 - DNA, 22 bp, Homo sapiens
acaccttctgagaactgagcag

SEQ ID NO: 7165386 - DNA, 22 bp, Homo sapiens
acacctttcaggtccagacagt

SEQ ID NO: 7165387 - DNA, 22 bp, Homo sapiens
acacggcactttaggaaggggc

SEQ ID NO: 7165388 - DNA, 22 bp, Homo sapiens
acacggcactttaggaaggggc

SEQ ID NO: 7165389 - DNA, 22 bp, Homo sapiens
acacggcactttaggaaggggc

SEQ ID NO: 7165390 - DNA, 22 bp, Homo sapiens
acacgcatgatgatgcacgtac

SEQ ID NO: 7165391 - DNA, 22 bp, Homo sapiens
acacggcactttaggaaggggc

SEQ ID NO: 7165392 - DNA, 22 bp, Homo sapiens
acacggcactttaggaaggggc

SEQ ID NO: 7165393 - DNA, 21 bp, Homo sapiens
acacgtgtgtgtaaacacaca

SEQ ID NO: 7165394 - DNA, 22 bp, Homo sapiens
acactaaatgagtctacagtac

SEQ ID NO: 7165395 - DNA, 22 bp, Homo sapiens
acactaaatgagtctacagtac

SEQ ID NO: 7165396 - DNA, 23 bp, Homo sapiens
acactaaatgtgaaggagcaaag

SEQ ID NO: 7165397 - DNA, 23 bp, Homo sapiens
acactaaatgtgaaggagcaaag

SEQ ID NO: 7165398 - DNA, 22 bp, Homo sapiens
acactacttttcataaaagtaa

SEQ ID NO: 7165399 - DNA, 22 bp, Homo sapiens
acactagagagcaggcattccc

SEQ ID NO: 7165400 - DNA, 22 bp, Homo sapiens
aagatacatcaaagcaaattgg

SEQ ID NO: 7165401 - DNA, 22 bp, Homo sapiens
acactacagggagaagactcac

SEQ ID NO: 7165402 - DNA, 22 bp, Homo sapiens
acactacagggagaagactcac

SEQ ID NO: 7165403 - DNA, 22 bp, Homo sapiens
acactacaatctcagaactata

SEQ ID NO: 7165404 - DNA, 22 bp, Homo sapiens
acactacaatctcagaactata

SEQ ID NO: 7165405 - DNA, 22 bp, Homo sapiens
aagatatactattaagtaccat

SEQ ID NO: 7165406 - DNA, 22 bp, Homo sapiens
aagatagcttggaaaagtacag

SEQ ID NO: 7165407 - DNA, 22 bp, Homo sapiens
aagatataataactgttgtcat

SEQ ID NO: 7165408 - DNA, 22 bp, Homo sapiens
aagatatagaaagagctgggag

SEQ ID NO: 7165409 - DNA, 22 bp, Homo sapiens
aagatatagataaaactatgca

SEQ ID NO: 7165410 - DNA, 19 bp, Homo sapiens
acagaaatgtaagtgagac

SEQ ID NO: 7165411 - DNA, 19 bp, Homo sapiens
acagaaatgtaagtgagac

SEQ ID NO: 7165412 - DNA, 19 bp, Homo sapiens
acagaaatgtaagtgagac

SEQ ID NO: 7165413 - DNA, 19 bp, Homo sapiens
acagaaatgtaagtgagac

SEQ ID NO: 7165414 - DNA, 19 bp, Homo sapiens
acagaaatgtaagtgagac

SEQ ID NO: 7165415 - DNA, 22 bp, Homo sapiens
acagaagaagttcaaggtgaag

SEQ ID NO: 7165416 - DNA, 22 bp, Homo sapiens
acagaagaagttcaaggtgaag

SEQ ID NO: 7165417 - DNA, 22 bp, Homo sapiens
acagaagaagttcaaggtgaag

SEQ ID NO: 7165418 - DNA, 22 bp, Homo sapiens
acagaagaagttcaaggtgaag

SEQ ID NO: 7165419 - DNA, 22 bp, Homo sapiens
acagaagaagttcaaggtgaag

SEQ ID NO: 7165420 - DNA, 22 bp, Homo sapiens
acagaagacagagtgttcatct

SEQ ID NO: 7165421 - DNA, 22 bp, Homo sapiens
acagaagacagagtgttcatct

SEQ ID NO: 7165422 - DNA, 22 bp, Homo sapiens
acagaagacagagtgttcatct

SEQ ID NO: 7165423 - DNA, 22 bp, Homo sapiens
acagaagacagagtgttcatct

SEQ ID NO: 7165424 - DNA, 22 bp, Homo sapiens
acagaagacagagtgttcatct

SEQ ID NO: 7165425 - DNA, 22 bp, Homo sapiens
acagaagaccaagaaagcttcc

SEQ ID NO: 7165426 - DNA, 22 bp, Homo sapiens
aagatagatgtcatcagcatat

SEQ ID NO: 7165427 - DNA, 22 bp, Homo sapiens
aagatagatgtcatcagcatat

SEQ ID NO: 7165428 - DNA, 22 bp, Homo sapiens
aagatactttgcatgcatgaag

SEQ ID NO: 7165429 - DNA, 22 bp, Homo sapiens
aagatacttcacttgccgaaat

SEQ ID NO: 7165430 - DNA, 22 bp, Homo sapiens
aagatactgatgatgtaggcta

SEQ ID NO: 7165431 - DNA, 22 bp, Homo sapiens
aagatacattttcttcagagaa

SEQ ID NO: 7165432 - DNA, 22 bp, Homo sapiens
aagatactcagtggatatgcat

SEQ ID NO: 7165433 - DNA, 20 bp, Homo sapiens
aagatactccagaaattaaa

SEQ ID NO: 7165434 - DNA, 20 bp, Homo sapiens
aagatactccagaaattaaa

SEQ ID NO: 7165435 - DNA, 20 bp, Homo sapiens
aagatactccagaaattaaa

SEQ ID NO: 7165436 - DNA, 22 bp, Homo sapiens
aagatactgatgatgtaggcta

SEQ ID NO: 7165437 - DNA, 22 bp, Homo sapiens
aagatactgatgatgtaggcta

SEQ ID NO: 7165438 - DNA, 22 bp, Homo sapiens
aagatacattttcttcagagaa

SEQ ID NO: 7165439 - DNA, 22 bp, Homo sapiens
aagatacattttcttcagagaa

SEQ ID NO: 7165440 - DNA, 22 bp, Homo sapiens
aagatacattttcttcagagaa

SEQ ID NO: 7165441 - DNA, 22 bp, Homo sapiens
aagatacattatgtctctctga

SEQ ID NO: 7165442 - DNA, 22 bp, Homo sapiens
aagatacattatgtctctctga

SEQ ID NO: 7165443 - DNA, 22 bp, Homo sapiens
aagatacattgtttttggtagt

SEQ ID NO: 7165444 - DNA, 22 bp, Homo sapiens
aagatacatcattcaggagtga

SEQ ID NO: 7165445 - DNA, 22 bp, Homo sapiens
aagatacatcattcaggagtga

SEQ ID NO: 7165446 - DNA, 22 bp, Homo sapiens
aagatacatcattcaggagtga

SEQ ID NO: 7165447 - DNA, 22 bp, Homo sapiens
aagatacatcattcaggagtga

SEQ ID NO: 7165448 - DNA, 22 bp, Homo sapiens
aagatacatgttaggagcaacc

SEQ ID NO: 7165449 - DNA, 22 bp, Homo sapiens
aagatacatgttaggagcaacc

SEQ ID NO: 7165450 - DNA, 22 bp, Homo sapiens
aagattttcagctaatggtgca

SEQ ID NO: 7165451 - DNA, 22 bp, Homo sapiens
aagattttcagctaatggtgca

SEQ ID NO: 7165452 - DNA, 19 bp, Homo sapiens
aagatttggtcattgataa

SEQ ID NO: 7165453 - DNA, 19 bp, Homo sapiens
aagatttggtcattgataa

SEQ ID NO: 7165454 - DNA, 22 bp, Homo sapiens
aagatttgtggatttaaggata

SEQ ID NO: 7165455 - DNA, 22 bp, Homo sapiens
aagattttcagctaatggtgca

SEQ ID NO: 7165456 - DNA, 22 bp, Homo sapiens
aagattttcagtgcctaaaaca

SEQ ID NO: 7165457 - DNA, 22 bp, Homo sapiens
aagattttctcaactgtatttg

SEQ ID NO: 7165458 - DNA, 22 bp, Homo sapiens
aagattttctcaactgtatttg

SEQ ID NO: 7165459 - DNA, 22 bp, Homo sapiens
aagatttttttccacagactca

SEQ ID NO: 7165460 - DNA, 22 bp, Homo sapiens
aagattttctcaactgtatttg

SEQ ID NO: 7165461 - DNA, 22 bp, Homo sapiens
aagatttttttccacagactca

SEQ ID NO: 7165462 - DNA, 22 bp, Homo sapiens
aagcaaaaggttacacttctgg

SEQ ID NO: 7165463 - DNA, 22 bp, Homo sapiens
aagcaaaaggttacacttctgg

SEQ ID NO: 7165464 - DNA, 22 bp, Homo sapiens
aagcaaaaggttacacttctgg

SEQ ID NO: 7165465 - DNA, 22 bp, Homo sapiens
acagaagaccagagagctaact

SEQ ID NO: 7165466 - DNA, 22 bp, Homo sapiens
acagaagaccagagagctaact

SEQ ID NO: 7165467 - DNA, 22 bp, Homo sapiens
acagaagaccagagagctaact

SEQ ID NO: 7165468 - DNA, 22 bp, Homo sapiens
acagaagaccagagagctaact

SEQ ID NO: 7165469 - DNA, 22 bp, Homo sapiens
acagaagagcacatttagtatg

SEQ ID NO: 7165470 - DNA, 22 bp, Homo sapiens
acagaagagcacatttagtatg

SEQ ID NO: 7165471 - DNA, 22 bp, Homo sapiens
acagaagagcacatttagtatg

SEQ ID NO: 7165472 - DNA, 22 bp, Homo sapiens
acagaagagcacatttagtatg

SEQ ID NO: 7165473 - DNA, 22 bp, Homo sapiens
acagaagagctggctctgtgct

SEQ ID NO: 7165474 - DNA, 22 bp, Homo sapiens
acagaagagctggctctgtgct

SEQ ID NO: 7165475 - DNA, 22 bp, Homo sapiens
acagaagagctggctctgtgct

SEQ ID NO: 7165476 - DNA, 22 bp, Homo sapiens
acagaagataactgggaccaga

SEQ ID NO: 7165477 - DNA, 22 bp, Homo sapiens
acagaagataatgctgccttgg

SEQ ID NO: 7165478 - DNA, 22 bp, Homo sapiens
acagaagataatgctgccttgg

SEQ ID NO: 7165479 - DNA, 22 bp, Homo sapiens
acagaagataatgctgccttgg

SEQ ID NO: 7165480 - DNA, 22 bp, Homo sapiens
acagaagataatgctgccttgg

SEQ ID NO: 7165481 - DNA, 22 bp, Homo sapiens
acagaagataatgctgccttgg

SEQ ID NO: 7165482 - DNA, 22 bp, Homo sapiens
acagaagcagccgtcacagata

SEQ ID NO: 7165483 - DNA, 22 bp, Homo sapiens
acagaagcagccgtcacagata

SEQ ID NO: 7165484 - DNA, 22 bp, Homo sapiens
acagaagcagccgtcacagata

SEQ ID NO: 7165485 - DNA, 22 bp, Homo sapiens
acagaagcagccgtcacagata

SEQ ID NO: 7165486 - DNA, 22 bp, Homo sapiens
acagaagcagccgtcacagata

SEQ ID NO: 7165487 - DNA, 22 bp, Homo sapiens
acagaagcagccgtcacagata

SEQ ID NO: 7165488 - DNA, 22 bp, Homo sapiens
acagaagcagcgcggctcttct

SEQ ID NO: 7165489 - DNA, 22 bp, Homo sapiens
aagatttgactctgattagcat

SEQ ID NO: 7165490 - DNA, 22 bp, Homo sapiens
acagatgagactccaggacctt

SEQ ID NO: 7165491 - DNA, 23 bp, Homo sapiens
acagatgaaagtgtggctcagag

SEQ ID NO: 7165492 - DNA, 22 bp, Homo sapiens
acagatgaatttatggatggaa

SEQ ID NO: 7165493 - DNA, 22 bp, Homo sapiens
acagagtcatggtagtcaaagg

SEQ ID NO: 7165494 - DNA, 23 bp, Homo sapiens
acagatcatctcgaaacaactat

SEQ ID NO: 7165495 - DNA, 23 bp, Homo sapiens
acagatcatctcgaaacaactat

SEQ ID NO: 7165496 - DNA, 22 bp, Homo sapiens
acagatctacattgtctgaccc

SEQ ID NO: 7165497 - DNA, 22 bp, Homo sapiens
acagatccttcttctgcattgc

SEQ ID NO: 7165498 - DNA, 22 bp, Homo sapiens
acagatgaaaaagcttgtggat

SEQ ID NO: 7165499 - DNA, 22 bp, Homo sapiens
aagcacatttggaaaacatgga

SEQ ID NO: 7165500 - DNA, 22 bp, Homo sapiens
aagcacattgtacatttgtgct

SEQ ID NO: 7165501 - DNA, 20 bp, Homo sapiens
aagcacatttctacaataat

SEQ ID NO: 7165502 - DNA, 22 bp, Homo sapiens
aagcacattgcctggcacatag

SEQ ID NO: 7165503 - DNA, 22 bp, Homo sapiens
aagcacattatagctatctagg

SEQ ID NO: 7165504 - DNA, 22 bp, Homo sapiens
aagcacattaaggaacattgaa

SEQ ID NO: 7165505 - DNA, 22 bp, Homo sapiens
aagcacattaaggaacattgaa

SEQ ID NO: 7165506 - DNA, 22 bp, Homo sapiens
aagcacatgaaaatgtgaagct

SEQ ID NO: 7165507 - DNA, 22 bp, Homo sapiens
aagcacatctcctgtgcagaac

SEQ ID NO: 7165508 - DNA, 22 bp, Homo sapiens
aagcacatctcaaacttcatct

SEQ ID NO: 7165509 - DNA, 22 bp, Homo sapiens
aagcacatctcaaacttcatct

SEQ ID NO: 7165510 - DNA, 22 bp, Homo sapiens
acagaggaagcatatagcacaa

SEQ ID NO: 7165511 - DNA, 22 bp, Homo sapiens
acagagcttaattcaggagctt

SEQ ID NO: 7165512 - DNA, 22 bp, Homo sapiens
acagagcttaattcaggagctt

SEQ ID NO: 7165513 - DNA, 22 bp, Homo sapiens
acagagcttaggatgactccca

SEQ ID NO: 7165514 - DNA, 22 bp, Homo sapiens
aagcaaacaggagaagagctgt

SEQ ID NO: 7165515 - DNA, 22 bp, Homo sapiens
acagagcacatagattggagtt

SEQ ID NO: 7165516 - DNA, 22 bp, Homo sapiens
acagagcacatagattggagtt

SEQ ID NO: 7165517 - DNA, 17 bp, Homo sapiens
acagagcacatcaagat

SEQ ID NO: 7165518 - DNA, 17 bp, Homo sapiens
acagagcacatcaagat

SEQ ID NO: 7165519 - DNA, 17 bp, Homo sapiens
acagagcacatcaagat

SEQ ID NO: 7165520 - DNA, 22 bp, Homo sapiens
acagagctgtacatgtgccatg

SEQ ID NO: 7165521 - DNA, 17 bp, Homo sapiens
acagagcacatcaagat

SEQ ID NO: 7165522 - DNA, 22 bp, Homo sapiens
acagaggaaggctgagctgccc

SEQ ID NO: 7165523 - DNA, 22 bp, Homo sapiens
acagaggaaggctgagctgccc

SEQ ID NO: 7165524 - DNA, 22 bp, Homo sapiens
acagaggaaggctgagctgccc

SEQ ID NO: 7165525 - DNA, 22 bp, Homo sapiens
acagaggacaactaggcgctca

SEQ ID NO: 7165526 - DNA, 18 bp, Homo sapiens
acagaggcagacatgtat

SEQ ID NO: 7165527 - DNA, 18 bp, Homo sapiens
acagaggcagacatgtat

SEQ ID NO: 7165528 - DNA, 22 bp, Homo sapiens
acagaggacaactaggcgctca

SEQ ID NO: 7165529 - DNA, 22 bp, Homo sapiens
aagcacagttcttagagttaca

SEQ ID NO: 7165530 - DNA, 22 bp, Homo sapiens
aagcacagttcttagagttaca

SEQ ID NO: 7165531 - DNA, 22 bp, Homo sapiens
aagcacagttcttagagttaca

SEQ ID NO: 7165532 - DNA, 22 bp, Homo sapiens
aagcacatcatgttgttcagac

SEQ ID NO: 7165533 - DNA, 22 bp, Homo sapiens
aattcaaagactagaattttgc

SEQ ID NO: 7165534 - DNA, 22 bp, Homo sapiens
aattcaaattacaatagttgtt

SEQ ID NO: 7165535 - DNA, 23 bp, Homo sapiens
aattcaaattcagtgtgactagg

SEQ ID NO: 7165536 - DNA, 23 bp, Homo sapiens
aattcaaattcagtgtgactagg

SEQ ID NO: 7165537 - DNA, 23 bp, Homo sapiens
aattcaaattcagtgtgactagg

SEQ ID NO: 7165538 - DNA, 23 bp, Homo sapiens
aattcaaattcagtgtgactagg

SEQ ID NO: 7165539 - DNA, 23 bp, Homo sapiens
aattcaaattcagtgtgactagg

SEQ ID NO: 7165540 - DNA, 22 bp, Homo sapiens
aattcaacagtcagttatctca

SEQ ID NO: 7165541 - DNA, 22 bp, Homo sapiens
aattcaaggatctgttaaatct

SEQ ID NO: 7165542 - DNA, 22 bp, Homo sapiens
aattcaatctaagaaatgatca

SEQ ID NO: 7165543 - DNA, 22 bp, Homo sapiens
aattcaatctaagaaatgatca

SEQ ID NO: 7165544 - DNA, 22 bp, Homo sapiens
aattcaatctaagaaatgatca

SEQ ID NO: 7165545 - DNA, 22 bp, Homo sapiens
aattcaatctaagaaatgatca

SEQ ID NO: 7165546 - DNA, 22 bp, Homo sapiens
aattcaatctaagaaatgatca

SEQ ID NO: 7165547 - DNA, 22 bp, Homo sapiens
aattcaatctaagaaatgatca

SEQ ID NO: 7165548 - DNA, 22 bp, Homo sapiens
aattagaatcttatttggggaa

SEQ ID NO: 7165549 - DNA, 22 bp, Homo sapiens
aattagaagggagttattgata

SEQ ID NO: 7165550 - DNA, 22 bp, Homo sapiens
aattagaagggagttattgata

SEQ ID NO: 7165551 - DNA, 22 bp, Homo sapiens
aattagagaagagtgaccagtc

SEQ ID NO: 7165552 - DNA, 22 bp, Homo sapiens
aattagaagctgttagcaaaat

SEQ ID NO: 7165553 - DNA, 22 bp, Homo sapiens
aattagaagctgttagcaaaat

SEQ ID NO: 7165554 - DNA, 22 bp, Homo sapiens
aattagaagctgttagcaaaat

SEQ ID NO: 7165555 - DNA, 22 bp, Homo sapiens
aattagcagcatattctgcgat

SEQ ID NO: 7165556 - DNA, 20 bp, Homo sapiens
aattagatgtttaatcaata

SEQ ID NO: 7165557 - DNA, 22 bp, Homo sapiens
aattatttaactcctttggaga

SEQ ID NO: 7165558 - DNA, 22 bp, Homo sapiens
aattatttaactcctttggaga

SEQ ID NO: 7165559 - DNA, 22 bp, Homo sapiens
aattagctaattaattgtagcc

SEQ ID NO: 7165560 - DNA, 22 bp, Homo sapiens
aattagctaattaattgtagcc

SEQ ID NO: 7165561 - DNA, 22 bp, Homo sapiens
aattagcatttcccatataaat

SEQ ID NO: 7165562 - DNA, 22 bp, Homo sapiens
aattagcatttcccatataaat

SEQ ID NO: 7165563 - DNA, 22 bp, Homo sapiens
aattagcatttcccatataaat

SEQ ID NO: 7165564 - DNA, 22 bp, Homo sapiens
aagacaagcatcaaatcaggca

SEQ ID NO: 7165565 - DNA, 22 bp, Homo sapiens
aagaattttccagcatgtcagt

SEQ ID NO: 7165566 - DNA, 22 bp, Homo sapiens
aagacaaaggggtccttggatg

SEQ ID NO: 7165567 - DNA, 22 bp, Homo sapiens
aagacaaaggggtccttggatg

SEQ ID NO: 7165568 - DNA, 22 bp, Homo sapiens
aagacaaaggggtccttggatg

SEQ ID NO: 7165569 - DNA, 22 bp, Homo sapiens
aagacaacagagatgacagact

SEQ ID NO: 7165570 - DNA, 22 bp, Homo sapiens
aagacaacagagatgacagact

SEQ ID NO: 7165571 - DNA, 22 bp, Homo sapiens
aagacaacagagatgacagact

SEQ ID NO: 7165572 - DNA, 17 bp, Homo sapiens
aagacaagacaaatgca

SEQ ID NO: 7165573 - DNA, 17 bp, Homo sapiens
aagacaagacaaatgca

SEQ ID NO: 7165574 - DNA, 17 bp, Homo sapiens
aagacaagacaaatgca

SEQ ID NO: 7165575 - DNA, 22 bp, Homo sapiens
aagaattattgcaatactagat

SEQ ID NO: 7165576 - DNA, 22 bp, Homo sapiens
aagaattattgcaatactagat

SEQ ID NO: 7165577 - DNA, 22 bp, Homo sapiens
aagaattattgcaatactagat

SEQ ID NO: 7165578 - DNA, 22 bp, Homo sapiens
aagaattattgcaatactagat

SEQ ID NO: 7165579 - DNA, 22 bp, Homo sapiens
aagaatgaaggatttagctgtt

SEQ ID NO: 7165580 - DNA, 22 bp, Homo sapiens
aagaattggtttcctctgtcat

SEQ ID NO: 7165581 - DNA, 22 bp, Homo sapiens
aagaatttaaactaaccatatg

SEQ ID NO: 7165582 - DNA, 22 bp, Homo sapiens
aagaattgatgtgaattgcagc

SEQ ID NO: 7165583 - DNA, 22 bp, Homo sapiens
aagaattgatgtgaattgcagc

SEQ ID NO: 7165584 - DNA, 22 bp, Homo sapiens
aattcaatggtttttaggatat

SEQ ID NO: 7165585 - DNA, 22 bp, Homo sapiens
aattcacaaaaccagattgctt

SEQ ID NO: 7165586 - DNA, 22 bp, Homo sapiens
aattcacaaaaccagattgctt

SEQ ID NO: 7165587 - DNA, 22 bp, Homo sapiens
aattcacaaaagttagatccat

SEQ ID NO: 7165588 - DNA, 22 bp, Homo sapiens
aattcacaatgtgtagtcatgc

SEQ ID NO: 7165589 - DNA, 22 bp, Homo sapiens
aattcacaatgtgtagtcatgc

SEQ ID NO: 7165590 - DNA, 22 bp, Homo sapiens
aagaatgaaggatttagctgtt

SEQ ID NO: 7165591 - DNA, 22 bp, Homo sapiens
aagacattgtcattttataatt

SEQ ID NO: 7165592 - DNA, 22 bp, Homo sapiens
aagacattgtcattttataatt

SEQ ID NO: 7165593 - DNA, 22 bp, Homo sapiens
aagacattgtcattttataatt

SEQ ID NO: 7165594 - DNA, 22 bp, Homo sapiens
aagacattggacaatccagagg

SEQ ID NO: 7165595 - DNA, 22 bp, Homo sapiens
aagacattgcatgataatgctg

SEQ ID NO: 7165596 - DNA, 22 bp, Homo sapiens
aagacattgctgcttttaattg

SEQ ID NO: 7165597 - DNA, 22 bp, Homo sapiens
aagacattcatgaagaagggat

SEQ ID NO: 7165598 - DNA, 22 bp, Homo sapiens
acaagaataaggataagagatt

SEQ ID NO: 7165599 - DNA, 22 bp, Homo sapiens
acaagaataaggataagagatt

SEQ ID NO: 7165600 - DNA, 22 bp, Homo sapiens
acaagaatgtagattagttaag

SEQ ID NO: 7165601 - DNA, 22 bp, Homo sapiens
acaactttctgggttatctgat

SEQ ID NO: 7165602 - DNA, 22 bp, Homo sapiens
acaactttctgggttatctgat

SEQ ID NO: 7165603 - DNA, 22 bp, Homo sapiens
acaactttaatgggtttcagct

SEQ ID NO: 7165604 - DNA, 23 bp, Homo sapiens
acaactttacagatacattttgt

SEQ ID NO: 7165605 - DNA, 22 bp, Homo sapiens
acaactgttggaggaacacagg

SEQ ID NO: 7165606 - DNA, 22 bp, Homo sapiens
acaactgttggaggaacacagg

SEQ ID NO: 7165607 - DNA, 22 bp, Homo sapiens
acaactttgtagcaattccacg

SEQ ID NO: 7165608 - DNA, 22 bp, Homo sapiens
acaagaaaggtaggattcaggt

SEQ ID NO: 7165609 - DNA, 22 bp, Homo sapiens
acaagaaaggtaggattcaggt

SEQ ID NO: 7165610 - DNA, 22 bp, Homo sapiens
acaagaaccaaagaaggatatt

SEQ ID NO: 7165611 - DNA, 22 bp, Homo sapiens
acaagaaccaaagaaggatatt

SEQ ID NO: 7165612 - DNA, 22 bp, Homo sapiens
acaagaaccaaagaaggatatt

SEQ ID NO: 7165613 - DNA, 22 bp, Homo sapiens
acaagaaccaaagaaggatatt

SEQ ID NO: 7165614 - DNA, 22 bp, Homo sapiens
acaagaagagcatttgcagggt

SEQ ID NO: 7165615 - DNA, 22 bp, Homo sapiens
acaagaagggtgattaggggca

SEQ ID NO: 7165616 - DNA, 22 bp, Homo sapiens
acaagaagggtgattaggggca

SEQ ID NO: 7165617 - DNA, 22 bp, Homo sapiens
acaagaagtaaaggtcggatgc

SEQ ID NO: 7165618 - DNA, 22 bp, Homo sapiens
acaagaagtaaaggtcggatgc

SEQ ID NO: 7165619 - DNA, 22 bp, Homo sapiens
acaagaagtcacatctaggagt

SEQ ID NO: 7165620 - DNA, 22 bp, Homo sapiens
acaagaataaggataagagatt

SEQ ID NO: 7165621 - DNA, 22 bp, Homo sapiens
acaactgggggcattactggca

SEQ ID NO: 7165622 - DNA, 22 bp, Homo sapiens
acaactgtcagtaaagaatatt

SEQ ID NO: 7165623 - DNA, 22 bp, Homo sapiens
acaactgatgggtcatgtggga

SEQ ID NO: 7165624 - DNA, 22 bp, Homo sapiens
acaactccttcttgggtcctgg

SEQ ID NO: 7165625 - DNA, 22 bp, Homo sapiens
acaactccttcttgggtcctgg

SEQ ID NO: 7165626 - DNA, 22 bp, Homo sapiens
acaactccttcttgggtcctgg

SEQ ID NO: 7165627 - DNA, 22 bp, Homo sapiens
acaactgtcagtaaagaatatt

SEQ ID NO: 7165628 - DNA, 22 bp, Homo sapiens
acaactgtcttcttcatgctcc

SEQ ID NO: 7165629 - DNA, 22 bp, Homo sapiens
acaactgtcttcttcatgctcc

SEQ ID NO: 7165630 - DNA, 22 bp, Homo sapiens
acaactgtcttcttcatgctcc

SEQ ID NO: 7165631 - DNA, 22 bp, Homo sapiens
acaactgttagacacttctaag

SEQ ID NO: 7165632 - DNA, 22 bp, Homo sapiens
acaactgttggaggaacacagg

SEQ ID NO: 7165633 - DNA, 22 bp, Homo sapiens
acaactgttggaggaacacagg

SEQ ID NO: 7165634 - DNA, 22 bp, Homo sapiens
aagacacaatgtagcccagcac

SEQ ID NO: 7165635 - DNA, 22 bp, Homo sapiens
aagacacacacatatgctgagt

SEQ ID NO: 7165636 - DNA, 22 bp, Homo sapiens
aagacacacacatatgctgagt

SEQ ID NO: 7165637 - DNA, 22 bp, Homo sapiens
aagacacacacatatgctgagt

SEQ ID NO: 7165638 - DNA, 22 bp, Homo sapiens
aagacacacacatatgctgagt

SEQ ID NO: 7165639 - DNA, 22 bp, Homo sapiens
aagacacacacatatgctgagt

SEQ ID NO: 7165640 - DNA, 22 bp, Homo sapiens
aagacacacacatatgctgagt

SEQ ID NO: 7165641 - DNA, 22 bp, Homo sapiens
aagacacagcgaaatgttcctg

SEQ ID NO: 7165642 - DNA, 22 bp, Homo sapiens
aagacacagcgaaatgttcctg

SEQ ID NO: 7165643 - DNA, 22 bp, Homo sapiens
acaacaaaatgaggaagtggtc

SEQ ID NO: 7165644 - DNA, 22 bp, Homo sapiens
acaacaaaatgaggaagtggtc

SEQ ID NO: 7165645 - DNA, 22 bp, Homo sapiens
aagacacaaagcttcccttttc

SEQ ID NO: 7165646 - DNA, 22 bp, Homo sapiens
aagacacaaagcttcccttttc

SEQ ID NO: 7165647 - DNA, 22 bp, Homo sapiens
aagacacaaagcttcccttttc

SEQ ID NO: 7165648 - DNA, 22 bp, Homo sapiens
aagacacaatgtagcccagcac

SEQ ID NO: 7165649 - DNA, 22 bp, Homo sapiens
aagacaattttgagtatgcaca

SEQ ID NO: 7165650 - DNA, 22 bp, Homo sapiens
aagacaattttgagtatgcaca

SEQ ID NO: 7165651 - DNA, 22 bp, Homo sapiens
aagacaatttatgttagggtca

SEQ ID NO: 7165652 - DNA, 22 bp, Homo sapiens
aagacaatttgatactagttgc

SEQ ID NO: 7165653 - DNA, 22 bp, Homo sapiens
aagacaatttgatactagttgc

SEQ ID NO: 7165654 - DNA, 22 bp, Homo sapiens
aagacaattttgagtatgcaca

SEQ ID NO: 7165655 - DNA, 22 bp, Homo sapiens
aagacaatgagtcctgatggga

SEQ ID NO: 7165656 - DNA, 22 bp, Homo sapiens
aagacaatgcattactaagaag

SEQ ID NO: 7165657 - DNA, 22 bp, Homo sapiens
aagacaatgcattactaagaag

SEQ ID NO: 7165658 - DNA, 22 bp, Homo sapiens
aagacaatgcattactaagaag

SEQ ID NO: 7165659 - DNA, 22 bp, Homo sapiens
aagacaatgcattactaagaag

SEQ ID NO: 7165660 - DNA, 22 bp, Homo sapiens
aagacaatgtttctgatagata

SEQ ID NO: 7165661 - DNA, 22 bp, Homo sapiens
aatgtcaacacaagagaaatgc

SEQ ID NO: 7165662 - DNA, 22 bp, Homo sapiens
aatgtcaaagtgctttgcaaac

SEQ ID NO: 7165663 - DNA, 22 bp, Homo sapiens
aatgtcaaaatggaatgagact

SEQ ID NO: 7165664 - DNA, 22 bp, Homo sapiens
aatgtcaaaatggaatgagact

SEQ ID NO: 7165665 - DNA, 22 bp, Homo sapiens
aatgtattttgggagtttcttt

SEQ ID NO: 7165666 - DNA, 22 bp, Homo sapiens
aatgtattttgggagtttcttt

SEQ ID NO: 7165667 - DNA, 22 bp, Homo sapiens
aatgtattttgggagtttcttt

SEQ ID NO: 7165668 - DNA, 20 bp, Homo sapiens
aatgtattgttttgtttcag

SEQ ID NO: 7165669 - DNA, 22 bp, Homo sapiens
aatgtatttgatgtattagcct

SEQ ID NO: 7165670 - DNA, 22 bp, Homo sapiens
aatgtatttgatgtattagcct

SEQ ID NO: 7165671 - DNA, 22 bp, Homo sapiens
aatgtatttgatgtattagcct

SEQ ID NO: 7165672 - DNA, 22 bp, Homo sapiens
aatgtattttgggagtttcttt

SEQ ID NO: 7165673 - DNA, 20 bp, Homo sapiens
aatgtcttgagacatttcag

SEQ ID NO: 7165674 - DNA, 22 bp, Homo sapiens
aatgtcttggatacagaggttg

SEQ ID NO: 7165675 - DNA, 22 bp, Homo sapiens
aatgtctttaaagtgcaataga

SEQ ID NO: 7165676 - DNA, 22 bp, Homo sapiens
aactctcagaacttttggtggg

SEQ ID NO: 7165677 - DNA, 22 bp, Homo sapiens
aactctctctggctcccagcaa

SEQ ID NO: 7165678 - DNA, 22 bp, Homo sapiens
aactctctctggctcccagcaa

SEQ ID NO: 7165679 - DNA, 22 bp, Homo sapiens
aactctcttgggagtacctgga

SEQ ID NO: 7165680 - DNA, 22 bp, Homo sapiens
aactctcttgggagtacctgga

SEQ ID NO: 7165681 - DNA, 22 bp, Homo sapiens
aactctctttagagagggacaa

SEQ ID NO: 7165682 - DNA, 22 bp, Homo sapiens
aactctctttagagagggacaa

SEQ ID NO: 7165683 - DNA, 22 bp, Homo sapiens
aactctggattttagatcaggg

SEQ ID NO: 7165684 - DNA, 22 bp, Homo sapiens
aactctggtccaggctagtgcc

SEQ ID NO: 7165685 - DNA, 22 bp, Homo sapiens
aactctatttaccctactaaac

SEQ ID NO: 7165686 - DNA, 22 bp, Homo sapiens
aactctatttaccctactaaac

SEQ ID NO: 7165687 - DNA, 22 bp, Homo sapiens
aactctacttgggactcctctg

SEQ ID NO: 7165688 - DNA, 22 bp, Homo sapiens
aactctagggaggcaggaagca

SEQ ID NO: 7165689 - DNA, 22 bp, Homo sapiens
aactcctgttctatgacaagag

SEQ ID NO: 7165690 - DNA, 22 bp, Homo sapiens
aactcctcactgcctctggcac

SEQ ID NO: 7165691 - DNA, 22 bp, Homo sapiens
aactcctatgacccactgaact

SEQ ID NO: 7165692 - DNA, 23 bp, Homo sapiens
aactcctgaatcgtgagccatct

SEQ ID NO: 7165693 - DNA, 22 bp, Homo sapiens
aactcctctctggtggttcgtc

SEQ ID NO: 7165694 - DNA, 22 bp, Homo sapiens
aatgtattctctttataagata

SEQ ID NO: 7165695 - DNA, 22 bp, Homo sapiens
aatgtattctgggaaaatgtta

SEQ ID NO: 7165696 - DNA, 22 bp, Homo sapiens
aatgtacaccgtgggtttttta

SEQ ID NO: 7165697 - DNA, 22 bp, Homo sapiens
aactgaaacggtgatcttttaa

SEQ ID NO: 7165698 - DNA, 22 bp, Homo sapiens
aactgaaacggtgatcttttaa

SEQ ID NO: 7165699 - DNA, 22 bp, Homo sapiens
aatgtattctgggaaaatgtta

SEQ ID NO: 7165700 - DNA, 22 bp, Homo sapiens
aatgtattctgggaaaatgtta

SEQ ID NO: 7165701 - DNA, 22 bp, Homo sapiens
aatgtattctgggaaaatgtta

SEQ ID NO: 7165702 - DNA, 22 bp, Homo sapiens
aactctttacatgtttgattca

SEQ ID NO: 7165703 - DNA, 22 bp, Homo sapiens
aactcttaattttcatgaaatg

SEQ ID NO: 7165704 - DNA, 22 bp, Homo sapiens
aactctgtgtaggaaccaggtc

SEQ ID NO: 7165705 - DNA, 22 bp, Homo sapiens
aactctttttttaagtgtagcc

SEQ ID NO: 7165706 - DNA, 22 bp, Homo sapiens
aatgttagattcctccacctag

SEQ ID NO: 7165707 - DNA, 22 bp, Homo sapiens
aatgttatgtggttcaacttaa

SEQ ID NO: 7165708 - DNA, 22 bp, Homo sapiens
aatgttatgtggttcaacttaa

SEQ ID NO: 7165709 - DNA, 22 bp, Homo sapiens
aatgttatgtggttcaacttaa

SEQ ID NO: 7165710 - DNA, 22 bp, Homo sapiens
aatgttatgtggttcaacttaa

SEQ ID NO: 7165711 - DNA, 22 bp, Homo sapiens
aatgttacataacccattgtcc

SEQ ID NO: 7165712 - DNA, 22 bp, Homo sapiens
aatgttacgatcaacaacacat

SEQ ID NO: 7165713 - DNA, 22 bp, Homo sapiens
aatgttacgatcaacaacacat

SEQ ID NO: 7165714 - DNA, 22 bp, Homo sapiens
aatgttacgatcaacaacacat

SEQ ID NO: 7165715 - DNA, 22 bp, Homo sapiens
aatgttaagtttagattataac

SEQ ID NO: 7165716 - DNA, 22 bp, Homo sapiens
aatgttaagtttagattataac

SEQ ID NO: 7165717 - DNA, 22 bp, Homo sapiens
aatgttaagtttagattataac

SEQ ID NO: 7165718 - DNA, 22 bp, Homo sapiens
aatgttaagtttagattataac

SEQ ID NO: 7165719 - DNA, 22 bp, Homo sapiens
aatgttaatgtgtttgcttatg

SEQ ID NO: 7165720 - DNA, 22 bp, Homo sapiens
aatgttaatgtgtttgcttatg

SEQ ID NO: 7165721 - DNA, 22 bp, Homo sapiens
aatgttaatgtgtttgcttatg

SEQ ID NO: 7165722 - DNA, 22 bp, Homo sapiens
aatgttaatgtgtttgcttatg

SEQ ID NO: 7165723 - DNA, 22 bp, Homo sapiens
aatgttaattcacagccaaata

SEQ ID NO: 7165724 - DNA, 22 bp, Homo sapiens
aatgttaattcacagccaaata

SEQ ID NO: 7165725 - DNA, 22 bp, Homo sapiens
aatgttaatttactgtcttcat

SEQ ID NO: 7165726 - DNA, 22 bp, Homo sapiens
aatgttaatttactgtcttcat

SEQ ID NO: 7165727 - DNA, 22 bp, Homo sapiens
aatgttaatttactgtcttcat

SEQ ID NO: 7165728 - DNA, 22 bp, Homo sapiens
aatgtgaaaccgcacagaataa

SEQ ID NO: 7165729 - DNA, 22 bp, Homo sapiens
aatgtgaaaccgcacagaataa

SEQ ID NO: 7165730 - DNA, 22 bp, Homo sapiens
aatgttaaaaccttcagtgctt

SEQ ID NO: 7165731 - DNA, 22 bp, Homo sapiens
aatgttaaaaccttcagtgctt

SEQ ID NO: 7165732 - DNA, 22 bp, Homo sapiens
aatgttaaaaccttcagtgctt

SEQ ID NO: 7165733 - DNA, 22 bp, Homo sapiens
aatgtcttttcccttactttcc

SEQ ID NO: 7165734 - DNA, 22 bp, Homo sapiens
aatgtcttttgatacaagttac

SEQ ID NO: 7165735 - DNA, 21 bp, Homo sapiens
aatgtctttgtccatgctctg

SEQ ID NO: 7165736 - DNA, 22 bp, Homo sapiens
aatgtcttttaaatgttgaggt

SEQ ID NO: 7165737 - DNA, 22 bp, Homo sapiens
aactttatcggaacaggtactc

SEQ ID NO: 7165738 - DNA, 22 bp, Homo sapiens
aactttatcggaacaggtactc

SEQ ID NO: 7165739 - DNA, 22 bp, Homo sapiens
aactttattgttaggggctaaa

SEQ ID NO: 7165740 - DNA, 22 bp, Homo sapiens
aatgttattacacttgtgaaat

SEQ ID NO: 7165741 - DNA, 22 bp, Homo sapiens
aatgttatgtggttcaacttaa

SEQ ID NO: 7165742 - DNA, 22 bp, Homo sapiens
aatgttattacacttgtgaaat

SEQ ID NO: 7165743 - DNA, 22 bp, Homo sapiens
aactttcagaatcctatgcatt

SEQ ID NO: 7165744 - DNA, 22 bp, Homo sapiens
aactttcagaatcctatgcatt

SEQ ID NO: 7165745 - DNA, 22 bp, Homo sapiens
aactttcagaatcctatgcatt

SEQ ID NO: 7165746 - DNA, 22 bp, Homo sapiens
aatgttttttggtctgatgaat

SEQ ID NO: 7165747 - DNA, 22 bp, Homo sapiens
aatgttttttggtctgatgaat

SEQ ID NO: 7165748 - DNA, 22 bp, Homo sapiens
aatgttttttggtctgatgaat

SEQ ID NO: 7165749 - DNA, 22 bp, Homo sapiens
aatgttttttggtctgatgaat

SEQ ID NO: 7165750 - DNA, 22 bp, Homo sapiens
aattactgtctgtaaagggaat

SEQ ID NO: 7165751 - DNA, 22 bp, Homo sapiens
aattacttaagagaaactttga

SEQ ID NO: 7165752 - DNA, 22 bp, Homo sapiens
aattacttaagagaaactttga

SEQ ID NO: 7165753 - DNA, 22 bp, Homo sapiens
aattagaaccagaagccatatt

SEQ ID NO: 7165754 - DNA, 22 bp, Homo sapiens
aattagaaccagaagccatatt

SEQ ID NO: 7165755 - DNA, 22 bp, Homo sapiens
aattagaaccagaagccatatt

SEQ ID NO: 7165756 - DNA, 22 bp, Homo sapiens
aactttctgaaaagcttgatca

SEQ ID NO: 7165757 - DNA, 22 bp, Homo sapiens
aatgttttgcattagttttcta

SEQ ID NO: 7165758 - DNA, 22 bp, Homo sapiens
aatgttttgtatgcctctgagc

SEQ ID NO: 7165759 - DNA, 22 bp, Homo sapiens
aatgttttgtatgcctctgagc

SEQ ID NO: 7165760 - DNA, 22 bp, Homo sapiens
aatgttttgtatgcctctgagc

SEQ ID NO: 7165761 - DNA, 22 bp, Homo sapiens
aactttctctggatggcttcct

SEQ ID NO: 7165762 - DNA, 22 bp, Homo sapiens
aagtggcagttcaggaagcaga

SEQ ID NO: 7165763 - DNA, 22 bp, Homo sapiens
aagtggcagttcaggaagcaga

SEQ ID NO: 7165764 - DNA, 22 bp, Homo sapiens
aagtggcagaatagtggcagga

SEQ ID NO: 7165765 - DNA, 22 bp, Homo sapiens
aagtggccctaggccaagggga

SEQ ID NO: 7165766 - DNA, 22 bp, Homo sapiens
aagtggctcatgtggcttctgc

SEQ ID NO: 7165767 - DNA, 22 bp, Homo sapiens
aagtttggtccttctaagaaga

SEQ ID NO: 7165768 - DNA, 22 bp, Homo sapiens
aagtttggtccttctaagaaga

SEQ ID NO: 7165769 - DNA, 22 bp, Homo sapiens
aagtttctgaatttgaaaggat

SEQ ID NO: 7165770 - DNA, 18 bp, Homo sapiens
aagtgggaaaagcaagca

SEQ ID NO: 7165771 - DNA, 22 bp, Homo sapiens
aagtggggcctggtggtacagt

SEQ ID NO: 7165772 - DNA, 22 bp, Homo sapiens
aagtggggcctggtggtacagt

SEQ ID NO: 7165773 - DNA, 22 bp, Homo sapiens
aagttttaacaagtacttacta

SEQ ID NO: 7165774 - DNA, 22 bp, Homo sapiens
aagttttaacaagtacttacta

SEQ ID NO: 7165775 - DNA, 22 bp, Homo sapiens
aagtttgttttagtctaatgat

SEQ ID NO: 7165776 - DNA, 22 bp, Homo sapiens
aagttttaacaagtacttacta

SEQ ID NO: 7165777 - DNA, 22 bp, Homo sapiens
aagttttactgaggacacatgt

SEQ ID NO: 7165778 - DNA, 22 bp, Homo sapiens
aagttttatgggaagatgtgca

SEQ ID NO: 7165779 - DNA, 22 bp, Homo sapiens
aagttttatgggaagatgtgca

SEQ ID NO: 7165780 - DNA, 22 bp, Homo sapiens
aagtttgtctcatttgatcttc

SEQ ID NO: 7165781 - DNA, 22 bp, Homo sapiens
aagtttgtggtcatttattata

SEQ ID NO: 7165782 - DNA, 22 bp, Homo sapiens
aagtggcacgctttttggagtt

SEQ ID NO: 7165783 - DNA, 22 bp, Homo sapiens
aagtggaggccgagttcacgca

SEQ ID NO: 7165784 - DNA, 18 bp, Homo sapiens
aagtggcacaggagtgca

SEQ ID NO: 7165785 - DNA, 22 bp, Homo sapiens
aagtggagctataggctcagat

SEQ ID NO: 7165786 - DNA, 22 bp, Homo sapiens
aagtggagtccctacaaccagc

SEQ ID NO: 7165787 - DNA, 22 bp, Homo sapiens
aagtggaggccgagttcacgca

SEQ ID NO: 7165788 - DNA, 22 bp, Homo sapiens
aagtggagctataggctcagat

SEQ ID NO: 7165789 - DNA, 22 bp, Homo sapiens
aagtggagctataggctcagat

SEQ ID NO: 7165790 - DNA, 22 bp, Homo sapiens
actcatctgccattcctgtacc

SEQ ID NO: 7165791 - DNA, 22 bp, Homo sapiens
actcatctgccattcctgtacc

SEQ ID NO: 7165792 - DNA, 22 bp, Homo sapiens
actcatcttccctcctggaggg

SEQ ID NO: 7165793 - DNA, 21 bp, Homo sapiens
actcatctttttggagaccag

SEQ ID NO: 7165794 - DNA, 21 bp, Homo sapiens
actcatctttttggagaccag

SEQ ID NO: 7165795 - DNA, 22 bp, Homo sapiens
actcatggtagcacaggctgtg

SEQ ID NO: 7165796 - DNA, 22 bp, Homo sapiens
actcatgtaagcggaatgtagt

SEQ ID NO: 7165797 - DNA, 22 bp, Homo sapiens
actcatgtaagcggaatgtagt

SEQ ID NO: 7165798 - DNA, 22 bp, Homo sapiens
actcatgtcatgtgttctttac

SEQ ID NO: 7165799 - DNA, 22 bp, Homo sapiens
actcatgtcctaggagtaaagc

SEQ ID NO: 7165800 - DNA, 22 bp, Homo sapiens
actcatgtcctaggagtaaagc

SEQ ID NO: 7165801 - DNA, 22 bp, Homo sapiens
aagtgcataagtatgattattt

SEQ ID NO: 7165802 - DNA, 22 bp, Homo sapiens
actcagtacatctggagttggc

SEQ ID NO: 7165803 - DNA, 22 bp, Homo sapiens
actcagtacatctggagttggc

SEQ ID NO: 7165804 - DNA, 22 bp, Homo sapiens
actcagtacatctggagttggc

SEQ ID NO: 7165805 - DNA, 22 bp, Homo sapiens
actcagtatacaccagtatagg

SEQ ID NO: 7165806 - DNA, 22 bp, Homo sapiens
actcagtatgagctccgtgaga

SEQ ID NO: 7165807 - DNA, 22 bp, Homo sapiens
actcagtgaattttcatcaaat

SEQ ID NO: 7165808 - DNA, 23 bp, Homo sapiens
actcagtgagggccttgggctgc

SEQ ID NO: 7165809 - DNA, 22 bp, Homo sapiens
actcagtggcactttggaattt

SEQ ID NO: 7165810 - DNA, 22 bp, Homo sapiens
actcatatactgttgtttttaa

SEQ ID NO: 7165811 - DNA, 22 bp, Homo sapiens
actcatatactgttgtttttaa

SEQ ID NO: 7165812 - DNA, 22 bp, Homo sapiens
actcatcaactgttacaaatgt

SEQ ID NO: 7165813 - DNA, 23 bp, Homo sapiens
actcatccttgatttgcagatgt

SEQ ID NO: 7165814 - DNA, 22 bp, Homo sapiens
actcatctattagatatctgtt

SEQ ID NO: 7165815 - DNA, 19 bp, Homo sapiens
actcatctgccacctctgt

SEQ ID NO: 7165816 - DNA, 19 bp, Homo sapiens
actcatctgccacctctgt

SEQ ID NO: 7165817 - DNA, 22 bp, Homo sapiens
aataacagaaacttgagcatca

SEQ ID NO: 7165818 - DNA, 22 bp, Homo sapiens
aataacagaaacttgagcatca

SEQ ID NO: 7165819 - DNA, 22 bp, Homo sapiens
aataaatgtttgttggatgttt

SEQ ID NO: 7165820 - DNA, 22 bp, Homo sapiens
aataaatgtttgttggatgttt

SEQ ID NO: 7165821 - DNA, 22 bp, Homo sapiens
aataaatgttaagattgtctca

SEQ ID NO: 7165822 - DNA, 22 bp, Homo sapiens
aataaatgtttgttggatgttt

SEQ ID NO: 7165823 - DNA, 22 bp, Homo sapiens
aataaatgttaagattgtctca

SEQ ID NO: 7165824 - DNA, 22 bp, Homo sapiens
aataaatgttaagattgtctca

SEQ ID NO: 7165825 - DNA, 22 bp, Homo sapiens
aataaatcaatcctattggtag

SEQ ID NO: 7165826 - DNA, 22 bp, Homo sapiens
aataaatgaacaaagcaggttg

SEQ ID NO: 7165827 - DNA, 22 bp, Homo sapiens
aataaatgaacaaagcaggttg

SEQ ID NO: 7165828 - DNA, 22 bp, Homo sapiens
aataaatgaacaaagcaggttg

SEQ ID NO: 7165829 - DNA, 22 bp, Homo sapiens
aataaatgaacaaagcaggttg

SEQ ID NO: 7165830 - DNA, 22 bp, Homo sapiens
aataaatgttaagattgtctca

SEQ ID NO: 7165831 - DNA, 22 bp, Homo sapiens
aataaaggcaccataaggcaaa

SEQ ID NO: 7165832 - DNA, 22 bp, Homo sapiens
aataaagtagcgtttaaggtgc

SEQ ID NO: 7165833 - DNA, 22 bp, Homo sapiens
aataaagtagcgtttaaggtgc

SEQ ID NO: 7165834 - DNA, 22 bp, Homo sapiens
aataaagccttattgattttac

SEQ ID NO: 7165835 - DNA, 22 bp, Homo sapiens
aataaagccttattgattttac

SEQ ID NO: 7165836 - DNA, 22 bp, Homo sapiens
aataaagccttattgattttac

SEQ ID NO: 7165837 - DNA, 22 bp, Homo sapiens
aataaagtagcgtttaaggtgc

SEQ ID NO: 7165838 - DNA, 22 bp, Homo sapiens
aataaagtagcgtttaaggtgc

SEQ ID NO: 7165839 - DNA, 22 bp, Homo sapiens
aataaagtgtattctttgtcat

SEQ ID NO: 7165840 - DNA, 22 bp, Homo sapiens
aataaagtgtattctttgtcat

SEQ ID NO: 7165841 - DNA, 22 bp, Homo sapiens
aataaatcaatcctattggtag

SEQ ID NO: 7165842 - DNA, 22 bp, Homo sapiens
aataaagcatgaggcatttatc

SEQ ID NO: 7165843 - DNA, 22 bp, Homo sapiens
aataaagcctgtctctttagag

SEQ ID NO: 7165844 - DNA, 18 bp, Homo sapiens
aataaagcaggatttctc

SEQ ID NO: 7165845 - DNA, 22 bp, Homo sapiens
aataaagacaaacaggggagcc

SEQ ID NO: 7165846 - DNA, 22 bp, Homo sapiens
aataaagactcagaggcccagg

SEQ ID NO: 7165847 - DNA, 22 bp, Homo sapiens
aataaagacaaacaggggagcc

SEQ ID NO: 7165848 - DNA, 22 bp, Homo sapiens
aataaagacaaacaggggagcc

SEQ ID NO: 7165849 - DNA, 22 bp, Homo sapiens
aataaagaatggatgagatcgt

SEQ ID NO: 7165850 - DNA, 22 bp, Homo sapiens
aataaagaatggatgagatcgt

SEQ ID NO: 7165851 - DNA, 22 bp, Homo sapiens
actgactcttgttaacttcagc

SEQ ID NO: 7165852 - DNA, 22 bp, Homo sapiens
actgactatgtgactttaggca

SEQ ID NO: 7165853 - DNA, 22 bp, Homo sapiens
actgactgtcagtggaaggcta

SEQ ID NO: 7165854 - DNA, 22 bp, Homo sapiens
actgactgtcagtggaaggcta

SEQ ID NO: 7165855 - DNA, 22 bp, Homo sapiens
actgactgtggatggcagcagc

SEQ ID NO: 7165856 - DNA, 22 bp, Homo sapiens
actgactgtggatggcagcagc

SEQ ID NO: 7165857 - DNA, 22 bp, Homo sapiens
actgacatttttccctaagcat

SEQ ID NO: 7165858 - DNA, 22 bp, Homo sapiens
actgagaaagaccacatggaga

SEQ ID NO: 7165859 - DNA, 22 bp, Homo sapiens
actgagaaatttccagacttgc

SEQ ID NO: 7165860 - DNA, 22 bp, Homo sapiens
aagttttattggctatagcact

SEQ ID NO: 7165861 - DNA, 22 bp, Homo sapiens
aagttttattggctatagcact

SEQ ID NO: 7165862 - DNA, 22 bp, Homo sapiens
aagttttattggctatagcact

SEQ ID NO: 7165863 - DNA, 22 bp, Homo sapiens
aagttttattggaacatagcca

SEQ ID NO: 7165864 - DNA, 22 bp, Homo sapiens
aagttttattggaacatagcca

SEQ ID NO: 7165865 - DNA, 22 bp, Homo sapiens
aagttttattggaacatagcca

SEQ ID NO: 7165866 - DNA, 21 bp, Homo sapiens
aagttttatgttgccatttgt

SEQ ID NO: 7165867 - DNA, 22 bp, Homo sapiens
actgagaagctcgcagtgatgc

SEQ ID NO: 7165868 - DNA, 22 bp, Homo sapiens
actgagaacttgccaaggactg

SEQ ID NO: 7165869 - DNA, 22 bp, Homo sapiens
actgagaacttggggacagagg

SEQ ID NO: 7165870 - DNA, 22 bp, Homo sapiens
actgagaacttggggacagagg

SEQ ID NO: 7165871 - DNA, 22 bp, Homo sapiens
actgagaagattctcactctta

SEQ ID NO: 7165872 - DNA, 22 bp, Homo sapiens
actgagaactcaagagaaaagg

SEQ ID NO: 7165873 - DNA, 22 bp, Homo sapiens
actgagaactcaagagaaaagg

SEQ ID NO: 7165874 - DNA, 22 bp, Homo sapiens
actgagaacttgccaaggactg

SEQ ID NO: 7165875 - DNA, 22 bp, Homo sapiens
actgagaacttgccaaggactg

SEQ ID NO: 7165876 - DNA, 22 bp, Homo sapiens
actgagaacttgccaaggactg

SEQ ID NO: 7165877 - DNA, 22 bp, Homo sapiens
aataaacttccactgtgttttt

SEQ ID NO: 7165878 - DNA, 22 bp, Homo sapiens
aataaagaatggatgagatcgt

SEQ ID NO: 7165879 - DNA, 22 bp, Homo sapiens
aataaagaatggatgagatcgt

SEQ ID NO: 7165880 - DNA, 22 bp, Homo sapiens
aataaagaatggatgagatcgt

SEQ ID NO: 7165881 - DNA, 22 bp, Homo sapiens
aagtgatacctaggaaatcaag

SEQ ID NO: 7165882 - DNA, 22 bp, Homo sapiens
aagtgatacctaggaaatcaag

SEQ ID NO: 7165883 - DNA, 22 bp, Homo sapiens
aagtgatgctacgactttgaca

SEQ ID NO: 7165884 - DNA, 22 bp, Homo sapiens
aagtgattaacatggagctttt

SEQ ID NO: 7165885 - DNA, 22 bp, Homo sapiens
aagtgattatgtccaggagaac

SEQ ID NO: 7165886 - DNA, 22 bp, Homo sapiens
aagtgattcattgatgatgagg

SEQ ID NO: 7165887 - DNA, 22 bp, Homo sapiens
aagtgattctagtcatgattct

SEQ ID NO: 7165888 - DNA, 18 bp, Homo sapiens
aagtgactggcaggccaa

SEQ ID NO: 7165889 - DNA, 22 bp, Homo sapiens
aagtgactatttgagtacatca

SEQ ID NO: 7165890 - DNA, 22 bp, Homo sapiens
aagtgactatttgagtacatca

SEQ ID NO: 7165891 - DNA, 22 bp, Homo sapiens
aagtgagattatatgtacggga

SEQ ID NO: 7165892 - DNA, 22 bp, Homo sapiens
aagtgaggcctaggcactgggt

SEQ ID NO: 7165893 - DNA, 22 bp, Homo sapiens
aagtgaggcctaggcactgggt

SEQ ID NO: 7165894 - DNA, 22 bp, Homo sapiens
aagtgaggtttctgctttcaga

SEQ ID NO: 7165895 - DNA, 22 bp, Homo sapiens
aagtgagtggcctggagaggtg

SEQ ID NO: 7165896 - DNA, 22 bp, Homo sapiens
aagtgagttaatggatgtgaac

SEQ ID NO: 7165897 - DNA, 22 bp, Homo sapiens
aagtgattgttccgttgagtgt

SEQ ID NO: 7165898 - DNA, 22 bp, Homo sapiens
aagtgatttagtcttataaagg

SEQ ID NO: 7165899 - DNA, 22 bp, Homo sapiens
aagtgatttgtacaaaatgtcg

SEQ ID NO: 7165900 - DNA, 22 bp, Homo sapiens
aagtgattttcccaccatctac

SEQ ID NO: 7165901 - DNA, 22 bp, Homo sapiens
aagtgattttcctacttgctaa

SEQ ID NO: 7165902 - DNA, 22 bp, Homo sapiens
aagtgattttcctacttgctaa

SEQ ID NO: 7165903 - DNA, 22 bp, Homo sapiens
aagtgattttcttcttagttat

SEQ ID NO: 7165904 - DNA, 22 bp, Homo sapiens
aagtgcaagatcaaggtgtcag

SEQ ID NO: 7165905 - DNA, 22 bp, Homo sapiens
aagtgcacttatagtaatatgt

SEQ ID NO: 7165906 - DNA, 22 bp, Homo sapiens
aagtgcaggagtggggaaagta

SEQ ID NO: 7165907 - DNA, 22 bp, Homo sapiens
aagtgcaggtctcagctactct

SEQ ID NO: 7165908 - DNA, 22 bp, Homo sapiens
aagtgacctcatggtttctcct

SEQ ID NO: 7165909 - DNA, 22 bp, Homo sapiens
aagtgacataccttacatatgt

SEQ ID NO: 7165910 - DNA, 17 bp, Homo sapiens
aagtgacatcaggctgc

SEQ ID NO: 7165911 - DNA, 22 bp, Homo sapiens
aagtgacataccttacatatgt

SEQ ID NO: 7165912 - DNA, 22 bp, Homo sapiens
aagtgacataccttacatatgt

SEQ ID NO: 7165913 - DNA, 22 bp, Homo sapiens
aagtgacaaaagggtatccaaa

SEQ ID NO: 7165914 - DNA, 22 bp, Homo sapiens
aagtgacacatggcacttctat

SEQ ID NO: 7165915 - DNA, 22 bp, Homo sapiens
aagtgacacatggcacttctat

SEQ ID NO: 7165916 - DNA, 22 bp, Homo sapiens
aagtgacacatttgtgatgaat

SEQ ID NO: 7165917 - DNA, 22 bp, Homo sapiens
aagtgacacctcttccctttcc

SEQ ID NO: 7165918 - DNA, 22 bp, Homo sapiens
aagtgacagtgaactgggactc

SEQ ID NO: 7165919 - DNA, 22 bp, Homo sapiens
aagtgaatttcattccaattct

SEQ ID NO: 7165920 - DNA, 22 bp, Homo sapiens
aagtgacaaaagggtatccaaa

SEQ ID NO: 7165921 - DNA, 18 bp, Homo sapiens
aagtgaattgtccttttc

SEQ ID NO: 7165922 - DNA, 22 bp, Homo sapiens
aagtgaatttcattccaattct

SEQ ID NO: 7165923 - DNA, 22 bp, Homo sapiens
aagtgaatggggcagacttcag

SEQ ID NO: 7165924 - DNA, 22 bp, Homo sapiens
aagtgaatgtagcaaacttgaa

SEQ ID NO: 7165925 - DNA, 22 bp, Homo sapiens
aagtgaattcattgtgttatat

SEQ ID NO: 7165926 - DNA, 22 bp, Homo sapiens
aagtgaataaaattgtgttctt

SEQ ID NO: 7165927 - DNA, 22 bp, Homo sapiens
aagtgaataccatcaagagctt

SEQ ID NO: 7165928 - DNA, 22 bp, Homo sapiens
aagtgaataccatcaagagctt

SEQ ID NO: 7165929 - DNA, 22 bp, Homo sapiens
aagtgaatagcctatttactag

SEQ ID NO: 7165930 - DNA, 22 bp, Homo sapiens
aagtgaatagcctatttactag

SEQ ID NO: 7165931 - DNA, 22 bp, Homo sapiens
aagtgaatctcctttctttatt

SEQ ID NO: 7165932 - DNA, 22 bp, Homo sapiens
aagtgaaattgccattcttata

SEQ ID NO: 7165933 - DNA, 22 bp, Homo sapiens
aagtctcttttcttcctgtatt

SEQ ID NO: 7165934 - DNA, 22 bp, Homo sapiens
aagtctgactagaatctctccc

SEQ ID NO: 7165935 - DNA, 22 bp, Homo sapiens
aagtctctttgggtactttatt

SEQ ID NO: 7165936 - DNA, 22 bp, Homo sapiens
aagtctctttgggtactttatt

SEQ ID NO: 7165937 - DNA, 22 bp, Homo sapiens
aagtctcttttcttcctgtatt

SEQ ID NO: 7165938 - DNA, 22 bp, Homo sapiens
aagtctcttttcttcctgtatt

SEQ ID NO: 7165939 - DNA, 22 bp, Homo sapiens
aagtctcttttcttcctgtatt

SEQ ID NO: 7165940 - DNA, 22 bp, Homo sapiens
aagtgaaattgccattcttata

SEQ ID NO: 7165941 - DNA, 22 bp, Homo sapiens
aagtgaagaaatacatgagaat

SEQ ID NO: 7165942 - DNA, 22 bp, Homo sapiens
aagtgaagaaatacatgagaat

SEQ ID NO: 7165943 - DNA, 22 bp, Homo sapiens
aagtgaataaaattgtgttctt

SEQ ID NO: 7165944 - DNA, 21 bp, Homo sapiens
acctttaattcaagcatcagg

SEQ ID NO: 7165945 - DNA, 21 bp, Homo sapiens
acctttaattcaagcatcagg

SEQ ID NO: 7165946 - DNA, 21 bp, Homo sapiens
acctttaattcaagcatcagg

SEQ ID NO: 7165947 - DNA, 22 bp, Homo sapiens
acctttatagcaacctggtgaa

SEQ ID NO: 7165948 - DNA, 22 bp, Homo sapiens
acctttatagcaacctggtgaa

SEQ ID NO: 7165949 - DNA, 22 bp, Homo sapiens
acctttatagctgattatgaca

SEQ ID NO: 7165950 - DNA, 22 bp, Homo sapiens
acctttatagctgattatgaca

SEQ ID NO: 7165951 - DNA, 22 bp, Homo sapiens
acctttatatatcaacttctcc

SEQ ID NO: 7165952 - DNA, 22 bp, Homo sapiens
acctttatatgaaagatgacat

SEQ ID NO: 7165953 - DNA, 22 bp, Homo sapiens
acctttatatgaaagatgacat

SEQ ID NO: 7165954 - DNA, 22 bp, Homo sapiens
acctttatatgaaagatgacat

SEQ ID NO: 7165955 - DNA, 22 bp, Homo sapiens
acctttatcgccatcattgtgc

SEQ ID NO: 7165956 - DNA, 22 bp, Homo sapiens
acctttatcgccatcattgtgc

SEQ ID NO: 7165957 - DNA, 22 bp, Homo sapiens
acctgcctctaagcagcaggtg

SEQ ID NO: 7165958 - DNA, 18 bp, Homo sapiens
acctggctgtgtgagctg

SEQ ID NO: 7165959 - DNA, 22 bp, Homo sapiens
acctggcttcagagtctggcca

SEQ ID NO: 7165960 - DNA, 22 bp, Homo sapiens
acctggcttccaatctaggagc

SEQ ID NO: 7165961 - DNA, 22 bp, Homo sapiens
acctggcttccaatctaggagc

SEQ ID NO: 7165962 - DNA, 20 bp, Homo sapiens
acctggcttcctcttggcat

SEQ ID NO: 7165963 - DNA, 20 bp, Homo sapiens
acctggcttcctcttggcat

SEQ ID NO: 7165964 - DNA, 22 bp, Homo sapiens
acctggcttctaatcatggctc

SEQ ID NO: 7165965 - DNA, 22 bp, Homo sapiens
acctggcttctaatcatggctc

SEQ ID NO: 7165966 - DNA, 22 bp, Homo sapiens
acctggcttctaatcatggctc

SEQ ID NO: 7165967 - DNA, 22 bp, Homo sapiens
aagtaacacatgttacttctgc

SEQ ID NO: 7165968 - DNA, 22 bp, Homo sapiens
aagtaacacatgttacttctgc

SEQ ID NO: 7165969 - DNA, 22 bp, Homo sapiens
aagtaacacatgttacttctgc

SEQ ID NO: 7165970 - DNA, 22 bp, Homo sapiens
aagtaacacggaacttgaagca

SEQ ID NO: 7165971 - DNA, 22 bp, Homo sapiens
aagtaacacggaacttgaagca

SEQ ID NO: 7165972 - DNA, 18 bp, Homo sapiens
aagtaacagaagagcaca

SEQ ID NO: 7165973 - DNA, 22 bp, Homo sapiens
aagtaaatgttggagctcaaat

SEQ ID NO: 7165974 - DNA, 22 bp, Homo sapiens
aagtaaatgttggagctcaaat

SEQ ID NO: 7165975 - DNA, 21 bp, Homo sapiens
aagtaaatcagagaaataacc

SEQ ID NO: 7165976 - DNA, 22 bp, Homo sapiens
aagtaaatgttggagctcaaat

SEQ ID NO: 7165977 - DNA, 21 bp, Homo sapiens
aagtaaatcagagaaataacc

SEQ ID NO: 7165978 - DNA, 21 bp, Homo sapiens
aagtaaatcagagaaataacc

SEQ ID NO: 7165979 - DNA, 21 bp, Homo sapiens
aagtaaatcagagaaataacc

SEQ ID NO: 7165980 - DNA, 21 bp, Homo sapiens
aagtaaatcagagaaataacc

SEQ ID NO: 7165981 - DNA, 21 bp, Homo sapiens
aagtaaatcagagaaataacc

SEQ ID NO: 7165982 - DNA, 21 bp, Homo sapiens
aagtaaatcagagaaataacc

SEQ ID NO: 7165983 - DNA, 22 bp, Homo sapiens
aagtaaatatctgtttatagca

SEQ ID NO: 7165984 - DNA, 22 bp, Homo sapiens
aagtaaatatctgtttatagca

SEQ ID NO: 7165985 - DNA, 22 bp, Homo sapiens
aagtaaatatctgtttatagca

SEQ ID NO: 7165986 - DNA, 22 bp, Homo sapiens
aagtaaatatctgtttatagca

SEQ ID NO: 7165987 - DNA, 22 bp, Homo sapiens
aagtaaatatctgtttatagca

SEQ ID NO: 7165988 - DNA, 22 bp, Homo sapiens
aagtaaacttacacatagtaaa

SEQ ID NO: 7165989 - DNA, 22 bp, Homo sapiens
aagtaaatatctgtagtcttta

SEQ ID NO: 7165990 - DNA, 22 bp, Homo sapiens
aagtaaacattgagagacaaga

SEQ ID NO: 7165991 - DNA, 22 bp, Homo sapiens
aagtaaactcagtggtcattca

SEQ ID NO: 7165992 - DNA, 22 bp, Homo sapiens
aagtaaacttacacatagtaaa

SEQ ID NO: 7165993 - DNA, 22 bp, Homo sapiens
acctgggaacgctttgtggagg

SEQ ID NO: 7165994 - DNA, 22 bp, Homo sapiens
acctgggaaagccgtggaaagg

SEQ ID NO: 7165995 - DNA, 22 bp, Homo sapiens
acctgggaaagccgtggaaagg

SEQ ID NO: 7165996 - DNA, 22 bp, Homo sapiens
acctgggaacgctttgtggagg

SEQ ID NO: 7165997 - DNA, 22 bp, Homo sapiens
acctgggaagatctttgaagct

SEQ ID NO: 7165998 - DNA, 22 bp, Homo sapiens
acctgggagagaggagccggcg

SEQ ID NO: 7165999 - DNA, 22 bp, Homo sapiens
acctgggagagaggagccggcg

SEQ ID NO: 7166000 - DNA, 22 bp, Homo sapiens
acctggcttgtttctacctcct

SEQ ID NO: 7166001 - DNA, 22 bp, Homo sapiens
acctggcttgtttctacctcct

SEQ ID NO: 7166002 - DNA, 22 bp, Homo sapiens
acctggctttggggataggctt

SEQ ID NO: 7166003 - DNA, 20 bp, Homo sapiens
acctgggaaaaccttttcct

SEQ ID NO: 7166004 - DNA, 22 bp, Homo sapiens
acctgggaaaaggagtggccat

SEQ ID NO: 7166005 - DNA, 22 bp, Homo sapiens
acctgggaaaaggagtggccat

SEQ ID NO: 7166006 - DNA, 22 bp, Homo sapiens
acctgggagtatgcagtggtga

SEQ ID NO: 7166007 - DNA, 22 bp, Homo sapiens
acctgggagtatgcagtggtga

SEQ ID NO: 7166008 - DNA, 22 bp, Homo sapiens
acctgggagtcacacctgagaa

SEQ ID NO: 7166009 - DNA, 22 bp, Homo sapiens
acctgggagtcacacctgagaa

SEQ ID NO: 7166010 - DNA, 22 bp, Homo sapiens
acctgggatggggccaggttta

SEQ ID NO: 7166011 - DNA, 20 bp, Homo sapiens
acctgggattagatacccaa

SEQ ID NO: 7166012 - DNA, 22 bp, Homo sapiens
acctgggaggcagaggttgcag

SEQ ID NO: 7166013 - DNA, 22 bp, Homo sapiens
acctgggaggcagaggttgcag

SEQ ID NO: 7166014 - DNA, 22 bp, Homo sapiens
acctgggaggcggaggttgcag

SEQ ID NO: 7166015 - DNA, 22 bp, Homo sapiens
acctgggaggcggaggttgcag

SEQ ID NO: 7166016 - DNA, 22 bp, Homo sapiens
acctgggcattttggatgatta

SEQ ID NO: 7166017 - DNA, 20 bp, Homo sapiens
acctggggttgcctgtgctc

SEQ ID NO: 7166018 - DNA, 20 bp, Homo sapiens
acctggggttgcctgtgctc

SEQ ID NO: 7166019 - DNA, 22 bp, Homo sapiens
acctgggtctggtgttgggacg

SEQ ID NO: 7166020 - DNA, 22 bp, Homo sapiens
acctgggttgctggcgtgaggg

SEQ ID NO: 7166021 - DNA, 22 bp, Homo sapiens
accttgatggggctgttggagt

SEQ ID NO: 7166022 - DNA, 22 bp, Homo sapiens
accttgggcaacctgctcctgc

SEQ ID NO: 7166023 - DNA, 19 bp, Homo sapiens
accttgggcaagtgccttc

SEQ ID NO: 7166024 - DNA, 22 bp, Homo sapiens
accttggggtgatgctgaaaga

SEQ ID NO: 7166025 - DNA, 22 bp, Homo sapiens
actgtggataagtcagagatgt

SEQ ID NO: 7166026 - DNA, 22 bp, Homo sapiens
actgtggatgccaaaggggagg

SEQ ID NO: 7166027 - DNA, 22 bp, Homo sapiens
actgtgctggagccctctggag

SEQ ID NO: 7166028 - DNA, 22 bp, Homo sapiens
actgtgctggagccctctggag

SEQ ID NO: 7166029 - DNA, 22 bp, Homo sapiens
actgtgctggcaatgactcagg

SEQ ID NO: 7166030 - DNA, 22 bp, Homo sapiens
actgtgcttgccaaaccattga

SEQ ID NO: 7166031 - DNA, 22 bp, Homo sapiens
actgtggagaaagaaagactgc

SEQ ID NO: 7166032 - DNA, 22 bp, Homo sapiens
actgtggagcagtggctaggga

SEQ ID NO: 7166033 - DNA, 22 bp, Homo sapiens
actgtggataagtcagagatgt

SEQ ID NO: 7166034 - DNA, 22 bp, Homo sapiens
actgtggctcatcaggctggtg

SEQ ID NO: 7166035 - DNA, 22 bp, Homo sapiens
actgtgggacatccctccctat

SEQ ID NO: 7166036 - DNA, 22 bp, Homo sapiens
actgtgggaaccactgaatcag

SEQ ID NO: 7166037 - DNA, 22 bp, Homo sapiens
actgtgggagcgcagtggcagc

SEQ ID NO: 7166038 - DNA, 22 bp, Homo sapiens
actgtgggagcgcagtggcagc

SEQ ID NO: 7166039 - DNA, 19 bp, Homo sapiens
actgtgctcgggaaccact

SEQ ID NO: 7166040 - DNA, 22 bp, Homo sapiens
actgtctgctggcccctggtta

SEQ ID NO: 7166041 - DNA, 22 bp, Homo sapiens
actgtctgcacccgaggaggcc

SEQ ID NO: 7166042 - DNA, 22 bp, Homo sapiens
actgtctgcacccgaggaggcc

SEQ ID NO: 7166043 - DNA, 18 bp, Homo sapiens
actgtctgccagattggg

SEQ ID NO: 7166044 - DNA, 22 bp, Homo sapiens
actgtctgccctgagatgccag

SEQ ID NO: 7166045 - DNA, 22 bp, Homo sapiens
aataactggcacatatcacata

SEQ ID NO: 7166046 - DNA, 22 bp, Homo sapiens
actgtctgcaaaactcatactc

SEQ ID NO: 7166047 - DNA, 22 bp, Homo sapiens
aataactgcacttgttgaatgc

SEQ ID NO: 7166048 - DNA, 22 bp, Homo sapiens
aataacaggctcatcagatgct

SEQ ID NO: 7166049 - DNA, 22 bp, Homo sapiens
aatacttatgtgacctcatttt

SEQ ID NO: 7166050 - DNA, 22 bp, Homo sapiens
aatactgtgggatgcagtagga

SEQ ID NO: 7166051 - DNA, 17 bp, Homo sapiens
aatacttccaactagtg

SEQ ID NO: 7166052 - DNA, 22 bp, Homo sapiens
aatacttgggctgagatttttg

SEQ ID NO: 7166053 - DNA, 22 bp, Homo sapiens
aatactttcctatataaggtgc

SEQ ID NO: 7166054 - DNA, 22 bp, Homo sapiens
aatactttcctatataaggtgc

SEQ ID NO: 7166055 - DNA, 22 bp, Homo sapiens
aatactttcctatataaggtgc

SEQ ID NO: 7166056 - DNA, 22 bp, Homo sapiens
aatactttcctatataaggtgc

SEQ ID NO: 7166057 - DNA, 22 bp, Homo sapiens
aatagaaaggaggggctcttgt

SEQ ID NO: 7166058 - DNA, 22 bp, Homo sapiens
aatacttttgaactgaaaggca

SEQ ID NO: 7166059 - DNA, 22 bp, Homo sapiens
actgtgggggagccagtcccat

SEQ ID NO: 7166060 - DNA, 22 bp, Homo sapiens
actgtgggggagccagtcccat

SEQ ID NO: 7166061 - DNA, 22 bp, Homo sapiens
actgtgggcctttcctttgacc

SEQ ID NO: 7166062 - DNA, 22 bp, Homo sapiens
actgtggggggctttgctcagt

SEQ ID NO: 7166063 - DNA, 22 bp, Homo sapiens
actgtggggtgaggcccaagaa

SEQ ID NO: 7166064 - DNA, 22 bp, Homo sapiens
actgtggggtgaggcccaagaa

SEQ ID NO: 7166065 - DNA, 22 bp, Homo sapiens
actgtggggtgcgaggcagtga

SEQ ID NO: 7166066 - DNA, 22 bp, Homo sapiens
actgtggggtgcgaggcagtga

SEQ ID NO: 7166067 - DNA, 22 bp, Homo sapiens
actgtgggagcttatcatttca

SEQ ID NO: 7166068 - DNA, 22 bp, Homo sapiens
actgtgggagcttatcatttca

SEQ ID NO: 7166069 - DNA, 23 bp, Homo sapiens
actgtgggcaccacagagagtgt

SEQ ID NO: 7166070 - DNA, 23 bp, Homo sapiens
actgtgggcaccacagagagtgt

SEQ ID NO: 7166071 - DNA, 22 bp, Homo sapiens
actgtgggcagcttctgggaac

SEQ ID NO: 7166072 - DNA, 22 bp, Homo sapiens
actgtgggccattgggttctgt

SEQ ID NO: 7166073 - DNA, 21 bp, Homo sapiens
actgtggggttcaactggcag

SEQ ID NO: 7166074 - DNA, 22 bp, Homo sapiens
aatactgtaaatggagcagcca

SEQ ID NO: 7166075 - DNA, 18 bp, Homo sapiens
aatactggtttattatga

SEQ ID NO: 7166076 - DNA, 22 bp, Homo sapiens
aatactgtgatatcgagcgatt

SEQ ID NO: 7166077 - DNA, 22 bp, Homo sapiens
aatagaaaggaggggctcttgt

SEQ ID NO: 7166078 - DNA, 22 bp, Homo sapiens
acttagcaatttgattaaaaga

SEQ ID NO: 7166079 - DNA, 22 bp, Homo sapiens
acttagcacagagccaggtagg

SEQ ID NO: 7166080 - DNA, 22 bp, Homo sapiens
acttagcagagtgagttgacta

SEQ ID NO: 7166081 - DNA, 22 bp, Homo sapiens
acttataagagtgctatgggga

SEQ ID NO: 7166082 - DNA, 22 bp, Homo sapiens
acttataagagtgctatgggga

SEQ ID NO: 7166083 - DNA, 22 bp, Homo sapiens
acttatactaaagtattatttg

SEQ ID NO: 7166084 - DNA, 22 bp, Homo sapiens
acttagcaggtactttcatatt

SEQ ID NO: 7166085 - DNA, 22 bp, Homo sapiens
acttagcaggtactttcatatt

SEQ ID NO: 7166086 - DNA, 22 bp, Homo sapiens
acttagcaggtggtgactcgaa

SEQ ID NO: 7166087 - DNA, 22 bp, Homo sapiens
acttagcagtttagaatatgtc

SEQ ID NO: 7166088 - DNA, 22 bp, Homo sapiens
acttagcattatgtaattacta

SEQ ID NO: 7166089 - DNA, 18 bp, Homo sapiens
acttaggaggtacctcaa

SEQ ID NO: 7166090 - DNA, 22 bp, Homo sapiens
acttagtagtggaattgctagg

SEQ ID NO: 7166091 - DNA, 22 bp, Homo sapiens
acttagtgccctggcccttaca

SEQ ID NO: 7166092 - DNA, 22 bp, Homo sapiens
acttatcacacactaaattagg

SEQ ID NO: 7166093 - DNA, 22 bp, Homo sapiens
acttatcagttgtctctaatgt

SEQ ID NO: 7166094 - DNA, 22 bp, Homo sapiens
acttatcgtagggaatttacta

SEQ ID NO: 7166095 - DNA, 22 bp, Homo sapiens
acttatatttgctttatgcttc

SEQ ID NO: 7166096 - DNA, 22 bp, Homo sapiens
acttatctgcaattagtacata

SEQ ID NO: 7166097 - DNA, 22 bp, Homo sapiens
acttatcttagttcatttgtat

SEQ ID NO: 7166098 - DNA, 22 bp, Homo sapiens
acttatgaatgtcattataatg

SEQ ID NO: 7166099 - DNA, 22 bp, Homo sapiens
acttatgaggagaaaatatata

SEQ ID NO: 7166100 - DNA, 22 bp, Homo sapiens
acttatgtagtacctcttatgt

SEQ ID NO: 7166101 - DNA, 18 bp, Homo sapiens
acttattcactaggtgga

SEQ ID NO: 7166102 - DNA, 18 bp, Homo sapiens
acttattcactaggtgga

SEQ ID NO: 7166103 - DNA, 22 bp, Homo sapiens
acttatttattcattcagctca

SEQ ID NO: 7166104 - DNA, 22 bp, Homo sapiens
acttatttattcattcagctca

SEQ ID NO: 7166105 - DNA, 22 bp, Homo sapiens
acttatttattcattcagctca

SEQ ID NO: 7166106 - DNA, 22 bp, Homo sapiens
acttatttcatggatcataatg

SEQ ID NO: 7166107 - DNA, 22 bp, Homo sapiens
acttatttcatggatcataatg

SEQ ID NO: 7166108 - DNA, 22 bp, Homo sapiens
acttccagctgccctgtgtgct

SEQ ID NO: 7166109 - DNA, 22 bp, Homo sapiens
acttccagctgccctgtgtgct

SEQ ID NO: 7166110 - DNA, 22 bp, Homo sapiens
acttcctgacttctgggttgga

SEQ ID NO: 7166111 - DNA, 22 bp, Homo sapiens
acttcctgcaatcgtccactcc

SEQ ID NO: 7166112 - DNA, 22 bp, Homo sapiens
acttcctgcaatcgtccactcc

SEQ ID NO: 7166113 - DNA, 22 bp, Homo sapiens
acttcctgacttctgggttgga

SEQ ID NO: 7166114 - DNA, 22 bp, Homo sapiens
acttcctgaatggggctaatta

SEQ ID NO: 7166115 - DNA, 22 bp, Homo sapiens
acttccgggtgctagatgattc

SEQ ID NO: 7166116 - DNA, 22 bp, Homo sapiens
acttcctgaatggggctaatta

SEQ ID NO: 7166117 - DNA, 22 bp, Homo sapiens
acttcctgaatggggctaatta

SEQ ID NO: 7166118 - DNA, 22 bp, Homo sapiens
acttcctgaatggggctaatta

SEQ ID NO: 7166119 - DNA, 18 bp, Homo sapiens
acttcccagatgagggga

SEQ ID NO: 7166120 - DNA, 21 bp, Homo sapiens
acttcccaggacctactcaga

SEQ ID NO: 7166121 - DNA, 21 bp, Homo sapiens
acttcccaggacctactcaga

SEQ ID NO: 7166122 - DNA, 22 bp, Homo sapiens
acttcccaggtggtgtggagtt

SEQ ID NO: 7166123 - DNA, 22 bp, Homo sapiens
acttcccaggtggtgtggagtt

SEQ ID NO: 7166124 - DNA, 22 bp, Homo sapiens
acttcccaggtggtgtggagtt

SEQ ID NO: 7166125 - DNA, 22 bp, Homo sapiens
acttcccatttctctgctttag

SEQ ID NO: 7166126 - DNA, 22 bp, Homo sapiens
acttcccatttctctgctttag

SEQ ID NO: 7166127 - DNA, 22 bp, Homo sapiens
acttcccactgcagtgactgag

SEQ ID NO: 7166128 - DNA, 22 bp, Homo sapiens
acttcccaacgtgggcctccca

SEQ ID NO: 7166129 - DNA, 22 bp, Homo sapiens
acttcccacaccctgttttctc

SEQ ID NO: 7166130 - DNA, 22 bp, Homo sapiens
acttcccacaccctgttttctc

SEQ ID NO: 7166131 - DNA, 22 bp, Homo sapiens
acttccagtgtctgctgctagc

SEQ ID NO: 7166132 - DNA, 22 bp, Homo sapiens
acttcccaacgtgggcctccca

SEQ ID NO: 7166133 - DNA, 22 bp, Homo sapiens
aatatcttctaaggatagaact

SEQ ID NO: 7166134 - DNA, 22 bp, Homo sapiens
aatatcttctaaggatagaact

SEQ ID NO: 7166135 - DNA, 22 bp, Homo sapiens
aatatcttctaaggatagaact

SEQ ID NO: 7166136 - DNA, 22 bp, Homo sapiens
aatatcagtatattgtatcagt

SEQ ID NO: 7166137 - DNA, 22 bp, Homo sapiens
aatatcagctctgtcacttact

SEQ ID NO: 7166138 - DNA, 22 bp, Homo sapiens
aatatcagctctgtcacttact

SEQ ID NO: 7166139 - DNA, 22 bp, Homo sapiens
aatatcagctctgtcacttact

SEQ ID NO: 7166140 - DNA, 22 bp, Homo sapiens
acttcctgcaatcgtccactcc

SEQ ID NO: 7166141 - DNA, 22 bp, Homo sapiens
acttcctgcagcttctcagccc

SEQ ID NO: 7166142 - DNA, 22 bp, Homo sapiens
acttcctgcagcttctcagccc

SEQ ID NO: 7166143 - DNA, 22 bp, Homo sapiens
acttcctgcagcttctcagccc

SEQ ID NO: 7166144 - DNA, 19 bp, Homo sapiens
acttcctgcccgctccttt

SEQ ID NO: 7166145 - DNA, 19 bp, Homo sapiens
acttcctgcccgctccttt

SEQ ID NO: 7166146 - DNA, 22 bp, Homo sapiens
acttcctgcagcttctcagccc

SEQ ID NO: 7166147 - DNA, 19 bp, Homo sapiens
acttcctgcccgctccttt

SEQ ID NO: 7166148 - DNA, 22 bp, Homo sapiens
aatatcttctaaggatagaact

SEQ ID NO: 7166149 - DNA, 22 bp, Homo sapiens
aatatcttctaaggatagaact

SEQ ID NO: 7166150 - DNA, 22 bp, Homo sapiens
aatatcttctaaggatagaact

SEQ ID NO: 7166151 - DNA, 22 bp, Homo sapiens
aatatcttggcccaactccaga

SEQ ID NO: 7166152 - DNA, 22 bp, Homo sapiens
aatatcttggcccaactccaga

SEQ ID NO: 7166153 - DNA, 22 bp, Homo sapiens
aatatcttggcccaactccaga

SEQ ID NO: 7166154 - DNA, 22 bp, Homo sapiens
aatatgaattattgttacaagt

SEQ ID NO: 7166155 - DNA, 22 bp, Homo sapiens
agaaaccatctttatatatctg

SEQ ID NO: 7166156 - DNA, 22 bp, Homo sapiens
agaaaccatctttatatatctg

SEQ ID NO: 7166157 - DNA, 22 bp, Homo sapiens
agaaaccagggcttaccagtgc

SEQ ID NO: 7166158 - DNA, 22 bp, Homo sapiens
agaaaccagggcttaccagtgc

SEQ ID NO: 7166159 - DNA, 22 bp, Homo sapiens
agaaaccatctttatatatctg

SEQ ID NO: 7166160 - DNA, 22 bp, Homo sapiens
agaaaccatctttatatatctg

SEQ ID NO: 7166161 - DNA, 22 bp, Homo sapiens
agaaaattactccagagacaag

SEQ ID NO: 7166162 - DNA, 23 bp, Homo sapiens
agaaaccactgaagagatccagt

SEQ ID NO: 7166163 - DNA, 23 bp, Homo sapiens
agaaaccactgaagagatccagt

SEQ ID NO: 7166164 - DNA, 23 bp, Homo sapiens
agaaaccactgaagagatccagt

SEQ ID NO: 7166165 - DNA, 22 bp, Homo sapiens
agaaaccagacttggcccattt

SEQ ID NO: 7166166 - DNA, 20 bp, Homo sapiens
agaaaatgttttcagctgga

SEQ ID NO: 7166167 - DNA, 22 bp, Homo sapiens
agaaaattactccagagacaag

SEQ ID NO: 7166168 - DNA, 21 bp, Homo sapiens
agaaaatggcgttttagattt

SEQ ID NO: 7166169 - DNA, 22 bp, Homo sapiens
agaaaatgtgaacttgtgaatt

SEQ ID NO: 7166170 - DNA, 22 bp, Homo sapiens
agaaaatgtgaacttgtgaatt

SEQ ID NO: 7166171 - DNA, 22 bp, Homo sapiens
agaaaatattcattgagaggct

SEQ ID NO: 7166172 - DNA, 22 bp, Homo sapiens
agaaaatattcattgagaggct

SEQ ID NO: 7166173 - DNA, 22 bp, Homo sapiens
agaaaatattcattgagaggct

SEQ ID NO: 7166174 - DNA, 22 bp, Homo sapiens
agaaaatattcattgagaggct

SEQ ID NO: 7166175 - DNA, 22 bp, Homo sapiens
agaaaatattcattgagaggct

SEQ ID NO: 7166176 - DNA, 21 bp, Homo sapiens
agaaaatggcgttttagattt

SEQ ID NO: 7166177 - DNA, 21 bp, Homo sapiens
agaaaatggcgttttagattt

SEQ ID NO: 7166178 - DNA, 21 bp, Homo sapiens
agaaaatggcgttttagattt

SEQ ID NO: 7166179 - DNA, 22 bp, Homo sapiens
agaaaactggagcctggggttg

SEQ ID NO: 7166180 - DNA, 22 bp, Homo sapiens
aatattcatttgcagaagaagt

SEQ ID NO: 7166181 - DNA, 22 bp, Homo sapiens
aatattcatttgcagaagaagt

SEQ ID NO: 7166182 - DNA, 22 bp, Homo sapiens
agaaaataatttcttggctggt

SEQ ID NO: 7166183 - DNA, 22 bp, Homo sapiens
agaaaactgggaggagagcttc

SEQ ID NO: 7166184 - DNA, 22 bp, Homo sapiens
aatatgcatgtatacatgtgta

SEQ ID NO: 7166185 - DNA, 22 bp, Homo sapiens
aatatggcttgttactatgttt

SEQ ID NO: 7166186 - DNA, 22 bp, Homo sapiens
aatatgtgaggtatgttcagtg

SEQ ID NO: 7166187 - DNA, 22 bp, Homo sapiens
aatatgatgccaaattgctaca

SEQ ID NO: 7166188 - DNA, 22 bp, Homo sapiens
aatatgcaaataggtgtaatga

SEQ ID NO: 7166189 - DNA, 22 bp, Homo sapiens
aatatgcaaataggtgtaatga

SEQ ID NO: 7166190 - DNA, 22 bp, Homo sapiens
aatatgcagcatgatgaagtaa

SEQ ID NO: 7166191 - DNA, 22 bp, Homo sapiens
aatatgcagcatgatgaagtaa

SEQ ID NO: 7166192 - DNA, 22 bp, Homo sapiens
aatatgcagcatgatgaagtaa

SEQ ID NO: 7166193 - DNA, 22 bp, Homo sapiens
aatattatcaaaagctttttca

SEQ ID NO: 7166194 - DNA, 22 bp, Homo sapiens
aatattcaagttattctttctt

SEQ ID NO: 7166195 - DNA, 22 bp, Homo sapiens
aatattatacagtcaacctctt

SEQ ID NO: 7166196 - DNA, 22 bp, Homo sapiens
aatattagtttctcaagagaga

SEQ ID NO: 7166197 - DNA, 22 bp, Homo sapiens
aatattagtttctcaagagaga

SEQ ID NO: 7166198 - DNA, 22 bp, Homo sapiens
aatatgtttataagatatcttc

SEQ ID NO: 7166199 - DNA, 22 bp, Homo sapiens
aatatgttccacttaaagctgg

SEQ ID NO: 7166200 - DNA, 22 bp, Homo sapiens
aatatgttccacttaaagctgg

SEQ ID NO: 7166201 - DNA, 22 bp, Homo sapiens
aatatgttgagtctatctttat

SEQ ID NO: 7166202 - DNA, 22 bp, Homo sapiens
aatatgttgagtctatctttat

SEQ ID NO: 7166203 - DNA, 22 bp, Homo sapiens
aatatgttccacttaaagctgg

SEQ ID NO: 7166204 - DNA, 22 bp, Homo sapiens
aatctgtttttgaaactttgta

SEQ ID NO: 7166205 - DNA, 22 bp, Homo sapiens
aatcttaaagaatattctacca

SEQ ID NO: 7166206 - DNA, 22 bp, Homo sapiens
aatcttaaagaatattctacca

SEQ ID NO: 7166207 - DNA, 22 bp, Homo sapiens
aatcttaaagaatattctacca

SEQ ID NO: 7166208 - DNA, 22 bp, Homo sapiens
aatcttaagctgaattctctcc

SEQ ID NO: 7166209 - DNA, 17 bp, Homo sapiens
aatctgtttacagtcag

SEQ ID NO: 7166210 - DNA, 22 bp, Homo sapiens
aatctgtttaacagatttctgt

SEQ ID NO: 7166211 - DNA, 22 bp, Homo sapiens
aatctgttaagaacagaaatgt

SEQ ID NO: 7166212 - DNA, 22 bp, Homo sapiens
aatctgtattgctcatacttga

SEQ ID NO: 7166213 - DNA, 22 bp, Homo sapiens
aatctgtattgttaacaagtaa

SEQ ID NO: 7166214 - DNA, 22 bp, Homo sapiens
aatctgtattgttaacaagtaa

SEQ ID NO: 7166215 - DNA, 22 bp, Homo sapiens
aatctgtattgttaacaagtaa

SEQ ID NO: 7166216 - DNA, 22 bp, Homo sapiens
aatctgtattgttaacaagtaa

SEQ ID NO: 7166217 - DNA, 22 bp, Homo sapiens
aatctgtattgttaacaagtaa

SEQ ID NO: 7166218 - DNA, 22 bp, Homo sapiens
aatctgtgctccctgcatttgt

SEQ ID NO: 7166219 - DNA, 22 bp, Homo sapiens
agaaactaagtcataactcttt

SEQ ID NO: 7166220 - DNA, 22 bp, Homo sapiens
agaaactacttggaggaaagat

SEQ ID NO: 7166221 - DNA, 22 bp, Homo sapiens
agaaacctccatttattcactc

SEQ ID NO: 7166222 - DNA, 22 bp, Homo sapiens
agaaacgcctgtgaaattatct

SEQ ID NO: 7166223 - DNA, 22 bp, Homo sapiens
agaaactaaagccaagggctct

SEQ ID NO: 7166224 - DNA, 22 bp, Homo sapiens
agaaactattatggtaaacaaa

SEQ ID NO: 7166225 - DNA, 22 bp, Homo sapiens
agaaactattatggtaaacaaa

SEQ ID NO: 7166226 - DNA, 22 bp, Homo sapiens
agaaactattatggtaaacaaa

SEQ ID NO: 7166227 - DNA, 22 bp, Homo sapiens
agaaactcatgccatctcgttg

SEQ ID NO: 7166228 - DNA, 22 bp, Homo sapiens
agaaactctggaagaactttta

SEQ ID NO: 7166229 - DNA, 22 bp, Homo sapiens
aatcttaggtttggcttcatct

SEQ ID NO: 7166230 - DNA, 22 bp, Homo sapiens
aatcttacaccgaatttaaact

SEQ ID NO: 7166231 - DNA, 22 bp, Homo sapiens
aatcttaaagaatattctacca

SEQ ID NO: 7166232 - DNA, 22 bp, Homo sapiens
aatcttaagctgaattctctcc

SEQ ID NO: 7166233 - DNA, 22 bp, Homo sapiens
aatcttacaccgaatttaaact

SEQ ID NO: 7166234 - DNA, 22 bp, Homo sapiens
aatcttcaacagaatggtagga

SEQ ID NO: 7166235 - DNA, 22 bp, Homo sapiens
aatcttcaacagaatggtagga

SEQ ID NO: 7166236 - DNA, 22 bp, Homo sapiens
aatcttcactcattcagagttg

SEQ ID NO: 7166237 - DNA, 22 bp, Homo sapiens
aatcttcactcttaactgtgca

SEQ ID NO: 7166238 - DNA, 22 bp, Homo sapiens
aatcttcataaaaatctagtag

SEQ ID NO: 7166239 - DNA, 22 bp, Homo sapiens
aatcttcataaaaatctagtag

SEQ ID NO: 7166240 - DNA, 22 bp, Homo sapiens
aatcttggaagtgtccactggt

SEQ ID NO: 7166241 - DNA, 22 bp, Homo sapiens
aatcttggaggtgacattccat

SEQ ID NO: 7166242 - DNA, 22 bp, Homo sapiens
aatcttggcaaatgtagcttcc

SEQ ID NO: 7166243 - DNA, 22 bp, Homo sapiens
aatcttctttcttaacagtaca

SEQ ID NO: 7166244 - DNA, 22 bp, Homo sapiens
aatcttctacttgacagttctc

SEQ ID NO: 7166245 - DNA, 22 bp, Homo sapiens
aatcttcatgtcctctctaatt

SEQ ID NO: 7166246 - DNA, 22 bp, Homo sapiens
aatcttcattttgacaagattc

SEQ ID NO: 7166247 - DNA, 22 bp, Homo sapiens
aatctttttcacaagaaagcac

SEQ ID NO: 7166248 - DNA, 22 bp, Homo sapiens
aatcttttaggggatcctgagg

SEQ ID NO: 7166249 - DNA, 22 bp, Homo sapiens
aatcttttaggggatcctgagg

SEQ ID NO: 7166250 - DNA, 22 bp, Homo sapiens
aatcttttgattctagggctgt

SEQ ID NO: 7166251 - DNA, 22 bp, Homo sapiens
aatctttcaaatttctttgggt

SEQ ID NO: 7166252 - DNA, 20 bp, Homo sapiens
acagtgtaatattcacattc

SEQ ID NO: 7166253 - DNA, 22 bp, Homo sapiens
acagtgctgtctatctcactaa

SEQ ID NO: 7166254 - DNA, 18 bp, Homo sapiens
acagtgctgtcactgctt

SEQ ID NO: 7166255 - DNA, 18 bp, Homo sapiens
acagtgctgtcactgctt

SEQ ID NO: 7166256 - DNA, 20 bp, Homo sapiens
acagtgggtggggagcactg

SEQ ID NO: 7166257 - DNA, 22 bp, Homo sapiens
acagtggtaggataactgtttt

SEQ ID NO: 7166258 - DNA, 22 bp, Homo sapiens
acagtgctaatgatgccaagat

SEQ ID NO: 7166259 - DNA, 22 bp, Homo sapiens
acagtgctgaacgacatggaag

SEQ ID NO: 7166260 - DNA, 22 bp, Homo sapiens
acagtgtccccagctctgtgag

SEQ ID NO: 7166261 - DNA, 22 bp, Homo sapiens
acagtttagaatgccacatagt

SEQ ID NO: 7166262 - DNA, 22 bp, Homo sapiens
acataacaatcataggacatag

SEQ ID NO: 7166263 - DNA, 22 bp, Homo sapiens
acagtgtactaaatagtaagag

SEQ ID NO: 7166264 - DNA, 22 bp, Homo sapiens
acagtgtactaggtacatgttc

SEQ ID NO: 7166265 - DNA, 22 bp, Homo sapiens
acagtgtagcatggtagcaatg

SEQ ID NO: 7166266 - DNA, 22 bp, Homo sapiens
acagtgtagtgtgatgtcaaaa

SEQ ID NO: 7166267 - DNA, 22 bp, Homo sapiens
acaggtgtgagaacatgccttg

SEQ ID NO: 7166268 - DNA, 22 bp, Homo sapiens
acaggtgtgagaacatgccttg

SEQ ID NO: 7166269 - DNA, 22 bp, Homo sapiens
acaggtgtgcggaaagctgtga

SEQ ID NO: 7166270 - DNA, 22 bp, Homo sapiens
acaggtgtgggctgggctctga

SEQ ID NO: 7166271 - DNA, 22 bp, Homo sapiens
acaggtgtgagaacatgccttg

SEQ ID NO: 7166272 - DNA, 22 bp, Homo sapiens
acaggtgtggggctgtggtact

SEQ ID NO: 7166273 - DNA, 22 bp, Homo sapiens
acaggtgtcctcacagggggtg

SEQ ID NO: 7166274 - DNA, 22 bp, Homo sapiens
acaggtgtctaaggcagacagc

SEQ ID NO: 7166275 - DNA, 22 bp, Homo sapiens
acaggtgtctaaggcagacagc

SEQ ID NO: 7166276 - DNA, 22 bp, Homo sapiens
acaggtgtccaacatttacctt

SEQ ID NO: 7166277 - DNA, 22 bp, Homo sapiens
acaggtgtatgaatatgttcca

SEQ ID NO: 7166278 - DNA, 22 bp, Homo sapiens
acaggtgtctgcaagttactgg

SEQ ID NO: 7166279 - DNA, 22 bp, Homo sapiens
acaggtgtctaaggcagacagc

SEQ ID NO: 7166280 - DNA, 22 bp, Homo sapiens
acaggtgtctgcaagttactgg

SEQ ID NO: 7166281 - DNA, 22 bp, Homo sapiens
acaggtgataagaaaactcgct

SEQ ID NO: 7166282 - DNA, 18 bp, Homo sapiens
acaggtgatatcttgaga

SEQ ID NO: 7166283 - DNA, 18 bp, Homo sapiens
acaggtgatatcttgaga

SEQ ID NO: 7166284 - DNA, 18 bp, Homo sapiens
acaggtgatatcttgaga

SEQ ID NO: 7166285 - DNA, 18 bp, Homo sapiens
acaggtgatatcttgaga

SEQ ID NO: 7166286 - DNA, 22 bp, Homo sapiens
acaggtgatgacatttgaacca

SEQ ID NO: 7166287 - DNA, 22 bp, Homo sapiens
acaggtgatgacatttgaacca

SEQ ID NO: 7166288 - DNA, 22 bp, Homo sapiens
acaggtgattcaggctctggga

SEQ ID NO: 7166289 - DNA, 22 bp, Homo sapiens
acaggtgtagaaaacagattat

SEQ ID NO: 7166290 - DNA, 22 bp, Homo sapiens
acaggtgtagcaggagcatcaa

SEQ ID NO: 7166291 - DNA, 22 bp, Homo sapiens
acaggtgtagcaggagcatcaa

SEQ ID NO: 7166292 - DNA, 22 bp, Homo sapiens
acaggtgtagcaggagcatcaa

SEQ ID NO: 7166293 - DNA, 22 bp, Homo sapiens
acaggtgtaggtacatttgcat

SEQ ID NO: 7166294 - DNA, 22 bp, Homo sapiens
acaggtgtatgaatatgttcca

SEQ ID NO: 7166295 - DNA, 22 bp, Homo sapiens
acaggtgtaggtacatttgcat

SEQ ID NO: 7166296 - DNA, 22 bp, Homo sapiens
acaggtgtaggtacatttgcat

SEQ ID NO: 7166297 - DNA, 22 bp, Homo sapiens
acagtgctaaacacttcttgaa

SEQ ID NO: 7166298 - DNA, 22 bp, Homo sapiens
acagtgcattattgctgaatgc

SEQ ID NO: 7166299 - DNA, 22 bp, Homo sapiens
acagtgcattattgctgaatgc

SEQ ID NO: 7166300 - DNA, 22 bp, Homo sapiens
acagtgcattattgctgaatgc

SEQ ID NO: 7166301 - DNA, 22 bp, Homo sapiens
acagtgcataaaaacaactttt

SEQ ID NO: 7166302 - DNA, 19 bp, Homo sapiens
acagtgcatgggacctggt

SEQ ID NO: 7166303 - DNA, 20 bp, Homo sapiens
acagtgcatggggggacagc

SEQ ID NO: 7166304 - DNA, 22 bp, Homo sapiens
acagtctttctacattctgtgc

SEQ ID NO: 7166305 - DNA, 22 bp, Homo sapiens
acagtctttgcaaagtcctggt

SEQ ID NO: 7166306 - DNA, 22 bp, Homo sapiens
acagtctttgcagaagcaatat

SEQ ID NO: 7166307 - DNA, 22 bp, Homo sapiens
acagtgcaggtctcaacaatta

SEQ ID NO: 7166308 - DNA, 22 bp, Homo sapiens
acagtgcaggtctcaacaatta

SEQ ID NO: 7166309 - DNA, 22 bp, Homo sapiens
acagtgcagtgtgatgagtatt

SEQ ID NO: 7166310 - DNA, 22 bp, Homo sapiens
acagtgcagtgtgatgagtatt

SEQ ID NO: 7166311 - DNA, 22 bp, Homo sapiens
acagtgcagtgtgatgagtatt

SEQ ID NO: 7166312 - DNA, 22 bp, Homo sapiens
acagtgcataaaaacaactttt

SEQ ID NO: 7166313 - DNA, 22 bp, Homo sapiens
acaggtagcatttttcctcttt

SEQ ID NO: 7166314 - DNA, 22 bp, Homo sapiens
acaggtacaagggattaggatg

SEQ ID NO: 7166315 - DNA, 23 bp, Homo sapiens
acaggtacacttgattgcaatcc

SEQ ID NO: 7166316 - DNA, 23 bp, Homo sapiens
acaggtacacttgattgcaatcc

SEQ ID NO: 7166317 - DNA, 22 bp, Homo sapiens
acaggtaccggtcagattacgg

SEQ ID NO: 7166318 - DNA, 16 bp, Homo sapiens
acaggtaccttctgga

SEQ ID NO: 7166319 - DNA, 22 bp, Homo sapiens
acaggtactttgtaatgaagga

SEQ ID NO: 7166320 - DNA, 22 bp, Homo sapiens
acaggtacatacttgggatcca

SEQ ID NO: 7166321 - DNA, 22 bp, Homo sapiens
acaggtagaaattcatctatat

SEQ ID NO: 7166322 - DNA, 22 bp, Homo sapiens
acaggtagaaattcatctatat

SEQ ID NO: 7166323 - DNA, 22 bp, Homo sapiens
acaggtagatacatacttctaa

SEQ ID NO: 7166324 - DNA, 22 bp, Homo sapiens
acaggtagatacatacttctaa

SEQ ID NO: 7166325 - DNA, 21 bp, Homo sapiens
acagggcttcagggagggtta

SEQ ID NO: 7166326 - DNA, 22 bp, Homo sapiens
acagggttttttatgagaacag

SEQ ID NO: 7166327 - DNA, 22 bp, Homo sapiens
acagggttttttatgagaacag

SEQ ID NO: 7166328 - DNA, 23 bp, Homo sapiens
acagggaaaagtcatcagtgtga

SEQ ID NO: 7166329 - DNA, 22 bp, Homo sapiens
acaggcttttttgctctcgaat

SEQ ID NO: 7166330 - DNA, 22 bp, Homo sapiens
acaggctttggcgaggcccatc

SEQ ID NO: 7166331 - DNA, 22 bp, Homo sapiens
acaggcttttttagaatgacat

SEQ ID NO: 7166332 - DNA, 22 bp, Homo sapiens
acaggctttggcgaggcccatc

SEQ ID NO: 7166333 - DNA, 22 bp, Homo sapiens
acaggcttttacggatatcttt

SEQ ID NO: 7166334 - DNA, 21 bp, Homo sapiens
acaggctttagaaaatgactc

SEQ ID NO: 7166335 - DNA, 22 bp, Homo sapiens
acaggctttatgtagtgactta

SEQ ID NO: 7166336 - DNA, 20 bp, Homo sapiens
acaggctttctgaggctggc

SEQ ID NO: 7166337 - DNA, 20 bp, Homo sapiens
acaggctttctgaggctggc

SEQ ID NO: 7166338 - DNA, 20 bp, Homo sapiens
acaggctttctgaggctggc

SEQ ID NO: 7166339 - DNA, 20 bp, Homo sapiens
acaggctttggagtctgaat

SEQ ID NO: 7166340 - DNA, 22 bp, Homo sapiens
acaggtcagataaaggctggtg

SEQ ID NO: 7166341 - DNA, 22 bp, Homo sapiens
acaggtcctcaagtcagctggg

SEQ ID NO: 7166342 - DNA, 22 bp, Homo sapiens
acaggtcagataaaggctggtg

SEQ ID NO: 7166343 - DNA, 22 bp, Homo sapiens
acaggtcaacgagagcaggcaa

SEQ ID NO: 7166344 - DNA, 22 bp, Homo sapiens
acaggtcaacgagagcaggcaa

SEQ ID NO: 7166345 - DNA, 22 bp, Homo sapiens
acaggtagtctgaacactgggt

SEQ ID NO: 7166346 - DNA, 22 bp, Homo sapiens
acaggtagtgggctagatctgg

SEQ ID NO: 7166347 - DNA, 22 bp, Homo sapiens
acaggtagtgggctagatctgg

SEQ ID NO: 7166348 - DNA, 22 bp, Homo sapiens
acaggtccttataagagcactc

SEQ ID NO: 7166349 - DNA, 22 bp, Homo sapiens
acaggtctggtctgggtgggac

SEQ ID NO: 7166350 - DNA, 22 bp, Homo sapiens
acaggtgaagtattacactaag

SEQ ID NO: 7166351 - DNA, 22 bp, Homo sapiens
acaggtgaagtattacactaag

SEQ ID NO: 7166352 - DNA, 22 bp, Homo sapiens
acaggtgaagtattacactaag

SEQ ID NO: 7166353 - DNA, 22 bp, Homo sapiens
acaggtgacctgctcatatgaa

SEQ ID NO: 7166354 - DNA, 22 bp, Homo sapiens
acaggtgacctgctcatatgaa

SEQ ID NO: 7166355 - DNA, 22 bp, Homo sapiens
acaggtgacttgcattttcaca

SEQ ID NO: 7166356 - DNA, 22 bp, Homo sapiens
acaggtgacttgcattttcaca

SEQ ID NO: 7166357 - DNA, 22 bp, Homo sapiens
acaggtgacttgcattttcaca

SEQ ID NO: 7166358 - DNA, 22 bp, Homo sapiens
acaggtgaggatctgagcctca

SEQ ID NO: 7166359 - DNA, 22 bp, Homo sapiens
acaggtgagggagctttgtgcc

SEQ ID NO: 7166360 - DNA, 22 bp, Homo sapiens
acaggtgagggagctttgtgcc

SEQ ID NO: 7166361 - DNA, 22 bp, Homo sapiens
acaggtgaggggttctaggctg

SEQ ID NO: 7166362 - DNA, 22 bp, Homo sapiens
acaggtgataagaaaactcgct

SEQ ID NO: 7166363 - DNA, 22 bp, Homo sapiens
acaggcttgcactagggtggca

SEQ ID NO: 7166364 - DNA, 22 bp, Homo sapiens
acaggcttgcactagggtggca

SEQ ID NO: 7166365 - DNA, 22 bp, Homo sapiens
acaggcttgcactagggtggca

SEQ ID NO: 7166366 - DNA, 22 bp, Homo sapiens
acaggcttggggctcagacaga

SEQ ID NO: 7166367 - DNA, 22 bp, Homo sapiens
acaggcttcagatgtattaact

SEQ ID NO: 7166368 - DNA, 22 bp, Homo sapiens
acaggcttctcacagaaaaggg

SEQ ID NO: 7166369 - DNA, 18 bp, Homo sapiens
acaggcttaggaaatgtg

SEQ ID NO: 7166370 - DNA, 22 bp, Homo sapiens
acaggcttagggcaggctgacc

SEQ ID NO: 7166371 - DNA, 22 bp, Homo sapiens
acaggcttagggcaggctgacc

SEQ ID NO: 7166372 - DNA, 22 bp, Homo sapiens
acaggcttagggcaggctgacc

SEQ ID NO: 7166373 - DNA, 22 bp, Homo sapiens
acaggctgttggggtccagggt

SEQ ID NO: 7166374 - DNA, 22 bp, Homo sapiens
acaggcttacaggctgcaagta

SEQ ID NO: 7166375 - DNA, 22 bp, Homo sapiens
acaggctgccacttgcatccaa

SEQ ID NO: 7166376 - DNA, 22 bp, Homo sapiens
acaggctgatagaccataaata

SEQ ID NO: 7166377 - DNA, 22 bp, Homo sapiens
acaggctgccacttgcatccaa

SEQ ID NO: 7166378 - DNA, 22 bp, Homo sapiens
acaggctgaggatgattgcatc

SEQ ID NO: 7166379 - DNA, 22 bp, Homo sapiens
acaggctgaggatgattgcatc

SEQ ID NO: 7166380 - DNA, 22 bp, Homo sapiens
acaggctgacttcctgccatgt

SEQ ID NO: 7166381 - DNA, 22 bp, Homo sapiens
acaggctgacttcctgccatgt

SEQ ID NO: 7166382 - DNA, 22 bp, Homo sapiens
acaggctgagcgtccatcttca

SEQ ID NO: 7166383 - DNA, 22 bp, Homo sapiens
acaggctgagcgtccatcttca

SEQ ID NO: 7166384 - DNA, 22 bp, Homo sapiens
acaggctgagcgtccatcttca

SEQ ID NO: 7166385 - DNA, 22 bp, Homo sapiens
acaggctgagcgtccatcttca

SEQ ID NO: 7166386 - DNA, 22 bp, Homo sapiens
acaggctgaaagttaagttctg

SEQ ID NO: 7166387 - DNA, 22 bp, Homo sapiens
acaggctgacttcctgccatgt

SEQ ID NO: 7166388 - DNA, 22 bp, Homo sapiens
acaggctgacttcctgccatgt

SEQ ID NO: 7166389 - DNA, 22 bp, Homo sapiens
acaggctgaaagttaagttctg

SEQ ID NO: 7166390 - DNA, 22 bp, Homo sapiens
acaggctgaaagttaagttctg

SEQ ID NO: 7166391 - DNA, 22 bp, Homo sapiens
acaggctgaaagttaagttctg

SEQ ID NO: 7166392 - DNA, 23 bp, Homo sapiens
acaggctcttaatcagtgctcct

SEQ ID NO: 7166393 - DNA, 23 bp, Homo sapiens
acaggctcttaatcagtgctcct

SEQ ID NO: 7166394 - DNA, 23 bp, Homo sapiens
acaggctcttaatcagtgctcct

SEQ ID NO: 7166395 - DNA, 23 bp, Homo sapiens
acaggctcttaatcagtgctcct

SEQ ID NO: 7166396 - DNA, 22 bp, Homo sapiens
acagctggagtgttggtgaggt

SEQ ID NO: 7166397 - DNA, 22 bp, Homo sapiens
acagctggagtgttggtgaggt

SEQ ID NO: 7166398 - DNA, 22 bp, Homo sapiens
acagctggcaggggggcatgaa

SEQ ID NO: 7166399 - DNA, 22 bp, Homo sapiens
acagctggcaggggggcatgaa

SEQ ID NO: 7166400 - DNA, 22 bp, Homo sapiens
acagcttgaatcttaagctctt

SEQ ID NO: 7166401 - DNA, 22 bp, Homo sapiens
acagcttgcaatggctttcaac

SEQ ID NO: 7166402 - DNA, 22 bp, Homo sapiens
acagcttgcaatggctttcaac

SEQ ID NO: 7166403 - DNA, 22 bp, Homo sapiens
acagcttgcacaagggaactca

SEQ ID NO: 7166404 - DNA, 22 bp, Homo sapiens
acagcttgcatgcagaggcact

SEQ ID NO: 7166405 - DNA, 22 bp, Homo sapiens
acagcttgcatgcagaggcact

SEQ ID NO: 7166406 - DNA, 22 bp, Homo sapiens
acagatttttggtaaataattt

SEQ ID NO: 7166407 - DNA, 22 bp, Homo sapiens
acagcaaaagacaagaacttaa

SEQ ID NO: 7166408 - DNA, 22 bp, Homo sapiens
acagcaaaagacaagaacttaa

SEQ ID NO: 7166409 - DNA, 22 bp, Homo sapiens
acagcaaaagacaagaacttaa

SEQ ID NO: 7166410 - DNA, 22 bp, Homo sapiens
acagcaaaagacaagaacttaa

SEQ ID NO: 7166411 - DNA, 22 bp, Homo sapiens
acagctggagtgttggtgaggt

SEQ ID NO: 7166412 - DNA, 22 bp, Homo sapiens
acagattttaaatttgtagttg

SEQ ID NO: 7166413 - DNA, 22 bp, Homo sapiens
acagattttaaatttgtagttg

SEQ ID NO: 7166414 - DNA, 21 bp, Homo sapiens
acagattttatatctctgctg

SEQ ID NO: 7166415 - DNA, 21 bp, Homo sapiens
acagattttatatctctgctg

SEQ ID NO: 7166416 - DNA, 22 bp, Homo sapiens
acagattttattattcaggtat

SEQ ID NO: 7166417 - DNA, 22 bp, Homo sapiens
acagattttattattcaggtat

SEQ ID NO: 7166418 - DNA, 22 bp, Homo sapiens
acagattttggtatttgcaatg

SEQ ID NO: 7166419 - DNA, 22 bp, Homo sapiens
acagattttggtatttgcaatg

SEQ ID NO: 7166420 - DNA, 22 bp, Homo sapiens
acagatttttcagctcctgtgt

SEQ ID NO: 7166421 - DNA, 22 bp, Homo sapiens
acagatttttcagctcctgtgt

SEQ ID NO: 7166422 - DNA, 22 bp, Homo sapiens
acagatttttggtaaataattt

SEQ ID NO: 7166423 - DNA, 20 bp, Homo sapiens
acagatgaggaaaatgaagt

SEQ ID NO: 7166424 - DNA, 20 bp, Homo sapiens
acagatgaggaaaatgaagt

SEQ ID NO: 7166425 - DNA, 22 bp, Homo sapiens
acagatgaggaagagtcagcca

SEQ ID NO: 7166426 - DNA, 22 bp, Homo sapiens
acagatttattgaagctgctgc

SEQ ID NO: 7166427 - DNA, 22 bp, Homo sapiens
acagatttattgaagctgctgc

SEQ ID NO: 7166428 - DNA, 22 bp, Homo sapiens
acagatttgactggtacctggc

SEQ ID NO: 7166429 - DNA, 22 bp, Homo sapiens
acagatttgactggtacctggc

SEQ ID NO: 7166430 - DNA, 22 bp, Homo sapiens
acagatttgatctgagaacaaa

SEQ ID NO: 7166431 - DNA, 22 bp, Homo sapiens
acagatttggaggcctcacccc

SEQ ID NO: 7166432 - DNA, 22 bp, Homo sapiens
acagatttggcccagccaatgc

SEQ ID NO: 7166433 - DNA, 22 bp, Homo sapiens
acagatttggcccagccaatgc

SEQ ID NO: 7166434 - DNA, 22 bp, Homo sapiens
acagatttggcccagccaatgc

SEQ ID NO: 7166435 - DNA, 22 bp, Homo sapiens
acagatttgttcttttgggcta

SEQ ID NO: 7166436 - DNA, 22 bp, Homo sapiens
acagattttaaatgacactccc

SEQ ID NO: 7166437 - DNA, 22 bp, Homo sapiens
acagattttaaatgacactccc

SEQ ID NO: 7166438 - DNA, 22 bp, Homo sapiens
acagattttaaatttgtagttg

SEQ ID NO: 7166439 - DNA, 22 bp, Homo sapiens
acaggaaattggcatatcagtt

SEQ ID NO: 7166440 - DNA, 22 bp, Homo sapiens
acaggaaatgaaatggtatcta

SEQ ID NO: 7166441 - DNA, 22 bp, Homo sapiens
acaggaaatgaaatggtatcta

SEQ ID NO: 7166442 - DNA, 22 bp, Homo sapiens
acaggaaagagctaggcatagg

SEQ ID NO: 7166443 - DNA, 22 bp, Homo sapiens
acaggaaattggcatatcagtt

SEQ ID NO: 7166444 - DNA, 22 bp, Homo sapiens
acaggaaattggcatatcagtt

SEQ ID NO: 7166445 - DNA, 22 bp, Homo sapiens
acaggaacagcttgatggcatc

SEQ ID NO: 7166446 - DNA, 22 bp, Homo sapiens
acaggaacagcttgatggcatc

SEQ ID NO: 7166447 - DNA, 22 bp, Homo sapiens
acaggaaccaggcaggtcgatt

SEQ ID NO: 7166448 - DNA, 22 bp, Homo sapiens
acaggaaccaggcaggtcgatt

SEQ ID NO: 7166449 - DNA, 22 bp, Homo sapiens
acaggagaccctgctggttctg

SEQ ID NO: 7166450 - DNA, 22 bp, Homo sapiens
acaggaacgaatgtacattgtt

SEQ ID NO: 7166451 - DNA, 22 bp, Homo sapiens
acaggaacccagaaacatttct

SEQ ID NO: 7166452 - DNA, 21 bp, Homo sapiens
acaggagaccgcctggcagtc

SEQ ID NO: 7166453 - DNA, 21 bp, Homo sapiens
acaggagaccgcctggcagtc

SEQ ID NO: 7166454 - DNA, 21 bp, Homo sapiens
acaggagaccgcctggcagtc

SEQ ID NO: 7166455 - DNA, 21 bp, Homo sapiens
acaggagaccgcctggcagtc

SEQ ID NO: 7166456 - DNA, 21 bp, Homo sapiens
acaggagaccgcctggcagtc

SEQ ID NO: 7166457 - DNA, 21 bp, Homo sapiens
acaggagaccgcctggcagtc

SEQ ID NO: 7166458 - DNA, 20 bp, Homo sapiens
acaggagatctgaggaaagg

SEQ ID NO: 7166459 - DNA, 23 bp, Homo sapiens
acagcttgccaattagccttccg

SEQ ID NO: 7166460 - DNA, 22 bp, Homo sapiens
acagcttgggatgctttatttc

SEQ ID NO: 7166461 - DNA, 22 bp, Homo sapiens
acagcttggggaggccctggga

SEQ ID NO: 7166462 - DNA, 22 bp, Homo sapiens
acagcttgtagaggccctggca

SEQ ID NO: 7166463 - DNA, 22 bp, Homo sapiens
acagcttgtatcccaatggagc

SEQ ID NO: 7166464 - DNA, 22 bp, Homo sapiens
acagcttgtctaccccagaggt

SEQ ID NO: 7166465 - DNA, 22 bp, Homo sapiens
acagctttagtgtgggtggtgc

SEQ ID NO: 7166466 - DNA, 22 bp, Homo sapiens
acagctttgggcaatgctatga

SEQ ID NO: 7166467 - DNA, 22 bp, Homo sapiens
acagctttgtgttaatgggaag

SEQ ID NO: 7166468 - DNA, 22 bp, Homo sapiens
acagcttttatgggaccagcca

SEQ ID NO: 7166469 - DNA, 22 bp, Homo sapiens
acagcttttcaattctgctgag

SEQ ID NO: 7166470 - DNA, 22 bp, Homo sapiens
acagcttttcaattctgctgag

SEQ ID NO: 7166471 - DNA, 22 bp, Homo sapiens
acagcttttgaaaaattactgg

SEQ ID NO: 7166472 - DNA, 22 bp, Homo sapiens
acagcttttgaaaaattactgg

SEQ ID NO: 7166473 - DNA, 22 bp, Homo sapiens
acagcttttgaaaaattactgg

SEQ ID NO: 7166474 - DNA, 22 bp, Homo sapiens
acagctttttactaatagattg

SEQ ID NO: 7166475 - DNA, 22 bp, Homo sapiens
acagctttttactaatagattg

SEQ ID NO: 7166476 - DNA, 22 bp, Homo sapiens
acaggaaagagctaggcatagg

SEQ ID NO: 7166477 - DNA, 22 bp, Homo sapiens
acaggaaagagctaggcatagg

SEQ ID NO: 7166478 - DNA, 22 bp, Homo sapiens
acaggccagaggtggggcagcc

SEQ ID NO: 7166479 - DNA, 22 bp, Homo sapiens
acaggccagcctggggtaaggt

SEQ ID NO: 7166480 - DNA, 22 bp, Homo sapiens
acaggctctggggcaggatggc

SEQ ID NO: 7166481 - DNA, 22 bp, Homo sapiens
acaggctctggggcaggatggc

SEQ ID NO: 7166482 - DNA, 22 bp, Homo sapiens
acaggctctggggcaggatggc

SEQ ID NO: 7166483 - DNA, 22 bp, Homo sapiens
aagccctggcgggtggagggcc

SEQ ID NO: 7166484 - DNA, 22 bp, Homo sapiens
aagccctggctcagctcaccag

SEQ ID NO: 7166485 - DNA, 22 bp, Homo sapiens
aagccctggcaatgtcagatga

SEQ ID NO: 7166486 - DNA, 22 bp, Homo sapiens
aagccctggcaatgtcagatga

SEQ ID NO: 7166487 - DNA, 22 bp, Homo sapiens
aagccctggatagagagaactg

SEQ ID NO: 7166488 - DNA, 22 bp, Homo sapiens
aagccctggattaaagatgcca

SEQ ID NO: 7166489 - DNA, 22 bp, Homo sapiens
aagccctggaactttcctagcc

SEQ ID NO: 7166490 - DNA, 22 bp, Homo sapiens
aagccctgccacccattcactg

SEQ ID NO: 7166491 - DNA, 22 bp, Homo sapiens
aagccctggacggcccttcccc

SEQ ID NO: 7166492 - DNA, 22 bp, Homo sapiens
aagccctgcagtctctgccaca

SEQ ID NO: 7166493 - DNA, 22 bp, Homo sapiens
aagccctgccacccattcactg

SEQ ID NO: 7166494 - DNA, 22 bp, Homo sapiens
aagccctgataggaaaatgctg

SEQ ID NO: 7166495 - DNA, 22 bp, Homo sapiens
aagccctgcagtctctgccaca

SEQ ID NO: 7166496 - DNA, 22 bp, Homo sapiens
aagccctgagcactgcagagaa

SEQ ID NO: 7166497 - DNA, 22 bp, Homo sapiens
aagccctgagcactgcagagaa

SEQ ID NO: 7166498 - DNA, 22 bp, Homo sapiens
aagccctgactatgaagacata

SEQ ID NO: 7166499 - DNA, 22 bp, Homo sapiens
acaggcagagagtggcggactc

SEQ ID NO: 7166500 - DNA, 22 bp, Homo sapiens
acaggcagagagtggcggactc

SEQ ID NO: 7166501 - DNA, 22 bp, Homo sapiens
acaggcagagtcaggttgggtt

SEQ ID NO: 7166502 - DNA, 22 bp, Homo sapiens
acaggcagagtcaggttgggtt

SEQ ID NO: 7166503 - DNA, 22 bp, Homo sapiens
acaggcagagtcaggttgggtt

SEQ ID NO: 7166504 - DNA, 22 bp, Homo sapiens
acaggcagagaactcagccaga

SEQ ID NO: 7166505 - DNA, 22 bp, Homo sapiens
acaggcagagaactcagccaga

SEQ ID NO: 7166506 - DNA, 22 bp, Homo sapiens
acaggcagagaactcagccaga

SEQ ID NO: 7166507 - DNA, 22 bp, Homo sapiens
acaggcagagagtggcggactc

SEQ ID NO: 7166508 - DNA, 19 bp, Homo sapiens
acaggcagaattgggtgtg

SEQ ID NO: 7166509 - DNA, 19 bp, Homo sapiens
acaggcagaattgggtgtg

SEQ ID NO: 7166510 - DNA, 19 bp, Homo sapiens
acaggcagaattgggtgtg

SEQ ID NO: 7166511 - DNA, 19 bp, Homo sapiens
acaggcagaattgggtgtg

SEQ ID NO: 7166512 - DNA, 19 bp, Homo sapiens
acaggcagaattgggtgtg

SEQ ID NO: 7166513 - DNA, 22 bp, Homo sapiens
acaggcagagaactcagccaga

SEQ ID NO: 7166514 - DNA, 22 bp, Homo sapiens
acaggcagagaactcagccaga

SEQ ID NO: 7166515 - DNA, 22 bp, Homo sapiens
acaggcagagaactcagccaga

SEQ ID NO: 7166516 - DNA, 22 bp, Homo sapiens
acaggaggagctgtttcaggga

SEQ ID NO: 7166517 - DNA, 22 bp, Homo sapiens
acaggcacctgccaccacatct

SEQ ID NO: 7166518 - DNA, 22 bp, Homo sapiens
acaggcacctgccaccacatct

SEQ ID NO: 7166519 - DNA, 22 bp, Homo sapiens
acaggcactgtcaagtcatgaa

SEQ ID NO: 7166520 - DNA, 22 bp, Homo sapiens
acaggcactgtcaagtcatgaa

SEQ ID NO: 7166521 - DNA, 22 bp, Homo sapiens
acaggcactgtcaagtcatgaa

SEQ ID NO: 7166522 - DNA, 22 bp, Homo sapiens
acaggcactttgacatgccatc

SEQ ID NO: 7166523 - DNA, 22 bp, Homo sapiens
acaggcactttgacatgccatc

SEQ ID NO: 7166524 - DNA, 22 bp, Homo sapiens
acaggcactttgacatgccatc

SEQ ID NO: 7166525 - DNA, 22 bp, Homo sapiens
acaggaggagcagctgtgtgcc

SEQ ID NO: 7166526 - DNA, 22 bp, Homo sapiens
acaggaggagctgtttcaggga

SEQ ID NO: 7166527 - DNA, 22 bp, Homo sapiens
acaggagcccaggatgggcgga

SEQ ID NO: 7166528 - DNA, 22 bp, Homo sapiens
acaggagctctagggacagcac

SEQ ID NO: 7166529 - DNA, 22 bp, Homo sapiens
acaggagctctagggacagcac

SEQ ID NO: 7166530 - DNA, 22 bp, Homo sapiens
acaggaggagcagctgtgtgcc

SEQ ID NO: 7166531 - DNA, 22 bp, Homo sapiens
acaggaggagcagctgtgtgcc

SEQ ID NO: 7166532 - DNA, 22 bp, Homo sapiens
acaggaggagcagctgtgtgcc

SEQ ID NO: 7166533 - DNA, 20 bp, Homo sapiens
acaggagatctgaggaaagg

SEQ ID NO: 7166534 - DNA, 20 bp, Homo sapiens
acaggagatctgaggaaagg

SEQ ID NO: 7166535 - DNA, 20 bp, Homo sapiens
acaggagatctgaggaaagg

SEQ ID NO: 7166536 - DNA, 20 bp, Homo sapiens
acaggagatctgaggaaagg

SEQ ID NO: 7166537 - DNA, 22 bp, Homo sapiens
acaggagcaacagactaagaca

SEQ ID NO: 7166538 - DNA, 22 bp, Homo sapiens
acaggagccaaacacatgccag

SEQ ID NO: 7166539 - DNA, 22 bp, Homo sapiens
acaggagccaaacacatgccag

SEQ ID NO: 7166540 - DNA, 22 bp, Homo sapiens
acaggagcccaggatgggcgga

SEQ ID NO: 7166541 - DNA, 22 bp, Homo sapiens
accaggaacaagccatggagga

SEQ ID NO: 7166542 - DNA, 22 bp, Homo sapiens
accagctgttatctgtagtatc

SEQ ID NO: 7166543 - DNA, 22 bp, Homo sapiens
accaggaaaaacactgtgttgg

SEQ ID NO: 7166544 - DNA, 22 bp, Homo sapiens
accagctgtgtgacctgaggca

SEQ ID NO: 7166545 - DNA, 22 bp, Homo sapiens
accagctgtgtgacctgaggca

SEQ ID NO: 7166546 - DNA, 22 bp, Homo sapiens
accagctgtgtgacttttaatg

SEQ ID NO: 7166547 - DNA, 22 bp, Homo sapiens
accagctgttaggcttggtgct

SEQ ID NO: 7166548 - DNA, 22 bp, Homo sapiens
accagctgttaggcttggtgct

SEQ ID NO: 7166549 - DNA, 22 bp, Homo sapiens
accagctggtcacctgggcact

SEQ ID NO: 7166550 - DNA, 22 bp, Homo sapiens
accagctggtcagggcttttct

SEQ ID NO: 7166551 - DNA, 22 bp, Homo sapiens
accagctggtcagttgaagatt

SEQ ID NO: 7166552 - DNA, 22 bp, Homo sapiens
accagctgtgtcctggctgcag

SEQ ID NO: 7166553 - DNA, 22 bp, Homo sapiens
accagctgtgtcctggctgcag

SEQ ID NO: 7166554 - DNA, 22 bp, Homo sapiens
accagctggtcacctgggcact

SEQ ID NO: 7166555 - DNA, 22 bp, Homo sapiens
accagctggtcacctgggcact

SEQ ID NO: 7166556 - DNA, 22 bp, Homo sapiens
accagctggcccatgagcacgt

SEQ ID NO: 7166557 - DNA, 22 bp, Homo sapiens
accagctggcccatgagcacgt

SEQ ID NO: 7166558 - DNA, 22 bp, Homo sapiens
accagctggcccatgagcacgt

SEQ ID NO: 7166559 - DNA, 22 bp, Homo sapiens
accaggcaaaaccacaggagca

SEQ ID NO: 7166560 - DNA, 17 bp, Homo sapiens
accaggcaacacgccca

SEQ ID NO: 7166561 - DNA, 22 bp, Homo sapiens
accaggcagctgggggtgatgt

SEQ ID NO: 7166562 - DNA, 22 bp, Homo sapiens
accaggcagtcaccgtccagga

SEQ ID NO: 7166563 - DNA, 22 bp, Homo sapiens
accaggcatgatgtggagcaca

SEQ ID NO: 7166564 - DNA, 22 bp, Homo sapiens
aaggtttttttccagtatctct

SEQ ID NO: 7166565 - DNA, 22 bp, Homo sapiens
aaggtttccagtgatattgtgg

SEQ ID NO: 7166566 - DNA, 22 bp, Homo sapiens
aaggtttttttccagtatctct

SEQ ID NO: 7166567 - DNA, 22 bp, Homo sapiens
aagtaaaacacacagtccaccg

SEQ ID NO: 7166568 - DNA, 22 bp, Homo sapiens
aagtaaaacacacagtccaccg

SEQ ID NO: 7166569 - DNA, 22 bp, Homo sapiens
aagtaaaacacacagtccaccg

SEQ ID NO: 7166570 - DNA, 22 bp, Homo sapiens
aagtaaaacacacagtccaccg

SEQ ID NO: 7166571 - DNA, 22 bp, Homo sapiens
aagtaaaacacacagtccaccg

SEQ ID NO: 7166572 - DNA, 22 bp, Homo sapiens
aagtaaaacacacagtccaccg

SEQ ID NO: 7166573 - DNA, 22 bp, Homo sapiens
aagtaaaagcaggtgtgctggg

SEQ ID NO: 7166574 - DNA, 22 bp, Homo sapiens
aagtaaaagcaggtgtgctggg

SEQ ID NO: 7166575 - DNA, 22 bp, Homo sapiens
aagtaaaagctttaccatgcgc

SEQ ID NO: 7166576 - DNA, 22 bp, Homo sapiens
aagtaaaagctttaccatgcgc

SEQ ID NO: 7166577 - DNA, 22 bp, Homo sapiens
aagtaaaatgtttcctttatta

SEQ ID NO: 7166578 - DNA, 22 bp, Homo sapiens
aagtaaaatgtttcctttatta

SEQ ID NO: 7166579 - DNA, 22 bp, Homo sapiens
aagtaaaatgtttcctttatta

SEQ ID NO: 7166580 - DNA, 22 bp, Homo sapiens
aagtaaaattcaatcttcactg

SEQ ID NO: 7166581 - DNA, 22 bp, Homo sapiens
aagtaaaattcaatcttcactg

SEQ ID NO: 7166582 - DNA, 22 bp, Homo sapiens
accaggccaaaatcatatttac

SEQ ID NO: 7166583 - DNA, 22 bp, Homo sapiens
accaggccaaaatcatatttac

SEQ ID NO: 7166584 - DNA, 22 bp, Homo sapiens
accaggccaaaatcatatttac

SEQ ID NO: 7166585 - DNA, 22 bp, Homo sapiens
accaggccaaaatcatatttac

SEQ ID NO: 7166586 - DNA, 22 bp, Homo sapiens
accaggcatgatgtggagcaca

SEQ ID NO: 7166587 - DNA, 22 bp, Homo sapiens
accaggcatgatgtggagcaca

SEQ ID NO: 7166588 - DNA, 22 bp, Homo sapiens
aaggtgtcactgggacaggaaa

SEQ ID NO: 7166589 - DNA, 22 bp, Homo sapiens
accaggccaacagctaagttaa

SEQ ID NO: 7166590 - DNA, 22 bp, Homo sapiens
accaggccaacagctaagttaa

SEQ ID NO: 7166591 - DNA, 22 bp, Homo sapiens
accaggccaacagctaagttaa

SEQ ID NO: 7166592 - DNA, 21 bp, Homo sapiens
accaggccaggaggctggcac

SEQ ID NO: 7166593 - DNA, 21 bp, Homo sapiens
accaggccaggaggctggcac

SEQ ID NO: 7166594 - DNA, 22 bp, Homo sapiens
aaggtgtcactgtttctggcct

SEQ ID NO: 7166595 - DNA, 22 bp, Homo sapiens
aaggttagtaagtatcttatgt

SEQ ID NO: 7166596 - DNA, 22 bp, Homo sapiens
aaggttagtaatatttctatat

SEQ ID NO: 7166597 - DNA, 22 bp, Homo sapiens
aaggttagtgcatcttttgttt

SEQ ID NO: 7166598 - DNA, 22 bp, Homo sapiens
aaggttagttttcaataattac

SEQ ID NO: 7166599 - DNA, 23 bp, Homo sapiens
aaggttgaaattggagcttggat

SEQ ID NO: 7166600 - DNA, 22 bp, Homo sapiens
aaggttgatatgtatctaggga

SEQ ID NO: 7166601 - DNA, 22 bp, Homo sapiens
aaggttgagggtaatcatatgg

SEQ ID NO: 7166602 - DNA, 22 bp, Homo sapiens
aaggtttaaggtctataaatgt

SEQ ID NO: 7166603 - DNA, 22 bp, Homo sapiens
accagctgccttttcttagtag

SEQ ID NO: 7166604 - DNA, 22 bp, Homo sapiens
accagctgctgattgctaaatg

SEQ ID NO: 7166605 - DNA, 22 bp, Homo sapiens
accagctgcctggtctatctgc

SEQ ID NO: 7166606 - DNA, 22 bp, Homo sapiens
accagctgccaagggctacact

SEQ ID NO: 7166607 - DNA, 23 bp, Homo sapiens
accagctgccctgaactttgtgc

SEQ ID NO: 7166608 - DNA, 22 bp, Homo sapiens
accagctgagttctcggatggt

SEQ ID NO: 7166609 - DNA, 22 bp, Homo sapiens
accagctgagttctcggatggt

SEQ ID NO: 7166610 - DNA, 22 bp, Homo sapiens
accagctgatttaagaataaag

SEQ ID NO: 7166611 - DNA, 22 bp, Homo sapiens
accagctgccaagggctacact

SEQ ID NO: 7166612 - DNA, 22 bp, Homo sapiens
accagctgccaagggctacact

SEQ ID NO: 7166613 - DNA, 22 bp, Homo sapiens
aagggcaggaaaagatggatgt

SEQ ID NO: 7166614 - DNA, 22 bp, Homo sapiens
accagcacggattagaatgctt

SEQ ID NO: 7166615 - DNA, 22 bp, Homo sapiens
accagcacggattagaatgctt

SEQ ID NO: 7166616 - DNA, 22 bp, Homo sapiens
accagcacttccagaggtcagg

SEQ ID NO: 7166617 - DNA, 22 bp, Homo sapiens
accagcacttccagaggtcagg

SEQ ID NO: 7166618 - DNA, 22 bp, Homo sapiens
accagcacttccagaggtcagg

SEQ ID NO: 7166619 - DNA, 22 bp, Homo sapiens
aagggcagctgacagatgctta

SEQ ID NO: 7166620 - DNA, 22 bp, Homo sapiens
aagggcagctgacagatgctta

SEQ ID NO: 7166621 - DNA, 22 bp, Homo sapiens
aagggcagcttaaattggtagc

SEQ ID NO: 7166622 - DNA, 22 bp, Homo sapiens
aagggcagcttaaattggtagc

SEQ ID NO: 7166623 - DNA, 22 bp, Homo sapiens
aagggcagcttaaattggtagc

SEQ ID NO: 7166624 - DNA, 22 bp, Homo sapiens
aagggcagctgacagatgctta

SEQ ID NO: 7166625 - DNA, 22 bp, Homo sapiens
aagggcagctattatcgtcatc

SEQ ID NO: 7166626 - DNA, 22 bp, Homo sapiens
aagggcagctgacagatgctta

SEQ ID NO: 7166627 - DNA, 22 bp, Homo sapiens
aagggcagctgacagatgctta

SEQ ID NO: 7166628 - DNA, 22 bp, Homo sapiens
aagggcagctgacagatgctta

SEQ ID NO: 7166629 - DNA, 22 bp, Homo sapiens
aagggcagcctgactcacggtc

SEQ ID NO: 7166630 - DNA, 22 bp, Homo sapiens
aagggcagcctgactcacggtc

SEQ ID NO: 7166631 - DNA, 22 bp, Homo sapiens
aagggcagcctgactcacggtc

SEQ ID NO: 7166632 - DNA, 22 bp, Homo sapiens
aagggcagcctgactcacggtc

SEQ ID NO: 7166633 - DNA, 22 bp, Homo sapiens
aagggcagctattatcgtcatc

SEQ ID NO: 7166634 - DNA, 22 bp, Homo sapiens
accacctcatcaagctggattg

SEQ ID NO: 7166635 - DNA, 17 bp, Homo sapiens
accacctctcaccagca

SEQ ID NO: 7166636 - DNA, 22 bp, Homo sapiens
accacctcatcaagctggattg

SEQ ID NO: 7166637 - DNA, 17 bp, Homo sapiens
accacctctcaccagca

SEQ ID NO: 7166638 - DNA, 17 bp, Homo sapiens
accacctctcaccagca

SEQ ID NO: 7166639 - DNA, 17 bp, Homo sapiens
accacctctcaccagca

SEQ ID NO: 7166640 - DNA, 22 bp, Homo sapiens
accactgcccatggtgaaaact

SEQ ID NO: 7166641 - DNA, 22 bp, Homo sapiens
aagggcagagggaatcccacat

SEQ ID NO: 7166642 - DNA, 22 bp, Homo sapiens
aagggcagcctgactcacggtc

SEQ ID NO: 7166643 - DNA, 22 bp, Homo sapiens
aagggcagcctgactcacggtc

SEQ ID NO: 7166644 - DNA, 22 bp, Homo sapiens
aagggcagcctgactcacggtc

SEQ ID NO: 7166645 - DNA, 22 bp, Homo sapiens
accacaggggaggaatgatgcc

SEQ ID NO: 7166646 - DNA, 22 bp, Homo sapiens
accacagggtaaagttagatat

SEQ ID NO: 7166647 - DNA, 22 bp, Homo sapiens
accacagggtaaagttagatat

SEQ ID NO: 7166648 - DNA, 22 bp, Homo sapiens
accacagtatgaaatctgaaat

SEQ ID NO: 7166649 - DNA, 22 bp, Homo sapiens
accacagtatgaaatctgaaat

SEQ ID NO: 7166650 - DNA, 22 bp, Homo sapiens
accacagtctcgaagcactgca

SEQ ID NO: 7166651 - DNA, 18 bp, Homo sapiens
accacagtgcttaatatg

SEQ ID NO: 7166652 - DNA, 22 bp, Homo sapiens
accacagtgggccacaagaagt

SEQ ID NO: 7166653 - DNA, 22 bp, Homo sapiens
accacagtgggccacaagaagt

SEQ ID NO: 7166654 - DNA, 22 bp, Homo sapiens
accacagtttagtccaatgaca

SEQ ID NO: 7166655 - DNA, 22 bp, Homo sapiens
accacagtttagtccaatgaca

SEQ ID NO: 7166656 - DNA, 22 bp, Homo sapiens
accacatttctgaatagcataa

SEQ ID NO: 7166657 - DNA, 22 bp, Homo sapiens
accaccaggggattttcagaac

SEQ ID NO: 7166658 - DNA, 22 bp, Homo sapiens
accacccacctcacagcatagt

SEQ ID NO: 7166659 - DNA, 22 bp, Homo sapiens
accacccattcagaaacactga

SEQ ID NO: 7166660 - DNA, 22 bp, Homo sapiens
accaccccaaatgaacctctgt

SEQ ID NO: 7166661 - DNA, 22 bp, Homo sapiens
accaccccagaatttttcaagg

SEQ ID NO: 7166662 - DNA, 22 bp, Homo sapiens
acattcttccagctggctgttg

SEQ ID NO: 7166663 - DNA, 22 bp, Homo sapiens
acattttgcccttatttgctga

SEQ ID NO: 7166664 - DNA, 22 bp, Homo sapiens
accacaggacccatgagtcagt

SEQ ID NO: 7166665 - DNA, 22 bp, Homo sapiens
accacaggaggatggctgctgg

SEQ ID NO: 7166666 - DNA, 22 bp, Homo sapiens
accacaggaggatggctgctgg

SEQ ID NO: 7166667 - DNA, 22 bp, Homo sapiens
accacaggggaggaatgatgcc

SEQ ID NO: 7166668 - DNA, 22 bp, Homo sapiens
accacaggggaggaatgatgcc

SEQ ID NO: 7166669 - DNA, 22 bp, Homo sapiens
acattcttaacagttaaaaact

SEQ ID NO: 7166670 - DNA, 22 bp, Homo sapiens
acattcttaacagttaaaaact

SEQ ID NO: 7166671 - DNA, 22 bp, Homo sapiens
acattctgtgagtcatgtttta

SEQ ID NO: 7166672 - DNA, 23 bp, Homo sapiens
acatgggagggacatggaggctg

SEQ ID NO: 7166673 - DNA, 22 bp, Homo sapiens
acatggctcagtctcatgacag

SEQ ID NO: 7166674 - DNA, 19 bp, Homo sapiens
acatggctctccagtctgg

SEQ ID NO: 7166675 - DNA, 23 bp, Homo sapiens
acatgggaaatgcaaagagaagt

SEQ ID NO: 7166676 - DNA, 22 bp, Homo sapiens
acatgggatcaatgaggcaggc

SEQ ID NO: 7166677 - DNA, 22 bp, Homo sapiens
acatgggatcaatgaggcaggc

SEQ ID NO: 7166678 - DNA, 22 bp, Homo sapiens
acatgggatcaatgaggcaggc

SEQ ID NO: 7166679 - DNA, 17 bp, Homo sapiens
acatgggctgagactcc

SEQ ID NO: 7166680 - DNA, 22 bp, Homo sapiens
acatggggcccaaagagaggtc

SEQ ID NO: 7166681 - DNA, 22 bp, Homo sapiens
acatggggcccaaagagaggtc

SEQ ID NO: 7166682 - DNA, 22 bp, Homo sapiens
acatgggttattgtgaggttaa

SEQ ID NO: 7166683 - DNA, 22 bp, Homo sapiens
acatggtaaattggtaaaggac

SEQ ID NO: 7166684 - DNA, 22 bp, Homo sapiens
acatacttagagtaaacaagta

SEQ ID NO: 7166685 - DNA, 22 bp, Homo sapiens
acatacttatgctaaaaatata

SEQ ID NO: 7166686 - DNA, 22 bp, Homo sapiens
acatacttatgctaaaaatata

SEQ ID NO: 7166687 - DNA, 22 bp, Homo sapiens
acatacttatgtgtatatgtgt

SEQ ID NO: 7166688 - DNA, 22 bp, Homo sapiens
acatacttctttacattccata

SEQ ID NO: 7166689 - DNA, 22 bp, Homo sapiens
acatacttgaagcaagtgatca

SEQ ID NO: 7166690 - DNA, 22 bp, Homo sapiens
acatactttttaaaagattgct

SEQ ID NO: 7166691 - DNA, 22 bp, Homo sapiens
acatagaaatttatttcttaca

SEQ ID NO: 7166692 - DNA, 23 bp, Homo sapiens
acatagaacagaatatatttgtg

SEQ ID NO: 7166693 - DNA, 23 bp, Homo sapiens
acatagaacagaatatatttgtg

SEQ ID NO: 7166694 - DNA, 23 bp, Homo sapiens
acatagaacagaatatatttgtg

SEQ ID NO: 7166695 - DNA, 22 bp, Homo sapiens
acatgcattaaaaatacttgtg

SEQ ID NO: 7166696 - DNA, 22 bp, Homo sapiens
acatgcattaaaaatacttgtg

SEQ ID NO: 7166697 - DNA, 22 bp, Homo sapiens
acatgcattaaaaatacttgtg

SEQ ID NO: 7166698 - DNA, 22 bp, Homo sapiens
acatgcattaaaaatacttgtg

SEQ ID NO: 7166699 - DNA, 22 bp, Homo sapiens
acatgcattaaaaatacttgtg

SEQ ID NO: 7166700 - DNA, 22 bp, Homo sapiens
acatgcattctctaaaagcaaa

SEQ ID NO: 7166701 - DNA, 22 bp, Homo sapiens
acatgcattctctaaaagcaaa

SEQ ID NO: 7166702 - DNA, 22 bp, Homo sapiens
acatgccaagatcctcgtcttt

SEQ ID NO: 7166703 - DNA, 18 bp, Homo sapiens
acatacattctgtctgca

SEQ ID NO: 7166704 - DNA, 18 bp, Homo sapiens
acatacattctgtctgca

SEQ ID NO: 7166705 - DNA, 18 bp, Homo sapiens
acatacattctgtctgca

SEQ ID NO: 7166706 - DNA, 22 bp, Homo sapiens
acatacattgcctcattggtaa

SEQ ID NO: 7166707 - DNA, 22 bp, Homo sapiens
acatacattgcctcattggtaa

SEQ ID NO: 7166708 - DNA, 22 bp, Homo sapiens
acatactatgaatacatgtgtc

SEQ ID NO: 7166709 - DNA, 22 bp, Homo sapiens
acatactatgaatacatgtgtc

SEQ ID NO: 7166710 - DNA, 22 bp, Homo sapiens
acatactatgaatacatgtgtc

SEQ ID NO: 7166711 - DNA, 22 bp, Homo sapiens
acataataggtgcctgaatatt

SEQ ID NO: 7166712 - DNA, 22 bp, Homo sapiens
acataataggtgcctgaatatt

SEQ ID NO: 7166713 - DNA, 22 bp, Homo sapiens
acataatgaaatgcagaaatca

SEQ ID NO: 7166714 - DNA, 22 bp, Homo sapiens
acataatgaaatgcagaaatca

SEQ ID NO: 7166715 - DNA, 22 bp, Homo sapiens
acataatgaaatgcagaaatca

SEQ ID NO: 7166716 - DNA, 22 bp, Homo sapiens
acataatgagctctttataaat

SEQ ID NO: 7166717 - DNA, 22 bp, Homo sapiens
acataacaatcataggacatag

SEQ ID NO: 7166718 - DNA, 22 bp, Homo sapiens
acataacactcttctctagtga

SEQ ID NO: 7166719 - DNA, 22 bp, Homo sapiens
acataacatagttgacattttt

SEQ ID NO: 7166720 - DNA, 22 bp, Homo sapiens
acataagtgcacaataaatatt

SEQ ID NO: 7166721 - DNA, 22 bp, Homo sapiens
acataagtgcacaataaatatt

SEQ ID NO: 7166722 - DNA, 22 bp, Homo sapiens
acataatacctaggacagtttg

SEQ ID NO: 7166723 - DNA, 22 bp, Homo sapiens
acataatagcatttctaatttg

SEQ ID NO: 7166724 - DNA, 22 bp, Homo sapiens
acataatagcatttctaatttg

SEQ ID NO: 7166725 - DNA, 22 bp, Homo sapiens
acataataggtacctgaataat

SEQ ID NO: 7166726 - DNA, 22 bp, Homo sapiens
acataataggtacctgaataat

SEQ ID NO: 7166727 - DNA, 22 bp, Homo sapiens
aaggccaggccagatgacagtc

SEQ ID NO: 7166728 - DNA, 22 bp, Homo sapiens
aaggccaggcctagcacggagg

SEQ ID NO: 7166729 - DNA, 22 bp, Homo sapiens
aaggccaggcctagcacggagg

SEQ ID NO: 7166730 - DNA, 22 bp, Homo sapiens
aaggccaggccagatgacagtc

SEQ ID NO: 7166731 - DNA, 22 bp, Homo sapiens
aaggccaggccagatgacagtc

SEQ ID NO: 7166732 - DNA, 22 bp, Homo sapiens
aaggccaggccagatgacagtc

SEQ ID NO: 7166733 - DNA, 22 bp, Homo sapiens
aaggccaggccagatgacagtc

SEQ ID NO: 7166734 - DNA, 22 bp, Homo sapiens
aaggccaggacaccaggggact

SEQ ID NO: 7166735 - DNA, 22 bp, Homo sapiens
aaggccaggcagggagctgtga

SEQ ID NO: 7166736 - DNA, 22 bp, Homo sapiens
aaggccaggcagggagctgtga

SEQ ID NO: 7166737 - DNA, 22 bp, Homo sapiens
aaggccaggcctagcacggagg

SEQ ID NO: 7166738 - DNA, 22 bp, Homo sapiens
aaggccagggatgccagctcgg

SEQ ID NO: 7166739 - DNA, 22 bp, Homo sapiens
acatgtgttaaaattctcacca

SEQ ID NO: 7166740 - DNA, 22 bp, Homo sapiens
acatgtgttttcctacttatga

SEQ ID NO: 7166741 - DNA, 21 bp, Homo sapiens
acattacagggtgatgtgtct

SEQ ID NO: 7166742 - DNA, 22 bp, Homo sapiens
acattacataagattgtaacct

SEQ ID NO: 7166743 - DNA, 22 bp, Homo sapiens
acattacataagattgtaacct

SEQ ID NO: 7166744 - DNA, 22 bp, Homo sapiens
acattacctggcatttgatctt

SEQ ID NO: 7166745 - DNA, 22 bp, Homo sapiens
aaggccagctggagggatgagg

SEQ ID NO: 7166746 - DNA, 22 bp, Homo sapiens
aaggccagcttgtagggctggt

SEQ ID NO: 7166747 - DNA, 22 bp, Homo sapiens
aaggccagcttgtagggctggt

SEQ ID NO: 7166748 - DNA, 22 bp, Homo sapiens
aaggccagctggagggatgagg

SEQ ID NO: 7166749 - DNA, 22 bp, Homo sapiens
aaggccagctggagggatgagg

SEQ ID NO: 7166750 - DNA, 22 bp, Homo sapiens
aaggccagcttgtagggctggt

SEQ ID NO: 7166751 - DNA, 22 bp, Homo sapiens
aaggccagcttgtagggctggt

SEQ ID NO: 7166752 - DNA, 22 bp, Homo sapiens
aaggccagcttgtagggctggt

SEQ ID NO: 7166753 - DNA, 22 bp, Homo sapiens
aaggccaggacaccaggggact

SEQ ID NO: 7166754 - DNA, 22 bp, Homo sapiens
acatggtatttctattataatt

SEQ ID NO: 7166755 - DNA, 22 bp, Homo sapiens
acatggtatttctattataatt

SEQ ID NO: 7166756 - DNA, 22 bp, Homo sapiens
acatgtaaaagataaattaaca

SEQ ID NO: 7166757 - DNA, 22 bp, Homo sapiens
aaggccagcgcagaccattgtc

SEQ ID NO: 7166758 - DNA, 22 bp, Homo sapiens
aaggccagctggagggatgagg

SEQ ID NO: 7166759 - DNA, 21 bp, Homo sapiens
acattataattcatattccac

SEQ ID NO: 7166760 - DNA, 22 bp, Homo sapiens
acattatagctttgagtttgga

SEQ ID NO: 7166761 - DNA, 22 bp, Homo sapiens
acattatagttgctacagagta

SEQ ID NO: 7166762 - DNA, 22 bp, Homo sapiens
acattatgagcccactggtgaa

SEQ ID NO: 7166763 - DNA, 22 bp, Homo sapiens
acattagatgactctttctttc

SEQ ID NO: 7166764 - DNA, 22 bp, Homo sapiens
acattagcttgtggcttaacag

SEQ ID NO: 7166765 - DNA, 22 bp, Homo sapiens
acattagataactcagaaagga

SEQ ID NO: 7166766 - DNA, 22 bp, Homo sapiens
acattagataactcagaaagga

SEQ ID NO: 7166767 - DNA, 22 bp, Homo sapiens
acattagagaagcttggagatg

SEQ ID NO: 7166768 - DNA, 22 bp, Homo sapiens
acattagagaagcttggagatg

SEQ ID NO: 7166769 - DNA, 22 bp, Homo sapiens
acattagaacattaatattggg

SEQ ID NO: 7166770 - DNA, 22 bp, Homo sapiens
acattagaacattaatattggg

SEQ ID NO: 7166771 - DNA, 22 bp, Homo sapiens
acattacctggcatttgatctt

SEQ ID NO: 7166772 - DNA, 22 bp, Homo sapiens
acattctcatttggtgatcatt

SEQ ID NO: 7166773 - DNA, 22 bp, Homo sapiens
acattctcaaatatttgtggaa

SEQ ID NO: 7166774 - DNA, 22 bp, Homo sapiens
acattcaagatgcattcactta

SEQ ID NO: 7166775 - DNA, 22 bp, Homo sapiens
acattcaagatgcattcactta

SEQ ID NO: 7166776 - DNA, 22 bp, Homo sapiens
acattcaagatgcattcactta

SEQ ID NO: 7166777 - DNA, 22 bp, Homo sapiens
acattcaagatgcattcactta

SEQ ID NO: 7166778 - DNA, 22 bp, Homo sapiens
acattcaaccaatgtttgctat

SEQ ID NO: 7166779 - DNA, 22 bp, Homo sapiens
acattctcttcctaaatatact

SEQ ID NO: 7166780 - DNA, 22 bp, Homo sapiens
acattctcttcctaaatatact

SEQ ID NO: 7166781 - DNA, 22 bp, Homo sapiens
acattctgaaaaacagtgtttt

SEQ ID NO: 7166782 - DNA, 22 bp, Homo sapiens
acattctgaaatccatgtgggt

SEQ ID NO: 7166783 - DNA, 22 bp, Homo sapiens
acattctgaaatccatgtgggt

SEQ ID NO: 7166784 - DNA, 22 bp, Homo sapiens
acattctgggtgatgttcttca

SEQ ID NO: 7166785 - DNA, 22 bp, Homo sapiens
acattctgtatcatctgtctca

SEQ ID NO: 7166786 - DNA, 22 bp, Homo sapiens
agagggcatgcttggtggcctg

SEQ ID NO: 7166787 - DNA, 22 bp, Homo sapiens
agagggcatgcttggtggcctg

SEQ ID NO: 7166788 - DNA, 22 bp, Homo sapiens
agagggccataggtgcatagtt

SEQ ID NO: 7166789 - DNA, 22 bp, Homo sapiens
agagggcccatgttgggctgct

SEQ ID NO: 7166790 - DNA, 22 bp, Homo sapiens
agagggctaactgggaagcagg

SEQ ID NO: 7166791 - DNA, 22 bp, Homo sapiens
agagggctaaggtttgggagat

SEQ ID NO: 7166792 - DNA, 22 bp, Homo sapiens
agagggctaaggtttgggagat

SEQ ID NO: 7166793 - DNA, 22 bp, Homo sapiens
agagggctaaggtttgggagat

SEQ ID NO: 7166794 - DNA, 22 bp, Homo sapiens
agagggcccatgttgggctgct

SEQ ID NO: 7166795 - DNA, 22 bp, Homo sapiens
agagggcccatgttgggctgct

SEQ ID NO: 7166796 - DNA, 21 bp, Homo sapiens
agagggcgaaggcggggtccg

SEQ ID NO: 7166797 - DNA, 22 bp, Homo sapiens
agagggctaactgggaagcagg

SEQ ID NO: 7166798 - DNA, 21 bp, Homo sapiens
aattttgaaggaagattaagg

SEQ ID NO: 7166799 - DNA, 21 bp, Homo sapiens
aattttgaaggaagattaagg

SEQ ID NO: 7166800 - DNA, 21 bp, Homo sapiens
aattttgaaggaagattaagg

SEQ ID NO: 7166801 - DNA, 21 bp, Homo sapiens
aattttgaaggaagattaagg

SEQ ID NO: 7166802 - DNA, 21 bp, Homo sapiens
aattttgaaggaagattaagg

SEQ ID NO: 7166803 - DNA, 22 bp, Homo sapiens
agagggctggacgcaggttgga

SEQ ID NO: 7166804 - DNA, 22 bp, Homo sapiens
aattttctggtgtgtaatgaag

SEQ ID NO: 7166805 - DNA, 17 bp, Homo sapiens
agagggctcaaggcatc

SEQ ID NO: 7166806 - DNA, 17 bp, Homo sapiens
agagggctcaaggcatc

SEQ ID NO: 7166807 - DNA, 22 bp, Homo sapiens
aatttatttcctgccagtacac

SEQ ID NO: 7166808 - DNA, 22 bp, Homo sapiens
aatttatttcctgccagtacac

SEQ ID NO: 7166809 - DNA, 22 bp, Homo sapiens
aatttatttcctgccagtacac

SEQ ID NO: 7166810 - DNA, 22 bp, Homo sapiens
aatttattcccgtctctgggct

SEQ ID NO: 7166811 - DNA, 22 bp, Homo sapiens
aatttatggccttcgtcttgat

SEQ ID NO: 7166812 - DNA, 21 bp, Homo sapiens
agaggccaagtcatcatttcc

SEQ ID NO: 7166813 - DNA, 21 bp, Homo sapiens
agaggccaagtcatcatttcc

SEQ ID NO: 7166814 - DNA, 21 bp, Homo sapiens
agaggccaagtcatcatttcc

SEQ ID NO: 7166815 - DNA, 22 bp, Homo sapiens
agaggccaatagtaggtggcat

SEQ ID NO: 7166816 - DNA, 22 bp, Homo sapiens
agaggccaatagtaggtggcat

SEQ ID NO: 7166817 - DNA, 22 bp, Homo sapiens
agaggccaatagtaggtggcat

SEQ ID NO: 7166818 - DNA, 22 bp, Homo sapiens
agaggccacaccagcctcccgt

SEQ ID NO: 7166819 - DNA, 22 bp, Homo sapiens
aatttatgacaaacaggtaggt

SEQ ID NO: 7166820 - DNA, 22 bp, Homo sapiens
aatttatggccttcgtcttgat

SEQ ID NO: 7166821 - DNA, 22 bp, Homo sapiens
aatttatggtggggtaagggga

SEQ ID NO: 7166822 - DNA, 22 bp, Homo sapiens
aatttattatatcctaggggaa

SEQ ID NO: 7166823 - DNA, 22 bp, Homo sapiens
agagggaaaaactcatgtcatt

SEQ ID NO: 7166824 - DNA, 22 bp, Homo sapiens
aatttcaatgcactcatggttg

SEQ ID NO: 7166825 - DNA, 22 bp, Homo sapiens
aatttcaaagctcactggcata

SEQ ID NO: 7166826 - DNA, 22 bp, Homo sapiens
aatttcaaagctcactggcata

SEQ ID NO: 7166827 - DNA, 22 bp, Homo sapiens
agaggccaaagaatctacaaga

SEQ ID NO: 7166828 - DNA, 22 bp, Homo sapiens
agaggccaaagaatctacaaga

SEQ ID NO: 7166829 - DNA, 22 bp, Homo sapiens
agaggcatgcacagatgtgctg

SEQ ID NO: 7166830 - DNA, 22 bp, Homo sapiens
agaggccaaagaatctacaaga

SEQ ID NO: 7166831 - DNA, 22 bp, Homo sapiens
agaggccaagccagactgtgca

SEQ ID NO: 7166832 - DNA, 22 bp, Homo sapiens
agaggccaagccagactgtgca

SEQ ID NO: 7166833 - DNA, 23 bp, Homo sapiens
agaggccaacttcttgcccctcc

SEQ ID NO: 7166834 - DNA, 23 bp, Homo sapiens
agaggccaacttcttgcccctcc

SEQ ID NO: 7166835 - DNA, 22 bp, Homo sapiens
agaggccaagccagactgtgca

SEQ ID NO: 7166836 - DNA, 21 bp, Homo sapiens
agaggcaggcattaagtacac

SEQ ID NO: 7166837 - DNA, 21 bp, Homo sapiens
agaggcaggcattaagtacac

SEQ ID NO: 7166838 - DNA, 22 bp, Homo sapiens
agaggcagtatacaatccgagc

SEQ ID NO: 7166839 - DNA, 21 bp, Homo sapiens
agaggcaggcattaagtacac

SEQ ID NO: 7166840 - DNA, 21 bp, Homo sapiens
agaggcaggcattaagtacac

SEQ ID NO: 7166841 - DNA, 22 bp, Homo sapiens
agaggcagtatacaatccgagc

SEQ ID NO: 7166842 - DNA, 19 bp, Homo sapiens
agaggcagtctccaacagg

SEQ ID NO: 7166843 - DNA, 19 bp, Homo sapiens
agaggcagtctccaacagg

SEQ ID NO: 7166844 - DNA, 19 bp, Homo sapiens
agaggcagtctccaacagg

SEQ ID NO: 7166845 - DNA, 19 bp, Homo sapiens
agaggcagtctccaacagg

SEQ ID NO: 7166846 - DNA, 22 bp, Homo sapiens
agaggcaacatggggaacagat

SEQ ID NO: 7166847 - DNA, 22 bp, Homo sapiens
agaggcaacatggggaacagat

SEQ ID NO: 7166848 - DNA, 22 bp, Homo sapiens
agagcaggtggcaactctggga

SEQ ID NO: 7166849 - DNA, 22 bp, Homo sapiens
agaggcaacatggggaacagat

SEQ ID NO: 7166850 - DNA, 23 bp, Homo sapiens
agaggcaggagtggcttgcccgg

SEQ ID NO: 7166851 - DNA, 22 bp, Homo sapiens
agagcaggcataaagctttgaa

SEQ ID NO: 7166852 - DNA, 22 bp, Homo sapiens
agagcaggcataaagctttgaa

SEQ ID NO: 7166853 - DNA, 22 bp, Homo sapiens
agagcaggggcaatgtgttgca

SEQ ID NO: 7166854 - DNA, 22 bp, Homo sapiens
agagcaggggcaatgtgttgca

SEQ ID NO: 7166855 - DNA, 22 bp, Homo sapiens
agagcagctgtgacatggacag

SEQ ID NO: 7166856 - DNA, 22 bp, Homo sapiens
agagcagctgtgacatggacag

SEQ ID NO: 7166857 - DNA, 22 bp, Homo sapiens
agagcagcttttcggaaccact

SEQ ID NO: 7166858 - DNA, 22 bp, Homo sapiens
agagcagcttttcggaaccact

SEQ ID NO: 7166859 - DNA, 22 bp, Homo sapiens
agagcagctggggcagagacca

SEQ ID NO: 7166860 - DNA, 22 bp, Homo sapiens
agagcagctgtgacatggacag

SEQ ID NO: 7166861 - DNA, 22 bp, Homo sapiens
agagcagctggggcagagacca

SEQ ID NO: 7166862 - DNA, 22 bp, Homo sapiens
aattcacaggaggtatttgtcc

SEQ ID NO: 7166863 - DNA, 22 bp, Homo sapiens
aattcacagcatttgcccatct

SEQ ID NO: 7166864 - DNA, 22 bp, Homo sapiens
aattcacaggatcacaggagag

SEQ ID NO: 7166865 - DNA, 22 bp, Homo sapiens
aattcacaggatcacaggagag

SEQ ID NO: 7166866 - DNA, 22 bp, Homo sapiens
aattcacagttctgcaccttac

SEQ ID NO: 7166867 - DNA, 22 bp, Homo sapiens
aattcacagttctgcaccttac

SEQ ID NO: 7166868 - DNA, 22 bp, Homo sapiens
aattcacatatacattattcct

SEQ ID NO: 7166869 - DNA, 22 bp, Homo sapiens
aattcacatatacattattcct

SEQ ID NO: 7166870 - DNA, 22 bp, Homo sapiens
aattcacatccgaccaggtcaa

SEQ ID NO: 7166871 - DNA, 22 bp, Homo sapiens
aattcacatgcatgtctgtgca

SEQ ID NO: 7166872 - DNA, 22 bp, Homo sapiens
aattcacatgcatgtctgtgca

SEQ ID NO: 7166873 - DNA, 22 bp, Homo sapiens
aattcacatgcatgtctgtgca

SEQ ID NO: 7166874 - DNA, 22 bp, Homo sapiens
aattcacatgttgaagtcctaa

SEQ ID NO: 7166875 - DNA, 22 bp, Homo sapiens
aattcactccacttctgtgtct

SEQ ID NO: 7166876 - DNA, 22 bp, Homo sapiens
aattcactgaacttctctgaga

SEQ ID NO: 7166877 - DNA, 22 bp, Homo sapiens
aattcactgttccttctgcttt

SEQ ID NO: 7166878 - DNA, 22 bp, Homo sapiens
aattcagagacatgaagtgaca

SEQ ID NO: 7166879 - DNA, 22 bp, Homo sapiens
aattcagagactcattctggag

SEQ ID NO: 7166880 - DNA, 22 bp, Homo sapiens
aattcagatggaagattctggc

SEQ ID NO: 7166881 - DNA, 20 bp, Homo sapiens
aattcagctgccttcatgct

SEQ ID NO: 7166882 - DNA, 22 bp, Homo sapiens
aattcagtaatcattaatgatg

SEQ ID NO: 7166883 - DNA, 22 bp, Homo sapiens
aattcagtgtctggcactgctg

SEQ ID NO: 7166884 - DNA, 22 bp, Homo sapiens
aattcagttatatgtccacttc

SEQ ID NO: 7166885 - DNA, 22 bp, Homo sapiens
aattcatactctatattgcttt

SEQ ID NO: 7166886 - DNA, 22 bp, Homo sapiens
aattcatactctatattgcttt

SEQ ID NO: 7166887 - DNA, 22 bp, Homo sapiens
agagcagcgtttgtggaacact

SEQ ID NO: 7166888 - DNA, 22 bp, Homo sapiens
agagcagcgtttgtggaacact

SEQ ID NO: 7166889 - DNA, 22 bp, Homo sapiens
agagcagctcgctacctctcta

SEQ ID NO: 7166890 - DNA, 22 bp, Homo sapiens
agagcagctgacagcctgccat

SEQ ID NO: 7166891 - DNA, 22 bp, Homo sapiens
agagcagctgacagcctgccat

SEQ ID NO: 7166892 - DNA, 22 bp, Homo sapiens
agagcagctgcattcagcacct

SEQ ID NO: 7166893 - DNA, 22 bp, Homo sapiens
agaggtggccatgggcgctgga

SEQ ID NO: 7166894 - DNA, 22 bp, Homo sapiens
agaggtggccatgggcgctgga

SEQ ID NO: 7166895 - DNA, 22 bp, Homo sapiens
agaggggttaagtgctagtccg

SEQ ID NO: 7166896 - DNA, 22 bp, Homo sapiens
agaggggttatgcttgacattt

SEQ ID NO: 7166897 - DNA, 22 bp, Homo sapiens
agagggtaacaagaggcctgga

SEQ ID NO: 7166898 - DNA, 22 bp, Homo sapiens
agagggtaacaagaggcctgga

SEQ ID NO: 7166899 - DNA, 22 bp, Homo sapiens
aattttgttttagtggaggctg

SEQ ID NO: 7166900 - DNA, 22 bp, Homo sapiens
acaaaaaccgtggattcagcat

SEQ ID NO: 7166901 - DNA, 22 bp, Homo sapiens
acaaaaaccgtggattcagcat

SEQ ID NO: 7166902 - DNA, 22 bp, Homo sapiens
acaaaaaccgtggattcagcat

SEQ ID NO: 7166903 - DNA, 22 bp, Homo sapiens
acaaaaaccgtggattcagcat

SEQ ID NO: 7166904 - DNA, 22 bp, Homo sapiens
acaaaaaccgtggattcagcat

SEQ ID NO: 7166905 - DNA, 20 bp, Homo sapiens
agagtaactggcacataggg

SEQ ID NO: 7166906 - DNA, 20 bp, Homo sapiens
agagtaactggcacataggg

SEQ ID NO: 7166907 - DNA, 22 bp, Homo sapiens
agagtaatattctccgaggtga

SEQ ID NO: 7166908 - DNA, 22 bp, Homo sapiens
agaggttgttagaatagtggag

SEQ ID NO: 7166909 - DNA, 22 bp, Homo sapiens
agaggttgggtctgaggtgaga

SEQ ID NO: 7166910 - DNA, 20 bp, Homo sapiens
agaggttcagtctggagaag

SEQ ID NO: 7166911 - DNA, 22 bp, Homo sapiens
agaggttgggtctgaggtgaga

SEQ ID NO: 7166912 - DNA, 22 bp, Homo sapiens
agaggttcagagaaggcgatct

SEQ ID NO: 7166913 - DNA, 20 bp, Homo sapiens
agaggttcagtctggagaag

SEQ ID NO: 7166914 - DNA, 23 bp, Homo sapiens
agaggtgtagtgtctcatctact

SEQ ID NO: 7166915 - DNA, 22 bp, Homo sapiens
agaggtggccatgggcgctgga

SEQ ID NO: 7166916 - DNA, 22 bp, Homo sapiens
agaggtggccatgggcgctgga

SEQ ID NO: 7166917 - DNA, 22 bp, Homo sapiens
agaggtggccatgggcgctgga

SEQ ID NO: 7166918 - DNA, 22 bp, Homo sapiens
agaggtggccatgggcgctgga

SEQ ID NO: 7166919 - DNA, 22 bp, Homo sapiens
agaggtgggagcctggtcacat

SEQ ID NO: 7166920 - DNA, 22 bp, Homo sapiens
agaggtgggagcctggtcacat

SEQ ID NO: 7166921 - DNA, 22 bp, Homo sapiens
agagtgaaaagctagagcagta

SEQ ID NO: 7166922 - DNA, 22 bp, Homo sapiens
agagtgaaaagctagagcagta

SEQ ID NO: 7166923 - DNA, 22 bp, Homo sapiens
agagtgaaaagctagagcagta

SEQ ID NO: 7166924 - DNA, 22 bp, Homo sapiens
agagtcttctggggccactttc

SEQ ID NO: 7166925 - DNA, 22 bp, Homo sapiens
agagtctgtgctttcatcagga

SEQ ID NO: 7166926 - DNA, 22 bp, Homo sapiens
agagtctgttacttgtccccta

SEQ ID NO: 7166927 - DNA, 22 bp, Homo sapiens
agagtcttatcttttacaagta

SEQ ID NO: 7166928 - DNA, 22 bp, Homo sapiens
agatataataatttacaagtgt

SEQ ID NO: 7166929 - DNA, 22 bp, Homo sapiens
agatatacacccatatcacata

SEQ ID NO: 7166930 - DNA, 22 bp, Homo sapiens
agagtgaaaagctagagcagta

SEQ ID NO: 7166931 - DNA, 22 bp, Homo sapiens
agagtgaaggccaggttacagt

SEQ ID NO: 7166932 - DNA, 22 bp, Homo sapiens
agagtgaaggttgacacttcac

SEQ ID NO: 7166933 - DNA, 22 bp, Homo sapiens
agagtaatgaacacattccaca

SEQ ID NO: 7166934 - DNA, 23 bp, Homo sapiens
agagtaatgtttttactgtattc

SEQ ID NO: 7166935 - DNA, 21 bp, Homo sapiens
agagtaattcctgctggaaag

SEQ ID NO: 7166936 - DNA, 22 bp, Homo sapiens
agagtaatttctgctgaaaagg

SEQ ID NO: 7166937 - DNA, 22 bp, Homo sapiens
agagtacactgtacacacaatt

SEQ ID NO: 7166938 - DNA, 22 bp, Homo sapiens
agagtaatttttggacaatgcc

SEQ ID NO: 7166939 - DNA, 22 bp, Homo sapiens
agagtaatttttggacaatgcc

SEQ ID NO: 7166940 - DNA, 22 bp, Homo sapiens
agagtacattcagagctaccta

SEQ ID NO: 7166941 - DNA, 22 bp, Homo sapiens
agagtactgcctcagttatgaa

SEQ ID NO: 7166942 - DNA, 22 bp, Homo sapiens
agagtactgcctcagttatgaa

SEQ ID NO: 7166943 - DNA, 22 bp, Homo sapiens
agagtctgcattgtaacaagat

SEQ ID NO: 7166944 - DNA, 21 bp, Homo sapiens
agagtctgcatttctgacaag

SEQ ID NO: 7166945 - DNA, 21 bp, Homo sapiens
agagtctgcatttctgacaag

SEQ ID NO: 7166946 - DNA, 22 bp, Homo sapiens
agagtctggaagcgcttctaaa

SEQ ID NO: 7166947 - DNA, 22 bp, Homo sapiens
agagtctgtgctggggccagct

SEQ ID NO: 7166948 - DNA, 22 bp, Homo sapiens
agatatatttaaggtaataagt

SEQ ID NO: 7166949 - DNA, 22 bp, Homo sapiens
agatatatttaaggtaataagt

SEQ ID NO: 7166950 - DNA, 22 bp, Homo sapiens
agatatcaccagttttacatac

SEQ ID NO: 7166951 - DNA, 22 bp, Homo sapiens
agatatcaccagttttacatac

SEQ ID NO: 7166952 - DNA, 22 bp, Homo sapiens
agatatcaccagttttacatac

SEQ ID NO: 7166953 - DNA, 22 bp, Homo sapiens
agatatagttgttgagaagaac

SEQ ID NO: 7166954 - DNA, 22 bp, Homo sapiens
agatatagttgttgagaagaac

SEQ ID NO: 7166955 - DNA, 22 bp, Homo sapiens
agatatatttaaggtaataagt

SEQ ID NO: 7166956 - DNA, 22 bp, Homo sapiens
agatatatttaaggtaataagt

SEQ ID NO: 7166957 - DNA, 22 bp, Homo sapiens
agatatgactagaagctcattt

SEQ ID NO: 7166958 - DNA, 22 bp, Homo sapiens
agatatgactagaagctcattt

SEQ ID NO: 7166959 - DNA, 22 bp, Homo sapiens
agatatgactagaagctcattt

SEQ ID NO: 7166960 - DNA, 22 bp, Homo sapiens
agatatgagaatatagaggccc

SEQ ID NO: 7166961 - DNA, 22 bp, Homo sapiens
agatatctgatgaaaatactct

SEQ ID NO: 7166962 - DNA, 22 bp, Homo sapiens
agatatctgatgaaaatactct

SEQ ID NO: 7166963 - DNA, 22 bp, Homo sapiens
agatatctgtattgtttccaat

SEQ ID NO: 7166964 - DNA, 22 bp, Homo sapiens
agatatctgtattgtttccaat

SEQ ID NO: 7166965 - DNA, 22 bp, Homo sapiens
agatatgtccctgtctaatatt

SEQ ID NO: 7166966 - DNA, 22 bp, Homo sapiens
agatatgtgccaattgttataa

SEQ ID NO: 7166967 - DNA, 22 bp, Homo sapiens
agatatgatctatgattttgac

SEQ ID NO: 7166968 - DNA, 22 bp, Homo sapiens
agatatgatgcatgtaaacatt

SEQ ID NO: 7166969 - DNA, 22 bp, Homo sapiens
agatatgcttgaagacaggaca

SEQ ID NO: 7166970 - DNA, 18 bp, Homo sapiens
agatatggagggggtggg

SEQ ID NO: 7166971 - DNA, 22 bp, Homo sapiens
agatcggctttgcagacctcat

SEQ ID NO: 7166972 - DNA, 22 bp, Homo sapiens
agatcgatttcatatcctctta

SEQ ID NO: 7166973 - DNA, 22 bp, Homo sapiens
agatctattagcaaactgccat

SEQ ID NO: 7166974 - DNA, 22 bp, Homo sapiens
agatctgaatctcatccgagga

SEQ ID NO: 7166975 - DNA, 22 bp, Homo sapiens
agatcctgccaatggaagcagg

SEQ ID NO: 7166976 - DNA, 22 bp, Homo sapiens
agatcctgccaatggaagcagg

SEQ ID NO: 7166977 - DNA, 22 bp, Homo sapiens
agatcccaggatactggcctat

SEQ ID NO: 7166978 - DNA, 21 bp, Homo sapiens
agatccctgaggagagcatcc

SEQ ID NO: 7166979 - DNA, 22 bp, Homo sapiens
agatccattttggtgtcaactc

SEQ ID NO: 7166980 - DNA, 21 bp, Homo sapiens
agatcctggggtctggggagg

SEQ ID NO: 7166981 - DNA, 22 bp, Homo sapiens
agatatgtgcgtcttagattga

SEQ ID NO: 7166982 - DNA, 22 bp, Homo sapiens
agatattaatcgtacataaggt

SEQ ID NO: 7166983 - DNA, 22 bp, Homo sapiens
agatattaatcgtacataaggt

SEQ ID NO: 7166984 - DNA, 22 bp, Homo sapiens
agatattaatcgtacataaggt

SEQ ID NO: 7166985 - DNA, 22 bp, Homo sapiens
agatccagttaatagcttcatt

SEQ ID NO: 7166986 - DNA, 22 bp, Homo sapiens
agatccagttaatagcttcatt

SEQ ID NO: 7166987 - DNA, 22 bp, Homo sapiens
agatccatcatcatattttcta

SEQ ID NO: 7166988 - DNA, 22 bp, Homo sapiens
agatccatccagcactcttgcc

SEQ ID NO: 7166989 - DNA, 23 bp, Homo sapiens
agatccatgtgggctggaaactg

SEQ ID NO: 7166990 - DNA, 23 bp, Homo sapiens
agatccatgtgggctggaaactg

SEQ ID NO: 7166991 - DNA, 22 bp, Homo sapiens
agatggtaatcacatttatctg

SEQ ID NO: 7166992 - DNA, 22 bp, Homo sapiens
agatggtaatcacatttatctg

SEQ ID NO: 7166993 - DNA, 22 bp, Homo sapiens
agatgtttgtgttatctccatt

SEQ ID NO: 7166994 - DNA, 22 bp, Homo sapiens
agatgttttggagacactaacc

SEQ ID NO: 7166995 - DNA, 22 bp, Homo sapiens
agatgttttgtgtatttcatca

SEQ ID NO: 7166996 - DNA, 22 bp, Homo sapiens
agatgtttttccaggtctaatt

SEQ ID NO: 7166997 - DNA, 21 bp, Homo sapiens
agattaaaatctgtgagaagg

SEQ ID NO: 7166998 - DNA, 22 bp, Homo sapiens
agattaactctcagaaaagagg

SEQ ID NO: 7166999 - DNA, 22 bp, Homo sapiens
agattaagaactcctggactgg

SEQ ID NO: 7167000 - DNA, 22 bp, Homo sapiens
agattacaaatcctctgtgttt

SEQ ID NO: 7167001 - DNA, 22 bp, Homo sapiens
agattacaaatcctctgtgttt

SEQ ID NO: 7167002 - DNA, 23 bp, Homo sapiens
agatctgatgttaccaagaattg

SEQ ID NO: 7167003 - DNA, 22 bp, Homo sapiens
agatctggccctcagcttgatt

SEQ ID NO: 7167004 - DNA, 22 bp, Homo sapiens
agatcttatttagctttaatca

SEQ ID NO: 7167005 - DNA, 22 bp, Homo sapiens
agatcttgttaaatgctgcctc

SEQ ID NO: 7167006 - DNA, 22 bp, Homo sapiens
agatctttaaaagttattatta

SEQ ID NO: 7167007 - DNA, 22 bp, Homo sapiens
agatgggtaattgatggcagta

SEQ ID NO: 7167008 - DNA, 20 bp, Homo sapiens
agatgggttaaagctatggg

SEQ ID NO: 7167009 - DNA, 22 bp, Homo sapiens
agatgggttgagaacacatgct

SEQ ID NO: 7167010 - DNA, 22 bp, Homo sapiens
agattacagcatgggaatggga

SEQ ID NO: 7167011 - DNA, 22 bp, Homo sapiens
agattacagcatgggaatggga

SEQ ID NO: 7167012 - DNA, 22 bp, Homo sapiens
agattacagcatgggaatggga

SEQ ID NO: 7167013 - DNA, 22 bp, Homo sapiens
agattacagcatgggaatggga

SEQ ID NO: 7167014 - DNA, 22 bp, Homo sapiens
agattacaacatgggacgcata

SEQ ID NO: 7167015 - DNA, 22 bp, Homo sapiens
agattacagaagaataagtaga

SEQ ID NO: 7167016 - DNA, 22 bp, Homo sapiens
agattacagaagaataagtaga

SEQ ID NO: 7167017 - DNA, 22 bp, Homo sapiens
agattacaacatgggacgcata

SEQ ID NO: 7167018 - DNA, 21 bp, Homo sapiens
agattacaggtgtgatccacc

SEQ ID NO: 7167019 - DNA, 21 bp, Homo sapiens
agattacaggtgtgatccacc

SEQ ID NO: 7167020 - DNA, 22 bp, Homo sapiens
agattaggattcagattctgcc

SEQ ID NO: 7167021 - DNA, 22 bp, Homo sapiens
agattagggtctgtgtctggcg

SEQ ID NO: 7167022 - DNA, 19 bp, Homo sapiens
agattattgcacattcatg

SEQ ID NO: 7167023 - DNA, 22 bp, Homo sapiens
agattatgctggctgctacaag

SEQ ID NO: 7167024 - DNA, 19 bp, Homo sapiens
agattatagggttatggga

SEQ ID NO: 7167025 - DNA, 19 bp, Homo sapiens
agattatagggttatggga

SEQ ID NO: 7167026 - DNA, 22 bp, Homo sapiens
agattatttccagactaatgaa

SEQ ID NO: 7167027 - DNA, 22 bp, Homo sapiens
agacctctggatagatgtgagg

SEQ ID NO: 7167028 - DNA, 22 bp, Homo sapiens
agacctctacgtgcgtctcatc

SEQ ID NO: 7167029 - DNA, 22 bp, Homo sapiens
agacctctgctcccttcatggt

SEQ ID NO: 7167030 - DNA, 22 bp, Homo sapiens
agacactggcactggggaagcc

SEQ ID NO: 7167031 - DNA, 22 bp, Homo sapiens
agacactggcactggggaagcc

SEQ ID NO: 7167032 - DNA, 22 bp, Homo sapiens
agacactggcactggggaagcc

SEQ ID NO: 7167033 - DNA, 22 bp, Homo sapiens
agacactggtgaagaaatcagg

SEQ ID NO: 7167034 - DNA, 21 bp, Homo sapiens
agacactggtttagcattcat

SEQ ID NO: 7167035 - DNA, 22 bp, Homo sapiens
agactctggagtcagctaggat

SEQ ID NO: 7167036 - DNA, 22 bp, Homo sapiens
agactctggaggggctggtcct

SEQ ID NO: 7167037 - DNA, 22 bp, Homo sapiens
agactctggtcctcttgaattt

SEQ ID NO: 7167038 - DNA, 17 bp, Homo sapiens
agactctgtcccatgta

SEQ ID NO: 7167039 - DNA, 19 bp, Homo sapiens
agactctgtgtgagacttt

SEQ ID NO: 7167040 - DNA, 22 bp, Homo sapiens
aatgtataaccataggaaattt

SEQ ID NO: 7167041 - DNA, 22 bp, Homo sapiens
aatgtataaccataggaaattt

SEQ ID NO: 7167042 - DNA, 22 bp, Homo sapiens
aatgtataaccataggaaattt

SEQ ID NO: 7167043 - DNA, 22 bp, Homo sapiens
aatgtataaccataggaaattt

SEQ ID NO: 7167044 - DNA, 21 bp, Homo sapiens
aatgtataacagagcccatca

SEQ ID NO: 7167045 - DNA, 22 bp, Homo sapiens
aatgtataaccataggaaattt

SEQ ID NO: 7167046 - DNA, 22 bp, Homo sapiens
aatgtataaccataggaaattt

SEQ ID NO: 7167047 - DNA, 22 bp, Homo sapiens
agacacctgccacccagagctc

SEQ ID NO: 7167048 - DNA, 22 bp, Homo sapiens
agacacctgccacccagagctc

SEQ ID NO: 7167049 - DNA, 22 bp, Homo sapiens
agacacctgccacccagagctc

SEQ ID NO: 7167050 - DNA, 22 bp, Homo sapiens
agacactgaaatgtattgaaga

SEQ ID NO: 7167051 - DNA, 22 bp, Homo sapiens
agacactgaaatgtattgaaga

SEQ ID NO: 7167052 - DNA, 22 bp, Homo sapiens
agacacctaatagatgaattca

SEQ ID NO: 7167053 - DNA, 22 bp, Homo sapiens
agacactgaaatgtattgaaga

SEQ ID NO: 7167054 - DNA, 22 bp, Homo sapiens
agacactgaatcagagggacat

SEQ ID NO: 7167055 - DNA, 22 bp, Homo sapiens
agacactgaatcagagggacat

SEQ ID NO: 7167056 - DNA, 22 bp, Homo sapiens
agacactgaatcagagggacat

SEQ ID NO: 7167057 - DNA, 22 bp, Homo sapiens
agacactgaatgtttggtggtc

SEQ ID NO: 7167058 - DNA, 17 bp, Homo sapiens
agacactgagccaagta

SEQ ID NO: 7167059 - DNA, 22 bp, Homo sapiens
agacactgaatcagagggacat

SEQ ID NO: 7167060 - DNA, 22 bp, Homo sapiens
agacactgagcattttcctagc

SEQ ID NO: 7167061 - DNA, 22 bp, Homo sapiens
agacactgagcattttcctagc

SEQ ID NO: 7167062 - DNA, 17 bp, Homo sapiens
agacactgagccaagta

SEQ ID NO: 7167063 - DNA, 17 bp, Homo sapiens
agacactgagccaagta

SEQ ID NO: 7167064 - DNA, 22 bp, Homo sapiens
agacactgatgttcagctcaat

SEQ ID NO: 7167065 - DNA, 22 bp, Homo sapiens
agacactgccacttctgttccc

SEQ ID NO: 7167066 - DNA, 22 bp, Homo sapiens
agacactgcggaggtcgggtgg

SEQ ID NO: 7167067 - DNA, 22 bp, Homo sapiens
agacactgccacttctgttccc

SEQ ID NO: 7167068 - DNA, 19 bp, Homo sapiens
agacactggatggaaaatg

SEQ ID NO: 7167069 - DNA, 23 bp, Homo sapiens
agactgaggctgccagggtcaga

SEQ ID NO: 7167070 - DNA, 23 bp, Homo sapiens
agactgaggctgccagggtcaga

SEQ ID NO: 7167071 - DNA, 22 bp, Homo sapiens
agactgagactggggaaagaca

SEQ ID NO: 7167072 - DNA, 17 bp, Homo sapiens
agactgaggacacagga

SEQ ID NO: 7167073 - DNA, 17 bp, Homo sapiens
agactgaggacacagga

SEQ ID NO: 7167074 - DNA, 23 bp, Homo sapiens
agactgaggctgccagggtcaga

SEQ ID NO: 7167075 - DNA, 21 bp, Homo sapiens
agactgccatctttgggccac

SEQ ID NO: 7167076 - DNA, 22 bp, Homo sapiens
agactggaagcctgccaagcaa

SEQ ID NO: 7167077 - DNA, 22 bp, Homo sapiens
agactggaagcctgccaagcaa

SEQ ID NO: 7167078 - DNA, 18 bp, Homo sapiens
agactggcagggaaaggg

SEQ ID NO: 7167079 - DNA, 18 bp, Homo sapiens
agactggcagggaaaggg

SEQ ID NO: 7167080 - DNA, 19 bp, Homo sapiens
agactctgtgtgagacttt

SEQ ID NO: 7167081 - DNA, 19 bp, Homo sapiens
agactctgtgtgagacttt

SEQ ID NO: 7167082 - DNA, 22 bp, Homo sapiens
agactgaagcaattcaaccagt

SEQ ID NO: 7167083 - DNA, 22 bp, Homo sapiens
agactgaagctccttgaggaca

SEQ ID NO: 7167084 - DNA, 22 bp, Homo sapiens
agactgaataggaaagagggaa

SEQ ID NO: 7167085 - DNA, 18 bp, Homo sapiens
agagaaagaccaaagcat

SEQ ID NO: 7167086 - DNA, 23 bp, Homo sapiens
agagaaagggataacacgttgaa

SEQ ID NO: 7167087 - DNA, 23 bp, Homo sapiens
agagaaagggataacacgttgaa

SEQ ID NO: 7167088 - DNA, 23 bp, Homo sapiens
agagaaagggataacacgttgaa

SEQ ID NO: 7167089 - DNA, 22 bp, Homo sapiens
agagaaagtaaagattctacct

SEQ ID NO: 7167090 - DNA, 18 bp, Homo sapiens
agagaaagaccaaagcat

SEQ ID NO: 7167091 - DNA, 18 bp, Homo sapiens
agagaaagaccaaagcat

SEQ ID NO: 7167092 - DNA, 19 bp, Homo sapiens
agagaaagaattgagtcta

SEQ ID NO: 7167093 - DNA, 18 bp, Homo sapiens
agagaaagaccaaagcat

SEQ ID NO: 7167094 - DNA, 22 bp, Homo sapiens
agagaaactgatgtcctttgaa

SEQ ID NO: 7167095 - DNA, 19 bp, Homo sapiens
agagaaagaattgagtcta

SEQ ID NO: 7167096 - DNA, 19 bp, Homo sapiens
agagaaagaattgagtcta

SEQ ID NO: 7167097 - DNA, 22 bp, Homo sapiens
agagaaacccttcagtgttttg

SEQ ID NO: 7167098 - DNA, 22 bp, Homo sapiens
agagaaacccttcagtgttttg

SEQ ID NO: 7167099 - DNA, 22 bp, Homo sapiens
agagaaacaggtcagctgggag

SEQ ID NO: 7167100 - DNA, 22 bp, Homo sapiens
agagaaacccttcagtgttttg

SEQ ID NO: 7167101 - DNA, 22 bp, Homo sapiens
agagaaactgatgtcctttgaa

SEQ ID NO: 7167102 - DNA, 22 bp, Homo sapiens
agactgggattctccctgatca

SEQ ID NO: 7167103 - DNA, 22 bp, Homo sapiens
agactgggccatttccccagct

SEQ ID NO: 7167104 - DNA, 23 bp, Homo sapiens
agactggggcataagaagatggc

SEQ ID NO: 7167105 - DNA, 23 bp, Homo sapiens
agactggggcataagaagatggc

SEQ ID NO: 7167106 - DNA, 23 bp, Homo sapiens
agactggggcataagaagatggc

SEQ ID NO: 7167107 - DNA, 22 bp, Homo sapiens
agactggggttctggcaaggag

SEQ ID NO: 7167108 - DNA, 22 bp, Homo sapiens
agagaaacaggtcagctgggag

SEQ ID NO: 7167109 - DNA, 22 bp, Homo sapiens
agagaaagtaaagattctacct

SEQ ID NO: 7167110 - DNA, 21 bp, Homo sapiens
agagaaagtcatggctgtggc

SEQ ID NO: 7167111 - DNA, 21 bp, Homo sapiens
agagaaagtcatggctgtggc

SEQ ID NO: 7167112 - DNA, 22 bp, Homo sapiens
agagaaagtcctgatctctcta

SEQ ID NO: 7167113 - DNA, 22 bp, Homo sapiens
agagaaagtcctgatctctcta

SEQ ID NO: 7167114 - DNA, 22 bp, Homo sapiens
agagaaagtcctgatctctcta

SEQ ID NO: 7167115 - DNA, 22 bp, Homo sapiens
agagaaatagattggtccagaa

SEQ ID NO: 7167116 - DNA, 22 bp, Homo sapiens
agagaaatagattggtccagaa

SEQ ID NO: 7167117 - DNA, 22 bp, Homo sapiens
agagacagggttttgccatgtt

SEQ ID NO: 7167118 - DNA, 22 bp, Homo sapiens
agagacagggttttgccatgtt

SEQ ID NO: 7167119 - DNA, 22 bp, Homo sapiens
agagagaattggataaattggt

SEQ ID NO: 7167120 - DNA, 20 bp, Homo sapiens
agagagacctaggcctagtc

SEQ ID NO: 7167121 - DNA, 18 bp, Homo sapiens
agagagaattccagtagg

SEQ ID NO: 7167122 - DNA, 22 bp, Homo sapiens
agagagaattggataaattggt

SEQ ID NO: 7167123 - DNA, 22 bp, Homo sapiens
agagagagaaatgaaatgtgct

SEQ ID NO: 7167124 - DNA, 22 bp, Homo sapiens
agagagagaaatgaaatgtgct

SEQ ID NO: 7167125 - DNA, 22 bp, Homo sapiens
agagagagaaatgaaatgtgct

SEQ ID NO: 7167126 - DNA, 22 bp, Homo sapiens
agagagagaaatgaaatgtgct

SEQ ID NO: 7167127 - DNA, 17 bp, Homo sapiens
agagagagcatgccacc

SEQ ID NO: 7167128 - DNA, 17 bp, Homo sapiens
agagagagcatgccacc

SEQ ID NO: 7167129 - DNA, 22 bp, Homo sapiens
agagagaggcagcagtgctcac

SEQ ID NO: 7167130 - DNA, 22 bp, Homo sapiens
agagagaggcagcagtgctcac

SEQ ID NO: 7167131 - DNA, 22 bp, Homo sapiens
agagagaggcagcagtgctcac

SEQ ID NO: 7167132 - DNA, 22 bp, Homo sapiens
agagagaggcagcagtgctcac

SEQ ID NO: 7167133 - DNA, 22 bp, Homo sapiens
agagagaggcagcagtgctcac

SEQ ID NO: 7167134 - DNA, 22 bp, Homo sapiens
agagagaggcagcagtgctcac

SEQ ID NO: 7167135 - DNA, 22 bp, Homo sapiens
agagagaggggcgagcaaacac

SEQ ID NO: 7167136 - DNA, 22 bp, Homo sapiens
agagagaggggcgagcaaacac

SEQ ID NO: 7167137 - DNA, 22 bp, Homo sapiens
agagagaggggcgagcaaacac

SEQ ID NO: 7167138 - DNA, 22 bp, Homo sapiens
agagagaggggcgagcaaacac

SEQ ID NO: 7167139 - DNA, 22 bp, Homo sapiens
agagagaggggcgagcaaacac

SEQ ID NO: 7167140 - DNA, 22 bp, Homo sapiens
agagagaggggcgagcaaacac

SEQ ID NO: 7167141 - DNA, 20 bp, Homo sapiens
agagagaggtaaattgagca

SEQ ID NO: 7167142 - DNA, 20 bp, Homo sapiens
agagagaggtaaattgagca

SEQ ID NO: 7167143 - DNA, 20 bp, Homo sapiens
agagagaggtaaattgagca

SEQ ID NO: 7167144 - DNA, 20 bp, Homo sapiens
agagagaggtaaattgagca

SEQ ID NO: 7167145 - DNA, 20 bp, Homo sapiens
agagagaggtaaattgagca

SEQ ID NO: 7167146 - DNA, 20 bp, Homo sapiens
agagagaggtaaattgagca

SEQ ID NO: 7167147 - DNA, 23 bp, Homo sapiens
agagagagtttgtgtcaggtacc

SEQ ID NO: 7167148 - DNA, 23 bp, Homo sapiens
agagagagtttgtgtcaggtacc

SEQ ID NO: 7167149 - DNA, 23 bp, Homo sapiens
agagagagtttgtgtcaggtacc

SEQ ID NO: 7167150 - DNA, 20 bp, Homo sapiens
agagagcacaggcaggaaag

SEQ ID NO: 7167151 - DNA, 20 bp, Homo sapiens
agagagcacaggcaggaaag

SEQ ID NO: 7167152 - DNA, 20 bp, Homo sapiens
agagagcacaggcaggaaag

SEQ ID NO: 7167153 - DNA, 20 bp, Homo sapiens
agagagcacaggcaggaaag

SEQ ID NO: 7167154 - DNA, 22 bp, Homo sapiens
agagagcaggacttcactgagc

SEQ ID NO: 7167155 - DNA, 22 bp, Homo sapiens
agagagcaggacttcactgagc

SEQ ID NO: 7167156 - DNA, 22 bp, Homo sapiens
agagagcagtctggaagaaaca

SEQ ID NO: 7167157 - DNA, 22 bp, Homo sapiens
agagagcagtctggaagaaaca

SEQ ID NO: 7167158 - DNA, 20 bp, Homo sapiens
agagagttgtcagtagcttc

SEQ ID NO: 7167159 - DNA, 22 bp, Homo sapiens
agagatatgagtagttgtgaca

SEQ ID NO: 7167160 - DNA, 22 bp, Homo sapiens
agagatatgctgcctaaattta

SEQ ID NO: 7167161 - DNA, 22 bp, Homo sapiens
agagatatggatgtcagaaact

SEQ ID NO: 7167162 - DNA, 22 bp, Homo sapiens
agagatattatttaccaagtta

SEQ ID NO: 7167163 - DNA, 22 bp, Homo sapiens
agagatataagtataaataggg

SEQ ID NO: 7167164 - DNA, 22 bp, Homo sapiens
agagatataagtataaataggg

SEQ ID NO: 7167165 - DNA, 22 bp, Homo sapiens
agagatagtgtattagttgggc

SEQ ID NO: 7167166 - DNA, 22 bp, Homo sapiens
agagatataagtataaataggg

SEQ ID NO: 7167167 - DNA, 22 bp, Homo sapiens
agagataaagctatgatttatg

SEQ ID NO: 7167168 - DNA, 22 bp, Homo sapiens
agagataattaggttaaatgag

SEQ ID NO: 7167169 - DNA, 22 bp, Homo sapiens
agagataattaggttaaatgag

SEQ ID NO: 7167170 - DNA, 19 bp, Homo sapiens
agagatccagcttctagct

SEQ ID NO: 7167171 - DNA, 22 bp, Homo sapiens
agagatcccttctgcctgggga

SEQ ID NO: 7167172 - DNA, 22 bp, Homo sapiens
agagatccttcaatctagtttt

SEQ ID NO: 7167173 - DNA, 22 bp, Homo sapiens
agagatctagcacctgctggtc

SEQ ID NO: 7167174 - DNA, 22 bp, Homo sapiens
agagatctagcacctgctggtc

SEQ ID NO: 7167175 - DNA, 22 bp, Homo sapiens
agagatctatttaatagtgtta

SEQ ID NO: 7167176 - DNA, 22 bp, Homo sapiens
agagatctccatgcccttataa

SEQ ID NO: 7167177 - DNA, 22 bp, Homo sapiens
agagatctctgaagctgctgct

SEQ ID NO: 7167178 - DNA, 22 bp, Homo sapiens
agagatctctgaagctgctgct

SEQ ID NO: 7167179 - DNA, 22 bp, Homo sapiens
agagatctgaaacaaattagga

SEQ ID NO: 7167180 - DNA, 22 bp, Homo sapiens
agagatctgaaacaaattagga

SEQ ID NO: 7167181 - DNA, 21 bp, Homo sapiens
agagatctgaagaaccattag

SEQ ID NO: 7167182 - DNA, 22 bp, Homo sapiens
agagatctgtctactatttaag

SEQ ID NO: 7167183 - DNA, 22 bp, Homo sapiens
agagatctgtgcttactacaag

SEQ ID NO: 7167184 - DNA, 22 bp, Homo sapiens
aattatgtagccatatgaaaca

SEQ ID NO: 7167185 - DNA, 22 bp, Homo sapiens
aattatgtggaagaggattaaa

SEQ ID NO: 7167186 - DNA, 22 bp, Homo sapiens
aattatgtttgctttagatgga

SEQ ID NO: 7167187 - DNA, 22 bp, Homo sapiens
aattcacaattatgttgggaga

SEQ ID NO: 7167188 - DNA, 22 bp, Homo sapiens
aattcacacctccggtttttct

SEQ ID NO: 7167189 - DNA, 22 bp, Homo sapiens
aattcacagaaccatggtgctc

SEQ ID NO: 7167190 - DNA, 23 bp, Homo sapiens
aatgctggaaattcaggcatgat

SEQ ID NO: 7167191 - DNA, 23 bp, Homo sapiens
aatgctggaaattcaggcatgat

SEQ ID NO: 7167192 - DNA, 22 bp, Homo sapiens
aatgaaacatatttaggaataa

SEQ ID NO: 7167193 - DNA, 22 bp, Homo sapiens
aatgaaaattggaccctagaac

SEQ ID NO: 7167194 - DNA, 22 bp, Homo sapiens
aatgctttgactatatctataa

SEQ ID NO: 7167195 - DNA, 22 bp, Homo sapiens
aatgctttgagggaagatgaaa

SEQ ID NO: 7167196 - DNA, 22 bp, Homo sapiens
aatgctttgagggaagatgaaa

SEQ ID NO: 7167197 - DNA, 22 bp, Homo sapiens
aatgctttgagggaagatgaaa

SEQ ID NO: 7167198 - DNA, 22 bp, Homo sapiens
aatgctttgattgattaaaaca

SEQ ID NO: 7167199 - DNA, 22 bp, Homo sapiens
aatgctttgattgattaaaaca

SEQ ID NO: 7167200 - DNA, 22 bp, Homo sapiens
aatgctttggggttggtactgt

SEQ ID NO: 7167201 - DNA, 22 bp, Homo sapiens
aatgctttggggttggtactgt

SEQ ID NO: 7167202 - DNA, 22 bp, Homo sapiens
aatggaacttgtaattatgtcc

SEQ ID NO: 7167203 - DNA, 18 bp, Homo sapiens
aatggaaggggtgctgtt

SEQ ID NO: 7167204 - DNA, 18 bp, Homo sapiens
aatggaaggggtgctgtt

SEQ ID NO: 7167205 - DNA, 21 bp, Homo sapiens
aatggaagtttaaaggtatcc

SEQ ID NO: 7167206 - DNA, 22 bp, Homo sapiens
aatgcttttacgacatgtacct

SEQ ID NO: 7167207 - DNA, 22 bp, Homo sapiens
aatgcttttacgacatgtacct

SEQ ID NO: 7167208 - DNA, 22 bp, Homo sapiens
aatgcttttacgacatgtacct

SEQ ID NO: 7167209 - DNA, 22 bp, Homo sapiens
aatgcttttgctgtcattgctt

SEQ ID NO: 7167210 - DNA, 22 bp, Homo sapiens
aatgcttttgctgtcattgctt

SEQ ID NO: 7167211 - DNA, 22 bp, Homo sapiens
aatggaatacctaggtggccca

SEQ ID NO: 7167212 - DNA, 22 bp, Homo sapiens
aatggaatacctaggtggccca

SEQ ID NO: 7167213 - DNA, 22 bp, Homo sapiens
aatggaatgcctcacatgtatt

SEQ ID NO: 7167214 - DNA, 22 bp, Homo sapiens
aatggacaaacttgggaagtat

SEQ ID NO: 7167215 - DNA, 22 bp, Homo sapiens
aatggacaggagagcatagtca

SEQ ID NO: 7167216 - DNA, 19 bp, Homo sapiens
aatggacaggcaatagtct

SEQ ID NO: 7167217 - DNA, 22 bp, Homo sapiens
agaataaatgctacctatcaca

SEQ ID NO: 7167218 - DNA, 22 bp, Homo sapiens
agaataaatgctacctatcaca

SEQ ID NO: 7167219 - DNA, 22 bp, Homo sapiens
agaataaatgctacctatcaca

SEQ ID NO: 7167220 - DNA, 22 bp, Homo sapiens
agaataaatgttggacttagga

SEQ ID NO: 7167221 - DNA, 22 bp, Homo sapiens
agaataaatgttggacttagga

SEQ ID NO: 7167222 - DNA, 22 bp, Homo sapiens
agaataaatgttggacttagga

SEQ ID NO: 7167223 - DNA, 22 bp, Homo sapiens
agaataaatcaaatgtcctgag

SEQ ID NO: 7167224 - DNA, 22 bp, Homo sapiens
agaataaatcaaatgtcctgag

SEQ ID NO: 7167225 - DNA, 22 bp, Homo sapiens
agaataaaatagtctgaagatg

SEQ ID NO: 7167226 - DNA, 22 bp, Homo sapiens
agaataaaatagtctgaagatg

SEQ ID NO: 7167227 - DNA, 22 bp, Homo sapiens
agaataaaatagtctgaagatg

SEQ ID NO: 7167228 - DNA, 22 bp, Homo sapiens
agaataaaatagtctgaagatg

SEQ ID NO: 7167229 - DNA, 22 bp, Homo sapiens
agaagttttgggaaatactgat

SEQ ID NO: 7167230 - DNA, 22 bp, Homo sapiens
agaataatcactgaagttcaaa

SEQ ID NO: 7167231 - DNA, 22 bp, Homo sapiens
agaataatcactgaagttcaaa

SEQ ID NO: 7167232 - DNA, 22 bp, Homo sapiens
agaataatactgaaatgctgaa

SEQ ID NO: 7167233 - DNA, 22 bp, Homo sapiens
agaataatcactgaagttcaaa

SEQ ID NO: 7167234 - DNA, 22 bp, Homo sapiens
agaataatcactgaagttcaaa

SEQ ID NO: 7167235 - DNA, 22 bp, Homo sapiens
agaataatcactgaagttcaaa

SEQ ID NO: 7167236 - DNA, 22 bp, Homo sapiens
agaataaatgttggacttagga

SEQ ID NO: 7167237 - DNA, 22 bp, Homo sapiens
agaataaatgttggacttagga

SEQ ID NO: 7167238 - DNA, 22 bp, Homo sapiens
agaataaccagtgtttcacagt

SEQ ID NO: 7167239 - DNA, 22 bp, Homo sapiens
agaataagcctgacgaaaccta

SEQ ID NO: 7167240 - DNA, 21 bp, Homo sapiens
agaataatggtatcatttgct

SEQ ID NO: 7167241 - DNA, 22 bp, Homo sapiens
agaatcagtgctggctattagc

SEQ ID NO: 7167242 - DNA, 19 bp, Homo sapiens
agaatcatcttgaagtgat

SEQ ID NO: 7167243 - DNA, 19 bp, Homo sapiens
agaatcatcttgaagtgat

SEQ ID NO: 7167244 - DNA, 22 bp, Homo sapiens
agaatcattatatttattaagc

SEQ ID NO: 7167245 - DNA, 21 bp, Homo sapiens
agaatccaagatgccattggc

SEQ ID NO: 7167246 - DNA, 22 bp, Homo sapiens
agaattgtaagcaatttgatta

SEQ ID NO: 7167247 - DNA, 22 bp, Homo sapiens
agaattggttggggaatgtgga

SEQ ID NO: 7167248 - DNA, 23 bp, Homo sapiens
agaattgtaaatagaatatacct

SEQ ID NO: 7167249 - DNA, 22 bp, Homo sapiens
agaatcttgggcaaattcatct

SEQ ID NO: 7167250 - DNA, 22 bp, Homo sapiens
agaattgtaagcaatttgatta

SEQ ID NO: 7167251 - DNA, 22 bp, Homo sapiens
agaattgtaataataatagcat

SEQ ID NO: 7167252 - DNA, 22 bp, Homo sapiens
agaattgttctgtagcttggct

SEQ ID NO: 7167253 - DNA, 22 bp, Homo sapiens
agaattgttctgtagcttggct

SEQ ID NO: 7167254 - DNA, 22 bp, Homo sapiens
agaattgttggggtaataaaag

SEQ ID NO: 7167255 - DNA, 22 bp, Homo sapiens
agaattgttggggtaataaaag

SEQ ID NO: 7167256 - DNA, 23 bp, Homo sapiens
agaattgttgttagggaaaagta

SEQ ID NO: 7167257 - DNA, 19 bp, Homo sapiens
agaattgttttatgtcttc

SEQ ID NO: 7167258 - DNA, 19 bp, Homo sapiens
agaattgttttatgtcttc

SEQ ID NO: 7167259 - DNA, 19 bp, Homo sapiens
agaattgttttgagacccc

SEQ ID NO: 7167260 - DNA, 22 bp, Homo sapiens
agaatttaggatgcatgtgaat

SEQ ID NO: 7167261 - DNA, 23 bp, Homo sapiens
agaatttcaaagtccagcacatt

SEQ ID NO: 7167262 - DNA, 22 bp, Homo sapiens
agaatctctactcaagtacttg

SEQ ID NO: 7167263 - DNA, 22 bp, Homo sapiens
agaatctacattttaacaagat

SEQ ID NO: 7167264 - DNA, 21 bp, Homo sapiens
agaatcatttttcccttctct

SEQ ID NO: 7167265 - DNA, 19 bp, Homo sapiens
agaatcccaggccccactg

SEQ ID NO: 7167266 - DNA, 22 bp, Homo sapiens
agaatccctgcttgtcttcaaa

SEQ ID NO: 7167267 - DNA, 22 bp, Homo sapiens
agaatccctggggagctgcagc

SEQ ID NO: 7167268 - DNA, 22 bp, Homo sapiens
agaatccctggggagctgcagc

SEQ ID NO: 7167269 - DNA, 22 bp, Homo sapiens
agaatcctattgtcagattctt

SEQ ID NO: 7167270 - DNA, 22 bp, Homo sapiens
agaatcctcttcagtaaattct

SEQ ID NO: 7167271 - DNA, 22 bp, Homo sapiens
agaatcctgatgaaaaggagag

SEQ ID NO: 7167272 - DNA, 22 bp, Homo sapiens
agaatcctggagaagctgtacc

SEQ ID NO: 7167273 - DNA, 22 bp, Homo sapiens
agaatcctggagaagctgtacc

SEQ ID NO: 7167274 - DNA, 22 bp, Homo sapiens
agaatcctggccaggtcagagc

SEQ ID NO: 7167275 - DNA, 22 bp, Homo sapiens
agaatcctggccaggtcagagc

SEQ ID NO: 7167276 - DNA, 22 bp, Homo sapiens
agaatccttgactcaggctgag

SEQ ID NO: 7167277 - DNA, 22 bp, Homo sapiens
agaatcctgttttacttcatca

SEQ ID NO: 7167278 - DNA, 22 bp, Homo sapiens
agaatccttgactcaggctgag

SEQ ID NO: 7167279 - DNA, 22 bp, Homo sapiens
agaatccttgactcaggctgag

SEQ ID NO: 7167280 - DNA, 19 bp, Homo sapiens
agaatctaaattatttctg

SEQ ID NO: 7167281 - DNA, 22 bp, Homo sapiens
agaatctaagtacacagacaga

SEQ ID NO: 7167282 - DNA, 22 bp, Homo sapiens
aatgtaaacagcaagagaaggg

SEQ ID NO: 7167283 - DNA, 23 bp, Homo sapiens
agacaaaagcctcagtcttaggc

SEQ ID NO: 7167284 - DNA, 23 bp, Homo sapiens
agacaaaagcctcagtcttaggc

SEQ ID NO: 7167285 - DNA, 22 bp, Homo sapiens
aatgtacactgaaagcctatca

SEQ ID NO: 7167286 - DNA, 22 bp, Homo sapiens
aatgtacactgaaagcctatca

SEQ ID NO: 7167287 - DNA, 22 bp, Homo sapiens
aatgtacactgaaagcctatca

SEQ ID NO: 7167288 - DNA, 22 bp, Homo sapiens
aatgtacactgaaagcctatca

SEQ ID NO: 7167289 - DNA, 22 bp, Homo sapiens
agaatttcaaatggaagtttta

SEQ ID NO: 7167290 - DNA, 22 bp, Homo sapiens
agaatttcctatgagagattcc

SEQ ID NO: 7167291 - DNA, 22 bp, Homo sapiens
agaatttctggaagattgcaag

SEQ ID NO: 7167292 - DNA, 22 bp, Homo sapiens
agaatttttgattatctactcg

SEQ ID NO: 7167293 - DNA, 23 bp, Homo sapiens
agacaaaagcctcagtcttaggc

SEQ ID NO: 7167294 - DNA, 22 bp, Homo sapiens
aatgtacatctcagtgtagtac

SEQ ID NO: 7167295 - DNA, 22 bp, Homo sapiens
aatgtacaggctggctatgggg

SEQ ID NO: 7167296 - DNA, 22 bp, Homo sapiens
aatgtacaggctggctatgggg

SEQ ID NO: 7167297 - DNA, 22 bp, Homo sapiens
aatgtacagctgtctttcctcc

SEQ ID NO: 7167298 - DNA, 22 bp, Homo sapiens
aatgtagatgagatattttttg

SEQ ID NO: 7167299 - DNA, 19 bp, Homo sapiens
aatgtagtgttatgtcaac

SEQ ID NO: 7167300 - DNA, 19 bp, Homo sapiens
aatgtagtgttatgtcaac

SEQ ID NO: 7167301 - DNA, 22 bp, Homo sapiens
aatgtagaatgatccttaggat

SEQ ID NO: 7167302 - DNA, 22 bp, Homo sapiens
aatgtactaataagcaacattt

SEQ ID NO: 7167303 - DNA, 22 bp, Homo sapiens
aatgtactaataagcaacattt

SEQ ID NO: 7167304 - DNA, 20 bp, Homo sapiens
aatgtactgtttgtgggggc

SEQ ID NO: 7167305 - DNA, 22 bp, Homo sapiens
aatgtataaagtgttaataact

SEQ ID NO: 7167306 - DNA, 22 bp, Homo sapiens
aatgtataaagtgttaataact

SEQ ID NO: 7167307 - DNA, 22 bp, Homo sapiens
aatgtagttgactgtgctgtag

SEQ ID NO: 7167308 - DNA, 22 bp, Homo sapiens
aatgtataaagtgttaataact

SEQ ID NO: 7167309 - DNA, 22 bp, Homo sapiens
aatgtataaagtgttaataact

SEQ ID NO: 7167310 - DNA, 22 bp, Homo sapiens
aatgtataaagtgttaataact

SEQ ID NO: 7167311 - DNA, 21 bp, Homo sapiens
aatgtataacagagcccatca

SEQ ID NO: 7167312 - DNA, 22 bp, Homo sapiens
agcaggagggttttgtagagtc

SEQ ID NO: 7167313 - DNA, 22 bp, Homo sapiens
agcaggagggttttgtagagtc

SEQ ID NO: 7167314 - DNA, 22 bp, Homo sapiens
agcaggagggttttgtagagtc

SEQ ID NO: 7167315 - DNA, 22 bp, Homo sapiens
agcaggagggttttgtagagtc

SEQ ID NO: 7167316 - DNA, 22 bp, Homo sapiens
agcaggagggttttgtagagtc

SEQ ID NO: 7167317 - DNA, 22 bp, Homo sapiens
agcaggagggttttgtagagtc

SEQ ID NO: 7167318 - DNA, 22 bp, Homo sapiens
agcaggagggttttgtagagtc

SEQ ID NO: 7167319 - DNA, 22 bp, Homo sapiens
agcaggagtgtcccctggctgt

SEQ ID NO: 7167320 - DNA, 22 bp, Homo sapiens
agcaggagggttttgtagagtc

SEQ ID NO: 7167321 - DNA, 22 bp, Homo sapiens
agcaggagtgtcccctggctgt

SEQ ID NO: 7167322 - DNA, 22 bp, Homo sapiens
agcaggcaggctgccagtgaat

SEQ ID NO: 7167323 - DNA, 22 bp, Homo sapiens
agcaggcaggctgccagtgaat

SEQ ID NO: 7167324 - DNA, 22 bp, Homo sapiens
agcaggcaggctgccagtgaat

SEQ ID NO: 7167325 - DNA, 19 bp, Homo sapiens
agcaggcaggtggcccagg

SEQ ID NO: 7167326 - DNA, 19 bp, Homo sapiens
agcaggcaggtggcccagg

SEQ ID NO: 7167327 - DNA, 22 bp, Homo sapiens
agcaggcaggctgccagtgaat

SEQ ID NO: 7167328 - DNA, 22 bp, Homo sapiens
agcaggcaggctgccagtgaat

SEQ ID NO: 7167329 - DNA, 22 bp, Homo sapiens
agcagctgagccccagctgtga

SEQ ID NO: 7167330 - DNA, 22 bp, Homo sapiens
agcagctgagccccagctgtga

SEQ ID NO: 7167331 - DNA, 22 bp, Homo sapiens
agcagctgagccccagctgtga

SEQ ID NO: 7167332 - DNA, 22 bp, Homo sapiens
agcagctgagccccagctgtga

SEQ ID NO: 7167333 - DNA, 22 bp, Homo sapiens
agcagctgagatggtaagattc

SEQ ID NO: 7167334 - DNA, 22 bp, Homo sapiens
agcagctgagatggtaagattc

SEQ ID NO: 7167335 - DNA, 22 bp, Homo sapiens
agcaggaacgagttcatgggga

SEQ ID NO: 7167336 - DNA, 22 bp, Homo sapiens
agcaggagcccttatcaccagg

SEQ ID NO: 7167337 - DNA, 22 bp, Homo sapiens
agcaggagctgtgggaagatgg

SEQ ID NO: 7167338 - DNA, 22 bp, Homo sapiens
agcaggaacgagttcatgggga

SEQ ID NO: 7167339 - DNA, 22 bp, Homo sapiens
agcagctgagccccagctgtga

SEQ ID NO: 7167340 - DNA, 22 bp, Homo sapiens
agcaggaacgagttcatgggga

SEQ ID NO: 7167341 - DNA, 22 bp, Homo sapiens
agcaggaggagagcctggcggt

SEQ ID NO: 7167342 - DNA, 22 bp, Homo sapiens
agcaggaggagagcctggcggt

SEQ ID NO: 7167343 - DNA, 21 bp, Homo sapiens
agcaggaggcagtcacagctc

SEQ ID NO: 7167344 - DNA, 21 bp, Homo sapiens
agcaggaggcagtcacagctc

SEQ ID NO: 7167345 - DNA, 21 bp, Homo sapiens
agcaggaggcagtcacagctc

SEQ ID NO: 7167346 - DNA, 22 bp, Homo sapiens
agcaggagctgtgggaagatgg

SEQ ID NO: 7167347 - DNA, 22 bp, Homo sapiens
agcaggagctgtgggaagatgg

SEQ ID NO: 7167348 - DNA, 22 bp, Homo sapiens
agcaggagctgtgggaagatgg

SEQ ID NO: 7167349 - DNA, 22 bp, Homo sapiens
agcagccagttctctgtggtag

SEQ ID NO: 7167350 - DNA, 22 bp, Homo sapiens
agcagccagtgggagtgataca

SEQ ID NO: 7167351 - DNA, 22 bp, Homo sapiens
agcagccatagatagcatgcaa

SEQ ID NO: 7167352 - DNA, 22 bp, Homo sapiens
agcagccatagatagcatgcaa

SEQ ID NO: 7167353 - DNA, 23 bp, Homo sapiens
agcagccatagggaagcaataca

SEQ ID NO: 7167354 - DNA, 23 bp, Homo sapiens
agcagccatagggaagcaataca

SEQ ID NO: 7167355 - DNA, 21 bp, Homo sapiens
agcagccatggatggtatgta

SEQ ID NO: 7167356 - DNA, 19 bp, Homo sapiens
agcagccatcgaccatgga

SEQ ID NO: 7167357 - DNA, 21 bp, Homo sapiens
agcagccatttcacagagact

SEQ ID NO: 7167358 - DNA, 21 bp, Homo sapiens
agcagccatttcacagagact

SEQ ID NO: 7167359 - DNA, 21 bp, Homo sapiens
agcagccatttcacagagact

SEQ ID NO: 7167360 - DNA, 21 bp, Homo sapiens
agcagccatttcacagagact

SEQ ID NO: 7167361 - DNA, 22 bp, Homo sapiens
agcagctcctctaggaacggat

SEQ ID NO: 7167362 - DNA, 22 bp, Homo sapiens
agcagctcgggctacagagggg

SEQ ID NO: 7167363 - DNA, 22 bp, Homo sapiens
agcagctctggcactgtagcat

SEQ ID NO: 7167364 - DNA, 22 bp, Homo sapiens
agcagctctgtttacctggagg

SEQ ID NO: 7167365 - DNA, 22 bp, Homo sapiens
agcagctctgtttacctggagg

SEQ ID NO: 7167366 - DNA, 17 bp, Homo sapiens
agcagctgaagcagcca

SEQ ID NO: 7167367 - DNA, 17 bp, Homo sapiens
agcagctgaagcagcca

SEQ ID NO: 7167368 - DNA, 22 bp, Homo sapiens
agcagctgaccagtgagtcctg

SEQ ID NO: 7167369 - DNA, 22 bp, Homo sapiens
agcagctgaccagtgagtcctg

SEQ ID NO: 7167370 - DNA, 22 bp, Homo sapiens
agcagctgaccagtgagtcctg

SEQ ID NO: 7167371 - DNA, 22 bp, Homo sapiens
agcaggtgagcacagccaggct

SEQ ID NO: 7167372 - DNA, 22 bp, Homo sapiens
agcaggtgagcacagccaggct

SEQ ID NO: 7167373 - DNA, 22 bp, Homo sapiens
agcaggtgagcacagccaggct

SEQ ID NO: 7167374 - DNA, 22 bp, Homo sapiens
agcaggtgagcacagccaggct

SEQ ID NO: 7167375 - DNA, 20 bp, Homo sapiens
agcaggtgacggggcctgct

SEQ ID NO: 7167376 - DNA, 20 bp, Homo sapiens
agcaggtgacggggcctgct

SEQ ID NO: 7167377 - DNA, 23 bp, Homo sapiens
agcagttagggatacaagttatc

SEQ ID NO: 7167378 - DNA, 22 bp, Homo sapiens
agcagttatattactctcaggt

SEQ ID NO: 7167379 - DNA, 22 bp, Homo sapiens
agcagttatattgaaataaaaa

SEQ ID NO: 7167380 - DNA, 22 bp, Homo sapiens
agcagttatcgaagaatcaggt

SEQ ID NO: 7167381 - DNA, 22 bp, Homo sapiens
agcagttatgttctataaagtc

SEQ ID NO: 7167382 - DNA, 22 bp, Homo sapiens
agcatcagcctctgtcctggag

SEQ ID NO: 7167383 - DNA, 22 bp, Homo sapiens
agcatcagcctctgtcctggag

SEQ ID NO: 7167384 - DNA, 22 bp, Homo sapiens
agcatccaacaggagggaaggg

SEQ ID NO: 7167385 - DNA, 22 bp, Homo sapiens
agcatccaactttgattagaga

SEQ ID NO: 7167386 - DNA, 22 bp, Homo sapiens
agcatccactcactgggagagg

SEQ ID NO: 7167387 - DNA, 22 bp, Homo sapiens
agcatccagatgcctgatgtca

SEQ ID NO: 7167388 - DNA, 22 bp, Homo sapiens
agcatccagcatcctatagaaa

SEQ ID NO: 7167389 - DNA, 22 bp, Homo sapiens
agcatccaggccaggttgggca

SEQ ID NO: 7167390 - DNA, 19 bp, Homo sapiens
agcatccagtcatgggatc

SEQ ID NO: 7167391 - DNA, 19 bp, Homo sapiens
agcatccagtcatgggatc

SEQ ID NO: 7167392 - DNA, 22 bp, Homo sapiens
agcatcccatgactctggagga

SEQ ID NO: 7167393 - DNA, 22 bp, Homo sapiens
agcaggtgacagggctgtggtg

SEQ ID NO: 7167394 - DNA, 22 bp, Homo sapiens
agcaggtgacagggctgtggtg

SEQ ID NO: 7167395 - DNA, 22 bp, Homo sapiens
agcaggtgacccaagcaggctg

SEQ ID NO: 7167396 - DNA, 22 bp, Homo sapiens
agcaggtgacccaagcaggctg

SEQ ID NO: 7167397 - DNA, 22 bp, Homo sapiens
agcaggtgacagggctgtggtg

SEQ ID NO: 7167398 - DNA, 22 bp, Homo sapiens
agcaggtgacagggctgtggtg

SEQ ID NO: 7167399 - DNA, 22 bp, Homo sapiens
agcaggtgacccaagcaggctg

SEQ ID NO: 7167400 - DNA, 22 bp, Homo sapiens
agcaggtgacccaagcaggctg

SEQ ID NO: 7167401 - DNA, 22 bp, Homo sapiens
agcaggtgacccaagcaggctg

SEQ ID NO: 7167402 - DNA, 22 bp, Homo sapiens
agcaggtgacccaagcaggctg

SEQ ID NO: 7167403 - DNA, 20 bp, Homo sapiens
agcaggtgacggggcctgct

SEQ ID NO: 7167404 - DNA, 22 bp, Homo sapiens
agcaggtgaattcctggatgtg

SEQ ID NO: 7167405 - DNA, 22 bp, Homo sapiens
agcaggtgaattcctggatgtg

SEQ ID NO: 7167406 - DNA, 21 bp, Homo sapiens
agcaggtgaacctccagtaca

SEQ ID NO: 7167407 - DNA, 21 bp, Homo sapiens
agcaggtgaacctccagtaca

SEQ ID NO: 7167408 - DNA, 22 bp, Homo sapiens
agcagggctttggctggctttc

SEQ ID NO: 7167409 - DNA, 22 bp, Homo sapiens
agcagggctttggctggctttc

SEQ ID NO: 7167410 - DNA, 22 bp, Homo sapiens
agcagggctttgtctctgtgaa

SEQ ID NO: 7167411 - DNA, 22 bp, Homo sapiens
agcagggctttgtctctgtgaa

SEQ ID NO: 7167412 - DNA, 22 bp, Homo sapiens
agcagggctttgtctctgtgaa

SEQ ID NO: 7167413 - DNA, 22 bp, Homo sapiens
agcagggctttgtctctgtgaa

SEQ ID NO: 7167414 - DNA, 22 bp, Homo sapiens
agcagggctttgtctctgtgaa

SEQ ID NO: 7167415 - DNA, 22 bp, Homo sapiens
agcagggcttgccgcttgtcct

SEQ ID NO: 7167416 - DNA, 22 bp, Homo sapiens
agcagggcttgccgcttgtcct

SEQ ID NO: 7167417 - DNA, 22 bp, Homo sapiens
agcagggcttgccgcttgtcct

SEQ ID NO: 7167418 - DNA, 22 bp, Homo sapiens
agcagggctttgcagacttggg

SEQ ID NO: 7167419 - DNA, 22 bp, Homo sapiens
agcagggctttgcagacttggg

SEQ ID NO: 7167420 - DNA, 22 bp, Homo sapiens
agcagggctttgcagacttggg

SEQ ID NO: 7167421 - DNA, 22 bp, Homo sapiens
agcagggctttggctggctttc

SEQ ID NO: 7167422 - DNA, 22 bp, Homo sapiens
agcagggcttctgtgcctgtgc

SEQ ID NO: 7167423 - DNA, 22 bp, Homo sapiens
agcagggcttctgtgcctgtgc

SEQ ID NO: 7167424 - DNA, 22 bp, Homo sapiens
agcagggcttctgtgcctgtgc

SEQ ID NO: 7167425 - DNA, 22 bp, Homo sapiens
agcagggcttctgtgcctgtgc

SEQ ID NO: 7167426 - DNA, 22 bp, Homo sapiens
agcagggcttctgtgcctgtgc

SEQ ID NO: 7167427 - DNA, 22 bp, Homo sapiens
agcagggcctctggcactggtc

SEQ ID NO: 7167428 - DNA, 22 bp, Homo sapiens
agcagggcctctggcactggtc

SEQ ID NO: 7167429 - DNA, 22 bp, Homo sapiens
agcagggctgtgctccttccga

SEQ ID NO: 7167430 - DNA, 22 bp, Homo sapiens
agcagggctgtgctccttccga

SEQ ID NO: 7167431 - DNA, 22 bp, Homo sapiens
agcagggctgtgctccttccga

SEQ ID NO: 7167432 - DNA, 22 bp, Homo sapiens
agcagggctgtgtaggtaatga

SEQ ID NO: 7167433 - DNA, 22 bp, Homo sapiens
agcagggctgtgtaggtaatga

SEQ ID NO: 7167434 - DNA, 22 bp, Homo sapiens
agcagggctgtgtaggtaatga

SEQ ID NO: 7167435 - DNA, 22 bp, Homo sapiens
agcaggcatagagtagcactca

SEQ ID NO: 7167436 - DNA, 22 bp, Homo sapiens
agcaggcatagagtagcactca

SEQ ID NO: 7167437 - DNA, 23 bp, Homo sapiens
agcaggcatctgtggcacaaggc

SEQ ID NO: 7167438 - DNA, 23 bp, Homo sapiens
agcaggcatctgtggcacaaggc

SEQ ID NO: 7167439 - DNA, 23 bp, Homo sapiens
agcaggcatctgtggcacaaggc

SEQ ID NO: 7167440 - DNA, 22 bp, Homo sapiens
agcaggcatagagtagcactca

SEQ ID NO: 7167441 - DNA, 22 bp, Homo sapiens
agcaggcatagagtagcactca

SEQ ID NO: 7167442 - DNA, 22 bp, Homo sapiens
agcaggcatagagtagcactca

SEQ ID NO: 7167443 - DNA, 22 bp, Homo sapiens
agcaggcatagagtagcactca

SEQ ID NO: 7167444 - DNA, 22 bp, Homo sapiens
agcaggcatagagtagcactca

SEQ ID NO: 7167445 - DNA, 19 bp, Homo sapiens
agcaggcaggtggcccagg

SEQ ID NO: 7167446 - DNA, 19 bp, Homo sapiens
agcaggcaggtggcccagg

SEQ ID NO: 7167447 - DNA, 21 bp, Homo sapiens
agcaggcagtgggctggattt

SEQ ID NO: 7167448 - DNA, 21 bp, Homo sapiens
agcaggcagtgggctggattt

SEQ ID NO: 7167449 - DNA, 22 bp, Homo sapiens
agcaggcagtgtagagccttca

SEQ ID NO: 7167450 - DNA, 22 bp, Homo sapiens
agcaggcagtgtagagccttca

SEQ ID NO: 7167451 - DNA, 19 bp, Homo sapiens
agcaggccacagggccagc

SEQ ID NO: 7167452 - DNA, 19 bp, Homo sapiens
agcaggccacagggccagc

SEQ ID NO: 7167453 - DNA, 22 bp, Homo sapiens
agcaggcatttgatatatattt

SEQ ID NO: 7167454 - DNA, 22 bp, Homo sapiens
agcaggccaaggaactttgtgg

SEQ ID NO: 7167455 - DNA, 22 bp, Homo sapiens
agcagggcctctggcactggtc

SEQ ID NO: 7167456 - DNA, 22 bp, Homo sapiens
agcagggcctctggcactggtc

SEQ ID NO: 7167457 - DNA, 22 bp, Homo sapiens
agcagggcccactaggggagat

SEQ ID NO: 7167458 - DNA, 22 bp, Homo sapiens
agcagggcccactaggggagat

SEQ ID NO: 7167459 - DNA, 22 bp, Homo sapiens
agcaggccaaggaactttgtgg

SEQ ID NO: 7167460 - DNA, 23 bp, Homo sapiens
agcaggcatctgtggcacaaggc

SEQ ID NO: 7167461 - DNA, 23 bp, Homo sapiens
agcaggcatctgtggcacaaggc

SEQ ID NO: 7167462 - DNA, 23 bp, Homo sapiens
agcaggcatctgtggcacaaggc

SEQ ID NO: 7167463 - DNA, 22 bp, Homo sapiens
agcaggcatttgatatatattt

SEQ ID NO: 7167464 - DNA, 23 bp, Homo sapiens
agcaggcatctgtggcacaaggc

SEQ ID NO: 7167465 - DNA, 22 bp, Homo sapiens
acacactggaggtaaatggggt

SEQ ID NO: 7167466 - DNA, 22 bp, Homo sapiens
agcacttatgtgattaggacag

SEQ ID NO: 7167467 - DNA, 22 bp, Homo sapiens
agcacttctcatgggatcaggt

SEQ ID NO: 7167468 - DNA, 21 bp, Homo sapiens
acacactgagttttccactgt

SEQ ID NO: 7167469 - DNA, 22 bp, Homo sapiens
acacactgagtgccataggacc

SEQ ID NO: 7167470 - DNA, 22 bp, Homo sapiens
acacactgagtgccataggacc

SEQ ID NO: 7167471 - DNA, 22 bp, Homo sapiens
acacactgctcatgaggagcat

SEQ ID NO: 7167472 - DNA, 22 bp, Homo sapiens
acacactgctcatgaggagcat

SEQ ID NO: 7167473 - DNA, 21 bp, Homo sapiens
acacactctgagtcttctatt

SEQ ID NO: 7167474 - DNA, 22 bp, Homo sapiens
acacactcaattgcataagcac

SEQ ID NO: 7167475 - DNA, 21 bp, Homo sapiens
acacactacacattcctagtt

SEQ ID NO: 7167476 - DNA, 22 bp, Homo sapiens
acacaccatgatttatttaccc

SEQ ID NO: 7167477 - DNA, 22 bp, Homo sapiens
acacaccatgatttatttaccc

SEQ ID NO: 7167478 - DNA, 22 bp, Homo sapiens
acacaccatgatttatttaccc

SEQ ID NO: 7167479 - DNA, 22 bp, Homo sapiens
agcacttgtcaggcagctctat

SEQ ID NO: 7167480 - DNA, 19 bp, Homo sapiens
agcacttgtggtcctccct

SEQ ID NO: 7167481 - DNA, 22 bp, Homo sapiens
agcactttaagcaacagatcaa

SEQ ID NO: 7167482 - DNA, 22 bp, Homo sapiens
agcactttattcaggaactcca

SEQ ID NO: 7167483 - DNA, 22 bp, Homo sapiens
agcactttcctggcaaatgtgg

SEQ ID NO: 7167484 - DNA, 22 bp, Homo sapiens
agcactttcctggcaaatgtgg

SEQ ID NO: 7167485 - DNA, 22 bp, Homo sapiens
agcactttgagcagatgaagga

SEQ ID NO: 7167486 - DNA, 22 bp, Homo sapiens
agcagaaaactttcatgctctg

SEQ ID NO: 7167487 - DNA, 22 bp, Homo sapiens
agcagaaaattggaaatgacaa

SEQ ID NO: 7167488 - DNA, 22 bp, Homo sapiens
agcagaaaattggaaatgacaa

SEQ ID NO: 7167489 - DNA, 22 bp, Homo sapiens
agcagaaaattggaaatgacaa

SEQ ID NO: 7167490 - DNA, 22 bp, Homo sapiens
agcagaaaattggaaatgacaa

SEQ ID NO: 7167491 - DNA, 22 bp, Homo sapiens
agcagaaaattggaaatgacaa

SEQ ID NO: 7167492 - DNA, 22 bp, Homo sapiens
agcagaaaattggaaatgacaa

SEQ ID NO: 7167493 - DNA, 22 bp, Homo sapiens
agcagaaaattggaaatgacaa

SEQ ID NO: 7167494 - DNA, 22 bp, Homo sapiens
agcagaaaattggaaatgacaa

SEQ ID NO: 7167495 - DNA, 22 bp, Homo sapiens
agcagaaacagccagtctggac

SEQ ID NO: 7167496 - DNA, 22 bp, Homo sapiens
agcagaaatagaagtcaatgat

SEQ ID NO: 7167497 - DNA, 22 bp, Homo sapiens
agcagaaatagaagtcaatgat

SEQ ID NO: 7167498 - DNA, 22 bp, Homo sapiens
agcagaaatgatggtatgggac

SEQ ID NO: 7167499 - DNA, 22 bp, Homo sapiens
acacacatggtattgttcagaa

SEQ ID NO: 7167500 - DNA, 22 bp, Homo sapiens
acacacatggtattgttcagaa

SEQ ID NO: 7167501 - DNA, 22 bp, Homo sapiens
acacacatggtattgttcagaa

SEQ ID NO: 7167502 - DNA, 22 bp, Homo sapiens
acacacatggtattgttcagaa

SEQ ID NO: 7167503 - DNA, 22 bp, Homo sapiens
acacacatggtattgttcagaa

SEQ ID NO: 7167504 - DNA, 22 bp, Homo sapiens
acacacagaaggaagccccact

SEQ ID NO: 7167505 - DNA, 22 bp, Homo sapiens
acacacagaaggaagccccact

SEQ ID NO: 7167506 - DNA, 22 bp, Homo sapiens
acacacagaaggaagccccact

SEQ ID NO: 7167507 - DNA, 22 bp, Homo sapiens
agattttatagataatttccca

SEQ ID NO: 7167508 - DNA, 22 bp, Homo sapiens
agattttagtttggggaggtgc

SEQ ID NO: 7167509 - DNA, 22 bp, Homo sapiens
agattttatagataatttccca

SEQ ID NO: 7167510 - DNA, 22 bp, Homo sapiens
acacacagaaggaagccccact

SEQ ID NO: 7167511 - DNA, 22 bp, Homo sapiens
acacacagaaggaagccccact

SEQ ID NO: 7167512 - DNA, 22 bp, Homo sapiens
agattttagtgtagaggacttg

SEQ ID NO: 7167513 - DNA, 21 bp, Homo sapiens
agatttgtcccttcccattta

SEQ ID NO: 7167514 - DNA, 22 bp, Homo sapiens
agatttgaaacttgcttcataa

SEQ ID NO: 7167515 - DNA, 22 bp, Homo sapiens
agatttgataaaagtagcagtt

SEQ ID NO: 7167516 - DNA, 22 bp, Homo sapiens
agatttgatatcatgcaacaaa

SEQ ID NO: 7167517 - DNA, 22 bp, Homo sapiens
agatttgggggctagggctggt

SEQ ID NO: 7167518 - DNA, 22 bp, Homo sapiens
agatttggtgtctggttgatat

SEQ ID NO: 7167519 - DNA, 22 bp, Homo sapiens
agcagcagctcagttctcagct

SEQ ID NO: 7167520 - DNA, 22 bp, Homo sapiens
agcagcagctcagttctcagct

SEQ ID NO: 7167521 - DNA, 22 bp, Homo sapiens
agcagcagctcagttctcagct

SEQ ID NO: 7167522 - DNA, 22 bp, Homo sapiens
agcagcagccgtagccttatta

SEQ ID NO: 7167523 - DNA, 21 bp, Homo sapiens
agcagcagcagtggggcttct

SEQ ID NO: 7167524 - DNA, 22 bp, Homo sapiens
agcagcagcattgagcgcttgt

SEQ ID NO: 7167525 - DNA, 22 bp, Homo sapiens
agcagcagcattgagcgcttgt

SEQ ID NO: 7167526 - DNA, 19 bp, Homo sapiens
agcagcagcaccagggatt

SEQ ID NO: 7167527 - DNA, 19 bp, Homo sapiens
agcagcagcaccagggatt

SEQ ID NO: 7167528 - DNA, 21 bp, Homo sapiens
agcagcagcagtggggcttct

SEQ ID NO: 7167529 - DNA, 21 bp, Homo sapiens
agcagcagcagtggggcttct

SEQ ID NO: 7167530 - DNA, 23 bp, Homo sapiens
agcagcagcaattaagtggatat

SEQ ID NO: 7167531 - DNA, 19 bp, Homo sapiens
agcagcagcaccagggatt

SEQ ID NO: 7167532 - DNA, 19 bp, Homo sapiens
agcagcagcaccagggatt

SEQ ID NO: 7167533 - DNA, 19 bp, Homo sapiens
agcagcagcaccagggatt

SEQ ID NO: 7167534 - DNA, 22 bp, Homo sapiens
agcagcaactgctagagtggca

SEQ ID NO: 7167535 - DNA, 22 bp, Homo sapiens
agcagcaactgctagagtggca

SEQ ID NO: 7167536 - DNA, 19 bp, Homo sapiens
agcagcaactgttgattca

SEQ ID NO: 7167537 - DNA, 22 bp, Homo sapiens
agcagaaccacagcactgttga

SEQ ID NO: 7167538 - DNA, 22 bp, Homo sapiens
agcagcagattatggtctacat

SEQ ID NO: 7167539 - DNA, 22 bp, Homo sapiens
agcagcagattatggtctacat

SEQ ID NO: 7167540 - DNA, 22 bp, Homo sapiens
agcagcagattatggtctacat

SEQ ID NO: 7167541 - DNA, 22 bp, Homo sapiens
agcagcagattcagcaggaatg

SEQ ID NO: 7167542 - DNA, 22 bp, Homo sapiens
agcagcagattcagcaggaatg

SEQ ID NO: 7167543 - DNA, 22 bp, Homo sapiens
agcagcagattcagcaggaatg

SEQ ID NO: 7167544 - DNA, 22 bp, Homo sapiens
agcagcagattcagcaggaatg

SEQ ID NO: 7167545 - DNA, 22 bp, Homo sapiens
agcagcagattcagcaggaatg

SEQ ID NO: 7167546 - DNA, 23 bp, Homo sapiens
agcagcagcaattaagtggatat

SEQ ID NO: 7167547 - DNA, 22 bp, Homo sapiens
acacactgtaaggactatcact

SEQ ID NO: 7167548 - DNA, 22 bp, Homo sapiens
acacactgggcatggtttatgc

SEQ ID NO: 7167549 - DNA, 22 bp, Homo sapiens
acacactggcccccagtactga

SEQ ID NO: 7167550 - DNA, 22 bp, Homo sapiens
agcagcagctcattcttcctgt

SEQ ID NO: 7167551 - DNA, 22 bp, Homo sapiens
agcagcagctcattcttcctgt

SEQ ID NO: 7167552 - DNA, 22 bp, Homo sapiens
agcagcagctctgttgccctac

SEQ ID NO: 7167553 - DNA, 22 bp, Homo sapiens
acacactggcaggagctataaa

SEQ ID NO: 7167554 - DNA, 22 bp, Homo sapiens
agcagccaggaatctgcagagc

SEQ ID NO: 7167555 - DNA, 22 bp, Homo sapiens
agcagccaggaatctgcagagc

SEQ ID NO: 7167556 - DNA, 22 bp, Homo sapiens
agcagccaggaatctgcagagc

SEQ ID NO: 7167557 - DNA, 22 bp, Homo sapiens
agcagccaggaatctgcagagc

SEQ ID NO: 7167558 - DNA, 22 bp, Homo sapiens
agcagccagagtctgaacatta

SEQ ID NO: 7167559 - DNA, 22 bp, Homo sapiens
agcagcatagaagctgggagga

SEQ ID NO: 7167560 - DNA, 22 bp, Homo sapiens
acacagaacctcatagcctctc

SEQ ID NO: 7167561 - DNA, 23 bp, Homo sapiens
acacagaagaagacccaaggaag

SEQ ID NO: 7167562 - DNA, 23 bp, Homo sapiens
acacagaagaagacccaaggaag

SEQ ID NO: 7167563 - DNA, 22 bp, Homo sapiens
agcagcagttgctgacgttcta

SEQ ID NO: 7167564 - DNA, 22 bp, Homo sapiens
agcagcagttgctgacgttcta

SEQ ID NO: 7167565 - DNA, 22 bp, Homo sapiens
agcagcatacacatcatgttga

SEQ ID NO: 7167566 - DNA, 22 bp, Homo sapiens
agcagcatacacatcatgttga

SEQ ID NO: 7167567 - DNA, 22 bp, Homo sapiens
agcagcatagaagctgggagga

SEQ ID NO: 7167568 - DNA, 22 bp, Homo sapiens
agccctggggctggtcttggaa

SEQ ID NO: 7167569 - DNA, 22 bp, Homo sapiens
agccctggggctggtcttggaa

SEQ ID NO: 7167570 - DNA, 22 bp, Homo sapiens
agccctggggctggtcttggaa

SEQ ID NO: 7167571 - DNA, 22 bp, Homo sapiens
agccctgcgatcgtgatttctt

SEQ ID NO: 7167572 - DNA, 22 bp, Homo sapiens
agccctgcgctcacgttctgca

SEQ ID NO: 7167573 - DNA, 22 bp, Homo sapiens
agccctgcgtgccaggggactg

SEQ ID NO: 7167574 - DNA, 22 bp, Homo sapiens
agccctggggctggtcttggaa

SEQ ID NO: 7167575 - DNA, 22 bp, Homo sapiens
agccctgcatagaagggaacac

SEQ ID NO: 7167576 - DNA, 22 bp, Homo sapiens
agccctgccattctctggagct

SEQ ID NO: 7167577 - DNA, 22 bp, Homo sapiens
agccctgccattctctggagct

SEQ ID NO: 7167578 - DNA, 22 bp, Homo sapiens
agccctgccctgccatgtggca

SEQ ID NO: 7167579 - DNA, 22 bp, Homo sapiens
agccctgccctgccatgtggca

SEQ ID NO: 7167580 - DNA, 16 bp, Homo sapiens
agccctgccgtgtact

SEQ ID NO: 7167581 - DNA, 22 bp, Homo sapiens
agccctgcctctccaatgccca

SEQ ID NO: 7167582 - DNA, 22 bp, Homo sapiens
agccctgcctctccaatgccca

SEQ ID NO: 7167583 - DNA, 22 bp, Homo sapiens
agccctgcctctccaatgccca

SEQ ID NO: 7167584 - DNA, 22 bp, Homo sapiens
agccctgcaggaggtgggagag

SEQ ID NO: 7167585 - DNA, 22 bp, Homo sapiens
agccctgcaggatgagggaggt

SEQ ID NO: 7167586 - DNA, 22 bp, Homo sapiens
agccctgcaggatgagggaggt

SEQ ID NO: 7167587 - DNA, 22 bp, Homo sapiens
agccctgcataaatcagttggt

SEQ ID NO: 7167588 - DNA, 22 bp, Homo sapiens
agccctgcataaatcagttggt

SEQ ID NO: 7167589 - DNA, 22 bp, Homo sapiens
agccctgcacaggtctgtggct

SEQ ID NO: 7167590 - DNA, 22 bp, Homo sapiens
agccctgcacagttcgggagga

SEQ ID NO: 7167591 - DNA, 22 bp, Homo sapiens
agcccctgtttttccagtcaga

SEQ ID NO: 7167592 - DNA, 22 bp, Homo sapiens
agcccctgtttttccagtcaga

SEQ ID NO: 7167593 - DNA, 22 bp, Homo sapiens
agcccctgtcctctctgatgac

SEQ ID NO: 7167594 - DNA, 22 bp, Homo sapiens
agcccctgtcctctctgatgac

SEQ ID NO: 7167595 - DNA, 22 bp, Homo sapiens
acagacatggaccaagcactgt

SEQ ID NO: 7167596 - DNA, 22 bp, Homo sapiens
agcctggcggtcgtcggtcagg

SEQ ID NO: 7167597 - DNA, 22 bp, Homo sapiens
agcctggcggtcgtcggtcagg

SEQ ID NO: 7167598 - DNA, 22 bp, Homo sapiens
agcctggcctgggcaggcacat

SEQ ID NO: 7167599 - DNA, 22 bp, Homo sapiens
agcctggcctgggcaggcacat

SEQ ID NO: 7167600 - DNA, 22 bp, Homo sapiens
agcctggcctgggcaggcacat

SEQ ID NO: 7167601 - DNA, 21 bp, Homo sapiens
agcctggcccagggggaggct

SEQ ID NO: 7167602 - DNA, 21 bp, Homo sapiens
agcctggcccagggggaggct

SEQ ID NO: 7167603 - DNA, 21 bp, Homo sapiens
agcctggcccagggggaggct

SEQ ID NO: 7167604 - DNA, 22 bp, Homo sapiens
agcctggccctgctgaactctg

SEQ ID NO: 7167605 - DNA, 22 bp, Homo sapiens
agcctggccctgctgaactctg

SEQ ID NO: 7167606 - DNA, 22 bp, Homo sapiens
agcctgcttccctttgtgcccc

SEQ ID NO: 7167607 - DNA, 22 bp, Homo sapiens
agcctggccactcagggcctga

SEQ ID NO: 7167608 - DNA, 22 bp, Homo sapiens
agcctggccaggcctgcccagg

SEQ ID NO: 7167609 - DNA, 22 bp, Homo sapiens
agcctggccaggcctgcccagg

SEQ ID NO: 7167610 - DNA, 21 bp, Homo sapiens
agcctggcccagggggaggct

SEQ ID NO: 7167611 - DNA, 22 bp, Homo sapiens
agcctgctgggaagggaggctt

SEQ ID NO: 7167612 - DNA, 22 bp, Homo sapiens
agcctgctgggaagggaggctt

SEQ ID NO: 7167613 - DNA, 22 bp, Homo sapiens
agcctgctgggaagggaggctt

SEQ ID NO: 7167614 - DNA, 22 bp, Homo sapiens
agccctggggtgcagaaccatg

SEQ ID NO: 7167615 - DNA, 22 bp, Homo sapiens
agccctggggctggtgcttacc

SEQ ID NO: 7167616 - DNA, 22 bp, Homo sapiens
agccctggggtgcagaaccatg

SEQ ID NO: 7167617 - DNA, 22 bp, Homo sapiens
agccctgggtcccagtcctggc

SEQ ID NO: 7167618 - DNA, 22 bp, Homo sapiens
agccctgggtcccagtcctggc

SEQ ID NO: 7167619 - DNA, 22 bp, Homo sapiens
agccctgggtcccagtcctggc

SEQ ID NO: 7167620 - DNA, 22 bp, Homo sapiens
agccctgggttagggtgggagc

SEQ ID NO: 7167621 - DNA, 22 bp, Homo sapiens
agccctgggttagggtgggagc

SEQ ID NO: 7167622 - DNA, 22 bp, Homo sapiens
agccctgggttagggtgggagc

SEQ ID NO: 7167623 - DNA, 22 bp, Homo sapiens
agccctgggttagggtgggagc

SEQ ID NO: 7167624 - DNA, 20 bp, Homo sapiens
agccctgtaaatcccctgga

SEQ ID NO: 7167625 - DNA, 22 bp, Homo sapiens
agccctggtttgcagcatttgc

SEQ ID NO: 7167626 - DNA, 17 bp, Homo sapiens
agccctgtgctcttttt

SEQ ID NO: 7167627 - DNA, 22 bp, Homo sapiens
agccctgtagatttaggagagt

SEQ ID NO: 7167628 - DNA, 22 bp, Homo sapiens
agccctgtagatttaggagagt

SEQ ID NO: 7167629 - DNA, 22 bp, Homo sapiens
agccctggtagcctgctgccat

SEQ ID NO: 7167630 - DNA, 22 bp, Homo sapiens
agccctggtagcctgctgccat

SEQ ID NO: 7167631 - DNA, 22 bp, Homo sapiens
agccctggtagcctgctgccat

SEQ ID NO: 7167632 - DNA, 22 bp, Homo sapiens
agccctggtagcctgctgccat

SEQ ID NO: 7167633 - DNA, 22 bp, Homo sapiens
agccctggtagcctgctgccat

SEQ ID NO: 7167634 - DNA, 22 bp, Homo sapiens
agccctggtagcctgctgccat

SEQ ID NO: 7167635 - DNA, 22 bp, Homo sapiens
agccttaaatgctagattcata

SEQ ID NO: 7167636 - DNA, 21 bp, Homo sapiens
agcctgttggtttactgctca

SEQ ID NO: 7167637 - DNA, 22 bp, Homo sapiens
agccttagagacttaaaacagg

SEQ ID NO: 7167638 - DNA, 22 bp, Homo sapiens
agcctgtgttgctctggcgata

SEQ ID NO: 7167639 - DNA, 22 bp, Homo sapiens
agcctgtgttgctctggcgata

SEQ ID NO: 7167640 - DNA, 22 bp, Homo sapiens
agcctgtgttttttctattgca

SEQ ID NO: 7167641 - DNA, 22 bp, Homo sapiens
agcctgtggatccctgcactgg

SEQ ID NO: 7167642 - DNA, 22 bp, Homo sapiens
agcctgtgggagccgctcccgt

SEQ ID NO: 7167643 - DNA, 22 bp, Homo sapiens
agcctgtgggagccgctcccgt

SEQ ID NO: 7167644 - DNA, 22 bp, Homo sapiens
agcctgtgagggatgctgcagt

SEQ ID NO: 7167645 - DNA, 22 bp, Homo sapiens
agcctgtgctgtgtttgctcca

SEQ ID NO: 7167646 - DNA, 22 bp, Homo sapiens
agcctgtggaaactgggtgcag

SEQ ID NO: 7167647 - DNA, 22 bp, Homo sapiens
agcctgtggaaactgggtgcag

SEQ ID NO: 7167648 - DNA, 22 bp, Homo sapiens
agcctgtggaaactgggtgcag

SEQ ID NO: 7167649 - DNA, 22 bp, Homo sapiens
agcctgtggatccctgcactgg

SEQ ID NO: 7167650 - DNA, 22 bp, Homo sapiens
agcctgtggatccctgcactgg

SEQ ID NO: 7167651 - DNA, 20 bp, Homo sapiens
agcctgtgtacttgcctgtg

SEQ ID NO: 7167652 - DNA, 20 bp, Homo sapiens
agcctgtgtacttgcctgtg

SEQ ID NO: 7167653 - DNA, 22 bp, Homo sapiens
agcctgtgtcctcatctgcagc

SEQ ID NO: 7167654 - DNA, 22 bp, Homo sapiens
agcctgtgtcctcatctgcagc

SEQ ID NO: 7167655 - DNA, 22 bp, Homo sapiens
agcctgtgtcctcatctgcagc

SEQ ID NO: 7167656 - DNA, 22 bp, Homo sapiens
agcctgtgtcctcatctgcagc

SEQ ID NO: 7167657 - DNA, 22 bp, Homo sapiens
agcctgtgtgaagccctcagag

SEQ ID NO: 7167658 - DNA, 22 bp, Homo sapiens
agcctgtgtgaagccctcagag

SEQ ID NO: 7167659 - DNA, 22 bp, Homo sapiens
agcctgtgtgaagccctcagag

SEQ ID NO: 7167660 - DNA, 22 bp, Homo sapiens
agcctgtgtgctttggacaggg

SEQ ID NO: 7167661 - DNA, 22 bp, Homo sapiens
agcctgtgtgctttggacaggg

SEQ ID NO: 7167662 - DNA, 22 bp, Homo sapiens
agcctgtgtgctttggacaggg

SEQ ID NO: 7167663 - DNA, 22 bp, Homo sapiens
agcctggcggtcgtcggtcagg

SEQ ID NO: 7167664 - DNA, 22 bp, Homo sapiens
agcctggctaaattctcccatg

SEQ ID NO: 7167665 - DNA, 22 bp, Homo sapiens
agcctggctaaattctcccatg

SEQ ID NO: 7167666 - DNA, 22 bp, Homo sapiens
agcctggctaaattctcccatg

SEQ ID NO: 7167667 - DNA, 22 bp, Homo sapiens
agcctggctgggaagagcctct

SEQ ID NO: 7167668 - DNA, 22 bp, Homo sapiens
agcctggctgggaagagcctct

SEQ ID NO: 7167669 - DNA, 22 bp, Homo sapiens
agcctggctgggaagagcctct

SEQ ID NO: 7167670 - DNA, 22 bp, Homo sapiens
agcctggctgtaacctcatggt

SEQ ID NO: 7167671 - DNA, 22 bp, Homo sapiens
agcctggctgtaacctcatggt

SEQ ID NO: 7167672 - DNA, 22 bp, Homo sapiens
agcctggctgtaacctcatggt

SEQ ID NO: 7167673 - DNA, 22 bp, Homo sapiens
agcctggctgtaacctcatggt

SEQ ID NO: 7167674 - DNA, 22 bp, Homo sapiens
agcctggcttaatcctcctttt

SEQ ID NO: 7167675 - DNA, 22 bp, Homo sapiens
agcctggcttaatcctcctttt

SEQ ID NO: 7167676 - DNA, 22 bp, Homo sapiens
agcctgtctgtctccaaagctg

SEQ ID NO: 7167677 - DNA, 22 bp, Homo sapiens
agcctgtgaaatctctgccact

SEQ ID NO: 7167678 - DNA, 22 bp, Homo sapiens
agcctgtgaaatctctgccact

SEQ ID NO: 7167679 - DNA, 22 bp, Homo sapiens
agcctgtgaaatctctgccact

SEQ ID NO: 7167680 - DNA, 22 bp, Homo sapiens
agcctgtgaaatctctgccact

SEQ ID NO: 7167681 - DNA, 22 bp, Homo sapiens
agcctgtgacattgactatgaa

SEQ ID NO: 7167682 - DNA, 22 bp, Homo sapiens
agcctgtgacattgactatgaa

SEQ ID NO: 7167683 - DNA, 22 bp, Homo sapiens
agcctgtgactctgtgaaacca

SEQ ID NO: 7167684 - DNA, 22 bp, Homo sapiens
agcctgtgactctgtgaaacca

SEQ ID NO: 7167685 - DNA, 22 bp, Homo sapiens
agcctgtgagggatgctgcagt

SEQ ID NO: 7167686 - DNA, 22 bp, Homo sapiens
agcctgtgagggatgctgcagt

SEQ ID NO: 7167687 - DNA, 22 bp, Homo sapiens
agcctgtgctgtgtttgctcca

SEQ ID NO: 7167688 - DNA, 22 bp, Homo sapiens
agctcaggtcattccagggatg

SEQ ID NO: 7167689 - DNA, 22 bp, Homo sapiens
agctcaggtcattccagggatg

SEQ ID NO: 7167690 - DNA, 22 bp, Homo sapiens
agctcaggtagactcagcatct

SEQ ID NO: 7167691 - DNA, 22 bp, Homo sapiens
agctcaggtagactcagcatct

SEQ ID NO: 7167692 - DNA, 22 bp, Homo sapiens
agctcaggtagactcagcatct

SEQ ID NO: 7167693 - DNA, 22 bp, Homo sapiens
agctcaggtagactcagcatct

SEQ ID NO: 7167694 - DNA, 22 bp, Homo sapiens
agctcaggtcattccagggatg

SEQ ID NO: 7167695 - DNA, 22 bp, Homo sapiens
agctcaggtctcaggaggtgtc

SEQ ID NO: 7167696 - DNA, 22 bp, Homo sapiens
agctcaggtctcaggaggtgtc

SEQ ID NO: 7167697 - DNA, 22 bp, Homo sapiens
agctcaggtctcaggaggtgtc

SEQ ID NO: 7167698 - DNA, 22 bp, Homo sapiens
agctcaggtctcaggaggtgtc

SEQ ID NO: 7167699 - DNA, 22 bp, Homo sapiens
agctcatggtgctatctcaggg

SEQ ID NO: 7167700 - DNA, 22 bp, Homo sapiens
agctcatggtgctatctcaggg

SEQ ID NO: 7167701 - DNA, 22 bp, Homo sapiens
agctcattgaagtcatgacctg

SEQ ID NO: 7167702 - DNA, 22 bp, Homo sapiens
agctcattgcaacctccgcctc

SEQ ID NO: 7167703 - DNA, 23 bp, Homo sapiens
agctccagggaacaggcagtagg

SEQ ID NO: 7167704 - DNA, 22 bp, Homo sapiens
agctccaggtagtgccttatcg

SEQ ID NO: 7167705 - DNA, 22 bp, Homo sapiens
agctccaggtcagtgcacccct

SEQ ID NO: 7167706 - DNA, 22 bp, Homo sapiens
agctccaggtcagtgcacccct

SEQ ID NO: 7167707 - DNA, 22 bp, Homo sapiens
agctccaggtcagtgcacccct

SEQ ID NO: 7167708 - DNA, 22 bp, Homo sapiens
agctccaggtcagtgcacccct

SEQ ID NO: 7167709 - DNA, 22 bp, Homo sapiens
agctcagggcaaagactcaaat

SEQ ID NO: 7167710 - DNA, 22 bp, Homo sapiens
agctcaggctctgcagggacta

SEQ ID NO: 7167711 - DNA, 22 bp, Homo sapiens
agctcagggcaaagactcaaat

SEQ ID NO: 7167712 - DNA, 22 bp, Homo sapiens
agctcagggccatcggcccttt

SEQ ID NO: 7167713 - DNA, 22 bp, Homo sapiens
agctcagggccatcggcccttt

SEQ ID NO: 7167714 - DNA, 22 bp, Homo sapiens
agctcagggcgatctgtctcgg

SEQ ID NO: 7167715 - DNA, 22 bp, Homo sapiens
agctcagggcgatctgtctcgg

SEQ ID NO: 7167716 - DNA, 22 bp, Homo sapiens
agctcagggcgatctgtctcgg

SEQ ID NO: 7167717 - DNA, 22 bp, Homo sapiens
agctcagggctccaggaccgct

SEQ ID NO: 7167718 - DNA, 22 bp, Homo sapiens
agctcaagtatttgggatttgt

SEQ ID NO: 7167719 - DNA, 22 bp, Homo sapiens
agctcaagtgcaagcattctat

SEQ ID NO: 7167720 - DNA, 22 bp, Homo sapiens
agctcaagtgcagttgggggat

SEQ ID NO: 7167721 - DNA, 22 bp, Homo sapiens
agctcaagctacacacagagtc

SEQ ID NO: 7167722 - DNA, 22 bp, Homo sapiens
agctcaagctacacacagagtc

SEQ ID NO: 7167723 - DNA, 22 bp, Homo sapiens
agctcaagctacacacagagtc

SEQ ID NO: 7167724 - DNA, 23 bp, Homo sapiens
agctcaaggcagtccacatttcc

SEQ ID NO: 7167725 - DNA, 22 bp, Homo sapiens
agctcaagttcttttaccatat

SEQ ID NO: 7167726 - DNA, 22 bp, Homo sapiens
agctcaggccggagctacaggc

SEQ ID NO: 7167727 - DNA, 22 bp, Homo sapiens
agctcaggccggagctacaggc

SEQ ID NO: 7167728 - DNA, 22 bp, Homo sapiens
agctcaggctctgcagggacta

SEQ ID NO: 7167729 - DNA, 22 bp, Homo sapiens
agctcaggctctgcagggacta

SEQ ID NO: 7167730 - DNA, 22 bp, Homo sapiens
agctcaggctctgcagggacta

SEQ ID NO: 7167731 - DNA, 22 bp, Homo sapiens
agcatcctgcctctcctcccaa

SEQ ID NO: 7167732 - DNA, 22 bp, Homo sapiens
agcatcctccttcccagagatg

SEQ ID NO: 7167733 - DNA, 22 bp, Homo sapiens
agcatcccatgactctggagga

SEQ ID NO: 7167734 - DNA, 22 bp, Homo sapiens
agcatccatccaggaaaattga

SEQ ID NO: 7167735 - DNA, 22 bp, Homo sapiens
agcatcctgcttgctgtctgtg

SEQ ID NO: 7167736 - DNA, 22 bp, Homo sapiens
agcatctaaactatcagtttga

SEQ ID NO: 7167737 - DNA, 22 bp, Homo sapiens
agcatctaacagatgggagatg

SEQ ID NO: 7167738 - DNA, 22 bp, Homo sapiens
agcatctctccattcctccttt

SEQ ID NO: 7167739 - DNA, 21 bp, Homo sapiens
agcatctgaggcagtttccta

SEQ ID NO: 7167740 - DNA, 22 bp, Homo sapiens
agcatctctgggagtcatccgt

SEQ ID NO: 7167741 - DNA, 21 bp, Homo sapiens
agcatctgaggcagtttccta

SEQ ID NO: 7167742 - DNA, 22 bp, Homo sapiens
agcatctgcataatgccttccc

SEQ ID NO: 7167743 - DNA, 22 bp, Homo sapiens
agcatctgcatattgggagacc

SEQ ID NO: 7167744 - DNA, 22 bp, Homo sapiens
agcatctgcatattgggagacc

SEQ ID NO: 7167745 - DNA, 22 bp, Homo sapiens
agcatctgcatattgggagacc

SEQ ID NO: 7167746 - DNA, 22 bp, Homo sapiens
agcatctgttaagtgccttcaa

SEQ ID NO: 7167747 - DNA, 22 bp, Homo sapiens
agcatctgttgaatataatatt

SEQ ID NO: 7167748 - DNA, 22 bp, Homo sapiens
agcatctggtgagggcctagtt

SEQ ID NO: 7167749 - DNA, 22 bp, Homo sapiens
agcatctgtgatattttgttat

SEQ ID NO: 7167750 - DNA, 22 bp, Homo sapiens
agcatctgcttaatggcttaac

SEQ ID NO: 7167751 - DNA, 22 bp, Homo sapiens
agcatctggatggaaagcaagg

SEQ ID NO: 7167752 - DNA, 22 bp, Homo sapiens
agcatctggcagaaagtcagaa

SEQ ID NO: 7167753 - DNA, 22 bp, Homo sapiens
agcatctggcctggttactttt

SEQ ID NO: 7167754 - DNA, 22 bp, Homo sapiens
agcattcattgctagaatgtaa

SEQ ID NO: 7167755 - DNA, 22 bp, Homo sapiens
agcattccacactgaagtctgc

SEQ ID NO: 7167756 - DNA, 22 bp, Homo sapiens
agcattccacactgaagtctgc

SEQ ID NO: 7167757 - DNA, 22 bp, Homo sapiens
agcatgaaagcataggacagtc

SEQ ID NO: 7167758 - DNA, 22 bp, Homo sapiens
agcatgaaaacatgaaacagca

SEQ ID NO: 7167759 - DNA, 22 bp, Homo sapiens
agcattccacactgaagtctgc

SEQ ID NO: 7167760 - DNA, 22 bp, Homo sapiens
agcattccacactgaagtctgc

SEQ ID NO: 7167761 - DNA, 20 bp, Homo sapiens
agcattctactagacttttc

SEQ ID NO: 7167762 - DNA, 20 bp, Homo sapiens
agcattctactagacttttc

SEQ ID NO: 7167763 - DNA, 22 bp, Homo sapiens
agcattctgtggtcttctatgg

SEQ ID NO: 7167764 - DNA, 22 bp, Homo sapiens
agcattctgtggtcttctatgg

SEQ ID NO: 7167765 - DNA, 22 bp, Homo sapiens
agccaggcggggcaggtttcct

SEQ ID NO: 7167766 - DNA, 22 bp, Homo sapiens
agccaggcggggcaggtttcct

SEQ ID NO: 7167767 - DNA, 22 bp, Homo sapiens
agccaggcgcagtggcttatgc

SEQ ID NO: 7167768 - DNA, 22 bp, Homo sapiens
agccaggcgcagtggcttatgc

SEQ ID NO: 7167769 - DNA, 22 bp, Homo sapiens
agccaggcgcagtggcttatgc

SEQ ID NO: 7167770 - DNA, 22 bp, Homo sapiens
agccaggcgcagtggcttatgc

SEQ ID NO: 7167771 - DNA, 22 bp, Homo sapiens
agccaggacagggcagctcgct

SEQ ID NO: 7167772 - DNA, 22 bp, Homo sapiens
agccaggacagggcagctcgct

SEQ ID NO: 7167773 - DNA, 22 bp, Homo sapiens
agccaggaatgcatgctctgct

SEQ ID NO: 7167774 - DNA, 22 bp, Homo sapiens
agcattgcctgcctattgctaa

SEQ ID NO: 7167775 - DNA, 22 bp, Homo sapiens
agcattggtggccagagtgcct

SEQ ID NO: 7167776 - DNA, 22 bp, Homo sapiens
agcattggtggccagagtgcct

SEQ ID NO: 7167777 - DNA, 22 bp, Homo sapiens
agcatttaagcttctgcaaagc

SEQ ID NO: 7167778 - DNA, 22 bp, Homo sapiens
agcatttaatcctacatagatc

SEQ ID NO: 7167779 - DNA, 22 bp, Homo sapiens
agcatttaatcctacatagatc

SEQ ID NO: 7167780 - DNA, 22 bp, Homo sapiens
agccaggctactccttgctgac

SEQ ID NO: 7167781 - DNA, 22 bp, Homo sapiens
agccaggctactccttgctgac

SEQ ID NO: 7167782 - DNA, 22 bp, Homo sapiens
agccaggctactccttgctgac

SEQ ID NO: 7167783 - DNA, 22 bp, Homo sapiens
agccaggctaaatgagccatga

SEQ ID NO: 7167784 - DNA, 22 bp, Homo sapiens
agccaggctaaatgagccatga

SEQ ID NO: 7167785 - DNA, 22 bp, Homo sapiens
agccaggctaaatgagccatga

SEQ ID NO: 7167786 - DNA, 22 bp, Homo sapiens
agccaggctaaatgagccatga

SEQ ID NO: 7167787 - DNA, 22 bp, Homo sapiens
agccaggctaaatgagccatga

SEQ ID NO: 7167788 - DNA, 22 bp, Homo sapiens
agccaggctaaatgagccatga

SEQ ID NO: 7167789 - DNA, 22 bp, Homo sapiens
agccaggcgggtctttgctcct

SEQ ID NO: 7167790 - DNA, 22 bp, Homo sapiens
agccaggctaaatgagccatga

SEQ ID NO: 7167791 - DNA, 22 bp, Homo sapiens
agccaggcgggtctttgctcct

SEQ ID NO: 7167792 - DNA, 22 bp, Homo sapiens
agccaggcgggtctttgctcct

SEQ ID NO: 7167793 - DNA, 22 bp, Homo sapiens
agccaggcggggcaggtttcct

SEQ ID NO: 7167794 - DNA, 22 bp, Homo sapiens
agccaggcgggtctttgctcct

SEQ ID NO: 7167795 - DNA, 20 bp, Homo sapiens
agccaggctcaagctccccc

SEQ ID NO: 7167796 - DNA, 22 bp, Homo sapiens
agccaggctactccttgctgac

SEQ ID NO: 7167797 - DNA, 20 bp, Homo sapiens
agccaggctcaagctccccc

SEQ ID NO: 7167798 - DNA, 20 bp, Homo sapiens
agccaggctcaagctccccc

SEQ ID NO: 7167799 - DNA, 20 bp, Homo sapiens
agccaggctcaagctccccc

SEQ ID NO: 7167800 - DNA, 22 bp, Homo sapiens
agccaggctactccttgctgac

SEQ ID NO: 7167801 - DNA, 22 bp, Homo sapiens
agccaggctcaaggcctgctcc

SEQ ID NO: 7167802 - DNA, 20 bp, Homo sapiens
agccaggctcaagctccccc

SEQ ID NO: 7167803 - DNA, 22 bp, Homo sapiens
agccaggctcaaggcctgctcc

SEQ ID NO: 7167804 - DNA, 22 bp, Homo sapiens
agccaggctcaaggcctgctcc

SEQ ID NO: 7167805 - DNA, 20 bp, Homo sapiens
agccaggctcaagctccccc

SEQ ID NO: 7167806 - DNA, 22 bp, Homo sapiens
agccaggctcaaggcctgctcc

SEQ ID NO: 7167807 - DNA, 22 bp, Homo sapiens
acagaacaagacctgcttattg

SEQ ID NO: 7167808 - DNA, 18 bp, Homo sapiens
acagaactgagatttgag

SEQ ID NO: 7167809 - DNA, 22 bp, Homo sapiens
acagaactgcaggaggaaaagc

SEQ ID NO: 7167810 - DNA, 22 bp, Homo sapiens
acagaactgggaaatgcacata

SEQ ID NO: 7167811 - DNA, 22 bp, Homo sapiens
acagaacatggatttttgaagt

SEQ ID NO: 7167812 - DNA, 22 bp, Homo sapiens
acagaacatggatttttgaagt

SEQ ID NO: 7167813 - DNA, 18 bp, Homo sapiens
acagaactcaggggcacc

SEQ ID NO: 7167814 - DNA, 20 bp, Homo sapiens
acagaactgagaacagtctc

SEQ ID NO: 7167815 - DNA, 22 bp, Homo sapiens
acagaactgagaattctctatc

SEQ ID NO: 7167816 - DNA, 18 bp, Homo sapiens
acagaactgagatttgag

SEQ ID NO: 7167817 - DNA, 18 bp, Homo sapiens
acagaactgagatttgag

SEQ ID NO: 7167818 - DNA, 22 bp, Homo sapiens
acagaacatattgcttctctca

SEQ ID NO: 7167819 - DNA, 22 bp, Homo sapiens
acagaacaggctgagaaaaaca

SEQ ID NO: 7167820 - DNA, 22 bp, Homo sapiens
acagaacaggctgagaaaaaca

SEQ ID NO: 7167821 - DNA, 22 bp, Homo sapiens
acagaacaggctgagaaaaaca

SEQ ID NO: 7167822 - DNA, 22 bp, Homo sapiens
acagaacatattgcttctctca

SEQ ID NO: 7167823 - DNA, 22 bp, Homo sapiens
acagaacagagggttttagaat

SEQ ID NO: 7167824 - DNA, 22 bp, Homo sapiens
acagaacaggctgagaaaaaca

SEQ ID NO: 7167825 - DNA, 22 bp, Homo sapiens
acagaacaggctgagaaaaaca

SEQ ID NO: 7167826 - DNA, 22 bp, Homo sapiens
acagaacaggctgagaaaaaca

SEQ ID NO: 7167827 - DNA, 22 bp, Homo sapiens
acagaacaggctgagaaaaaca

SEQ ID NO: 7167828 - DNA, 22 bp, Homo sapiens
agcccaggtctcaaagtacagg

SEQ ID NO: 7167829 - DNA, 22 bp, Homo sapiens
agcccaggtccagttcactgca

SEQ ID NO: 7167830 - DNA, 22 bp, Homo sapiens
agcccaggtccagttcactgca

SEQ ID NO: 7167831 - DNA, 22 bp, Homo sapiens
agcccaggtccagttcactgca

SEQ ID NO: 7167832 - DNA, 22 bp, Homo sapiens
agcccagctttgaaccatatca

SEQ ID NO: 7167833 - DNA, 22 bp, Homo sapiens
agcccagggctaataggaacca

SEQ ID NO: 7167834 - DNA, 22 bp, Homo sapiens
agcccagggctaataggaacca

SEQ ID NO: 7167835 - DNA, 22 bp, Homo sapiens
agcccagggctaataggaacca

SEQ ID NO: 7167836 - DNA, 22 bp, Homo sapiens
acagaactgtgatctcataaat

SEQ ID NO: 7167837 - DNA, 22 bp, Homo sapiens
acagaactgtgtgatgattaag

SEQ ID NO: 7167838 - DNA, 22 bp, Homo sapiens
acagaacttcagtagtattccc

SEQ ID NO: 7167839 - DNA, 22 bp, Homo sapiens
agcccagctttcacccctctgg

SEQ ID NO: 7167840 - DNA, 22 bp, Homo sapiens
agcccagctttgaaccatatca

SEQ ID NO: 7167841 - DNA, 22 bp, Homo sapiens
acagaactgggggcacagatag

SEQ ID NO: 7167842 - DNA, 21 bp, Homo sapiens
acagaactgtatagtgataaa

SEQ ID NO: 7167843 - DNA, 21 bp, Homo sapiens
acagaactgtatagtgataaa

SEQ ID NO: 7167844 - DNA, 21 bp, Homo sapiens
acagaactgtatagtgataaa

SEQ ID NO: 7167845 - DNA, 22 bp, Homo sapiens
acagacatcatcaacatcttcc

SEQ ID NO: 7167846 - DNA, 22 bp, Homo sapiens
acagacatcatcaacatcttcc

SEQ ID NO: 7167847 - DNA, 22 bp, Homo sapiens
acagacatctatccatttaatt

SEQ ID NO: 7167848 - DNA, 22 bp, Homo sapiens
acagacatctatccatttaatt

SEQ ID NO: 7167849 - DNA, 22 bp, Homo sapiens
acagacatgctgtttgggtggt

SEQ ID NO: 7167850 - DNA, 22 bp, Homo sapiens
acagacagtatggtggggctga

SEQ ID NO: 7167851 - DNA, 21 bp, Homo sapiens
acagacagtccagagaaaaga

SEQ ID NO: 7167852 - DNA, 21 bp, Homo sapiens
acagacagtccagagaaaaga

SEQ ID NO: 7167853 - DNA, 22 bp, Homo sapiens
acagacagtatggtggggctga

SEQ ID NO: 7167854 - DNA, 21 bp, Homo sapiens
acagacagtccagagaaaaga

SEQ ID NO: 7167855 - DNA, 21 bp, Homo sapiens
acagacagtccagagaaaaga

SEQ ID NO: 7167856 - DNA, 21 bp, Homo sapiens
acagacagtccagagaaaaga

SEQ ID NO: 7167857 - DNA, 22 bp, Homo sapiens
acagacatatttggcccatagc

SEQ ID NO: 7167858 - DNA, 22 bp, Homo sapiens
acagacatatttggcccatagc

SEQ ID NO: 7167859 - DNA, 22 bp, Homo sapiens
acagacagggcacctgcctcct

SEQ ID NO: 7167860 - DNA, 21 bp, Homo sapiens
acagacagggccagtgtcccc

SEQ ID NO: 7167861 - DNA, 21 bp, Homo sapiens
acagacagggccagtgtcccc

SEQ ID NO: 7167862 - DNA, 21 bp, Homo sapiens
acagacagggccagtgtcccc

SEQ ID NO: 7167863 - DNA, 21 bp, Homo sapiens
acagacagggccagtgtcccc

SEQ ID NO: 7167864 - DNA, 22 bp, Homo sapiens
acagacagtaaatagtgtggct

SEQ ID NO: 7167865 - DNA, 22 bp, Homo sapiens
acagacagtaaatagtgtggct

SEQ ID NO: 7167866 - DNA, 22 bp, Homo sapiens
acagacagtaaatagtgtggct

SEQ ID NO: 7167867 - DNA, 22 bp, Homo sapiens
acagacagtatggtggggctga

SEQ ID NO: 7167868 - DNA, 22 bp, Homo sapiens
acagacagtatggtggggctga

SEQ ID NO: 7167869 - DNA, 22 bp, Homo sapiens
acagacagtaaatagtgtggct

SEQ ID NO: 7167870 - DNA, 22 bp, Homo sapiens
acagacagtatggtggggctga

SEQ ID NO: 7167871 - DNA, 22 bp, Homo sapiens
acagacagtaaatagtgtggct

SEQ ID NO: 7167872 - DNA, 22 bp, Homo sapiens
agcccaggtgactcatacaccc

SEQ ID NO: 7167873 - DNA, 22 bp, Homo sapiens
agcccaggtgactcatacaccc

SEQ ID NO: 7167874 - DNA, 22 bp, Homo sapiens
agcccaggtgactcatacaccc

SEQ ID NO: 7167875 - DNA, 22 bp, Homo sapiens
agcccaggtgaggggttcgaaa

SEQ ID NO: 7167876 - DNA, 22 bp, Homo sapiens
agcccaggtgaggggttcgaaa

SEQ ID NO: 7167877 - DNA, 22 bp, Homo sapiens
agcccaggtggagtgtgtgggg

SEQ ID NO: 7167878 - DNA, 22 bp, Homo sapiens
agcccaggtggagtgtgtgggg

SEQ ID NO: 7167879 - DNA, 22 bp, Homo sapiens
agcccaggtggagtgtgtgggg

SEQ ID NO: 7167880 - DNA, 22 bp, Homo sapiens
agcccaggtggagtgtgtgggg

SEQ ID NO: 7167881 - DNA, 22 bp, Homo sapiens
agcccaggttctaaagccaaac

SEQ ID NO: 7167882 - DNA, 22 bp, Homo sapiens
agcccaggttctaaagccaaac

SEQ ID NO: 7167883 - DNA, 22 bp, Homo sapiens
acagacagggcacctgcctcct

SEQ ID NO: 7167884 - DNA, 21 bp, Homo sapiens
acagacagggccagtgtcccc

SEQ ID NO: 7167885 - DNA, 22 bp, Homo sapiens
agcccaggtctggcccagcctg

SEQ ID NO: 7167886 - DNA, 22 bp, Homo sapiens
agcccaggtctggcccagcctg

SEQ ID NO: 7167887 - DNA, 22 bp, Homo sapiens
agcccaggtctggcccagcctg

SEQ ID NO: 7167888 - DNA, 22 bp, Homo sapiens
agcccaggtctcaaagtacagg

SEQ ID NO: 7167889 - DNA, 22 bp, Homo sapiens
agcccaggtctcaaagtacagg

SEQ ID NO: 7167890 - DNA, 22 bp, Homo sapiens
agcccaggtctggcccagcctg

SEQ ID NO: 7167891 - DNA, 22 bp, Homo sapiens
agcccaggtctggcccagcctg

SEQ ID NO: 7167892 - DNA, 22 bp, Homo sapiens
agcccaggtgactcatacaccc

SEQ ID NO: 7167893 - DNA, 22 bp, Homo sapiens
tcacagacatggtgaggtaaca

SEQ ID NO: 7167894 - DNA, 22 bp, Homo sapiens
tcacagacatggtgaggtaaca

SEQ ID NO: 7167895 - DNA, 22 bp, Homo sapiens
tcacagacccttgctgagctct

SEQ ID NO: 7167896 - DNA, 22 bp, Homo sapiens
tcacagagagaatattgtgttt

SEQ ID NO: 7167897 - DNA, 22 bp, Homo sapiens
tcacagagagaatattgtgttt

SEQ ID NO: 7167898 - DNA, 22 bp, Homo sapiens
tcacagagagaatattgtgttt

SEQ ID NO: 7167899 - DNA, 22 bp, Homo sapiens
tcacagagaggttaagcagttg

SEQ ID NO: 7167900 - DNA, 22 bp, Homo sapiens
tcacagagaggttaagcagttg

SEQ ID NO: 7167901 - DNA, 22 bp, Homo sapiens
tcacagagaggttaagcagttg

SEQ ID NO: 7167902 - DNA, 22 bp, Homo sapiens
tcacagagagtgacttgttgct

SEQ ID NO: 7167903 - DNA, 22 bp, Homo sapiens
tcacagagagtgacttgttgct

SEQ ID NO: 7167904 - DNA, 22 bp, Homo sapiens
tcacagagagtgacttgttgct

SEQ ID NO: 7167905 - DNA, 22 bp, Homo sapiens
tcacagagatgaacttttgata

SEQ ID NO: 7167906 - DNA, 22 bp, Homo sapiens
tcacagagatgaacttttgata

SEQ ID NO: 7167907 - DNA, 22 bp, Homo sapiens
tcacagagatgaacttttgata

SEQ ID NO: 7167908 - DNA, 22 bp, Homo sapiens
tcacagagcacacaagaattgc

SEQ ID NO: 7167909 - DNA, 22 bp, Homo sapiens
tcacagagcacacaagaattgc

SEQ ID NO: 7167910 - DNA, 22 bp, Homo sapiens
tcacagacagaagggatgggat

SEQ ID NO: 7167911 - DNA, 22 bp, Homo sapiens
tcacagacagaagggatgggat

SEQ ID NO: 7167912 - DNA, 19 bp, Homo sapiens
tcacagacagagcaatcac

SEQ ID NO: 7167913 - DNA, 22 bp, Homo sapiens
tcacagacactgggttattgca

SEQ ID NO: 7167914 - DNA, 22 bp, Homo sapiens
tcacagacagaagggatgggat

SEQ ID NO: 7167915 - DNA, 19 bp, Homo sapiens
tcacagacagagcaatcac

SEQ ID NO: 7167916 - DNA, 18 bp, Homo sapiens
tcacagacagctgtcttt

SEQ ID NO: 7167917 - DNA, 22 bp, Homo sapiens
tcacagacacagggagaagcat

SEQ ID NO: 7167918 - DNA, 22 bp, Homo sapiens
tcacagacacattaaacatgtg

SEQ ID NO: 7167919 - DNA, 22 bp, Homo sapiens
tcacagacacagggagaagcat

SEQ ID NO: 7167920 - DNA, 22 bp, Homo sapiens
tcacagacacattaaacatgtg

SEQ ID NO: 7167921 - DNA, 22 bp, Homo sapiens
tcacagacaccttggccacagt

SEQ ID NO: 7167922 - DNA, 22 bp, Homo sapiens
tcacagacactgggttattgca

SEQ ID NO: 7167923 - DNA, 20 bp, Homo sapiens
tcacagatgaaagttcaaga

SEQ ID NO: 7167924 - DNA, 19 bp, Homo sapiens
tcacagagttcttacggga

SEQ ID NO: 7167925 - DNA, 20 bp, Homo sapiens
tcacagatgaaagttcaaga

SEQ ID NO: 7167926 - DNA, 20 bp, Homo sapiens
tcacagatgaaagttcaaga

SEQ ID NO: 7167927 - DNA, 20 bp, Homo sapiens
tcacagatgaaagttcaaga

SEQ ID NO: 7167928 - DNA, 22 bp, Homo sapiens
tcacagagttaaaagtttcttt

SEQ ID NO: 7167929 - DNA, 22 bp, Homo sapiens
tcacagagttaaaagtttcttt

SEQ ID NO: 7167930 - DNA, 19 bp, Homo sapiens
tcacagagttcttacggga

SEQ ID NO: 7167931 - DNA, 22 bp, Homo sapiens
tcacagcaaaagtgtgcagagc

SEQ ID NO: 7167932 - DNA, 22 bp, Homo sapiens
tcacagcaaaagtgtgcagagc

SEQ ID NO: 7167933 - DNA, 22 bp, Homo sapiens
tcacagcaaaagtgtgcagagc

SEQ ID NO: 7167934 - DNA, 22 bp, Homo sapiens
tcacagcaaaagtgtgcagagc

SEQ ID NO: 7167935 - DNA, 22 bp, Homo sapiens
tcacagcaaaagtgtgcagagc

SEQ ID NO: 7167936 - DNA, 22 bp, Homo sapiens
tcacagcaaatgctgcttctca

SEQ ID NO: 7167937 - DNA, 22 bp, Homo sapiens
tcacagcaaatgctgcttctca

SEQ ID NO: 7167938 - DNA, 21 bp, Homo sapiens
tcacagagccacagaattggt

SEQ ID NO: 7167939 - DNA, 21 bp, Homo sapiens
tcacagagccacagaattggt

SEQ ID NO: 7167940 - DNA, 21 bp, Homo sapiens
tcacagagccacagaattggt

SEQ ID NO: 7167941 - DNA, 22 bp, Homo sapiens
tcacagagcacacaagaattgc

SEQ ID NO: 7167942 - DNA, 22 bp, Homo sapiens
tcacagagcacgtatcatgcct

SEQ ID NO: 7167943 - DNA, 22 bp, Homo sapiens
tcacagagcacgtatcatgcct

SEQ ID NO: 7167944 - DNA, 22 bp, Homo sapiens
tcacagagcacgtatcatgcct

SEQ ID NO: 7167945 - DNA, 23 bp, Homo sapiens
tcacagagcatactgcattttgc

SEQ ID NO: 7167946 - DNA, 23 bp, Homo sapiens
tcacagagcatactgcattttgc

SEQ ID NO: 7167947 - DNA, 22 bp, Homo sapiens
tcacagagctcacagtttagca

SEQ ID NO: 7167948 - DNA, 22 bp, Homo sapiens
tcacagagctcacagtttagca

SEQ ID NO: 7167949 - DNA, 20 bp, Homo sapiens
tcacagagtagccttgtctg

SEQ ID NO: 7167950 - DNA, 20 bp, Homo sapiens
tcacagagtagccttgtctg

SEQ ID NO: 7167951 - DNA, 22 bp, Homo sapiens
tcacagagttaaaagtttcttt

SEQ ID NO: 7167952 - DNA, 22 bp, Homo sapiens
tcacacaggtttgcaatgattt

SEQ ID NO: 7167953 - DNA, 22 bp, Homo sapiens
tcacacagggttctggtctcat

SEQ ID NO: 7167954 - DNA, 22 bp, Homo sapiens
tcacacaggtttgcaatgattt

SEQ ID NO: 7167955 - DNA, 22 bp, Homo sapiens
tcacacagtgagaaagtgcgga

SEQ ID NO: 7167956 - DNA, 22 bp, Homo sapiens
tcacacagtgagcggggctcag

SEQ ID NO: 7167957 - DNA, 22 bp, Homo sapiens
tcacacagtggtaaaaccctga

SEQ ID NO: 7167958 - DNA, 22 bp, Homo sapiens
tcacacatctcaggtgtttaat

SEQ ID NO: 7167959 - DNA, 22 bp, Homo sapiens
tcacacatctcaggtgtttaat

SEQ ID NO: 7167960 - DNA, 22 bp, Homo sapiens
tcacacatactcatgtgtgagt

SEQ ID NO: 7167961 - DNA, 22 bp, Homo sapiens
tcacacatactcatgtgtgagt

SEQ ID NO: 7167962 - DNA, 22 bp, Homo sapiens
tcacacatgagtaaatacaggg

SEQ ID NO: 7167963 - DNA, 22 bp, Homo sapiens
tcacacataaaaagaagactag

SEQ ID NO: 7167964 - DNA, 22 bp, Homo sapiens
tcacacataaaaagaagactag

SEQ ID NO: 7167965 - DNA, 20 bp, Homo sapiens
tcacacataagtgaacgcac

SEQ ID NO: 7167966 - DNA, 22 bp, Homo sapiens
tcacacatactcatgtgtgagt

SEQ ID NO: 7167967 - DNA, 18 bp, Homo sapiens
tcacagaatattgagtgg

SEQ ID NO: 7167968 - DNA, 18 bp, Homo sapiens
tcacagaatattgagtgg

SEQ ID NO: 7167969 - DNA, 22 bp, Homo sapiens
tcacagaatagcactgtaagcg

SEQ ID NO: 7167970 - DNA, 22 bp, Homo sapiens
tcacagaatagcactgtaagcg

SEQ ID NO: 7167971 - DNA, 22 bp, Homo sapiens
tcacagaatctctgataagtct

SEQ ID NO: 7167972 - DNA, 22 bp, Homo sapiens
tcacagaatctctgataagtct

SEQ ID NO: 7167973 - DNA, 22 bp, Homo sapiens
tcacagaatgtcagagttgggg

SEQ ID NO: 7167974 - DNA, 22 bp, Homo sapiens
tcacagaatgtctagcataatt

SEQ ID NO: 7167975 - DNA, 22 bp, Homo sapiens
tcacagaatgtctagcataatt

SEQ ID NO: 7167976 - DNA, 22 bp, Homo sapiens
tcacagaatgtcagagttgggg

SEQ ID NO: 7167977 - DNA, 22 bp, Homo sapiens
tcacagaatttttgcttccagt

SEQ ID NO: 7167978 - DNA, 22 bp, Homo sapiens
tcacagacaattgttttggtgt

SEQ ID NO: 7167979 - DNA, 22 bp, Homo sapiens
tcacagcattgtcacaaggctg

SEQ ID NO: 7167980 - DNA, 22 bp, Homo sapiens
tcacagcattgtcacaaggctg

SEQ ID NO: 7167981 - DNA, 22 bp, Homo sapiens
tcacagcattgtcacaaggctg

SEQ ID NO: 7167982 - DNA, 22 bp, Homo sapiens
tcacagcatttttagaaagatt

SEQ ID NO: 7167983 - DNA, 22 bp, Homo sapiens
tcacagcatttttagaaagatt

SEQ ID NO: 7167984 - DNA, 22 bp, Homo sapiens
tcacagcatttttagaaagatt

SEQ ID NO: 7167985 - DNA, 22 bp, Homo sapiens
tcacagcatttttagaaagatt

SEQ ID NO: 7167986 - DNA, 22 bp, Homo sapiens
tcacagcattgagtgtactaga

SEQ ID NO: 7167987 - DNA, 22 bp, Homo sapiens
tcacagcattgagtgtactaga

SEQ ID NO: 7167988 - DNA, 22 bp, Homo sapiens
tcacagcagggtaacaggaaga

SEQ ID NO: 7167989 - DNA, 22 bp, Homo sapiens
tcacagcagtaaagaaaacact

SEQ ID NO: 7167990 - DNA, 22 bp, Homo sapiens
tcacagcagtaaagaaaacact

SEQ ID NO: 7167991 - DNA, 22 bp, Homo sapiens
tcacagcagtaaagaaaacact

SEQ ID NO: 7167992 - DNA, 22 bp, Homo sapiens
tcacagcagtaaagaaaacact

SEQ ID NO: 7167993 - DNA, 19 bp, Homo sapiens
tcacagcatctgtctgaac

SEQ ID NO: 7167994 - DNA, 19 bp, Homo sapiens
tcacagcatctgtctgaac

SEQ ID NO: 7167995 - DNA, 19 bp, Homo sapiens
tcacagcatctgtctgaac

SEQ ID NO: 7167996 - DNA, 19 bp, Homo sapiens
tcacagcatctgtctgaac

SEQ ID NO: 7167997 - DNA, 22 bp, Homo sapiens
tcacagcattcgcaatggacag

SEQ ID NO: 7167998 - DNA, 22 bp, Homo sapiens
tcacagcaccctgaggtgctgg

SEQ ID NO: 7167999 - DNA, 22 bp, Homo sapiens
tcacagcagaatttaggaggca

SEQ ID NO: 7168000 - DNA, 22 bp, Homo sapiens
tcacagcaccctgaggtgctgg

SEQ ID NO: 7168001 - DNA, 22 bp, Homo sapiens
tcacagcaccctgaggtgctgg

SEQ ID NO: 7168002 - DNA, 22 bp, Homo sapiens
tcacagcaggcagatattgttg

SEQ ID NO: 7168003 - DNA, 22 bp, Homo sapiens
tcacagcaggcagatattgttg

SEQ ID NO: 7168004 - DNA, 22 bp, Homo sapiens
tcacagcagggtaacaggaaga

SEQ ID NO: 7168005 - DNA, 22 bp, Homo sapiens
tcacagcagggtaacaggaaga

SEQ ID NO: 7168006 - DNA, 22 bp, Homo sapiens
tcacagcagggtaacaggaaga

SEQ ID NO: 7168007 - DNA, 22 bp, Homo sapiens
tcacagcaaccctgaggcgagt

SEQ ID NO: 7168008 - DNA, 22 bp, Homo sapiens
tcacagcaaccctgaggcgagt

SEQ ID NO: 7168009 - DNA, 22 bp, Homo sapiens
tcacagcaaccctgaggcgagt

SEQ ID NO: 7168010 - DNA, 22 bp, Homo sapiens
tcacagcaacactggggcagac

SEQ ID NO: 7168011 - DNA, 22 bp, Homo sapiens
tcacagcaacactggggcagac

SEQ ID NO: 7168012 - DNA, 22 bp, Homo sapiens
tcacagcaacactggggcagac

SEQ ID NO: 7168013 - DNA, 22 bp, Homo sapiens
tcacagcacatggaccgagtcc

SEQ ID NO: 7168014 - DNA, 22 bp, Homo sapiens
tcacagcacatggaccgagtcc

SEQ ID NO: 7168015 - DNA, 22 bp, Homo sapiens
tcacagcaccaggatctctcca

SEQ ID NO: 7168016 - DNA, 22 bp, Homo sapiens
tcacagcaccaggatctctcca

SEQ ID NO: 7168017 - DNA, 22 bp, Homo sapiens
tcacatcacatgagtgcaagga

SEQ ID NO: 7168018 - DNA, 22 bp, Homo sapiens
tcacatcacatgagtgcaagga

SEQ ID NO: 7168019 - DNA, 22 bp, Homo sapiens
tcacatcacatgacagtaggcc

SEQ ID NO: 7168020 - DNA, 17 bp, Homo sapiens
tcacatcacacaagcaa

SEQ ID NO: 7168021 - DNA, 17 bp, Homo sapiens
tcacatcacacaagcaa

SEQ ID NO: 7168022 - DNA, 17 bp, Homo sapiens
tcacatcacacaagcaa

SEQ ID NO: 7168023 - DNA, 22 bp, Homo sapiens
tcacatcaacattatagcatga

SEQ ID NO: 7168024 - DNA, 22 bp, Homo sapiens
tcacatatttaagaaagttaaa

SEQ ID NO: 7168025 - DNA, 23 bp, Homo sapiens
tcacatatgtagaagtggaattc

SEQ ID NO: 7168026 - DNA, 22 bp, Homo sapiens
tcacatatttaagaaagttaaa

SEQ ID NO: 7168027 - DNA, 22 bp, Homo sapiens
tcacagctaagcttggtcactg

SEQ ID NO: 7168028 - DNA, 23 bp, Homo sapiens
tcacatatcaagaaagtggtaga

SEQ ID NO: 7168029 - DNA, 22 bp, Homo sapiens
tcacagcatttttagaaagatt

SEQ ID NO: 7168030 - DNA, 22 bp, Homo sapiens
tcacagcctggtcactctgccc

SEQ ID NO: 7168031 - DNA, 22 bp, Homo sapiens
tcacagcctggtcactctgccc

SEQ ID NO: 7168032 - DNA, 22 bp, Homo sapiens
tcacatcattaagacttctcct

SEQ ID NO: 7168033 - DNA, 22 bp, Homo sapiens
tcacatctccctggaggacaca

SEQ ID NO: 7168034 - DNA, 22 bp, Homo sapiens
tcacatctgaaaaaatattgag

SEQ ID NO: 7168035 - DNA, 22 bp, Homo sapiens
tcacatctgattagtgactgat

SEQ ID NO: 7168036 - DNA, 22 bp, Homo sapiens
tcacatctgcaaaatccctttt

SEQ ID NO: 7168037 - DNA, 22 bp, Homo sapiens
tcacatctgcctccatagcacc

SEQ ID NO: 7168038 - DNA, 22 bp, Homo sapiens
tcacatctgcctccatagcacc

SEQ ID NO: 7168039 - DNA, 22 bp, Homo sapiens
tcaaaagacacaggaggctagt

SEQ ID NO: 7168040 - DNA, 22 bp, Homo sapiens
tcaaaaggacagaagacctaaa

SEQ ID NO: 7168041 - DNA, 22 bp, Homo sapiens
tcaaaaatgttttatattggta

SEQ ID NO: 7168042 - DNA, 22 bp, Homo sapiens
tcaaaaatgttttatattggta

SEQ ID NO: 7168043 - DNA, 22 bp, Homo sapiens
tcaaaaatggtctttgagctgc

SEQ ID NO: 7168044 - DNA, 22 bp, Homo sapiens
tcaaaaatggtctttgagctgc

SEQ ID NO: 7168045 - DNA, 22 bp, Homo sapiens
tcaaaaatggtctttgagctgc

SEQ ID NO: 7168046 - DNA, 22 bp, Homo sapiens
tcaaaagtttcacatagagata

SEQ ID NO: 7168047 - DNA, 22 bp, Homo sapiens
tcaaaagtttcacatagagata

SEQ ID NO: 7168048 - DNA, 22 bp, Homo sapiens
tcaaaagtttcacatagagata

SEQ ID NO: 7168049 - DNA, 22 bp, Homo sapiens
tcaaaagtggcctgtaaaatct

SEQ ID NO: 7168050 - DNA, 22 bp, Homo sapiens
tcaaaagtctgcattcttcaca

SEQ ID NO: 7168051 - DNA, 22 bp, Homo sapiens
tcaaaagtctgcattcttcaca

SEQ ID NO: 7168052 - DNA, 22 bp, Homo sapiens
tcaaaagtctgcattcttcaca

SEQ ID NO: 7168053 - DNA, 22 bp, Homo sapiens
tcaaaagtggcctgtaaaatct

SEQ ID NO: 7168054 - DNA, 22 bp, Homo sapiens
tcaaaagtggcctgtaaaatct

SEQ ID NO: 7168055 - DNA, 22 bp, Homo sapiens
tcaaaagtttcacatagagata

SEQ ID NO: 7168056 - DNA, 20 bp, Homo sapiens
tcaaaataggtgtgggcgga

SEQ ID NO: 7168057 - DNA, 20 bp, Homo sapiens
tcaaaataggtgtgggcgga

SEQ ID NO: 7168058 - DNA, 18 bp, Homo sapiens
tcaaaatatttctgtgga

SEQ ID NO: 7168059 - DNA, 18 bp, Homo sapiens
tcaaaatatttctgtgga

SEQ ID NO: 7168060 - DNA, 18 bp, Homo sapiens
tcaaaatatttctgtgga

SEQ ID NO: 7168061 - DNA, 22 bp, Homo sapiens
tcaaaattagtgaccaaaggca

SEQ ID NO: 7168062 - DNA, 22 bp, Homo sapiens
tcaaaatcaaagatacttgaaa

SEQ ID NO: 7168063 - DNA, 22 bp, Homo sapiens
tcaaacaccatctgaccttatg

SEQ ID NO: 7168064 - DNA, 22 bp, Homo sapiens
tcaaacactgtaacatggaaaa

SEQ ID NO: 7168065 - DNA, 22 bp, Homo sapiens
tcaaacactgtaacatggaaaa

SEQ ID NO: 7168066 - DNA, 22 bp, Homo sapiens
tcaaaattctagggagaatggt

SEQ ID NO: 7168067 - DNA, 22 bp, Homo sapiens
tcaaaatttcagcactagccct

SEQ ID NO: 7168068 - DNA, 22 bp, Homo sapiens
tcaaaattttatttctcaagga

SEQ ID NO: 7168069 - DNA, 22 bp, Homo sapiens
tcaaacatctaaactacccact

SEQ ID NO: 7168070 - DNA, 22 bp, Homo sapiens
tcaaacataggcacacattcag

SEQ ID NO: 7168071 - DNA, 22 bp, Homo sapiens
tcaaacatatctgattttccat

SEQ ID NO: 7168072 - DNA, 21 bp, Homo sapiens
tcaatacaggtgcatgtgtct

SEQ ID NO: 7168073 - DNA, 22 bp, Homo sapiens
tcaatacatacaatgtatagtg

SEQ ID NO: 7168074 - DNA, 22 bp, Homo sapiens
tcaatacatacaatgtatagtg

SEQ ID NO: 7168075 - DNA, 22 bp, Homo sapiens
tcaatactaatcttgctggaag

SEQ ID NO: 7168076 - DNA, 22 bp, Homo sapiens
tcaatactatgattttgtacat

SEQ ID NO: 7168077 - DNA, 22 bp, Homo sapiens
tcaatactcacaaagagatttt

SEQ ID NO: 7168078 - DNA, 22 bp, Homo sapiens
tcaatactcacaaagagatttt

SEQ ID NO: 7168079 - DNA, 22 bp, Homo sapiens
tcaatacttaagcttaattcta

SEQ ID NO: 7168080 - DNA, 22 bp, Homo sapiens
tcaatacttggcacactgcaca

SEQ ID NO: 7168081 - DNA, 22 bp, Homo sapiens
tcaatagaaatgcagagtctca

SEQ ID NO: 7168082 - DNA, 22 bp, Homo sapiens
tcaatagaaatgcagagtctca

SEQ ID NO: 7168083 - DNA, 22 bp, Homo sapiens
tcaatgatagtacaatcagcct

SEQ ID NO: 7168084 - DNA, 22 bp, Homo sapiens
tcaatgatatcagcaggatgtg

SEQ ID NO: 7168085 - DNA, 22 bp, Homo sapiens
tcaatgcaacctccacctcccg

SEQ ID NO: 7168086 - DNA, 22 bp, Homo sapiens
tcaatgcaacttccacctccca

SEQ ID NO: 7168087 - DNA, 22 bp, Homo sapiens
tcaatgcacacaggacttggtg

SEQ ID NO: 7168088 - DNA, 22 bp, Homo sapiens
tcaatgcataggaggtggcaga

SEQ ID NO: 7168089 - DNA, 19 bp, Homo sapiens
tcaatgcatgaaatcagcc

SEQ ID NO: 7168090 - DNA, 22 bp, Homo sapiens
tcacacagggtcggaaagagtg

SEQ ID NO: 7168091 - DNA, 22 bp, Homo sapiens
tcacacagggtcggaaagagtg

SEQ ID NO: 7168092 - DNA, 22 bp, Homo sapiens
tcacacagcttggagttatggt

SEQ ID NO: 7168093 - DNA, 22 bp, Homo sapiens
tcacacagggtcggaaagagtg

SEQ ID NO: 7168094 - DNA, 22 bp, Homo sapiens
tcacacagggtcggaaagagtg

SEQ ID NO: 7168095 - DNA, 22 bp, Homo sapiens
tcacacagggtcggaaagagtg

SEQ ID NO: 7168096 - DNA, 22 bp, Homo sapiens
tcacacagggtcggaaagagtg

SEQ ID NO: 7168097 - DNA, 22 bp, Homo sapiens
tcacacagggtcggaaagagtg

SEQ ID NO: 7168098 - DNA, 22 bp, Homo sapiens
tcacacagcttggagttatggt

SEQ ID NO: 7168099 - DNA, 22 bp, Homo sapiens
tcacacagcttggagttatggt

SEQ ID NO: 7168100 - DNA, 22 bp, Homo sapiens
tcacacagattggtagagctga

SEQ ID NO: 7168101 - DNA, 22 bp, Homo sapiens
tcacacagcagccccgggtgtt

SEQ ID NO: 7168102 - DNA, 22 bp, Homo sapiens
tcacacagctcctttccttagt

SEQ ID NO: 7168103 - DNA, 22 bp, Homo sapiens
tcacacagctgacagagccttt

SEQ ID NO: 7168104 - DNA, 22 bp, Homo sapiens
tcacacagctgacagagccttt

SEQ ID NO: 7168105 - DNA, 22 bp, Homo sapiens
tcacacagctgacagagccttt

SEQ ID NO: 7168106 - DNA, 23 bp, Homo sapiens
tcacacagctggtcaggtacaga

SEQ ID NO: 7168107 - DNA, 23 bp, Homo sapiens
tcacacagctggtcaggtacaga

SEQ ID NO: 7168108 - DNA, 23 bp, Homo sapiens
tcacacagctggtcaggtacaga

SEQ ID NO: 7168109 - DNA, 23 bp, Homo sapiens
tcacacagctggtcaggtacaga

SEQ ID NO: 7168110 - DNA, 21 bp, Homo sapiens
tcacacacgtttccaagggca

SEQ ID NO: 7168111 - DNA, 22 bp, Homo sapiens
tcacacagattggtagagctga

SEQ ID NO: 7168112 - DNA, 22 bp, Homo sapiens
tcacacagattggtagagctga

SEQ ID NO: 7168113 - DNA, 22 bp, Homo sapiens
tcacacagattggtagagctga

SEQ ID NO: 7168114 - DNA, 22 bp, Homo sapiens
tcacacagattggtagagctga

SEQ ID NO: 7168115 - DNA, 22 bp, Homo sapiens
tcacacacatttgctgtctgat

SEQ ID NO: 7168116 - DNA, 22 bp, Homo sapiens
tcacacacatggatagtatttt

SEQ ID NO: 7168117 - DNA, 22 bp, Homo sapiens
tcacacacatggatagtatttt

SEQ ID NO: 7168118 - DNA, 22 bp, Homo sapiens
tcacacacataatctaagatta

SEQ ID NO: 7168119 - DNA, 22 bp, Homo sapiens
tcaattctggtcctcaggaact

SEQ ID NO: 7168120 - DNA, 22 bp, Homo sapiens
tcaattcttattggtgttctgc

SEQ ID NO: 7168121 - DNA, 22 bp, Homo sapiens
tcaattcttattggtgttctgc

SEQ ID NO: 7168122 - DNA, 22 bp, Homo sapiens
tcaatttaaggtactactttgg

SEQ ID NO: 7168123 - DNA, 23 bp, Homo sapiens
tcaattgatgatgttctcttttg

SEQ ID NO: 7168124 - DNA, 22 bp, Homo sapiens
tcacaatttggatacagctatg

SEQ ID NO: 7168125 - DNA, 22 bp, Homo sapiens
tcaattactaaccaaataatgt

SEQ ID NO: 7168126 - DNA, 22 bp, Homo sapiens
tcaattacagcaatgactgtac

SEQ ID NO: 7168127 - DNA, 22 bp, Homo sapiens
tcaattacagcaatgactgtac

SEQ ID NO: 7168128 - DNA, 22 bp, Homo sapiens
tcaattatgccattgcaatatt

SEQ ID NO: 7168129 - DNA, 23 bp, Homo sapiens
tcaattatcaatggaaagaagtt

SEQ ID NO: 7168130 - DNA, 23 bp, Homo sapiens
tcaattatcaatggaaagaagtt

SEQ ID NO: 7168131 - DNA, 22 bp, Homo sapiens
tcaattatgccattgcaatatt

SEQ ID NO: 7168132 - DNA, 22 bp, Homo sapiens
tcaatgtccgggccccattcca

SEQ ID NO: 7168133 - DNA, 22 bp, Homo sapiens
tcaatgtccgggccccattcca

SEQ ID NO: 7168134 - DNA, 22 bp, Homo sapiens
tcaatgtctgcggctagctgga

SEQ ID NO: 7168135 - DNA, 22 bp, Homo sapiens
tcaatgtctgtctatctattta

SEQ ID NO: 7168136 - DNA, 22 bp, Homo sapiens
tcaatgtctgtctatctattta

SEQ ID NO: 7168137 - DNA, 22 bp, Homo sapiens
tcaatgttcaagtatgacaatg

SEQ ID NO: 7168138 - DNA, 22 bp, Homo sapiens
tcaatgtttggaaatcctttgt

SEQ ID NO: 7168139 - DNA, 22 bp, Homo sapiens
tcaatgtttgttcatgaaaata

SEQ ID NO: 7168140 - DNA, 22 bp, Homo sapiens
tcaattaagaggctaagttact

SEQ ID NO: 7168141 - DNA, 22 bp, Homo sapiens
tcaattcaacacatgcacattg

SEQ ID NO: 7168142 - DNA, 22 bp, Homo sapiens
tcaattatttgatatgaaaggg

SEQ ID NO: 7168143 - DNA, 22 bp, Homo sapiens
tcaattcagtccaacagtaatt

SEQ ID NO: 7168144 - DNA, 22 bp, Homo sapiens
tcaattcagactgagaaatgat

SEQ ID NO: 7168145 - DNA, 22 bp, Homo sapiens
tcaattcaattgcatttctgtg

SEQ ID NO: 7168146 - DNA, 22 bp, Homo sapiens
tcaattctagtggagagagttt

SEQ ID NO: 7168147 - DNA, 22 bp, Homo sapiens
tcaattctgcatacatttcact

SEQ ID NO: 7168148 - DNA, 22 bp, Homo sapiens
tcaattctgcctctaaatattt

SEQ ID NO: 7168149 - DNA, 22 bp, Homo sapiens
tcaattctagtggagagagttt

SEQ ID NO: 7168150 - DNA, 22 bp, Homo sapiens
tcaattctagagccttacattg

SEQ ID NO: 7168151 - DNA, 22 bp, Homo sapiens
tcaattcatagagttgacacag

SEQ ID NO: 7168152 - DNA, 22 bp, Homo sapiens
tcagaagagtaatagggtgaga

SEQ ID NO: 7168153 - DNA, 22 bp, Homo sapiens
tcagaagactactaggacacat

SEQ ID NO: 7168154 - DNA, 22 bp, Homo sapiens
tcagaagcagaaaataggtggg

SEQ ID NO: 7168155 - DNA, 22 bp, Homo sapiens
tcagaagaaaagacttttagag

SEQ ID NO: 7168156 - DNA, 22 bp, Homo sapiens
tcagaagaaagatgttattact

SEQ ID NO: 7168157 - DNA, 22 bp, Homo sapiens
tcagaagaaggtatatttatac

SEQ ID NO: 7168158 - DNA, 22 bp, Homo sapiens
tcagaactcaagacttgacatc

SEQ ID NO: 7168159 - DNA, 19 bp, Homo sapiens
tcagaactcagaatgtgta

SEQ ID NO: 7168160 - DNA, 19 bp, Homo sapiens
tcagaactcagaatgtgta

SEQ ID NO: 7168161 - DNA, 22 bp, Homo sapiens
tcagaactgctgctcctgcaaa

SEQ ID NO: 7168162 - DNA, 21 bp, Homo sapiens
tcagaactggtgcagatgaat

SEQ ID NO: 7168163 - DNA, 22 bp, Homo sapiens
tcagaacatgaaggttaatttg

SEQ ID NO: 7168164 - DNA, 22 bp, Homo sapiens
tcagaacatgaaggttaatttg

SEQ ID NO: 7168165 - DNA, 22 bp, Homo sapiens
tcagaacatgtttgagtaagac

SEQ ID NO: 7168166 - DNA, 22 bp, Homo sapiens
tcagaacattaaggatttgaag

SEQ ID NO: 7168167 - DNA, 22 bp, Homo sapiens
tcagaacattaaggatttgaag

SEQ ID NO: 7168168 - DNA, 22 bp, Homo sapiens
tcagaacattaaggatttgaag

SEQ ID NO: 7168169 - DNA, 22 bp, Homo sapiens
tcagaacattacattttgagct

SEQ ID NO: 7168170 - DNA, 22 bp, Homo sapiens
tcagaacattacattttgagct

SEQ ID NO: 7168171 - DNA, 22 bp, Homo sapiens
tcagaacattacattttgagct

SEQ ID NO: 7168172 - DNA, 22 bp, Homo sapiens
tcagaacattctcattgactgc

SEQ ID NO: 7168173 - DNA, 22 bp, Homo sapiens
tcagaacattctcattgactgc

SEQ ID NO: 7168174 - DNA, 22 bp, Homo sapiens
tcagaacattctcattgactgc

SEQ ID NO: 7168175 - DNA, 22 bp, Homo sapiens
tcagaacattgacattcttatt

SEQ ID NO: 7168176 - DNA, 22 bp, Homo sapiens
tcagaacattgacattcttatt

SEQ ID NO: 7168177 - DNA, 22 bp, Homo sapiens
tcagaacattgacattcttatt

SEQ ID NO: 7168178 - DNA, 22 bp, Homo sapiens
tcagaacattgacattcttatt

SEQ ID NO: 7168179 - DNA, 22 bp, Homo sapiens
tcagaacatttgggactttggg

SEQ ID NO: 7168180 - DNA, 22 bp, Homo sapiens
tcagaacatttgggactttggg

SEQ ID NO: 7168181 - DNA, 22 bp, Homo sapiens
tcagaacatttgggactttggg

SEQ ID NO: 7168182 - DNA, 22 bp, Homo sapiens
tcagaacctcctagcagtgttc

SEQ ID NO: 7168183 - DNA, 22 bp, Homo sapiens
tcagaaccagcccagcagatga

SEQ ID NO: 7168184 - DNA, 22 bp, Homo sapiens
tcagaacctgcaagtctaacct

SEQ ID NO: 7168185 - DNA, 22 bp, Homo sapiens
tcagaactacatggacatgtta

SEQ ID NO: 7168186 - DNA, 22 bp, Homo sapiens
tcagaactatagtagtttcatg

SEQ ID NO: 7168187 - DNA, 22 bp, Homo sapiens
tcagagaattgtttaatggaat

SEQ ID NO: 7168188 - DNA, 22 bp, Homo sapiens
tcagagaattgtttaatggaat

SEQ ID NO: 7168189 - DNA, 22 bp, Homo sapiens
tcagagaattgtttaatggaat

SEQ ID NO: 7168190 - DNA, 22 bp, Homo sapiens
tcagagaattctcagatgactc

SEQ ID NO: 7168191 - DNA, 22 bp, Homo sapiens
tcagagaattcgattaaatgca

SEQ ID NO: 7168192 - DNA, 22 bp, Homo sapiens
tcagagaatgtgaatattaaac

SEQ ID NO: 7168193 - DNA, 22 bp, Homo sapiens
tcagagaattcgattaaatgca

SEQ ID NO: 7168194 - DNA, 23 bp, Homo sapiens
tcagagaatggtatgcttttcct

SEQ ID NO: 7168195 - DNA, 23 bp, Homo sapiens
tcagagaatggtatgcttttcct

SEQ ID NO: 7168196 - DNA, 23 bp, Homo sapiens
tcagagaatggtatgcttttcct

SEQ ID NO: 7168197 - DNA, 22 bp, Homo sapiens
tcagagaatgtccttcttcatt

SEQ ID NO: 7168198 - DNA, 22 bp, Homo sapiens
tcagagaatgtccttcttcatt

SEQ ID NO: 7168199 - DNA, 22 bp, Homo sapiens
tcagagaatctctccttagttt

SEQ ID NO: 7168200 - DNA, 21 bp, Homo sapiens
tcagagaatggcctactctca

SEQ ID NO: 7168201 - DNA, 21 bp, Homo sapiens
tcagagaatggcctactctca

SEQ ID NO: 7168202 - DNA, 23 bp, Homo sapiens
tcagagaataattctgatagact

SEQ ID NO: 7168203 - DNA, 23 bp, Homo sapiens
tcagagaataattctgatagact

SEQ ID NO: 7168204 - DNA, 22 bp, Homo sapiens
tcagagaagtaggctaatggtg

SEQ ID NO: 7168205 - DNA, 22 bp, Homo sapiens
tcagagaagtaaggtggggtgc

SEQ ID NO: 7168206 - DNA, 22 bp, Homo sapiens
tcagagaaggtaagtgacctgc

SEQ ID NO: 7168207 - DNA, 20 bp, Homo sapiens
tcagagaagggactgagatt

SEQ ID NO: 7168208 - DNA, 20 bp, Homo sapiens
tcagagaagggactgagatt

SEQ ID NO: 7168209 - DNA, 20 bp, Homo sapiens
tcagagaagggactgagatt

SEQ ID NO: 7168210 - DNA, 22 bp, Homo sapiens
tcagaagccaccttttgttggg

SEQ ID NO: 7168211 - DNA, 22 bp, Homo sapiens
tcagaagcaggagtgtgcacaa

SEQ ID NO: 7168212 - DNA, 22 bp, Homo sapiens
tcagaagcaggagtgtgcacaa

SEQ ID NO: 7168213 - DNA, 22 bp, Homo sapiens
tcagaggaccttactgagaacc

SEQ ID NO: 7168214 - DNA, 22 bp, Homo sapiens
tcagaggaccttactgagaacc

SEQ ID NO: 7168215 - DNA, 22 bp, Homo sapiens
tcagaggacagcagctaaataa

SEQ ID NO: 7168216 - DNA, 22 bp, Homo sapiens
tcagaggacaagctccctggtg

SEQ ID NO: 7168217 - DNA, 22 bp, Homo sapiens
tcagaggacagcagctaaataa

SEQ ID NO: 7168218 - DNA, 22 bp, Homo sapiens
tcagaggacaagctccctggtg

SEQ ID NO: 7168219 - DNA, 22 bp, Homo sapiens
tcagaggaatttgcttttcatg

SEQ ID NO: 7168220 - DNA, 22 bp, Homo sapiens
tcagaggaatttgcttttcatg

SEQ ID NO: 7168221 - DNA, 22 bp, Homo sapiens
tcagaggaataatgctgcattt

SEQ ID NO: 7168222 - DNA, 22 bp, Homo sapiens
tcagaggaagccttggtgggag

SEQ ID NO: 7168223 - DNA, 22 bp, Homo sapiens
tcagagaggcaatactgtttaa

SEQ ID NO: 7168224 - DNA, 22 bp, Homo sapiens
tcagagaggattttaataagtg

SEQ ID NO: 7168225 - DNA, 22 bp, Homo sapiens
tcagagaggattttaataagtg

SEQ ID NO: 7168226 - DNA, 23 bp, Homo sapiens
tcagagagctgttgagagctgcc

SEQ ID NO: 7168227 - DNA, 23 bp, Homo sapiens
tcagagagctgttgagagctgcc

SEQ ID NO: 7168228 - DNA, 23 bp, Homo sapiens
tcagagagctgttgagagctgcc

SEQ ID NO: 7168229 - DNA, 23 bp, Homo sapiens
tcagagagctgttgagagctgcc

SEQ ID NO: 7168230 - DNA, 23 bp, Homo sapiens
tcagagagctgttgagagctgcc

SEQ ID NO: 7168231 - DNA, 18 bp, Homo sapiens
tcagagagaatagtaatt

SEQ ID NO: 7168232 - DNA, 18 bp, Homo sapiens
tcagagagaatagtaatt

SEQ ID NO: 7168233 - DNA, 20 bp, Homo sapiens
tcagagagagggtgccactt

SEQ ID NO: 7168234 - DNA, 20 bp, Homo sapiens
tcagagagagggtgccactt

SEQ ID NO: 7168235 - DNA, 22 bp, Homo sapiens
tcagagagaaatagtttttgac

SEQ ID NO: 7168236 - DNA, 22 bp, Homo sapiens
tcagagacagtattggctattg

SEQ ID NO: 7168237 - DNA, 22 bp, Homo sapiens
tcagagacagttctggggcagg

SEQ ID NO: 7168238 - DNA, 22 bp, Homo sapiens
tcagagacctagcaagaaattg

SEQ ID NO: 7168239 - DNA, 22 bp, Homo sapiens
tcagagactggtctgcagatgc

SEQ ID NO: 7168240 - DNA, 22 bp, Homo sapiens
tcagagacctagcaagaaattg

SEQ ID NO: 7168241 - DNA, 20 bp, Homo sapiens
tcagagagagggtgccactt

SEQ ID NO: 7168242 - DNA, 22 bp, Homo sapiens
tcagagagcagaacttttttac

SEQ ID NO: 7168243 - DNA, 22 bp, Homo sapiens
tcagagagcagaacttttttac

SEQ ID NO: 7168244 - DNA, 18 bp, Homo sapiens
tcagagagcagctttatt

SEQ ID NO: 7168245 - DNA, 18 bp, Homo sapiens
tcagagagcagctttatt

SEQ ID NO: 7168246 - DNA, 22 bp, Homo sapiens
tcagagagcctcaggcactgcc

SEQ ID NO: 7168247 - DNA, 22 bp, Homo sapiens
tcagagagcctcaggcactgcc

SEQ ID NO: 7168248 - DNA, 22 bp, Homo sapiens
tcagagagcctcaggcactgcc

SEQ ID NO: 7168249 - DNA, 22 bp, Homo sapiens
tcagagagctggtgggcagagg

SEQ ID NO: 7168250 - DNA, 22 bp, Homo sapiens
tcagagagctggtgggcagagg

SEQ ID NO: 7168251 - DNA, 22 bp, Homo sapiens
tcagagagctggtgggcagagg

SEQ ID NO: 7168252 - DNA, 19 bp, Homo sapiens
tcagaggatttggctatga

SEQ ID NO: 7168253 - DNA, 22 bp, Homo sapiens
tcagaggattggacttttatgt

SEQ ID NO: 7168254 - DNA, 19 bp, Homo sapiens
tcagaggatttggctatga

SEQ ID NO: 7168255 - DNA, 22 bp, Homo sapiens
tcagaggattgcctcagcgagc

SEQ ID NO: 7168256 - DNA, 18 bp, Homo sapiens
tcagaggagatacctaaa

SEQ ID NO: 7168257 - DNA, 22 bp, Homo sapiens
tcagaggagaccaaggggaata

SEQ ID NO: 7168258 - DNA, 22 bp, Homo sapiens
tcagaggagaccaaggggaata

SEQ ID NO: 7168259 - DNA, 22 bp, Homo sapiens
tcagaggagaagttgggaaaat

SEQ ID NO: 7168260 - DNA, 22 bp, Homo sapiens
tcagaggagaagttgggaaaat

SEQ ID NO: 7168261 - DNA, 22 bp, Homo sapiens
tcagaggactaccttctccagt

SEQ ID NO: 7168262 - DNA, 22 bp, Homo sapiens
tcagaggactaccttctccagt

SEQ ID NO: 7168263 - DNA, 22 bp, Homo sapiens
tcagaggacgcactagggttgt

SEQ ID NO: 7168264 - DNA, 20 bp, Homo sapiens
tcagaggctgccagctgggg

SEQ ID NO: 7168265 - DNA, 20 bp, Homo sapiens
tcagaggctgccagctgggg

SEQ ID NO: 7168266 - DNA, 22 bp, Homo sapiens
tcagaggctcactgtctacttt

SEQ ID NO: 7168267 - DNA, 22 bp, Homo sapiens
tcagaggctcatctgccttgca

SEQ ID NO: 7168268 - DNA, 22 bp, Homo sapiens
tcagaggctcatctgccttgca

SEQ ID NO: 7168269 - DNA, 22 bp, Homo sapiens
tcagaggcctgaaagaatttgg

SEQ ID NO: 7168270 - DNA, 22 bp, Homo sapiens
tcagaggccttggttatggtat

SEQ ID NO: 7168271 - DNA, 22 bp, Homo sapiens
tcagaggctacagtctgggagt

SEQ ID NO: 7168272 - DNA, 22 bp, Homo sapiens
tcagaggccaaactgagcaggg

SEQ ID NO: 7168273 - DNA, 22 bp, Homo sapiens
tcagaggcagctgatgttctgt

SEQ ID NO: 7168274 - DNA, 22 bp, Homo sapiens
tcagaggcatcattcatagtta

SEQ ID NO: 7168275 - DNA, 22 bp, Homo sapiens
tcagaggcagctgatgttctgt

SEQ ID NO: 7168276 - DNA, 22 bp, Homo sapiens
tcagaggcagctgatgttctgt

SEQ ID NO: 7168277 - DNA, 22 bp, Homo sapiens
tcagaggcagctgatgttctgt

SEQ ID NO: 7168278 - DNA, 21 bp, Homo sapiens
tcagaggcactgagagcaatg

SEQ ID NO: 7168279 - DNA, 21 bp, Homo sapiens
tcagaggcactgagagcaatg

SEQ ID NO: 7168280 - DNA, 22 bp, Homo sapiens
tcagaggcaaagaactttatta

SEQ ID NO: 7168281 - DNA, 21 bp, Homo sapiens
tcagaggcactgagagcaatg

SEQ ID NO: 7168282 - DNA, 22 bp, Homo sapiens
tcactgggccctgaggtgggac

SEQ ID NO: 7168283 - DNA, 22 bp, Homo sapiens
tcactgggccctgaggtgggac

SEQ ID NO: 7168284 - DNA, 22 bp, Homo sapiens
tcactgggagatgtgggaaggg

SEQ ID NO: 7168285 - DNA, 22 bp, Homo sapiens
tcactgggagatgtgggaaggg

SEQ ID NO: 7168286 - DNA, 22 bp, Homo sapiens
tcactgggcatcggagctgaaa

SEQ ID NO: 7168287 - DNA, 22 bp, Homo sapiens
tcactgggcatcggagctgaaa

SEQ ID NO: 7168288 - DNA, 22 bp, Homo sapiens
tcactggggccatgtgagggac

SEQ ID NO: 7168289 - DNA, 22 bp, Homo sapiens
tcactggggccatgtgagggac

SEQ ID NO: 7168290 - DNA, 22 bp, Homo sapiens
tcactggggccatgtgagggac

SEQ ID NO: 7168291 - DNA, 17 bp, Homo sapiens
tcactgggcctgctccc

SEQ ID NO: 7168292 - DNA, 17 bp, Homo sapiens
tcactgggcctgctccc

SEQ ID NO: 7168293 - DNA, 22 bp, Homo sapiens
tcactggggagcactgacatgt

SEQ ID NO: 7168294 - DNA, 22 bp, Homo sapiens
tcactggggagcactgacatgt

SEQ ID NO: 7168295 - DNA, 22 bp, Homo sapiens
tcactgggagagctgacaagga

SEQ ID NO: 7168296 - DNA, 18 bp, Homo sapiens
tcactgggagaagatatt

SEQ ID NO: 7168297 - DNA, 18 bp, Homo sapiens
tcactgggagaagatatt

SEQ ID NO: 7168298 - DNA, 18 bp, Homo sapiens
tcactgggagaagatatt

SEQ ID NO: 7168299 - DNA, 22 bp, Homo sapiens
tcactgggagagctgacaagga

SEQ ID NO: 7168300 - DNA, 22 bp, Homo sapiens
tcactgggagagctgacaagga

SEQ ID NO: 7168301 - DNA, 22 bp, Homo sapiens
tcactggattctcttttgttcc

SEQ ID NO: 7168302 - DNA, 22 bp, Homo sapiens
tcactggcaacttgtgctccct

SEQ ID NO: 7168303 - DNA, 20 bp, Homo sapiens
tcactggccagagtagccct

SEQ ID NO: 7168304 - DNA, 20 bp, Homo sapiens
tcactggccagagtagccct

SEQ ID NO: 7168305 - DNA, 22 bp, Homo sapiens
tcactaatgagctaaggaaaag

SEQ ID NO: 7168306 - DNA, 22 bp, Homo sapiens
tcactaatgattttgaaagaag

SEQ ID NO: 7168307 - DNA, 22 bp, Homo sapiens
tcactaatgattttgaaagaag

SEQ ID NO: 7168308 - DNA, 22 bp, Homo sapiens
tcactaatagggggagcatagg

SEQ ID NO: 7168309 - DNA, 22 bp, Homo sapiens
tcactaatgagctaaggaaaag

SEQ ID NO: 7168310 - DNA, 22 bp, Homo sapiens
tcactaatgagctaaggaaaag

SEQ ID NO: 7168311 - DNA, 22 bp, Homo sapiens
tcacgttttactgagtgagata

SEQ ID NO: 7168312 - DNA, 21 bp, Homo sapiens
tcactggaatacaattgattt

SEQ ID NO: 7168313 - DNA, 22 bp, Homo sapiens
tcactggaaatgcacagctgta

SEQ ID NO: 7168314 - DNA, 22 bp, Homo sapiens
tcactgctttgagccactgagc

SEQ ID NO: 7168315 - DNA, 22 bp, Homo sapiens
tcactgctttgtttacaactat

SEQ ID NO: 7168316 - DNA, 22 bp, Homo sapiens
tcactgcttcttggagaatgtc

SEQ ID NO: 7168317 - DNA, 22 bp, Homo sapiens
tcactgctttcaaaaattattg

SEQ ID NO: 7168318 - DNA, 22 bp, Homo sapiens
tcactgtctgaaagaaatggcc

SEQ ID NO: 7168319 - DNA, 22 bp, Homo sapiens
tcactgtccctgtcctcttatc

SEQ ID NO: 7168320 - DNA, 22 bp, Homo sapiens
tcactgtatttgctgatgcata

SEQ ID NO: 7168321 - DNA, 22 bp, Homo sapiens
tcactgtatttggaagggatgg

SEQ ID NO: 7168322 - DNA, 20 bp, Homo sapiens
tcagaacagtagaggagcta

SEQ ID NO: 7168323 - DNA, 22 bp, Homo sapiens
tcagaacagtgcctggcactaa

SEQ ID NO: 7168324 - DNA, 22 bp, Homo sapiens
tcagaacagtgcctggcactaa

SEQ ID NO: 7168325 - DNA, 22 bp, Homo sapiens
tcagaacagttcttaatattgc

SEQ ID NO: 7168326 - DNA, 22 bp, Homo sapiens
tcagaacagttcttaatattgc

SEQ ID NO: 7168327 - DNA, 22 bp, Homo sapiens
tcagaacagttcttaatattgc

SEQ ID NO: 7168328 - DNA, 22 bp, Homo sapiens
tcagaacagttcttaatattgc

SEQ ID NO: 7168329 - DNA, 23 bp, Homo sapiens
tcagaacagttcttggtgcatag

SEQ ID NO: 7168330 - DNA, 22 bp, Homo sapiens
tcagaacatatattttgtgatg

SEQ ID NO: 7168331 - DNA, 22 bp, Homo sapiens
tcagaacatatattttgtgatg

SEQ ID NO: 7168332 - DNA, 22 bp, Homo sapiens
tcagaacatatattttgtgatg

SEQ ID NO: 7168333 - DNA, 22 bp, Homo sapiens
tcagaacatcctggtttaaaat

SEQ ID NO: 7168334 - DNA, 22 bp, Homo sapiens
tcactgtaccttccatttcatt

SEQ ID NO: 7168335 - DNA, 22 bp, Homo sapiens
tcactgtagtgagcagaatata

SEQ ID NO: 7168336 - DNA, 22 bp, Homo sapiens
tcactgtatcatgttgcactta

SEQ ID NO: 7168337 - DNA, 22 bp, Homo sapiens
tcactggttagaagaagtaagc

SEQ ID NO: 7168338 - DNA, 22 bp, Homo sapiens
tcactgtaaagtaatactgtca

SEQ ID NO: 7168339 - DNA, 22 bp, Homo sapiens
tcactgtaataggtttgaagat

SEQ ID NO: 7168340 - DNA, 22 bp, Homo sapiens
tcactgtaatttgtatctgtgg

SEQ ID NO: 7168341 - DNA, 22 bp, Homo sapiens
tcactggtgtgagaggagcaaa

SEQ ID NO: 7168342 - DNA, 18 bp, Homo sapiens
tcactgggtgtatgtggc

SEQ ID NO: 7168343 - DNA, 22 bp, Homo sapiens
tcactgggtaggacatgctgat

SEQ ID NO: 7168344 - DNA, 22 bp, Homo sapiens
tcactgggtaggacatgctgat

SEQ ID NO: 7168345 - DNA, 22 bp, Homo sapiens
tcactgggtaggacatgctgat

SEQ ID NO: 7168346 - DNA, 22 bp, Homo sapiens
tcactggggcccacatcaacat

SEQ ID NO: 7168347 - DNA, 22 bp, Homo sapiens
tcactggggcctttggtcagga

SEQ ID NO: 7168348 - DNA, 22 bp, Homo sapiens
tcactggggcctttggtcagga

SEQ ID NO: 7168349 - DNA, 22 bp, Homo sapiens
tcactggggcctttggtcagga

SEQ ID NO: 7168350 - DNA, 22 bp, Homo sapiens
tcactggggcctttggtcagga

SEQ ID NO: 7168351 - DNA, 22 bp, Homo sapiens
tcactgggtaggacatgctgat

SEQ ID NO: 7168352 - DNA, 22 bp, Homo sapiens
tcactgggtaggacatgctgat

SEQ ID NO: 7168353 - DNA, 20 bp, Homo sapiens
tcacatctggcagctgatga

SEQ ID NO: 7168354 - DNA, 20 bp, Homo sapiens
tcacatctggcagctgatga

SEQ ID NO: 7168355 - DNA, 22 bp, Homo sapiens
tcacatcttattagagtatctc

SEQ ID NO: 7168356 - DNA, 22 bp, Homo sapiens
tcacatgaaatgctgtaaagaa

SEQ ID NO: 7168357 - DNA, 18 bp, Homo sapiens
tcacatgacagctgttgc

SEQ ID NO: 7168358 - DNA, 22 bp, Homo sapiens
tcacatgaggttatgacaaagc

SEQ ID NO: 7168359 - DNA, 22 bp, Homo sapiens
tcacatgaggttatgacaaagc

SEQ ID NO: 7168360 - DNA, 22 bp, Homo sapiens
tcacatgagtattattttccaa

SEQ ID NO: 7168361 - DNA, 22 bp, Homo sapiens
tcacatgagtattattttccaa

SEQ ID NO: 7168362 - DNA, 22 bp, Homo sapiens
tcacatgagtattattttccaa

SEQ ID NO: 7168363 - DNA, 22 bp, Homo sapiens
tcacatgccacagatgaggcaa

SEQ ID NO: 7168364 - DNA, 21 bp, Homo sapiens
tcacatgcccattactggagc

SEQ ID NO: 7168365 - DNA, 21 bp, Homo sapiens
tcacatgcccattactggagc

SEQ ID NO: 7168366 - DNA, 22 bp, Homo sapiens
tcacatgccctacctaatctta

SEQ ID NO: 7168367 - DNA, 22 bp, Homo sapiens
tcacatgccctacctaatctta

SEQ ID NO: 7168368 - DNA, 22 bp, Homo sapiens
tcacatgcagtcactgagcagg

SEQ ID NO: 7168369 - DNA, 20 bp, Homo sapiens
tcacatgcatattcgtttct

SEQ ID NO: 7168370 - DNA, 20 bp, Homo sapiens
tcacatgcatattcgtttct

SEQ ID NO: 7168371 - DNA, 20 bp, Homo sapiens
tcacatgcatattcgtttct

SEQ ID NO: 7168372 - DNA, 22 bp, Homo sapiens
tcacatgccacagatgaggcaa

SEQ ID NO: 7168373 - DNA, 22 bp, Homo sapiens
tcacatgagtcactatcttaat

SEQ ID NO: 7168374 - DNA, 22 bp, Homo sapiens
tcacatgcacatacttcctgtg

SEQ ID NO: 7168375 - DNA, 22 bp, Homo sapiens
tcacatgcacatacttcctgtg

SEQ ID NO: 7168376 - DNA, 22 bp, Homo sapiens
tcacatgcacatacttcctgtg

SEQ ID NO: 7168377 - DNA, 22 bp, Homo sapiens
tcacatgcacatctctggaacc

SEQ ID NO: 7168378 - DNA, 22 bp, Homo sapiens
tcacatgcagtagcagggattg

SEQ ID NO: 7168379 - DNA, 22 bp, Homo sapiens
tcacatgcagtagcagggattg

SEQ ID NO: 7168380 - DNA, 22 bp, Homo sapiens
tcacatgcagtcactgagcagg

SEQ ID NO: 7168381 - DNA, 22 bp, Homo sapiens
tcacatgcagtcactgagcagg

SEQ ID NO: 7168382 - DNA, 22 bp, Homo sapiens
tcacccagggtgtttggtgtct

SEQ ID NO: 7168383 - DNA, 22 bp, Homo sapiens
tcacccagggtgtttggtgtct

SEQ ID NO: 7168384 - DNA, 22 bp, Homo sapiens
tcacccagggtgtttggtgtct

SEQ ID NO: 7168385 - DNA, 22 bp, Homo sapiens
tcacccaggtccaggctctggc

SEQ ID NO: 7168386 - DNA, 22 bp, Homo sapiens
tcacccaggtaatagcagtttg

SEQ ID NO: 7168387 - DNA, 22 bp, Homo sapiens
tcacccaggtaatagcagtttg

SEQ ID NO: 7168388 - DNA, 22 bp, Homo sapiens
tcacccaggtccaggctctggc

SEQ ID NO: 7168389 - DNA, 22 bp, Homo sapiens
tcacccaggtccaggctctggc

SEQ ID NO: 7168390 - DNA, 22 bp, Homo sapiens
tcacatgccctgtatttaccag

SEQ ID NO: 7168391 - DNA, 22 bp, Homo sapiens
tcacatgccctgtatttaccag

SEQ ID NO: 7168392 - DNA, 22 bp, Homo sapiens
tcacatgccttttactctgcac

SEQ ID NO: 7168393 - DNA, 22 bp, Homo sapiens
tcacatgccttttactctgcac

SEQ ID NO: 7168394 - DNA, 22 bp, Homo sapiens
tcacccaggctggtgcgcagtg

SEQ ID NO: 7168395 - DNA, 22 bp, Homo sapiens
tcacccaggctggtgcgcagtg

SEQ ID NO: 7168396 - DNA, 22 bp, Homo sapiens
tcacccaggctggtgcgcagtg

SEQ ID NO: 7168397 - DNA, 22 bp, Homo sapiens
tcacccagggactgtgatggaa

SEQ ID NO: 7168398 - DNA, 22 bp, Homo sapiens
tcacccagggactgtgatggaa

SEQ ID NO: 7168399 - DNA, 22 bp, Homo sapiens
tcacccagggactgtgatggaa

SEQ ID NO: 7168400 - DNA, 22 bp, Homo sapiens
tcacccagggactgtgatggaa

SEQ ID NO: 7168401 - DNA, 22 bp, Homo sapiens
tcaccgaggctggagtgcagtg

SEQ ID NO: 7168402 - DNA, 22 bp, Homo sapiens
tcaccgaggctggagtgcagtg

SEQ ID NO: 7168403 - DNA, 22 bp, Homo sapiens
tcaccggtgaccctcggctcgc

SEQ ID NO: 7168404 - DNA, 17 bp, Homo sapiens
tcaccgtttggctttcc

SEQ ID NO: 7168405 - DNA, 22 bp, Homo sapiens
tcacccaggtccaggctctggc

SEQ ID NO: 7168406 - DNA, 22 bp, Homo sapiens
tcacccaggtccaggctctggc

SEQ ID NO: 7168407 - DNA, 22 bp, Homo sapiens
tcaccccaaagttgagtttgat

SEQ ID NO: 7168408 - DNA, 22 bp, Homo sapiens
tcaccccctgtattagtagcta

SEQ ID NO: 7168409 - DNA, 22 bp, Homo sapiens
tcacccctacatttcccttgct

SEQ ID NO: 7168410 - DNA, 22 bp, Homo sapiens
tcacccctacatttcccttgct

SEQ ID NO: 7168411 - DNA, 22 bp, Homo sapiens
tcacccctaccaaggagcactg

SEQ ID NO: 7168412 - DNA, 22 bp, Homo sapiens
tcacctgtattaatacagaact

SEQ ID NO: 7168413 - DNA, 22 bp, Homo sapiens
tcacctgggagggctgtggtag

SEQ ID NO: 7168414 - DNA, 22 bp, Homo sapiens
tcacctgggagggctgtggtag

SEQ ID NO: 7168415 - DNA, 22 bp, Homo sapiens
tcaccttagctagaggaagaga

SEQ ID NO: 7168416 - DNA, 22 bp, Homo sapiens
tcaccttgtgatccgcccacct

SEQ ID NO: 7168417 - DNA, 22 bp, Homo sapiens
tcacctctactcagcctagttc

SEQ ID NO: 7168418 - DNA, 21 bp, Homo sapiens
tcacctggcttctgacctggc

SEQ ID NO: 7168419 - DNA, 22 bp, Homo sapiens
tcacctcaccacccttatggtt

SEQ ID NO: 7168420 - DNA, 22 bp, Homo sapiens
tcacctcagagattattttgaa

SEQ ID NO: 7168421 - DNA, 22 bp, Homo sapiens
tcacgagaggcacagaatagag

SEQ ID NO: 7168422 - DNA, 20 bp, Homo sapiens
tcacctttgttggtattcat

SEQ ID NO: 7168423 - DNA, 22 bp, Homo sapiens
tcaccttgtgatctccctgcct

SEQ ID NO: 7168424 - DNA, 22 bp, Homo sapiens
tcaccttgtgatccgcccacct

SEQ ID NO: 7168425 - DNA, 22 bp, Homo sapiens
tcaccttgtgatctccctgcct

SEQ ID NO: 7168426 - DNA, 22 bp, Homo sapiens
tcacgagaggcacagaatagag

SEQ ID NO: 7168427 - DNA, 22 bp, Homo sapiens
tcacggacctaagaggaagatt

SEQ ID NO: 7168428 - DNA, 21 bp, Homo sapiens
tcacgtggtcacatgagcttt

SEQ ID NO: 7168429 - DNA, 21 bp, Homo sapiens
tcacgtggtcacatgagcttt

SEQ ID NO: 7168430 - DNA, 22 bp, Homo sapiens
tcagtggggtcgatgtgaggga

SEQ ID NO: 7168431 - DNA, 22 bp, Homo sapiens
tcagtggtaccaagggggctgg

SEQ ID NO: 7168432 - DNA, 22 bp, Homo sapiens
tcagtggtatgcgtgggagctg

SEQ ID NO: 7168433 - DNA, 22 bp, Homo sapiens
tcagtggtatgcgtgggagctg

SEQ ID NO: 7168434 - DNA, 22 bp, Homo sapiens
tcagttactcaacagaggtgga

SEQ ID NO: 7168435 - DNA, 22 bp, Homo sapiens
tcagtggattgacatgaaaaag

SEQ ID NO: 7168436 - DNA, 19 bp, Homo sapiens
tcagtggatgaacatgttt

SEQ ID NO: 7168437 - DNA, 22 bp, Homo sapiens
tcagtggatatttctgtggctg

SEQ ID NO: 7168438 - DNA, 22 bp, Homo sapiens
tcagtggagtatggatgaagtc

SEQ ID NO: 7168439 - DNA, 22 bp, Homo sapiens
tcagtggagctaagcatgagat

SEQ ID NO: 7168440 - DNA, 22 bp, Homo sapiens
tcagtggattgtagaaggctta

SEQ ID NO: 7168441 - DNA, 22 bp, Homo sapiens
tcagtggattggatgagatctg

SEQ ID NO: 7168442 - DNA, 22 bp, Homo sapiens
tcagtgggagcaggagagtgac

SEQ ID NO: 7168443 - DNA, 22 bp, Homo sapiens
tcagtgggagcaggagagtgac

SEQ ID NO: 7168444 - DNA, 20 bp, Homo sapiens
tcagtgggaaagtgagagtg

SEQ ID NO: 7168445 - DNA, 22 bp, Homo sapiens
tcagtggagagcttccaggatt

SEQ ID NO: 7168446 - DNA, 19 bp, Homo sapiens
tcagtggagaaaggggaag

SEQ ID NO: 7168447 - DNA, 22 bp, Homo sapiens
tcagtggaactgtctgggtgag

SEQ ID NO: 7168448 - DNA, 22 bp, Homo sapiens
tcagtgcttttgtcacatggtc

SEQ ID NO: 7168449 - DNA, 23 bp, Homo sapiens
tcagtgcttgggggtgacgcgcc

SEQ ID NO: 7168450 - DNA, 22 bp, Homo sapiens
tcagtgcttgcctctggaggag

SEQ ID NO: 7168451 - DNA, 22 bp, Homo sapiens
tcagtgcttttgagaagctcct

SEQ ID NO: 7168452 - DNA, 22 bp, Homo sapiens
tcagtgcttttgagaagctcct

SEQ ID NO: 7168453 - DNA, 22 bp, Homo sapiens
tcagtgcttcctggaggaagcc

SEQ ID NO: 7168454 - DNA, 22 bp, Homo sapiens
tcagtgcttcctggaggaagcc

SEQ ID NO: 7168455 - DNA, 22 bp, Homo sapiens
tcagtgcttcggcgagcaccta

SEQ ID NO: 7168456 - DNA, 22 bp, Homo sapiens
tcagtgcttcggcgagcaccta

SEQ ID NO: 7168457 - DNA, 22 bp, Homo sapiens
tcagtgcttgacagctctggga

SEQ ID NO: 7168458 - DNA, 22 bp, Homo sapiens
tcagtgcttgacagctctggga

SEQ ID NO: 7168459 - DNA, 22 bp, Homo sapiens
tcagtgcttgcctctggaggag

SEQ ID NO: 7168460 - DNA, 22 bp, Homo sapiens
tcagttttaaggtttgagaatt

SEQ ID NO: 7168461 - DNA, 22 bp, Homo sapiens
tcagttttaaggtttgagaatt

SEQ ID NO: 7168462 - DNA, 22 bp, Homo sapiens
tcagttttcatttcatgagcag

SEQ ID NO: 7168463 - DNA, 22 bp, Homo sapiens
tcagttcctgttgcacagcatc

SEQ ID NO: 7168464 - DNA, 22 bp, Homo sapiens
tcagttcctgttgcacagcatc

SEQ ID NO: 7168465 - DNA, 22 bp, Homo sapiens
tcagttcctctgcccaaggcag

SEQ ID NO: 7168466 - DNA, 22 bp, Homo sapiens
tcagttcagtatacactattct

SEQ ID NO: 7168467 - DNA, 21 bp, Homo sapiens
tcagttcctaagggaggccgc

SEQ ID NO: 7168468 - DNA, 22 bp, Homo sapiens
tcagtttcctggttttgacatt

SEQ ID NO: 7168469 - DNA, 22 bp, Homo sapiens
tcataaaaatagactctaaagt

SEQ ID NO: 7168470 - DNA, 22 bp, Homo sapiens
tcataaaaatagactctaaagt

SEQ ID NO: 7168471 - DNA, 22 bp, Homo sapiens
tcataaaaatagactctaaagt

SEQ ID NO: 7168472 - DNA, 22 bp, Homo sapiens
tcataaaaatagactctaaagt

SEQ ID NO: 7168473 - DNA, 19 bp, Homo sapiens
tcataaaaatggtaaccca

SEQ ID NO: 7168474 - DNA, 22 bp, Homo sapiens
tcataaaacacaccaggtagtt

SEQ ID NO: 7168475 - DNA, 22 bp, Homo sapiens
tcataaaacacaccaggtagtt

SEQ ID NO: 7168476 - DNA, 22 bp, Homo sapiens
tcagttttgaaaacattgaatg

SEQ ID NO: 7168477 - DNA, 22 bp, Homo sapiens
tcagttttgattcctggttctc

SEQ ID NO: 7168478 - DNA, 22 bp, Homo sapiens
tcagttttctcatctgtgaaat

SEQ ID NO: 7168479 - DNA, 22 bp, Homo sapiens
tcagttttctcatctgtaattt

SEQ ID NO: 7168480 - DNA, 22 bp, Homo sapiens
tcatctccatacggtctcgcag

SEQ ID NO: 7168481 - DNA, 22 bp, Homo sapiens
tcatctcctcatgtatctggga

SEQ ID NO: 7168482 - DNA, 22 bp, Homo sapiens
tcatctctcaggataccagcag

SEQ ID NO: 7168483 - DNA, 22 bp, Homo sapiens
tcatctctccccagtgtcttta

SEQ ID NO: 7168484 - DNA, 20 bp, Homo sapiens
tcatggctgctgagaggttc

SEQ ID NO: 7168485 - DNA, 22 bp, Homo sapiens
tcatctaatagctggaaaagaa

SEQ ID NO: 7168486 - DNA, 22 bp, Homo sapiens
tcatctaattttggaacagaga

SEQ ID NO: 7168487 - DNA, 22 bp, Homo sapiens
tcatctcagagaggtatgttag

SEQ ID NO: 7168488 - DNA, 22 bp, Homo sapiens
tcatctcagggcgacatcatgt

SEQ ID NO: 7168489 - DNA, 22 bp, Homo sapiens
tcatctcagggcgacatcatgt

SEQ ID NO: 7168490 - DNA, 22 bp, Homo sapiens
tcatccttttgcatgggaaggc

SEQ ID NO: 7168491 - DNA, 20 bp, Homo sapiens
tcatccttggcctctaccca

SEQ ID NO: 7168492 - DNA, 22 bp, Homo sapiens
tcatcctgtatcctcagaccat

SEQ ID NO: 7168493 - DNA, 22 bp, Homo sapiens
tcatccagtatgactggtgtct

SEQ ID NO: 7168494 - DNA, 22 bp, Homo sapiens
tcatccagtatgactggtgtct

SEQ ID NO: 7168495 - DNA, 22 bp, Homo sapiens
tcatccagttgtggagagggaa

SEQ ID NO: 7168496 - DNA, 22 bp, Homo sapiens
tcatccatactattgagaggca

SEQ ID NO: 7168497 - DNA, 22 bp, Homo sapiens
tcatccatactattgagaggca

SEQ ID NO: 7168498 - DNA, 22 bp, Homo sapiens
tcatccatatagaaagatgatt

SEQ ID NO: 7168499 - DNA, 22 bp, Homo sapiens
tcatccatctttgatttcatag

SEQ ID NO: 7168500 - DNA, 22 bp, Homo sapiens
tcatccatgaagagtgacagaa

SEQ ID NO: 7168501 - DNA, 22 bp, Homo sapiens
tcatccatctttgatttcatag

SEQ ID NO: 7168502 - DNA, 22 bp, Homo sapiens
tcatccatgtcagagcatgtat

SEQ ID NO: 7168503 - DNA, 22 bp, Homo sapiens
tcatccattgtcctcacattag

SEQ ID NO: 7168504 - DNA, 22 bp, Homo sapiens
tcatcccagtgtccatgctcag

SEQ ID NO: 7168505 - DNA, 22 bp, Homo sapiens
tcatccctaaggacagctctgc

SEQ ID NO: 7168506 - DNA, 22 bp, Homo sapiens
tcatccctctgccaggcccagg

SEQ ID NO: 7168507 - DNA, 22 bp, Homo sapiens
tcatcctgaagaacctgcttcc

SEQ ID NO: 7168508 - DNA, 22 bp, Homo sapiens
tcatcctgcactggctcctcct

SEQ ID NO: 7168509 - DNA, 20 bp, Homo sapiens
tcatccaggacaggagtggc

SEQ ID NO: 7168510 - DNA, 21 bp, Homo sapiens
tcatccaggtcctgcttcttc

SEQ ID NO: 7168511 - DNA, 22 bp, Homo sapiens
tcatccagtaccatggaaggca

SEQ ID NO: 7168512 - DNA, 22 bp, Homo sapiens
tcatccagtaccatggaaggca

SEQ ID NO: 7168513 - DNA, 22 bp, Homo sapiens
tcatccagagcttcataagtaa

SEQ ID NO: 7168514 - DNA, 22 bp, Homo sapiens
tcatccaggaaaagatttggaa

SEQ ID NO: 7168515 - DNA, 20 bp, Homo sapiens
tcatccaggacaggagtggc

SEQ ID NO: 7168516 - DNA, 22 bp, Homo sapiens
tcatattttgcaaggtcagcta

SEQ ID NO: 7168517 - DNA, 20 bp, Homo sapiens
tcatatttttgccctgggcc

SEQ ID NO: 7168518 - DNA, 22 bp, Homo sapiens
tcatcaaaagccttctgggtta

SEQ ID NO: 7168519 - DNA, 23 bp, Homo sapiens
tcatcaaacagctgctcaagaaa

SEQ ID NO: 7168520 - DNA, 22 bp, Homo sapiens
tcatcaaagcgcttggagtagg

SEQ ID NO: 7168521 - DNA, 22 bp, Homo sapiens
tcatcaaaggattgcatgattt

SEQ ID NO: 7168522 - DNA, 22 bp, Homo sapiens
tcatcaaaggattgcatgattt

SEQ ID NO: 7168523 - DNA, 22 bp, Homo sapiens
tcatcatctgggcttgggggtg

SEQ ID NO: 7168524 - DNA, 22 bp, Homo sapiens
tcatcatgtttgatttccacag

SEQ ID NO: 7168525 - DNA, 22 bp, Homo sapiens
tcatatttgggggtgtgtgttt

SEQ ID NO: 7168526 - DNA, 22 bp, Homo sapiens
tcataaagagtgctgttgtttt

SEQ ID NO: 7168527 - DNA, 22 bp, Homo sapiens
tcataaagatactaagtgagtt

SEQ ID NO: 7168528 - DNA, 22 bp, Homo sapiens
tcataaagcatttcagcttttg

SEQ ID NO: 7168529 - DNA, 20 bp, Homo sapiens
tcataaagaggaaataaata

SEQ ID NO: 7168530 - DNA, 20 bp, Homo sapiens
tcataaagaggaaataaata

SEQ ID NO: 7168531 - DNA, 22 bp, Homo sapiens
tcataaacaaaacagtttatgc

SEQ ID NO: 7168532 - DNA, 22 bp, Homo sapiens
tcataaacaaaacagtttatgc

SEQ ID NO: 7168533 - DNA, 22 bp, Homo sapiens
tcataaacacactagtatgatt

SEQ ID NO: 7168534 - DNA, 22 bp, Homo sapiens
tcataaactcactagtttatgt

SEQ ID NO: 7168535 - DNA, 22 bp, Homo sapiens
tcataaactcactagtttatgt

SEQ ID NO: 7168536 - DNA, 22 bp, Homo sapiens
tcataaaagtactcatgttcat

SEQ ID NO: 7168537 - DNA, 22 bp, Homo sapiens
tcataaaagtactcatgttcat

SEQ ID NO: 7168538 - DNA, 22 bp, Homo sapiens
tcataaaatgctcctgatattg

SEQ ID NO: 7168539 - DNA, 22 bp, Homo sapiens
tcaggggaaatctctcagcgaa

SEQ ID NO: 7168540 - DNA, 22 bp, Homo sapiens
tcaggggaaatctctcagcgaa

SEQ ID NO: 7168541 - DNA, 22 bp, Homo sapiens
tcaggggacagccagctggagg

SEQ ID NO: 7168542 - DNA, 22 bp, Homo sapiens
tcaggggacttaggagagaagt

SEQ ID NO: 7168543 - DNA, 22 bp, Homo sapiens
tcaggggacttaggagagaagt

SEQ ID NO: 7168544 - DNA, 22 bp, Homo sapiens
tcaggggcagctgtgctttgtg

SEQ ID NO: 7168545 - DNA, 22 bp, Homo sapiens
tcaggggcagccggggaagcca

SEQ ID NO: 7168546 - DNA, 22 bp, Homo sapiens
tcaggggacttaggagagaagt

SEQ ID NO: 7168547 - DNA, 22 bp, Homo sapiens
tcaggggcttgaggtgcatgtc

SEQ ID NO: 7168548 - DNA, 22 bp, Homo sapiens
tcaggggcttgaggtgcatgtc

SEQ ID NO: 7168549 - DNA, 21 bp, Homo sapiens
tcaggggctgtgttttccatc

SEQ ID NO: 7168550 - DNA, 22 bp, Homo sapiens
tcaggggctgtgcatttcccag

SEQ ID NO: 7168551 - DNA, 22 bp, Homo sapiens
tcaggggctgtgcatttcccag

SEQ ID NO: 7168552 - DNA, 22 bp, Homo sapiens
tcaggggcccttccctcagcag

SEQ ID NO: 7168553 - DNA, 22 bp, Homo sapiens
tcagggctgccgggcagaccgt

SEQ ID NO: 7168554 - DNA, 22 bp, Homo sapiens
tcagggcagcctaaggcacctc

SEQ ID NO: 7168555 - DNA, 22 bp, Homo sapiens
tcagggcagcctaaggcacctc

SEQ ID NO: 7168556 - DNA, 21 bp, Homo sapiens
tcagggcagctgctcttcaga

SEQ ID NO: 7168557 - DNA, 21 bp, Homo sapiens
tcagggcagctgctcttcaga

SEQ ID NO: 7168558 - DNA, 22 bp, Homo sapiens
tcagggcaccaaaaaagatgcc

SEQ ID NO: 7168559 - DNA, 22 bp, Homo sapiens
tcagggcacgtttctgcaatgc

SEQ ID NO: 7168560 - DNA, 22 bp, Homo sapiens
tcagggcacgtttctgcaatgc

SEQ ID NO: 7168561 - DNA, 22 bp, Homo sapiens
tcagggcacgtttctgcaatgc

SEQ ID NO: 7168562 - DNA, 22 bp, Homo sapiens
tcagggcactgtcacctgatat

SEQ ID NO: 7168563 - DNA, 22 bp, Homo sapiens
tcagggcactgtcacctgatat

SEQ ID NO: 7168564 - DNA, 22 bp, Homo sapiens
tcagggcactgtcacctgatat

SEQ ID NO: 7168565 - DNA, 22 bp, Homo sapiens
tcagggcagaatccaaagaatt

SEQ ID NO: 7168566 - DNA, 22 bp, Homo sapiens
tcagggcagaatccaaagaatt

SEQ ID NO: 7168567 - DNA, 22 bp, Homo sapiens
tcagggcagaatccaaagaatt

SEQ ID NO: 7168568 - DNA, 22 bp, Homo sapiens
tcagggcagaatccaaagaatt

SEQ ID NO: 7168569 - DNA, 16 bp, Homo sapiens
tcagggcagaatggca

SEQ ID NO: 7168570 - DNA, 16 bp, Homo sapiens
tcagggcagaatggca

SEQ ID NO: 7168571 - DNA, 22 bp, Homo sapiens
tcagggcagcctaaggcacctc

SEQ ID NO: 7168572 - DNA, 22 bp, Homo sapiens
tcaggtccaagatggccatcca

SEQ ID NO: 7168573 - DNA, 22 bp, Homo sapiens
tcaggtcccactgctagtaagt

SEQ ID NO: 7168574 - DNA, 20 bp, Homo sapiens
tcaggtagatctttgaggtc

SEQ ID NO: 7168575 - DNA, 22 bp, Homo sapiens
tcaggtcatctgtctctgggct

SEQ ID NO: 7168576 - DNA, 22 bp, Homo sapiens
tcaggtcatctgtctctgggct

SEQ ID NO: 7168577 - DNA, 22 bp, Homo sapiens
tcagggttgtgaaggaaagggg

SEQ ID NO: 7168578 - DNA, 22 bp, Homo sapiens
tcagggttgtggtggaattcag

SEQ ID NO: 7168579 - DNA, 22 bp, Homo sapiens
tcaggtaagtgtaatatataga

SEQ ID NO: 7168580 - DNA, 22 bp, Homo sapiens
tcaggtactgcagggcacgcag

SEQ ID NO: 7168581 - DNA, 22 bp, Homo sapiens
tcaggtacttaagactctttag

SEQ ID NO: 7168582 - DNA, 22 bp, Homo sapiens
tcagggtatgttctagatctga

SEQ ID NO: 7168583 - DNA, 22 bp, Homo sapiens
tcagggtcagattccagagcct

SEQ ID NO: 7168584 - DNA, 22 bp, Homo sapiens
tcagggggaggagactgccagt

SEQ ID NO: 7168585 - DNA, 22 bp, Homo sapiens
tcagggggaggagactgccagt

SEQ ID NO: 7168586 - DNA, 22 bp, Homo sapiens
tcagggtgaaccaggcaggaat

SEQ ID NO: 7168587 - DNA, 22 bp, Homo sapiens
tcagggtgaaccaggcaggaat

SEQ ID NO: 7168588 - DNA, 22 bp, Homo sapiens
tcagggtgaaattgggtcctgg

SEQ ID NO: 7168589 - DNA, 22 bp, Homo sapiens
tcagggtgaaccaggcaggaat

SEQ ID NO: 7168590 - DNA, 22 bp, Homo sapiens
tcaggtggagacctccttggcc

SEQ ID NO: 7168591 - DNA, 22 bp, Homo sapiens
tcagtgcagtgaaaggtttact

SEQ ID NO: 7168592 - DNA, 22 bp, Homo sapiens
tcagtgcagtgaaaggtttact

SEQ ID NO: 7168593 - DNA, 22 bp, Homo sapiens
tcagtgcatcacagaactttgt

SEQ ID NO: 7168594 - DNA, 22 bp, Homo sapiens
tcaggtgacctgagccactatg

SEQ ID NO: 7168595 - DNA, 22 bp, Homo sapiens
tcaggtggaattaattaagaga

SEQ ID NO: 7168596 - DNA, 22 bp, Homo sapiens
tcagtgcatggacagatttaga

SEQ ID NO: 7168597 - DNA, 22 bp, Homo sapiens
tcagtgcatggacagatttaga

SEQ ID NO: 7168598 - DNA, 22 bp, Homo sapiens
tcagtgcattaataatatcagt

SEQ ID NO: 7168599 - DNA, 22 bp, Homo sapiens
tcagtgcattcatgggtggctg

SEQ ID NO: 7168600 - DNA, 22 bp, Homo sapiens
tcaggtcctctgggtcccagcc

SEQ ID NO: 7168601 - DNA, 22 bp, Homo sapiens
tcaggtcctctgggtcccagcc

SEQ ID NO: 7168602 - DNA, 22 bp, Homo sapiens
tcaggtccttactgtgctccct

SEQ ID NO: 7168603 - DNA, 22 bp, Homo sapiens
tcaggctgaatcatcctagctt

SEQ ID NO: 7168604 - DNA, 22 bp, Homo sapiens
tcaggctgaatcatcctagctt

SEQ ID NO: 7168605 - DNA, 22 bp, Homo sapiens
tcaggctgaatcatcctagctt

SEQ ID NO: 7168606 - DNA, 22 bp, Homo sapiens
tcaggctgaaggaggcctatct

SEQ ID NO: 7168607 - DNA, 22 bp, Homo sapiens
tcaggctgaaggaggcctatct

SEQ ID NO: 7168608 - DNA, 22 bp, Homo sapiens
tcaggctgaaggaggcctatct

SEQ ID NO: 7168609 - DNA, 22 bp, Homo sapiens
tcaggctgaaggaggcctatct

SEQ ID NO: 7168610 - DNA, 22 bp, Homo sapiens
tcaggctgaaaggactccagtt

SEQ ID NO: 7168611 - DNA, 22 bp, Homo sapiens
tcaggctgaaaggactccagtt

SEQ ID NO: 7168612 - DNA, 22 bp, Homo sapiens
tcaggctgaaaggactccagtt

SEQ ID NO: 7168613 - DNA, 22 bp, Homo sapiens
tcaggctctgggtacacctgac

SEQ ID NO: 7168614 - DNA, 22 bp, Homo sapiens
tcaggctctgggtacacctgac

SEQ ID NO: 7168615 - DNA, 22 bp, Homo sapiens
tcaggctctgggtacacctgac

SEQ ID NO: 7168616 - DNA, 22 bp, Homo sapiens
tcaggctctgggtacacctgac

SEQ ID NO: 7168617 - DNA, 22 bp, Homo sapiens
tcaggctctgggtacacctgac

SEQ ID NO: 7168618 - DNA, 22 bp, Homo sapiens
tcaggctgaaaggactccagtt

SEQ ID NO: 7168619 - DNA, 22 bp, Homo sapiens
tcaggctgaaaggactccagtt

SEQ ID NO: 7168620 - DNA, 22 bp, Homo sapiens
tcaggctctgagctgatgctaa

SEQ ID NO: 7168621 - DNA, 22 bp, Homo sapiens
tcaggctctgagctgatgctaa

SEQ ID NO: 7168622 - DNA, 22 bp, Homo sapiens
tcaggctctgagctgatgctaa

SEQ ID NO: 7168623 - DNA, 22 bp, Homo sapiens
tcaggctctgagctgatgctaa

SEQ ID NO: 7168624 - DNA, 22 bp, Homo sapiens
tcaggctctgccacctagatta

SEQ ID NO: 7168625 - DNA, 22 bp, Homo sapiens
tcaggctctgccacctagatta

SEQ ID NO: 7168626 - DNA, 22 bp, Homo sapiens
tcaggctctgccacctagatta

SEQ ID NO: 7168627 - DNA, 22 bp, Homo sapiens
tcaggctctgccacctagatta

SEQ ID NO: 7168628 - DNA, 22 bp, Homo sapiens
tcaggcgaggcttaatccaagg

SEQ ID NO: 7168629 - DNA, 22 bp, Homo sapiens
tcaggcctttgaacttggagtg

SEQ ID NO: 7168630 - DNA, 22 bp, Homo sapiens
tcaggctcaaagggccggatga

SEQ ID NO: 7168631 - DNA, 22 bp, Homo sapiens
tcaggctcaaagggccggatga

SEQ ID NO: 7168632 - DNA, 22 bp, Homo sapiens
tcaggctcaggaatgtgtttat

SEQ ID NO: 7168633 - DNA, 22 bp, Homo sapiens
tcaggctcaggaatgtgtttat

SEQ ID NO: 7168634 - DNA, 22 bp, Homo sapiens
tcaggctcaggttaggggccaa

SEQ ID NO: 7168635 - DNA, 22 bp, Homo sapiens
tcaggctccctgctgggctctg

SEQ ID NO: 7168636 - DNA, 22 bp, Homo sapiens
tcaggctccctgctgggctctg

SEQ ID NO: 7168637 - DNA, 20 bp, Homo sapiens
tcaggctccgcattaactta

SEQ ID NO: 7168638 - DNA, 20 bp, Homo sapiens
tcaggctccgcattaactta

SEQ ID NO: 7168639 - DNA, 22 bp, Homo sapiens
tcaggctctacacttgacacac

SEQ ID NO: 7168640 - DNA, 22 bp, Homo sapiens
tcaggctctacacttgacacac

SEQ ID NO: 7168641 - DNA, 22 bp, Homo sapiens
tcaggctctcagaccaacagca

SEQ ID NO: 7168642 - DNA, 22 bp, Homo sapiens
tcaggctctcagaccaacagca

SEQ ID NO: 7168643 - DNA, 22 bp, Homo sapiens
tcaggctctcagaccaacagca

SEQ ID NO: 7168644 - DNA, 18 bp, Homo sapiens
tcaggctctctggctaga

SEQ ID NO: 7168645 - DNA, 18 bp, Homo sapiens
tcaggctctctggctaga

SEQ ID NO: 7168646 - DNA, 18 bp, Homo sapiens
tcaggctctctggctaga

SEQ ID NO: 7168647 - DNA, 22 bp, Homo sapiens
tcaggctgaggtcatctgcatc

SEQ ID NO: 7168648 - DNA, 22 bp, Homo sapiens
tcagggactaggtgctgcctga

SEQ ID NO: 7168649 - DNA, 22 bp, Homo sapiens
tcagggactaggtgctgcctga

SEQ ID NO: 7168650 - DNA, 22 bp, Homo sapiens
tcaggctgagaaaatctggacc

SEQ ID NO: 7168651 - DNA, 22 bp, Homo sapiens
tcaggctgagaaaatctggacc

SEQ ID NO: 7168652 - DNA, 22 bp, Homo sapiens
tcaggctgaccaggttttgctc

SEQ ID NO: 7168653 - DNA, 22 bp, Homo sapiens
tcagggacttacaaaccagaag

SEQ ID NO: 7168654 - DNA, 22 bp, Homo sapiens
tcagggacttacaaaccagaag

SEQ ID NO: 7168655 - DNA, 22 bp, Homo sapiens
tcagggagagcctgtctgacgt

SEQ ID NO: 7168656 - DNA, 22 bp, Homo sapiens
tcagggactaggtgctgcctga

SEQ ID NO: 7168657 - DNA, 22 bp, Homo sapiens
tcagggactgcagagggaagct

SEQ ID NO: 7168658 - DNA, 22 bp, Homo sapiens
tcagggactgcagagggaagct

SEQ ID NO: 7168659 - DNA, 22 bp, Homo sapiens
tcagggactgttactgcctttg

SEQ ID NO: 7168660 - DNA, 22 bp, Homo sapiens
tcagggagagcctgtctgacgt

SEQ ID NO: 7168661 - DNA, 22 bp, Homo sapiens
tcagggcaaaagggaaaccatt

SEQ ID NO: 7168662 - DNA, 22 bp, Homo sapiens
tcagggcaaaagggaaaccatt

SEQ ID NO: 7168663 - DNA, 22 bp, Homo sapiens
tcagggcaaaagggaaaccatt

SEQ ID NO: 7168664 - DNA, 22 bp, Homo sapiens
tcagggcaaaagggaaaccatt

SEQ ID NO: 7168665 - DNA, 22 bp, Homo sapiens
tcagggcaaaagggaaaccatt

SEQ ID NO: 7168666 - DNA, 22 bp, Homo sapiens
tcagggcacattctgcagtggc

SEQ ID NO: 7168667 - DNA, 22 bp, Homo sapiens
tcagggcacattctgcagtggc

SEQ ID NO: 7168668 - DNA, 22 bp, Homo sapiens
tcagggcaatgtccctcagaag

SEQ ID NO: 7168669 - DNA, 22 bp, Homo sapiens
tcagggcacaggcctgtgggtt

SEQ ID NO: 7168670 - DNA, 22 bp, Homo sapiens
tcagggcacaggcctgtgggtt

SEQ ID NO: 7168671 - DNA, 22 bp, Homo sapiens
tcagggcacattctgcagtggc

SEQ ID NO: 7168672 - DNA, 22 bp, Homo sapiens
tcagggcacattctgcagtggc

SEQ ID NO: 7168673 - DNA, 22 bp, Homo sapiens
tcagggcaccaaaaaagatgcc

SEQ ID NO: 7168674 - DNA, 22 bp, Homo sapiens
tcagggcaccaaaaaagatgcc

SEQ ID NO: 7168675 - DNA, 22 bp, Homo sapiens
tcagggcaaagggcagagtttg

SEQ ID NO: 7168676 - DNA, 22 bp, Homo sapiens
tcagggcaaagggcagagtttg

SEQ ID NO: 7168677 - DNA, 22 bp, Homo sapiens
tcagggcaaagggcagagtttg

SEQ ID NO: 7168678 - DNA, 22 bp, Homo sapiens
tcagggcaagattggttaataa

SEQ ID NO: 7168679 - DNA, 22 bp, Homo sapiens
tcagggcaagattggttaataa

SEQ ID NO: 7168680 - DNA, 22 bp, Homo sapiens
tcagggcaagtctcagaaggtt

SEQ ID NO: 7168681 - DNA, 22 bp, Homo sapiens
tcagggcaagattggttaataa

SEQ ID NO: 7168682 - DNA, 22 bp, Homo sapiens
tcagggcaagtctcagaaggtt

SEQ ID NO: 7168683 - DNA, 22 bp, Homo sapiens
tcagggcaagtctcagaaggtt

SEQ ID NO: 7168684 - DNA, 22 bp, Homo sapiens
tcagggcaatgtccctcagaag

SEQ ID NO: 7168685 - DNA, 22 bp, Homo sapiens
tcagggcaatgtccctcagaag

SEQ ID NO: 7168686 - DNA, 22 bp, Homo sapiens
tcagctttctctcgccatcagg

SEQ ID NO: 7168687 - DNA, 22 bp, Homo sapiens
tcagctttctcagaggcctaac

SEQ ID NO: 7168688 - DNA, 22 bp, Homo sapiens
tcaggaaagagttagatgatta

SEQ ID NO: 7168689 - DNA, 22 bp, Homo sapiens
tcaggaaagagttagatgatta

SEQ ID NO: 7168690 - DNA, 22 bp, Homo sapiens
tcaggaaagagttagatgatta

SEQ ID NO: 7168691 - DNA, 22 bp, Homo sapiens
tcaggaaagagtgtatccatca

SEQ ID NO: 7168692 - DNA, 22 bp, Homo sapiens
tcaggaaagagtgtatccatca

SEQ ID NO: 7168693 - DNA, 22 bp, Homo sapiens
tcaggaaaggtttgttgaatgg

SEQ ID NO: 7168694 - DNA, 22 bp, Homo sapiens
tcaggaaagcctagaagagaac

SEQ ID NO: 7168695 - DNA, 22 bp, Homo sapiens
tcaggaaagcctagaagagaac

SEQ ID NO: 7168696 - DNA, 22 bp, Homo sapiens
tcaggaaagcctagaagagaac

SEQ ID NO: 7168697 - DNA, 22 bp, Homo sapiens
tcaggaaagcctagaagagaac

SEQ ID NO: 7168698 - DNA, 22 bp, Homo sapiens
tcaggaaagtgttctcagagga

SEQ ID NO: 7168699 - DNA, 22 bp, Homo sapiens
tcaggaaatacaagtgacatca

SEQ ID NO: 7168700 - DNA, 22 bp, Homo sapiens
tcaggaaatggaattcttgtgt

SEQ ID NO: 7168701 - DNA, 22 bp, Homo sapiens
tcaggagagtgttcagtggagg

SEQ ID NO: 7168702 - DNA, 22 bp, Homo sapiens
tcaggaacacaggggcccatgc

SEQ ID NO: 7168703 - DNA, 22 bp, Homo sapiens
tcaggaaattaaacacttgaaa

SEQ ID NO: 7168704 - DNA, 22 bp, Homo sapiens
tcaggaaatggtgatttggttg

SEQ ID NO: 7168705 - DNA, 22 bp, Homo sapiens
tcaggaaatggacatctttgct

SEQ ID NO: 7168706 - DNA, 22 bp, Homo sapiens
tcaggaaatggacatctttgct

SEQ ID NO: 7168707 - DNA, 22 bp, Homo sapiens
tcaggaaatggtgatttggttg

SEQ ID NO: 7168708 - DNA, 22 bp, Homo sapiens
tcaggagcagcatgggtgagag

SEQ ID NO: 7168709 - DNA, 22 bp, Homo sapiens
tcaggagcaacatctttgaatc

SEQ ID NO: 7168710 - DNA, 22 bp, Homo sapiens
tcaggagcagccttggagagcg

SEQ ID NO: 7168711 - DNA, 22 bp, Homo sapiens
tcaggagcagctgtaggaaggg

SEQ ID NO: 7168712 - DNA, 22 bp, Homo sapiens
tcaggagatgtaaccttagctg

SEQ ID NO: 7168713 - DNA, 22 bp, Homo sapiens
tcaggagctgtgaatacaaagg

SEQ ID NO: 7168714 - DNA, 22 bp, Homo sapiens
tcaggagcttggtagtgtgatt

SEQ ID NO: 7168715 - DNA, 19 bp, Homo sapiens
tcaggagcagcttctgaac

SEQ ID NO: 7168716 - DNA, 22 bp, Homo sapiens
tcaggagcagggggaagctctg

SEQ ID NO: 7168717 - DNA, 22 bp, Homo sapiens
tcaggagcctgaaagaggtcta

SEQ ID NO: 7168718 - DNA, 20 bp, Homo sapiens
tcaggagcctaggacatgat

SEQ ID NO: 7168719 - DNA, 20 bp, Homo sapiens
tcaggagcctaggacatgat

SEQ ID NO: 7168720 - DNA, 22 bp, Homo sapiens
tcaggagcctgaaagaggtcta

SEQ ID NO: 7168721 - DNA, 22 bp, Homo sapiens
tcaggaggatgtcggcaaattt

SEQ ID NO: 7168722 - DNA, 22 bp, Homo sapiens
tcaggaggatgtcggcaaattt

SEQ ID NO: 7168723 - DNA, 22 bp, Homo sapiens
tcaggaggcaagtaggtattga

SEQ ID NO: 7168724 - DNA, 22 bp, Homo sapiens
tcaggagggagtgtggatagag

SEQ ID NO: 7168725 - DNA, 22 bp, Homo sapiens
tcaggagcttggtagtgtgatt

SEQ ID NO: 7168726 - DNA, 22 bp, Homo sapiens
tcaggaggacagataaggatag

SEQ ID NO: 7168727 - DNA, 22 bp, Homo sapiens
tcaggaggagctcataagtttg

SEQ ID NO: 7168728 - DNA, 22 bp, Homo sapiens
tcaggagggtctctattttcct

SEQ ID NO: 7168729 - DNA, 22 bp, Homo sapiens
tcaggagggtgacaggccctgg

SEQ ID NO: 7168730 - DNA, 22 bp, Homo sapiens
tcaggagggtgacaggccctgg

SEQ ID NO: 7168731 - DNA, 22 bp, Homo sapiens
tcaggagggattgttgcctatt

SEQ ID NO: 7168732 - DNA, 22 bp, Homo sapiens
tcaggagggattgttgcctatt

SEQ ID NO: 7168733 - DNA, 22 bp, Homo sapiens
tcaggagggctaagactgtagc

SEQ ID NO: 7168734 - DNA, 22 bp, Homo sapiens
tcaggcagtagaattgcttgaa

SEQ ID NO: 7168735 - DNA, 22 bp, Homo sapiens
tcaggccttgtcctgacctcct

SEQ ID NO: 7168736 - DNA, 22 bp, Homo sapiens
tcaggcaggttggctgcaggtc

SEQ ID NO: 7168737 - DNA, 22 bp, Homo sapiens
tcaggcaggttggctgcaggtc

SEQ ID NO: 7168738 - DNA, 22 bp, Homo sapiens
tcaggcaggtggctggctatgg

SEQ ID NO: 7168739 - DNA, 22 bp, Homo sapiens
tcaggcaggctcagaggaaaac

SEQ ID NO: 7168740 - DNA, 22 bp, Homo sapiens
tcaggcaggctcagaggaaaac

SEQ ID NO: 7168741 - DNA, 22 bp, Homo sapiens
tcaggcaggctcagaggaaaac

SEQ ID NO: 7168742 - DNA, 22 bp, Homo sapiens
tcaggcaggctcagaggaaaac

SEQ ID NO: 7168743 - DNA, 22 bp, Homo sapiens
tcaggcaggctcagaggaaaac

SEQ ID NO: 7168744 - DNA, 21 bp, Homo sapiens
tcaggcaggcgcagagggaag

SEQ ID NO: 7168745 - DNA, 21 bp, Homo sapiens
tcaggcaggcgcagagggaag

SEQ ID NO: 7168746 - DNA, 21 bp, Homo sapiens
tcaggcaggcgcagagggaag

SEQ ID NO: 7168747 - DNA, 21 bp, Homo sapiens
tcaggcaggcgcagagggaag

SEQ ID NO: 7168748 - DNA, 21 bp, Homo sapiens
tcaggcaggcgcagagggaag

SEQ ID NO: 7168749 - DNA, 22 bp, Homo sapiens
tcaggcaggcagagggcaaatg

SEQ ID NO: 7168750 - DNA, 21 bp, Homo sapiens
tcaggcaggcgcagagggaag

SEQ ID NO: 7168751 - DNA, 22 bp, Homo sapiens
tcaggcaggatcccagggaagg

SEQ ID NO: 7168752 - DNA, 22 bp, Homo sapiens
tcaggcaggcagagggcaaatg

SEQ ID NO: 7168753 - DNA, 22 bp, Homo sapiens
tcaggcaggatcccagggaagg

SEQ ID NO: 7168754 - DNA, 22 bp, Homo sapiens
tcaggcaggatcccagggaagg

SEQ ID NO: 7168755 - DNA, 22 bp, Homo sapiens
tcaggcaggacaattatttagg

SEQ ID NO: 7168756 - DNA, 22 bp, Homo sapiens
tcaggcaggacaattatttagg

SEQ ID NO: 7168757 - DNA, 22 bp, Homo sapiens
tcaggcaggaagggaggacttg

SEQ ID NO: 7168758 - DNA, 22 bp, Homo sapiens
tcaggcaggaagggaggacttg

SEQ ID NO: 7168759 - DNA, 22 bp, Homo sapiens
tcaggcaggaagggaggacttg

SEQ ID NO: 7168760 - DNA, 22 bp, Homo sapiens
tcaggcagctccaggaatggta

SEQ ID NO: 7168761 - DNA, 22 bp, Homo sapiens
tcaggcagcattaaacttcagc

SEQ ID NO: 7168762 - DNA, 22 bp, Homo sapiens
tcaggcagctccaggaatggta

SEQ ID NO: 7168763 - DNA, 22 bp, Homo sapiens
tcaggcagctccaggaatggta

SEQ ID NO: 7168764 - DNA, 22 bp, Homo sapiens
tcaggcaggaagcccctgcaca

SEQ ID NO: 7168765 - DNA, 22 bp, Homo sapiens
tcaggcagatgcagggatggat

SEQ ID NO: 7168766 - DNA, 22 bp, Homo sapiens
tcaggcagatgcagggatggat

SEQ ID NO: 7168767 - DNA, 22 bp, Homo sapiens
tcaggcagatgcagggatggat

SEQ ID NO: 7168768 - DNA, 22 bp, Homo sapiens
tcaggcagatgcagggatggat

SEQ ID NO: 7168769 - DNA, 22 bp, Homo sapiens
tcaggcagcattaaacttcagc

SEQ ID NO: 7168770 - DNA, 22 bp, Homo sapiens
tcaggcagcattaaacttcagc

SEQ ID NO: 7168771 - DNA, 22 bp, Homo sapiens
tcaggcagcattaaacttcagc

SEQ ID NO: 7168772 - DNA, 22 bp, Homo sapiens
tcaggcactgctttctgatatg

SEQ ID NO: 7168773 - DNA, 22 bp, Homo sapiens
tcaggcactgctttctgatatg

SEQ ID NO: 7168774 - DNA, 22 bp, Homo sapiens
tcaggcagaaaaatcactaatt

SEQ ID NO: 7168775 - DNA, 22 bp, Homo sapiens
tcaggcagagttaatttgctcc

SEQ ID NO: 7168776 - DNA, 22 bp, Homo sapiens
tcaggcagatgcagggatggat

SEQ ID NO: 7168777 - DNA, 22 bp, Homo sapiens
tcaggagggtgacaggccctgg

SEQ ID NO: 7168778 - DNA, 22 bp, Homo sapiens
tcaggaggtaaggtaaaacaga

SEQ ID NO: 7168779 - DNA, 22 bp, Homo sapiens
tcaggaggtaggacatactggt

SEQ ID NO: 7168780 - DNA, 22 bp, Homo sapiens
tcaggaggtaggacatactggt

SEQ ID NO: 7168781 - DNA, 22 bp, Homo sapiens
tcaggaggtaggacatactggt

SEQ ID NO: 7168782 - DNA, 22 bp, Homo sapiens
tcaggaggtccgcccgggaggg

SEQ ID NO: 7168783 - DNA, 22 bp, Homo sapiens
tcaggaggtccgcccgggaggg

SEQ ID NO: 7168784 - DNA, 22 bp, Homo sapiens
tcaggaggtccgcccgggaggg

SEQ ID NO: 7168785 - DNA, 19 bp, Homo sapiens
tcaggaggtcgacctggca

SEQ ID NO: 7168786 - DNA, 22 bp, Homo sapiens
tcaggcaatctgacagctggag

SEQ ID NO: 7168787 - DNA, 22 bp, Homo sapiens
tcaggcaatctgacagctggag

SEQ ID NO: 7168788 - DNA, 22 bp, Homo sapiens
tcaggcaccccttgagtagggg

SEQ ID NO: 7168789 - DNA, 22 bp, Homo sapiens
tcaggcaccttcctcttatctg

SEQ ID NO: 7168790 - DNA, 22 bp, Homo sapiens
tcaggaggtgtaacgaatacag

SEQ ID NO: 7168791 - DNA, 22 bp, Homo sapiens
tcaggaggtgtaacgaatacag

SEQ ID NO: 7168792 - DNA, 19 bp, Homo sapiens
tcaggaggtcgacctggca

SEQ ID NO: 7168793 - DNA, 19 bp, Homo sapiens
tcaggaggtcgacctggca

SEQ ID NO: 7168794 - DNA, 22 bp, Homo sapiens
tcaggaggtctgctgcggggtg

SEQ ID NO: 7168795 - DNA, 22 bp, Homo sapiens
tcagctttctatgttgctaaac

SEQ ID NO: 7168796 - DNA, 22 bp, Homo sapiens
tcagctttccttgctttagatt

SEQ ID NO: 7168797 - DNA, 22 bp, Homo sapiens
tcagcttgggaaattgagcaag

SEQ ID NO: 7168798 - DNA, 22 bp, Homo sapiens
tcagcttgggggtggcttctca

SEQ ID NO: 7168799 - DNA, 20 bp, Homo sapiens
tcagcttgggtgaagttcat

SEQ ID NO: 7168800 - DNA, 22 bp, Homo sapiens
tcagcttgtttatgataagcag

SEQ ID NO: 7168801 - DNA, 22 bp, Homo sapiens
tcagctttcctgcagctaaggg

SEQ ID NO: 7168802 - DNA, 22 bp, Homo sapiens
tcagcttccctatctgaccata

SEQ ID NO: 7168803 - DNA, 22 bp, Homo sapiens
tcagcttccctatctgaccata

SEQ ID NO: 7168804 - DNA, 22 bp, Homo sapiens
tcagcttccctatctgaccata

SEQ ID NO: 7168805 - DNA, 22 bp, Homo sapiens
tcagcttcctctgtggttccag

SEQ ID NO: 7168806 - DNA, 22 bp, Homo sapiens
tcagcttctcaaaatggcttag

SEQ ID NO: 7168807 - DNA, 19 bp, Homo sapiens
tcagcttctgtgtattgta

SEQ ID NO: 7168808 - DNA, 21 bp, Homo sapiens
tcagcttgaatctagagatag

SEQ ID NO: 7168809 - DNA, 22 bp, Homo sapiens
tcagcttgatccatccaactat

SEQ ID NO: 7168810 - DNA, 23 bp, Homo sapiens
tcagcttcattgtcttctatggc

SEQ ID NO: 7168811 - DNA, 18 bp, Homo sapiens
tcagcttccagcatgttt

SEQ ID NO: 7168812 - DNA, 22 bp, Homo sapiens
tcagcttcagatcagctagaga

SEQ ID NO: 7168813 - DNA, 22 bp, Homo sapiens
tcagcttcagatcagctagaga

SEQ ID NO: 7168814 - DNA, 22 bp, Homo sapiens
tcagctgtgtatcccagggcct

SEQ ID NO: 7168815 - DNA, 22 bp, Homo sapiens
tcagctgttatcactgtctgtc

SEQ ID NO: 7168816 - DNA, 23 bp, Homo sapiens
tcagctgttcttttccctgggac

SEQ ID NO: 7168817 - DNA, 23 bp, Homo sapiens
tcagcctcttaggacttctcacc

SEQ ID NO: 7168818 - DNA, 23 bp, Homo sapiens
tcagcctcttaggacttctcacc

SEQ ID NO: 7168819 - DNA, 22 bp, Homo sapiens
tcagcctgcgtcatggtgacac

SEQ ID NO: 7168820 - DNA, 22 bp, Homo sapiens
tcagcctgcgtcatggtgacac

SEQ ID NO: 7168821 - DNA, 22 bp, Homo sapiens
tcagctgtaggtatggatgtcc

SEQ ID NO: 7168822 - DNA, 22 bp, Homo sapiens
tcagcctcctaatttcctgtga

SEQ ID NO: 7168823 - DNA, 22 bp, Homo sapiens
tcagcctcctaatttcctgtga

SEQ ID NO: 7168824 - DNA, 22 bp, Homo sapiens
tcagcctctctgagtccagacc

SEQ ID NO: 7168825 - DNA, 22 bp, Homo sapiens
tcagcctctctgagtccagacc

SEQ ID NO: 7168826 - DNA, 22 bp, Homo sapiens
tcagcctcattttctgctctgt

SEQ ID NO: 7168827 - DNA, 22 bp, Homo sapiens
tcagcctccgaaagtgctggga

SEQ ID NO: 7168828 - DNA, 22 bp, Homo sapiens
tcagcctccgaaagtgctggga

SEQ ID NO: 7168829 - DNA, 22 bp, Homo sapiens
tcagcctccgaaagtgctggga

SEQ ID NO: 7168830 - DNA, 18 bp, Homo sapiens
tcagcccagagcccagtt

SEQ ID NO: 7168831 - DNA, 22 bp, Homo sapiens
tcagcccagcccagcaagtgca

SEQ ID NO: 7168832 - DNA, 22 bp, Homo sapiens
tcagcccagcccagcaagtgca

SEQ ID NO: 7168833 - DNA, 22 bp, Homo sapiens
tcagcccagcccagcaagtgca

SEQ ID NO: 7168834 - DNA, 22 bp, Homo sapiens
tcagcccaggaatgagccttct

SEQ ID NO: 7168835 - DNA, 22 bp, Homo sapiens
tcagcccttcctggagctttta

SEQ ID NO: 7168836 - DNA, 22 bp, Homo sapiens
tcagcccttgatgtttgggggt

SEQ ID NO: 7168837 - DNA, 22 bp, Homo sapiens
tcagcctcaggtgttcagattt

SEQ ID NO: 7168838 - DNA, 22 bp, Homo sapiens
tcagcctcaggtgttcagattt

SEQ ID NO: 7168839 - DNA, 22 bp, Homo sapiens
tcagcctcattttctgctctgt

SEQ ID NO: 7168840 - DNA, 22 bp, Homo sapiens
tcagccagtgtgcacctggagt

SEQ ID NO: 7168841 - DNA, 22 bp, Homo sapiens
tcagccagtgtgcacctggagt

SEQ ID NO: 7168842 - DNA, 22 bp, Homo sapiens
tcagccagttaaggcttagaca

SEQ ID NO: 7168843 - DNA, 22 bp, Homo sapiens
tcagccagttaaggcttagaca

SEQ ID NO: 7168844 - DNA, 22 bp, Homo sapiens
tcagccagttaaggcttagaca

SEQ ID NO: 7168845 - DNA, 22 bp, Homo sapiens
tcagccagttaagtcaagaaat

SEQ ID NO: 7168846 - DNA, 22 bp, Homo sapiens
tcagccagttgccccagttagt

SEQ ID NO: 7168847 - DNA, 22 bp, Homo sapiens
tcagccagttgccccagttagt

SEQ ID NO: 7168848 - DNA, 22 bp, Homo sapiens
tcagccagtttgattctatttg

SEQ ID NO: 7168849 - DNA, 22 bp, Homo sapiens
tcagccagtttgattctatttg

SEQ ID NO: 7168850 - DNA, 22 bp, Homo sapiens
tcagccagtttgtttattccgg

SEQ ID NO: 7168851 - DNA, 20 bp, Homo sapiens
tcagccattccttacctttc

SEQ ID NO: 7168852 - DNA, 22 bp, Homo sapiens
tcagcccaaccctgcacaagga

SEQ ID NO: 7168853 - DNA, 22 bp, Homo sapiens
tcagcccaaccctgcacaagga

SEQ ID NO: 7168854 - DNA, 22 bp, Homo sapiens
tcagcccaaccctgcacaagga

SEQ ID NO: 7168855 - DNA, 23 bp, Homo sapiens
tcagcccacatctagtcattagc

SEQ ID NO: 7168856 - DNA, 22 bp, Homo sapiens
tcagcccacctggtgtggggct

SEQ ID NO: 7168857 - DNA, 22 bp, Homo sapiens
tcagcccacctggtgtggggct

SEQ ID NO: 7168858 - DNA, 22 bp, Homo sapiens
tcagcccaccttcaggggagtt

SEQ ID NO: 7168859 - DNA, 22 bp, Homo sapiens
tcagagtgaccttacatggtct

SEQ ID NO: 7168860 - DNA, 22 bp, Homo sapiens
tcagagtgaggcccagcaatct

SEQ ID NO: 7168861 - DNA, 22 bp, Homo sapiens
tcagagtgaggcgtcaacatga

SEQ ID NO: 7168862 - DNA, 21 bp, Homo sapiens
tcagagtctcaggagcaaggg

SEQ ID NO: 7168863 - DNA, 22 bp, Homo sapiens
tcagagtcattgcaagtagaag

SEQ ID NO: 7168864 - DNA, 22 bp, Homo sapiens
tcagagtacgcatgctctgatt

SEQ ID NO: 7168865 - DNA, 23 bp, Homo sapiens
tcagagtagcaatttttctctcc

SEQ ID NO: 7168866 - DNA, 22 bp, Homo sapiens
tcagaggttcttctcagtggcc

SEQ ID NO: 7168867 - DNA, 22 bp, Homo sapiens
tcagaggttcttctcagtggcc

SEQ ID NO: 7168868 - DNA, 22 bp, Homo sapiens
tcagaggttccggccataacca

SEQ ID NO: 7168869 - DNA, 22 bp, Homo sapiens
tcagaggtggtaaaggacagca

SEQ ID NO: 7168870 - DNA, 22 bp, Homo sapiens
tcagaggttacccatgggacag

SEQ ID NO: 7168871 - DNA, 22 bp, Homo sapiens
tcagagtgaggcgtcaacatga

SEQ ID NO: 7168872 - DNA, 22 bp, Homo sapiens
tcagagtgaggcgtcaacatga

SEQ ID NO: 7168873 - DNA, 22 bp, Homo sapiens
tcagagtgcagggagtagcagc

SEQ ID NO: 7168874 - DNA, 22 bp, Homo sapiens
tcagccaggccaggcattcaca

SEQ ID NO: 7168875 - DNA, 22 bp, Homo sapiens
tcagccaggccaggcattcaca

SEQ ID NO: 7168876 - DNA, 22 bp, Homo sapiens
tcagccaggccaggcattcaca

SEQ ID NO: 7168877 - DNA, 22 bp, Homo sapiens
tcagccaggccctaagagattg

SEQ ID NO: 7168878 - DNA, 22 bp, Homo sapiens
tcagccagggcagagcaggtga

SEQ ID NO: 7168879 - DNA, 22 bp, Homo sapiens
tcagccagggcagagcaggtga

SEQ ID NO: 7168880 - DNA, 22 bp, Homo sapiens
tcagccagggcagagcaggtga

SEQ ID NO: 7168881 - DNA, 22 bp, Homo sapiens
tcagccagggcagagcaggtga

SEQ ID NO: 7168882 - DNA, 22 bp, Homo sapiens
tcagccagggctctggcctcag

SEQ ID NO: 7168883 - DNA, 22 bp, Homo sapiens
tcagccagggctctggcctcag

SEQ ID NO: 7168884 - DNA, 22 bp, Homo sapiens
tcagccagggctctggcctcag

SEQ ID NO: 7168885 - DNA, 22 bp, Homo sapiens
tcagccagggctctggcctcag

SEQ ID NO: 7168886 - DNA, 22 bp, Homo sapiens
tcagccagggggagagaatgga

SEQ ID NO: 7168887 - DNA, 22 bp, Homo sapiens
tcagccagggggagagaatgga

SEQ ID NO: 7168888 - DNA, 22 bp, Homo sapiens
tcagccaggtaatgtggagatg

SEQ ID NO: 7168889 - DNA, 22 bp, Homo sapiens
tcagccagtatttgagtgctca

SEQ ID NO: 7168890 - DNA, 22 bp, Homo sapiens
tcagccagtatttgagtgctca

SEQ ID NO: 7168891 - DNA, 22 bp, Homo sapiens
tcagccagtatttgagtgctca

SEQ ID NO: 7168892 - DNA, 22 bp, Homo sapiens
tcagccagtatttgagtgctca

SEQ ID NO: 7168893 - DNA, 22 bp, Homo sapiens
tcagccagtgccttgatcttgc

SEQ ID NO: 7168894 - DNA, 22 bp, Homo sapiens
tcagccagtgccttgatcttgc

SEQ ID NO: 7168895 - DNA, 22 bp, Homo sapiens
tcagaggtggcccctgccctca

SEQ ID NO: 7168896 - DNA, 22 bp, Homo sapiens
tcagaggtggtaaaggacagca

SEQ ID NO: 7168897 - DNA, 22 bp, Homo sapiens
tcagaggtggagatagttggga

SEQ ID NO: 7168898 - DNA, 22 bp, Homo sapiens
tcagaggtggcaggggtgtcca

SEQ ID NO: 7168899 - DNA, 22 bp, Homo sapiens
tcagaggtggcaggggtgtcca

SEQ ID NO: 7168900 - DNA, 22 bp, Homo sapiens
tcagaggtgcaagaagttctga

SEQ ID NO: 7168901 - DNA, 22 bp, Homo sapiens
tcagaggtgagcttcttgctaa

SEQ ID NO: 7168902 - DNA, 22 bp, Homo sapiens
tcagaggtgagcttcttgctaa

SEQ ID NO: 7168903 - DNA, 22 bp, Homo sapiens
tcagaggtgagcatgtgaccaa

SEQ ID NO: 7168904 - DNA, 22 bp, Homo sapiens
tcagaggtccctagcaggagtg

SEQ ID NO: 7168905 - DNA, 22 bp, Homo sapiens
tcagaggtccctagcaggagtg

SEQ ID NO: 7168906 - DNA, 22 bp, Homo sapiens
tcagaggtcagcagcttgccca

SEQ ID NO: 7168907 - DNA, 22 bp, Homo sapiens
tcagaggtagtagcagagttga

SEQ ID NO: 7168908 - DNA, 22 bp, Homo sapiens
tcagaggtcacacagcaagttt

SEQ ID NO: 7168909 - DNA, 22 bp, Homo sapiens
tcagaggtcacacagcaagttt

SEQ ID NO: 7168910 - DNA, 18 bp, Homo sapiens
tcagaggtacagaaaagt

SEQ ID NO: 7168911 - DNA, 22 bp, Homo sapiens
tcagaggtaagggctgagagga

SEQ ID NO: 7168912 - DNA, 22 bp, Homo sapiens
tcagaggtaaaaactcactgta

SEQ ID NO: 7168913 - DNA, 21 bp, Homo sapiens
tcagagggccctggaggctca

SEQ ID NO: 7168914 - DNA, 21 bp, Homo sapiens
tcagagggccctggaggctca

SEQ ID NO: 7168915 - DNA, 22 bp, Homo sapiens
tcagagggcttatgatatattg

SEQ ID NO: 7168916 - DNA, 22 bp, Homo sapiens
tcagagggcttatgatatattg

SEQ ID NO: 7168917 - DNA, 22 bp, Homo sapiens
tcagagggtggctgggagcatc

SEQ ID NO: 7168918 - DNA, 22 bp, Homo sapiens
tcagaggcttgaagcccaagcc

SEQ ID NO: 7168919 - DNA, 22 bp, Homo sapiens
tcagaggctttcaatgtgtttt

SEQ ID NO: 7168920 - DNA, 17 bp, Homo sapiens
tcagagggatgagcagg

SEQ ID NO: 7168921 - DNA, 22 bp, Homo sapiens
tcagaggcttctgctcacctca

SEQ ID NO: 7168922 - DNA, 22 bp, Homo sapiens
tcagaggcttctgctcacctca

SEQ ID NO: 7168923 - DNA, 22 bp, Homo sapiens
tcagaggcttctgctcacctca

SEQ ID NO: 7168924 - DNA, 22 bp, Homo sapiens
tcagaggcttctgctcacctca

SEQ ID NO: 7168925 - DNA, 22 bp, Homo sapiens
tcagaggcttctggccagtctg

SEQ ID NO: 7168926 - DNA, 20 bp, Homo sapiens
tcagaggctgccagctgggg

SEQ ID NO: 7168927 - DNA, 22 bp, Homo sapiens
tcagaggctggaagagcctcct

SEQ ID NO: 7168928 - DNA, 22 bp, Homo sapiens
tcagaggctggaagagcctcct

SEQ ID NO: 7168929 - DNA, 21 bp, Homo sapiens
tcagaggctgggggaatgccc

SEQ ID NO: 7168930 - DNA, 22 bp, Homo sapiens
tccagggagatggcagaggctg

SEQ ID NO: 7168931 - DNA, 22 bp, Homo sapiens
tccagggacctccctgagagct

SEQ ID NO: 7168932 - DNA, 22 bp, Homo sapiens
tccagggacagtatagaggatc

SEQ ID NO: 7168933 - DNA, 21 bp, Homo sapiens
tccaggcctcaggaagggatg

SEQ ID NO: 7168934 - DNA, 21 bp, Homo sapiens
tccaggcctcaggaagggatg

SEQ ID NO: 7168935 - DNA, 22 bp, Homo sapiens
tccaggccgcaggggcagcccc

SEQ ID NO: 7168936 - DNA, 22 bp, Homo sapiens
tccaggccgcaggggcagcccc

SEQ ID NO: 7168937 - DNA, 22 bp, Homo sapiens
tccaggccgcaggggcagcccc

SEQ ID NO: 7168938 - DNA, 22 bp, Homo sapiens
tccaggccctgggatgggagca

SEQ ID NO: 7168939 - DNA, 22 bp, Homo sapiens
tccaggccctgggatgggagca

SEQ ID NO: 7168940 - DNA, 22 bp, Homo sapiens
tccaggccgcaggggcagcccc

SEQ ID NO: 7168941 - DNA, 22 bp, Homo sapiens
tccaggccctgggatgggagca

SEQ ID NO: 7168942 - DNA, 22 bp, Homo sapiens
tccaggcccatagacacttctc

SEQ ID NO: 7168943 - DNA, 22 bp, Homo sapiens
tccaggcccatagacacttctc

SEQ ID NO: 7168944 - DNA, 22 bp, Homo sapiens
tccaggcccgagatgggctgga

SEQ ID NO: 7168945 - DNA, 22 bp, Homo sapiens
tccaggccctgggatgggagca

SEQ ID NO: 7168946 - DNA, 22 bp, Homo sapiens
tccaggcctaggccaagtgatt

SEQ ID NO: 7168947 - DNA, 22 bp, Homo sapiens
tccaggcctaggccaagtgatt

SEQ ID NO: 7168948 - DNA, 22 bp, Homo sapiens
tccaggcctaggccaagtgatt

SEQ ID NO: 7168949 - DNA, 21 bp, Homo sapiens
tccaggcctcaggaagggatg

SEQ ID NO: 7168950 - DNA, 21 bp, Homo sapiens
tccaggcctcaggaagggatg

SEQ ID NO: 7168951 - DNA, 21 bp, Homo sapiens
tccaggcctcaggaagggatg

SEQ ID NO: 7168952 - DNA, 22 bp, Homo sapiens
tccaggccgcaggggcagcccc

SEQ ID NO: 7168953 - DNA, 22 bp, Homo sapiens
tccaggccgcaggggcagcccc

SEQ ID NO: 7168954 - DNA, 22 bp, Homo sapiens
tccaggccgcatagttactctg

SEQ ID NO: 7168955 - DNA, 22 bp, Homo sapiens
tccaggccgcatagttactctg

SEQ ID NO: 7168956 - DNA, 22 bp, Homo sapiens
tccaggccgcatagttactctg

SEQ ID NO: 7168957 - DNA, 22 bp, Homo sapiens
tccaggcctaggccaagtgatt

SEQ ID NO: 7168958 - DNA, 22 bp, Homo sapiens
tccaggcctaggccaagtgatt

SEQ ID NO: 7168959 - DNA, 22 bp, Homo sapiens
tccaggaggaggaaggctgcca

SEQ ID NO: 7168960 - DNA, 22 bp, Homo sapiens
tccaggaggaggaaggctgcca

SEQ ID NO: 7168961 - DNA, 22 bp, Homo sapiens
tccaggaggcagggctgtgccc

SEQ ID NO: 7168962 - DNA, 22 bp, Homo sapiens
tccaggaggcagggctgtgccc

SEQ ID NO: 7168963 - DNA, 22 bp, Homo sapiens
tccaggaggcagggctgtgccc

SEQ ID NO: 7168964 - DNA, 22 bp, Homo sapiens
tccaggaggcagggctgtgccc

SEQ ID NO: 7168965 - DNA, 22 bp, Homo sapiens
tccaggccactgcagaggctct

SEQ ID NO: 7168966 - DNA, 22 bp, Homo sapiens
tccaggccagggtaagaggaga

SEQ ID NO: 7168967 - DNA, 22 bp, Homo sapiens
tccaggccagggtaagaggaga

SEQ ID NO: 7168968 - DNA, 21 bp, Homo sapiens
tccaggccatggtggggaggc

SEQ ID NO: 7168969 - DNA, 21 bp, Homo sapiens
tccaggccatggtggggaggc

SEQ ID NO: 7168970 - DNA, 19 bp, Homo sapiens
tccaggccattcccagagc

SEQ ID NO: 7168971 - DNA, 19 bp, Homo sapiens
tccaggccattcccagagc

SEQ ID NO: 7168972 - DNA, 19 bp, Homo sapiens
tccaggccattcccagagc

SEQ ID NO: 7168973 - DNA, 19 bp, Homo sapiens
tccaggccattcccagagc

SEQ ID NO: 7168974 - DNA, 22 bp, Homo sapiens
tccaggccattgactgcatcct

SEQ ID NO: 7168975 - DNA, 22 bp, Homo sapiens
tccaggccattgactgcatcct

SEQ ID NO: 7168976 - DNA, 21 bp, Homo sapiens
tccaggccatggtggggaggc

SEQ ID NO: 7168977 - DNA, 21 bp, Homo sapiens
tccaggccatggtggggaggc

SEQ ID NO: 7168978 - DNA, 21 bp, Homo sapiens
tccaggccatggtggggaggc

SEQ ID NO: 7168979 - DNA, 21 bp, Homo sapiens
tccaggccatggtggggaggc

SEQ ID NO: 7168980 - DNA, 22 bp, Homo sapiens
tccaggccagggtaagaggaga

SEQ ID NO: 7168981 - DNA, 22 bp, Homo sapiens
tccaggccagggtaagaggaga

SEQ ID NO: 7168982 - DNA, 22 bp, Homo sapiens
tccaggccattgactgcatcct

SEQ ID NO: 7168983 - DNA, 22 bp, Homo sapiens
tccaggccattgactgcatcct

SEQ ID NO: 7168984 - DNA, 20 bp, Homo sapiens
tccaggcccactcagctgaa

SEQ ID NO: 7168985 - DNA, 22 bp, Homo sapiens
tccaggccattgactgcatcct

SEQ ID NO: 7168986 - DNA, 20 bp, Homo sapiens
tccaggcccactcagctgaa

SEQ ID NO: 7168987 - DNA, 20 bp, Homo sapiens
tccaggcccactcagctgaa

SEQ ID NO: 7168988 - DNA, 20 bp, Homo sapiens
tccaggcccactcagctgaa

SEQ ID NO: 7168989 - DNA, 22 bp, Homo sapiens
tccaggcccactcagctgaaat

SEQ ID NO: 7168990 - DNA, 22 bp, Homo sapiens
tccaggcccactcagctgaaat

SEQ ID NO: 7168991 - DNA, 22 bp, Homo sapiens
tccaggcccactcagctgaaat

SEQ ID NO: 7168992 - DNA, 22 bp, Homo sapiens
tccaggcccactcagctgaaat

SEQ ID NO: 7168993 - DNA, 22 bp, Homo sapiens
tccaggcccactcggtggggct

SEQ ID NO: 7168994 - DNA, 22 bp, Homo sapiens
tccaggcccactcagctgaaat

SEQ ID NO: 7168995 - DNA, 22 bp, Homo sapiens
tccaggcccactcggtggggct

SEQ ID NO: 7168996 - DNA, 22 bp, Homo sapiens
tccaggcccagacggggtgagg

SEQ ID NO: 7168997 - DNA, 22 bp, Homo sapiens
tccaggcccagacggggtgagg

SEQ ID NO: 7168998 - DNA, 22 bp, Homo sapiens
tccaggcccagacggggtgagg

SEQ ID NO: 7168999 - DNA, 22 bp, Homo sapiens
tccaggcccagacggggtgagg

SEQ ID NO: 7169000 - DNA, 22 bp, Homo sapiens
tccaggcccagacggggtgagg

SEQ ID NO: 7169001 - DNA, 22 bp, Homo sapiens
tccaggcccactcggtggggct

SEQ ID NO: 7169002 - DNA, 22 bp, Homo sapiens
tccaggcccactcggtggggct

SEQ ID NO: 7169003 - DNA, 22 bp, Homo sapiens
tccagtcaggctgaattcaagg

SEQ ID NO: 7169004 - DNA, 22 bp, Homo sapiens
tccagtcatctcccttcacatt

SEQ ID NO: 7169005 - DNA, 22 bp, Homo sapiens
tccagtcatggtgtcctcacaa

SEQ ID NO: 7169006 - DNA, 22 bp, Homo sapiens
tccagtcatttccattgttccc

SEQ ID NO: 7169007 - DNA, 22 bp, Homo sapiens
tccagtcatttccattgttccc

SEQ ID NO: 7169008 - DNA, 22 bp, Homo sapiens
tccagtccactgccttgctctt

SEQ ID NO: 7169009 - DNA, 22 bp, Homo sapiens
tccagtccagggaatggctgat

SEQ ID NO: 7169010 - DNA, 22 bp, Homo sapiens
tccagtccatggcctcagtctt

SEQ ID NO: 7169011 - DNA, 22 bp, Homo sapiens
tccagtccatggcctcagtctt

SEQ ID NO: 7169012 - DNA, 18 bp, Homo sapiens
tccagtcccaaggccagc

SEQ ID NO: 7169013 - DNA, 20 bp, Homo sapiens
tccagggcaactagagtgtg

SEQ ID NO: 7169014 - DNA, 22 bp, Homo sapiens
tccagggcaccagcgtccccct

SEQ ID NO: 7169015 - DNA, 20 bp, Homo sapiens
tccagggcaaactcatcacc

SEQ ID NO: 7169016 - DNA, 20 bp, Homo sapiens
tccagggcaaactcatcacc

SEQ ID NO: 7169017 - DNA, 20 bp, Homo sapiens
tccagggcaaactcatcacc

SEQ ID NO: 7169018 - DNA, 23 bp, Homo sapiens
tccagggattaatgaagtcagtc

SEQ ID NO: 7169019 - DNA, 22 bp, Homo sapiens
tccagggatctttagagtcttt

SEQ ID NO: 7169020 - DNA, 22 bp, Homo sapiens
tccagggatctttagagtcttt

SEQ ID NO: 7169021 - DNA, 22 bp, Homo sapiens
tccagggagcaagtcaggccgg

SEQ ID NO: 7169022 - DNA, 22 bp, Homo sapiens
tccagggagtcaaatgaactac

SEQ ID NO: 7169023 - DNA, 22 bp, Homo sapiens
tccagggagcaagtcaggccgg

SEQ ID NO: 7169024 - DNA, 20 bp, Homo sapiens
tccagtggcctgaatctgga

SEQ ID NO: 7169025 - DNA, 22 bp, Homo sapiens
tccagtggcaggcggtgaggtc

SEQ ID NO: 7169026 - DNA, 22 bp, Homo sapiens
tccagtggcactggagactaga

SEQ ID NO: 7169027 - DNA, 22 bp, Homo sapiens
tccagtgctggaccagagcacc

SEQ ID NO: 7169028 - DNA, 22 bp, Homo sapiens
tccagtgctggaccagagcacc

SEQ ID NO: 7169029 - DNA, 20 bp, Homo sapiens
tccagtggcctgaatctgga

SEQ ID NO: 7169030 - DNA, 21 bp, Homo sapiens
tccagtggggatctctgatat

SEQ ID NO: 7169031 - DNA, 22 bp, Homo sapiens
tccagtgggtctggcaagacca

SEQ ID NO: 7169032 - DNA, 22 bp, Homo sapiens
tccagtgggttgctgagggagg

SEQ ID NO: 7169033 - DNA, 22 bp, Homo sapiens
tccagtggtggtttgaagggca

SEQ ID NO: 7169034 - DNA, 21 bp, Homo sapiens
tccagtggtgtctagaatgtg

SEQ ID NO: 7169035 - DNA, 23 bp, Homo sapiens
tccagtctcctgaaaggcagcgt

SEQ ID NO: 7169036 - DNA, 22 bp, Homo sapiens
tccagtcctatctgcccttgga

SEQ ID NO: 7169037 - DNA, 22 bp, Homo sapiens
tccagtcctgggagcctttctg

SEQ ID NO: 7169038 - DNA, 22 bp, Homo sapiens
tccagtcctgggagcctttctg

SEQ ID NO: 7169039 - DNA, 22 bp, Homo sapiens
tccagtccttgaaaatccaaca

SEQ ID NO: 7169040 - DNA, 22 bp, Homo sapiens
tccagtccttgcctctgtcagg

SEQ ID NO: 7169041 - DNA, 18 bp, Homo sapiens
tccagtcccagctctgcc

SEQ ID NO: 7169042 - DNA, 22 bp, Homo sapiens
tccagtcccattacccacattt

SEQ ID NO: 7169043 - DNA, 20 bp, Homo sapiens
tccagtccccacttgctcct

SEQ ID NO: 7169044 - DNA, 23 bp, Homo sapiens
tccagtcccctaaatctcactgt

SEQ ID NO: 7169045 - DNA, 22 bp, Homo sapiens
tccagtcccttgcctccacagc

SEQ ID NO: 7169046 - DNA, 22 bp, Homo sapiens
tccagtcctagaaactggagag

SEQ ID NO: 7169047 - DNA, 22 bp, Homo sapiens
tccagtcctagaaactggagag

SEQ ID NO: 7169048 - DNA, 22 bp, Homo sapiens
tccagtctggagccttctggtt

SEQ ID NO: 7169049 - DNA, 22 bp, Homo sapiens
tccagtctggagccttctggtt

SEQ ID NO: 7169050 - DNA, 22 bp, Homo sapiens
tccagtctctactctgagataa

SEQ ID NO: 7169051 - DNA, 22 bp, Homo sapiens
tccagtcttcttgcagctacat

SEQ ID NO: 7169052 - DNA, 22 bp, Homo sapiens
tccagtgatctagggagctgga

SEQ ID NO: 7169053 - DNA, 22 bp, Homo sapiens
tccagtgcattcagacacttgg

SEQ ID NO: 7169054 - DNA, 22 bp, Homo sapiens
tcccagagttcaatgggaaggt

SEQ ID NO: 7169055 - DNA, 22 bp, Homo sapiens
tcccagagttcaatgggaaggt

SEQ ID NO: 7169056 - DNA, 22 bp, Homo sapiens
tcccagagtgtgggcatcaagg

SEQ ID NO: 7169057 - DNA, 21 bp, Homo sapiens
tcccagagtgcttgggactgc

SEQ ID NO: 7169058 - DNA, 22 bp, Homo sapiens
tcccagagtgtgggcatcaagg

SEQ ID NO: 7169059 - DNA, 22 bp, Homo sapiens
tcccagagtgtgggcatcaagg

SEQ ID NO: 7169060 - DNA, 22 bp, Homo sapiens
tcccagagtgagccaggggcag

SEQ ID NO: 7169061 - DNA, 21 bp, Homo sapiens
tcccagagtgcttgggactgc

SEQ ID NO: 7169062 - DNA, 21 bp, Homo sapiens
tcccagagtgcttgggactgc

SEQ ID NO: 7169063 - DNA, 22 bp, Homo sapiens
tcccagagtgagccaggggcag

SEQ ID NO: 7169064 - DNA, 22 bp, Homo sapiens
tcccagagtgagccaggggcag

SEQ ID NO: 7169065 - DNA, 19 bp, Homo sapiens
tcccagagtctagaggttg

SEQ ID NO: 7169066 - DNA, 22 bp, Homo sapiens
tcccagagtcttctcctgtaat

SEQ ID NO: 7169067 - DNA, 22 bp, Homo sapiens
tcccagagtcttctcctgtaat

SEQ ID NO: 7169068 - DNA, 19 bp, Homo sapiens
tcccagagtctagaggttg

SEQ ID NO: 7169069 - DNA, 19 bp, Homo sapiens
tcccagagtctagaggttg

SEQ ID NO: 7169070 - DNA, 22 bp, Homo sapiens
tcccagagtcagaggtggggcc

SEQ ID NO: 7169071 - DNA, 22 bp, Homo sapiens
tcccagagaaagtcaaggtctt

SEQ ID NO: 7169072 - DNA, 22 bp, Homo sapiens
tcccagagtattagcaattgct

SEQ ID NO: 7169073 - DNA, 22 bp, Homo sapiens
tcccagagaaagtcaaggtctt

SEQ ID NO: 7169074 - DNA, 22 bp, Homo sapiens
tcccagaatctttggaagagca

SEQ ID NO: 7169075 - DNA, 22 bp, Homo sapiens
tcccagaatctttggaagagca

SEQ ID NO: 7169076 - DNA, 22 bp, Homo sapiens
tcccagaatctttggaagagca

SEQ ID NO: 7169077 - DNA, 22 bp, Homo sapiens
tcccagaatggcccagctgccc

SEQ ID NO: 7169078 - DNA, 22 bp, Homo sapiens
tcccagaatggcccagctgccc

SEQ ID NO: 7169079 - DNA, 22 bp, Homo sapiens
tcccagaatcctcactctatca

SEQ ID NO: 7169080 - DNA, 22 bp, Homo sapiens
tcccagaatctccagtgctaca

SEQ ID NO: 7169081 - DNA, 22 bp, Homo sapiens
tcccagaatctccagtgctaca

SEQ ID NO: 7169082 - DNA, 22 bp, Homo sapiens
tcccagaatctccagtgctaca

SEQ ID NO: 7169083 - DNA, 22 bp, Homo sapiens
tcccagaatctccagtgctaca

SEQ ID NO: 7169084 - DNA, 22 bp, Homo sapiens
tcccagaatctccagtgctaca

SEQ ID NO: 7169085 - DNA, 22 bp, Homo sapiens
tcccagaaccctgccaggtcct

SEQ ID NO: 7169086 - DNA, 22 bp, Homo sapiens
tcccagaaccctgccaggtcct

SEQ ID NO: 7169087 - DNA, 22 bp, Homo sapiens
tcccagaacctcagagtgtgac

SEQ ID NO: 7169088 - DNA, 22 bp, Homo sapiens
tcccagaacctcagagtgtgac

SEQ ID NO: 7169089 - DNA, 22 bp, Homo sapiens
tcccagaacctcagagtgtgac

SEQ ID NO: 7169090 - DNA, 22 bp, Homo sapiens
tcccagaaccttttagcttcac

SEQ ID NO: 7169091 - DNA, 22 bp, Homo sapiens
tcccagaaccttttagcttcac

SEQ ID NO: 7169092 - DNA, 22 bp, Homo sapiens
tcccagaacgggttcttcccag

SEQ ID NO: 7169093 - DNA, 22 bp, Homo sapiens
tcccagaacgggttcttcccag

SEQ ID NO: 7169094 - DNA, 22 bp, Homo sapiens
tcccagaacgggttcttcccag

SEQ ID NO: 7169095 - DNA, 22 bp, Homo sapiens
tcccagaagagatgccacttga

SEQ ID NO: 7169096 - DNA, 22 bp, Homo sapiens
tcccagaagagatgccacttga

SEQ ID NO: 7169097 - DNA, 22 bp, Homo sapiens
tcccagaagtccagccatgggc

SEQ ID NO: 7169098 - DNA, 22 bp, Homo sapiens
tcccagaagtccagccatgggc

SEQ ID NO: 7169099 - DNA, 22 bp, Homo sapiens
tcccagaagtccagccatgggc

SEQ ID NO: 7169100 - DNA, 22 bp, Homo sapiens
tcccagaagtgaaatttctaga

SEQ ID NO: 7169101 - DNA, 22 bp, Homo sapiens
tcccagaagtgaaatttctaga

SEQ ID NO: 7169102 - DNA, 22 bp, Homo sapiens
tcccagaagtgaaatttctaga

SEQ ID NO: 7169103 - DNA, 22 bp, Homo sapiens
tcccagaatcctcactctatca

SEQ ID NO: 7169104 - DNA, 21 bp, Homo sapiens
tcccactggcccagggctcca

SEQ ID NO: 7169105 - DNA, 21 bp, Homo sapiens
tcccactggcccagggctcca

SEQ ID NO: 7169106 - DNA, 20 bp, Homo sapiens
tcccactgggcctcagtttc

SEQ ID NO: 7169107 - DNA, 20 bp, Homo sapiens
tcccactgggcctcagtttc

SEQ ID NO: 7169108 - DNA, 22 bp, Homo sapiens
tcccactggacgtctgtgctgg

SEQ ID NO: 7169109 - DNA, 22 bp, Homo sapiens
tcccactggacgtctgtgctgg

SEQ ID NO: 7169110 - DNA, 22 bp, Homo sapiens
tcccactggacgtctgtgctgg

SEQ ID NO: 7169111 - DNA, 22 bp, Homo sapiens
tcccactgctttgctctgctca

SEQ ID NO: 7169112 - DNA, 21 bp, Homo sapiens
tcccactgccacagcttcagg

SEQ ID NO: 7169113 - DNA, 22 bp, Homo sapiens
tcccactggacgtctgtgctgg

SEQ ID NO: 7169114 - DNA, 22 bp, Homo sapiens
tcccactgctttgctctgctca

SEQ ID NO: 7169115 - DNA, 22 bp, Homo sapiens
tcccactgtgcctgttgtaatc

SEQ ID NO: 7169116 - DNA, 22 bp, Homo sapiens
tcccactgtgaatccaaggcct

SEQ ID NO: 7169117 - DNA, 22 bp, Homo sapiens
tcccactgtctgtcttgctgca

SEQ ID NO: 7169118 - DNA, 22 bp, Homo sapiens
tcccactgtctgtcttgctgca

SEQ ID NO: 7169119 - DNA, 22 bp, Homo sapiens
tcccactgtcttctcgtgctcg

SEQ ID NO: 7169120 - DNA, 22 bp, Homo sapiens
tcccactgtgaatccaaggcct

SEQ ID NO: 7169121 - DNA, 22 bp, Homo sapiens
tcccactgtgcctgttgtaatc

SEQ ID NO: 7169122 - DNA, 22 bp, Homo sapiens
tcccactgtgcctgttgtaatc

SEQ ID NO: 7169123 - DNA, 22 bp, Homo sapiens
tcccacttaactgtgacttctc

SEQ ID NO: 7169124 - DNA, 22 bp, Homo sapiens
tcccagaaaaaggaggctatga

SEQ ID NO: 7169125 - DNA, 22 bp, Homo sapiens
tcccagaaaaaggaggctatga

SEQ ID NO: 7169126 - DNA, 22 bp, Homo sapiens
tcccagaaacgcatatgttcat

SEQ ID NO: 7169127 - DNA, 22 bp, Homo sapiens
tcccagaaacgcatatgttcat

SEQ ID NO: 7169128 - DNA, 22 bp, Homo sapiens
tcccacagtggtacagccctga

SEQ ID NO: 7169129 - DNA, 22 bp, Homo sapiens
tcccacagtggtacagccctga

SEQ ID NO: 7169130 - DNA, 22 bp, Homo sapiens
tcccacagtggtacagccctga

SEQ ID NO: 7169131 - DNA, 22 bp, Homo sapiens
tcccacagtggtacagccctga

SEQ ID NO: 7169132 - DNA, 22 bp, Homo sapiens
tcccactgagcccctgctggtg

SEQ ID NO: 7169133 - DNA, 22 bp, Homo sapiens
tcccactgagcccctgctggtg

SEQ ID NO: 7169134 - DNA, 22 bp, Homo sapiens
tcccactgagcccctgctggtg

SEQ ID NO: 7169135 - DNA, 21 bp, Homo sapiens
tcccactgccacagcttcagg

SEQ ID NO: 7169136 - DNA, 22 bp, Homo sapiens
tccagtgtggacccctgcagtc

SEQ ID NO: 7169137 - DNA, 22 bp, Homo sapiens
tccagtgtctgagcccttagct

SEQ ID NO: 7169138 - DNA, 19 bp, Homo sapiens
tccagtgtagctggtcatt

SEQ ID NO: 7169139 - DNA, 20 bp, Homo sapiens
tccagtgtggggactggggc

SEQ ID NO: 7169140 - DNA, 16 bp, Homo sapiens
tccagtgttcctggat

SEQ ID NO: 7169141 - DNA, 22 bp, Homo sapiens
tcccagcagtcagagctatgtg

SEQ ID NO: 7169142 - DNA, 22 bp, Homo sapiens
tcccagcagtcagagctatgtg

SEQ ID NO: 7169143 - DNA, 22 bp, Homo sapiens
tcccagcagtcagagctatgtg

SEQ ID NO: 7169144 - DNA, 22 bp, Homo sapiens
tcccagcagtcagagctatgtg

SEQ ID NO: 7169145 - DNA, 22 bp, Homo sapiens
tcccagcataacaaactgcccg

SEQ ID NO: 7169146 - DNA, 22 bp, Homo sapiens
tcccagcataacaaactgcccg

SEQ ID NO: 7169147 - DNA, 22 bp, Homo sapiens
tcccagcctttcttttctgctg

SEQ ID NO: 7169148 - DNA, 22 bp, Homo sapiens
tcccagcctttcttttctgctg

SEQ ID NO: 7169149 - DNA, 22 bp, Homo sapiens
tcccagcctttcttttctgctg

SEQ ID NO: 7169150 - DNA, 22 bp, Homo sapiens
tcccagcagggccgaccagcct

SEQ ID NO: 7169151 - DNA, 22 bp, Homo sapiens
tcccagcagggccgaccagcct

SEQ ID NO: 7169152 - DNA, 22 bp, Homo sapiens
tcccagcaggagtccagttccc

SEQ ID NO: 7169153 - DNA, 22 bp, Homo sapiens
tcccagcagatgagctgaccta

SEQ ID NO: 7169154 - DNA, 22 bp, Homo sapiens
tcccagcagatgagctgaccta

SEQ ID NO: 7169155 - DNA, 22 bp, Homo sapiens
tcccagcagatgagctgaccta

SEQ ID NO: 7169156 - DNA, 22 bp, Homo sapiens
tcccagcagcatagctcagaat

SEQ ID NO: 7169157 - DNA, 22 bp, Homo sapiens
tcccagattcctgctcttatat

SEQ ID NO: 7169158 - DNA, 22 bp, Homo sapiens
tcccagattcctgctcttatat

SEQ ID NO: 7169159 - DNA, 22 bp, Homo sapiens
tcccagattgttgatggcttaa

SEQ ID NO: 7169160 - DNA, 22 bp, Homo sapiens
tcccagattcctgctcttatat

SEQ ID NO: 7169161 - DNA, 22 bp, Homo sapiens
tcccagagttcaatgggaaggt

SEQ ID NO: 7169162 - DNA, 22 bp, Homo sapiens
tcccagagttcaatgggaaggt

SEQ ID NO: 7169163 - DNA, 22 bp, Homo sapiens
tcccagagtttcctgtgtccca

SEQ ID NO: 7169164 - DNA, 22 bp, Homo sapiens
tcccagcaagaaagggggtggc

SEQ ID NO: 7169165 - DNA, 22 bp, Homo sapiens
tcccagcacagggcagatgtga

SEQ ID NO: 7169166 - DNA, 22 bp, Homo sapiens
tcccagcacagggcagatgtga

SEQ ID NO: 7169167 - DNA, 22 bp, Homo sapiens
tcccagcacgtctgctgtttct

SEQ ID NO: 7169168 - DNA, 22 bp, Homo sapiens
tcccagcacgtctgctgtttct

SEQ ID NO: 7169169 - DNA, 22 bp, Homo sapiens
tcccagcacgtctgctgtttct

SEQ ID NO: 7169170 - DNA, 22 bp, Homo sapiens
tcccagcactgtaattctttgg

SEQ ID NO: 7169171 - DNA, 22 bp, Homo sapiens
tcccagcactgtaattctttgg

SEQ ID NO: 7169172 - DNA, 22 bp, Homo sapiens
tcccagcagagccagcaagccg

SEQ ID NO: 7169173 - DNA, 22 bp, Homo sapiens
tcccagcagagccagcaagccg

SEQ ID NO: 7169174 - DNA, 22 bp, Homo sapiens
tcccagcagagccagcaagccg

SEQ ID NO: 7169175 - DNA, 22 bp, Homo sapiens
tcccagcagagccagcaagccg

SEQ ID NO: 7169176 - DNA, 21 bp, Homo sapiens
tcccagctgggtcagtgctgc

SEQ ID NO: 7169177 - DNA, 21 bp, Homo sapiens
tcccagctgggtcagtgctgc

SEQ ID NO: 7169178 - DNA, 21 bp, Homo sapiens
tcccagctgggtcagtgctgc

SEQ ID NO: 7169179 - DNA, 22 bp, Homo sapiens
tcccagctgagattgagcaagg

SEQ ID NO: 7169180 - DNA, 22 bp, Homo sapiens
tcccagctgagattgagcaagg

SEQ ID NO: 7169181 - DNA, 22 bp, Homo sapiens
tcccagctgagattgagcaagg

SEQ ID NO: 7169182 - DNA, 22 bp, Homo sapiens
tcccagctcacatatggtaact

SEQ ID NO: 7169183 - DNA, 22 bp, Homo sapiens
tcccagctcacatatggtaact

SEQ ID NO: 7169184 - DNA, 22 bp, Homo sapiens
tcccagctactctagaggctga

SEQ ID NO: 7169185 - DNA, 22 bp, Homo sapiens
tcccagctactctagaggctga

SEQ ID NO: 7169186 - DNA, 22 bp, Homo sapiens
tcccagcgcggggggaggatcc

SEQ ID NO: 7169187 - DNA, 22 bp, Homo sapiens
tcccaggaaaacactcgaggac

SEQ ID NO: 7169188 - DNA, 22 bp, Homo sapiens
tcccaggaaaacactcgaggac

SEQ ID NO: 7169189 - DNA, 22 bp, Homo sapiens
tcccagcttagatttgctcatt

SEQ ID NO: 7169190 - DNA, 22 bp, Homo sapiens
tcccagcttagatttgctcatt

SEQ ID NO: 7169191 - DNA, 22 bp, Homo sapiens
tcccagcttagatttgctcatt

SEQ ID NO: 7169192 - DNA, 22 bp, Homo sapiens
tcccagcttagatttgctcatt

SEQ ID NO: 7169193 - DNA, 22 bp, Homo sapiens
tcccaggaaaacactcgaggac

SEQ ID NO: 7169194 - DNA, 21 bp, Homo sapiens
tcccagctgggtcagtgctgc

SEQ ID NO: 7169195 - DNA, 21 bp, Homo sapiens
tcccagctgggtcagtgctgc

SEQ ID NO: 7169196 - DNA, 22 bp, Homo sapiens
tcccagctgtgtggaggagatg

SEQ ID NO: 7169197 - DNA, 22 bp, Homo sapiens
tcccaggaaaacactcgaggac

SEQ ID NO: 7169198 - DNA, 17 bp, Homo sapiens
tcccaggaacagggaat

SEQ ID NO: 7169199 - DNA, 17 bp, Homo sapiens
tcccaggaacagggaat

SEQ ID NO: 7169200 - DNA, 17 bp, Homo sapiens
tcccaggaacagggaat

SEQ ID NO: 7169201 - DNA, 19 bp, Homo sapiens
tcccaggaaccttttattt

SEQ ID NO: 7169202 - DNA, 22 bp, Homo sapiens
tcccaggaagatcccagggacc

SEQ ID NO: 7169203 - DNA, 22 bp, Homo sapiens
tcccaggaagatcccagggacc

SEQ ID NO: 7169204 - DNA, 22 bp, Homo sapiens
tcccaggaagatcccagggacc

SEQ ID NO: 7169205 - DNA, 22 bp, Homo sapiens
tcccaggaagatcccagggacc

SEQ ID NO: 7169206 - DNA, 19 bp, Homo sapiens
tcccaggaagcaaatgtca

SEQ ID NO: 7169207 - DNA, 22 bp, Homo sapiens
tcccaggaaggattcggcattt

SEQ ID NO: 7169208 - DNA, 22 bp, Homo sapiens
tcccaggaatccgtcctctaga

SEQ ID NO: 7169209 - DNA, 22 bp, Homo sapiens
tcccaggatgaagacagtgttg

SEQ ID NO: 7169210 - DNA, 22 bp, Homo sapiens
tcccaggatgaagacagtgttg

SEQ ID NO: 7169211 - DNA, 22 bp, Homo sapiens
tcccaggatgaagacagtgttg

SEQ ID NO: 7169212 - DNA, 22 bp, Homo sapiens
tcccaggatgtgcgtgccgccg

SEQ ID NO: 7169213 - DNA, 22 bp, Homo sapiens
tcccaggatgttggcggcaggt

SEQ ID NO: 7169214 - DNA, 22 bp, Homo sapiens
tccactcatgagatctggctga

SEQ ID NO: 7169215 - DNA, 22 bp, Homo sapiens
tccacgtgagcttcgtgtgcag

SEQ ID NO: 7169216 - DNA, 22 bp, Homo sapiens
tccactcaaggccattgcacat

SEQ ID NO: 7169217 - DNA, 22 bp, Homo sapiens
tccactcaaggccattgcacat

SEQ ID NO: 7169218 - DNA, 22 bp, Homo sapiens
tccactccttatgccagacggt

SEQ ID NO: 7169219 - DNA, 22 bp, Homo sapiens
tccactccttatgccagacggt

SEQ ID NO: 7169220 - DNA, 22 bp, Homo sapiens
tccactctaattactaccttct

SEQ ID NO: 7169221 - DNA, 22 bp, Homo sapiens
tccactctaattactaccttct

SEQ ID NO: 7169222 - DNA, 22 bp, Homo sapiens
tccacgtgagcttcgtgtgcag

SEQ ID NO: 7169223 - DNA, 22 bp, Homo sapiens
tccacgtgagcttcgtgtgcag

SEQ ID NO: 7169224 - DNA, 22 bp, Homo sapiens
tccacgctgtgtgaccttgggc

SEQ ID NO: 7169225 - DNA, 22 bp, Homo sapiens
tccacgttttcaacacagccaa

SEQ ID NO: 7169226 - DNA, 22 bp, Homo sapiens
tccaccctgctttcttatctcc

SEQ ID NO: 7169227 - DNA, 22 bp, Homo sapiens
tccacctccatgctgggcagag

SEQ ID NO: 7169228 - DNA, 22 bp, Homo sapiens
tccacctccatgctgggcagag

SEQ ID NO: 7169229 - DNA, 19 bp, Homo sapiens
tccacctttcttcatttgg

SEQ ID NO: 7169230 - DNA, 22 bp, Homo sapiens
tccacgctgtgtgaccttgggc

SEQ ID NO: 7169231 - DNA, 20 bp, Homo sapiens
tccacttactagctctgtga

SEQ ID NO: 7169232 - DNA, 22 bp, Homo sapiens
tccacttcatccagggtcacca

SEQ ID NO: 7169233 - DNA, 22 bp, Homo sapiens
tccacttccacgtgtgcagaat

SEQ ID NO: 7169234 - DNA, 22 bp, Homo sapiens
tccacttctattgggtcttggt

SEQ ID NO: 7169235 - DNA, 22 bp, Homo sapiens
tccacttgccctcttctgtgct

SEQ ID NO: 7169236 - DNA, 22 bp, Homo sapiens
tccactttagcaatgattgaat

SEQ ID NO: 7169237 - DNA, 22 bp, Homo sapiens
tccactttagcaatgattgaat

SEQ ID NO: 7169238 - DNA, 22 bp, Homo sapiens
tccagaaaaagtaatttatttg

SEQ ID NO: 7169239 - DNA, 21 bp, Homo sapiens
tccagaaaagaggtcattagc

SEQ ID NO: 7169240 - DNA, 22 bp, Homo sapiens
tccagaaaattttacagtgcct

SEQ ID NO: 7169241 - DNA, 22 bp, Homo sapiens
tccagaaaattttacagtgcct

SEQ ID NO: 7169242 - DNA, 22 bp, Homo sapiens
tccactgctcattccacaggca

SEQ ID NO: 7169243 - DNA, 22 bp, Homo sapiens
tccactgcagcttctgatggaa

SEQ ID NO: 7169244 - DNA, 22 bp, Homo sapiens
tccactgctacaacctcccaga

SEQ ID NO: 7169245 - DNA, 22 bp, Homo sapiens
tccactggcctctgtctttcag

SEQ ID NO: 7169246 - DNA, 22 bp, Homo sapiens
tccactggcttggaaaatcatt

SEQ ID NO: 7169247 - DNA, 22 bp, Homo sapiens
tccactgtgcagctctgctgat

SEQ ID NO: 7169248 - DNA, 22 bp, Homo sapiens
tccaccatgatttagcactggc

SEQ ID NO: 7169249 - DNA, 22 bp, Homo sapiens
tccaccatgatttagcactggc

SEQ ID NO: 7169250 - DNA, 22 bp, Homo sapiens
tccaccagttcaccttgtagca

SEQ ID NO: 7169251 - DNA, 18 bp, Homo sapiens
tccaccagtcaatctgtc

SEQ ID NO: 7169252 - DNA, 22 bp, Homo sapiens
tccaccatgtaacaagctctgt

SEQ ID NO: 7169253 - DNA, 22 bp, Homo sapiens
tccaccatgtaacaagctctgt

SEQ ID NO: 7169254 - DNA, 22 bp, Homo sapiens
tccaccatgtaacaagctctgt

SEQ ID NO: 7169255 - DNA, 22 bp, Homo sapiens
tccacccagcacactgtggtag

SEQ ID NO: 7169256 - DNA, 22 bp, Homo sapiens
tccacccagcacactgtggtag

SEQ ID NO: 7169257 - DNA, 19 bp, Homo sapiens
tccaccccagccagctctg

SEQ ID NO: 7169258 - DNA, 19 bp, Homo sapiens
tccaccccagccagctctg

SEQ ID NO: 7169259 - DNA, 23 bp, Homo sapiens
tccaccccagctgaggcttagcc

SEQ ID NO: 7169260 - DNA, 22 bp, Homo sapiens
tccaccaggctccatgttcagt

SEQ ID NO: 7169261 - DNA, 22 bp, Homo sapiens
tccaccagggtttcatctccct

SEQ ID NO: 7169262 - DNA, 22 bp, Homo sapiens
tccaccagcttcttcaccagct

SEQ ID NO: 7169263 - DNA, 20 bp, Homo sapiens
tccaccaggaagggtaggga

SEQ ID NO: 7169264 - DNA, 20 bp, Homo sapiens
tccaccaggaagggtaggga

SEQ ID NO: 7169265 - DNA, 20 bp, Homo sapiens
tccaccaggaagggtaggga

SEQ ID NO: 7169266 - DNA, 22 bp, Homo sapiens
tccaccagcttcttcaccagct

SEQ ID NO: 7169267 - DNA, 21 bp, Homo sapiens
tccaccagctcttcctcttca

SEQ ID NO: 7169268 - DNA, 22 bp, Homo sapiens
tccaccagcagcctgtcagcct

SEQ ID NO: 7169269 - DNA, 22 bp, Homo sapiens
tccaccagccaggcccaggctg

SEQ ID NO: 7169270 - DNA, 22 bp, Homo sapiens
tccaccagccaggcccaggctg

SEQ ID NO: 7169271 - DNA, 22 bp, Homo sapiens
tccaccagcagcctgtcagcct

SEQ ID NO: 7169272 - DNA, 22 bp, Homo sapiens
tccaccagagccctctttgcgg

SEQ ID NO: 7169273 - DNA, 22 bp, Homo sapiens
tccaccagagccttcccatgct

SEQ ID NO: 7169274 - DNA, 22 bp, Homo sapiens
tccacagggattcacccaaaag

SEQ ID NO: 7169275 - DNA, 22 bp, Homo sapiens
tccacagggcctttctggtgtg

SEQ ID NO: 7169276 - DNA, 22 bp, Homo sapiens
tccacattctctgttacagata

SEQ ID NO: 7169277 - DNA, 22 bp, Homo sapiens
tccaccacttcctgcagccatt

SEQ ID NO: 7169278 - DNA, 22 bp, Homo sapiens
tccacagaccagtatctgcagc

SEQ ID NO: 7169279 - DNA, 22 bp, Homo sapiens
tccacagaccagtatctgcagc

SEQ ID NO: 7169280 - DNA, 22 bp, Homo sapiens
tccacagaccagtatctgcagc

SEQ ID NO: 7169281 - DNA, 22 bp, Homo sapiens
tccacagaccagtatctgcagc

SEQ ID NO: 7169282 - DNA, 22 bp, Homo sapiens
tccacagaatgtaagatccaca

SEQ ID NO: 7169283 - DNA, 22 bp, Homo sapiens
tccacagaatgtaagatccaca

SEQ ID NO: 7169284 - DNA, 22 bp, Homo sapiens
tccacagaatgtaagatccaca

SEQ ID NO: 7169285 - DNA, 22 bp, Homo sapiens
tccacagaccagtatctgcagc

SEQ ID NO: 7169286 - DNA, 22 bp, Homo sapiens
tccacagactattaagtgatct

SEQ ID NO: 7169287 - DNA, 22 bp, Homo sapiens
tccacacacatttctatgtgca

SEQ ID NO: 7169288 - DNA, 22 bp, Homo sapiens
tccacacttgctgtctgctgag

SEQ ID NO: 7169289 - DNA, 22 bp, Homo sapiens
tccacagaatggaattctccgc

SEQ ID NO: 7169290 - DNA, 22 bp, Homo sapiens
tccacagaatggaattctccgc

SEQ ID NO: 7169291 - DNA, 22 bp, Homo sapiens
tccacagaatgtaagatccaca

SEQ ID NO: 7169292 - DNA, 22 bp, Homo sapiens
tcattaataagtctaactctcc

SEQ ID NO: 7169293 - DNA, 22 bp, Homo sapiens
tcattaatcccggggtccaggg

SEQ ID NO: 7169294 - DNA, 22 bp, Homo sapiens
tcattaatttgcttagacttat

SEQ ID NO: 7169295 - DNA, 22 bp, Homo sapiens
tccacagcacaaagccagtgtg

SEQ ID NO: 7169296 - DNA, 22 bp, Homo sapiens
tccacagcacaaagccagtgtg

SEQ ID NO: 7169297 - DNA, 22 bp, Homo sapiens
tccacagcattattagaaggat

SEQ ID NO: 7169298 - DNA, 22 bp, Homo sapiens
tccacagctgtcctgtaacagg

SEQ ID NO: 7169299 - DNA, 22 bp, Homo sapiens
tccacaggaaagcacctcccat

SEQ ID NO: 7169300 - DNA, 22 bp, Homo sapiens
tccacagataaaaacagaggtt

SEQ ID NO: 7169301 - DNA, 22 bp, Homo sapiens
tccacagatgacagaggggatg

SEQ ID NO: 7169302 - DNA, 22 bp, Homo sapiens
tccacagattaaaaacatactt

SEQ ID NO: 7169303 - DNA, 22 bp, Homo sapiens
tccacagattaaaaacatactt

SEQ ID NO: 7169304 - DNA, 22 bp, Homo sapiens
tccacagattaaaaacatactt

SEQ ID NO: 7169305 - DNA, 22 bp, Homo sapiens
tccacagcacaaagccagtgtg

SEQ ID NO: 7169306 - DNA, 22 bp, Homo sapiens
tccacaggcaagtctcttggca

SEQ ID NO: 7169307 - DNA, 22 bp, Homo sapiens
tccacaggcaagtctcttggca

SEQ ID NO: 7169308 - DNA, 22 bp, Homo sapiens
tccacaggctgaggcccttctg

SEQ ID NO: 7169309 - DNA, 22 bp, Homo sapiens
tccacaggctgaggcccttctg

SEQ ID NO: 7169310 - DNA, 22 bp, Homo sapiens
tccacagggatgcctgcggctt

SEQ ID NO: 7169311 - DNA, 22 bp, Homo sapiens
tccacagggatgttgagttctt

SEQ ID NO: 7169312 - DNA, 22 bp, Homo sapiens
tccacagggatgttgagttctt

SEQ ID NO: 7169313 - DNA, 21 bp, Homo sapiens
tcatgtgtaacttttgaccac

SEQ ID NO: 7169314 - DNA, 22 bp, Homo sapiens
tcatgtgtcctagttcatataa

SEQ ID NO: 7169315 - DNA, 22 bp, Homo sapiens
tcatgtgtcctagttcatataa

SEQ ID NO: 7169316 - DNA, 22 bp, Homo sapiens
tcatgtgtctgccagtgtttat

SEQ ID NO: 7169317 - DNA, 22 bp, Homo sapiens
tcatgttattgactcataatat

SEQ ID NO: 7169318 - DNA, 22 bp, Homo sapiens
tcatgtgttaaactccaagata

SEQ ID NO: 7169319 - DNA, 22 bp, Homo sapiens
tcatgtgttgcactgaggacct

SEQ ID NO: 7169320 - DNA, 22 bp, Homo sapiens
tcatgtgtctgccagtgtttat

SEQ ID NO: 7169321 - DNA, 22 bp, Homo sapiens
tcatgtgtctgctgcagctgtt

SEQ ID NO: 7169322 - DNA, 20 bp, Homo sapiens
tcatgtgtgtcctacagaga

SEQ ID NO: 7169323 - DNA, 22 bp, Homo sapiens
tcatgtgtgtttcatgtatgga

SEQ ID NO: 7169324 - DNA, 22 bp, Homo sapiens
tcatgtttgttggaaatgtggc

SEQ ID NO: 7169325 - DNA, 22 bp, Homo sapiens
tcatgtttgccctaagaaaaag

SEQ ID NO: 7169326 - DNA, 20 bp, Homo sapiens
tcatgttgggccatcagaat

SEQ ID NO: 7169327 - DNA, 22 bp, Homo sapiens
tcatgtttttgccatatgactc

SEQ ID NO: 7169328 - DNA, 22 bp, Homo sapiens
tcatgttttagctgcaaaatga

SEQ ID NO: 7169329 - DNA, 22 bp, Homo sapiens
tccagccctgcttcctgcctca

SEQ ID NO: 7169330 - DNA, 22 bp, Homo sapiens
tccagccctgcttcctgcctca

SEQ ID NO: 7169331 - DNA, 22 bp, Homo sapiens
tccagccctgcccattctctcg

SEQ ID NO: 7169332 - DNA, 17 bp, Homo sapiens
tccagccctgcccgacg

SEQ ID NO: 7169333 - DNA, 17 bp, Homo sapiens
tccagccctgcccgacg

SEQ ID NO: 7169334 - DNA, 20 bp, Homo sapiens
tccagccctcatgtcgctca

SEQ ID NO: 7169335 - DNA, 22 bp, Homo sapiens
tccagccctcctgggatcacag

SEQ ID NO: 7169336 - DNA, 22 bp, Homo sapiens
tccagccctcctgggatcacag

SEQ ID NO: 7169337 - DNA, 22 bp, Homo sapiens
tccagccctcctgggatcacag

SEQ ID NO: 7169338 - DNA, 22 bp, Homo sapiens
tccagccctctggcccgcggtg

SEQ ID NO: 7169339 - DNA, 22 bp, Homo sapiens
tccagccctctggcccgcggtg

SEQ ID NO: 7169340 - DNA, 22 bp, Homo sapiens
tccagccctgcactgattagat

SEQ ID NO: 7169341 - DNA, 22 bp, Homo sapiens
tccagccctgcccattctctcg

SEQ ID NO: 7169342 - DNA, 22 bp, Homo sapiens
tccagcccgactgggcctgccg

SEQ ID NO: 7169343 - DNA, 22 bp, Homo sapiens
tccagcccgactgggcctgccg

SEQ ID NO: 7169344 - DNA, 22 bp, Homo sapiens
tccagcccgactgggcctgccg

SEQ ID NO: 7169345 - DNA, 22 bp, Homo sapiens
tccagcccgactgggcctgccg

SEQ ID NO: 7169346 - DNA, 19 bp, Homo sapiens
tccagcccctctgtgtgtg

SEQ ID NO: 7169347 - DNA, 20 bp, Homo sapiens
tccagcccctgcatgttgct

SEQ ID NO: 7169348 - DNA, 20 bp, Homo sapiens
tccagcccctgcatgttgct

SEQ ID NO: 7169349 - DNA, 20 bp, Homo sapiens
tccagcccctgcatgttgct

SEQ ID NO: 7169350 - DNA, 22 bp, Homo sapiens
tccagccccttttactcattca

SEQ ID NO: 7169351 - DNA, 22 bp, Homo sapiens
tccagcccgagggcgctgatga

SEQ ID NO: 7169352 - DNA, 22 bp, Homo sapiens
tccagcccgggggcaggtgacc

SEQ ID NO: 7169353 - DNA, 22 bp, Homo sapiens
tccagcccgggggcaggtgacc

SEQ ID NO: 7169354 - DNA, 22 bp, Homo sapiens
tccagcccgggggcaggtgacc

SEQ ID NO: 7169355 - DNA, 22 bp, Homo sapiens
tccagccctcagccaagtggaa

SEQ ID NO: 7169356 - DNA, 22 bp, Homo sapiens
tccagccctcagccaagtggaa

SEQ ID NO: 7169357 - DNA, 22 bp, Homo sapiens
tccagccctcagccaagtggaa

SEQ ID NO: 7169358 - DNA, 22 bp, Homo sapiens
tccagccctcagccaagtggaa

SEQ ID NO: 7169359 - DNA, 20 bp, Homo sapiens
tccagccctcatgtcgctca

SEQ ID NO: 7169360 - DNA, 20 bp, Homo sapiens
tccagccctcatgtcgctca

SEQ ID NO: 7169361 - DNA, 22 bp, Homo sapiens
tccagcccaggctggagtgtag

SEQ ID NO: 7169362 - DNA, 20 bp, Homo sapiens
tccagcccaggtcctgcctg

SEQ ID NO: 7169363 - DNA, 20 bp, Homo sapiens
tccagcccaggtcctgcctg

SEQ ID NO: 7169364 - DNA, 20 bp, Homo sapiens
tccagcccaggtcctgcctg

SEQ ID NO: 7169365 - DNA, 22 bp, Homo sapiens
tccagccactcagcagggattg

SEQ ID NO: 7169366 - DNA, 22 bp, Homo sapiens
tccagccactcagcagggattg

SEQ ID NO: 7169367 - DNA, 22 bp, Homo sapiens
tccagccactcagcagggattg

SEQ ID NO: 7169368 - DNA, 22 bp, Homo sapiens
tccagccactcagcagggattg

SEQ ID NO: 7169369 - DNA, 20 bp, Homo sapiens
tccagccacttccgctggtc

SEQ ID NO: 7169370 - DNA, 20 bp, Homo sapiens
tccagccacttccgctggtc

SEQ ID NO: 7169371 - DNA, 22 bp, Homo sapiens
tccagcccaggctggagtgtag

SEQ ID NO: 7169372 - DNA, 22 bp, Homo sapiens
tccagaaatgcaagccaggtgt

SEQ ID NO: 7169373 - DNA, 22 bp, Homo sapiens
tccagccactcagcagggattg

SEQ ID NO: 7169374 - DNA, 22 bp, Homo sapiens
tccagaaactgctgagataaga

SEQ ID NO: 7169375 - DNA, 19 bp, Homo sapiens
tccagcccctctgtgtgtg

SEQ ID NO: 7169376 - DNA, 19 bp, Homo sapiens
tccagcccctctgtgtgtg

SEQ ID NO: 7169377 - DNA, 19 bp, Homo sapiens
tccagcccctctgtgtgtg

SEQ ID NO: 7169378 - DNA, 22 bp, Homo sapiens
tccagcccctcctgagccaagc

SEQ ID NO: 7169379 - DNA, 22 bp, Homo sapiens
tccagcccctcctgagccaagc

SEQ ID NO: 7169380 - DNA, 22 bp, Homo sapiens
tccagccccgggatgttcttca

SEQ ID NO: 7169381 - DNA, 22 bp, Homo sapiens
tccagccccgggatgttcttca

SEQ ID NO: 7169382 - DNA, 22 bp, Homo sapiens
tccagcccatccctagcctggg

SEQ ID NO: 7169383 - DNA, 22 bp, Homo sapiens
tccagcccatccctagcctggg

SEQ ID NO: 7169384 - DNA, 22 bp, Homo sapiens
tccagcccatccctagcctggg

SEQ ID NO: 7169385 - DNA, 22 bp, Homo sapiens
tccagcccatccctagcctggg

SEQ ID NO: 7169386 - DNA, 22 bp, Homo sapiens
tccagccccgaggccggcgacg

SEQ ID NO: 7169387 - DNA, 22 bp, Homo sapiens
tccagccccggcttccttacag

SEQ ID NO: 7169388 - DNA, 20 bp, Homo sapiens
tccagccctgcttctctctt

SEQ ID NO: 7169389 - DNA, 20 bp, Homo sapiens
tccagccctgcttctctctt

SEQ ID NO: 7169390 - DNA, 22 bp, Homo sapiens
tccagccctgtggcttccaccc

SEQ ID NO: 7169391 - DNA, 22 bp, Homo sapiens
tccagccctgtggcttccaccc

SEQ ID NO: 7169392 - DNA, 23 bp, Homo sapiens
tccagcctcttgctctcacatgc

SEQ ID NO: 7169393 - DNA, 23 bp, Homo sapiens
tccagcctcttgctctcacatgc

SEQ ID NO: 7169394 - DNA, 22 bp, Homo sapiens
tccagcctgaactttgtccaga

SEQ ID NO: 7169395 - DNA, 19 bp, Homo sapiens
tccagcctgctgtttctct

SEQ ID NO: 7169396 - DNA, 19 bp, Homo sapiens
tccagcctgctgtttctct

SEQ ID NO: 7169397 - DNA, 22 bp, Homo sapiens
tccagcctggttgcgggcatcc

SEQ ID NO: 7169398 - DNA, 22 bp, Homo sapiens
tccagccttccttttcactctc

SEQ ID NO: 7169399 - DNA, 22 bp, Homo sapiens
tccagccttccttttcactctc

SEQ ID NO: 7169400 - DNA, 22 bp, Homo sapiens
tccagccttccttttcactctc

SEQ ID NO: 7169401 - DNA, 22 bp, Homo sapiens
tccagccttctcaaggctggct

SEQ ID NO: 7169402 - DNA, 22 bp, Homo sapiens
tccagccttctcaaggctggct

SEQ ID NO: 7169403 - DNA, 22 bp, Homo sapiens
tccagccttctcaaggctggct

SEQ ID NO: 7169404 - DNA, 22 bp, Homo sapiens
tccagccttctcaaggctggct

SEQ ID NO: 7169405 - DNA, 22 bp, Homo sapiens
tccagccttgccacttttctgt

SEQ ID NO: 7169406 - DNA, 22 bp, Homo sapiens
tccagccttgccacttttctgt

SEQ ID NO: 7169407 - DNA, 22 bp, Homo sapiens
tccagccttgccacttttctgt

SEQ ID NO: 7169408 - DNA, 21 bp, Homo sapiens
tccagcctttccctcacttcc

SEQ ID NO: 7169409 - DNA, 21 bp, Homo sapiens
tccagcctttccctcacttcc

SEQ ID NO: 7169410 - DNA, 22 bp, Homo sapiens
tccaggaaatcataaattgctt

SEQ ID NO: 7169411 - DNA, 22 bp, Homo sapiens
tccaggaactgaagccaggtgt

SEQ ID NO: 7169412 - DNA, 22 bp, Homo sapiens
tccaggaagccacactgggcct

SEQ ID NO: 7169413 - DNA, 22 bp, Homo sapiens
tccaggaaggactaatggtttg

SEQ ID NO: 7169414 - DNA, 22 bp, Homo sapiens
tccaggaatagatcagagattt

SEQ ID NO: 7169415 - DNA, 22 bp, Homo sapiens
tccaggaatagatcagagattt

SEQ ID NO: 7169416 - DNA, 22 bp, Homo sapiens
tccaggaatagatcagagattt

SEQ ID NO: 7169417 - DNA, 22 bp, Homo sapiens
tccaggaatagtcatgttttag

SEQ ID NO: 7169418 - DNA, 22 bp, Homo sapiens
tccaggaatctgtgcctagccc

SEQ ID NO: 7169419 - DNA, 23 bp, Homo sapiens
tccaggagcatgctggctggcga

SEQ ID NO: 7169420 - DNA, 23 bp, Homo sapiens
tccaggagcatgctggctggcga

SEQ ID NO: 7169421 - DNA, 22 bp, Homo sapiens
tccaggagcatccaggtgaagc

SEQ ID NO: 7169422 - DNA, 22 bp, Homo sapiens
tccaggagaaggccatccagcg

SEQ ID NO: 7169423 - DNA, 20 bp, Homo sapiens
tccaggagaactgggagccg

SEQ ID NO: 7169424 - DNA, 22 bp, Homo sapiens
tccaggagaaggccatccagcg

SEQ ID NO: 7169425 - DNA, 22 bp, Homo sapiens
tccaggagaaggccatccagcg

SEQ ID NO: 7169426 - DNA, 20 bp, Homo sapiens
tccaggagaactgggagccg

SEQ ID NO: 7169427 - DNA, 20 bp, Homo sapiens
tccaggagaactgggagccg

SEQ ID NO: 7169428 - DNA, 23 bp, Homo sapiens
tccaggagaacccctgtctgtcc

SEQ ID NO: 7169429 - DNA, 23 bp, Homo sapiens
tccaggagaacccctgtctgtcc

SEQ ID NO: 7169430 - DNA, 23 bp, Homo sapiens
tccaggagaacccctgtctgtcc

SEQ ID NO: 7169431 - DNA, 22 bp, Homo sapiens
tccaggaggactgagggggctg

SEQ ID NO: 7169432 - DNA, 22 bp, Homo sapiens
tccaggaggactgagggggctg

SEQ ID NO: 7169433 - DNA, 22 bp, Homo sapiens
tccaggagctcatccacgtcaa

SEQ ID NO: 7169434 - DNA, 22 bp, Homo sapiens
tccaggaggaggaaggctgcca

SEQ ID NO: 7169435 - DNA, 22 bp, Homo sapiens
tccaggaggaggaaggctgcca

SEQ ID NO: 7169436 - DNA, 22 bp, Homo sapiens
tccaggaggaggaaggctgcca

SEQ ID NO: 7169437 - DNA, 23 bp, Homo sapiens
tccaggagcatgctggctggcga

SEQ ID NO: 7169438 - DNA, 22 bp, Homo sapiens
tccaggacctgactgggcctgc

SEQ ID NO: 7169439 - DNA, 22 bp, Homo sapiens
tccaggactagcatttctgata

SEQ ID NO: 7169440 - DNA, 22 bp, Homo sapiens
tccaggactataggaaagacac

SEQ ID NO: 7169441 - DNA, 22 bp, Homo sapiens
tccaggactggttcacacggtg

SEQ ID NO: 7169442 - DNA, 21 bp, Homo sapiens
tccaggacttgagaattccag

SEQ ID NO: 7169443 - DNA, 20 bp, Homo sapiens
tccaggaatggtagaggact

SEQ ID NO: 7169444 - DNA, 20 bp, Homo sapiens
tccaggaatggtagaggact

SEQ ID NO: 7169445 - DNA, 21 bp, Homo sapiens
tccaggaatgtctgttcatct

SEQ ID NO: 7169446 - DNA, 22 bp, Homo sapiens
tccaggacagagtagaagcagc

SEQ ID NO: 7169447 - DNA, 22 bp, Homo sapiens
tccaggacagagtagaagcagc

SEQ ID NO: 7169448 - DNA, 22 bp, Homo sapiens
tccaggacagcggcaggcagat

SEQ ID NO: 7169449 - DNA, 22 bp, Homo sapiens
tccaggacagcggcaggcagat

SEQ ID NO: 7169450 - DNA, 22 bp, Homo sapiens
tccaggacagcggcaggcagat

SEQ ID NO: 7169451 - DNA, 22 bp, Homo sapiens
tccaggaccaaagacacatgta

SEQ ID NO: 7169452 - DNA, 22 bp, Homo sapiens
tccaggaccaaagacacatgta

SEQ ID NO: 7169453 - DNA, 23 bp, Homo sapiens
tccaggaccctggtagacacaca

SEQ ID NO: 7169454 - DNA, 22 bp, Homo sapiens
tcctccagcttctcttttgggg

SEQ ID NO: 7169455 - DNA, 22 bp, Homo sapiens
tcctccagctgtatcctgcctg

SEQ ID NO: 7169456 - DNA, 22 bp, Homo sapiens
tcctccagcttctcttttgggg

SEQ ID NO: 7169457 - DNA, 22 bp, Homo sapiens
tcctccaggataaaatgtgttg

SEQ ID NO: 7169458 - DNA, 22 bp, Homo sapiens
tcctccagctactaggcaaata

SEQ ID NO: 7169459 - DNA, 22 bp, Homo sapiens
tcctccagccctctaggaaaat

SEQ ID NO: 7169460 - DNA, 22 bp, Homo sapiens
tcctccagctgtatcctgcctg

SEQ ID NO: 7169461 - DNA, 22 bp, Homo sapiens
tcctccagctgtatcctgcctg

SEQ ID NO: 7169462 - DNA, 22 bp, Homo sapiens
tcctccaggcacctcactggct

SEQ ID NO: 7169463 - DNA, 22 bp, Homo sapiens
tcctccagggggatcttcagcc

SEQ ID NO: 7169464 - DNA, 22 bp, Homo sapiens
tcctccagggggatcttcagcc

SEQ ID NO: 7169465 - DNA, 22 bp, Homo sapiens
tcctccaggcacctcactggct

SEQ ID NO: 7169466 - DNA, 22 bp, Homo sapiens
tcctccaggataaaatgtgttg

SEQ ID NO: 7169467 - DNA, 22 bp, Homo sapiens
tcctccaggataaaatgtgttg

SEQ ID NO: 7169468 - DNA, 22 bp, Homo sapiens
tcctccagcaggactgaggccc

SEQ ID NO: 7169469 - DNA, 22 bp, Homo sapiens
tcctccagcaggactgaggccc

SEQ ID NO: 7169470 - DNA, 22 bp, Homo sapiens
tcctccagccctctaggaaaat

SEQ ID NO: 7169471 - DNA, 22 bp, Homo sapiens
tcctccagccctctaggaaaat

SEQ ID NO: 7169472 - DNA, 22 bp, Homo sapiens
tcctccagctactaggcaaata

SEQ ID NO: 7169473 - DNA, 23 bp, Homo sapiens
tcctccagaggccctccttggcc

SEQ ID NO: 7169474 - DNA, 22 bp, Homo sapiens
tcctccagcaggactgaggccc

SEQ ID NO: 7169475 - DNA, 22 bp, Homo sapiens
tcctccagcaggactgaggccc

SEQ ID NO: 7169476 - DNA, 22 bp, Homo sapiens
tcctccagagatttgagttatt

SEQ ID NO: 7169477 - DNA, 23 bp, Homo sapiens
tcctccagaggccctccttggcc

SEQ ID NO: 7169478 - DNA, 22 bp, Homo sapiens
tcctccagaccacttctgtgcg

SEQ ID NO: 7169479 - DNA, 22 bp, Homo sapiens
tcctccagaccacttctgtgcg

SEQ ID NO: 7169480 - DNA, 22 bp, Homo sapiens
tcctccagagatttgagttatt

SEQ ID NO: 7169481 - DNA, 22 bp, Homo sapiens
tcctccagagatttgagttatt

SEQ ID NO: 7169482 - DNA, 23 bp, Homo sapiens
tcctccagaggccctccttggcc

SEQ ID NO: 7169483 - DNA, 23 bp, Homo sapiens
tcctccagaggccctccttggcc

SEQ ID NO: 7169484 - DNA, 20 bp, Homo sapiens
tcctccagaagggcagggtg

SEQ ID NO: 7169485 - DNA, 20 bp, Homo sapiens
tcctccagaagggcagggtg

SEQ ID NO: 7169486 - DNA, 20 bp, Homo sapiens
tcctccagaagggcagggtg

SEQ ID NO: 7169487 - DNA, 22 bp, Homo sapiens
tcctccagaaactgaggcagaa

SEQ ID NO: 7169488 - DNA, 20 bp, Homo sapiens
tcctccagaagggcagggtg

SEQ ID NO: 7169489 - DNA, 22 bp, Homo sapiens
tcctccacgatggcacacctgg

SEQ ID NO: 7169490 - DNA, 22 bp, Homo sapiens
tcctccacgatggcacacctgg

SEQ ID NO: 7169491 - DNA, 22 bp, Homo sapiens
tcctccactttgtctagcaaca

SEQ ID NO: 7169492 - DNA, 22 bp, Homo sapiens
tcctccagaaactgaggcagaa

SEQ ID NO: 7169493 - DNA, 22 bp, Homo sapiens
tcctccagaaactgaggcagaa

SEQ ID NO: 7169494 - DNA, 22 bp, Homo sapiens
tcctccagaaactgaggcagaa

SEQ ID NO: 7169495 - DNA, 22 bp, Homo sapiens
tcctccagaaactgaggcagaa

SEQ ID NO: 7169496 - DNA, 22 bp, Homo sapiens
tcctcatctcggaacctgccac

SEQ ID NO: 7169497 - DNA, 22 bp, Homo sapiens
tcctcatgccgggtctcacgct

SEQ ID NO: 7169498 - DNA, 22 bp, Homo sapiens
tcctcatgccgggtctcacgct

SEQ ID NO: 7169499 - DNA, 22 bp, Homo sapiens
tcctcattcttggtgcatcaaa

SEQ ID NO: 7169500 - DNA, 22 bp, Homo sapiens
tcctcattgtcactggcccgca

SEQ ID NO: 7169501 - DNA, 22 bp, Homo sapiens
tccggcggccggcctgagcccg

SEQ ID NO: 7169502 - DNA, 22 bp, Homo sapiens
tccggcagcagctctgaaggag

SEQ ID NO: 7169503 - DNA, 22 bp, Homo sapiens
tccgcgtgggaggggccggtgt

SEQ ID NO: 7169504 - DNA, 22 bp, Homo sapiens
tccgggaggcagaggttgcagt

SEQ ID NO: 7169505 - DNA, 22 bp, Homo sapiens
tccgggcaactgaagggaggtt

SEQ ID NO: 7169506 - DNA, 22 bp, Homo sapiens
tccgggcaactgaagggaggtt

SEQ ID NO: 7169507 - DNA, 22 bp, Homo sapiens
tccgggagctgaacgtcttgcg

SEQ ID NO: 7169508 - DNA, 22 bp, Homo sapiens
tccgagaagcataaagcaggaa

SEQ ID NO: 7169509 - DNA, 22 bp, Homo sapiens
tccgaggccaaagctgtgaata

SEQ ID NO: 7169510 - DNA, 22 bp, Homo sapiens
tccgagggctggacgcaggggc

SEQ ID NO: 7169511 - DNA, 22 bp, Homo sapiens
tccgataagcaattcttgtgct

SEQ ID NO: 7169512 - DNA, 22 bp, Homo sapiens
tccctttcacttaactagccca

SEQ ID NO: 7169513 - DNA, 22 bp, Homo sapiens
tcctcatagactgactgcttgc

SEQ ID NO: 7169514 - DNA, 22 bp, Homo sapiens
tcctcatctcggaacctgccac

SEQ ID NO: 7169515 - DNA, 22 bp, Homo sapiens
tcctcatctcggaacctgccac

SEQ ID NO: 7169516 - DNA, 22 bp, Homo sapiens
tcctcagttataaataggaaac

SEQ ID NO: 7169517 - DNA, 22 bp, Homo sapiens
tcctcagtggggcattcattat

SEQ ID NO: 7169518 - DNA, 22 bp, Homo sapiens
tccgggtgactggctacccccc

SEQ ID NO: 7169519 - DNA, 22 bp, Homo sapiens
tccgggtgtttcaacttcccga

SEQ ID NO: 7169520 - DNA, 22 bp, Homo sapiens
tccgggttttacactcacatca

SEQ ID NO: 7169521 - DNA, 23 bp, Homo sapiens
tcctcagtatataaaggcagatg

SEQ ID NO: 7169522 - DNA, 22 bp, Homo sapiens
tcctcagtattgtggagcagat

SEQ ID NO: 7169523 - DNA, 22 bp, Homo sapiens
tcctccctgtaccattcctctg

SEQ ID NO: 7169524 - DNA, 22 bp, Homo sapiens
tcctccctgtaccattcctctg

SEQ ID NO: 7169525 - DNA, 22 bp, Homo sapiens
tcctccctgtaccattcctctg

SEQ ID NO: 7169526 - DNA, 22 bp, Homo sapiens
tcctcccttctcactgggaagg

SEQ ID NO: 7169527 - DNA, 22 bp, Homo sapiens
tcctcccttctcactgggaagg

SEQ ID NO: 7169528 - DNA, 22 bp, Homo sapiens
tcctcccttgactcctgctttt

SEQ ID NO: 7169529 - DNA, 22 bp, Homo sapiens
tcctcccttgactcctgctttt

SEQ ID NO: 7169530 - DNA, 22 bp, Homo sapiens
tcctccctgcactcagtgaagt

SEQ ID NO: 7169531 - DNA, 22 bp, Homo sapiens
tcctccctgggagcttctgagt

SEQ ID NO: 7169532 - DNA, 22 bp, Homo sapiens
tcctccctgggagcttctgagt

SEQ ID NO: 7169533 - DNA, 22 bp, Homo sapiens
tcctccctgggagcttctgagt

SEQ ID NO: 7169534 - DNA, 22 bp, Homo sapiens
tcctccctgggagcttctgagt

SEQ ID NO: 7169535 - DNA, 22 bp, Homo sapiens
tcctccctgggagcttctgagt

SEQ ID NO: 7169536 - DNA, 22 bp, Homo sapiens
tcctccctgtaccattcctctg

SEQ ID NO: 7169537 - DNA, 22 bp, Homo sapiens
tcctccctaaatcctagactgt

SEQ ID NO: 7169538 - DNA, 22 bp, Homo sapiens
tcctccctaactcatgatgagt

SEQ ID NO: 7169539 - DNA, 22 bp, Homo sapiens
tcctccctaactcatgatgagt

SEQ ID NO: 7169540 - DNA, 23 bp, Homo sapiens
tcctccctgacttctacagcaca

SEQ ID NO: 7169541 - DNA, 23 bp, Homo sapiens
tcctccctgacttctacagcaca

SEQ ID NO: 7169542 - DNA, 23 bp, Homo sapiens
tcctccctgacttctacagcaca

SEQ ID NO: 7169543 - DNA, 23 bp, Homo sapiens
tcctccctgacttctacagcaca

SEQ ID NO: 7169544 - DNA, 21 bp, Homo sapiens
tcctccctgagctgtggggga

SEQ ID NO: 7169545 - DNA, 22 bp, Homo sapiens
tcctccctgagtggggacagct

SEQ ID NO: 7169546 - DNA, 22 bp, Homo sapiens
tcctccctgagtggggacagct

SEQ ID NO: 7169547 - DNA, 22 bp, Homo sapiens
tcctccctgcactcagtgaagt

SEQ ID NO: 7169548 - DNA, 22 bp, Homo sapiens
tcctccagttccttggtttcag

SEQ ID NO: 7169549 - DNA, 22 bp, Homo sapiens
tcctccctaaatcctagactgt

SEQ ID NO: 7169550 - DNA, 23 bp, Homo sapiens
tcctcccaaatttcagcctcatt

SEQ ID NO: 7169551 - DNA, 23 bp, Homo sapiens
tcctcccaaatttcagcctcatt

SEQ ID NO: 7169552 - DNA, 22 bp, Homo sapiens
tcctcccctgcccatgaggagg

SEQ ID NO: 7169553 - DNA, 22 bp, Homo sapiens
tcctcccctgcccatgaggagg

SEQ ID NO: 7169554 - DNA, 22 bp, Homo sapiens
tcctccagtgtctggggccttg

SEQ ID NO: 7169555 - DNA, 22 bp, Homo sapiens
tcctccagttccttggtttcag

SEQ ID NO: 7169556 - DNA, 22 bp, Homo sapiens
tcctccagtgtctggggccttg

SEQ ID NO: 7169557 - DNA, 22 bp, Homo sapiens
tcctccagtgtctggggccttg

SEQ ID NO: 7169558 - DNA, 22 bp, Homo sapiens
tcctccagtggtactggccaat

SEQ ID NO: 7169559 - DNA, 22 bp, Homo sapiens
tcctccagtggcccagtccttc

SEQ ID NO: 7169560 - DNA, 22 bp, Homo sapiens
tcctccagtggtactggccaat

SEQ ID NO: 7169561 - DNA, 22 bp, Homo sapiens
tcctccagtggtactggccaat

SEQ ID NO: 7169562 - DNA, 22 bp, Homo sapiens
tcctccagtggcccagtccttc

SEQ ID NO: 7169563 - DNA, 22 bp, Homo sapiens
tcctccagtggcccagtccttc

SEQ ID NO: 7169564 - DNA, 22 bp, Homo sapiens
tcctccagtggcccagtccttc

SEQ ID NO: 7169565 - DNA, 22 bp, Homo sapiens
tcctccagtcttggtgaggttg

SEQ ID NO: 7169566 - DNA, 22 bp, Homo sapiens
tcctccagtcttggtgaggttg

SEQ ID NO: 7169567 - DNA, 22 bp, Homo sapiens
tcctccaggtctagggtggctt

SEQ ID NO: 7169568 - DNA, 22 bp, Homo sapiens
tcctccagggggatcttcagcc

SEQ ID NO: 7169569 - DNA, 22 bp, Homo sapiens
tcctccaggtctagggtggctt

SEQ ID NO: 7169570 - DNA, 22 bp, Homo sapiens
tcctccaggtctagggtggctt

SEQ ID NO: 7169571 - DNA, 22 bp, Homo sapiens
tcctccgggcacgtcagtccct

SEQ ID NO: 7169572 - DNA, 21 bp, Homo sapiens
tcctcctccactaggctagcc

SEQ ID NO: 7169573 - DNA, 22 bp, Homo sapiens
tcctcctcctcacagtcacctg

SEQ ID NO: 7169574 - DNA, 22 bp, Homo sapiens
tcctcctcctcacagtcacctg

SEQ ID NO: 7169575 - DNA, 22 bp, Homo sapiens
tcctcccttgactcctgctttt

SEQ ID NO: 7169576 - DNA, 22 bp, Homo sapiens
tcctcccttggggtttcgttat

SEQ ID NO: 7169577 - DNA, 22 bp, Homo sapiens
tcctcccttggggtttcgttat

SEQ ID NO: 7169578 - DNA, 22 bp, Homo sapiens
tcctcccttgactcctgctttt

SEQ ID NO: 7169579 - DNA, 22 bp, Homo sapiens
tcctcccttgactcctgctttt

SEQ ID NO: 7169580 - DNA, 22 bp, Homo sapiens
tcctcccttggggtttcgttat

SEQ ID NO: 7169581 - DNA, 19 bp, Homo sapiens
tcctccctttggtgtcctg

SEQ ID NO: 7169582 - DNA, 22 bp, Homo sapiens
tcctcctcctcacagtcacctg

SEQ ID NO: 7169583 - DNA, 22 bp, Homo sapiens
tcctcctcctcacagtcacctg

SEQ ID NO: 7169584 - DNA, 22 bp, Homo sapiens
tcctcctctatcagacagtgcc

SEQ ID NO: 7169585 - DNA, 23 bp, Homo sapiens
tcctcctgacacagcctgagtga

SEQ ID NO: 7169586 - DNA, 23 bp, Homo sapiens
tcctcctgacacagcctgagtga

SEQ ID NO: 7169587 - DNA, 23 bp, Homo sapiens
tcctcctgacacagcctgagtga

SEQ ID NO: 7169588 - DNA, 23 bp, Homo sapiens
tcctcctgacacagcctgagtga

SEQ ID NO: 7169589 - DNA, 23 bp, Homo sapiens
tcctcctgagtgagagtgccagc

SEQ ID NO: 7169590 - DNA, 23 bp, Homo sapiens
tcctcctgagtgagagtgccagc

SEQ ID NO: 7169591 - DNA, 22 bp, Homo sapiens
tcctcctgcctttgcttcttgt

SEQ ID NO: 7169592 - DNA, 23 bp, Homo sapiens
tcctcctgacacagcctgagtga

SEQ ID NO: 7169593 - DNA, 23 bp, Homo sapiens
tcctcctgacacagcctgagtga

SEQ ID NO: 7169594 - DNA, 23 bp, Homo sapiens
tcctcctgagtgagagtgccagc

SEQ ID NO: 7169595 - DNA, 22 bp, Homo sapiens
tcctcctgcctttgcttcttgt

SEQ ID NO: 7169596 - DNA, 22 bp, Homo sapiens
tcctcctgctgttagtcttgaa

SEQ ID NO: 7169597 - DNA, 22 bp, Homo sapiens
tcctcctgctgttagtcttgaa

SEQ ID NO: 7169598 - DNA, 22 bp, Homo sapiens
tcctcctgctgttagtcttgaa

SEQ ID NO: 7169599 - DNA, 22 bp, Homo sapiens
tcctcctgctgttagtcttgaa

SEQ ID NO: 7169600 - DNA, 21 bp, Homo sapiens
tcctcctggccaggcggcccc

SEQ ID NO: 7169601 - DNA, 21 bp, Homo sapiens
tcctcctggccaggcggcccc

SEQ ID NO: 7169602 - DNA, 22 bp, Homo sapiens
tcccttgtgagaacatgtgttg

SEQ ID NO: 7169603 - DNA, 22 bp, Homo sapiens
tcccttgtcctcttcgtcactg

SEQ ID NO: 7169604 - DNA, 22 bp, Homo sapiens
tcccttgtcctgtgggaagagc

SEQ ID NO: 7169605 - DNA, 22 bp, Homo sapiens
tcccttgtcacctcacactatg

SEQ ID NO: 7169606 - DNA, 22 bp, Homo sapiens
tcccttctggcagcagtgtgag

SEQ ID NO: 7169607 - DNA, 22 bp, Homo sapiens
tcccttgagagttggccaattg

SEQ ID NO: 7169608 - DNA, 22 bp, Homo sapiens
tcccttcctcataggcagaagg

SEQ ID NO: 7169609 - DNA, 19 bp, Homo sapiens
tcccttcctgtcgggctcc

SEQ ID NO: 7169610 - DNA, 22 bp, Homo sapiens
tcccttcctcataggcagaagg

SEQ ID NO: 7169611 - DNA, 18 bp, Homo sapiens
tcccttctcccttgcctc

SEQ ID NO: 7169612 - DNA, 22 bp, Homo sapiens
tcccttcatcagtgagcaagcc

SEQ ID NO: 7169613 - DNA, 22 bp, Homo sapiens
tcccttaaaactcatgtgttgt

SEQ ID NO: 7169614 - DNA, 22 bp, Homo sapiens
tcccttatctggtattttttag

SEQ ID NO: 7169615 - DNA, 23 bp, Homo sapiens
tccctgtgtacagcctgcatgag

SEQ ID NO: 7169616 - DNA, 22 bp, Homo sapiens
tccctgtattcgaaagtgatcg

SEQ ID NO: 7169617 - DNA, 22 bp, Homo sapiens
tccctgtccaaagtcttcctat

SEQ ID NO: 7169618 - DNA, 22 bp, Homo sapiens
tccctgtctcccttgagactag

SEQ ID NO: 7169619 - DNA, 22 bp, Homo sapiens
tccctgtctcccttgagactag

SEQ ID NO: 7169620 - DNA, 22 bp, Homo sapiens
tccctggggcagtggctcggag

SEQ ID NO: 7169621 - DNA, 22 bp, Homo sapiens
tccctggttacgtataaagatg

SEQ ID NO: 7169622 - DNA, 22 bp, Homo sapiens
tccctgtgcctatatgtgctga

SEQ ID NO: 7169623 - DNA, 22 bp, Homo sapiens
tccctgtgacaagtctgagttc

SEQ ID NO: 7169624 - DNA, 22 bp, Homo sapiens
tccctgtggaagactgccagag

SEQ ID NO: 7169625 - DNA, 22 bp, Homo sapiens
tccctgggcctatcttagctcc

SEQ ID NO: 7169626 - DNA, 22 bp, Homo sapiens
tccctgggcctatcttagctcc

SEQ ID NO: 7169627 - DNA, 22 bp, Homo sapiens
tccctgggcctatcttagctcc

SEQ ID NO: 7169628 - DNA, 22 bp, Homo sapiens
tccctgggcctcctgctatgca

SEQ ID NO: 7169629 - DNA, 22 bp, Homo sapiens
tccctgggcctcctgctatgca

SEQ ID NO: 7169630 - DNA, 22 bp, Homo sapiens
tccctgggcggacattctccca

SEQ ID NO: 7169631 - DNA, 22 bp, Homo sapiens
tccctgggcttctccagacttg

SEQ ID NO: 7169632 - DNA, 22 bp, Homo sapiens
tccctgggcttctccagacttg

SEQ ID NO: 7169633 - DNA, 22 bp, Homo sapiens
tccctggggaagggcaagcaag

SEQ ID NO: 7169634 - DNA, 22 bp, Homo sapiens
tccctggggaagggcaagcaag

SEQ ID NO: 7169635 - DNA, 22 bp, Homo sapiens
tccctggggatgttggcctgcc

SEQ ID NO: 7169636 - DNA, 22 bp, Homo sapiens
tcccaggattttaggctctcag

SEQ ID NO: 7169637 - DNA, 22 bp, Homo sapiens
tcccaggcaaaggcagctcatt

SEQ ID NO: 7169638 - DNA, 22 bp, Homo sapiens
tcccaggatgtttatggctggt

SEQ ID NO: 7169639 - DNA, 22 bp, Homo sapiens
tcccaggatgtttatggctggt

SEQ ID NO: 7169640 - DNA, 22 bp, Homo sapiens
tcccaggattttaggctctcag

SEQ ID NO: 7169641 - DNA, 22 bp, Homo sapiens
tcccaggattttaggctctcag

SEQ ID NO: 7169642 - DNA, 23 bp, Homo sapiens
tccctgagatgctgctctgtccc

SEQ ID NO: 7169643 - DNA, 21 bp, Homo sapiens
tccctgagcccaaggggctcc

SEQ ID NO: 7169644 - DNA, 21 bp, Homo sapiens
tccctgagcccaaggggctcc

SEQ ID NO: 7169645 - DNA, 22 bp, Homo sapiens
tccctgagctcacatggcagga

SEQ ID NO: 7169646 - DNA, 19 bp, Homo sapiens
tcccaggcaaaggcttctc

SEQ ID NO: 7169647 - DNA, 19 bp, Homo sapiens
tcccaggcaaaggcttctc

SEQ ID NO: 7169648 - DNA, 19 bp, Homo sapiens
tcccaggcaaaggcttctc

SEQ ID NO: 7169649 - DNA, 23 bp, Homo sapiens
tccctgagatgctgctctgtccc

SEQ ID NO: 7169650 - DNA, 23 bp, Homo sapiens
tccctgagatgctgctctgtccc

SEQ ID NO: 7169651 - DNA, 19 bp, Homo sapiens
tccctgagttccagcccag

SEQ ID NO: 7169652 - DNA, 16 bp, Homo sapiens
tccctgaggttttgga

SEQ ID NO: 7169653 - DNA, 22 bp, Homo sapiens
tccctgagtgggctggtagtat

SEQ ID NO: 7169654 - DNA, 22 bp, Homo sapiens
tccctgagtgtatgtggtgaac

SEQ ID NO: 7169655 - DNA, 22 bp, Homo sapiens
tccctgagggcagctcaagtcc

SEQ ID NO: 7169656 - DNA, 22 bp, Homo sapiens
tccctgagggcagctcaagtcc

SEQ ID NO: 7169657 - DNA, 22 bp, Homo sapiens
tccctgaggatgaggctgatca

SEQ ID NO: 7169658 - DNA, 22 bp, Homo sapiens
tccctgaggatgaggctgatca

SEQ ID NO: 7169659 - DNA, 22 bp, Homo sapiens
tccctgaggatggttgtattta

SEQ ID NO: 7169660 - DNA, 23 bp, Homo sapiens
tccctgagctggagagactgcac

SEQ ID NO: 7169661 - DNA, 23 bp, Homo sapiens
tccctgagctggagagactgcac

SEQ ID NO: 7169662 - DNA, 23 bp, Homo sapiens
tccctgagctggagagactgcac

SEQ ID NO: 7169663 - DNA, 22 bp, Homo sapiens
tccctgagctgagctcaacagc

SEQ ID NO: 7169664 - DNA, 22 bp, Homo sapiens
tccctgagcttcatcaggcttt

SEQ ID NO: 7169665 - DNA, 22 bp, Homo sapiens
tccctgagcttcatcaggcttt

SEQ ID NO: 7169666 - DNA, 22 bp, Homo sapiens
tccctgaggaaggggtgtggtg

SEQ ID NO: 7169667 - DNA, 22 bp, Homo sapiens
tccctgagcttctctgaaatgg

SEQ ID NO: 7169668 - DNA, 22 bp, Homo sapiens
tccctgcagacgtcctgcgggt

SEQ ID NO: 7169669 - DNA, 22 bp, Homo sapiens
tccctgcagacgtcctgcgggt

SEQ ID NO: 7169670 - DNA, 22 bp, Homo sapiens
tccctgcacccttgctgggccc

SEQ ID NO: 7169671 - DNA, 22 bp, Homo sapiens
tccctgcacccttgctgggccc

SEQ ID NO: 7169672 - DNA, 22 bp, Homo sapiens
tccctgcacagccgagccatgc

SEQ ID NO: 7169673 - DNA, 22 bp, Homo sapiens
tccctgcacagccgagccatgc

SEQ ID NO: 7169674 - DNA, 22 bp, Homo sapiens
tccctgcacagccgagccatgc

SEQ ID NO: 7169675 - DNA, 21 bp, Homo sapiens
tccctgagttctctgagcatc

SEQ ID NO: 7169676 - DNA, 22 bp, Homo sapiens
tccctgagttttctttctgact

SEQ ID NO: 7169677 - DNA, 22 bp, Homo sapiens
tccctgagttttctttctgact

SEQ ID NO: 7169678 - DNA, 22 bp, Homo sapiens
tccctgcagcaggtgatcaatg

SEQ ID NO: 7169679 - DNA, 22 bp, Homo sapiens
tccctgcagcaggtgatcaatg

SEQ ID NO: 7169680 - DNA, 22 bp, Homo sapiens
tccctgcagcccctgagccttc

SEQ ID NO: 7169681 - DNA, 22 bp, Homo sapiens
tccctgcagcccctgagccttc

SEQ ID NO: 7169682 - DNA, 22 bp, Homo sapiens
tccctgcagctgtaggccggcg

SEQ ID NO: 7169683 - DNA, 22 bp, Homo sapiens
tccctgcaggtggggtggccag

SEQ ID NO: 7169684 - DNA, 22 bp, Homo sapiens
tccctgcaggtggggtggccag

SEQ ID NO: 7169685 - DNA, 22 bp, Homo sapiens
tccctgcaggtgtgcaagctga

SEQ ID NO: 7169686 - DNA, 22 bp, Homo sapiens
tccctgcagtaggcagccctcc

SEQ ID NO: 7169687 - DNA, 22 bp, Homo sapiens
tccctgcagtaggcagccctcc

SEQ ID NO: 7169688 - DNA, 22 bp, Homo sapiens
tccctgcagtagtggctaagat

SEQ ID NO: 7169689 - DNA, 22 bp, Homo sapiens
tccctgcatttgggagagtgtc

SEQ ID NO: 7169690 - DNA, 22 bp, Homo sapiens
tccctgccctcagtgcacccgg

SEQ ID NO: 7169691 - DNA, 22 bp, Homo sapiens
tccctgccagtcctggtctgaa

SEQ ID NO: 7169692 - DNA, 22 bp, Homo sapiens
tccctgcatttgggagagtgtc

SEQ ID NO: 7169693 - DNA, 22 bp, Homo sapiens
tccctgccaatgattggagcaa

SEQ ID NO: 7169694 - DNA, 22 bp, Homo sapiens
tccctgccaatgattggagcaa

SEQ ID NO: 7169695 - DNA, 22 bp, Homo sapiens
tccctgggcaagtttactcttc

SEQ ID NO: 7169696 - DNA, 22 bp, Homo sapiens
tccctgggcacaatctgctggc

SEQ ID NO: 7169697 - DNA, 22 bp, Homo sapiens
tccctgggcacaatctgctggc

SEQ ID NO: 7169698 - DNA, 22 bp, Homo sapiens
tccctgggcatcacgttgcttc

SEQ ID NO: 7169699 - DNA, 22 bp, Homo sapiens
tccctgggcatcacgttgcttc

SEQ ID NO: 7169700 - DNA, 22 bp, Homo sapiens
tccctgggccacagctgtgagc

SEQ ID NO: 7169701 - DNA, 23 bp, Homo sapiens
tccctgggcccgtgccagcggtg

SEQ ID NO: 7169702 - DNA, 23 bp, Homo sapiens
tccctgggcccgtgccagcggtg

SEQ ID NO: 7169703 - DNA, 22 bp, Homo sapiens
tactggtccaacaaggttggca

SEQ ID NO: 7169704 - DNA, 18 bp, Homo sapiens
tactggtccttttatgat

SEQ ID NO: 7169705 - DNA, 22 bp, Homo sapiens
tactggtctcagcagattgagg

SEQ ID NO: 7169706 - DNA, 22 bp, Homo sapiens
tactggggtatgctcagatata

SEQ ID NO: 7169707 - DNA, 23 bp, Homo sapiens
tactggtcagtgcctctggggct

SEQ ID NO: 7169708 - DNA, 22 bp, Homo sapiens
tactgtaatgagattagcttcc

SEQ ID NO: 7169709 - DNA, 22 bp, Homo sapiens
tactgtaatcagggcttaggta

SEQ ID NO: 7169710 - DNA, 22 bp, Homo sapiens
tacttacatttctgtaatcggc

SEQ ID NO: 7169711 - DNA, 22 bp, Homo sapiens
tacttagtgttcttgtattgac

SEQ ID NO: 7169712 - DNA, 22 bp, Homo sapiens
tacttataaggaggcacacaaa

SEQ ID NO: 7169713 - DNA, 19 bp, Homo sapiens
tacttattagaaatatggg

SEQ ID NO: 7169714 - DNA, 22 bp, Homo sapiens
tacttatgatattgtagacact

SEQ ID NO: 7169715 - DNA, 22 bp, Homo sapiens
tacttattggttcagaagttta

SEQ ID NO: 7169716 - DNA, 22 bp, Homo sapiens
tacttcctgtttccatgtctgt

SEQ ID NO: 7169717 - DNA, 22 bp, Homo sapiens
tacttcctgtttccatgtctgt

SEQ ID NO: 7169718 - DNA, 22 bp, Homo sapiens
tacttcccactggggtctacca

SEQ ID NO: 7169719 - DNA, 22 bp, Homo sapiens
tacttccagcaatctgcatatt

SEQ ID NO: 7169720 - DNA, 22 bp, Homo sapiens
tacttccaggcggacaaagccc

SEQ ID NO: 7169721 - DNA, 22 bp, Homo sapiens
tacttcattcctttgtaaaatg

SEQ ID NO: 7169722 - DNA, 22 bp, Homo sapiens
tacttctctgcgatcacttgat

SEQ ID NO: 7169723 - DNA, 22 bp, Homo sapiens
tacttctctccgcctcgtgctt

SEQ ID NO: 7169724 - DNA, 22 bp, Homo sapiens
tacttctgaatgtgagtttgtt

SEQ ID NO: 7169725 - DNA, 22 bp, Homo sapiens
tacttctgccttagagaacact

SEQ ID NO: 7169726 - DNA, 20 bp, Homo sapiens
tacttgaatgttgcagcagt

SEQ ID NO: 7169727 - DNA, 22 bp, Homo sapiens
tacttgctgggtgtaattttct

SEQ ID NO: 7169728 - DNA, 22 bp, Homo sapiens
tacttgctgggtgtaattttct

SEQ ID NO: 7169729 - DNA, 22 bp, Homo sapiens
tactggaagttagagatctttt

SEQ ID NO: 7169730 - DNA, 22 bp, Homo sapiens
tactgcttgttagctgtatttg

SEQ ID NO: 7169731 - DNA, 22 bp, Homo sapiens
tactgctttgactgtatgggac

SEQ ID NO: 7169732 - DNA, 22 bp, Homo sapiens
tactgcttttagctggatacac

SEQ ID NO: 7169733 - DNA, 20 bp, Homo sapiens
tactggaaatttctccacct

SEQ ID NO: 7169734 - DNA, 23 bp, Homo sapiens
tactggaaatttgacagatttga

SEQ ID NO: 7169735 - DNA, 22 bp, Homo sapiens
tactggagatggaatgcttttg

SEQ ID NO: 7169736 - DNA, 22 bp, Homo sapiens
tactggagtcagaaatgccttg

SEQ ID NO: 7169737 - DNA, 22 bp, Homo sapiens
tactgctgattagagctgaggt

SEQ ID NO: 7169738 - DNA, 22 bp, Homo sapiens
tactgctgagctgggtagaagg

SEQ ID NO: 7169739 - DNA, 22 bp, Homo sapiens
tactgcgccttcaccaagcggc

SEQ ID NO: 7169740 - DNA, 22 bp, Homo sapiens
tactgctagatgaaaatgtagg

SEQ ID NO: 7169741 - DNA, 22 bp, Homo sapiens
tactgctagatgaaaatgtagg

SEQ ID NO: 7169742 - DNA, 22 bp, Homo sapiens
tactgcttcacccttgagtctt

SEQ ID NO: 7169743 - DNA, 22 bp, Homo sapiens
tactgcttcatatagggatgta

SEQ ID NO: 7169744 - DNA, 22 bp, Homo sapiens
tactgcttcatatatgggagac

SEQ ID NO: 7169745 - DNA, 22 bp, Homo sapiens
tactgcttgatctagcatggct

SEQ ID NO: 7169746 - DNA, 22 bp, Homo sapiens
tactgcttggtgttgttgtatc

SEQ ID NO: 7169747 - DNA, 22 bp, Homo sapiens
tactgcctggagcattggtgct

SEQ ID NO: 7169748 - DNA, 22 bp, Homo sapiens
tactgcctattcaattggaatt

SEQ ID NO: 7169749 - DNA, 22 bp, Homo sapiens
tactgacaggattgacagtaaa

SEQ ID NO: 7169750 - DNA, 20 bp, Homo sapiens
tactgcaggaatcagctagc

SEQ ID NO: 7169751 - DNA, 22 bp, Homo sapiens
tactgcactccagcctgggtga

SEQ ID NO: 7169752 - DNA, 22 bp, Homo sapiens
tactgcacttgagaaagctgag

SEQ ID NO: 7169753 - DNA, 20 bp, Homo sapiens
tactgcaggaatcagctagc

SEQ ID NO: 7169754 - DNA, 22 bp, Homo sapiens
tactgagtaccaagcattgtgt

SEQ ID NO: 7169755 - DNA, 22 bp, Homo sapiens
tactgatatgatgtgctttaga

SEQ ID NO: 7169756 - DNA, 22 bp, Homo sapiens
tactgatatgatgtgctttaga

SEQ ID NO: 7169757 - DNA, 22 bp, Homo sapiens
tactgcaaaccatttacagtag

SEQ ID NO: 7169758 - DNA, 22 bp, Homo sapiens
tacctgagttatattaataatt

SEQ ID NO: 7169759 - DNA, 22 bp, Homo sapiens
tacctgattttattaccagttt

SEQ ID NO: 7169760 - DNA, 22 bp, Homo sapiens
tacccagcccatgcctacctca

SEQ ID NO: 7169761 - DNA, 22 bp, Homo sapiens
tacccagcaatccctagaggtt

SEQ ID NO: 7169762 - DNA, 22 bp, Homo sapiens
tacccagctcctcagaagacca

SEQ ID NO: 7169763 - DNA, 22 bp, Homo sapiens
tacccagaagattgtcagcaaa

SEQ ID NO: 7169764 - DNA, 22 bp, Homo sapiens
tacccagagggagagcaactat

SEQ ID NO: 7169765 - DNA, 22 bp, Homo sapiens
tacattccatgtgtgtgtattc

SEQ ID NO: 7169766 - DNA, 22 bp, Homo sapiens
tacattccactagtgactggcg

SEQ ID NO: 7169767 - DNA, 22 bp, Homo sapiens
tacattcccccaattaccaatg

SEQ ID NO: 7169768 - DNA, 22 bp, Homo sapiens
taccttctctagatctttattc

SEQ ID NO: 7169769 - DNA, 22 bp, Homo sapiens
taccttcaccagcgaatgtttg

SEQ ID NO: 7169770 - DNA, 22 bp, Homo sapiens
tacctgttttaaagctaaaagg

SEQ ID NO: 7169771 - DNA, 22 bp, Homo sapiens
tacctgttgtcacgataacact

SEQ ID NO: 7169772 - DNA, 22 bp, Homo sapiens
taccttggaggccaagcagttt

SEQ ID NO: 7169773 - DNA, 22 bp, Homo sapiens
taccttgggctattatctttga

SEQ ID NO: 7169774 - DNA, 22 bp, Homo sapiens
taccttggggttttgttgctct

SEQ ID NO: 7169775 - DNA, 22 bp, Homo sapiens
taccttggggttttgttgctct

SEQ ID NO: 7169776 - DNA, 22 bp, Homo sapiens
tacctggaatttatatagctat

SEQ ID NO: 7169777 - DNA, 22 bp, Homo sapiens
tacctggcaagggtcccaggat

SEQ ID NO: 7169778 - DNA, 22 bp, Homo sapiens
tacctggcagtcagtctttccg

SEQ ID NO: 7169779 - DNA, 22 bp, Homo sapiens
tacctggccttaaggtgctgac

SEQ ID NO: 7169780 - DNA, 22 bp, Homo sapiens
tacctggctggggaatagccag

SEQ ID NO: 7169781 - DNA, 22 bp, Homo sapiens
tacctgtcaaaagacatggaga

SEQ ID NO: 7169782 - DNA, 22 bp, Homo sapiens
tacctgttgatttatactgaaa

SEQ ID NO: 7169783 - DNA, 22 bp, Homo sapiens
tactaaatgattaagcaggaat

SEQ ID NO: 7169784 - DNA, 19 bp, Homo sapiens
tactaaacatgcatattgg

SEQ ID NO: 7169785 - DNA, 22 bp, Homo sapiens
tactaaatagtttaattcctca

SEQ ID NO: 7169786 - DNA, 22 bp, Homo sapiens
tactaaatagtttaattcctca

SEQ ID NO: 7169787 - DNA, 22 bp, Homo sapiens
tacgggcacgcaccacgatgcc

SEQ ID NO: 7169788 - DNA, 21 bp, Homo sapiens
tacgtgtgtgcatgtttatat

SEQ ID NO: 7169789 - DNA, 22 bp, Homo sapiens
tacgtggtaggtatttacctta

SEQ ID NO: 7169790 - DNA, 22 bp, Homo sapiens
tacgttttaaacacggagccag

SEQ ID NO: 7169791 - DNA, 22 bp, Homo sapiens
tacgaacagggccatagaaact

SEQ ID NO: 7169792 - DNA, 22 bp, Homo sapiens
taccttgtgagatgtcagtgag

SEQ ID NO: 7169793 - DNA, 22 bp, Homo sapiens
taccttgggttgagttcattct

SEQ ID NO: 7169794 - DNA, 22 bp, Homo sapiens
taccttgggttgagttcattct

SEQ ID NO: 7169795 - DNA, 22 bp, Homo sapiens
tacctttaaggagatttgacaa

SEQ ID NO: 7169796 - DNA, 23 bp, Homo sapiens
tacctttccctgggagactgctc

SEQ ID NO: 7169797 - DNA, 22 bp, Homo sapiens
tacgattagagatgaatgcatg

SEQ ID NO: 7169798 - DNA, 22 bp, Homo sapiens
tacgcctgtaatcccagcactt

SEQ ID NO: 7169799 - DNA, 22 bp, Homo sapiens
taccttttgcttattatgacac

SEQ ID NO: 7169800 - DNA, 22 bp, Homo sapiens
tacgcctgtaatcccagcactt

SEQ ID NO: 7169801 - DNA, 22 bp, Homo sapiens
tactgaaagactgaatatttag

SEQ ID NO: 7169802 - DNA, 22 bp, Homo sapiens
tactgaaagagtggtggactct

SEQ ID NO: 7169803 - DNA, 22 bp, Homo sapiens
tactgaaagtctgtgggtcctc

SEQ ID NO: 7169804 - DNA, 22 bp, Homo sapiens
tactgaaagtggtcaacagtgg

SEQ ID NO: 7169805 - DNA, 22 bp, Homo sapiens
tactgaaagtggtcaacagtgg

SEQ ID NO: 7169806 - DNA, 22 bp, Homo sapiens
tactaacaatgagaacaagcca

SEQ ID NO: 7169807 - DNA, 22 bp, Homo sapiens
tactaacaatgagaacaagcca

SEQ ID NO: 7169808 - DNA, 22 bp, Homo sapiens
tactacaaggccgaagctctca

SEQ ID NO: 7169809 - DNA, 22 bp, Homo sapiens
tactgaaagactgaatatttag

SEQ ID NO: 7169810 - DNA, 22 bp, Homo sapiens
tactgaaagactgaatatttag

SEQ ID NO: 7169811 - DNA, 22 bp, Homo sapiens
tactgaaatggcagatatataa

SEQ ID NO: 7169812 - DNA, 22 bp, Homo sapiens
tactgaaatggcagatatataa

SEQ ID NO: 7169813 - DNA, 22 bp, Homo sapiens
tactgaaatagcactctgatgc

SEQ ID NO: 7169814 - DNA, 22 bp, Homo sapiens
tactgaaatactaagaagttaa

SEQ ID NO: 7169815 - DNA, 22 bp, Homo sapiens
tactgaaatactaagaagttaa

SEQ ID NO: 7169816 - DNA, 22 bp, Homo sapiens
tactgaaatggcagatatataa

SEQ ID NO: 7169817 - DNA, 22 bp, Homo sapiens
tactgaaatggcagatatataa

SEQ ID NO: 7169818 - DNA, 22 bp, Homo sapiens
tacatacaagcattcaatttta

SEQ ID NO: 7169819 - DNA, 22 bp, Homo sapiens
tacatacacaaatatactgttt

SEQ ID NO: 7169820 - DNA, 22 bp, Homo sapiens
tacatacacaaatatactgttt

SEQ ID NO: 7169821 - DNA, 22 bp, Homo sapiens
tacatacaagcattcaatttta

SEQ ID NO: 7169822 - DNA, 22 bp, Homo sapiens
tacatacaagcattcaatttta

SEQ ID NO: 7169823 - DNA, 22 bp, Homo sapiens
tacatacacaaatatactgttt

SEQ ID NO: 7169824 - DNA, 22 bp, Homo sapiens
tacatacacaaatatactgttt

SEQ ID NO: 7169825 - DNA, 22 bp, Homo sapiens
tacatacaagatgtgtttaaaa

SEQ ID NO: 7169826 - DNA, 22 bp, Homo sapiens
tacatacaagcattcaatttta

SEQ ID NO: 7169827 - DNA, 22 bp, Homo sapiens
tacatacagagatgctagttaa

SEQ ID NO: 7169828 - DNA, 22 bp, Homo sapiens
tacatacacaaatgctgaatgg

SEQ ID NO: 7169829 - DNA, 22 bp, Homo sapiens
tacatacacaaatgctgaatgg

SEQ ID NO: 7169830 - DNA, 22 bp, Homo sapiens
tacatacagagatgctagttaa

SEQ ID NO: 7169831 - DNA, 22 bp, Homo sapiens
tacatacagagatgctagttaa

SEQ ID NO: 7169832 - DNA, 22 bp, Homo sapiens
tacatacatattcatacaggtg

SEQ ID NO: 7169833 - DNA, 22 bp, Homo sapiens
tacatacagccaagtatgaagt

SEQ ID NO: 7169834 - DNA, 22 bp, Homo sapiens
tacatacagtggatgctttagg

SEQ ID NO: 7169835 - DNA, 22 bp, Homo sapiens
tacatacatattcatacaggtg

SEQ ID NO: 7169836 - DNA, 22 bp, Homo sapiens
tacatacatattcatacaggtg

SEQ ID NO: 7169837 - DNA, 22 bp, Homo sapiens
tacatacatattcatacaggtg

SEQ ID NO: 7169838 - DNA, 22 bp, Homo sapiens
tacatacatattcatacaggtg

SEQ ID NO: 7169839 - DNA, 22 bp, Homo sapiens
tacatgtctacagccatgtctg

SEQ ID NO: 7169840 - DNA, 22 bp, Homo sapiens
tacatgtatgtttatcttgaga

SEQ ID NO: 7169841 - DNA, 22 bp, Homo sapiens
tacatgtattgatttctcttct

SEQ ID NO: 7169842 - DNA, 22 bp, Homo sapiens
tacatgtgataaattgattaaa

SEQ ID NO: 7169843 - DNA, 22 bp, Homo sapiens
tacatgtttggtaaatgatggc

SEQ ID NO: 7169844 - DNA, 22 bp, Homo sapiens
tacattaacttacgtccacatg

SEQ ID NO: 7169845 - DNA, 22 bp, Homo sapiens
tacattaaggatatggacatga

SEQ ID NO: 7169846 - DNA, 22 bp, Homo sapiens
tacattcagcaaaagaatggtt

SEQ ID NO: 7169847 - DNA, 22 bp, Homo sapiens
tacattcatatgtgtgcataca

SEQ ID NO: 7169848 - DNA, 22 bp, Homo sapiens
tacattcatatgtgtgcataca

SEQ ID NO: 7169849 - DNA, 22 bp, Homo sapiens
tacattcatggtgacttgtatg

SEQ ID NO: 7169850 - DNA, 22 bp, Homo sapiens
tacattcatggtgacttgtatg

SEQ ID NO: 7169851 - DNA, 22 bp, Homo sapiens
tacattcatggtgacttgtatg

SEQ ID NO: 7169852 - DNA, 22 bp, Homo sapiens
tacattcatggtgacttgtatg

SEQ ID NO: 7169853 - DNA, 22 bp, Homo sapiens
tacattcatggtgacttgtatg

SEQ ID NO: 7169854 - DNA, 15 bp, Homo sapiens
tacattcatttccac

SEQ ID NO: 7169855 - DNA, 15 bp, Homo sapiens
tacattcatttccac

SEQ ID NO: 7169856 - DNA, 23 bp, Homo sapiens
tacattcatttgcacagccagta

SEQ ID NO: 7169857 - DNA, 22 bp, Homo sapiens
tacattcagaagaatggacacg

SEQ ID NO: 7169858 - DNA, 22 bp, Homo sapiens
tacattcagaattgggaggcaa

SEQ ID NO: 7169859 - DNA, 22 bp, Homo sapiens
tacattcagagaaagtttccat

SEQ ID NO: 7169860 - DNA, 22 bp, Homo sapiens
tacattcagagaaagtttccat

SEQ ID NO: 7169861 - DNA, 22 bp, Homo sapiens
tacattcagcaaaagaatggtt

SEQ ID NO: 7169862 - DNA, 22 bp, Homo sapiens
tacattcagcaaaagaatggtt

SEQ ID NO: 7169863 - DNA, 22 bp, Homo sapiens
tacattcacagttgttcatctc

SEQ ID NO: 7169864 - DNA, 22 bp, Homo sapiens
tacattcacttgttgaaggtgg

SEQ ID NO: 7169865 - DNA, 22 bp, Homo sapiens
tacattcagaagaatggacacg

SEQ ID NO: 7169866 - DNA, 22 bp, Homo sapiens
tacattcagaagaatggacacg

SEQ ID NO: 7169867 - DNA, 22 bp, Homo sapiens
tacattcagaagaatggacacg

SEQ ID NO: 7169868 - DNA, 22 bp, Homo sapiens
tacattatcttgttatctttca

SEQ ID NO: 7169869 - DNA, 22 bp, Homo sapiens
tacattatttcatcagtcatct

SEQ ID NO: 7169870 - DNA, 20 bp, Homo sapiens
tacattcaaaacaaactctg

SEQ ID NO: 7169871 - DNA, 20 bp, Homo sapiens
tacattcaaaacaaactctg

SEQ ID NO: 7169872 - DNA, 22 bp, Homo sapiens
tacattacaggaaagataaaga

SEQ ID NO: 7169873 - DNA, 22 bp, Homo sapiens
tacattacaggaaagataaaga

SEQ ID NO: 7169874 - DNA, 22 bp, Homo sapiens
tacattagcaaacatcttggtg

SEQ ID NO: 7169875 - DNA, 22 bp, Homo sapiens
tacattatcttgttatctttca

SEQ ID NO: 7169876 - DNA, 22 bp, Homo sapiens
tacattcaaacgatttattgat

SEQ ID NO: 7169877 - DNA, 22 bp, Homo sapiens
tacattcaaacgatttattgat

SEQ ID NO: 7169878 - DNA, 22 bp, Homo sapiens
tacattcaaacgatttattgat

SEQ ID NO: 7169879 - DNA, 22 bp, Homo sapiens
tacattcaacatgtcactatgt

SEQ ID NO: 7169880 - DNA, 22 bp, Homo sapiens
tacattcaacatgtcactatgt

SEQ ID NO: 7169881 - DNA, 22 bp, Homo sapiens
tacattcaacatgtcactatgt

SEQ ID NO: 7169882 - DNA, 22 bp, Homo sapiens
tacattcaacatgtcactatgt

SEQ ID NO: 7169883 - DNA, 22 bp, Homo sapiens
tacattcaacatgtcactatgt

SEQ ID NO: 7169884 - DNA, 22 bp, Homo sapiens
tacattcaacatgtcactatgt

SEQ ID NO: 7169885 - DNA, 22 bp, Homo sapiens
tacattcaacatgtcactatgt

SEQ ID NO: 7169886 - DNA, 22 bp, Homo sapiens
tacattcaacatgtcactatgt

SEQ ID NO: 7169887 - DNA, 22 bp, Homo sapiens
tacattcaacatgtcactatgt

SEQ ID NO: 7169888 - DNA, 22 bp, Homo sapiens
tacattcacagttgttcatctc

SEQ ID NO: 7169889 - DNA, 22 bp, Homo sapiens
tacattcacagttgttcatctc

SEQ ID NO: 7169890 - DNA, 22 bp, Homo sapiens
tacaggaaggctctggaggtgc

SEQ ID NO: 7169891 - DNA, 22 bp, Homo sapiens
tacaggaaggctctggaggtgc

SEQ ID NO: 7169892 - DNA, 22 bp, Homo sapiens
tacaggaagcactcaagaaatg

SEQ ID NO: 7169893 - DNA, 22 bp, Homo sapiens
tacaggaagcactcaagaaatg

SEQ ID NO: 7169894 - DNA, 22 bp, Homo sapiens
tacaggaaggagcacatcggga

SEQ ID NO: 7169895 - DNA, 18 bp, Homo sapiens
tacaggaaggggttctcg

SEQ ID NO: 7169896 - DNA, 22 bp, Homo sapiens
tacaggaagtaagtaatgaaat

SEQ ID NO: 7169897 - DNA, 22 bp, Homo sapiens
tacaggaagtctcagtacagta

SEQ ID NO: 7169898 - DNA, 22 bp, Homo sapiens
tacaggaagttacagactatga

SEQ ID NO: 7169899 - DNA, 22 bp, Homo sapiens
tacagcttttgcagctgttttg

SEQ ID NO: 7169900 - DNA, 22 bp, Homo sapiens
tacagctttgggaaggccccat

SEQ ID NO: 7169901 - DNA, 22 bp, Homo sapiens
tacagcttttcatatttgtgtt

SEQ ID NO: 7169902 - DNA, 22 bp, Homo sapiens
tacagcttttgcagctgttttg

SEQ ID NO: 7169903 - DNA, 22 bp, Homo sapiens
tacaggaactgggcaggacatt

SEQ ID NO: 7169904 - DNA, 22 bp, Homo sapiens
tacaggaactgggcaggacatt

SEQ ID NO: 7169905 - DNA, 22 bp, Homo sapiens
tacagcttttcatatttgtgtt

SEQ ID NO: 7169906 - DNA, 22 bp, Homo sapiens
tacagctttgggaaggccccat

SEQ ID NO: 7169907 - DNA, 22 bp, Homo sapiens
tacagctttatacccatcaaaa

SEQ ID NO: 7169908 - DNA, 22 bp, Homo sapiens
tacagcttgatgtttgtgtgtt

SEQ ID NO: 7169909 - DNA, 22 bp, Homo sapiens
tacagctttagcaaattaccta

SEQ ID NO: 7169910 - DNA, 22 bp, Homo sapiens
tacagctttatacccatcaaaa

SEQ ID NO: 7169911 - DNA, 22 bp, Homo sapiens
tacagctttagcaaattaccta

SEQ ID NO: 7169912 - DNA, 22 bp, Homo sapiens
tacagcttgatgtttgtgtgtt

SEQ ID NO: 7169913 - DNA, 18 bp, Homo sapiens
tacagcttgagttgactg

SEQ ID NO: 7169914 - DNA, 22 bp, Homo sapiens
tacagcttgatgagagcgcgag

SEQ ID NO: 7169915 - DNA, 22 bp, Homo sapiens
tacagcttgacccataatgtct

SEQ ID NO: 7169916 - DNA, 18 bp, Homo sapiens
tacagcttgagttgactg

SEQ ID NO: 7169917 - DNA, 22 bp, Homo sapiens
tacagcttgacccataatgtct

SEQ ID NO: 7169918 - DNA, 22 bp, Homo sapiens
tacagcttgacccataatgtct

SEQ ID NO: 7169919 - DNA, 22 bp, Homo sapiens
tacagcttgacccataatgtct

SEQ ID NO: 7169920 - DNA, 22 bp, Homo sapiens
tacagcttcagtgtgccccagt

SEQ ID NO: 7169921 - DNA, 22 bp, Homo sapiens
tacagcttcagtgtgccccagt

SEQ ID NO: 7169922 - DNA, 22 bp, Homo sapiens
tacagcttaaaagatgcattta

SEQ ID NO: 7169923 - DNA, 22 bp, Homo sapiens
tacagcttatccagcttgatag

SEQ ID NO: 7169924 - DNA, 22 bp, Homo sapiens
tacagcttaaaagatgcattta

SEQ ID NO: 7169925 - DNA, 22 bp, Homo sapiens
tacagcagagtgggatgcatct

SEQ ID NO: 7169926 - DNA, 22 bp, Homo sapiens
tacagcagagtgggatgcatct

SEQ ID NO: 7169927 - DNA, 22 bp, Homo sapiens
tacagcagcatcgcagtgacct

SEQ ID NO: 7169928 - DNA, 22 bp, Homo sapiens
tacactattttactgatacaaa

SEQ ID NO: 7169929 - DNA, 22 bp, Homo sapiens
tacagcactgtgcatagtggtt

SEQ ID NO: 7169930 - DNA, 22 bp, Homo sapiens
tacagcacttaattaccttgag

SEQ ID NO: 7169931 - DNA, 20 bp, Homo sapiens
tacaggaatcaagactgcat

SEQ ID NO: 7169932 - DNA, 22 bp, Homo sapiens
tacaggacagatgtttacagga

SEQ ID NO: 7169933 - DNA, 22 bp, Homo sapiens
tacaggagagatttagtaatca

SEQ ID NO: 7169934 - DNA, 22 bp, Homo sapiens
tacaggagagatttagtaatca

SEQ ID NO: 7169935 - DNA, 22 bp, Homo sapiens
tacagttaccctggaaagaaat

SEQ ID NO: 7169936 - DNA, 22 bp, Homo sapiens
tacagtttgttacattgttagt

SEQ ID NO: 7169937 - DNA, 22 bp, Homo sapiens
tacagttttggtgatgatgatg

SEQ ID NO: 7169938 - DNA, 22 bp, Homo sapiens
tacagtttgttacattgttagt

SEQ ID NO: 7169939 - DNA, 22 bp, Homo sapiens
tacagttactttgaaaattgat

SEQ ID NO: 7169940 - DNA, 22 bp, Homo sapiens
tacagttactttgaaaattgat

SEQ ID NO: 7169941 - DNA, 22 bp, Homo sapiens
tacagttactgttatatgtgct

SEQ ID NO: 7169942 - DNA, 22 bp, Homo sapiens
tacagtttttattcatgacaag

SEQ ID NO: 7169943 - DNA, 22 bp, Homo sapiens
tacagtttttattcatgacaag

SEQ ID NO: 7169944 - DNA, 22 bp, Homo sapiens
tacagtttttattcatgacaag

SEQ ID NO: 7169945 - DNA, 22 bp, Homo sapiens
tacagttttggtgatgatgatg

SEQ ID NO: 7169946 - DNA, 22 bp, Homo sapiens
tacagttttggtgatgatgatg

SEQ ID NO: 7169947 - DNA, 22 bp, Homo sapiens
tacagtttttattcatgacaag

SEQ ID NO: 7169948 - DNA, 22 bp, Homo sapiens
tacagtttttcactgaagatgt

SEQ ID NO: 7169949 - DNA, 22 bp, Homo sapiens
tacagtttttcactgaagatgt

SEQ ID NO: 7169950 - DNA, 22 bp, Homo sapiens
tacagtttttcactgaagatgt

SEQ ID NO: 7169951 - DNA, 22 bp, Homo sapiens
tacataattgtctttgtcctca

SEQ ID NO: 7169952 - DNA, 22 bp, Homo sapiens
tacataatgagctagttaagtt

SEQ ID NO: 7169953 - DNA, 22 bp, Homo sapiens
tacataattaatctttaagttc

SEQ ID NO: 7169954 - DNA, 22 bp, Homo sapiens
tacataattaatctttaagttc

SEQ ID NO: 7169955 - DNA, 22 bp, Homo sapiens
tacataattaatctttaagttc

SEQ ID NO: 7169956 - DNA, 19 bp, Homo sapiens
taagtgttggtgaatttct

SEQ ID NO: 7169957 - DNA, 22 bp, Homo sapiens
taagtgttgctctctctcagct

SEQ ID NO: 7169958 - DNA, 22 bp, Homo sapiens
taagtgtttctccagtgtcttt

SEQ ID NO: 7169959 - DNA, 22 bp, Homo sapiens
taagtgtttctccagtgtcttt

SEQ ID NO: 7169960 - DNA, 22 bp, Homo sapiens
taagttagagcacaattcttac

SEQ ID NO: 7169961 - DNA, 22 bp, Homo sapiens
taagttagaggttaggcactta

SEQ ID NO: 7169962 - DNA, 22 bp, Homo sapiens
taagttagatcttaattaaagt

SEQ ID NO: 7169963 - DNA, 22 bp, Homo sapiens
taagttagcaaggccaaggtaa

SEQ ID NO: 7169964 - DNA, 22 bp, Homo sapiens
taagttagccctattaaattaa

SEQ ID NO: 7169965 - DNA, 22 bp, Homo sapiens
taagttcagttggtcgaagtag

SEQ ID NO: 7169966 - DNA, 22 bp, Homo sapiens
taagttcctagcctttacatag

SEQ ID NO: 7169967 - DNA, 17 bp, Homo sapiens
taagttatagcagaaga

SEQ ID NO: 7169968 - DNA, 22 bp, Homo sapiens
taagttagtcctttttaaaagt

SEQ ID NO: 7169969 - DNA, 22 bp, Homo sapiens
taagttatcggagtgtgtttca

SEQ ID NO: 7169970 - DNA, 22 bp, Homo sapiens
taagttatcggagtgtgtttca

SEQ ID NO: 7169971 - DNA, 22 bp, Homo sapiens
taagttcaagtcttggatataa

SEQ ID NO: 7169972 - DNA, 22 bp, Homo sapiens
taagttcaccagttgtaataag

SEQ ID NO: 7169973 - DNA, 22 bp, Homo sapiens
taagcataactaaaaatgattt

SEQ ID NO: 7169974 - DNA, 22 bp, Homo sapiens
taagcagtttttcttgtattaa

SEQ ID NO: 7169975 - DNA, 22 bp, Homo sapiens
taagcataagatacatgagaca

SEQ ID NO: 7169976 - DNA, 22 bp, Homo sapiens
taagcatacattctctcctttc

SEQ ID NO: 7169977 - DNA, 22 bp, Homo sapiens
taagcaggggtcaagtgtacaa

SEQ ID NO: 7169978 - DNA, 22 bp, Homo sapiens
taagcaggggtcaagtgtacaa

SEQ ID NO: 7169979 - DNA, 22 bp, Homo sapiens
taagcaggggtcaagtgtacaa

SEQ ID NO: 7169980 - DNA, 20 bp, Homo sapiens
taagcacatgaacagtcctc

SEQ ID NO: 7169981 - DNA, 22 bp, Homo sapiens
taagcagaaaaagtgggagtta

SEQ ID NO: 7169982 - DNA, 22 bp, Homo sapiens
taagcaagtggtagaaggacaa

SEQ ID NO: 7169983 - DNA, 22 bp, Homo sapiens
taagcaatctaaaagccttacc

SEQ ID NO: 7169984 - DNA, 22 bp, Homo sapiens
taagcaatctgtagttggaatc

SEQ ID NO: 7169985 - DNA, 18 bp, Homo sapiens
taagcaatgacattgcaa

SEQ ID NO: 7169986 - DNA, 18 bp, Homo sapiens
taagcaatgacattgcaa

SEQ ID NO: 7169987 - DNA, 18 bp, Homo sapiens
taagcaatgacattgcaa

SEQ ID NO: 7169988 - DNA, 22 bp, Homo sapiens
taagcaatgagataatcatggg

SEQ ID NO: 7169989 - DNA, 22 bp, Homo sapiens
taagcaatgagataatcatggg

SEQ ID NO: 7169990 - DNA, 22 bp, Homo sapiens
taagcaatgagataatcatggg

SEQ ID NO: 7169991 - DNA, 22 bp, Homo sapiens
taagcaatgctgtagttcagtc

SEQ ID NO: 7169992 - DNA, 22 bp, Homo sapiens
taagcacacaatatctggagag

SEQ ID NO: 7169993 - DNA, 22 bp, Homo sapiens
taagcacacaatatctggagag

SEQ ID NO: 7169994 - DNA, 20 bp, Homo sapiens
taagcacatgaacagtcctc

SEQ ID NO: 7169995 - DNA, 22 bp, Homo sapiens
taagttctgagtaaatactgtt

SEQ ID NO: 7169996 - DNA, 22 bp, Homo sapiens
taagttgattataaccactgga

SEQ ID NO: 7169997 - DNA, 22 bp, Homo sapiens
taagtttaaatgtacatgaagc

SEQ ID NO: 7169998 - DNA, 22 bp, Homo sapiens
taagttggaaaggctatgaggc

SEQ ID NO: 7169999 - DNA, 22 bp, Homo sapiens
taagttggcaataatactgtaa

SEQ ID NO: 7170000 - DNA, 22 bp, Homo sapiens
taagttggcaataatactgtaa

SEQ ID NO: 7170001 - DNA, 21 bp, Homo sapiens
taagttggcatgagtggctac

SEQ ID NO: 7170002 - DNA, 21 bp, Homo sapiens
taagttggcatgagtggctac

SEQ ID NO: 7170003 - DNA, 22 bp, Homo sapiens
taagttggctgttgctatagtt

SEQ ID NO: 7170004 - DNA, 22 bp, Homo sapiens
taagtttaaatgtacatgaagc

SEQ ID NO: 7170005 - DNA, 22 bp, Homo sapiens
taagtttctccaaagcacagaa

SEQ ID NO: 7170006 - DNA, 22 bp, Homo sapiens
taagtttagagagaatggggac

SEQ ID NO: 7170007 - DNA, 22 bp, Homo sapiens
taagtttaagtcatgtttgatg

SEQ ID NO: 7170008 - DNA, 22 bp, Homo sapiens
taataacaattgtaggacatga

SEQ ID NO: 7170009 - DNA, 22 bp, Homo sapiens
taataacaattgtaggacatga

SEQ ID NO: 7170010 - DNA, 22 bp, Homo sapiens
taataacaattgtaggacatga

SEQ ID NO: 7170011 - DNA, 22 bp, Homo sapiens
taataaatgaaagtgctggcat

SEQ ID NO: 7170012 - DNA, 22 bp, Homo sapiens
taataaatgaaagtgctggcat

SEQ ID NO: 7170013 - DNA, 22 bp, Homo sapiens
taataaatgaaagtgctggcat

SEQ ID NO: 7170014 - DNA, 22 bp, Homo sapiens
taataaatgaaagtgctggcat

SEQ ID NO: 7170015 - DNA, 22 bp, Homo sapiens
taataaatgaaagtgctggcat

SEQ ID NO: 7170016 - DNA, 22 bp, Homo sapiens
taataaatgaaagtgctggcat

SEQ ID NO: 7170017 - DNA, 22 bp, Homo sapiens
taataaatgaaagtgctggcat

SEQ ID NO: 7170018 - DNA, 22 bp, Homo sapiens
taagttttctggaataacttgg

SEQ ID NO: 7170019 - DNA, 22 bp, Homo sapiens
taataaagatgtgggctttgaa

SEQ ID NO: 7170020 - DNA, 22 bp, Homo sapiens
taagttttaagcaatctgataa

SEQ ID NO: 7170021 - DNA, 22 bp, Homo sapiens
taagttttctggaataacttgg

SEQ ID NO: 7170022 - DNA, 22 bp, Homo sapiens
taatgaataaacttgagagtca

SEQ ID NO: 7170023 - DNA, 22 bp, Homo sapiens
taatgaataaacttgagagtca

SEQ ID NO: 7170024 - DNA, 22 bp, Homo sapiens
taatgaatgagaatataacaga

SEQ ID NO: 7170025 - DNA, 19 bp, Homo sapiens
taataagcaatatggaagt

SEQ ID NO: 7170026 - DNA, 22 bp, Homo sapiens
taatgaacatgcatcgtgtgta

SEQ ID NO: 7170027 - DNA, 22 bp, Homo sapiens
taatgaactctttactttggga

SEQ ID NO: 7170028 - DNA, 22 bp, Homo sapiens
taatgaatgagaatataacaga

SEQ ID NO: 7170029 - DNA, 22 bp, Homo sapiens
taatgaatgagaatataacaga

SEQ ID NO: 7170030 - DNA, 22 bp, Homo sapiens
taatgactgccgtctctcttca

SEQ ID NO: 7170031 - DNA, 22 bp, Homo sapiens
taatgactgtaccaaggcttca

SEQ ID NO: 7170032 - DNA, 22 bp, Homo sapiens
taatgagatacctcttgctgtc

SEQ ID NO: 7170033 - DNA, 22 bp, Homo sapiens
taatgaggaaatagagggaatg

SEQ ID NO: 7170034 - DNA, 22 bp, Homo sapiens
taatgaggaaatagagggaatg

SEQ ID NO: 7170035 - DNA, 22 bp, Homo sapiens
taatgaggcaagagtcatggct

SEQ ID NO: 7170036 - DNA, 22 bp, Homo sapiens
taatgaggcatttgagtcacct

SEQ ID NO: 7170037 - DNA, 19 bp, Homo sapiens
taatgcacttaacacatgg

SEQ ID NO: 7170038 - DNA, 22 bp, Homo sapiens
taatgcatgtaatgggctgata

SEQ ID NO: 7170039 - DNA, 22 bp, Homo sapiens
taatgccaatttaatgatccat

SEQ ID NO: 7170040 - DNA, 22 bp, Homo sapiens
taatgccaatttaatgatccat

SEQ ID NO: 7170041 - DNA, 22 bp, Homo sapiens
taatgccacctacctgctttat

SEQ ID NO: 7170042 - DNA, 22 bp, Homo sapiens
taatgccacggcagggaacagc

SEQ ID NO: 7170043 - DNA, 22 bp, Homo sapiens
taatgccacggcagggaacagc

SEQ ID NO: 7170044 - DNA, 23 bp, Homo sapiens
taatgccagccctgcagttaagc

SEQ ID NO: 7170045 - DNA, 23 bp, Homo sapiens
taatgccagccctgcagttaagc

SEQ ID NO: 7170046 - DNA, 22 bp, Homo sapiens
taatgcaaggaattccaagtag

SEQ ID NO: 7170047 - DNA, 22 bp, Homo sapiens
taatgcaatttagcaaagtttt

SEQ ID NO: 7170048 - DNA, 22 bp, Homo sapiens
taatgcaatttagcaaagtttt

SEQ ID NO: 7170049 - DNA, 22 bp, Homo sapiens
taatgcacatagaagtacttag

SEQ ID NO: 7170050 - DNA, 19 bp, Homo sapiens
taatgcacttaacacatgg

SEQ ID NO: 7170051 - DNA, 22 bp, Homo sapiens
taatgcaacgtgagataattaa

SEQ ID NO: 7170052 - DNA, 22 bp, Homo sapiens
taatgcaacgtgagataattaa

SEQ ID NO: 7170053 - DNA, 22 bp, Homo sapiens
taatgcaacagctgctagtgat

SEQ ID NO: 7170054 - DNA, 22 bp, Homo sapiens
taatgcaaggaattccaagtag

SEQ ID NO: 7170055 - DNA, 21 bp, Homo sapiens
taatgcaaggaactaatgtca

SEQ ID NO: 7170056 - DNA, 21 bp, Homo sapiens
taatgcaaggaactaatgtca

SEQ ID NO: 7170057 - DNA, 22 bp, Homo sapiens
taatgaggtgatgactaaggtc

SEQ ID NO: 7170058 - DNA, 22 bp, Homo sapiens
taatgaggtgatgactaaggtc

SEQ ID NO: 7170059 - DNA, 22 bp, Homo sapiens
taatgagtcattcctgaatgct

SEQ ID NO: 7170060 - DNA, 22 bp, Homo sapiens
taatgataagagaggttctggc

SEQ ID NO: 7170061 - DNA, 18 bp, Homo sapiens
taatgataagccttgaag

SEQ ID NO: 7170062 - DNA, 18 bp, Homo sapiens
taatgataagccttgaag

SEQ ID NO: 7170063 - DNA, 22 bp, Homo sapiens
taatgatatttcccatttctct

SEQ ID NO: 7170064 - DNA, 22 bp, Homo sapiens
taatgatatttcccatttctct

SEQ ID NO: 7170065 - DNA, 22 bp, Homo sapiens
taatgatatttcccatttctct

SEQ ID NO: 7170066 - DNA, 22 bp, Homo sapiens
taatgatgctagatttatctgg

SEQ ID NO: 7170067 - DNA, 22 bp, Homo sapiens
taatgctttgtcagcctaaggg

SEQ ID NO: 7170068 - DNA, 22 bp, Homo sapiens
taatgctttgttttgatctaac

SEQ ID NO: 7170069 - DNA, 22 bp, Homo sapiens
taatgcttatgttatgcaattt

SEQ ID NO: 7170070 - DNA, 22 bp, Homo sapiens
taatgcttcctatatagcactc

SEQ ID NO: 7170071 - DNA, 22 bp, Homo sapiens
taatgcttcctatatagcactc

SEQ ID NO: 7170072 - DNA, 22 bp, Homo sapiens
taatgcttctgttaggatcttc

SEQ ID NO: 7170073 - DNA, 22 bp, Homo sapiens
taatgcttaacagctggctttt

SEQ ID NO: 7170074 - DNA, 22 bp, Homo sapiens
taatgcttaattttcacaagcc

SEQ ID NO: 7170075 - DNA, 22 bp, Homo sapiens
taatgcttaattttcacaagcc

SEQ ID NO: 7170076 - DNA, 22 bp, Homo sapiens
taatgcttaattttcacaagcc

SEQ ID NO: 7170077 - DNA, 22 bp, Homo sapiens
taatgccaggagggagttttta

SEQ ID NO: 7170078 - DNA, 20 bp, Homo sapiens
taatgcctcatgatactaga

SEQ ID NO: 7170079 - DNA, 22 bp, Homo sapiens
taatgcctttctgtactatatg

SEQ ID NO: 7170080 - DNA, 22 bp, Homo sapiens
taatgctaacatcatatcactg

SEQ ID NO: 7170081 - DNA, 22 bp, Homo sapiens
taatgctcaccctgcatcaggc

SEQ ID NO: 7170082 - DNA, 22 bp, Homo sapiens
taatttctaattcattttcagt

SEQ ID NO: 7170083 - DNA, 22 bp, Homo sapiens
taatttcagtgcaagctcacgg

SEQ ID NO: 7170084 - DNA, 22 bp, Homo sapiens
taatttcagtgcaagctcacgg

SEQ ID NO: 7170085 - DNA, 22 bp, Homo sapiens
taatttcagtgggctctgggct

SEQ ID NO: 7170086 - DNA, 22 bp, Homo sapiens
taatttcaccgttgctagaaat

SEQ ID NO: 7170087 - DNA, 22 bp, Homo sapiens
taatttcaccgttgctagaaat

SEQ ID NO: 7170088 - DNA, 22 bp, Homo sapiens
taatttcaccgttgctagaaat

SEQ ID NO: 7170089 - DNA, 22 bp, Homo sapiens
taatttcactgatatgaagtca

SEQ ID NO: 7170090 - DNA, 22 bp, Homo sapiens
taatttcactgatatgaagtca

SEQ ID NO: 7170091 - DNA, 22 bp, Homo sapiens
taatttcactgatatgaagtca

SEQ ID NO: 7170092 - DNA, 22 bp, Homo sapiens
taatggaagttaaatatggtat

SEQ ID NO: 7170093 - DNA, 22 bp, Homo sapiens
taatggagatttagcacttacg

SEQ ID NO: 7170094 - DNA, 22 bp, Homo sapiens
taatttcaatagcttgcataat

SEQ ID NO: 7170095 - DNA, 22 bp, Homo sapiens
taatttcaatagcttgcataat

SEQ ID NO: 7170096 - DNA, 22 bp, Homo sapiens
taatttcaatagcttgcataat

SEQ ID NO: 7170097 - DNA, 22 bp, Homo sapiens
taatttcacagttcaacgcaca

SEQ ID NO: 7170098 - DNA, 22 bp, Homo sapiens
taatttcacagttcaacgcaca

SEQ ID NO: 7170099 - DNA, 22 bp, Homo sapiens
taatttcacagttcaacgcaca

SEQ ID NO: 7170100 - DNA, 22 bp, Homo sapiens
taatttctggagggagaaagag

SEQ ID NO: 7170101 - DNA, 22 bp, Homo sapiens
taatttctggagggagaaagag

SEQ ID NO: 7170102 - DNA, 22 bp, Homo sapiens
taatttctagggactaaggtgc

SEQ ID NO: 7170103 - DNA, 22 bp, Homo sapiens
taatttcttcatctctgcagct

SEQ ID NO: 7170104 - DNA, 22 bp, Homo sapiens
taatttcttcatctctgcagct

SEQ ID NO: 7170105 - DNA, 22 bp, Homo sapiens
taatttcttcatctctgcagct

SEQ ID NO: 7170106 - DNA, 22 bp, Homo sapiens
taattttaactgtgctgtttgg

SEQ ID NO: 7170107 - DNA, 22 bp, Homo sapiens
taatttgaatctcgctatttta

SEQ ID NO: 7170108 - DNA, 22 bp, Homo sapiens
taattttaatagtatgtggcat

SEQ ID NO: 7170109 - DNA, 22 bp, Homo sapiens
taattttaactgtgctgtttgg

SEQ ID NO: 7170110 - DNA, 22 bp, Homo sapiens
taattttacttcctgagcacct

SEQ ID NO: 7170111 - DNA, 23 bp, Homo sapiens
taattttagccttacaggaccct

SEQ ID NO: 7170112 - DNA, 22 bp, Homo sapiens
taattttatgacagtgtatttt

SEQ ID NO: 7170113 - DNA, 22 bp, Homo sapiens
taattttatgacagtgtatttt

SEQ ID NO: 7170114 - DNA, 22 bp, Homo sapiens
taattttatgacagtgtatttt

SEQ ID NO: 7170115 - DNA, 22 bp, Homo sapiens
taattttatgacagtgtatttt

SEQ ID NO: 7170116 - DNA, 22 bp, Homo sapiens
taattttgtattgccattgtag

SEQ ID NO: 7170117 - DNA, 22 bp, Homo sapiens
taattttgtcacagtgacatgc

SEQ ID NO: 7170118 - DNA, 22 bp, Homo sapiens
taattttgtattgccattgtag

SEQ ID NO: 7170119 - DNA, 22 bp, Homo sapiens
taattttgctgtgaccattgaa

SEQ ID NO: 7170120 - DNA, 22 bp, Homo sapiens
taattttgtcacagtgacatgc

SEQ ID NO: 7170121 - DNA, 22 bp, Homo sapiens
taattttgtcacagtgacatgc

SEQ ID NO: 7170122 - DNA, 22 bp, Homo sapiens
taattttgtccccctgcacata

SEQ ID NO: 7170123 - DNA, 22 bp, Homo sapiens
tacaatgagctgtacatctcca

SEQ ID NO: 7170124 - DNA, 22 bp, Homo sapiens
tacaatgagctgagccagaggc

SEQ ID NO: 7170125 - DNA, 22 bp, Homo sapiens
tacaatgagctgtacatctcca

SEQ ID NO: 7170126 - DNA, 22 bp, Homo sapiens
tacaatgatgatactttactgg

SEQ ID NO: 7170127 - DNA, 22 bp, Homo sapiens
tacaatgattagctaacttgcc

SEQ ID NO: 7170128 - DNA, 22 bp, Homo sapiens
tacaatgattagctaacttgcc

SEQ ID NO: 7170129 - DNA, 22 bp, Homo sapiens
tacaatgaccatattatgtaag

SEQ ID NO: 7170130 - DNA, 22 bp, Homo sapiens
tacaatgaccatattatgtaag

SEQ ID NO: 7170131 - DNA, 22 bp, Homo sapiens
tacaatgaccatattatgtaag

SEQ ID NO: 7170132 - DNA, 22 bp, Homo sapiens
tacaatgactctcagtttggct

SEQ ID NO: 7170133 - DNA, 22 bp, Homo sapiens
tacaatgcaaaatactgtctgc

SEQ ID NO: 7170134 - DNA, 22 bp, Homo sapiens
tacaatgcaaaatactgtctgc

SEQ ID NO: 7170135 - DNA, 23 bp, Homo sapiens
tacaatgcaaacttggcccatgg

SEQ ID NO: 7170136 - DNA, 21 bp, Homo sapiens
tacaatgcacaggagagcctc

SEQ ID NO: 7170137 - DNA, 22 bp, Homo sapiens
tacaatgcagtgacctccttta

SEQ ID NO: 7170138 - DNA, 22 bp, Homo sapiens
tacaatgcattcatttttgagg

SEQ ID NO: 7170139 - DNA, 22 bp, Homo sapiens
tacaatgcattcatttttgagg

SEQ ID NO: 7170140 - DNA, 22 bp, Homo sapiens
tacaatgcattcgttgtctcgg

SEQ ID NO: 7170141 - DNA, 22 bp, Homo sapiens
tacaatgcattcatttttgagg

SEQ ID NO: 7170142 - DNA, 22 bp, Homo sapiens
tacaatgctgtgcatgtaatgg

SEQ ID NO: 7170143 - DNA, 22 bp, Homo sapiens
tacaatgctgtgcatgtaatgg

SEQ ID NO: 7170144 - DNA, 22 bp, Homo sapiens
tacaatgctgtttgtttctact

SEQ ID NO: 7170145 - DNA, 22 bp, Homo sapiens
tacaatgctgtttgtttctact

SEQ ID NO: 7170146 - DNA, 22 bp, Homo sapiens
tacaatgctgtttgtttctact

SEQ ID NO: 7170147 - DNA, 22 bp, Homo sapiens
tacaatgtaattctgattatgt

SEQ ID NO: 7170148 - DNA, 22 bp, Homo sapiens
tacaatgtaattctgattatgt

SEQ ID NO: 7170149 - DNA, 16 bp, Homo sapiens
tacaatgtagaaaaca

SEQ ID NO: 7170150 - DNA, 22 bp, Homo sapiens
tacaaaaaattgatactgacga

SEQ ID NO: 7170151 - DNA, 22 bp, Homo sapiens
tacaaaaaattgatactgacga

SEQ ID NO: 7170152 - DNA, 22 bp, Homo sapiens
taatttttccacgtacactggg

SEQ ID NO: 7170153 - DNA, 22 bp, Homo sapiens
tacaaaaaattgatactgacga

SEQ ID NO: 7170154 - DNA, 22 bp, Homo sapiens
tacaagctgaccctgaagatga

SEQ ID NO: 7170155 - DNA, 22 bp, Homo sapiens
tacaagctgaccctgaagatga

SEQ ID NO: 7170156 - DNA, 22 bp, Homo sapiens
tacaagctgaccctgaagatga

SEQ ID NO: 7170157 - DNA, 19 bp, Homo sapiens
tacaagcttaaagtaatgt

SEQ ID NO: 7170158 - DNA, 22 bp, Homo sapiens
tacaatatgtggccttttgtga

SEQ ID NO: 7170159 - DNA, 22 bp, Homo sapiens
tacaatatgtggccttttgtga

SEQ ID NO: 7170160 - DNA, 20 bp, Homo sapiens
tacaatattcccactttgct

SEQ ID NO: 7170161 - DNA, 22 bp, Homo sapiens
tacaagcttttgtgtataaatg

SEQ ID NO: 7170162 - DNA, 22 bp, Homo sapiens
tacaatatgtggccttttgtga

SEQ ID NO: 7170163 - DNA, 22 bp, Homo sapiens
tacaatcacccaaagagccaga

SEQ ID NO: 7170164 - DNA, 22 bp, Homo sapiens
tacacatcccagactcccagga

SEQ ID NO: 7170165 - DNA, 22 bp, Homo sapiens
tacacatcatacactgggatta

SEQ ID NO: 7170166 - DNA, 22 bp, Homo sapiens
tacacatccatgttttgacttt

SEQ ID NO: 7170167 - DNA, 22 bp, Homo sapiens
tacacatccttctgaacaacct

SEQ ID NO: 7170168 - DNA, 22 bp, Homo sapiens
tacacatctctgtcagtagtga

SEQ ID NO: 7170169 - DNA, 22 bp, Homo sapiens
tacacatctctgtcagtagtga

SEQ ID NO: 7170170 - DNA, 22 bp, Homo sapiens
tacacatctggagaagccctgt

SEQ ID NO: 7170171 - DNA, 22 bp, Homo sapiens
tacacatctggtgtgactgcca

SEQ ID NO: 7170172 - DNA, 22 bp, Homo sapiens
tacacatgacagtggactgaga

SEQ ID NO: 7170173 - DNA, 22 bp, Homo sapiens
tacacatgacagtggactgaga

SEQ ID NO: 7170174 - DNA, 22 bp, Homo sapiens
tacacatgacagtggactgaga

SEQ ID NO: 7170175 - DNA, 22 bp, Homo sapiens
tacacatgatcatttagtagca

SEQ ID NO: 7170176 - DNA, 22 bp, Homo sapiens
tacacatgatcatttagtagca

SEQ ID NO: 7170177 - DNA, 22 bp, Homo sapiens
tacacataggtctgaataaaaa

SEQ ID NO: 7170178 - DNA, 22 bp, Homo sapiens
tacacatatgtccattaatcag

SEQ ID NO: 7170179 - DNA, 22 bp, Homo sapiens
tacacatatgtccattaatcag

SEQ ID NO: 7170180 - DNA, 22 bp, Homo sapiens
tacacatatgtgtgtatatgtg

SEQ ID NO: 7170181 - DNA, 22 bp, Homo sapiens
tacacatatgtgtgtatatgtg

SEQ ID NO: 7170182 - DNA, 22 bp, Homo sapiens
tacacatcaacctggctttggc

SEQ ID NO: 7170183 - DNA, 22 bp, Homo sapiens
tacacatcactgtatctttcag

SEQ ID NO: 7170184 - DNA, 22 bp, Homo sapiens
tacacaaaggcactctgttgtt

SEQ ID NO: 7170185 - DNA, 22 bp, Homo sapiens
tacacaaaggcactctgttgtt

SEQ ID NO: 7170186 - DNA, 22 bp, Homo sapiens
tacacaaaggcactctgttgtt

SEQ ID NO: 7170187 - DNA, 21 bp, Homo sapiens
tacacaaagcgtggtccagag

SEQ ID NO: 7170188 - DNA, 21 bp, Homo sapiens
tacacaaagcgtggtccagag

SEQ ID NO: 7170189 - DNA, 22 bp, Homo sapiens
tacaatttagtggtgtgtggtt

SEQ ID NO: 7170190 - DNA, 22 bp, Homo sapiens
tacaatttagtggtgtgtggtt

SEQ ID NO: 7170191 - DNA, 17 bp, Homo sapiens
tacaatgtgattcaatc

SEQ ID NO: 7170192 - DNA, 22 bp, Homo sapiens
tacaatgtgtgcttcttgtcac

SEQ ID NO: 7170193 - DNA, 22 bp, Homo sapiens
tacaatgttaaggaaagagaga

SEQ ID NO: 7170194 - DNA, 22 bp, Homo sapiens
tacaatgttaaggaaagagaga

SEQ ID NO: 7170195 - DNA, 22 bp, Homo sapiens
tacaatgttcctagcaggaaag

SEQ ID NO: 7170196 - DNA, 22 bp, Homo sapiens
tacaatgttggtaaagtatcat

SEQ ID NO: 7170197 - DNA, 22 bp, Homo sapiens
tacaatgttggtaaagtatcat

SEQ ID NO: 7170198 - DNA, 22 bp, Homo sapiens
tacaatgttggtaaagtatcat

SEQ ID NO: 7170199 - DNA, 22 bp, Homo sapiens
tacacattacataatactatct

SEQ ID NO: 7170200 - DNA, 22 bp, Homo sapiens
tacacattacataatactatct

SEQ ID NO: 7170201 - DNA, 22 bp, Homo sapiens
tacacattagtcaagagtttga

SEQ ID NO: 7170202 - DNA, 22 bp, Homo sapiens
tacacattagtcaagagtttga

SEQ ID NO: 7170203 - DNA, 22 bp, Homo sapiens
tacacattagtgaggtattttg

SEQ ID NO: 7170204 - DNA, 22 bp, Homo sapiens
tacacattagtgaggtattttg

SEQ ID NO: 7170205 - DNA, 22 bp, Homo sapiens
tacacattctagggcacagtta

SEQ ID NO: 7170206 - DNA, 22 bp, Homo sapiens
tacacatgatcatttagtagca

SEQ ID NO: 7170207 - DNA, 22 bp, Homo sapiens
tacacatgcatgtactccagga

SEQ ID NO: 7170208 - DNA, 22 bp, Homo sapiens
tacacatgcatgtactccagga

SEQ ID NO: 7170209 - DNA, 22 bp, Homo sapiens
tacacatgcatgtactccagga

SEQ ID NO: 7170210 - DNA, 22 bp, Homo sapiens
tacacatgcatgtactccagga

SEQ ID NO: 7170211 - DNA, 22 bp, Homo sapiens
tacacatgctcagattcctgtg

SEQ ID NO: 7170212 - DNA, 22 bp, Homo sapiens
tacacatgctcagattcctgtg

SEQ ID NO: 7170213 - DNA, 22 bp, Homo sapiens
tacacatgctcagattcctgtg

SEQ ID NO: 7170214 - DNA, 22 bp, Homo sapiens
tacacatgtatttatgtgtaca

SEQ ID NO: 7170215 - DNA, 22 bp, Homo sapiens
tacacatgtatttatgtgtaca

SEQ ID NO: 7170216 - DNA, 22 bp, Homo sapiens
tacacatgtccaaggtgtcacc

SEQ ID NO: 7170217 - DNA, 22 bp, Homo sapiens
tacacatgtccaaggtgtcacc

SEQ ID NO: 7170218 - DNA, 22 bp, Homo sapiens
tacacatgtgcacgcgtgtcct

SEQ ID NO: 7170219 - DNA, 22 bp, Homo sapiens
tacacatgtgcacgcgtgtcct

SEQ ID NO: 7170220 - DNA, 22 bp, Homo sapiens
tacacatgtttggcaagtatgt

SEQ ID NO: 7170221 - DNA, 22 bp, Homo sapiens
tacacatgtttggcaagtatgt

SEQ ID NO: 7170222 - DNA, 22 bp, Homo sapiens
tacacatgtttggcaagtatgt

SEQ ID NO: 7170223 - DNA, 22 bp, Homo sapiens
tacacatgtttggcaagtatgt

SEQ ID NO: 7170224 - DNA, 22 bp, Homo sapiens
tacaccattcccaggtggattt

SEQ ID NO: 7170225 - DNA, 22 bp, Homo sapiens
tacacccacatgcctaggaggg

SEQ ID NO: 7170226 - DNA, 22 bp, Homo sapiens
tacacccttctcctgagtgtgt

SEQ ID NO: 7170227 - DNA, 22 bp, Homo sapiens
tacacctgctgagcctgtcctc

SEQ ID NO: 7170228 - DNA, 22 bp, Homo sapiens
tacacctgggacccatccaaga

SEQ ID NO: 7170229 - DNA, 22 bp, Homo sapiens
tacacccttctcctgagtgtgt

SEQ ID NO: 7170230 - DNA, 22 bp, Homo sapiens
tacactaaatcttcatctttta

SEQ ID NO: 7170231 - DNA, 19 bp, Homo sapiens
taagatggcaagtgtctct

SEQ ID NO: 7170232 - DNA, 22 bp, Homo sapiens
taagatggcagatgagcttgtt

SEQ ID NO: 7170233 - DNA, 22 bp, Homo sapiens
taagatgggctaagtttgtcct

SEQ ID NO: 7170234 - DNA, 22 bp, Homo sapiens
taagatgaggtaggtaagactt

SEQ ID NO: 7170235 - DNA, 22 bp, Homo sapiens
taagatgaggtaggtaagactt

SEQ ID NO: 7170236 - DNA, 22 bp, Homo sapiens
taagatgatcaccaaatgctgg

SEQ ID NO: 7170237 - DNA, 22 bp, Homo sapiens
taagcaacaagtggctggagga

SEQ ID NO: 7170238 - DNA, 22 bp, Homo sapiens
taagatatggtaggaagtttgg

SEQ ID NO: 7170239 - DNA, 22 bp, Homo sapiens
taagatagaactctgaggctac

SEQ ID NO: 7170240 - DNA, 22 bp, Homo sapiens
taagatagaactctgaggctac

SEQ ID NO: 7170241 - DNA, 22 bp, Homo sapiens
taagatattgagtggtaatttg

SEQ ID NO: 7170242 - DNA, 19 bp, Homo sapiens
taagatacccctctatttt

SEQ ID NO: 7170243 - DNA, 22 bp, Homo sapiens
taagatgaaggctcacctagaa

SEQ ID NO: 7170244 - DNA, 22 bp, Homo sapiens
taagatgaccttataaagagca

SEQ ID NO: 7170245 - DNA, 22 bp, Homo sapiens
taagatgactacttaccactga

SEQ ID NO: 7170246 - DNA, 20 bp, Homo sapiens
taagatgagctataagaagt

SEQ ID NO: 7170247 - DNA, 22 bp, Homo sapiens
taagatcatgggaaatggacat

SEQ ID NO: 7170248 - DNA, 22 bp, Homo sapiens
taagatccaccttgaaatggac

SEQ ID NO: 7170249 - DNA, 22 bp, Homo sapiens
taagatgaagcagaagagttat

SEQ ID NO: 7170250 - DNA, 22 bp, Homo sapiens
taagataataagtatgtctatg

SEQ ID NO: 7170251 - DNA, 22 bp, Homo sapiens
taagataagtgggttgagatgg

SEQ ID NO: 7170252 - DNA, 22 bp, Homo sapiens
taagataagtgggttgagatgg

SEQ ID NO: 7170253 - DNA, 22 bp, Homo sapiens
taagataataccatgggccagg

SEQ ID NO: 7170254 - DNA, 22 bp, Homo sapiens
taagaggcattagagacatagc

SEQ ID NO: 7170255 - DNA, 22 bp, Homo sapiens
taagaggcagcattcctcgcct

SEQ ID NO: 7170256 - DNA, 22 bp, Homo sapiens
taagaaatttagttatagaatg

SEQ ID NO: 7170257 - DNA, 22 bp, Homo sapiens
taagagttgaaggagattttca

SEQ ID NO: 7170258 - DNA, 22 bp, Homo sapiens
taacttcactggactcagcagc

SEQ ID NO: 7170259 - DNA, 22 bp, Homo sapiens
taacttctctgctatcatagga

SEQ ID NO: 7170260 - DNA, 22 bp, Homo sapiens
taacttctgaatagcaatagta

SEQ ID NO: 7170261 - DNA, 22 bp, Homo sapiens
taacttctgcacagaaaatttg

SEQ ID NO: 7170262 - DNA, 22 bp, Homo sapiens
taactgtgtgaacgtgatcatt

SEQ ID NO: 7170263 - DNA, 22 bp, Homo sapiens
taactgttgtgcgggtctctgg

SEQ ID NO: 7170264 - DNA, 22 bp, Homo sapiens
taactgtacctagataacgaac

SEQ ID NO: 7170265 - DNA, 22 bp, Homo sapiens
taactgtagttataaagctatc

SEQ ID NO: 7170266 - DNA, 22 bp, Homo sapiens
taactgtagttataaagctatc

SEQ ID NO: 7170267 - DNA, 22 bp, Homo sapiens
taactgtatagcttggactaaa

SEQ ID NO: 7170268 - DNA, 22 bp, Homo sapiens
taactgtatagcttggactaaa

SEQ ID NO: 7170269 - DNA, 22 bp, Homo sapiens
taactgtatagcttggactaaa

SEQ ID NO: 7170270 - DNA, 22 bp, Homo sapiens
taagaaatttagttatagaatg

SEQ ID NO: 7170271 - DNA, 22 bp, Homo sapiens
taagaaacttaactgggaacta

SEQ ID NO: 7170272 - DNA, 22 bp, Homo sapiens
taagaaatttagttatagaatg

SEQ ID NO: 7170273 - DNA, 22 bp, Homo sapiens
taagaaatttagttatagaatg

SEQ ID NO: 7170274 - DNA, 22 bp, Homo sapiens
taagaaatttagttatagaatg

SEQ ID NO: 7170275 - DNA, 22 bp, Homo sapiens
taagaaatttagttatagaatg

SEQ ID NO: 7170276 - DNA, 22 bp, Homo sapiens
taagaaactattgtctctgaac

SEQ ID NO: 7170277 - DNA, 22 bp, Homo sapiens
taagaaactgtcacagtactat

SEQ ID NO: 7170278 - DNA, 22 bp, Homo sapiens
taacttctgcacagaaaatttg

SEQ ID NO: 7170279 - DNA, 22 bp, Homo sapiens
taacttctggaaatgcatctgc

SEQ ID NO: 7170280 - DNA, 16 bp, Homo sapiens
taacttcttccttcaa

SEQ ID NO: 7170281 - DNA, 22 bp, Homo sapiens
taacttctttggtttaaagaga

SEQ ID NO: 7170282 - DNA, 22 bp, Homo sapiens
taagaaacccaggaatttctta

SEQ ID NO: 7170283 - DNA, 22 bp, Homo sapiens
taagaaactaatgcaataagag

SEQ ID NO: 7170284 - DNA, 22 bp, Homo sapiens
taagaaactatggagaagaact

SEQ ID NO: 7170285 - DNA, 21 bp, Homo sapiens
taacacattttggtactttgg

SEQ ID NO: 7170286 - DNA, 21 bp, Homo sapiens
taacacattttggtactttgg

SEQ ID NO: 7170287 - DNA, 21 bp, Homo sapiens
taacacattttggtactttgg

SEQ ID NO: 7170288 - DNA, 22 bp, Homo sapiens
taacacattttcctcatacgga

SEQ ID NO: 7170289 - DNA, 22 bp, Homo sapiens
taacacattttcctcatacgga

SEQ ID NO: 7170290 - DNA, 21 bp, Homo sapiens
taacacattttggtactttgg

SEQ ID NO: 7170291 - DNA, 21 bp, Homo sapiens
taacacattttggtactttgg

SEQ ID NO: 7170292 - DNA, 22 bp, Homo sapiens
taacacattttcctcatacgga

SEQ ID NO: 7170293 - DNA, 22 bp, Homo sapiens
taacacattttcctcatacgga

SEQ ID NO: 7170294 - DNA, 22 bp, Homo sapiens
taacacattttaagccatttta

SEQ ID NO: 7170295 - DNA, 22 bp, Homo sapiens
taacacattttaagccatttta

SEQ ID NO: 7170296 - DNA, 22 bp, Homo sapiens
taacacattagttctcctagat

SEQ ID NO: 7170297 - DNA, 22 bp, Homo sapiens
taacacattttaagccatttta

SEQ ID NO: 7170298 - DNA, 22 bp, Homo sapiens
taacacattagttctcctagat

SEQ ID NO: 7170299 - DNA, 22 bp, Homo sapiens
taacacatgtctgggatgtgaa

SEQ ID NO: 7170300 - DNA, 22 bp, Homo sapiens
taacacatgtctgggatgtgaa

SEQ ID NO: 7170301 - DNA, 22 bp, Homo sapiens
taacacatgtctgggatgtgaa

SEQ ID NO: 7170302 - DNA, 22 bp, Homo sapiens
taacacatggttctgtcaggaa

SEQ ID NO: 7170303 - DNA, 22 bp, Homo sapiens
taacacatggttctgtcaggaa

SEQ ID NO: 7170304 - DNA, 22 bp, Homo sapiens
taacacatggttagtacacaat

SEQ ID NO: 7170305 - DNA, 22 bp, Homo sapiens
taacacatggttctgtcaggaa

SEQ ID NO: 7170306 - DNA, 22 bp, Homo sapiens
taactggtatatcagtgtacac

SEQ ID NO: 7170307 - DNA, 22 bp, Homo sapiens
taactggtcctcggatgttgtg

SEQ ID NO: 7170308 - DNA, 22 bp, Homo sapiens
taactggtcctgaacagcccag

SEQ ID NO: 7170309 - DNA, 22 bp, Homo sapiens
taactggtgagtaggatttata

SEQ ID NO: 7170310 - DNA, 22 bp, Homo sapiens
taactggtgagttggttgagtg

SEQ ID NO: 7170311 - DNA, 19 bp, Homo sapiens
taactggtgccttcagtca

SEQ ID NO: 7170312 - DNA, 19 bp, Homo sapiens
taactggttaaaaagcttg

SEQ ID NO: 7170313 - DNA, 22 bp, Homo sapiens
taactggttaagggtgaaatcc

SEQ ID NO: 7170314 - DNA, 18 bp, Homo sapiens
taactggtttcttcccat

SEQ ID NO: 7170315 - DNA, 22 bp, Homo sapiens
taactggtttggctcagggtct

SEQ ID NO: 7170316 - DNA, 22 bp, Homo sapiens
taactggtttcatatcatttcc

SEQ ID NO: 7170317 - DNA, 22 bp, Homo sapiens
taactggtttcatatcatttcc

SEQ ID NO: 7170318 - DNA, 22 bp, Homo sapiens
taacacatgaaagcaccttctt

SEQ ID NO: 7170319 - DNA, 22 bp, Homo sapiens
taacacatatttgcagtaagca

SEQ ID NO: 7170320 - DNA, 22 bp, Homo sapiens
taacacatgaaagcaccttctt

SEQ ID NO: 7170321 - DNA, 22 bp, Homo sapiens
taacacatatttgcagtaagca

SEQ ID NO: 7170322 - DNA, 22 bp, Homo sapiens
taacacatggttagtacacaat

SEQ ID NO: 7170323 - DNA, 22 bp, Homo sapiens
taacacatggttagtacacaat

SEQ ID NO: 7170324 - DNA, 22 bp, Homo sapiens
taacacatgaaagcaccttctt

SEQ ID NO: 7170325 - DNA, 22 bp, Homo sapiens
taacacatggttagtacacaat

SEQ ID NO: 7170326 - DNA, 22 bp, Homo sapiens
taacacatggttagtacacaat

SEQ ID NO: 7170327 - DNA, 22 bp, Homo sapiens
taacacatatttcaagagtagt

SEQ ID NO: 7170328 - DNA, 22 bp, Homo sapiens
taacacatatctacaacatgtg

SEQ ID NO: 7170329 - DNA, 22 bp, Homo sapiens
taacacatatttcaagagtagt

SEQ ID NO: 7170330 - DNA, 22 bp, Homo sapiens
taacacatatttcaagagtagt

SEQ ID NO: 7170331 - DNA, 22 bp, Homo sapiens
taacacatatctacaacatgtg

SEQ ID NO: 7170332 - DNA, 22 bp, Homo sapiens
taacacatagatattttaactt

SEQ ID NO: 7170333 - DNA, 22 bp, Homo sapiens
taacacatatctacaacatgtg

SEQ ID NO: 7170334 - DNA, 22 bp, Homo sapiens
taacacatagatattttaactt

SEQ ID NO: 7170335 - DNA, 22 bp, Homo sapiens
taacacatagatattttaactt

SEQ ID NO: 7170336 - DNA, 22 bp, Homo sapiens
taacacatagatattttaactt

SEQ ID NO: 7170337 - DNA, 22 bp, Homo sapiens
taacacataagctgagaccatg

SEQ ID NO: 7170338 - DNA, 22 bp, Homo sapiens
taacacataagctgagaccatg

SEQ ID NO: 7170339 - DNA, 22 bp, Homo sapiens
taacacagttctctgttgcaca

SEQ ID NO: 7170340 - DNA, 22 bp, Homo sapiens
taacacataagctgagaccatg

SEQ ID NO: 7170341 - DNA, 22 bp, Homo sapiens
taacacagtgtcctcagaaaca

SEQ ID NO: 7170342 - DNA, 22 bp, Homo sapiens
taacacagtgtctaccattatt

SEQ ID NO: 7170343 - DNA, 22 bp, Homo sapiens
taacaatagtgtttgctagtca

SEQ ID NO: 7170344 - DNA, 22 bp, Homo sapiens
taacaaaggttgccaaactaag

SEQ ID NO: 7170345 - DNA, 22 bp, Homo sapiens
taacaaactggaaattgacatt

SEQ ID NO: 7170346 - DNA, 22 bp, Homo sapiens
taacaaactggaaattgacatt

SEQ ID NO: 7170347 - DNA, 21 bp, Homo sapiens
taacaaagacttctggtcagg

SEQ ID NO: 7170348 - DNA, 21 bp, Homo sapiens
taacaaagacttctggtcagg

SEQ ID NO: 7170349 - DNA, 22 bp, Homo sapiens
taaatactgagttggagttggc

SEQ ID NO: 7170350 - DNA, 22 bp, Homo sapiens
taaatacttagttttgtgtcta

SEQ ID NO: 7170351 - DNA, 22 bp, Homo sapiens
taaatttttgttaacagcctct

SEQ ID NO: 7170352 - DNA, 22 bp, Homo sapiens
taacacagacagccactagtaa

SEQ ID NO: 7170353 - DNA, 22 bp, Homo sapiens
taacaatttgcttcatttgttt

SEQ ID NO: 7170354 - DNA, 22 bp, Homo sapiens
taacaatggttttgctgataat

SEQ ID NO: 7170355 - DNA, 22 bp, Homo sapiens
taacaatggttttgctgataat

SEQ ID NO: 7170356 - DNA, 23 bp, Homo sapiens
taacaatggactcctcttagcta

SEQ ID NO: 7170357 - DNA, 22 bp, Homo sapiens
taacaatggagttttgagaaag

SEQ ID NO: 7170358 - DNA, 22 bp, Homo sapiens
taacaatgggaaggactgatga

SEQ ID NO: 7170359 - DNA, 22 bp, Homo sapiens
taacaatgggaaggactgatga

SEQ ID NO: 7170360 - DNA, 22 bp, Homo sapiens
taacaatgattagtgactacag

SEQ ID NO: 7170361 - DNA, 22 bp, Homo sapiens
taacaatgattagtgactacag

SEQ ID NO: 7170362 - DNA, 22 bp, Homo sapiens
taacaatgattagtgactacag

SEQ ID NO: 7170363 - DNA, 22 bp, Homo sapiens
taacaatgcaaaatgaatttag

SEQ ID NO: 7170364 - DNA, 17 bp, Homo sapiens
taaatacacaagggtat

SEQ ID NO: 7170365 - DNA, 17 bp, Homo sapiens
taaatacacaagggtat

SEQ ID NO: 7170366 - DNA, 17 bp, Homo sapiens
taaatacacaagggtat

SEQ ID NO: 7170367 - DNA, 22 bp, Homo sapiens
taaatacagtcatttgagccat

SEQ ID NO: 7170368 - DNA, 22 bp, Homo sapiens
taaatacagtcatttgagccat

SEQ ID NO: 7170369 - DNA, 22 bp, Homo sapiens
taaatacagtcatttgagccat

SEQ ID NO: 7170370 - DNA, 21 bp, Homo sapiens
taaataataagttgctgagat

SEQ ID NO: 7170371 - DNA, 21 bp, Homo sapiens
taaataataagttgctgagat

SEQ ID NO: 7170372 - DNA, 21 bp, Homo sapiens
taaataataagttgctgagat

SEQ ID NO: 7170373 - DNA, 21 bp, Homo sapiens
taaataataagttgctgagat

SEQ ID NO: 7170374 - DNA, 21 bp, Homo sapiens
taaataataagttgctgagat

SEQ ID NO: 7170375 - DNA, 22 bp, Homo sapiens
taaataagttcttcattgtttg

SEQ ID NO: 7170376 - DNA, 21 bp, Homo sapiens
taaataataagttgctgagat

SEQ ID NO: 7170377 - DNA, 22 bp, Homo sapiens
taaagtttggcagacaataaca

SEQ ID NO: 7170378 - DNA, 22 bp, Homo sapiens
taaagtttggcagacaataaca

SEQ ID NO: 7170379 - DNA, 22 bp, Homo sapiens
taaagtttgtagcaattgatat

SEQ ID NO: 7170380 - DNA, 22 bp, Homo sapiens
taaagtttgtagcaattgatat

SEQ ID NO: 7170381 - DNA, 22 bp, Homo sapiens
taaagtttgtagcaattgatat

SEQ ID NO: 7170382 - DNA, 22 bp, Homo sapiens
taaagtttgtagcaattgatat

SEQ ID NO: 7170383 - DNA, 22 bp, Homo sapiens
taaataagtcactgaccattta

SEQ ID NO: 7170384 - DNA, 22 bp, Homo sapiens
taaataagtcactgaccattta

SEQ ID NO: 7170385 - DNA, 22 bp, Homo sapiens
taaataagttcttcattgtttg

SEQ ID NO: 7170386 - DNA, 22 bp, Homo sapiens
taaagtttatttgaacatctct

SEQ ID NO: 7170387 - DNA, 22 bp, Homo sapiens
taaagtttattggcaccaccat

SEQ ID NO: 7170388 - DNA, 22 bp, Homo sapiens
taaagtttatttgaacatctct

SEQ ID NO: 7170389 - DNA, 22 bp, Homo sapiens
taaagttggacctgattttatt

SEQ ID NO: 7170390 - DNA, 22 bp, Homo sapiens
taaagttggacctgattttatt

SEQ ID NO: 7170391 - DNA, 22 bp, Homo sapiens
taaagttggacctgattttatt

SEQ ID NO: 7170392 - DNA, 21 bp, Homo sapiens
taaagaagatgaatgtgatca

SEQ ID NO: 7170393 - DNA, 21 bp, Homo sapiens
taaagaagatgaatgtgatca

SEQ ID NO: 7170394 - DNA, 22 bp, Homo sapiens
taaagaacacagggaatagcac

SEQ ID NO: 7170395 - DNA, 22 bp, Homo sapiens
taaactgtgaaaggcttaacat

SEQ ID NO: 7170396 - DNA, 22 bp, Homo sapiens
taaagaataatacccatggagc

SEQ ID NO: 7170397 - DNA, 22 bp, Homo sapiens
taaagaatagatgggtagggag

SEQ ID NO: 7170398 - DNA, 22 bp, Homo sapiens
taaagaatagatgggtagggag

SEQ ID NO: 7170399 - DNA, 22 bp, Homo sapiens
taaagacaaacccactagggtt

SEQ ID NO: 7170400 - DNA, 22 bp, Homo sapiens
taaagacaaacccactagggtt

SEQ ID NO: 7170401 - DNA, 22 bp, Homo sapiens
taaagacaaatgacattacggc

SEQ ID NO: 7170402 - DNA, 22 bp, Homo sapiens
taaagacaataggaaagttgtt

SEQ ID NO: 7170403 - DNA, 22 bp, Homo sapiens
taaagacaataggaaagttgtt

SEQ ID NO: 7170404 - DNA, 22 bp, Homo sapiens
taaagacaatttcgagctgtag

SEQ ID NO: 7170405 - DNA, 22 bp, Homo sapiens
taaagacacccagggagggact

SEQ ID NO: 7170406 - DNA, 22 bp, Homo sapiens
taaagacactggttttaatcat

SEQ ID NO: 7170407 - DNA, 22 bp, Homo sapiens
taaagtgtgcatggtcaaatat

SEQ ID NO: 7170408 - DNA, 22 bp, Homo sapiens
taaagtgtgtatatacatatgg

SEQ ID NO: 7170409 - DNA, 22 bp, Homo sapiens
taaagtgtgtatatacatatgg

SEQ ID NO: 7170410 - DNA, 22 bp, Homo sapiens
taaagtgtgtatatacatatgg

SEQ ID NO: 7170411 - DNA, 22 bp, Homo sapiens
taaagtgtgtgggttctaaatt

SEQ ID NO: 7170412 - DNA, 22 bp, Homo sapiens
taaagtgttgtacaaatgtatg

SEQ ID NO: 7170413 - DNA, 22 bp, Homo sapiens
taaagtgttgtacaaatgtatg

SEQ ID NO: 7170414 - DNA, 22 bp, Homo sapiens
taaagtgttgtacaaatgtatg

SEQ ID NO: 7170415 - DNA, 22 bp, Homo sapiens
gttttataattgcttcataaga

SEQ ID NO: 7170416 - DNA, 22 bp, Homo sapiens
gttttagtgtaacggagtgtga

SEQ ID NO: 7170417 - DNA, 22 bp, Homo sapiens
gttttataattgcttcataaga

SEQ ID NO: 7170418 - DNA, 22 bp, Homo sapiens
gttttataattgcttcataaga

SEQ ID NO: 7170419 - DNA, 22 bp, Homo sapiens
gttttataattgcttcataaga

SEQ ID NO: 7170420 - DNA, 22 bp, Homo sapiens
gttttataggctgttgctatat

SEQ ID NO: 7170421 - DNA, 22 bp, Homo sapiens
gttttataggctgttgctatat

SEQ ID NO: 7170422 - DNA, 22 bp, Homo sapiens
gttttataggctgttgctatat

SEQ ID NO: 7170423 - DNA, 22 bp, Homo sapiens
gttttataggctgttgctatat

SEQ ID NO: 7170424 - DNA, 22 bp, Homo sapiens
gttttataggctgttgctatat

SEQ ID NO: 7170425 - DNA, 22 bp, Homo sapiens
gttttataggtgaaatattact

SEQ ID NO: 7170426 - DNA, 22 bp, Homo sapiens
gttttatgagacctcaggaata

SEQ ID NO: 7170427 - DNA, 22 bp, Homo sapiens
gttttatagttcgggacctgtt

SEQ ID NO: 7170428 - DNA, 22 bp, Homo sapiens
gttttatatgtctctgctgaca

SEQ ID NO: 7170429 - DNA, 20 bp, Homo sapiens
gttttatgccagttctgtgt

SEQ ID NO: 7170430 - DNA, 20 bp, Homo sapiens
gttttatgccagttctgtgt

SEQ ID NO: 7170431 - DNA, 22 bp, Homo sapiens
gttttattggaacacagccatg

SEQ ID NO: 7170432 - DNA, 22 bp, Homo sapiens
gttttattggaacacagccatg

SEQ ID NO: 7170433 - DNA, 22 bp, Homo sapiens
gttttattggaacacagccatg

SEQ ID NO: 7170434 - DNA, 22 bp, Homo sapiens
gttttattggaacacagccatg

SEQ ID NO: 7170435 - DNA, 22 bp, Homo sapiens
gttttatttccatgagagaccg

SEQ ID NO: 7170436 - DNA, 22 bp, Homo sapiens
gttttatttccatgagagaccg

SEQ ID NO: 7170437 - DNA, 22 bp, Homo sapiens
gttttatttccatgagagaccg

SEQ ID NO: 7170438 - DNA, 22 bp, Homo sapiens
gttttatttccatgagagaccg

SEQ ID NO: 7170439 - DNA, 23 bp, Homo sapiens
gttttcaacacaataaatgtaac

SEQ ID NO: 7170440 - DNA, 22 bp, Homo sapiens
gttttattggaacacagccatg

SEQ ID NO: 7170441 - DNA, 22 bp, Homo sapiens
gttttattggaacacagccatg

SEQ ID NO: 7170442 - DNA, 22 bp, Homo sapiens
gttttattggaacacagccatg

SEQ ID NO: 7170443 - DNA, 22 bp, Homo sapiens
gttttattggaacacagccatg

SEQ ID NO: 7170444 - DNA, 22 bp, Homo sapiens
gttttattggaacacagccatg

SEQ ID NO: 7170445 - DNA, 22 bp, Homo sapiens
gttttattggaacacagccatg

SEQ ID NO: 7170446 - DNA, 22 bp, Homo sapiens
gttttatttccatgagagaccg

SEQ ID NO: 7170447 - DNA, 22 bp, Homo sapiens
gttttatttccatgagagaccg

SEQ ID NO: 7170448 - DNA, 22 bp, Homo sapiens
gttttatttccatgagagaccg

SEQ ID NO: 7170449 - DNA, 22 bp, Homo sapiens
gttttatttccatgagagaccg

SEQ ID NO: 7170450 - DNA, 22 bp, Homo sapiens
gttttatttccatgagagaccg

SEQ ID NO: 7170451 - DNA, 22 bp, Homo sapiens
gttttattggaacacagccatg

SEQ ID NO: 7170452 - DNA, 22 bp, Homo sapiens
taaacagcctcccctttcactc

SEQ ID NO: 7170453 - DNA, 22 bp, Homo sapiens
taaacagcctaaaactttcttt

SEQ ID NO: 7170454 - DNA, 16 bp, Homo sapiens
taaacagcagacagtt

SEQ ID NO: 7170455 - DNA, 16 bp, Homo sapiens
taaacagcagacagtt

SEQ ID NO: 7170456 - DNA, 22 bp, Homo sapiens
taaacagagtgctagttcacgg

SEQ ID NO: 7170457 - DNA, 22 bp, Homo sapiens
taaacagagagtgcagttatag

SEQ ID NO: 7170458 - DNA, 22 bp, Homo sapiens
taaacagagatgcctgggtctg

SEQ ID NO: 7170459 - DNA, 22 bp, Homo sapiens
taaacagagatgcctgggtctg

SEQ ID NO: 7170460 - DNA, 22 bp, Homo sapiens
taaacagagtgctagttcacgg

SEQ ID NO: 7170461 - DNA, 22 bp, Homo sapiens
taaacagagtgctagttcacgg

SEQ ID NO: 7170462 - DNA, 22 bp, Homo sapiens
gttttcagccaggagcacattt

SEQ ID NO: 7170463 - DNA, 22 bp, Homo sapiens
gttttcagccaggagcacattt

SEQ ID NO: 7170464 - DNA, 22 bp, Homo sapiens
gttttcagccaggagcacattt

SEQ ID NO: 7170465 - DNA, 21 bp, Homo sapiens
gttttcatgatagagtctgta

SEQ ID NO: 7170466 - DNA, 21 bp, Homo sapiens
gttttcatgatagagtctgta

SEQ ID NO: 7170467 - DNA, 21 bp, Homo sapiens
gttttcatgatagagtctgta

SEQ ID NO: 7170468 - DNA, 22 bp, Homo sapiens
taaacagagaagactttgagca

SEQ ID NO: 7170469 - DNA, 22 bp, Homo sapiens
taaacatggattctgatcacag

SEQ ID NO: 7170470 - DNA, 22 bp, Homo sapiens
taaacatggattctgatcacag

SEQ ID NO: 7170471 - DNA, 22 bp, Homo sapiens
taaacatgcccagtgacaggga

SEQ ID NO: 7170472 - DNA, 22 bp, Homo sapiens
taaacatctgtagccttcagtc

SEQ ID NO: 7170473 - DNA, 22 bp, Homo sapiens
taaacatctgtcatgtgtttat

SEQ ID NO: 7170474 - DNA, 22 bp, Homo sapiens
taaacatgttgacatcttacct

SEQ ID NO: 7170475 - DNA, 22 bp, Homo sapiens
taaacatgttgacatcttacct

SEQ ID NO: 7170476 - DNA, 22 bp, Homo sapiens
taaacagctactgtgtcaaagg

SEQ ID NO: 7170477 - DNA, 22 bp, Homo sapiens
taaacaggagttgaagcagtaa

SEQ ID NO: 7170478 - DNA, 22 bp, Homo sapiens
taaacaggagttgaagcagtaa

SEQ ID NO: 7170479 - DNA, 20 bp, Homo sapiens
taaacagtatttactaggag

SEQ ID NO: 7170480 - DNA, 22 bp, Homo sapiens
taaacagttaacatgccagaat

SEQ ID NO: 7170481 - DNA, 21 bp, Homo sapiens
taaacataaccttgtatggct

SEQ ID NO: 7170482 - DNA, 22 bp, Homo sapiens
taaacatcaccttctgcagttg

SEQ ID NO: 7170483 - DNA, 22 bp, Homo sapiens
taaacatctgaatcctgcttcc

SEQ ID NO: 7170484 - DNA, 22 bp, Homo sapiens
gtttctatggtttatattactg

SEQ ID NO: 7170485 - DNA, 22 bp, Homo sapiens
gtttctcaaattatttcagctt

SEQ ID NO: 7170486 - DNA, 22 bp, Homo sapiens
gtttctcaaattatttcagctt

SEQ ID NO: 7170487 - DNA, 22 bp, Homo sapiens
gtttctcaacatgctttctaac

SEQ ID NO: 7170488 - DNA, 22 bp, Homo sapiens
gtttctcaacatgctttctaac

SEQ ID NO: 7170489 - DNA, 22 bp, Homo sapiens
gtttctcaacatgctttctaac

SEQ ID NO: 7170490 - DNA, 22 bp, Homo sapiens
gtttctcaagcttgaatgcaca

SEQ ID NO: 7170491 - DNA, 22 bp, Homo sapiens
gtttctcacaaggctgcaatcc

SEQ ID NO: 7170492 - DNA, 22 bp, Homo sapiens
gtttctcacaaggctgcaatcc

SEQ ID NO: 7170493 - DNA, 22 bp, Homo sapiens
gtttctcacttaccaacacatg

SEQ ID NO: 7170494 - DNA, 22 bp, Homo sapiens
gtttctcacttccagtagccaa

SEQ ID NO: 7170495 - DNA, 22 bp, Homo sapiens
gtttctcagaggcccccaaaca

SEQ ID NO: 7170496 - DNA, 22 bp, Homo sapiens
gtttctcagcaactatatgact

SEQ ID NO: 7170497 - DNA, 22 bp, Homo sapiens
gtttctcagcatgtcagtacaa

SEQ ID NO: 7170498 - DNA, 22 bp, Homo sapiens
gtttctcagtttggtctgcaga

SEQ ID NO: 7170499 - DNA, 22 bp, Homo sapiens
gtttctacatgcctctttcacc

SEQ ID NO: 7170500 - DNA, 22 bp, Homo sapiens
gtttctatggtttatattactg

SEQ ID NO: 7170501 - DNA, 22 bp, Homo sapiens
gtttcgtcaggcttattctatc

SEQ ID NO: 7170502 - DNA, 22 bp, Homo sapiens
gtttctaaatgttctgagtttt

SEQ ID NO: 7170503 - DNA, 22 bp, Homo sapiens
gtttatatgaacttcataccca

SEQ ID NO: 7170504 - DNA, 22 bp, Homo sapiens
gtttatatgaacttcataccca

SEQ ID NO: 7170505 - DNA, 22 bp, Homo sapiens
gtttatatgaacttcataccca

SEQ ID NO: 7170506 - DNA, 22 bp, Homo sapiens
gtttatatgtgtgccactctta

SEQ ID NO: 7170507 - DNA, 22 bp, Homo sapiens
gtttatatgtgtgccactctta

SEQ ID NO: 7170508 - DNA, 22 bp, Homo sapiens
gtttatatgtgtgccactctta

SEQ ID NO: 7170509 - DNA, 22 bp, Homo sapiens
gtttataaggcccaatatttct

SEQ ID NO: 7170510 - DNA, 22 bp, Homo sapiens
gtttataatccaactctgctcc

SEQ ID NO: 7170511 - DNA, 22 bp, Homo sapiens
gtttcctaggcttatacagctg

SEQ ID NO: 7170512 - DNA, 22 bp, Homo sapiens
gtttcctaccagtggttccaga

SEQ ID NO: 7170513 - DNA, 22 bp, Homo sapiens
gtttcctagatcagtgttctta

SEQ ID NO: 7170514 - DNA, 22 bp, Homo sapiens
gtttcctagatcagtgttctta

SEQ ID NO: 7170515 - DNA, 22 bp, Homo sapiens
gtttcctaccagtggttccaga

SEQ ID NO: 7170516 - DNA, 22 bp, Homo sapiens
gtttcctacactgtagtattat

SEQ ID NO: 7170517 - DNA, 22 bp, Homo sapiens
gtttcctacactgtagtattat

SEQ ID NO: 7170518 - DNA, 22 bp, Homo sapiens
gtttcccatatctagggagagg

SEQ ID NO: 7170519 - DNA, 22 bp, Homo sapiens
gtttccttttggaattagagct

SEQ ID NO: 7170520 - DNA, 22 bp, Homo sapiens
gtttctcctctgtgtcttgttt

SEQ ID NO: 7170521 - DNA, 21 bp, Homo sapiens
gtttctcatgtggccttatgg

SEQ ID NO: 7170522 - DNA, 22 bp, Homo sapiens
gtttctcatcagtttctgatat

SEQ ID NO: 7170523 - DNA, 22 bp, Homo sapiens
gtttctcatcagtttctgatat

SEQ ID NO: 7170524 - DNA, 22 bp, Homo sapiens
gtttctctgtacctctgtccca

SEQ ID NO: 7170525 - DNA, 22 bp, Homo sapiens
gtttctctgtctgttacattgg

SEQ ID NO: 7170526 - DNA, 22 bp, Homo sapiens
gtttctgagcacttttattgca

SEQ ID NO: 7170527 - DNA, 22 bp, Homo sapiens
gtttctcttaacacataaagta

SEQ ID NO: 7170528 - DNA, 22 bp, Homo sapiens
gtttctctttgaagcctggctg

SEQ ID NO: 7170529 - DNA, 22 bp, Homo sapiens
gtttctgattctagaggcaggc

SEQ ID NO: 7170530 - DNA, 22 bp, Homo sapiens
gtttctgtgttagatgagtctt

SEQ ID NO: 7170531 - DNA, 23 bp, Homo sapiens
gttttacaggtgagaaaatggag

SEQ ID NO: 7170532 - DNA, 23 bp, Homo sapiens
gttttacaggtgagaaaatggag

SEQ ID NO: 7170533 - DNA, 23 bp, Homo sapiens
gttttacaggtgagaaaatggag

SEQ ID NO: 7170534 - DNA, 23 bp, Homo sapiens
gttttacaggtgagaaaatggag

SEQ ID NO: 7170535 - DNA, 22 bp, Homo sapiens
gttttagataaagctgtccttg

SEQ ID NO: 7170536 - DNA, 22 bp, Homo sapiens
gttttacacacctatgaaagac

SEQ ID NO: 7170537 - DNA, 22 bp, Homo sapiens
gttttacacacctatgaaagac

SEQ ID NO: 7170538 - DNA, 22 bp, Homo sapiens
gttttacaaggttaatcagcag

SEQ ID NO: 7170539 - DNA, 22 bp, Homo sapiens
gttttacaaggttaatcagcag

SEQ ID NO: 7170540 - DNA, 22 bp, Homo sapiens
gttttacacacctatgaaagac

SEQ ID NO: 7170541 - DNA, 22 bp, Homo sapiens
gttttacacacctatgaaagac

SEQ ID NO: 7170542 - DNA, 22 bp, Homo sapiens
gtttctgttgctcagataatgc

SEQ ID NO: 7170543 - DNA, 22 bp, Homo sapiens
gttttacaaggttaatcagcag

SEQ ID NO: 7170544 - DNA, 22 bp, Homo sapiens
gttttacaaggttaatcagcag

SEQ ID NO: 7170545 - DNA, 20 bp, Homo sapiens
gttcccaggaattgaagacc

SEQ ID NO: 7170546 - DNA, 22 bp, Homo sapiens
gttcccaggccctgggctctcc

SEQ ID NO: 7170547 - DNA, 22 bp, Homo sapiens
gttcccaggccctgggctctcc

SEQ ID NO: 7170548 - DNA, 18 bp, Homo sapiens
gttcccagatggtgctga

SEQ ID NO: 7170549 - DNA, 18 bp, Homo sapiens
gttcccagatggtgctga

SEQ ID NO: 7170550 - DNA, 22 bp, Homo sapiens
gttcccaccatgctgcacccat

SEQ ID NO: 7170551 - DNA, 22 bp, Homo sapiens
gttcccacgcctcctctccagc

SEQ ID NO: 7170552 - DNA, 22 bp, Homo sapiens
gttcccactagactgctactta

SEQ ID NO: 7170553 - DNA, 22 bp, Homo sapiens
gttcccacttggtgcactatga

SEQ ID NO: 7170554 - DNA, 22 bp, Homo sapiens
gttccaggtggtcacagagctc

SEQ ID NO: 7170555 - DNA, 22 bp, Homo sapiens
gttccaggaccctggcctctga

SEQ ID NO: 7170556 - DNA, 22 bp, Homo sapiens
gttccacatcacactacttgat

SEQ ID NO: 7170557 - DNA, 22 bp, Homo sapiens
gttccacaaaaggtctagttta

SEQ ID NO: 7170558 - DNA, 22 bp, Homo sapiens
gttccacaaagattgtctctct

SEQ ID NO: 7170559 - DNA, 22 bp, Homo sapiens
gttccacaaagattgtctctct

SEQ ID NO: 7170560 - DNA, 22 bp, Homo sapiens
gttccacataacacatctacaa

SEQ ID NO: 7170561 - DNA, 22 bp, Homo sapiens
gtttaattttaggttgtcaagc

SEQ ID NO: 7170562 - DNA, 22 bp, Homo sapiens
gttccttgggaacaacgctgaa

SEQ ID NO: 7170563 - DNA, 22 bp, Homo sapiens
gttccttgtatttcagacatga

SEQ ID NO: 7170564 - DNA, 22 bp, Homo sapiens
gttccttggaagaacttgaggt

SEQ ID NO: 7170565 - DNA, 22 bp, Homo sapiens
gttcctgtggggttaaccctga

SEQ ID NO: 7170566 - DNA, 22 bp, Homo sapiens
gttcctgttgatttcccaggag

SEQ ID NO: 7170567 - DNA, 21 bp, Homo sapiens
gtttagaagtagtctggctca

SEQ ID NO: 7170568 - DNA, 21 bp, Homo sapiens
gtttagaagtagtctggctca

SEQ ID NO: 7170569 - DNA, 22 bp, Homo sapiens
gtttagaatgaaacttttgagc

SEQ ID NO: 7170570 - DNA, 22 bp, Homo sapiens
gtttagaagccaagatttgggt

SEQ ID NO: 7170571 - DNA, 22 bp, Homo sapiens
gtttagaagccaagatttgggt

SEQ ID NO: 7170572 - DNA, 22 bp, Homo sapiens
gtttagaagccaagatttgggt

SEQ ID NO: 7170573 - DNA, 22 bp, Homo sapiens
gtttagaacacggaaatactga

SEQ ID NO: 7170574 - DNA, 22 bp, Homo sapiens
gtttagaaaatagtgaagcaag

SEQ ID NO: 7170575 - DNA, 22 bp, Homo sapiens
gtttagaaaatagtgaagcaag

SEQ ID NO: 7170576 - DNA, 22 bp, Homo sapiens
gtttagaaaatagtgaagcaag

SEQ ID NO: 7170577 - DNA, 22 bp, Homo sapiens
gtttacaaatattttaaatggt

SEQ ID NO: 7170578 - DNA, 22 bp, Homo sapiens
gtttagatgaaagtttgtttca

SEQ ID NO: 7170579 - DNA, 22 bp, Homo sapiens
gtttagatgaaagtttgtttca

SEQ ID NO: 7170580 - DNA, 22 bp, Homo sapiens
gtttagaattctaactttaagg

SEQ ID NO: 7170581 - DNA, 22 bp, Homo sapiens
gtttagaattctaactttaagg

SEQ ID NO: 7170582 - DNA, 22 bp, Homo sapiens
gtttagaatggcaaaattaagt

SEQ ID NO: 7170583 - DNA, 22 bp, Homo sapiens
gtttagaattctaactttaagg

SEQ ID NO: 7170584 - DNA, 22 bp, Homo sapiens
gtttagaatgaaacttttgagc

SEQ ID NO: 7170585 - DNA, 22 bp, Homo sapiens
gtttagaatggcaaaattaagt

SEQ ID NO: 7170586 - DNA, 22 bp, Homo sapiens
gtttagcaataaaaacacatga

SEQ ID NO: 7170587 - DNA, 22 bp, Homo sapiens
gtttataaattctgcttttgtt

SEQ ID NO: 7170588 - DNA, 22 bp, Homo sapiens
gtttataaattctgcttttgtt

SEQ ID NO: 7170589 - DNA, 22 bp, Homo sapiens
gtgttaaatttctaatttgtga

SEQ ID NO: 7170590 - DNA, 22 bp, Homo sapiens
gtgttaaatgcaatcacatgca

SEQ ID NO: 7170591 - DNA, 22 bp, Homo sapiens
gtgttaaatgcaatcacatgca

SEQ ID NO: 7170592 - DNA, 22 bp, Homo sapiens
gtgttaaatgcaatcacatgca

SEQ ID NO: 7170593 - DNA, 22 bp, Homo sapiens
gtgttaaacatgttcacagcat

SEQ ID NO: 7170594 - DNA, 22 bp, Homo sapiens
gtgttaaaaatcccatgatatg

SEQ ID NO: 7170595 - DNA, 22 bp, Homo sapiens
gtgttaaaaatcccatgatatg

SEQ ID NO: 7170596 - DNA, 22 bp, Homo sapiens
gtgttaatggctatgaactgat

SEQ ID NO: 7170597 - DNA, 22 bp, Homo sapiens
gtgttaatggtagaatctgagt

SEQ ID NO: 7170598 - DNA, 22 bp, Homo sapiens
gtgtgtttcaccctgacaccaa

SEQ ID NO: 7170599 - DNA, 22 bp, Homo sapiens
gtgtgttcgtatcaacagagga

SEQ ID NO: 7170600 - DNA, 22 bp, Homo sapiens
gtgtgtgttcaataaatttaag

SEQ ID NO: 7170601 - DNA, 22 bp, Homo sapiens
gtgtgtgttcaataaatttaag

SEQ ID NO: 7170602 - DNA, 22 bp, Homo sapiens
gtgtgtgttcaataaatttaag

SEQ ID NO: 7170603 - DNA, 22 bp, Homo sapiens
gtgtgtgttcaataaatttaag

SEQ ID NO: 7170604 - DNA, 22 bp, Homo sapiens
gtgtgtgttcaataaatttaag

SEQ ID NO: 7170605 - DNA, 22 bp, Homo sapiens
gtgtgtgtgtaaaaatccagag

SEQ ID NO: 7170606 - DNA, 22 bp, Homo sapiens
gtgtgtgtgtaaaaatccagag

SEQ ID NO: 7170607 - DNA, 22 bp, Homo sapiens
gtgtgtgtgtaaaaatccagag

SEQ ID NO: 7170608 - DNA, 22 bp, Homo sapiens
gtgtgtgtgtaaaaatccagag

SEQ ID NO: 7170609 - DNA, 22 bp, Homo sapiens
gtgtgtgttcaataaatttaag

SEQ ID NO: 7170610 - DNA, 22 bp, Homo sapiens
gtgtgtgtgcctgcacacacac

SEQ ID NO: 7170611 - DNA, 22 bp, Homo sapiens
gtgtgtgtgtaaaaatccagag

SEQ ID NO: 7170612 - DNA, 22 bp, Homo sapiens
gtgtgtgtgcatctcttttatt

SEQ ID NO: 7170613 - DNA, 22 bp, Homo sapiens
gtgtgtgtgcatctcttttatt

SEQ ID NO: 7170614 - DNA, 22 bp, Homo sapiens
gtgtgtgtgcctgcacacacac

SEQ ID NO: 7170615 - DNA, 22 bp, Homo sapiens
gtgtgtgtgcatctcttttatt

SEQ ID NO: 7170616 - DNA, 22 bp, Homo sapiens
gtgtgtgtgcctgcacacacac

SEQ ID NO: 7170617 - DNA, 22 bp, Homo sapiens
gtgtgtgtgcctgcacacacac

SEQ ID NO: 7170618 - DNA, 22 bp, Homo sapiens
gtgtgtgtgcctgcacacacac

SEQ ID NO: 7170619 - DNA, 22 bp, Homo sapiens
gtgtgtgtgcatataacatata

SEQ ID NO: 7170620 - DNA, 22 bp, Homo sapiens
gtgtgtgtgcatataacatata

SEQ ID NO: 7170621 - DNA, 22 bp, Homo sapiens
gtgtgtgtgcatataacatata

SEQ ID NO: 7170622 - DNA, 22 bp, Homo sapiens
gtgtgtgtgcatataacatata

SEQ ID NO: 7170623 - DNA, 22 bp, Homo sapiens
gtgtgtgtgcatctcttttatt

SEQ ID NO: 7170624 - DNA, 22 bp, Homo sapiens
gtgtgtgtgcatctcttttatt

SEQ ID NO: 7170625 - DNA, 22 bp, Homo sapiens
gtgtgtgtgcatctcttttatt

SEQ ID NO: 7170626 - DNA, 22 bp, Homo sapiens
gtgtgtgtctccgcggccgtag

SEQ ID NO: 7170627 - DNA, 22 bp, Homo sapiens
gtgtgtgtgcatataacatata

SEQ ID NO: 7170628 - DNA, 22 bp, Homo sapiens
gtgtgtgtctccgcggccgtag

SEQ ID NO: 7170629 - DNA, 22 bp, Homo sapiens
gtgtgtgtctccgcggccgtag

SEQ ID NO: 7170630 - DNA, 22 bp, Homo sapiens
gtgtgtgtctccgcggccgtag

SEQ ID NO: 7170631 - DNA, 22 bp, Homo sapiens
gtgtgtgtctccgcggccgtag

SEQ ID NO: 7170632 - DNA, 22 bp, Homo sapiens
gtgtgtgtctccgcggccgtag

SEQ ID NO: 7170633 - DNA, 22 bp, Homo sapiens
gtgtgtgtatctgcctatcaca

SEQ ID NO: 7170634 - DNA, 22 bp, Homo sapiens
gtgtgtgtatctgcctatcaca

SEQ ID NO: 7170635 - DNA, 22 bp, Homo sapiens
gtgtgtccttgggcctctgcag

SEQ ID NO: 7170636 - DNA, 21 bp, Homo sapiens
gtgtgtctaatgtagtggaaa

SEQ ID NO: 7170637 - DNA, 21 bp, Homo sapiens
gtgtgtctaatgtagtggaaa

SEQ ID NO: 7170638 - DNA, 22 bp, Homo sapiens
gtgcttttccttatttggtgct

SEQ ID NO: 7170639 - DNA, 22 bp, Homo sapiens
gtgcttttctgcagggtcctat

SEQ ID NO: 7170640 - DNA, 22 bp, Homo sapiens
gtgtgtcctcataagatggagg

SEQ ID NO: 7170641 - DNA, 22 bp, Homo sapiens
gtgtgtcctcttaactattatg

SEQ ID NO: 7170642 - DNA, 22 bp, Homo sapiens
gtgtgtcctgttttaaaatagt

SEQ ID NO: 7170643 - DNA, 22 bp, Homo sapiens
gtgcttttaattctggtgagta

SEQ ID NO: 7170644 - DNA, 21 bp, Homo sapiens
gtgcttttccttaatgttctt

SEQ ID NO: 7170645 - DNA, 22 bp, Homo sapiens
gtgcttttaacttttgaaagga

SEQ ID NO: 7170646 - DNA, 22 bp, Homo sapiens
gtgcttttaattctggtgagta

SEQ ID NO: 7170647 - DNA, 22 bp, Homo sapiens
gtgctttgttaagtctgaaatt

SEQ ID NO: 7170648 - DNA, 22 bp, Homo sapiens
gtgctttctgctgcattcctct

SEQ ID NO: 7170649 - DNA, 22 bp, Homo sapiens
gtgctttgtcttcaggatcata

SEQ ID NO: 7170650 - DNA, 22 bp, Homo sapiens
gtgctttctgcatggttcctac

SEQ ID NO: 7170651 - DNA, 22 bp, Homo sapiens
gtgctttctgcatggttcctac

SEQ ID NO: 7170652 - DNA, 23 bp, Homo sapiens
gtgctttatgatctgctgtccct

SEQ ID NO: 7170653 - DNA, 22 bp, Homo sapiens
gtgctttagttcttgcaactgg

SEQ ID NO: 7170654 - DNA, 22 bp, Homo sapiens
gtgctttagttcttgcaactgg

SEQ ID NO: 7170655 - DNA, 22 bp, Homo sapiens
gtgctttaaaaataggagatga

SEQ ID NO: 7170656 - DNA, 22 bp, Homo sapiens
gtgctttaaaccactgtgctgt

SEQ ID NO: 7170657 - DNA, 22 bp, Homo sapiens
gtgctttaataagatttcactt

SEQ ID NO: 7170658 - DNA, 22 bp, Homo sapiens
gtgctttagctgagttggtcaa

SEQ ID NO: 7170659 - DNA, 22 bp, Homo sapiens
gttaggtagaagtttactttga

SEQ ID NO: 7170660 - DNA, 22 bp, Homo sapiens
gttaggtagaagtttactttga

SEQ ID NO: 7170661 - DNA, 22 bp, Homo sapiens
gttaggcaaataactgtggagc

SEQ ID NO: 7170662 - DNA, 22 bp, Homo sapiens
gttaggcaatacctcttacacc

SEQ ID NO: 7170663 - DNA, 22 bp, Homo sapiens
gttaggcagcccaagatgtcag

SEQ ID NO: 7170664 - DNA, 19 bp, Homo sapiens
gttaggcagggtggggagt

SEQ ID NO: 7170665 - DNA, 22 bp, Homo sapiens
gttaggcagttttcttcattct

SEQ ID NO: 7170666 - DNA, 22 bp, Homo sapiens
gttaggcagtgtggtatagcag

SEQ ID NO: 7170667 - DNA, 22 bp, Homo sapiens
gttaggcatgagtgtgtattaa

SEQ ID NO: 7170668 - DNA, 22 bp, Homo sapiens
gttaggcatttgccttaatttt

SEQ ID NO: 7170669 - DNA, 22 bp, Homo sapiens
gttaggaaggtatagttgtatt

SEQ ID NO: 7170670 - DNA, 22 bp, Homo sapiens
gttaggaagtggtaaggttctg

SEQ ID NO: 7170671 - DNA, 22 bp, Homo sapiens
gttaggaatttgttactgtgta

SEQ ID NO: 7170672 - DNA, 20 bp, Homo sapiens
gttaggaggttggacatgga

SEQ ID NO: 7170673 - DNA, 20 bp, Homo sapiens
gttaggaggttggacatgga

SEQ ID NO: 7170674 - DNA, 20 bp, Homo sapiens
gttaggaggttggacatgga

SEQ ID NO: 7170675 - DNA, 22 bp, Homo sapiens
gttagagggctgccttttgttt

SEQ ID NO: 7170676 - DNA, 22 bp, Homo sapiens
gttagaggttcagtcgctataa

SEQ ID NO: 7170677 - DNA, 22 bp, Homo sapiens
gttagcaaaatgtttttgaggc

SEQ ID NO: 7170678 - DNA, 22 bp, Homo sapiens
gttagcaacaagtctcaatgac

SEQ ID NO: 7170679 - DNA, 22 bp, Homo sapiens
gttagcaatgcccaggaatgca

SEQ ID NO: 7170680 - DNA, 22 bp, Homo sapiens
gttagcaattgcttaagactag

SEQ ID NO: 7170681 - DNA, 22 bp, Homo sapiens
gttagcatgacttagaatcagg

SEQ ID NO: 7170682 - DNA, 22 bp, Homo sapiens
gttagcatgattcctgctcatt

SEQ ID NO: 7170683 - DNA, 22 bp, Homo sapiens
gttagcatttgtttaatatcag

SEQ ID NO: 7170684 - DNA, 20 bp, Homo sapiens
gttagcctcctaaggatttc

SEQ ID NO: 7170685 - DNA, 22 bp, Homo sapiens
gttaggaacactggagcctaaa

SEQ ID NO: 7170686 - DNA, 22 bp, Homo sapiens
gttaggaacattaatgtgattt

SEQ ID NO: 7170687 - DNA, 22 bp, Homo sapiens
gttaggaagacaggagtgggtt

SEQ ID NO: 7170688 - DNA, 22 bp, Homo sapiens
gttagaccatagaaagagcatc

SEQ ID NO: 7170689 - DNA, 22 bp, Homo sapiens
gttagaaatgcagaaacttgac

SEQ ID NO: 7170690 - DNA, 22 bp, Homo sapiens
gttagaaacacattcttattga

SEQ ID NO: 7170691 - DNA, 22 bp, Homo sapiens
gttagaaacacattcttattga

SEQ ID NO: 7170692 - DNA, 22 bp, Homo sapiens
gttacaaaggtcataaaagtgt

SEQ ID NO: 7170693 - DNA, 22 bp, Homo sapiens
gttacaaaggtcataaaagtgt

SEQ ID NO: 7170694 - DNA, 22 bp, Homo sapiens
gtgttattagagcattaatttt

SEQ ID NO: 7170695 - DNA, 22 bp, Homo sapiens
gttacaaaggtcataaaagtgt

SEQ ID NO: 7170696 - DNA, 22 bp, Homo sapiens
gttacaaatgccaaagctgaga

SEQ ID NO: 7170697 - DNA, 22 bp, Homo sapiens
gttacaaatgccaaagctgaga

SEQ ID NO: 7170698 - DNA, 22 bp, Homo sapiens
gttataaatacctaataggatt

SEQ ID NO: 7170699 - DNA, 22 bp, Homo sapiens
gttataaatacctaataggatt

SEQ ID NO: 7170700 - DNA, 22 bp, Homo sapiens
gttcattttactgtaaatagca

SEQ ID NO: 7170701 - DNA, 22 bp, Homo sapiens
gttcattttactgtaaatagca

SEQ ID NO: 7170702 - DNA, 22 bp, Homo sapiens
gttataaaggtgataatggtca

SEQ ID NO: 7170703 - DNA, 22 bp, Homo sapiens
gttataaaggtgataatggtca

SEQ ID NO: 7170704 - DNA, 22 bp, Homo sapiens
gttataaatacctaataggatt

SEQ ID NO: 7170705 - DNA, 22 bp, Homo sapiens
gttataaaatgcacagttgttt

SEQ ID NO: 7170706 - DNA, 22 bp, Homo sapiens
gttataaaatgcacagttgttt

SEQ ID NO: 7170707 - DNA, 22 bp, Homo sapiens
gttataaaatgcacagttgttt

SEQ ID NO: 7170708 - DNA, 22 bp, Homo sapiens
gttagtatgctcttatgcccat

SEQ ID NO: 7170709 - DNA, 22 bp, Homo sapiens
gttagtgtatattgccttcaaa

SEQ ID NO: 7170710 - DNA, 22 bp, Homo sapiens
gttagtgtgactgaggaatgca

SEQ ID NO: 7170711 - DNA, 22 bp, Homo sapiens
gttagtgtgactgaggaatgca

SEQ ID NO: 7170712 - DNA, 22 bp, Homo sapiens
gttcatttttagaatgctagta

SEQ ID NO: 7170713 - DNA, 22 bp, Homo sapiens
gttcatttttccctaatgagta

SEQ ID NO: 7170714 - DNA, 22 bp, Homo sapiens
gttcatttttccctaatgagta

SEQ ID NO: 7170715 - DNA, 22 bp, Homo sapiens
gttcatttttccctaatgagta

SEQ ID NO: 7170716 - DNA, 23 bp, Homo sapiens
gttcattttattgtctgattgct

SEQ ID NO: 7170717 - DNA, 23 bp, Homo sapiens
gttcattttattgtctgattgct

SEQ ID NO: 7170718 - DNA, 22 bp, Homo sapiens
gttccaaagtctctgagctgag

SEQ ID NO: 7170719 - DNA, 20 bp, Homo sapiens
tattcaactttaaaaactta

SEQ ID NO: 7170720 - DNA, 22 bp, Homo sapiens
tattcaaagtgcgaggtcaggg

SEQ ID NO: 7170721 - DNA, 22 bp, Homo sapiens
tattcaagattgaactggcaga

SEQ ID NO: 7170722 - DNA, 22 bp, Homo sapiens
tatgtttatactttgatgtact

SEQ ID NO: 7170723 - DNA, 22 bp, Homo sapiens
tattcaaagtaccttcattgcc

SEQ ID NO: 7170724 - DNA, 22 bp, Homo sapiens
tatgtttatactttgatgtact

SEQ ID NO: 7170725 - DNA, 22 bp, Homo sapiens
tatgtttatactttgatgtact

SEQ ID NO: 7170726 - DNA, 22 bp, Homo sapiens
tattcacaggcacgaaatattg

SEQ ID NO: 7170727 - DNA, 22 bp, Homo sapiens
tattcacaggcacgaaatattg

SEQ ID NO: 7170728 - DNA, 22 bp, Homo sapiens
tattcacaggcacgaaatattg

SEQ ID NO: 7170729 - DNA, 22 bp, Homo sapiens
tattcacaggcacgaaatattg

SEQ ID NO: 7170730 - DNA, 22 bp, Homo sapiens
tattcacaggcacgaaatattg

SEQ ID NO: 7170731 - DNA, 22 bp, Homo sapiens
tattcacaggcacgaaatattg

SEQ ID NO: 7170732 - DNA, 22 bp, Homo sapiens
tattcacagctgccgcactcag

SEQ ID NO: 7170733 - DNA, 22 bp, Homo sapiens
tattcacaaaatgaggtcctca

SEQ ID NO: 7170734 - DNA, 22 bp, Homo sapiens
tattcacaaaatgaggtcctca

SEQ ID NO: 7170735 - DNA, 22 bp, Homo sapiens
tattcacatgtacatatgctca

SEQ ID NO: 7170736 - DNA, 22 bp, Homo sapiens
tattcacatgtacatatgctca

SEQ ID NO: 7170737 - DNA, 22 bp, Homo sapiens
tattcacatgaaaacaaatttt

SEQ ID NO: 7170738 - DNA, 22 bp, Homo sapiens
tattcacatgaaaacaaatttt

SEQ ID NO: 7170739 - DNA, 22 bp, Homo sapiens
tattcacatgtacatatgctca

SEQ ID NO: 7170740 - DNA, 22 bp, Homo sapiens
tattcacatgtacatatgctca

SEQ ID NO: 7170741 - DNA, 22 bp, Homo sapiens
tattcacatgtacatatgctca

SEQ ID NO: 7170742 - DNA, 22 bp, Homo sapiens
tattcacattaataagtcttca

SEQ ID NO: 7170743 - DNA, 22 bp, Homo sapiens
tattcacattaataagtcttca

SEQ ID NO: 7170744 - DNA, 22 bp, Homo sapiens
tattcacagttgatttacagtt

SEQ ID NO: 7170745 - DNA, 22 bp, Homo sapiens
tattcacaggttctggggatca

SEQ ID NO: 7170746 - DNA, 22 bp, Homo sapiens
tattcacagttgatttacagtt

SEQ ID NO: 7170747 - DNA, 22 bp, Homo sapiens
tattcacagttgatttacagtt

SEQ ID NO: 7170748 - DNA, 22 bp, Homo sapiens
tattcacaggctggagtgatgt

SEQ ID NO: 7170749 - DNA, 22 bp, Homo sapiens
tattcacaggttccggagatta

SEQ ID NO: 7170750 - DNA, 17 bp, Homo sapiens
tattcagaggagtattt

SEQ ID NO: 7170751 - DNA, 22 bp, Homo sapiens
tattcagaataaagactacatt

SEQ ID NO: 7170752 - DNA, 22 bp, Homo sapiens
tattcagaaaactgagcgatga

SEQ ID NO: 7170753 - DNA, 22 bp, Homo sapiens
tattcagaaaactgagcgatga

SEQ ID NO: 7170754 - DNA, 22 bp, Homo sapiens
tattcagaaaataaattggatt

SEQ ID NO: 7170755 - DNA, 22 bp, Homo sapiens
tattcacattctcaggcctggt

SEQ ID NO: 7170756 - DNA, 22 bp, Homo sapiens
tattcaccagatcccatatctt

SEQ ID NO: 7170757 - DNA, 22 bp, Homo sapiens
tattcaccctgcctcctagttg

SEQ ID NO: 7170758 - DNA, 22 bp, Homo sapiens
tattcacctcttgttcttcata

SEQ ID NO: 7170759 - DNA, 22 bp, Homo sapiens
tattcagaggtgaagtagggag

SEQ ID NO: 7170760 - DNA, 22 bp, Homo sapiens
tattcagagggttgaattttta

SEQ ID NO: 7170761 - DNA, 22 bp, Homo sapiens
tattcagagggttgaattttta

SEQ ID NO: 7170762 - DNA, 22 bp, Homo sapiens
tattcagagtattccatgaggt

SEQ ID NO: 7170763 - DNA, 22 bp, Homo sapiens
tattcagagtgtagcaaataga

SEQ ID NO: 7170764 - DNA, 21 bp, Homo sapiens
tattcagtccattgatgttta

SEQ ID NO: 7170765 - DNA, 22 bp, Homo sapiens
tattcagtgcgggaactcagcc

SEQ ID NO: 7170766 - DNA, 22 bp, Homo sapiens
tattcagtggaaaatgtgttga

SEQ ID NO: 7170767 - DNA, 22 bp, Homo sapiens
tattcatagtaaacaaaagtgg

SEQ ID NO: 7170768 - DNA, 22 bp, Homo sapiens
tattcatattgtaaaagaagtg

SEQ ID NO: 7170769 - DNA, 22 bp, Homo sapiens
tattgatgcttggattgggcca

SEQ ID NO: 7170770 - DNA, 22 bp, Homo sapiens
tattgatgcagagccaaattgc

SEQ ID NO: 7170771 - DNA, 22 bp, Homo sapiens
tattgatgtatttctaggtgct

SEQ ID NO: 7170772 - DNA, 22 bp, Homo sapiens
tattgatctggatatttagaca

SEQ ID NO: 7170773 - DNA, 22 bp, Homo sapiens
tattgatctggatatttagaca

SEQ ID NO: 7170774 - DNA, 22 bp, Homo sapiens
tattgatgaaagggattttgga

SEQ ID NO: 7170775 - DNA, 20 bp, Homo sapiens
tattgagtacctactgtata

SEQ ID NO: 7170776 - DNA, 22 bp, Homo sapiens
tattgaggaaacagagcaggca

SEQ ID NO: 7170777 - DNA, 22 bp, Homo sapiens
tattgaggattgaggaaagcac

SEQ ID NO: 7170778 - DNA, 22 bp, Homo sapiens
tattgaggtgcttagctggggg

SEQ ID NO: 7170779 - DNA, 22 bp, Homo sapiens
tattgagtaattattacttcaa

SEQ ID NO: 7170780 - DNA, 20 bp, Homo sapiens
tattgagtacctactgtata

SEQ ID NO: 7170781 - DNA, 22 bp, Homo sapiens
tattgagacttccagtatatga

SEQ ID NO: 7170782 - DNA, 22 bp, Homo sapiens
tattgagacttccagtatatga

SEQ ID NO: 7170783 - DNA, 22 bp, Homo sapiens
tattgagacttccagtatatga

SEQ ID NO: 7170784 - DNA, 22 bp, Homo sapiens
tattgagaaccctcaggaggca

SEQ ID NO: 7170785 - DNA, 22 bp, Homo sapiens
tattgagaaccctcaggaggca

SEQ ID NO: 7170786 - DNA, 22 bp, Homo sapiens
tattgaccagactgacacacat

SEQ ID NO: 7170787 - DNA, 22 bp, Homo sapiens
tattcatattgtaaaagaagtg

SEQ ID NO: 7170788 - DNA, 22 bp, Homo sapiens
tattcatcttcatagtcacagt

SEQ ID NO: 7170789 - DNA, 22 bp, Homo sapiens
tatgtttacgctggtagaatta

SEQ ID NO: 7170790 - DNA, 22 bp, Homo sapiens
tatgtttagtatccattttcag

SEQ ID NO: 7170791 - DNA, 22 bp, Homo sapiens
tatgtttacgctggtagaatta

SEQ ID NO: 7170792 - DNA, 22 bp, Homo sapiens
tatgtttacgctggtagaatta

SEQ ID NO: 7170793 - DNA, 22 bp, Homo sapiens
tatgtttacgctggtagaatta

SEQ ID NO: 7170794 - DNA, 22 bp, Homo sapiens
tatgtttacgctggtagaatta

SEQ ID NO: 7170795 - DNA, 22 bp, Homo sapiens
tatgtttaaatgtatgtgtatg

SEQ ID NO: 7170796 - DNA, 22 bp, Homo sapiens
tatgtttaaatgtatgtgtatg

SEQ ID NO: 7170797 - DNA, 22 bp, Homo sapiens
tatgtttaaatgtatgtgtatg

SEQ ID NO: 7170798 - DNA, 22 bp, Homo sapiens
tatgtttaaatgtatgtgtatg

SEQ ID NO: 7170799 - DNA, 22 bp, Homo sapiens
tatgttgatcataggtaaaaga

SEQ ID NO: 7170800 - DNA, 22 bp, Homo sapiens
tatgttgagtgaaagaagctag

SEQ ID NO: 7170801 - DNA, 22 bp, Homo sapiens
tatgttgcaccaacctaataat

SEQ ID NO: 7170802 - DNA, 22 bp, Homo sapiens
tatgttgcaccaacctaataat

SEQ ID NO: 7170803 - DNA, 22 bp, Homo sapiens
tatgttcttggactaagttgtt

SEQ ID NO: 7170804 - DNA, 22 bp, Homo sapiens
tatgttctgtctgtacagattt

SEQ ID NO: 7170805 - DNA, 22 bp, Homo sapiens
tatgttctctgctctaggatgt

SEQ ID NO: 7170806 - DNA, 22 bp, Homo sapiens
tatgttctctgctctaggatgt

SEQ ID NO: 7170807 - DNA, 22 bp, Homo sapiens
tatgttctgactctacatggga

SEQ ID NO: 7170808 - DNA, 22 bp, Homo sapiens
tatgttctgactctacatggga

SEQ ID NO: 7170809 - DNA, 22 bp, Homo sapiens
tatgttcatgcttatgcagaat

SEQ ID NO: 7170810 - DNA, 22 bp, Homo sapiens
tatgttcatctggtgcatcagt

SEQ ID NO: 7170811 - DNA, 22 bp, Homo sapiens
tatgttcatgtcaaacaaatgc

SEQ ID NO: 7170812 - DNA, 22 bp, Homo sapiens
tatgttctagacttttgctgtg

SEQ ID NO: 7170813 - DNA, 22 bp, Homo sapiens
tatgttctaggaatggttgatg

SEQ ID NO: 7170814 - DNA, 22 bp, Homo sapiens
tatgttattttcatacaacaga

SEQ ID NO: 7170815 - DNA, 22 bp, Homo sapiens
tatgttattttcatacaacaga

SEQ ID NO: 7170816 - DNA, 22 bp, Homo sapiens
tatgttattttcatacaacaga

SEQ ID NO: 7170817 - DNA, 22 bp, Homo sapiens
tatgttcatagaaatcatgacc

SEQ ID NO: 7170818 - DNA, 22 bp, Homo sapiens
tatgttcatagaaatcatgacc

SEQ ID NO: 7170819 - DNA, 22 bp, Homo sapiens
tatgttcatctggtgcatcagt

SEQ ID NO: 7170820 - DNA, 22 bp, Homo sapiens
tatgttattttcatacaacaga

SEQ ID NO: 7170821 - DNA, 19 bp, Homo sapiens
tatgttatgttgtttactc

SEQ ID NO: 7170822 - DNA, 23 bp, Homo sapiens
tatgttaggtttgcaagccagat

SEQ ID NO: 7170823 - DNA, 22 bp, Homo sapiens
tatgttatattttgtcaattgt

SEQ ID NO: 7170824 - DNA, 19 bp, Homo sapiens
tatgttatgttgtttactc

SEQ ID NO: 7170825 - DNA, 19 bp, Homo sapiens
tatgttatgttgtttactc

SEQ ID NO: 7170826 - DNA, 22 bp, Homo sapiens
tatgtgtttgacaccctgcaag

SEQ ID NO: 7170827 - DNA, 22 bp, Homo sapiens
tatgtgtttgacaccctgcaag

SEQ ID NO: 7170828 - DNA, 22 bp, Homo sapiens
tatgttaaatgtttgatgttta

SEQ ID NO: 7170829 - DNA, 22 bp, Homo sapiens
tatgttaaatgtttgatgttta

SEQ ID NO: 7170830 - DNA, 22 bp, Homo sapiens
tatgttaacatgttaggaactg

SEQ ID NO: 7170831 - DNA, 22 bp, Homo sapiens
tatgttaagtgggataatcaaa

SEQ ID NO: 7170832 - DNA, 22 bp, Homo sapiens
tatgttaagtgggataatcaaa

SEQ ID NO: 7170833 - DNA, 22 bp, Homo sapiens
tatgttaagtgggataatcaaa

SEQ ID NO: 7170834 - DNA, 22 bp, Homo sapiens
tatgttaagtgggataatcaaa

SEQ ID NO: 7170835 - DNA, 17 bp, Homo sapiens
tatgtgtgtttgcagca

SEQ ID NO: 7170836 - DNA, 17 bp, Homo sapiens
tatgtgtgtttgcagca

SEQ ID NO: 7170837 - DNA, 17 bp, Homo sapiens
tatgtgtgtttgcagca

SEQ ID NO: 7170838 - DNA, 22 bp, Homo sapiens
tatgtgttatttggtatacatt

SEQ ID NO: 7170839 - DNA, 22 bp, Homo sapiens
tatgtgttgaatttgaacgtta

SEQ ID NO: 7170840 - DNA, 22 bp, Homo sapiens
tatgtgtttgacaccctgcaag

SEQ ID NO: 7170841 - DNA, 22 bp, Homo sapiens
tatgtgtttgacaccctgcaag

SEQ ID NO: 7170842 - DNA, 22 bp, Homo sapiens
tatgctgcaatatcattttgct

SEQ ID NO: 7170843 - DNA, 22 bp, Homo sapiens
tatgctgtgctagatacaatat

SEQ ID NO: 7170844 - DNA, 22 bp, Homo sapiens
tatgctttaacattaaacaaca

SEQ ID NO: 7170845 - DNA, 22 bp, Homo sapiens
tatgctttaacattaaacaaca

SEQ ID NO: 7170846 - DNA, 22 bp, Homo sapiens
tatgtgtgtatgacagacagag

SEQ ID NO: 7170847 - DNA, 17 bp, Homo sapiens
tatgtgtgtgtttatac

SEQ ID NO: 7170848 - DNA, 17 bp, Homo sapiens
tatgtgtgtgtttatac

SEQ ID NO: 7170849 - DNA, 17 bp, Homo sapiens
tatgtgtgtgtttatac

SEQ ID NO: 7170850 - DNA, 22 bp, Homo sapiens
tatgcctgataactgtgtctct

SEQ ID NO: 7170851 - DNA, 22 bp, Homo sapiens
tatgcctacctccaaaatatat

SEQ ID NO: 7170852 - DNA, 22 bp, Homo sapiens
tatgccgcagccggatttcccc

SEQ ID NO: 7170853 - DNA, 21 bp, Homo sapiens
tatgcctgatttctaatgatg

SEQ ID NO: 7170854 - DNA, 22 bp, Homo sapiens
tatgcctggaacctttctcttt

SEQ ID NO: 7170855 - DNA, 22 bp, Homo sapiens
tatgcctggggtgctcaggcca

SEQ ID NO: 7170856 - DNA, 22 bp, Homo sapiens
tatgccactgctctccatccta

SEQ ID NO: 7170857 - DNA, 22 bp, Homo sapiens
tatgccctgaattacccacaag

SEQ ID NO: 7170858 - DNA, 22 bp, Homo sapiens
tatgcgtgcctctgtctgtctg

SEQ ID NO: 7170859 - DNA, 22 bp, Homo sapiens
tatgcctgtctcaccattgtat

SEQ ID NO: 7170860 - DNA, 22 bp, Homo sapiens
tatgctaaatatgttcacattg

SEQ ID NO: 7170861 - DNA, 22 bp, Homo sapiens
tatgctaagataaacagagtta

SEQ ID NO: 7170862 - DNA, 22 bp, Homo sapiens
tatgctacatcctgggggatgt

SEQ ID NO: 7170863 - DNA, 22 bp, Homo sapiens
tatgctactagaaataaaatgg

SEQ ID NO: 7170864 - DNA, 22 bp, Homo sapiens
tatgctactagaaataaaatgg

SEQ ID NO: 7170865 - DNA, 22 bp, Homo sapiens
tatgctagatggaaaaatattg

SEQ ID NO: 7170866 - DNA, 22 bp, Homo sapiens
tatgctagatggaaaaatattg

SEQ ID NO: 7170867 - DNA, 22 bp, Homo sapiens
tatgctattttaatgaagatgt

SEQ ID NO: 7170868 - DNA, 22 bp, Homo sapiens
tattttcattctgtgtgactgt

SEQ ID NO: 7170869 - DNA, 22 bp, Homo sapiens
tattttcattctgtgtgactgt

SEQ ID NO: 7170870 - DNA, 22 bp, Homo sapiens
tattttcatcttgtccttggat

SEQ ID NO: 7170871 - DNA, 22 bp, Homo sapiens
tattttcattctgtgtgactgt

SEQ ID NO: 7170872 - DNA, 22 bp, Homo sapiens
tattttcattctgtgtgactgt

SEQ ID NO: 7170873 - DNA, 22 bp, Homo sapiens
tattttcatcttgtccttggat

SEQ ID NO: 7170874 - DNA, 22 bp, Homo sapiens
tattttcaccttctctggatat

SEQ ID NO: 7170875 - DNA, 22 bp, Homo sapiens
tattttcaccttctctggatat

SEQ ID NO: 7170876 - DNA, 22 bp, Homo sapiens
tattttcaccttctctggatat

SEQ ID NO: 7170877 - DNA, 22 bp, Homo sapiens
tattttcaccttctctggatat

SEQ ID NO: 7170878 - DNA, 22 bp, Homo sapiens
tatttgttgcgggaattgctat

SEQ ID NO: 7170879 - DNA, 22 bp, Homo sapiens
tatttgttgcgggaattgctat

SEQ ID NO: 7170880 - DNA, 22 bp, Homo sapiens
tattttcaccatgtatccctgt

SEQ ID NO: 7170881 - DNA, 22 bp, Homo sapiens
tatttgttgagttgttatgtct

SEQ ID NO: 7170882 - DNA, 22 bp, Homo sapiens
tatttgttgagttgttatgtct

SEQ ID NO: 7170883 - DNA, 22 bp, Homo sapiens
tatttgttgagttgttatgtct

SEQ ID NO: 7170884 - DNA, 22 bp, Homo sapiens
tatttgttgagttgttatgtct

SEQ ID NO: 7170885 - DNA, 22 bp, Homo sapiens
tatttgttccagagataaaaat

SEQ ID NO: 7170886 - DNA, 22 bp, Homo sapiens
tatttgttccagagataaaaat

SEQ ID NO: 7170887 - DNA, 22 bp, Homo sapiens
tatttgtgagactgactgaagt

SEQ ID NO: 7170888 - DNA, 22 bp, Homo sapiens
tatttgttccagagataaaaat

SEQ ID NO: 7170889 - DNA, 22 bp, Homo sapiens
tatttgtatttcatgcagtaaa

SEQ ID NO: 7170890 - DNA, 22 bp, Homo sapiens
tatttgtatttcatgcagtaaa

SEQ ID NO: 7170891 - DNA, 20 bp, Homo sapiens
tatttgtatttgggaaagtt

SEQ ID NO: 7170892 - DNA, 22 bp, Homo sapiens
tatttgtcaagagagggggata

SEQ ID NO: 7170893 - DNA, 22 bp, Homo sapiens
tatttgtcacctatggctgtcc

SEQ ID NO: 7170894 - DNA, 22 bp, Homo sapiens
tatttgtccttattaagatctg

SEQ ID NO: 7170895 - DNA, 22 bp, Homo sapiens
tatttgtctaagaggctgacag

SEQ ID NO: 7170896 - DNA, 23 bp, Homo sapiens
tatttgtctcttaccactgctgt

SEQ ID NO: 7170897 - DNA, 22 bp, Homo sapiens
tatttgtcagctgttgagttca

SEQ ID NO: 7170898 - DNA, 22 bp, Homo sapiens
tatttgtcactagaaagggtaa

SEQ ID NO: 7170899 - DNA, 22 bp, Homo sapiens
tatttgtatttcatgcagtaaa

SEQ ID NO: 7170900 - DNA, 22 bp, Homo sapiens
tatttgtatgtgtgtacatata

SEQ ID NO: 7170901 - DNA, 22 bp, Homo sapiens
tatttgtatgtgtgtacatata

SEQ ID NO: 7170902 - DNA, 22 bp, Homo sapiens
tatttgtatgtgtgtacatata

SEQ ID NO: 7170903 - DNA, 22 bp, Homo sapiens
tatttgtagaatggattaaggg

SEQ ID NO: 7170904 - DNA, 22 bp, Homo sapiens
tatttgtagcttcccaaagctt

SEQ ID NO: 7170905 - DNA, 22 bp, Homo sapiens
tatttgtatgtgtgtacatata

SEQ ID NO: 7170906 - DNA, 22 bp, Homo sapiens
tatttgtatgtgtgtacatata

SEQ ID NO: 7170907 - DNA, 22 bp, Homo sapiens
tatttggaggccactgttgagt

SEQ ID NO: 7170908 - DNA, 22 bp, Homo sapiens
tatttggaggccactgttgagt

SEQ ID NO: 7170909 - DNA, 22 bp, Homo sapiens
tatttggagtgatggaaatgtt

SEQ ID NO: 7170910 - DNA, 22 bp, Homo sapiens
tatttggatacaatcatttgct

SEQ ID NO: 7170911 - DNA, 22 bp, Homo sapiens
tatttggatagacagggagatg

SEQ ID NO: 7170912 - DNA, 22 bp, Homo sapiens
tatttggatagacagggagatg

SEQ ID NO: 7170913 - DNA, 22 bp, Homo sapiens
tatttccttgagacggagtctc

SEQ ID NO: 7170914 - DNA, 22 bp, Homo sapiens
tatttcctgtggatacttttag

SEQ ID NO: 7170915 - DNA, 22 bp, Homo sapiens
tatttcctgcatggtgatgtaa

SEQ ID NO: 7170916 - DNA, 22 bp, Homo sapiens
tatttctaagagatatctgtac

SEQ ID NO: 7170917 - DNA, 22 bp, Homo sapiens
tatttctaagagatatctgtac

SEQ ID NO: 7170918 - DNA, 22 bp, Homo sapiens
tatttctaagagatatctgtac

SEQ ID NO: 7170919 - DNA, 22 bp, Homo sapiens
tatttctaagagatatctgtac

SEQ ID NO: 7170920 - DNA, 22 bp, Homo sapiens
tatttctaagagatatctgtac

SEQ ID NO: 7170921 - DNA, 22 bp, Homo sapiens
tatttctaagctgtaagtctga

SEQ ID NO: 7170922 - DNA, 22 bp, Homo sapiens
tatttctaagctgtaagtctga

SEQ ID NO: 7170923 - DNA, 22 bp, Homo sapiens
tatttcagggagaataaatttg

SEQ ID NO: 7170924 - DNA, 22 bp, Homo sapiens
tatttcagggggtacaagaaga

SEQ ID NO: 7170925 - DNA, 22 bp, Homo sapiens
tatttccagcagtaagaagaca

SEQ ID NO: 7170926 - DNA, 22 bp, Homo sapiens
tatttcagggggtacaagaaga

SEQ ID NO: 7170927 - DNA, 22 bp, Homo sapiens
tatttccatgttagaactaagt

SEQ ID NO: 7170928 - DNA, 22 bp, Homo sapiens
tatttccatgttagaactaagt

SEQ ID NO: 7170929 - DNA, 18 bp, Homo sapiens
tatttcccaatggaaaca

SEQ ID NO: 7170930 - DNA, 22 bp, Homo sapiens
tatttcccagggagcaacaagc

SEQ ID NO: 7170931 - DNA, 22 bp, Homo sapiens
tatttcaccttactaagctgtg

SEQ ID NO: 7170932 - DNA, 22 bp, Homo sapiens
tatttcacctaaaagtgtcaaa

SEQ ID NO: 7170933 - DNA, 22 bp, Homo sapiens
tatttcaccaccgctgatgaag

SEQ ID NO: 7170934 - DNA, 22 bp, Homo sapiens
tatttcacagcagctcatttaa

SEQ ID NO: 7170935 - DNA, 22 bp, Homo sapiens
tattgtatcttaccacatgtat

SEQ ID NO: 7170936 - DNA, 22 bp, Homo sapiens
tattgtatcttaccacatgtat

SEQ ID NO: 7170937 - DNA, 22 bp, Homo sapiens
tattgtactgaggaataaagct

SEQ ID NO: 7170938 - DNA, 22 bp, Homo sapiens
tatttcaagaacttctatccat

SEQ ID NO: 7170939 - DNA, 22 bp, Homo sapiens
tatttcaagaacttctatccat

SEQ ID NO: 7170940 - DNA, 22 bp, Homo sapiens
tatttcactcagtataccatag

SEQ ID NO: 7170941 - DNA, 22 bp, Homo sapiens
tatttcactattctctgtaact

SEQ ID NO: 7170942 - DNA, 22 bp, Homo sapiens
tatttcactcagtataccatag

SEQ ID NO: 7170943 - DNA, 21 bp, Homo sapiens
tatttcagaagagtctcagag

SEQ ID NO: 7170944 - DNA, 22 bp, Homo sapiens
tatttcagacactgatcttgca

SEQ ID NO: 7170945 - DNA, 22 bp, Homo sapiens
tatttcagagttgttttctgtc

SEQ ID NO: 7170946 - DNA, 22 bp, Homo sapiens
tatttcagcaagaagaatgtgg

SEQ ID NO: 7170947 - DNA, 22 bp, Homo sapiens
tatttcagcacatgggataggt

SEQ ID NO: 7170948 - DNA, 22 bp, Homo sapiens
tatttcagccctactacttggc

SEQ ID NO: 7170949 - DNA, 22 bp, Homo sapiens
tatttcagccctactacttggc

SEQ ID NO: 7170950 - DNA, 22 bp, Homo sapiens
tatttcagctctttggattatc

SEQ ID NO: 7170951 - DNA, 22 bp, Homo sapiens
tatttcagcaagaagaatgtgg

SEQ ID NO: 7170952 - DNA, 22 bp, Homo sapiens
tatttcagcaagaagaatgtgg

SEQ ID NO: 7170953 - DNA, 22 bp, Homo sapiens
tatttcagctctttggattatc

SEQ ID NO: 7170954 - DNA, 22 bp, Homo sapiens
tatttcaggctatatttcttgt

SEQ ID NO: 7170955 - DNA, 19 bp, Homo sapiens
tatttcaggctcagagtct

SEQ ID NO: 7170956 - DNA, 22 bp, Homo sapiens
tatttcagggagaataaatttg

SEQ ID NO: 7170957 - DNA, 22 bp, Homo sapiens
tattgggtaaagatccagtttt

SEQ ID NO: 7170958 - DNA, 22 bp, Homo sapiens
tattggtaggactcagctgaga

SEQ ID NO: 7170959 - DNA, 22 bp, Homo sapiens
tattggtagaaataggttctgg

SEQ ID NO: 7170960 - DNA, 22 bp, Homo sapiens
tattggtataggcattgaaact

SEQ ID NO: 7170961 - DNA, 22 bp, Homo sapiens
tattggtatggtaagaattgaa

SEQ ID NO: 7170962 - DNA, 19 bp, Homo sapiens
tattggtatgtgtgaggca

SEQ ID NO: 7170963 - DNA, 22 bp, Homo sapiens
tattggtcaagttgaggaccct

SEQ ID NO: 7170964 - DNA, 22 bp, Homo sapiens
tattggtcaatttcaccttgat

SEQ ID NO: 7170965 - DNA, 22 bp, Homo sapiens
tattggtctgcttaagtggatt

SEQ ID NO: 7170966 - DNA, 22 bp, Homo sapiens
tattggtgatgacttgaggcca

SEQ ID NO: 7170967 - DNA, 22 bp, Homo sapiens
tattggtgggggcagagagaga

SEQ ID NO: 7170968 - DNA, 22 bp, Homo sapiens
tattggtgggggcagagagaga

SEQ ID NO: 7170969 - DNA, 22 bp, Homo sapiens
tattggtgtacttatagcagag

SEQ ID NO: 7170970 - DNA, 22 bp, Homo sapiens
tattggtgtacttatagcagag

SEQ ID NO: 7170971 - DNA, 22 bp, Homo sapiens
tattggtttattgtgtatgaga

SEQ ID NO: 7170972 - DNA, 22 bp, Homo sapiens
tattggtttattgtgtatgaga

SEQ ID NO: 7170973 - DNA, 22 bp, Homo sapiens
tattgtacatggttatgcagga

SEQ ID NO: 7170974 - DNA, 22 bp, Homo sapiens
tattgtacatttcaaaattgct

SEQ ID NO: 7170975 - DNA, 22 bp, Homo sapiens
tattgtacatttcaaagtagct

SEQ ID NO: 7170976 - DNA, 22 bp, Homo sapiens
tattgtacatttcaaagtagct

SEQ ID NO: 7170977 - DNA, 22 bp, Homo sapiens
tattgcatctcttcatatctgt

SEQ ID NO: 7170978 - DNA, 22 bp, Homo sapiens
tattgcagacaaaatgagctac

SEQ ID NO: 7170979 - DNA, 22 bp, Homo sapiens
tattgcagacaaaatgagctac

SEQ ID NO: 7170980 - DNA, 23 bp, Homo sapiens
tattgcacacatagaaacataga

SEQ ID NO: 7170981 - DNA, 22 bp, Homo sapiens
tattgcagaagaaatgaatgaa

SEQ ID NO: 7170982 - DNA, 23 bp, Homo sapiens
tattgcacacatagaaacataga

SEQ ID NO: 7170983 - DNA, 20 bp, Homo sapiens
tatgataattacaaaatagt

SEQ ID NO: 7170984 - DNA, 20 bp, Homo sapiens
tatgataattacaaaatagt

SEQ ID NO: 7170985 - DNA, 20 bp, Homo sapiens
tatgataattacaaaatagt

SEQ ID NO: 7170986 - DNA, 22 bp, Homo sapiens
tatgatatgcactttatcagaa

SEQ ID NO: 7170987 - DNA, 22 bp, Homo sapiens
tatgagtttaaggctaaaatag

SEQ ID NO: 7170988 - DNA, 20 bp, Homo sapiens
tatgataattacaaaatagt

SEQ ID NO: 7170989 - DNA, 20 bp, Homo sapiens
tatgataattacaaaatagt

SEQ ID NO: 7170990 - DNA, 20 bp, Homo sapiens
tatgataattacaaaatagt

SEQ ID NO: 7170991 - DNA, 22 bp, Homo sapiens
tatctttgcaaatatctctaag

SEQ ID NO: 7170992 - DNA, 22 bp, Homo sapiens
tatctttgcaaatatctctaag

SEQ ID NO: 7170993 - DNA, 22 bp, Homo sapiens
tatctttgcaaatatctctaag

SEQ ID NO: 7170994 - DNA, 22 bp, Homo sapiens
tatgagtttaaggctaaaatag

SEQ ID NO: 7170995 - DNA, 22 bp, Homo sapiens
tatgcagggtgggttctctgag

SEQ ID NO: 7170996 - DNA, 22 bp, Homo sapiens
tatgcagtgagcactatttata

SEQ ID NO: 7170997 - DNA, 20 bp, Homo sapiens
tatgcagtatgtgtgtataa

SEQ ID NO: 7170998 - DNA, 22 bp, Homo sapiens
tatgcactggtactattcgtgt

SEQ ID NO: 7170999 - DNA, 22 bp, Homo sapiens
tatgcacattctttgtgggagc

SEQ ID NO: 7171000 - DNA, 22 bp, Homo sapiens
tatgcacattctttgtgggagc

SEQ ID NO: 7171001 - DNA, 22 bp, Homo sapiens
tatgcatatgtgttcattggag

SEQ ID NO: 7171002 - DNA, 22 bp, Homo sapiens
tatgcatatgtgttcattggag

SEQ ID NO: 7171003 - DNA, 22 bp, Homo sapiens
tatgcatatatcacgtgcatgc

SEQ ID NO: 7171004 - DNA, 22 bp, Homo sapiens
tatgcatatatcacgtgcatgc

SEQ ID NO: 7171005 - DNA, 19 bp, Homo sapiens
tatgcatatgttttcccag

SEQ ID NO: 7171006 - DNA, 22 bp, Homo sapiens
tatgcatgtggtatatgcttat

SEQ ID NO: 7171007 - DNA, 22 bp, Homo sapiens
tatgcattatacattaatttct

SEQ ID NO: 7171008 - DNA, 22 bp, Homo sapiens
tatgcattcagaggttgggtgt

SEQ ID NO: 7171009 - DNA, 22 bp, Homo sapiens
tatgcattcagaggttgggtgt

SEQ ID NO: 7171010 - DNA, 22 bp, Homo sapiens
tatgcattgtgagactgtggga

SEQ ID NO: 7171011 - DNA, 22 bp, Homo sapiens
tatgcattttatagtgcaaagc

SEQ ID NO: 7171012 - DNA, 22 bp, Homo sapiens
tatgccactgctctccatccta

SEQ ID NO: 7171013 - DNA, 22 bp, Homo sapiens
tatgcataattggataagtaga

SEQ ID NO: 7171014 - DNA, 22 bp, Homo sapiens
tatgcataattggataagtaga

SEQ ID NO: 7171015 - DNA, 22 bp, Homo sapiens
tatgcataattggataagtaga

SEQ ID NO: 7171016 - DNA, 22 bp, Homo sapiens
tatgcagtggtatcattttaaa

SEQ ID NO: 7171017 - DNA, 22 bp, Homo sapiens
tatgcagtgtacgatgtttagt

SEQ ID NO: 7171018 - DNA, 22 bp, Homo sapiens
tatgcagtgtatgcactgagat

SEQ ID NO: 7171019 - DNA, 21 bp, Homo sapiens
tatgcagtttacttaggtatt

SEQ ID NO: 7171020 - DNA, 21 bp, Homo sapiens
tatgcagtttacttaggtatt

SEQ ID NO: 7171021 - DNA, 22 bp, Homo sapiens
tatgcatagatattatcagcca

SEQ ID NO: 7171022 - DNA, 22 bp, Homo sapiens
tatgcataggtatctatactca

SEQ ID NO: 7171023 - DNA, 22 bp, Homo sapiens
tatgcatagtgatttagaacag

SEQ ID NO: 7171024 - DNA, 22 bp, Homo sapiens
tatgcatagtggaattagcaaa

SEQ ID NO: 7171025 - DNA, 22 bp, Homo sapiens
tatgcatataaatgtgtgaatt

SEQ ID NO: 7171026 - DNA, 22 bp, Homo sapiens
tatcttaaaaatcgaagcagat

SEQ ID NO: 7171027 - DNA, 22 bp, Homo sapiens
tatcttaaatgcatgatagaca

SEQ ID NO: 7171028 - DNA, 22 bp, Homo sapiens
tatcttaaatgcatgatagaca

SEQ ID NO: 7171029 - DNA, 22 bp, Homo sapiens
tatctgttgtcttttacatgta

SEQ ID NO: 7171030 - DNA, 22 bp, Homo sapiens
tatctgtttattgttactgtca

SEQ ID NO: 7171031 - DNA, 22 bp, Homo sapiens
tatctgtttcctatgcatgtga

SEQ ID NO: 7171032 - DNA, 23 bp, Homo sapiens
tatcttacctcccttctttcctg

SEQ ID NO: 7171033 - DNA, 22 bp, Homo sapiens
tatcttagggaattaactaaaa

SEQ ID NO: 7171034 - DNA, 22 bp, Homo sapiens
tatcttagggaattaactaaaa

SEQ ID NO: 7171035 - DNA, 22 bp, Homo sapiens
tatcttcaactaggattcattt

SEQ ID NO: 7171036 - DNA, 22 bp, Homo sapiens
tatcttcaatttattcaaggag

SEQ ID NO: 7171037 - DNA, 22 bp, Homo sapiens
tatcttcaatttattcaaggag

SEQ ID NO: 7171038 - DNA, 22 bp, Homo sapiens
tatcttcagctgaagcagagtc

SEQ ID NO: 7171039 - DNA, 22 bp, Homo sapiens
tatcttctcagtatatgggatg

SEQ ID NO: 7171040 - DNA, 22 bp, Homo sapiens
tatcttcttgccaggctggtgt

SEQ ID NO: 7171041 - DNA, 22 bp, Homo sapiens
tatctttagaggaagagaatct

SEQ ID NO: 7171042 - DNA, 22 bp, Homo sapiens
tatctttaacttgcagtattta

SEQ ID NO: 7171043 - DNA, 22 bp, Homo sapiens
tatcttgttttggcctccaggg

SEQ ID NO: 7171044 - DNA, 22 bp, Homo sapiens
tatcttgttttggcctccaggg

SEQ ID NO: 7171045 - DNA, 22 bp, Homo sapiens
tatcttggactctttgcagtgc

SEQ ID NO: 7171046 - DNA, 22 bp, Homo sapiens
tatcttggcttgaaagatgctt

SEQ ID NO: 7171047 - DNA, 21 bp, Homo sapiens
tatcttgggctctgtgcttga

SEQ ID NO: 7171048 - DNA, 22 bp, Homo sapiens
tatcttggtgggcttaatataa

SEQ ID NO: 7171049 - DNA, 22 bp, Homo sapiens
tatcttgagagacaacacagca

SEQ ID NO: 7171050 - DNA, 22 bp, Homo sapiens
tatcttgagagacaacacagca

SEQ ID NO: 7171051 - DNA, 22 bp, Homo sapiens
tatcttgatcaagtagaagagg

SEQ ID NO: 7171052 - DNA, 22 bp, Homo sapiens
tatcttgcctttaactgctcat

SEQ ID NO: 7171053 - DNA, 22 bp, Homo sapiens
tatcttgcctttaactgctcat

SEQ ID NO: 7171054 - DNA, 22 bp, Homo sapiens
tatcttggactctttgcagtgc

SEQ ID NO: 7171055 - DNA, 22 bp, Homo sapiens
tatctttagaggaagagaatct

SEQ ID NO: 7171056 - DNA, 22 bp, Homo sapiens
tatctttagaggaagagaatct

SEQ ID NO: 7171057 - DNA, 22 bp, Homo sapiens
tatctttagaggaagagaatct

SEQ ID NO: 7171058 - DNA, 22 bp, Homo sapiens
tatctttagaggaagagaatct

SEQ ID NO: 7171059 - DNA, 22 bp, Homo sapiens
tatctttattatgtctatctgc

SEQ ID NO: 7171060 - DNA, 22 bp, Homo sapiens
tatctttctgtcctagattctg

SEQ ID NO: 7171061 - DNA, 22 bp, Homo sapiens
tatctttgatgccagatgttac

SEQ ID NO: 7171062 - DNA, 18 bp, Homo sapiens
tatctttgagtcctctgc

SEQ ID NO: 7171063 - DNA, 22 bp, Homo sapiens
tatatttgtgtgtgatttatga

SEQ ID NO: 7171064 - DNA, 22 bp, Homo sapiens
tatatttgtgtgtgatttatga

SEQ ID NO: 7171065 - DNA, 22 bp, Homo sapiens
tatatttgtgtgtgatttatga

SEQ ID NO: 7171066 - DNA, 22 bp, Homo sapiens
tatatttgctaaatgtgtgcaa

SEQ ID NO: 7171067 - DNA, 19 bp, Homo sapiens
tatatttgagtgtgcatgc

SEQ ID NO: 7171068 - DNA, 18 bp, Homo sapiens
tatatttcacacatattc

SEQ ID NO: 7171069 - DNA, 18 bp, Homo sapiens
tatatttcacacatattc

SEQ ID NO: 7171070 - DNA, 22 bp, Homo sapiens
tatatttaattagttgctggat

SEQ ID NO: 7171071 - DNA, 22 bp, Homo sapiens
tatatttaattagttgctggat

SEQ ID NO: 7171072 - DNA, 22 bp, Homo sapiens
tatatttaatcctagagccatt

SEQ ID NO: 7171073 - DNA, 22 bp, Homo sapiens
tatatttaatcctagagccatt

SEQ ID NO: 7171074 - DNA, 22 bp, Homo sapiens
tatatttaaatccaggttgaaa

SEQ ID NO: 7171075 - DNA, 22 bp, Homo sapiens
tatatttaaatccaggttgaaa

SEQ ID NO: 7171076 - DNA, 22 bp, Homo sapiens
tatatttaatcctagagccatt

SEQ ID NO: 7171077 - DNA, 22 bp, Homo sapiens
tatattcaacaggctaatgtca

SEQ ID NO: 7171078 - DNA, 22 bp, Homo sapiens
tatattcaacaggctaatgtca

SEQ ID NO: 7171079 - DNA, 20 bp, Homo sapiens
tatattttctctttggcctt

SEQ ID NO: 7171080 - DNA, 22 bp, Homo sapiens
tatattttagacaccctcacgc

SEQ ID NO: 7171081 - DNA, 22 bp, Homo sapiens
tatattttagacaccctcacgc

SEQ ID NO: 7171082 - DNA, 19 bp, Homo sapiens
tatatttgttgaataaaaa

SEQ ID NO: 7171083 - DNA, 19 bp, Homo sapiens
tatatttgttgaataaaaa

SEQ ID NO: 7171084 - DNA, 19 bp, Homo sapiens
tatatttgttgaataaaaa

SEQ ID NO: 7171085 - DNA, 22 bp, Homo sapiens
tatcaaaaggagttgaaagggg

SEQ ID NO: 7171086 - DNA, 22 bp, Homo sapiens
tatcaaaaggagttgaaagggg

SEQ ID NO: 7171087 - DNA, 22 bp, Homo sapiens
tatcaaaaggagttgaaagggg

SEQ ID NO: 7171088 - DNA, 22 bp, Homo sapiens
tatcaaattgaggcagctgggg

SEQ ID NO: 7171089 - DNA, 22 bp, Homo sapiens
tatcaacaaaggccttgtgttt

SEQ ID NO: 7171090 - DNA, 22 bp, Homo sapiens
tatctgttggctcctagttgta

SEQ ID NO: 7171091 - DNA, 22 bp, Homo sapiens
tatctgttcttagctatagatg

SEQ ID NO: 7171092 - DNA, 22 bp, Homo sapiens
tatctgttcatgtttatatgtc

SEQ ID NO: 7171093 - DNA, 22 bp, Homo sapiens
tatctgttctgcttgattttga

SEQ ID NO: 7171094 - DNA, 22 bp, Homo sapiens
tatctgttcatgtttatatgtc

SEQ ID NO: 7171095 - DNA, 22 bp, Homo sapiens
tatctgttatgggctgaattgc

SEQ ID NO: 7171096 - DNA, 22 bp, Homo sapiens
tatctagatggattttagtgaa

SEQ ID NO: 7171097 - DNA, 22 bp, Homo sapiens
tatctagatggattttagtgaa

SEQ ID NO: 7171098 - DNA, 22 bp, Homo sapiens
tatctagatttctttctctgtg

SEQ ID NO: 7171099 - DNA, 22 bp, Homo sapiens
tatctagatttctttctctgtg

SEQ ID NO: 7171100 - DNA, 22 bp, Homo sapiens
tatctagcaagtaacatgctga

SEQ ID NO: 7171101 - DNA, 22 bp, Homo sapiens
tatctagtttgtctagctttgc

SEQ ID NO: 7171102 - DNA, 22 bp, Homo sapiens
tatctataagtactaacatggt

SEQ ID NO: 7171103 - DNA, 22 bp, Homo sapiens
tatctataatgttttacttcct

SEQ ID NO: 7171104 - DNA, 23 bp, Homo sapiens
tatctgtatttgttcactgctgt

SEQ ID NO: 7171105 - DNA, 22 bp, Homo sapiens
tatctgtcacctgtagggtagg

SEQ ID NO: 7171106 - DNA, 22 bp, Homo sapiens
tatctgtgaaatgtgtttgtat

SEQ ID NO: 7171107 - DNA, 17 bp, Homo sapiens
tatctgtgttcctggct

SEQ ID NO: 7171108 - DNA, 22 bp, Homo sapiens
tatcacaattcctatagtttgt

SEQ ID NO: 7171109 - DNA, 22 bp, Homo sapiens
tatcacagccttttggtgaggg

SEQ ID NO: 7171110 - DNA, 22 bp, Homo sapiens
tatcacactgttttaattactt

SEQ ID NO: 7171111 - DNA, 22 bp, Homo sapiens
tatctagatatttggataaatg

SEQ ID NO: 7171112 - DNA, 22 bp, Homo sapiens
tatcaattgggccaaatggtac

SEQ ID NO: 7171113 - DNA, 20 bp, Homo sapiens
tatcaatcagaaagaagact

SEQ ID NO: 7171114 - DNA, 22 bp, Homo sapiens
tatcaatacatgttatcagtgt

SEQ ID NO: 7171115 - DNA, 22 bp, Homo sapiens
tatcaatacatgttatcagtgt

SEQ ID NO: 7171116 - DNA, 21 bp, Homo sapiens
tatcaagatgttatggttgaa

SEQ ID NO: 7171117 - DNA, 22 bp, Homo sapiens
tatcaaggcatggaaaatgcta

SEQ ID NO: 7171118 - DNA, 22 bp, Homo sapiens
tatcaaggtcaacattgacagt

SEQ ID NO: 7171119 - DNA, 22 bp, Homo sapiens
tatcaatacatgttatcagtgt

SEQ ID NO: 7171120 - DNA, 22 bp, Homo sapiens
tatcaatacatgttatcagtgt

SEQ ID NO: 7171121 - DNA, 22 bp, Homo sapiens
tatcaacaaaggccttgtgttt

SEQ ID NO: 7171122 - DNA, 22 bp, Homo sapiens
tatcaacaatagccagtgttta

SEQ ID NO: 7171123 - DNA, 22 bp, Homo sapiens
tatcaacaatagccagtgttta

SEQ ID NO: 7171124 - DNA, 22 bp, Homo sapiens
tatcaacttttcagaaggggct

SEQ ID NO: 7171125 - DNA, 19 bp, Homo sapiens
tagtgtttttctggagcag

SEQ ID NO: 7171126 - DNA, 22 bp, Homo sapiens
tagtgtttttcattggcagagg

SEQ ID NO: 7171127 - DNA, 22 bp, Homo sapiens
tagtgtttttcattggcagagg

SEQ ID NO: 7171128 - DNA, 22 bp, Homo sapiens
tagtgtttgggaattgtagaga

SEQ ID NO: 7171129 - DNA, 22 bp, Homo sapiens
tagtgtttgggaattgtagaga

SEQ ID NO: 7171130 - DNA, 22 bp, Homo sapiens
tagtgttttctagaatggtttt

SEQ ID NO: 7171131 - DNA, 22 bp, Homo sapiens
tagtgttttctagaatggtttt

SEQ ID NO: 7171132 - DNA, 22 bp, Homo sapiens
tagtgttttctagaatggtttt

SEQ ID NO: 7171133 - DNA, 22 bp, Homo sapiens
tagtgtttagtacatatgcata

SEQ ID NO: 7171134 - DNA, 22 bp, Homo sapiens
tagtgtttagtacatatgcata

SEQ ID NO: 7171135 - DNA, 22 bp, Homo sapiens
tagtgtatgtctaacatacact

SEQ ID NO: 7171136 - DNA, 22 bp, Homo sapiens
tagtgtatgtctaacatacact

SEQ ID NO: 7171137 - DNA, 22 bp, Homo sapiens
tagtgtatgttcagcttatatg

SEQ ID NO: 7171138 - DNA, 22 bp, Homo sapiens
tagtgtcagggagtgataaatg

SEQ ID NO: 7171139 - DNA, 23 bp, Homo sapiens
tagtgtcatcctcagcttctgtt

SEQ ID NO: 7171140 - DNA, 22 bp, Homo sapiens
tatacagaactgcacgtgcacg

SEQ ID NO: 7171141 - DNA, 22 bp, Homo sapiens
tatacagaaccgcctgaagtct

SEQ ID NO: 7171142 - DNA, 22 bp, Homo sapiens
tatacagaaccgcctgaagtct

SEQ ID NO: 7171143 - DNA, 15 bp, Homo sapiens
tatacagaagttcag

SEQ ID NO: 7171144 - DNA, 21 bp, Homo sapiens
tatacagaggggaacaggaga

SEQ ID NO: 7171145 - DNA, 22 bp, Homo sapiens
tagttaatggaaatgatggaaa

SEQ ID NO: 7171146 - DNA, 22 bp, Homo sapiens
tagttaattctttaagaacaag

SEQ ID NO: 7171147 - DNA, 22 bp, Homo sapiens
tagttaattctttaagaacaag

SEQ ID NO: 7171148 - DNA, 22 bp, Homo sapiens
tatacagaacattaagaactgt

SEQ ID NO: 7171149 - DNA, 22 bp, Homo sapiens
tagttaaagccctaaattgata

SEQ ID NO: 7171150 - DNA, 22 bp, Homo sapiens
tagttaaagccctaaattgata

SEQ ID NO: 7171151 - DNA, 22 bp, Homo sapiens
tagttaactcttggtaataggt

SEQ ID NO: 7171152 - DNA, 22 bp, Homo sapiens
tagttaaagccctaaattgata

SEQ ID NO: 7171153 - DNA, 22 bp, Homo sapiens
tagttaaagccctaaattgata

SEQ ID NO: 7171154 - DNA, 22 bp, Homo sapiens
tagttaaagattctgttaagag

SEQ ID NO: 7171155 - DNA, 20 bp, Homo sapiens
tatactaacatatatctgtt

SEQ ID NO: 7171156 - DNA, 22 bp, Homo sapiens
tatactacgcaccaaacaaagg

SEQ ID NO: 7171157 - DNA, 22 bp, Homo sapiens
tatactattattgtcagtttat

SEQ ID NO: 7171158 - DNA, 22 bp, Homo sapiens
tatactattattgtcagtttat

SEQ ID NO: 7171159 - DNA, 22 bp, Homo sapiens
tatactctgaaaacaatagtag

SEQ ID NO: 7171160 - DNA, 22 bp, Homo sapiens
tatactctgagaaacgtgtcac

SEQ ID NO: 7171161 - DNA, 22 bp, Homo sapiens
tatactctgagaaacgtgtcac

SEQ ID NO: 7171162 - DNA, 20 bp, Homo sapiens
tatactaacatatatctgtt

SEQ ID NO: 7171163 - DNA, 20 bp, Homo sapiens
tatactaacatatatctgtt

SEQ ID NO: 7171164 - DNA, 22 bp, Homo sapiens
tatacctttaccttgaccaaat

SEQ ID NO: 7171165 - DNA, 22 bp, Homo sapiens
tataccatgtgtgcacactccc

SEQ ID NO: 7171166 - DNA, 22 bp, Homo sapiens
tataccaaaatatcagaaaggg

SEQ ID NO: 7171167 - DNA, 22 bp, Homo sapiens
tatacagatatctaagatgtaa

SEQ ID NO: 7171168 - DNA, 22 bp, Homo sapiens
tatacagataatgaagaccaag

SEQ ID NO: 7171169 - DNA, 22 bp, Homo sapiens
tatactgtaggtgcagaaagaa

SEQ ID NO: 7171170 - DNA, 22 bp, Homo sapiens
tatactgtccctctgcactcca

SEQ ID NO: 7171171 - DNA, 22 bp, Homo sapiens
tatactgtcgcattacactcac

SEQ ID NO: 7171172 - DNA, 22 bp, Homo sapiens
tatactgtgttttcaccactgt

SEQ ID NO: 7171173 - DNA, 22 bp, Homo sapiens
tatacttatgctaaaaaatgtt

SEQ ID NO: 7171174 - DNA, 22 bp, Homo sapiens
tatactctgagaaacgtgtcac

SEQ ID NO: 7171175 - DNA, 22 bp, Homo sapiens
tatactctgagaaacgtgtcac

SEQ ID NO: 7171176 - DNA, 22 bp, Homo sapiens
tatactctgagaaacgtgtcac

SEQ ID NO: 7171177 - DNA, 22 bp, Homo sapiens
tatactctgagaaacgtgtcac

SEQ ID NO: 7171178 - DNA, 22 bp, Homo sapiens
tatagaagtaagcattgtgatg

SEQ ID NO: 7171179 - DNA, 22 bp, Homo sapiens
tatagacaagcgtaacaagaag

SEQ ID NO: 7171180 - DNA, 22 bp, Homo sapiens
tatagacaagcgtaacaagaag

SEQ ID NO: 7171181 - DNA, 22 bp, Homo sapiens
tatagaagagacatgtgcatag

SEQ ID NO: 7171182 - DNA, 22 bp, Homo sapiens
tatacttatgctaaaaaatgtt

SEQ ID NO: 7171183 - DNA, 22 bp, Homo sapiens
tatactttcctgcaactttgat

SEQ ID NO: 7171184 - DNA, 22 bp, Homo sapiens
tatactttcctgcaactttgat

SEQ ID NO: 7171185 - DNA, 22 bp, Homo sapiens
tatatgcagattttcatcatcg

SEQ ID NO: 7171186 - DNA, 22 bp, Homo sapiens
tatatgcagtgtgtcattcaag

SEQ ID NO: 7171187 - DNA, 22 bp, Homo sapiens
tatatgcagtgtgtcattcaag

SEQ ID NO: 7171188 - DNA, 22 bp, Homo sapiens
tatagcaaggacataatatgct

SEQ ID NO: 7171189 - DNA, 22 bp, Homo sapiens
tatagcaactccaaagagactt

SEQ ID NO: 7171190 - DNA, 20 bp, Homo sapiens
tatagatcacatcttctagc

SEQ ID NO: 7171191 - DNA, 22 bp, Homo sapiens
tatagatcccccgtatgtgtga

SEQ ID NO: 7171192 - DNA, 22 bp, Homo sapiens
tatagcaaaatagtttccacac

SEQ ID NO: 7171193 - DNA, 22 bp, Homo sapiens
tatagaggccaccaacatgaaa

SEQ ID NO: 7171194 - DNA, 22 bp, Homo sapiens
tatagaggtggaaactgaggtt

SEQ ID NO: 7171195 - DNA, 22 bp, Homo sapiens
tatagatagactgacgatacag

SEQ ID NO: 7171196 - DNA, 22 bp, Homo sapiens
tatagacaagcgtaacaagaag

SEQ ID NO: 7171197 - DNA, 22 bp, Homo sapiens
tatagacaagcgtaacaagaag

SEQ ID NO: 7171198 - DNA, 18 bp, Homo sapiens
tatagacacatatgccag

SEQ ID NO: 7171199 - DNA, 22 bp, Homo sapiens
tatagactagcagcagaattta

SEQ ID NO: 7171200 - DNA, 22 bp, Homo sapiens
tatagactgtgaaatttaggca

SEQ ID NO: 7171201 - DNA, 22 bp, Homo sapiens
tatagaggatgaacatctatta

SEQ ID NO: 7171202 - DNA, 22 bp, Homo sapiens
tatatgtagtcagtcagagtaa

SEQ ID NO: 7171203 - DNA, 22 bp, Homo sapiens
tatatgtagtcagtcagagtaa

SEQ ID NO: 7171204 - DNA, 17 bp, Homo sapiens
tatatgtatgcctctcc

SEQ ID NO: 7171205 - DNA, 22 bp, Homo sapiens
tatatgtgcagcatttttaatt

SEQ ID NO: 7171206 - DNA, 22 bp, Homo sapiens
tatatgtgcagcatttttaatt

SEQ ID NO: 7171207 - DNA, 22 bp, Homo sapiens
tatatgtagattgtaccaatgt

SEQ ID NO: 7171208 - DNA, 22 bp, Homo sapiens
tatatgtaagctatgtaagagt

SEQ ID NO: 7171209 - DNA, 22 bp, Homo sapiens
tatatgtagattgtaccaatgt

SEQ ID NO: 7171210 - DNA, 22 bp, Homo sapiens
tatatgtagtcagtcagagtaa

SEQ ID NO: 7171211 - DNA, 22 bp, Homo sapiens
tatatgtagtcagtcagagtaa

SEQ ID NO: 7171212 - DNA, 22 bp, Homo sapiens
tatatgtaagctatgtaagagt

SEQ ID NO: 7171213 - DNA, 22 bp, Homo sapiens
tatatgtaagctatgtaagagt

SEQ ID NO: 7171214 - DNA, 22 bp, Homo sapiens
tatatgcttgggaaatggtaga

SEQ ID NO: 7171215 - DNA, 22 bp, Homo sapiens
tatatgcttgtgcatgtctttg

SEQ ID NO: 7171216 - DNA, 22 bp, Homo sapiens
tatatgcatgcccatgtataca

SEQ ID NO: 7171217 - DNA, 22 bp, Homo sapiens
tatatgcatgcccatgtataca

SEQ ID NO: 7171218 - DNA, 22 bp, Homo sapiens
tatatgcatgcccatgtataca

SEQ ID NO: 7171219 - DNA, 22 bp, Homo sapiens
tatatgctaatggtgccattcc

SEQ ID NO: 7171220 - DNA, 22 bp, Homo sapiens
tatatgctctgggatcctgaaa

SEQ ID NO: 7171221 - DNA, 22 bp, Homo sapiens
tatatgcttgggaaatggtaga

SEQ ID NO: 7171222 - DNA, 22 bp, Homo sapiens
tatattatcataaaaccattca

SEQ ID NO: 7171223 - DNA, 22 bp, Homo sapiens
tatattatcataaaaccattca

SEQ ID NO: 7171224 - DNA, 22 bp, Homo sapiens
tatattatcataaaaccattca

SEQ ID NO: 7171225 - DNA, 22 bp, Homo sapiens
tatattagtgagatttatccat

SEQ ID NO: 7171226 - DNA, 22 bp, Homo sapiens
tatattagtgagatttatccat

SEQ ID NO: 7171227 - DNA, 22 bp, Homo sapiens
tatattagtggaatgatatgaa

SEQ ID NO: 7171228 - DNA, 22 bp, Homo sapiens
tatattataagccctttcagaa

SEQ ID NO: 7171229 - DNA, 22 bp, Homo sapiens
tatattacctgcctgatctata

SEQ ID NO: 7171230 - DNA, 22 bp, Homo sapiens
tatattacctgcctgatctata

SEQ ID NO: 7171231 - DNA, 22 bp, Homo sapiens
tatattaacacccacttgcctc

SEQ ID NO: 7171232 - DNA, 22 bp, Homo sapiens
tatattaaagtgctttgcagtg

SEQ ID NO: 7171233 - DNA, 22 bp, Homo sapiens
tatatgtttttctaattaggga

SEQ ID NO: 7171234 - DNA, 22 bp, Homo sapiens
tatattaaaccctctctgtagg

SEQ ID NO: 7171235 - DNA, 22 bp, Homo sapiens
tatattaaaccctctctgtagg

SEQ ID NO: 7171236 - DNA, 22 bp, Homo sapiens
tatatgtttcttacaaaatatt

SEQ ID NO: 7171237 - DNA, 22 bp, Homo sapiens
tatatgtttttctaattaggga

SEQ ID NO: 7171238 - DNA, 20 bp, Homo sapiens
tatatgtgtacatacacaca

SEQ ID NO: 7171239 - DNA, 22 bp, Homo sapiens
tatatgttgatactaattctgg

SEQ ID NO: 7171240 - DNA, 22 bp, Homo sapiens
tatatgttgatactaattctgg

SEQ ID NO: 7171241 - DNA, 22 bp, Homo sapiens
tatattaaagtgctttgcagtg

SEQ ID NO: 7171242 - DNA, 22 bp, Homo sapiens
tatattaaatgaccagttttaa

SEQ ID NO: 7171243 - DNA, 22 bp, Homo sapiens
tatattaaatgaccagttttaa

SEQ ID NO: 7171244 - DNA, 22 bp, Homo sapiens
tatattaaatgaccagttttaa

SEQ ID NO: 7171245 - DNA, 22 bp, Homo sapiens
tatattaacacccacttgcctc

SEQ ID NO: 7171246 - DNA, 22 bp, Homo sapiens
tagtcacaaccttcaagttgtc

SEQ ID NO: 7171247 - DNA, 22 bp, Homo sapiens
tagtcacaaccttcaagttgtc

SEQ ID NO: 7171248 - DNA, 22 bp, Homo sapiens
tagtcaaaagcttcactcggaa

SEQ ID NO: 7171249 - DNA, 20 bp, Homo sapiens
tagtatttgcataaggatag

SEQ ID NO: 7171250 - DNA, 22 bp, Homo sapiens
tagtattttagaaaaccatgaa

SEQ ID NO: 7171251 - DNA, 22 bp, Homo sapiens
tagtattttagaaaaccatgaa

SEQ ID NO: 7171252 - DNA, 22 bp, Homo sapiens
tagtatttgcagatttgtgtca

SEQ ID NO: 7171253 - DNA, 22 bp, Homo sapiens
tagtatttgcagatttgtgtca

SEQ ID NO: 7171254 - DNA, 22 bp, Homo sapiens
tagtatttgcagatttgtgtca

SEQ ID NO: 7171255 - DNA, 22 bp, Homo sapiens
tagtatttgcagatttgtgtca

SEQ ID NO: 7171256 - DNA, 20 bp, Homo sapiens
tagtatttgcataaggatag

SEQ ID NO: 7171257 - DNA, 22 bp, Homo sapiens
tagtatttaatcacttttgtct

SEQ ID NO: 7171258 - DNA, 22 bp, Homo sapiens
tagtatttataatcatgcttaa

SEQ ID NO: 7171259 - DNA, 22 bp, Homo sapiens
tagtatttataatcatgcttaa

SEQ ID NO: 7171260 - DNA, 22 bp, Homo sapiens
tagtatttaatcacttttgtct

SEQ ID NO: 7171261 - DNA, 22 bp, Homo sapiens
tagtatttaatcacttttgtct

SEQ ID NO: 7171262 - DNA, 22 bp, Homo sapiens
tagtatttaatcacttttgtct

SEQ ID NO: 7171263 - DNA, 22 bp, Homo sapiens
tagtatctttctatatttccca

SEQ ID NO: 7171264 - DNA, 22 bp, Homo sapiens
tagtatgtcttactctaataca

SEQ ID NO: 7171265 - DNA, 22 bp, Homo sapiens
tagtatgttgtctgatgttacc

SEQ ID NO: 7171266 - DNA, 22 bp, Homo sapiens
tagtatgttgtctgatgttacc

SEQ ID NO: 7171267 - DNA, 22 bp, Homo sapiens
tagtatttcctgtaagctatag

SEQ ID NO: 7171268 - DNA, 22 bp, Homo sapiens
tagtccagaaactgagcttata

SEQ ID NO: 7171269 - DNA, 22 bp, Homo sapiens
tagtcattctccttacaaagcc

SEQ ID NO: 7171270 - DNA, 22 bp, Homo sapiens
tagtcatttttccactaagtta

SEQ ID NO: 7171271 - DNA, 22 bp, Homo sapiens
tagtcataattttgatgtttgt

SEQ ID NO: 7171272 - DNA, 22 bp, Homo sapiens
tagtcataattttgatgtttgt

SEQ ID NO: 7171273 - DNA, 22 bp, Homo sapiens
tagtcagtagcaaggtattttg

SEQ ID NO: 7171274 - DNA, 22 bp, Homo sapiens
tagtcagtatgaaattgctcaa

SEQ ID NO: 7171275 - DNA, 23 bp, Homo sapiens
tagtcagtatgtaagtctaattg

SEQ ID NO: 7171276 - DNA, 22 bp, Homo sapiens
tagtcagtcttacatatttgaa

SEQ ID NO: 7171277 - DNA, 22 bp, Homo sapiens
tagtcagtgatcagtggagttg

SEQ ID NO: 7171278 - DNA, 22 bp, Homo sapiens
tagtcagtgcacagacacttgt

SEQ ID NO: 7171279 - DNA, 22 bp, Homo sapiens
tagtcagttgggtctagtggca

SEQ ID NO: 7171280 - DNA, 22 bp, Homo sapiens
tagtcacaaccttcaagttgtc

SEQ ID NO: 7171281 - DNA, 22 bp, Homo sapiens
tagtcacacaattgtgtacatt

SEQ ID NO: 7171282 - DNA, 22 bp, Homo sapiens
tagtcacacaattgtgtacatt

SEQ ID NO: 7171283 - DNA, 22 bp, Homo sapiens
tagtcacaggaagtttcaatgt

SEQ ID NO: 7171284 - DNA, 22 bp, Homo sapiens
tagtcacaggaagtttcaatgt

SEQ ID NO: 7171285 - DNA, 22 bp, Homo sapiens
tagtcacagtacaggataaaga

SEQ ID NO: 7171286 - DNA, 22 bp, Homo sapiens
tagtcacagtacaggataaaga

SEQ ID NO: 7171287 - DNA, 22 bp, Homo sapiens
tagtcacagtacaggataaaga

SEQ ID NO: 7171288 - DNA, 22 bp, Homo sapiens
tagtcacatgatcacaggatcg

SEQ ID NO: 7171289 - DNA, 22 bp, Homo sapiens
tagtcacatgatcacaggatcg

SEQ ID NO: 7171290 - DNA, 22 bp, Homo sapiens
tagtcaccagctacaggacagc

SEQ ID NO: 7171291 - DNA, 22 bp, Homo sapiens
tagtcacctttggcacctgcaa

SEQ ID NO: 7171292 - DNA, 22 bp, Homo sapiens
tagtcctcagctgaactgctgc

SEQ ID NO: 7171293 - DNA, 22 bp, Homo sapiens
tagtccatcttgaattcagtga

SEQ ID NO: 7171294 - DNA, 22 bp, Homo sapiens
tagtccatgttgatatcctcat

SEQ ID NO: 7171295 - DNA, 22 bp, Homo sapiens
tagtccattaaattagattcaa

SEQ ID NO: 7171296 - DNA, 22 bp, Homo sapiens
tagtccattgattagctcattt

SEQ ID NO: 7171297 - DNA, 22 bp, Homo sapiens
tagtccattttcacactgctga

SEQ ID NO: 7171298 - DNA, 22 bp, Homo sapiens
tagtcctgaccagctggatgtt

SEQ ID NO: 7171299 - DNA, 22 bp, Homo sapiens
tagtccttacttactagaataa

SEQ ID NO: 7171300 - DNA, 22 bp, Homo sapiens
tagtccttggtaaaattctatg

SEQ ID NO: 7171301 - DNA, 22 bp, Homo sapiens
tagtcctttatcaaacatttat

SEQ ID NO: 7171302 - DNA, 22 bp, Homo sapiens
tagtccaggttaatccctgcct

SEQ ID NO: 7171303 - DNA, 22 bp, Homo sapiens
tagtccaggtttccatctccac

SEQ ID NO: 7171304 - DNA, 22 bp, Homo sapiens
tagtggggaaggaggacaagaa

SEQ ID NO: 7171305 - DNA, 22 bp, Homo sapiens
tagtggggcctgggagggttcc

SEQ ID NO: 7171306 - DNA, 22 bp, Homo sapiens
tagtggggcctgggagggttcc

SEQ ID NO: 7171307 - DNA, 22 bp, Homo sapiens
tagtgggtgatttgatgaggaa

SEQ ID NO: 7171308 - DNA, 22 bp, Homo sapiens
tagtgggtgatttgatgaggaa

SEQ ID NO: 7171309 - DNA, 22 bp, Homo sapiens
tagtgtaaataactgcctagac

SEQ ID NO: 7171310 - DNA, 22 bp, Homo sapiens
tagtgtaatgacatttagacga

SEQ ID NO: 7171311 - DNA, 23 bp, Homo sapiens
tagtgtatatcaacatttgtccc

SEQ ID NO: 7171312 - DNA, 23 bp, Homo sapiens
tagtgtatatcaacatttgtccc

SEQ ID NO: 7171313 - DNA, 22 bp, Homo sapiens
tagtgtatctgttcttttatct

SEQ ID NO: 7171314 - DNA, 22 bp, Homo sapiens
tagtggctgcttcattggtgag

SEQ ID NO: 7171315 - DNA, 22 bp, Homo sapiens
tagtggggaaggaggacaagaa

SEQ ID NO: 7171316 - DNA, 22 bp, Homo sapiens
tagtggggaaggaggacaagaa

SEQ ID NO: 7171317 - DNA, 22 bp, Homo sapiens
tagtggatgttcagagatttga

SEQ ID NO: 7171318 - DNA, 22 bp, Homo sapiens
tagtggcaaaagcattttgggt

SEQ ID NO: 7171319 - DNA, 17 bp, Homo sapiens
tagtggcaggaaatgaa

SEQ ID NO: 7171320 - DNA, 22 bp, Homo sapiens
tagtggcattgttgtgaggatt

SEQ ID NO: 7171321 - DNA, 22 bp, Homo sapiens
tagtctatcgcctctcacacgt

SEQ ID NO: 7171322 - DNA, 19 bp, Homo sapiens
tagtggagtgacaagttct

SEQ ID NO: 7171323 - DNA, 22 bp, Homo sapiens
tagtggatgttcagagatttga

SEQ ID NO: 7171324 - DNA, 22 bp, Homo sapiens
tagtggatgttcagagatttga

SEQ ID NO: 7171325 - DNA, 22 bp, Homo sapiens
tagtggatgttcagagatttga

SEQ ID NO: 7171326 - DNA, 22 bp, Homo sapiens
taggctggaacttaggcagagg

SEQ ID NO: 7171327 - DNA, 22 bp, Homo sapiens
taggctggaacttaggcagagg

SEQ ID NO: 7171328 - DNA, 22 bp, Homo sapiens
taggctggaacttaggcagagg

SEQ ID NO: 7171329 - DNA, 22 bp, Homo sapiens
taggctgctcaccaggctcaga

SEQ ID NO: 7171330 - DNA, 22 bp, Homo sapiens
taggctgagctaagagagctta

SEQ ID NO: 7171331 - DNA, 22 bp, Homo sapiens
taggctgggaagaaagattctc

SEQ ID NO: 7171332 - DNA, 22 bp, Homo sapiens
taggctggaggaagcagtgcct

SEQ ID NO: 7171333 - DNA, 22 bp, Homo sapiens
taggctggaggaagcagtgcct

SEQ ID NO: 7171334 - DNA, 22 bp, Homo sapiens
taggctggaggaagcagtgcct

SEQ ID NO: 7171335 - DNA, 22 bp, Homo sapiens
taggctggaggaagcagtgcct

SEQ ID NO: 7171336 - DNA, 22 bp, Homo sapiens
taggctggaacttaggcagagg

SEQ ID NO: 7171337 - DNA, 22 bp, Homo sapiens
taggtttactgaattagtggaa

SEQ ID NO: 7171338 - DNA, 22 bp, Homo sapiens
taggtttactgaattagtggaa

SEQ ID NO: 7171339 - DNA, 22 bp, Homo sapiens
taggttcagagaactgaaaata

SEQ ID NO: 7171340 - DNA, 22 bp, Homo sapiens
taggtgtgggctcaggaatgtg

SEQ ID NO: 7171341 - DNA, 22 bp, Homo sapiens
taggtgtgattcgaagagcaaa

SEQ ID NO: 7171342 - DNA, 22 bp, Homo sapiens
taggttcaagttcaggctctat

SEQ ID NO: 7171343 - DNA, 20 bp, Homo sapiens
taggtgtctttgccagcttt

SEQ ID NO: 7171344 - DNA, 22 bp, Homo sapiens
taggctgggagcctgaggctag

SEQ ID NO: 7171345 - DNA, 22 bp, Homo sapiens
taggctgggaagaaagattctc

SEQ ID NO: 7171346 - DNA, 22 bp, Homo sapiens
taggttttcctaaaattctggt

SEQ ID NO: 7171347 - DNA, 22 bp, Homo sapiens
tagtaaaaagcaatggtgagta

SEQ ID NO: 7171348 - DNA, 22 bp, Homo sapiens
tagtaaaaagcaatggtgagta

SEQ ID NO: 7171349 - DNA, 22 bp, Homo sapiens
tagtaaaaggtcttcctttgtt

SEQ ID NO: 7171350 - DNA, 22 bp, Homo sapiens
tagtaaaaggtcttcctttgtt

SEQ ID NO: 7171351 - DNA, 22 bp, Homo sapiens
taggtttcagaggtgccgggaa

SEQ ID NO: 7171352 - DNA, 22 bp, Homo sapiens
tagtaaaagtttagttgaaagt

SEQ ID NO: 7171353 - DNA, 22 bp, Homo sapiens
tagtaaaagtttagttgaaagt

SEQ ID NO: 7171354 - DNA, 22 bp, Homo sapiens
tagtaaacagctctgccacaat

SEQ ID NO: 7171355 - DNA, 22 bp, Homo sapiens
tagtaaacaggcaagggaccac

SEQ ID NO: 7171356 - DNA, 22 bp, Homo sapiens
tagtaaagtgtcttaacacata

SEQ ID NO: 7171357 - DNA, 22 bp, Homo sapiens
tagtacagtttaaatattaata

SEQ ID NO: 7171358 - DNA, 22 bp, Homo sapiens
tagtacagtttaaatattaata

SEQ ID NO: 7171359 - DNA, 22 bp, Homo sapiens
tagtacagtttactttcagcgc

SEQ ID NO: 7171360 - DNA, 22 bp, Homo sapiens
tagtatatgtctatggttgtag

SEQ ID NO: 7171361 - DNA, 22 bp, Homo sapiens
tagtatattaattctcacggtt

SEQ ID NO: 7171362 - DNA, 22 bp, Homo sapiens
tagtatatctttagtacatagt

SEQ ID NO: 7171363 - DNA, 22 bp, Homo sapiens
tagtatattttgttgcaattca

SEQ ID NO: 7171364 - DNA, 22 bp, Homo sapiens
tagtatctattagtaacaagag

SEQ ID NO: 7171365 - DNA, 22 bp, Homo sapiens
tagtatatctttagtacatagt

SEQ ID NO: 7171366 - DNA, 22 bp, Homo sapiens
tagtatagattgaagcagatca

SEQ ID NO: 7171367 - DNA, 22 bp, Homo sapiens
tagtatagattgaagcagatca

SEQ ID NO: 7171368 - DNA, 22 bp, Homo sapiens
tagtatagattgaagcagatca

SEQ ID NO: 7171369 - DNA, 22 bp, Homo sapiens
tagtatagattgaagcagatca

SEQ ID NO: 7171370 - DNA, 22 bp, Homo sapiens
tagtatagtgaatattttggtg

SEQ ID NO: 7171371 - DNA, 22 bp, Homo sapiens
tagtatatctttagtacatagt

SEQ ID NO: 7171372 - DNA, 22 bp, Homo sapiens
tagtatatctttagtacatagt

SEQ ID NO: 7171373 - DNA, 22 bp, Homo sapiens
tagtacagttttggcacatgga

SEQ ID NO: 7171374 - DNA, 22 bp, Homo sapiens
tagtacagttttggcacatgga

SEQ ID NO: 7171375 - DNA, 22 bp, Homo sapiens
tagtacagtttactttcagcgc

SEQ ID NO: 7171376 - DNA, 22 bp, Homo sapiens
tagtactacgttttctactatc

SEQ ID NO: 7171377 - DNA, 22 bp, Homo sapiens
tagtacttatctctgtcattgt

SEQ ID NO: 7171378 - DNA, 22 bp, Homo sapiens
tagtagtaattgttatcttatt

SEQ ID NO: 7171379 - DNA, 20 bp, Homo sapiens
tagtagtaaaaagataatct

SEQ ID NO: 7171380 - DNA, 22 bp, Homo sapiens
tagtagtgagtctttataaata

SEQ ID NO: 7171381 - DNA, 22 bp, Homo sapiens
tagtataattgttctggaatca

SEQ ID NO: 7171382 - DNA, 22 bp, Homo sapiens
taggaaagaaatgagtagtgat

SEQ ID NO: 7171383 - DNA, 22 bp, Homo sapiens
taggaaagaaatgagtagtgat

SEQ ID NO: 7171384 - DNA, 22 bp, Homo sapiens
taggaaagaaatgagtagtgat

SEQ ID NO: 7171385 - DNA, 22 bp, Homo sapiens
taggaaagaaatgagtagtgat

SEQ ID NO: 7171386 - DNA, 22 bp, Homo sapiens
tagcccagatgattgaaccatg

SEQ ID NO: 7171387 - DNA, 22 bp, Homo sapiens
tagcccagatgattgaaccatg

SEQ ID NO: 7171388 - DNA, 22 bp, Homo sapiens
tagcccagagtcccaattccag

SEQ ID NO: 7171389 - DNA, 22 bp, Homo sapiens
tagcccagatacaaatcatgat

SEQ ID NO: 7171390 - DNA, 22 bp, Homo sapiens
tagcccagatacaaatcatgat

SEQ ID NO: 7171391 - DNA, 22 bp, Homo sapiens
tagcccagatacaaatcatgat

SEQ ID NO: 7171392 - DNA, 22 bp, Homo sapiens
tagccatgttgttaaaagacaa

SEQ ID NO: 7171393 - DNA, 22 bp, Homo sapiens
tagccattgacttaaagcttat

SEQ ID NO: 7171394 - DNA, 22 bp, Homo sapiens
tagccatttttattaatgctgg

SEQ ID NO: 7171395 - DNA, 22 bp, Homo sapiens
tagcccagaaagcaaatgtctc

SEQ ID NO: 7171396 - DNA, 22 bp, Homo sapiens
tagcccagaaagcaaatgtctc

SEQ ID NO: 7171397 - DNA, 22 bp, Homo sapiens
tagcccagaagagggaagcaac

SEQ ID NO: 7171398 - DNA, 22 bp, Homo sapiens
tagcccagaagagggaagcaac

SEQ ID NO: 7171399 - DNA, 22 bp, Homo sapiens
tagcccagagagccaggggctt

SEQ ID NO: 7171400 - DNA, 22 bp, Homo sapiens
tagcccagagagccaggggctt

SEQ ID NO: 7171401 - DNA, 22 bp, Homo sapiens
tagcccagagagccaggggctt

SEQ ID NO: 7171402 - DNA, 22 bp, Homo sapiens
tagcccagagagccaggggctt

SEQ ID NO: 7171403 - DNA, 19 bp, Homo sapiens
tagcccagagcctggctac

SEQ ID NO: 7171404 - DNA, 19 bp, Homo sapiens
tagcccagagcctggctac

SEQ ID NO: 7171405 - DNA, 19 bp, Homo sapiens
tagcccagagcctggctac

SEQ ID NO: 7171406 - DNA, 19 bp, Homo sapiens
tagcccagagcctggctac

SEQ ID NO: 7171407 - DNA, 19 bp, Homo sapiens
tagcccagagcctggctac

SEQ ID NO: 7171408 - DNA, 22 bp, Homo sapiens
tagcccagagtcccaattccag

SEQ ID NO: 7171409 - DNA, 22 bp, Homo sapiens
tagcccagagtcccaattccag

SEQ ID NO: 7171410 - DNA, 22 bp, Homo sapiens
taggaaagcagtagagccagga

SEQ ID NO: 7171411 - DNA, 22 bp, Homo sapiens
taggaaagcagtagagccagga

SEQ ID NO: 7171412 - DNA, 22 bp, Homo sapiens
taggaaagcagtagagccagga

SEQ ID NO: 7171413 - DNA, 22 bp, Homo sapiens
taggaaagcagtagagccagga

SEQ ID NO: 7171414 - DNA, 22 bp, Homo sapiens
taggaaatactgtaagtttggg

SEQ ID NO: 7171415 - DNA, 22 bp, Homo sapiens
taggaaatattgatttcagtca

SEQ ID NO: 7171416 - DNA, 22 bp, Homo sapiens
taggaaatatttgaacatagga

SEQ ID NO: 7171417 - DNA, 22 bp, Homo sapiens
taggaaatatttgaacatagga

SEQ ID NO: 7171418 - DNA, 22 bp, Homo sapiens
taggaaatcagagaaagaggtg

SEQ ID NO: 7171419 - DNA, 18 bp, Homo sapiens
taggaagcttaatgtttt

SEQ ID NO: 7171420 - DNA, 22 bp, Homo sapiens
taggaagctgagcagcattcct

SEQ ID NO: 7171421 - DNA, 22 bp, Homo sapiens
taggaagctgatggaactagag

SEQ ID NO: 7171422 - DNA, 22 bp, Homo sapiens
taggaagctgagcagcattcct

SEQ ID NO: 7171423 - DNA, 22 bp, Homo sapiens
taggaagctatgggagatgtga

SEQ ID NO: 7171424 - DNA, 22 bp, Homo sapiens
taggaagctctttgttttgtga

SEQ ID NO: 7171425 - DNA, 22 bp, Homo sapiens
taggaagctctttgttttgtga

SEQ ID NO: 7171426 - DNA, 18 bp, Homo sapiens
taggaagcttaatgtttt

SEQ ID NO: 7171427 - DNA, 22 bp, Homo sapiens
taggaagcttccagaacttaag

SEQ ID NO: 7171428 - DNA, 22 bp, Homo sapiens
taggaaggaagagcctcagatt

SEQ ID NO: 7171429 - DNA, 22 bp, Homo sapiens
taggaaggaagagcctcagatt

SEQ ID NO: 7171430 - DNA, 22 bp, Homo sapiens
taggaaggaggccatcttggcg

SEQ ID NO: 7171431 - DNA, 22 bp, Homo sapiens
taggaaggaggccatcttggcg

SEQ ID NO: 7171432 - DNA, 22 bp, Homo sapiens
taggaagctatgggagatgtga

SEQ ID NO: 7171433 - DNA, 22 bp, Homo sapiens
taggaagcctgctgtgcacagc

SEQ ID NO: 7171434 - DNA, 22 bp, Homo sapiens
taggaagcgagcatctaactag

SEQ ID NO: 7171435 - DNA, 22 bp, Homo sapiens
taggaagcctaaattaagtggt

SEQ ID NO: 7171436 - DNA, 22 bp, Homo sapiens
taggaagcccttctgccatagt

SEQ ID NO: 7171437 - DNA, 22 bp, Homo sapiens
taggaagcctaaattaagtggt

SEQ ID NO: 7171438 - DNA, 22 bp, Homo sapiens
taggaagcactcatttaaagga

SEQ ID NO: 7171439 - DNA, 22 bp, Homo sapiens
taggaagcacttaaagaatttg

SEQ ID NO: 7171440 - DNA, 22 bp, Homo sapiens
taggaagcattatcatcactga

SEQ ID NO: 7171441 - DNA, 22 bp, Homo sapiens
taggaagcatttaaagagatgg

SEQ ID NO: 7171442 - DNA, 22 bp, Homo sapiens
taggaagatgagtatcaacttg

SEQ ID NO: 7171443 - DNA, 22 bp, Homo sapiens
taggaagatgagtatcaacttg

SEQ ID NO: 7171444 - DNA, 22 bp, Homo sapiens
taggaagatcaagtttatctca

SEQ ID NO: 7171445 - DNA, 22 bp, Homo sapiens
taggaagatcaagtttatctca

SEQ ID NO: 7171446 - DNA, 22 bp, Homo sapiens
taggaagatcaagtttatctca

SEQ ID NO: 7171447 - DNA, 22 bp, Homo sapiens
taggaagataaacatttgtatg

SEQ ID NO: 7171448 - DNA, 22 bp, Homo sapiens
taggaagataaacatttgtatg

SEQ ID NO: 7171449 - DNA, 22 bp, Homo sapiens
taggaagataaacatttgtatg

SEQ ID NO: 7171450 - DNA, 22 bp, Homo sapiens
taggaagataaacatttgtatg

SEQ ID NO: 7171451 - DNA, 22 bp, Homo sapiens
taggaagagctataggtcccca

SEQ ID NO: 7171452 - DNA, 23 bp, Homo sapiens
taggaagacagcaaaagaatgga

SEQ ID NO: 7171453 - DNA, 23 bp, Homo sapiens
taggaagacagcaaaagaatgga

SEQ ID NO: 7171454 - DNA, 23 bp, Homo sapiens
taggaagacagcaaaagaatgga

SEQ ID NO: 7171455 - DNA, 23 bp, Homo sapiens
taggaagacagcaaaagaatgga

SEQ ID NO: 7171456 - DNA, 22 bp, Homo sapiens
taggaacttagatgaacacatg

SEQ ID NO: 7171457 - DNA, 22 bp, Homo sapiens
taggaagaaactttccctgcag

SEQ ID NO: 7171458 - DNA, 22 bp, Homo sapiens
taggaagaaactttccctgcag

SEQ ID NO: 7171459 - DNA, 22 bp, Homo sapiens
taggaaatgctccattgcataa

SEQ ID NO: 7171460 - DNA, 22 bp, Homo sapiens
taggaaatgctccattgcataa

SEQ ID NO: 7171461 - DNA, 22 bp, Homo sapiens
taggaaatggctcagttactgc

SEQ ID NO: 7171462 - DNA, 22 bp, Homo sapiens
taggaatgtctatgcagtgagg

SEQ ID NO: 7171463 - DNA, 22 bp, Homo sapiens
taggaatgtggcaggcagaaca

SEQ ID NO: 7171464 - DNA, 22 bp, Homo sapiens
taggaatgtggcaggcagaaca

SEQ ID NO: 7171465 - DNA, 22 bp, Homo sapiens
taggaatgtttttatcaactta

SEQ ID NO: 7171466 - DNA, 22 bp, Homo sapiens
taggaatgtttttatcaactta

SEQ ID NO: 7171467 - DNA, 22 bp, Homo sapiens
taggaatttttgtaatggtact

SEQ ID NO: 7171468 - DNA, 23 bp, Homo sapiens
taggacagaatgcagaaaaatac

SEQ ID NO: 7171469 - DNA, 23 bp, Homo sapiens
taggacagaatgcagaaaaatac

SEQ ID NO: 7171470 - DNA, 22 bp, Homo sapiens
taggacagagatttgttttatg

SEQ ID NO: 7171471 - DNA, 22 bp, Homo sapiens
taggacagagatttgttttatg

SEQ ID NO: 7171472 - DNA, 22 bp, Homo sapiens
taggacagagatttgttttatg

SEQ ID NO: 7171473 - DNA, 22 bp, Homo sapiens
taggacagagctggttacaatg

SEQ ID NO: 7171474 - DNA, 22 bp, Homo sapiens
taggacagagctggttacaatg

SEQ ID NO: 7171475 - DNA, 22 bp, Homo sapiens
taggacagagctggttacaatg

SEQ ID NO: 7171476 - DNA, 22 bp, Homo sapiens
taggacagagttccctgatggc

SEQ ID NO: 7171477 - DNA, 22 bp, Homo sapiens
taggaatgattggaattccagg

SEQ ID NO: 7171478 - DNA, 22 bp, Homo sapiens
taggaatgcagatgcataataa

SEQ ID NO: 7171479 - DNA, 22 bp, Homo sapiens
taggaatgcagatgcataataa

SEQ ID NO: 7171480 - DNA, 22 bp, Homo sapiens
taggaatgcagtgagacacaga

SEQ ID NO: 7171481 - DNA, 22 bp, Homo sapiens
taggaatgcagtgagacacaga

SEQ ID NO: 7171482 - DNA, 22 bp, Homo sapiens
taggaatgcatgggggattctg

SEQ ID NO: 7171483 - DNA, 22 bp, Homo sapiens
taggaatggaacactttgattt

SEQ ID NO: 7171484 - DNA, 22 bp, Homo sapiens
taggaatggcagcagccggggg

SEQ ID NO: 7171485 - DNA, 22 bp, Homo sapiens
taggaatggcagcagccggggg

SEQ ID NO: 7171486 - DNA, 22 bp, Homo sapiens
taggaatgggcaagacaaagaa

SEQ ID NO: 7171487 - DNA, 22 bp, Homo sapiens
taggaatgggcaagacaaagaa

SEQ ID NO: 7171488 - DNA, 22 bp, Homo sapiens
taggaatgggctatcccaagct

SEQ ID NO: 7171489 - DNA, 22 bp, Homo sapiens
taggaatggtgctcagcagaaa

SEQ ID NO: 7171490 - DNA, 22 bp, Homo sapiens
taggaatggtgctcagcagaaa

SEQ ID NO: 7171491 - DNA, 22 bp, Homo sapiens
taggaatgtaatctctgttatg

SEQ ID NO: 7171492 - DNA, 19 bp, Homo sapiens
taggaatgtagaatcctag

SEQ ID NO: 7171493 - DNA, 22 bp, Homo sapiens
taggaatgtctatgcagtgagg

SEQ ID NO: 7171494 - DNA, 22 bp, Homo sapiens
taggaatgtctatgcagtgagg

SEQ ID NO: 7171495 - DNA, 22 bp, Homo sapiens
taggaaggcctgtcactacttg

SEQ ID NO: 7171496 - DNA, 22 bp, Homo sapiens
taggaagggaaaggcttcaact

SEQ ID NO: 7171497 - DNA, 22 bp, Homo sapiens
taggaagggaaaggcttcaact

SEQ ID NO: 7171498 - DNA, 22 bp, Homo sapiens
taggaagggctcagggctcggt

SEQ ID NO: 7171499 - DNA, 22 bp, Homo sapiens
taggaagggctcagggctcggt

SEQ ID NO: 7171500 - DNA, 22 bp, Homo sapiens
taggaaggtccatgtcttatct

SEQ ID NO: 7171501 - DNA, 22 bp, Homo sapiens
taggaaggtccatgtcttatct

SEQ ID NO: 7171502 - DNA, 22 bp, Homo sapiens
taggaaggtgtttttaaggagc

SEQ ID NO: 7171503 - DNA, 22 bp, Homo sapiens
taggaaggtgtttttaaggagc

SEQ ID NO: 7171504 - DNA, 22 bp, Homo sapiens
taggaatgatgtatttttctct

SEQ ID NO: 7171505 - DNA, 22 bp, Homo sapiens
taggaatgattggaattccagg

SEQ ID NO: 7171506 - DNA, 22 bp, Homo sapiens
taggaatgattggaattccagg

SEQ ID NO: 7171507 - DNA, 22 bp, Homo sapiens
taggaatgattggaattccagg

SEQ ID NO: 7171508 - DNA, 22 bp, Homo sapiens
taggaatgaaggataaggtgtg

SEQ ID NO: 7171509 - DNA, 22 bp, Homo sapiens
taggaatgagaaagaattagat

SEQ ID NO: 7171510 - DNA, 22 bp, Homo sapiens
taggaatgagagggtgaggatt

SEQ ID NO: 7171511 - DNA, 22 bp, Homo sapiens
taggaatgataatagtaaagag

SEQ ID NO: 7171512 - DNA, 22 bp, Homo sapiens
taggaatgaaaatggccataga

SEQ ID NO: 7171513 - DNA, 22 bp, Homo sapiens
taggaatgaaagtgttttgaaa

SEQ ID NO: 7171514 - DNA, 22 bp, Homo sapiens
taggaatgaagaagtatgatat

SEQ ID NO: 7171515 - DNA, 22 bp, Homo sapiens
taggaatgaagaagtatgatat

SEQ ID NO: 7171516 - DNA, 22 bp, Homo sapiens
taggctcacatagcactaagtg

SEQ ID NO: 7171517 - DNA, 22 bp, Homo sapiens
taggcgacagcttgatggtgcg

SEQ ID NO: 7171518 - DNA, 22 bp, Homo sapiens
taggctaaagctccggctctgg

SEQ ID NO: 7171519 - DNA, 22 bp, Homo sapiens
taggctaggctgaaggttttgg

SEQ ID NO: 7171520 - DNA, 22 bp, Homo sapiens
taggctcagggctgggtgacgg

SEQ ID NO: 7171521 - DNA, 22 bp, Homo sapiens
taggcctggtactgtgttaata

SEQ ID NO: 7171522 - DNA, 22 bp, Homo sapiens
taggctctagatgtggtctttg

SEQ ID NO: 7171523 - DNA, 23 bp, Homo sapiens
taggctctgtaggtagagatggg

SEQ ID NO: 7171524 - DNA, 22 bp, Homo sapiens
taggctcattaagtccccaggg

SEQ ID NO: 7171525 - DNA, 22 bp, Homo sapiens
taggctcattaagtccccaggg

SEQ ID NO: 7171526 - DNA, 22 bp, Homo sapiens
taggacagagctggttacaatg

SEQ ID NO: 7171527 - DNA, 22 bp, Homo sapiens
taggacagagttccctgatggc

SEQ ID NO: 7171528 - DNA, 22 bp, Homo sapiens
taggacagagttccctgatggc

SEQ ID NO: 7171529 - DNA, 22 bp, Homo sapiens
taggacagagttccctgatggc

SEQ ID NO: 7171530 - DNA, 21 bp, Homo sapiens
taggacagcccccctgccctc

SEQ ID NO: 7171531 - DNA, 21 bp, Homo sapiens
taggacagcccccctgccctc

SEQ ID NO: 7171532 - DNA, 21 bp, Homo sapiens
taggacagcccccctgccctc

SEQ ID NO: 7171533 - DNA, 22 bp, Homo sapiens
taggacaggatcatgatgctgg

SEQ ID NO: 7171534 - DNA, 22 bp, Homo sapiens
taggacaggatcatgatgctgg

SEQ ID NO: 7171535 - DNA, 22 bp, Homo sapiens
taggacaggatcatgatgctgg

SEQ ID NO: 7171536 - DNA, 22 bp, Homo sapiens
taggacaggatcatgatgctgg

SEQ ID NO: 7171537 - DNA, 20 bp, Homo sapiens
taggacaggcagccgagggg

SEQ ID NO: 7171538 - DNA, 20 bp, Homo sapiens
taggacaggcagccgagggg

SEQ ID NO: 7171539 - DNA, 20 bp, Homo sapiens
taggacaggcagccgagggg

SEQ ID NO: 7171540 - DNA, 22 bp, Homo sapiens
taggacaggctaaaagggataa

SEQ ID NO: 7171541 - DNA, 22 bp, Homo sapiens
taggacaggctaaaagggataa

SEQ ID NO: 7171542 - DNA, 22 bp, Homo sapiens
taggacagggacatctttttga

SEQ ID NO: 7171543 - DNA, 22 bp, Homo sapiens
taggacagggacatctttttga

SEQ ID NO: 7171544 - DNA, 20 bp, Homo sapiens
taggacagggcctggcttct

SEQ ID NO: 7171545 - DNA, 22 bp, Homo sapiens
taggacagggacatctttttga

SEQ ID NO: 7171546 - DNA, 20 bp, Homo sapiens
taggacagggcctggcttct

SEQ ID NO: 7171547 - DNA, 20 bp, Homo sapiens
taggacagggcctggcttct

SEQ ID NO: 7171548 - DNA, 22 bp, Homo sapiens
taggacaggtgaggggctgtgg

SEQ ID NO: 7171549 - DNA, 20 bp, Homo sapiens
taggacagggcctggcttct

SEQ ID NO: 7171550 - DNA, 22 bp, Homo sapiens
taggcccctagtgccacgtggc

SEQ ID NO: 7171551 - DNA, 22 bp, Homo sapiens
taggcccctagtgccacgtggc

SEQ ID NO: 7171552 - DNA, 19 bp, Homo sapiens
taggccctagctctgcagt

SEQ ID NO: 7171553 - DNA, 19 bp, Homo sapiens
taggccctagctctgcagt

SEQ ID NO: 7171554 - DNA, 19 bp, Homo sapiens
taggccctagctctgcagt

SEQ ID NO: 7171555 - DNA, 22 bp, Homo sapiens
taggcctggatctctgggagca

SEQ ID NO: 7171556 - DNA, 22 bp, Homo sapiens
tagaggcaccctggaggagact

SEQ ID NO: 7171557 - DNA, 22 bp, Homo sapiens
tagaggcaccctggaggagact

SEQ ID NO: 7171558 - DNA, 22 bp, Homo sapiens
tagaggcaaccagtgttgagaa

SEQ ID NO: 7171559 - DNA, 22 bp, Homo sapiens
tagaggatgcaggattgtttgt

SEQ ID NO: 7171560 - DNA, 23 bp, Homo sapiens
tagaggaggatgtgatgcatatt

SEQ ID NO: 7171561 - DNA, 22 bp, Homo sapiens
tagaggaggcaaggccctccct

SEQ ID NO: 7171562 - DNA, 22 bp, Homo sapiens
tagaggaggtgattcttgagct

SEQ ID NO: 7171563 - DNA, 22 bp, Homo sapiens
tagaggagggctgttcttcagt

SEQ ID NO: 7171564 - DNA, 22 bp, Homo sapiens
tagaggaggtgattcttgagct

SEQ ID NO: 7171565 - DNA, 22 bp, Homo sapiens
tagaggagagttgctggatgga

SEQ ID NO: 7171566 - DNA, 22 bp, Homo sapiens
tagaggagagttgctggatgga

SEQ ID NO: 7171567 - DNA, 22 bp, Homo sapiens
tagaggagcggcgagctgagct

SEQ ID NO: 7171568 - DNA, 22 bp, Homo sapiens
tagaggagcggcgagctgagct

SEQ ID NO: 7171569 - DNA, 22 bp, Homo sapiens
tagaggagcggcgagctgagct

SEQ ID NO: 7171570 - DNA, 22 bp, Homo sapiens
tagaggagcggcgagctgagct

SEQ ID NO: 7171571 - DNA, 22 bp, Homo sapiens
tagaggagcggcgagctgagct

SEQ ID NO: 7171572 - DNA, 23 bp, Homo sapiens
tagaggaggatgtgatgcatatt

SEQ ID NO: 7171573 - DNA, 23 bp, Homo sapiens
tagaggaggatgtgatgcatatt

SEQ ID NO: 7171574 - DNA, 22 bp, Homo sapiens
tagatggacgtcaagtctactc

SEQ ID NO: 7171575 - DNA, 22 bp, Homo sapiens
tagatgctgaaacatggaggcg

SEQ ID NO: 7171576 - DNA, 22 bp, Homo sapiens
tagatgctgagcttaagagaat

SEQ ID NO: 7171577 - DNA, 22 bp, Homo sapiens
tagatgctgtagaaatacttat

SEQ ID NO: 7171578 - DNA, 22 bp, Homo sapiens
tagaggcagaagaaattgacaa

SEQ ID NO: 7171579 - DNA, 22 bp, Homo sapiens
tagaggcaccctggaggagact

SEQ ID NO: 7171580 - DNA, 22 bp, Homo sapiens
tagatgatggaaaaaagcaata

SEQ ID NO: 7171581 - DNA, 22 bp, Homo sapiens
tagatgatggaaaaaagcaata

SEQ ID NO: 7171582 - DNA, 22 bp, Homo sapiens
tagatgatgtgactctcttgca

SEQ ID NO: 7171583 - DNA, 22 bp, Homo sapiens
tagatgcatagagcacagcaca

SEQ ID NO: 7171584 - DNA, 22 bp, Homo sapiens
tagagcagttggcagctgtatt

SEQ ID NO: 7171585 - DNA, 22 bp, Homo sapiens
tagagcagttggcagctgtatt

SEQ ID NO: 7171586 - DNA, 20 bp, Homo sapiens
tagagcatgaagtcctatcc

SEQ ID NO: 7171587 - DNA, 20 bp, Homo sapiens
tagagcatgaagtcctatcc

SEQ ID NO: 7171588 - DNA, 22 bp, Homo sapiens
tagagcattaagtattgttgtt

SEQ ID NO: 7171589 - DNA, 22 bp, Homo sapiens
tagagcattaagtattgttgtt

SEQ ID NO: 7171590 - DNA, 22 bp, Homo sapiens
tagagcattagaaattagtgta

SEQ ID NO: 7171591 - DNA, 22 bp, Homo sapiens
tagagcattatgacaaccccat

SEQ ID NO: 7171592 - DNA, 22 bp, Homo sapiens
tagagcattatgacaaccccat

SEQ ID NO: 7171593 - DNA, 22 bp, Homo sapiens
tagagcattctatctccaacag

SEQ ID NO: 7171594 - DNA, 22 bp, Homo sapiens
tagagcagccttcagagcagtt

SEQ ID NO: 7171595 - DNA, 22 bp, Homo sapiens
tagagcattctatctccaacag

SEQ ID NO: 7171596 - DNA, 23 bp, Homo sapiens
tagagcattgctgaggcctccct

SEQ ID NO: 7171597 - DNA, 23 bp, Homo sapiens
tagagcattgctgaggcctccct

SEQ ID NO: 7171598 - DNA, 22 bp, Homo sapiens
tagagcatttagaggggcagga

SEQ ID NO: 7171599 - DNA, 22 bp, Homo sapiens
tagagctagcttcaaaatgcga

SEQ ID NO: 7171600 - DNA, 22 bp, Homo sapiens
tagagctatacactgagtaaaa

SEQ ID NO: 7171601 - DNA, 22 bp, Homo sapiens
tagagctatttatcagccagaa

SEQ ID NO: 7171602 - DNA, 22 bp, Homo sapiens
tagagctgataatgaggccaag

SEQ ID NO: 7171603 - DNA, 22 bp, Homo sapiens
tagagcagaacttgttaacacc

SEQ ID NO: 7171604 - DNA, 21 bp, Homo sapiens
tagagatgtttgctaagtagc

SEQ ID NO: 7171605 - DNA, 22 bp, Homo sapiens
tagagcaatgctctactccttg

SEQ ID NO: 7171606 - DNA, 22 bp, Homo sapiens
tagagcagccttcagagcagtt

SEQ ID NO: 7171607 - DNA, 22 bp, Homo sapiens
tagagcagccttcagagcagtt

SEQ ID NO: 7171608 - DNA, 22 bp, Homo sapiens
tagagatagcagtattgattcg

SEQ ID NO: 7171609 - DNA, 22 bp, Homo sapiens
tagagatgaattctgcagtctt

SEQ ID NO: 7171610 - DNA, 22 bp, Homo sapiens
tagagatgaattctgcagtctt

SEQ ID NO: 7171611 - DNA, 22 bp, Homo sapiens
tagaatctggaaggggctattc

SEQ ID NO: 7171612 - DNA, 22 bp, Homo sapiens
tagaatctgcctgcagcaaaga

SEQ ID NO: 7171613 - DNA, 22 bp, Homo sapiens
tagaatctgaatattcttattt

SEQ ID NO: 7171614 - DNA, 23 bp, Homo sapiens
tagaatctgtatttctgcagttc

SEQ ID NO: 7171615 - DNA, 20 bp, Homo sapiens
tagaatctggtgatgtatcg

SEQ ID NO: 7171616 - DNA, 22 bp, Homo sapiens
tactttcatgtctatacatatt

SEQ ID NO: 7171617 - DNA, 22 bp, Homo sapiens
tactttctgtccttctgttaaa

SEQ ID NO: 7171618 - DNA, 22 bp, Homo sapiens
tactttctgtccttctgttaaa

SEQ ID NO: 7171619 - DNA, 22 bp, Homo sapiens
tactttcatgggttttctttat

SEQ ID NO: 7171620 - DNA, 22 bp, Homo sapiens
tacttgttaaaatattagctat

SEQ ID NO: 7171621 - DNA, 22 bp, Homo sapiens
tacttgttaggaatttctacta

SEQ ID NO: 7171622 - DNA, 22 bp, Homo sapiens
tactttattgtaaatgctgatg

SEQ ID NO: 7171623 - DNA, 22 bp, Homo sapiens
tacttgtggcagtttgaattta

SEQ ID NO: 7171624 - DNA, 22 bp, Homo sapiens
tacttgctgggtgtaattttct

SEQ ID NO: 7171625 - DNA, 22 bp, Homo sapiens
tacttgctgttagtattttaca

SEQ ID NO: 7171626 - DNA, 22 bp, Homo sapiens
tacttgctgttagtattttaca

SEQ ID NO: 7171627 - DNA, 22 bp, Homo sapiens
tacttgctgttagtattttaca

SEQ ID NO: 7171628 - DNA, 22 bp, Homo sapiens
tacttgcttggatttcaccaga

SEQ ID NO: 7171629 - DNA, 22 bp, Homo sapiens
tacttgcttggatttcaccaga

SEQ ID NO: 7171630 - DNA, 22 bp, Homo sapiens
tacttggattaataatttgttt

SEQ ID NO: 7171631 - DNA, 22 bp, Homo sapiens
tacttggtctgggcagggggtt

SEQ ID NO: 7171632 - DNA, 22 bp, Homo sapiens
tacttggtttagtttggaggga

SEQ ID NO: 7171633 - DNA, 22 bp, Homo sapiens
tactttgaagacaatatctgga

SEQ ID NO: 7171634 - DNA, 19 bp, Homo sapiens
tagaagcactaggcaaact

SEQ ID NO: 7171635 - DNA, 22 bp, Homo sapiens
tactttcttgttcctttcataa

SEQ ID NO: 7171636 - DNA, 22 bp, Homo sapiens
tactttcttgttcctttcataa

SEQ ID NO: 7171637 - DNA, 22 bp, Homo sapiens
tactttctttcccaagaggtgg

SEQ ID NO: 7171638 - DNA, 22 bp, Homo sapiens
tactttcttgttcctttcataa

SEQ ID NO: 7171639 - DNA, 22 bp, Homo sapiens
tagaagcactgacagagtttga

SEQ ID NO: 7171640 - DNA, 22 bp, Homo sapiens
tagaagcagcaggactcatggt

SEQ ID NO: 7171641 - DNA, 22 bp, Homo sapiens
tagaagcagcaggactcatggt

SEQ ID NO: 7171642 - DNA, 22 bp, Homo sapiens
tagaagcagcaggagtaaaggc

SEQ ID NO: 7171643 - DNA, 22 bp, Homo sapiens
tagaagcagcaggagtaaaggc

SEQ ID NO: 7171644 - DNA, 19 bp, Homo sapiens
tagaagcagggaagctgag

SEQ ID NO: 7171645 - DNA, 22 bp, Homo sapiens
tagaagcagtaatagaaatagg

SEQ ID NO: 7171646 - DNA, 22 bp, Homo sapiens
tagaagttcatgcgaattattt

SEQ ID NO: 7171647 - DNA, 22 bp, Homo sapiens
tagaagttatgataataatagt

SEQ ID NO: 7171648 - DNA, 22 bp, Homo sapiens
tagaagttatgataataatagt

SEQ ID NO: 7171649 - DNA, 22 bp, Homo sapiens
tagaagttgaactaaaaatatt

SEQ ID NO: 7171650 - DNA, 22 bp, Homo sapiens
tagaagttaggaaataggaata

SEQ ID NO: 7171651 - DNA, 22 bp, Homo sapiens
tagaagtgggaatataaaatat

SEQ ID NO: 7171652 - DNA, 22 bp, Homo sapiens
tagaagtgggaatataaaatat

SEQ ID NO: 7171653 - DNA, 22 bp, Homo sapiens
tagaagcagtaatagaaatagg

SEQ ID NO: 7171654 - DNA, 22 bp, Homo sapiens
tagaaggaggactggcagtgtt

SEQ ID NO: 7171655 - DNA, 22 bp, Homo sapiens
tagaaggcaggtggttggagtt

SEQ ID NO: 7171656 - DNA, 22 bp, Homo sapiens
tagaataagttgatgatatatg

SEQ ID NO: 7171657 - DNA, 22 bp, Homo sapiens
tagaatcagaagatttgactgt

SEQ ID NO: 7171658 - DNA, 22 bp, Homo sapiens
tagaatcagaagatttgactgt

SEQ ID NO: 7171659 - DNA, 22 bp, Homo sapiens
tagaataagttgatgatatatg

SEQ ID NO: 7171660 - DNA, 22 bp, Homo sapiens
tagaataagttgatgatatatg

SEQ ID NO: 7171661 - DNA, 22 bp, Homo sapiens
tagaatcatacctctaggaaca

SEQ ID NO: 7171662 - DNA, 22 bp, Homo sapiens
tagaatcatacctctaggaaca

SEQ ID NO: 7171663 - DNA, 22 bp, Homo sapiens
tagaatcattgagaataacagg

SEQ ID NO: 7171664 - DNA, 22 bp, Homo sapiens
tagaatccaagaaggtgagcaa

SEQ ID NO: 7171665 - DNA, 22 bp, Homo sapiens
tagaatccacctacacaagaga

SEQ ID NO: 7171666 - DNA, 22 bp, Homo sapiens
tagaatccagattctatgctaa

SEQ ID NO: 7171667 - DNA, 22 bp, Homo sapiens
tagaatcccagccagctggaag

SEQ ID NO: 7171668 - DNA, 23 bp, Homo sapiens
tagaatcctctgagatggaatag

SEQ ID NO: 7171669 - DNA, 21 bp, Homo sapiens
tagaatcctggactgggactc

SEQ ID NO: 7171670 - DNA, 22 bp, Homo sapiens
tagaatctagttcattcatttg

SEQ ID NO: 7171671 - DNA, 22 bp, Homo sapiens
tagccaggctgcagctgatccg

SEQ ID NO: 7171672 - DNA, 22 bp, Homo sapiens
tagccaggcgaggtcagtgtcg

SEQ ID NO: 7171673 - DNA, 22 bp, Homo sapiens
tagccaggcctttgatcccggc

SEQ ID NO: 7171674 - DNA, 22 bp, Homo sapiens
tagccaggcgaggtcagtgtcg

SEQ ID NO: 7171675 - DNA, 22 bp, Homo sapiens
tagccaggcgaggtcagtgtcg

SEQ ID NO: 7171676 - DNA, 22 bp, Homo sapiens
tagccaggcgaggtcagtgtcg

SEQ ID NO: 7171677 - DNA, 22 bp, Homo sapiens
tagccaggcctttgatcccggc

SEQ ID NO: 7171678 - DNA, 22 bp, Homo sapiens
tagccactattcctgagctaga

SEQ ID NO: 7171679 - DNA, 22 bp, Homo sapiens
tagccaggcaattatgggtgat

SEQ ID NO: 7171680 - DNA, 22 bp, Homo sapiens
tagccaggcaattatgggtgat

SEQ ID NO: 7171681 - DNA, 23 bp, Homo sapiens
tagccaggcccagcatggacacc

SEQ ID NO: 7171682 - DNA, 23 bp, Homo sapiens
tagccaggcccagcatggacacc

SEQ ID NO: 7171683 - DNA, 23 bp, Homo sapiens
tagccaggcccagcatggacacc

SEQ ID NO: 7171684 - DNA, 22 bp, Homo sapiens
tagccaggctggaagcaaaagg

SEQ ID NO: 7171685 - DNA, 22 bp, Homo sapiens
tagccaggctggaagcaaaagg

SEQ ID NO: 7171686 - DNA, 22 bp, Homo sapiens
tagccaggctgcagctgatccg

SEQ ID NO: 7171687 - DNA, 22 bp, Homo sapiens
tagccaggctgcagctgatccg

SEQ ID NO: 7171688 - DNA, 22 bp, Homo sapiens
tagccaggctgcagctgatccg

SEQ ID NO: 7171689 - DNA, 22 bp, Homo sapiens
tagccagggagacactgtggag

SEQ ID NO: 7171690 - DNA, 22 bp, Homo sapiens
tagccagggagacactgtggag

SEQ ID NO: 7171691 - DNA, 22 bp, Homo sapiens
tagccagggagacactgtggag

SEQ ID NO: 7171692 - DNA, 22 bp, Homo sapiens
tagccagggagacactgtggag

SEQ ID NO: 7171693 - DNA, 22 bp, Homo sapiens
tagccaggtcacactgtgtgtt

SEQ ID NO: 7171694 - DNA, 22 bp, Homo sapiens
tagccaggtcacactgtgtgtt

SEQ ID NO: 7171695 - DNA, 22 bp, Homo sapiens
tagccaggtcacactgtgtgtt

SEQ ID NO: 7171696 - DNA, 22 bp, Homo sapiens
tagccatcttcccaccccatct

SEQ ID NO: 7171697 - DNA, 22 bp, Homo sapiens
tagccatcattctcacattctt

SEQ ID NO: 7171698 - DNA, 22 bp, Homo sapiens
tagccatgtgtggaacacagcc

SEQ ID NO: 7171699 - DNA, 22 bp, Homo sapiens
tagccaaagaaggtatatttgt

SEQ ID NO: 7171700 - DNA, 22 bp, Homo sapiens
tagccaatctccagcataaatc

SEQ ID NO: 7171701 - DNA, 22 bp, Homo sapiens
tagccacatgcagactttcatg

SEQ ID NO: 7171702 - DNA, 22 bp, Homo sapiens
tagccacatgcagactttcatg

SEQ ID NO: 7171703 - DNA, 22 bp, Homo sapiens
tagccactacctataccataag

SEQ ID NO: 7171704 - DNA, 22 bp, Homo sapiens
tagcatttcccaaatgcatttg

SEQ ID NO: 7171705 - DNA, 22 bp, Homo sapiens
tagcatttcactgatcttcact

SEQ ID NO: 7171706 - DNA, 22 bp, Homo sapiens
tagcatttcactgatcttcact

SEQ ID NO: 7171707 - DNA, 22 bp, Homo sapiens
tagcatttattccagatttgga

SEQ ID NO: 7171708 - DNA, 22 bp, Homo sapiens
tagcagtgccctgtggaataag

SEQ ID NO: 7171709 - DNA, 22 bp, Homo sapiens
tagcagtggttcctacgtgttg

SEQ ID NO: 7171710 - DNA, 22 bp, Homo sapiens
tagcacattgttgaccagaagg

SEQ ID NO: 7171711 - DNA, 22 bp, Homo sapiens
tagcacagttcctgactctttg

SEQ ID NO: 7171712 - DNA, 22 bp, Homo sapiens
tagcacagttcctgactctttg

SEQ ID NO: 7171713 - DNA, 22 bp, Homo sapiens
tagcacagttcctgactctttg

SEQ ID NO: 7171714 - DNA, 22 bp, Homo sapiens
tagcacagttcctgactctttg

SEQ ID NO: 7171715 - DNA, 22 bp, Homo sapiens
tagcacagttcactatgataca

SEQ ID NO: 7171716 - DNA, 22 bp, Homo sapiens
tagcaccatacccggcagctcg

SEQ ID NO: 7171717 - DNA, 22 bp, Homo sapiens
tagcacctagagtattttatca

SEQ ID NO: 7171718 - DNA, 22 bp, Homo sapiens
tagcacctcaattttgcaaata

SEQ ID NO: 7171719 - DNA, 22 bp, Homo sapiens
tagcacctcaattttgcaaata

SEQ ID NO: 7171720 - DNA, 22 bp, Homo sapiens
tagcacctgatacctagtatgt

SEQ ID NO: 7171721 - DNA, 23 bp, Homo sapiens
tagcacctctcacatagtgggtt

SEQ ID NO: 7171722 - DNA, 23 bp, Homo sapiens
tagcacctctcacatagtgggtt

SEQ ID NO: 7171723 - DNA, 22 bp, Homo sapiens
tagcacctgcaggatgtgcaca

SEQ ID NO: 7171724 - DNA, 22 bp, Homo sapiens
tagcacctgcaggatgtgcaca

SEQ ID NO: 7171725 - DNA, 22 bp, Homo sapiens
tagcacctgtgcacaccaggca

SEQ ID NO: 7171726 - DNA, 22 bp, Homo sapiens
tagcaccttaactctgctgcgt

SEQ ID NO: 7171727 - DNA, 21 bp, Homo sapiens
tagcagaaacagttcaggcca

SEQ ID NO: 7171728 - DNA, 21 bp, Homo sapiens
tagcagaaacagttcaggcca

SEQ ID NO: 7171729 - DNA, 22 bp, Homo sapiens
tagcactgagtctagctttgga

SEQ ID NO: 7171730 - DNA, 22 bp, Homo sapiens
tagcaccttagcatttctagtg

SEQ ID NO: 7171731 - DNA, 22 bp, Homo sapiens
tagcacctggtcaattcagtca

SEQ ID NO: 7171732 - DNA, 22 bp, Homo sapiens
tagcaccttgacttcaggattt

SEQ ID NO: 7171733 - DNA, 22 bp, Homo sapiens
tagcactacttaggtacagcca

SEQ ID NO: 7171734 - DNA, 22 bp, Homo sapiens
tagcactatatgttagctatta

SEQ ID NO: 7171735 - DNA, 22 bp, Homo sapiens
tagcactatatgttagctatta

SEQ ID NO: 7171736 - DNA, 22 bp, Homo sapiens
tagcactatctattgcatgcaa

SEQ ID NO: 7171737 - DNA, 22 bp, Homo sapiens
tagcactatttttcactatcct

SEQ ID NO: 7171738 - DNA, 22 bp, Homo sapiens
tagcactatttttcactatcct

SEQ ID NO: 7171739 - DNA, 22 bp, Homo sapiens
tagcagaaccagtcagtgagcc

SEQ ID NO: 7171740 - DNA, 22 bp, Homo sapiens
tagcagaaccagcagtcaattt

SEQ ID NO: 7171741 - DNA, 22 bp, Homo sapiens
tagcagaacaatagtcaatgat

SEQ ID NO: 7171742 - DNA, 22 bp, Homo sapiens
tagcagggttttgaagagggtt

SEQ ID NO: 7171743 - DNA, 20 bp, Homo sapiens
tagcaggtagctgcacgttt

SEQ ID NO: 7171744 - DNA, 22 bp, Homo sapiens
tagcaggtgctcatttaactcc

SEQ ID NO: 7171745 - DNA, 22 bp, Homo sapiens
tagcaggttactattttaatat

SEQ ID NO: 7171746 - DNA, 22 bp, Homo sapiens
tagcagtcatcggcagagaaaa

SEQ ID NO: 7171747 - DNA, 22 bp, Homo sapiens
tagcagtctggtgggcagattc

SEQ ID NO: 7171748 - DNA, 22 bp, Homo sapiens
tagcagtctggtgggcagattc

SEQ ID NO: 7171749 - DNA, 22 bp, Homo sapiens
tagcagtctttctttgggacta

SEQ ID NO: 7171750 - DNA, 21 bp, Homo sapiens
tagcagtgaatccatacgggt

SEQ ID NO: 7171751 - DNA, 22 bp, Homo sapiens
tagcagtgcacagtaggacacc

SEQ ID NO: 7171752 - DNA, 22 bp, Homo sapiens
tagatgttgaagtcatatttgg

SEQ ID NO: 7171753 - DNA, 22 bp, Homo sapiens
tagatgttccacatatatatgt

SEQ ID NO: 7171754 - DNA, 22 bp, Homo sapiens
tagatgttgaagtcatatttgg

SEQ ID NO: 7171755 - DNA, 22 bp, Homo sapiens
tagatgttggtgagtgctgagg

SEQ ID NO: 7171756 - DNA, 22 bp, Homo sapiens
tagatgttggtgagtgctgagg

SEQ ID NO: 7171757 - DNA, 20 bp, Homo sapiens
tagatgtttcctgtcataaa

SEQ ID NO: 7171758 - DNA, 20 bp, Homo sapiens
tagatgtttcctgtcataaa

SEQ ID NO: 7171759 - DNA, 20 bp, Homo sapiens
tagatgtttcctgtcataaa

SEQ ID NO: 7171760 - DNA, 22 bp, Homo sapiens
tagatgtttccttccatgtgga

SEQ ID NO: 7171761 - DNA, 22 bp, Homo sapiens
tagatgtttgagaagtttatgt

SEQ ID NO: 7171762 - DNA, 22 bp, Homo sapiens
tagatgtttgagaagtttatgt

SEQ ID NO: 7171763 - DNA, 23 bp, Homo sapiens
tagatgtttggggaactttgccc

SEQ ID NO: 7171764 - DNA, 22 bp, Homo sapiens
tagatgttttaactcttggtta

SEQ ID NO: 7171765 - DNA, 22 bp, Homo sapiens
tagatgttttgatatttgctga

SEQ ID NO: 7171766 - DNA, 22 bp, Homo sapiens
tagatgtagccactgctaaaag

SEQ ID NO: 7171767 - DNA, 22 bp, Homo sapiens
tagatgtaaaattgagactatt

SEQ ID NO: 7171768 - DNA, 22 bp, Homo sapiens
tagatgtaagcagaagaacagc

SEQ ID NO: 7171769 - DNA, 22 bp, Homo sapiens
tagatgttaagcttctagaagg

SEQ ID NO: 7171770 - DNA, 22 bp, Homo sapiens
tagatgtgttgcctggagttgt

SEQ ID NO: 7171771 - DNA, 22 bp, Homo sapiens
tagatgtgttgcctggagttgt

SEQ ID NO: 7171772 - DNA, 22 bp, Homo sapiens
tagatgttaagcttctagaagg

SEQ ID NO: 7171773 - DNA, 22 bp, Homo sapiens
tagatgtgttgcctggagttgt

SEQ ID NO: 7171774 - DNA, 22 bp, Homo sapiens
tagattttacttctgtcattac

SEQ ID NO: 7171775 - DNA, 22 bp, Homo sapiens
tagattttacttctgtcattac

SEQ ID NO: 7171776 - DNA, 22 bp, Homo sapiens
tagatttgtttccttctctcca

SEQ ID NO: 7171777 - DNA, 18 bp, Homo sapiens
tagattaaaattgaattc

SEQ ID NO: 7171778 - DNA, 18 bp, Homo sapiens
tagattaaaattgaattc

SEQ ID NO: 7171779 - DNA, 17 bp, Homo sapiens
tagattaaacacggcca

SEQ ID NO: 7171780 - DNA, 22 bp, Homo sapiens
tagattaacagttttgttgaag

SEQ ID NO: 7171781 - DNA, 22 bp, Homo sapiens
tagattaacagttttgttgaag

SEQ ID NO: 7171782 - DNA, 22 bp, Homo sapiens
tagattaagatgccagttttga

SEQ ID NO: 7171783 - DNA, 22 bp, Homo sapiens
tagattttaggagattttactg

SEQ ID NO: 7171784 - DNA, 22 bp, Homo sapiens
tagattttacttctgtcattac

SEQ ID NO: 7171785 - DNA, 22 bp, Homo sapiens
tagattttgcatttctaacaag

SEQ ID NO: 7171786 - DNA, 22 bp, Homo sapiens
tagattttttggagactctctg

SEQ ID NO: 7171787 - DNA, 22 bp, Homo sapiens
tagcaaaaaaactggcatctcc

SEQ ID NO: 7171788 - DNA, 22 bp, Homo sapiens
tagcaaaaaaactggcatctcc

SEQ ID NO: 7171789 - DNA, 22 bp, Homo sapiens
tagcacaggtcttgttgccatt

SEQ ID NO: 7171790 - DNA, 22 bp, Homo sapiens
tagcacaggtcttgttgccatt

SEQ ID NO: 7171791 - DNA, 22 bp, Homo sapiens
tagcacaggtcttgttgccatt

SEQ ID NO: 7171792 - DNA, 22 bp, Homo sapiens
tagcacaggtcttgttgccatt

SEQ ID NO: 7171793 - DNA, 22 bp, Homo sapiens
tagcacaggtcttgttgccatt

SEQ ID NO: 7171794 - DNA, 22 bp, Homo sapiens
tagcacagggcatatgcggtgg

SEQ ID NO: 7171795 - DNA, 22 bp, Homo sapiens
tagcacagggcatatgcggtgg

SEQ ID NO: 7171796 - DNA, 22 bp, Homo sapiens
tagcacagggctcctcaaccca

SEQ ID NO: 7171797 - DNA, 22 bp, Homo sapiens
tagcacagggctcctcaaccca

SEQ ID NO: 7171798 - DNA, 22 bp, Homo sapiens
tagcacaggtcttgttgccatt

SEQ ID NO: 7171799 - DNA, 22 bp, Homo sapiens
tagcacagtatttctcaactgg

SEQ ID NO: 7171800 - DNA, 22 bp, Homo sapiens
tagcacagtatttctcaactgg

SEQ ID NO: 7171801 - DNA, 22 bp, Homo sapiens
tagcacagtatttctcaactgg

SEQ ID NO: 7171802 - DNA, 22 bp, Homo sapiens
tagcacagtatttctcaactgg

SEQ ID NO: 7171803 - DNA, 17 bp, Homo sapiens
tagcacagtgcctggta

SEQ ID NO: 7171804 - DNA, 17 bp, Homo sapiens
tagcacagtgcctggta

SEQ ID NO: 7171805 - DNA, 17 bp, Homo sapiens
tagcacagtgcctggta

SEQ ID NO: 7171806 - DNA, 17 bp, Homo sapiens
tagcacagtgcctggta

SEQ ID NO: 7171807 - DNA, 22 bp, Homo sapiens
tagcacagtgttcacaacagtg

SEQ ID NO: 7171808 - DNA, 22 bp, Homo sapiens
tagcacagtgttcacaacagtg

SEQ ID NO: 7171809 - DNA, 22 bp, Homo sapiens
tagcacagttcactatgataca

SEQ ID NO: 7171810 - DNA, 22 bp, Homo sapiens
tagcacagttcactatgataca

SEQ ID NO: 7171811 - DNA, 18 bp, Homo sapiens
tagcacagagcaggatgt

SEQ ID NO: 7171812 - DNA, 18 bp, Homo sapiens
tagcacagagcaggatgt

SEQ ID NO: 7171813 - DNA, 18 bp, Homo sapiens
tagcacagagcaggatgt

SEQ ID NO: 7171814 - DNA, 18 bp, Homo sapiens
tagcacagagcaggatgt

SEQ ID NO: 7171815 - DNA, 22 bp, Homo sapiens
tagcacagacagaatggtcata

SEQ ID NO: 7171816 - DNA, 22 bp, Homo sapiens
tagcacagacagaatggtcata

SEQ ID NO: 7171817 - DNA, 22 bp, Homo sapiens
tagcacagacagaatggtcata

SEQ ID NO: 7171818 - DNA, 18 bp, Homo sapiens
tagcacagagcaggatgt

SEQ ID NO: 7171819 - DNA, 22 bp, Homo sapiens
tagcacagagcttttaaacttc

SEQ ID NO: 7171820 - DNA, 22 bp, Homo sapiens
tagcacagagcttttaaacttc

SEQ ID NO: 7171821 - DNA, 22 bp, Homo sapiens
tagcacagagcttttaaacttc

SEQ ID NO: 7171822 - DNA, 21 bp, Homo sapiens
tagcacagctgtagacagttt

SEQ ID NO: 7171823 - DNA, 21 bp, Homo sapiens
tagcacagctgtagacagttt

SEQ ID NO: 7171824 - DNA, 22 bp, Homo sapiens
tagcacagcttcttgatgtcac

SEQ ID NO: 7171825 - DNA, 22 bp, Homo sapiens
tagcacagcttcttgatgtcac

SEQ ID NO: 7171826 - DNA, 22 bp, Homo sapiens
tagcacagcttcttgatgtcac

SEQ ID NO: 7171827 - DNA, 22 bp, Homo sapiens
tagcaagacaacttttctcagt

SEQ ID NO: 7171828 - DNA, 22 bp, Homo sapiens
tagcaaaaaaactggcatctcc

SEQ ID NO: 7171829 - DNA, 22 bp, Homo sapiens
tagcaaaaactgcagttacttt

SEQ ID NO: 7171830 - DNA, 22 bp, Homo sapiens
tagcaagaggtgaaggtttcat

SEQ ID NO: 7171831 - DNA, 22 bp, Homo sapiens
tagcacaagaagtacacataga

SEQ ID NO: 7171832 - DNA, 22 bp, Homo sapiens
tagcacaagaagtacacataga

SEQ ID NO: 7171833 - DNA, 22 bp, Homo sapiens
tagcacaagaagtacacataga

SEQ ID NO: 7171834 - DNA, 22 bp, Homo sapiens
tagcacaagcaactactgaagt

SEQ ID NO: 7171835 - DNA, 22 bp, Homo sapiens
gtgcaataaataaatagattgt

SEQ ID NO: 7171836 - DNA, 22 bp, Homo sapiens
gtgcaaattccactggaaagct

SEQ ID NO: 7171837 - DNA, 22 bp, Homo sapiens
gtgcaaatgtaattgtggtttt

SEQ ID NO: 7171838 - DNA, 22 bp, Homo sapiens
gtgcaaatgtaattgtggtttt

SEQ ID NO: 7171839 - DNA, 22 bp, Homo sapiens
gtgcaaattccactggaaagct

SEQ ID NO: 7171840 - DNA, 22 bp, Homo sapiens
gtgcaaattccactggaaagct

SEQ ID NO: 7171841 - DNA, 22 bp, Homo sapiens
gtgcacactcttggggcacttt

SEQ ID NO: 7171842 - DNA, 22 bp, Homo sapiens
gtgcaattcactgttatgtctg

SEQ ID NO: 7171843 - DNA, 22 bp, Homo sapiens
gtgcaatgaaactgttttgtgg

SEQ ID NO: 7171844 - DNA, 22 bp, Homo sapiens
gtgcacagaaacatacaatgtg

SEQ ID NO: 7171845 - DNA, 22 bp, Homo sapiens
gtgcccaggggccagctgccgg

SEQ ID NO: 7171846 - DNA, 22 bp, Homo sapiens
gtgcccaggtgtccctgagaag

SEQ ID NO: 7171847 - DNA, 22 bp, Homo sapiens
gtgcccaggtgtccctgagaag

SEQ ID NO: 7171848 - DNA, 22 bp, Homo sapiens
gtgcccaggtgtccctgagaag

SEQ ID NO: 7171849 - DNA, 22 bp, Homo sapiens
gtgccctgatcgctaggctccc

SEQ ID NO: 7171850 - DNA, 22 bp, Homo sapiens
gtgccctgcatgccccgggtat

SEQ ID NO: 7171851 - DNA, 22 bp, Homo sapiens
gtgcaaaaataattgtggtttt

SEQ ID NO: 7171852 - DNA, 22 bp, Homo sapiens
gtgcaaaaataattgtggtttt

SEQ ID NO: 7171853 - DNA, 22 bp, Homo sapiens
gtgcaaaagcaattgcagtttt

SEQ ID NO: 7171854 - DNA, 22 bp, Homo sapiens
gtgcaaaagcagttggattttt

SEQ ID NO: 7171855 - DNA, 22 bp, Homo sapiens
gtgcaaaagcagttgtggtttt

SEQ ID NO: 7171856 - DNA, 22 bp, Homo sapiens
gtgcaaaagcagttgtggtttt

SEQ ID NO: 7171857 - DNA, 22 bp, Homo sapiens
gtgcaaaaggcattgtggtttt

SEQ ID NO: 7171858 - DNA, 22 bp, Homo sapiens
gtgcaaaaggcattgtggtttt

SEQ ID NO: 7171859 - DNA, 22 bp, Homo sapiens
gtgcaaaagtaaatgtggtttt

SEQ ID NO: 7171860 - DNA, 22 bp, Homo sapiens
gtgcaaaagtaaatgtggtttt

SEQ ID NO: 7171861 - DNA, 22 bp, Homo sapiens
gtgcaaaagtaactgtggtttt

SEQ ID NO: 7171862 - DNA, 22 bp, Homo sapiens
gtgcaaaagtaactgtggtttt

SEQ ID NO: 7171863 - DNA, 22 bp, Homo sapiens
gtgcaaatgtaattgccattga

SEQ ID NO: 7171864 - DNA, 22 bp, Homo sapiens
gtgcaaatgtaattgtgatttt

SEQ ID NO: 7171865 - DNA, 22 bp, Homo sapiens
gtgcaaatgtaattgtgatttt

SEQ ID NO: 7171866 - DNA, 22 bp, Homo sapiens
gtgattctggcaggcagaaggg

SEQ ID NO: 7171867 - DNA, 22 bp, Homo sapiens
gtgattcttcctgctggcatac

SEQ ID NO: 7171868 - DNA, 22 bp, Homo sapiens
gtgattcttcctgctggcatac

SEQ ID NO: 7171869 - DNA, 22 bp, Homo sapiens
gtgattctttgatctatgaaag

SEQ ID NO: 7171870 - DNA, 22 bp, Homo sapiens
gtgatttagatgttgaaagtga

SEQ ID NO: 7171871 - DNA, 22 bp, Homo sapiens
gtgatttcaaatatagagtgag

SEQ ID NO: 7171872 - DNA, 23 bp, Homo sapiens
gtgatttcagggaacagaatcag

SEQ ID NO: 7171873 - DNA, 22 bp, Homo sapiens
gtgatttctaatcatctgaatg

SEQ ID NO: 7171874 - DNA, 22 bp, Homo sapiens
gtgattatatttctatgtgaat

SEQ ID NO: 7171875 - DNA, 22 bp, Homo sapiens
gtgattctcaaattgtgatatc

SEQ ID NO: 7171876 - DNA, 22 bp, Homo sapiens
gtgattctgaaatattagaaaa

SEQ ID NO: 7171877 - DNA, 22 bp, Homo sapiens
gtgattctgaccttcagggagt

SEQ ID NO: 7171878 - DNA, 22 bp, Homo sapiens
gtgattctgatatagctaaagt

SEQ ID NO: 7171879 - DNA, 22 bp, Homo sapiens
gtgcctgaaagccatgctcact

SEQ ID NO: 7171880 - DNA, 22 bp, Homo sapiens
gtgcctgagccagctgcagctc

SEQ ID NO: 7171881 - DNA, 22 bp, Homo sapiens
gtgctgggattacaggtgtgag

SEQ ID NO: 7171882 - DNA, 22 bp, Homo sapiens
gtgctgggattacaggtgtgag

SEQ ID NO: 7171883 - DNA, 22 bp, Homo sapiens
gtgcctccttaaattctgcacc

SEQ ID NO: 7171884 - DNA, 22 bp, Homo sapiens
gtgcctccttaaattctgcacc

SEQ ID NO: 7171885 - DNA, 22 bp, Homo sapiens
gtgcctcccggggctcttcctt

SEQ ID NO: 7171886 - DNA, 22 bp, Homo sapiens
gtgcctccctgttgactagggt

SEQ ID NO: 7171887 - DNA, 22 bp, Homo sapiens
gtgcctccatcagtgcctccaa

SEQ ID NO: 7171888 - DNA, 22 bp, Homo sapiens
gtgcctccatcagtgcctccaa

SEQ ID NO: 7171889 - DNA, 22 bp, Homo sapiens
gtgcctccatcagtgcctccaa

SEQ ID NO: 7171890 - DNA, 22 bp, Homo sapiens
gtgcctccatcagtgcctccaa

SEQ ID NO: 7171891 - DNA, 22 bp, Homo sapiens
gtgcctcccgggaccatgcact

SEQ ID NO: 7171892 - DNA, 22 bp, Homo sapiens
gtgcctcccgggaccatgcact

SEQ ID NO: 7171893 - DNA, 22 bp, Homo sapiens
gtgcctcccggggctcttcctt

SEQ ID NO: 7171894 - DNA, 22 bp, Homo sapiens
gtgccgcgacgcagtcggtgcc

SEQ ID NO: 7171895 - DNA, 22 bp, Homo sapiens
gtgccgtgggccttagtgatct

SEQ ID NO: 7171896 - DNA, 22 bp, Homo sapiens
gtgcctatgcctgttaatgtct

SEQ ID NO: 7171897 - DNA, 22 bp, Homo sapiens
gtgcctcagcaccgcctgcagc

SEQ ID NO: 7171898 - DNA, 22 bp, Homo sapiens
gtgcctccaggctcgactagtc

SEQ ID NO: 7171899 - DNA, 21 bp, Homo sapiens
gtgccctgttcccacatgccc

SEQ ID NO: 7171900 - DNA, 22 bp, Homo sapiens
gtgccctgttgcacacttgagg

SEQ ID NO: 7171901 - DNA, 22 bp, Homo sapiens
gtgccctgggccttcagggcca

SEQ ID NO: 7171902 - DNA, 22 bp, Homo sapiens
gtgccctggctcacagtgtctc

SEQ ID NO: 7171903 - DNA, 22 bp, Homo sapiens
gtgccctggctcacagtgtctc

SEQ ID NO: 7171904 - DNA, 22 bp, Homo sapiens
gtgccctggtccccagcatata

SEQ ID NO: 7171905 - DNA, 22 bp, Homo sapiens
gtgcttgggggaagtaacagac

SEQ ID NO: 7171906 - DNA, 22 bp, Homo sapiens
gtgcttgatctcacctgatctc

SEQ ID NO: 7171907 - DNA, 23 bp, Homo sapiens
gtgctgtgagccccttggcctcc

SEQ ID NO: 7171908 - DNA, 22 bp, Homo sapiens
gtgctgtattgagacaaggtcg

SEQ ID NO: 7171909 - DNA, 22 bp, Homo sapiens
gtgctgtaacaacagagtgtct

SEQ ID NO: 7171910 - DNA, 22 bp, Homo sapiens
gtgctgggggtttctgtaggtc

SEQ ID NO: 7171911 - DNA, 22 bp, Homo sapiens
gtgctgggtgctgcagacaggt

SEQ ID NO: 7171912 - DNA, 22 bp, Homo sapiens
gtgctgggtgctgcagacaggt

SEQ ID NO: 7171913 - DNA, 22 bp, Homo sapiens
gtgctgggtgctgcagacaggt

SEQ ID NO: 7171914 - DNA, 22 bp, Homo sapiens
gtgctgggggtttctgtaggtc

SEQ ID NO: 7171915 - DNA, 22 bp, Homo sapiens
gtgctgggggtttctgtaggtc

SEQ ID NO: 7171916 - DNA, 22 bp, Homo sapiens
gtgctgggggtttctgtaggtc

SEQ ID NO: 7171917 - DNA, 22 bp, Homo sapiens
gtgctgggggtttctgtaggtc

SEQ ID NO: 7171918 - DNA, 22 bp, Homo sapiens
gtgctgggggtttctgtaggtc

SEQ ID NO: 7171919 - DNA, 22 bp, Homo sapiens
gtgctggggagataggaagaga

SEQ ID NO: 7171920 - DNA, 22 bp, Homo sapiens
gtgctggggagataggaagaga

SEQ ID NO: 7171921 - DNA, 22 bp, Homo sapiens
gtgctggggagataggaagaga

SEQ ID NO: 7171922 - DNA, 22 bp, Homo sapiens
gtgctggggagataggaagaga

SEQ ID NO: 7171923 - DNA, 22 bp, Homo sapiens
gtgctggggagataggaagaga

SEQ ID NO: 7171924 - DNA, 22 bp, Homo sapiens
gtgctgggctccaccccagagg

SEQ ID NO: 7171925 - DNA, 22 bp, Homo sapiens
gtgctgggccctgagaccaggg

SEQ ID NO: 7171926 - DNA, 22 bp, Homo sapiens
gtgctgggattacaggtgtgag

SEQ ID NO: 7171927 - DNA, 22 bp, Homo sapiens
gtgctgggccctgagaccaggg

SEQ ID NO: 7171928 - DNA, 22 bp, Homo sapiens
gtgatcctataaagtgagcaca

SEQ ID NO: 7171929 - DNA, 23 bp, Homo sapiens
gtgatattaaggatagagacaag

SEQ ID NO: 7171930 - DNA, 22 bp, Homo sapiens
gtgatatttcaagagtggggca

SEQ ID NO: 7171931 - DNA, 22 bp, Homo sapiens
gtgatatttttaaagattaagg

SEQ ID NO: 7171932 - DNA, 22 bp, Homo sapiens
gtgatatttttaaagattaagg

SEQ ID NO: 7171933 - DNA, 22 bp, Homo sapiens
gtgatatttttaaagattaagg

SEQ ID NO: 7171934 - DNA, 22 bp, Homo sapiens
gtgatcactgcttcttccacca

SEQ ID NO: 7171935 - DNA, 22 bp, Homo sapiens
gtgatcactgcttcttccacca

SEQ ID NO: 7171936 - DNA, 22 bp, Homo sapiens
gtgataattgcagagaaaggag

SEQ ID NO: 7171937 - DNA, 22 bp, Homo sapiens
gtgatatcttacaattctcttt

SEQ ID NO: 7171938 - DNA, 22 bp, Homo sapiens
gtgatggagtcaaggctagaac

SEQ ID NO: 7171939 - DNA, 22 bp, Homo sapiens
gtgatggaataatccaagattt

SEQ ID NO: 7171940 - DNA, 22 bp, Homo sapiens
gtgatgggtaactgtttaggga

SEQ ID NO: 7171941 - DNA, 22 bp, Homo sapiens
gtgatgtagccctaattctgca

SEQ ID NO: 7171942 - DNA, 22 bp, Homo sapiens
gtgatgtggggaccgtcctggc

SEQ ID NO: 7171943 - DNA, 22 bp, Homo sapiens
gtgatgttatgaagatgaatgt

SEQ ID NO: 7171944 - DNA, 22 bp, Homo sapiens
gtgagtgttaacccactgcttc

SEQ ID NO: 7171945 - DNA, 22 bp, Homo sapiens
gtgagtgtcagtcaaaggtttt

SEQ ID NO: 7171946 - DNA, 22 bp, Homo sapiens
gtgataaaatagaaacagtggt

SEQ ID NO: 7171947 - DNA, 22 bp, Homo sapiens
gtgataaaatagaaacagtggt

SEQ ID NO: 7171948 - DNA, 22 bp, Homo sapiens
gtgataaaggggaggaagtgtg

SEQ ID NO: 7171949 - DNA, 22 bp, Homo sapiens
gtgataaaggggaggaagtgtg

SEQ ID NO: 7171950 - DNA, 22 bp, Homo sapiens
gtgataaaattcaaatagctct

SEQ ID NO: 7171951 - DNA, 22 bp, Homo sapiens
gtgataaagacgtgtcataatt

SEQ ID NO: 7171952 - DNA, 22 bp, Homo sapiens
gtgataaagacgtgtcataatt

SEQ ID NO: 7171953 - DNA, 22 bp, Homo sapiens
gtgataaaatagaaacagtggt

SEQ ID NO: 7171954 - DNA, 22 bp, Homo sapiens
gtgataaaattcaaatagctct

SEQ ID NO: 7171955 - DNA, 22 bp, Homo sapiens
gtgagtgtcagtcaaaggtttt

SEQ ID NO: 7171956 - DNA, 23 bp, Homo sapiens
gtgagtcttgcctttgctgtgga

SEQ ID NO: 7171957 - DNA, 22 bp, Homo sapiens
gtgaggtggtacaatattaact

SEQ ID NO: 7171958 - DNA, 22 bp, Homo sapiens
gtgaggtggtacaatattaact

SEQ ID NO: 7171959 - DNA, 22 bp, Homo sapiens
gtgaggtggtacaatattaact

SEQ ID NO: 7171960 - DNA, 22 bp, Homo sapiens
gtgaggtggtacaatattaact

SEQ ID NO: 7171961 - DNA, 22 bp, Homo sapiens
gtgaggtgagtagtgagaagcc

SEQ ID NO: 7171962 - DNA, 22 bp, Homo sapiens
gtgaggtgggctggccagagac

SEQ ID NO: 7171963 - DNA, 22 bp, Homo sapiens
gtgaggtgggctggccagagac

SEQ ID NO: 7171964 - DNA, 22 bp, Homo sapiens
gtgaggtgactagcaggtgggg

SEQ ID NO: 7171965 - DNA, 22 bp, Homo sapiens
gtgaggtgactagcaggtgggg

SEQ ID NO: 7171966 - DNA, 22 bp, Homo sapiens
gtgagggaggtagatttcatca

SEQ ID NO: 7171967 - DNA, 22 bp, Homo sapiens
gtgaggcagggaaagaggataa

SEQ ID NO: 7171968 - DNA, 22 bp, Homo sapiens
gtgaggcattgaagaccggaat

SEQ ID NO: 7171969 - DNA, 22 bp, Homo sapiens
gtgaggccgcacgccccggagt

SEQ ID NO: 7171970 - DNA, 22 bp, Homo sapiens
gtgaggcattgaagaccggaat

SEQ ID NO: 7171971 - DNA, 22 bp, Homo sapiens
gtgaggctactcagctgtccga

SEQ ID NO: 7171972 - DNA, 22 bp, Homo sapiens
gtcttctgttctgtgaggcttc

SEQ ID NO: 7171973 - DNA, 22 bp, Homo sapiens
gtcttctgttctgtgaggcttc

SEQ ID NO: 7171974 - DNA, 22 bp, Homo sapiens
gtcttcttttcagtctgcttgt

SEQ ID NO: 7171975 - DNA, 22 bp, Homo sapiens
gtcttcttttcagtctgcttgt

SEQ ID NO: 7171976 - DNA, 22 bp, Homo sapiens
gtcttgaaaagtggccagtttg

SEQ ID NO: 7171977 - DNA, 22 bp, Homo sapiens
gtcttgaaattctgttaaagga

SEQ ID NO: 7171978 - DNA, 22 bp, Homo sapiens
gtcttgatctcctgaccttgtg

SEQ ID NO: 7171979 - DNA, 22 bp, Homo sapiens
gtcttgatctcctgaccttgtg

SEQ ID NO: 7171980 - DNA, 22 bp, Homo sapiens
gtcttgatctcctgaccttgtg

SEQ ID NO: 7171981 - DNA, 22 bp, Homo sapiens
gtgaggcagggaaagaggataa

SEQ ID NO: 7171982 - DNA, 22 bp, Homo sapiens
gtcttctttaacctactaaagc

SEQ ID NO: 7171983 - DNA, 22 bp, Homo sapiens
gtctcctggaaatatgcccata

SEQ ID NO: 7171984 - DNA, 22 bp, Homo sapiens
gtctcctgctagcaagcaccac

SEQ ID NO: 7171985 - DNA, 22 bp, Homo sapiens
gtctcctgctagcaagcaccac

SEQ ID NO: 7171986 - DNA, 22 bp, Homo sapiens
gtctcctgctagcaagcaccac

SEQ ID NO: 7171987 - DNA, 22 bp, Homo sapiens
gtctcctgccacactcagtccc

SEQ ID NO: 7171988 - DNA, 22 bp, Homo sapiens
gtctcctgcccccggtgcttgg

SEQ ID NO: 7171989 - DNA, 22 bp, Homo sapiens
gtctcctggcttttgtcccagt

SEQ ID NO: 7171990 - DNA, 22 bp, Homo sapiens
gtctcctggcttttgtcccagt

SEQ ID NO: 7171991 - DNA, 22 bp, Homo sapiens
gtctcctggctgcagctaagac

SEQ ID NO: 7171992 - DNA, 22 bp, Homo sapiens
gtctcctggctgcagctaagac

SEQ ID NO: 7171993 - DNA, 22 bp, Homo sapiens
gtctcctggcctccagtttctc

SEQ ID NO: 7171994 - DNA, 22 bp, Homo sapiens
gtctcctggcctccagtttctc

SEQ ID NO: 7171995 - DNA, 22 bp, Homo sapiens
gtctcctgccacactcagtccc

SEQ ID NO: 7171996 - DNA, 22 bp, Homo sapiens
gtctcctgccacactcagtccc

SEQ ID NO: 7171997 - DNA, 22 bp, Homo sapiens
gtctcctgagccttgactgcaa

SEQ ID NO: 7171998 - DNA, 22 bp, Homo sapiens
gtctcctgaggcatccattgaa

SEQ ID NO: 7171999 - DNA, 22 bp, Homo sapiens
gtctcctgaggcatccattgaa

SEQ ID NO: 7172000 - DNA, 22 bp, Homo sapiens
gtctcctgaggcatccattgaa

SEQ ID NO: 7172001 - DNA, 22 bp, Homo sapiens
gtctcctgaggcatccattgaa

SEQ ID NO: 7172002 - DNA, 22 bp, Homo sapiens
gtctcctgagccttgactgcaa

SEQ ID NO: 7172003 - DNA, 22 bp, Homo sapiens
gtctcctgagactgcagtcacc

SEQ ID NO: 7172004 - DNA, 22 bp, Homo sapiens
gtctcctgagccttgactgcaa

SEQ ID NO: 7172005 - DNA, 20 bp, Homo sapiens
gtctcctctttgcattccta

SEQ ID NO: 7172006 - DNA, 22 bp, Homo sapiens
gtctcctgagactgcagtcacc

SEQ ID NO: 7172007 - DNA, 22 bp, Homo sapiens
gtctcctgagactgcagtcacc

SEQ ID NO: 7172008 - DNA, 22 bp, Homo sapiens
gtctctgacctgcgtccctcct

SEQ ID NO: 7172009 - DNA, 22 bp, Homo sapiens
gtctggggtactttcatctgat

SEQ ID NO: 7172010 - DNA, 22 bp, Homo sapiens
gtctggggtactttcatctgat

SEQ ID NO: 7172011 - DNA, 22 bp, Homo sapiens
gtctggggtccttttggcttta

SEQ ID NO: 7172012 - DNA, 22 bp, Homo sapiens
gtctctatcatagctgaaccct

SEQ ID NO: 7172013 - DNA, 22 bp, Homo sapiens
gtctctctcccaagattggcta

SEQ ID NO: 7172014 - DNA, 22 bp, Homo sapiens
gtctctctgactggtccacacc

SEQ ID NO: 7172015 - DNA, 22 bp, Homo sapiens
gtctctctgctaggcctccagt

SEQ ID NO: 7172016 - DNA, 22 bp, Homo sapiens
gtctcctgtcctgcaggatgga

SEQ ID NO: 7172017 - DNA, 22 bp, Homo sapiens
gtctcctggcttttgtcccagt

SEQ ID NO: 7172018 - DNA, 22 bp, Homo sapiens
gtctcctgtcctgcaggatgga

SEQ ID NO: 7172019 - DNA, 22 bp, Homo sapiens
gtctcctgtcctgcaggatgga

SEQ ID NO: 7172020 - DNA, 22 bp, Homo sapiens
gtctcctgtcctgcaggatgga

SEQ ID NO: 7172021 - DNA, 22 bp, Homo sapiens
gtctccttgtggatctcaagga

SEQ ID NO: 7172022 - DNA, 22 bp, Homo sapiens
gtctccttgtggatctcaagga

SEQ ID NO: 7172023 - DNA, 22 bp, Homo sapiens
gtctccttgtggatctcaagga

SEQ ID NO: 7172024 - DNA, 22 bp, Homo sapiens
gtctcgtcaatggcaggttccc

SEQ ID NO: 7172025 - DNA, 22 bp, Homo sapiens
gtctctatcatagctgaaccct

SEQ ID NO: 7172026 - DNA, 22 bp, Homo sapiens
gtcttatttaaagagatcatac

SEQ ID NO: 7172027 - DNA, 22 bp, Homo sapiens
gtcttattgcgtatgtatacaa

SEQ ID NO: 7172028 - DNA, 22 bp, Homo sapiens
gtcttattaaaaatctaatccc

SEQ ID NO: 7172029 - DNA, 22 bp, Homo sapiens
gtcttattaaaaatctaatccc

SEQ ID NO: 7172030 - DNA, 22 bp, Homo sapiens
gtcttattaaaatgcagtttct

SEQ ID NO: 7172031 - DNA, 22 bp, Homo sapiens
gtcttattatgaggttagactt

SEQ ID NO: 7172032 - DNA, 22 bp, Homo sapiens
gtcttatagtacaatttgaagt

SEQ ID NO: 7172033 - DNA, 22 bp, Homo sapiens
gtctggggtgaggcccgggatt

SEQ ID NO: 7172034 - DNA, 22 bp, Homo sapiens
gtctggggtgaggcccgggatt

SEQ ID NO: 7172035 - DNA, 22 bp, Homo sapiens
gtctggtcctcttcacagtggc

SEQ ID NO: 7172036 - DNA, 22 bp, Homo sapiens
gtcttcctaatttgctattagg

SEQ ID NO: 7172037 - DNA, 22 bp, Homo sapiens
gtcttatttaaggacaagaaga

SEQ ID NO: 7172038 - DNA, 22 bp, Homo sapiens
gtcttatttaaggcttatacaa

SEQ ID NO: 7172039 - DNA, 22 bp, Homo sapiens
gtcttatttaaggcttatacaa

SEQ ID NO: 7172040 - DNA, 22 bp, Homo sapiens
gtcttattttctgtctactaaa

SEQ ID NO: 7172041 - DNA, 22 bp, Homo sapiens
gtcttcaactggactccaggga

SEQ ID NO: 7172042 - DNA, 22 bp, Homo sapiens
gtagagcaggacttgagatgtt

SEQ ID NO: 7172043 - DNA, 22 bp, Homo sapiens
gtagagcaggacttgagatgtt

SEQ ID NO: 7172044 - DNA, 22 bp, Homo sapiens
gtagaggacatttgacatgatg

SEQ ID NO: 7172045 - DNA, 22 bp, Homo sapiens
gtagaggacatttgacatgatg

SEQ ID NO: 7172046 - DNA, 22 bp, Homo sapiens
gtagaggctgaaatctgagggc

SEQ ID NO: 7172047 - DNA, 22 bp, Homo sapiens
gtagaccatttatctggggagt

SEQ ID NO: 7172048 - DNA, 22 bp, Homo sapiens
gtagacatctagatttatgtgt

SEQ ID NO: 7172049 - DNA, 23 bp, Homo sapiens
gtaatgatgggaatttacttaga

SEQ ID NO: 7172050 - DNA, 22 bp, Homo sapiens
gtagacagcaaccaaaccaggt

SEQ ID NO: 7172051 - DNA, 22 bp, Homo sapiens
gtagacaggttataaatcagtg

SEQ ID NO: 7172052 - DNA, 22 bp, Homo sapiens
gtagatcatgagaatgtttttg

SEQ ID NO: 7172053 - DNA, 22 bp, Homo sapiens
gtagatctcagactttgaaatt

SEQ ID NO: 7172054 - DNA, 22 bp, Homo sapiens
gtagatgagctcacatgacctt

SEQ ID NO: 7172055 - DNA, 22 bp, Homo sapiens
gtagatctgccttaacctggga

SEQ ID NO: 7172056 - DNA, 22 bp, Homo sapiens
gtagatggaggggctgcagggc

SEQ ID NO: 7172057 - DNA, 22 bp, Homo sapiens
gtagaggtagacttccttgtct

SEQ ID NO: 7172058 - DNA, 22 bp, Homo sapiens
gtagatatggctcaaaggcatg

SEQ ID NO: 7172059 - DNA, 22 bp, Homo sapiens
gtagcccacctggggagggcga

SEQ ID NO: 7172060 - DNA, 22 bp, Homo sapiens
gtagcccacctggggagggcga

SEQ ID NO: 7172061 - DNA, 22 bp, Homo sapiens
gtagcccacctggggagggcga

SEQ ID NO: 7172062 - DNA, 16 bp, Homo sapiens
gtagccgtggccgctg

SEQ ID NO: 7172063 - DNA, 22 bp, Homo sapiens
gtagccattggcaatgaagcct

SEQ ID NO: 7172064 - DNA, 22 bp, Homo sapiens
gtagcccacctggggagggcga

SEQ ID NO: 7172065 - DNA, 22 bp, Homo sapiens
gtagcccacctggggagggcga

SEQ ID NO: 7172066 - DNA, 22 bp, Homo sapiens
gtagccagatctgctgtgtctg

SEQ ID NO: 7172067 - DNA, 22 bp, Homo sapiens
gtagcaggtattctggtgtgag

SEQ ID NO: 7172068 - DNA, 22 bp, Homo sapiens
gtagcattctgagttcgcagag

SEQ ID NO: 7172069 - DNA, 22 bp, Homo sapiens
gtagcaggtattctggtgtgag

SEQ ID NO: 7172070 - DNA, 22 bp, Homo sapiens
gtagcagagggcccaggtaact

SEQ ID NO: 7172071 - DNA, 22 bp, Homo sapiens
gtagcagctctgagcatgctgc

SEQ ID NO: 7172072 - DNA, 21 bp, Homo sapiens
gtagatttggcccaaagccat

SEQ ID NO: 7172073 - DNA, 22 bp, Homo sapiens
gtaggaaatcaggggtttaagc

SEQ ID NO: 7172074 - DNA, 22 bp, Homo sapiens
gtcaacagagacagagacactg

SEQ ID NO: 7172075 - DNA, 17 bp, Homo sapiens
gtcaacaggatttcttt

SEQ ID NO: 7172076 - DNA, 22 bp, Homo sapiens
gtaggaaagggagtgaagggaa

SEQ ID NO: 7172077 - DNA, 22 bp, Homo sapiens
gtagctttatagtgaataaacc

SEQ ID NO: 7172078 - DNA, 22 bp, Homo sapiens
gtaggaaagggagtgaagggaa

SEQ ID NO: 7172079 - DNA, 22 bp, Homo sapiens
gtaggaaagggagtgaagggaa

SEQ ID NO: 7172080 - DNA, 22 bp, Homo sapiens
gtaggaaagtaaatgaaataca

SEQ ID NO: 7172081 - DNA, 22 bp, Homo sapiens
gtaggaaagtaaatgaaataca

SEQ ID NO: 7172082 - DNA, 22 bp, Homo sapiens
gtagctatttatgatactcatg

SEQ ID NO: 7172083 - DNA, 22 bp, Homo sapiens
gtagctcatgccagggactttg

SEQ ID NO: 7172084 - DNA, 22 bp, Homo sapiens
gtagctctgtttaaagttcttt

SEQ ID NO: 7172085 - DNA, 22 bp, Homo sapiens
gtagctgatattagcaatgagt

SEQ ID NO: 7172086 - DNA, 22 bp, Homo sapiens
gtagctgatcctgaggacaggg

SEQ ID NO: 7172087 - DNA, 22 bp, Homo sapiens
gtagctgcctttctggcccagg

SEQ ID NO: 7172088 - DNA, 22 bp, Homo sapiens
gtcaataattttatggagagaa

SEQ ID NO: 7172089 - DNA, 22 bp, Homo sapiens
gtcaataattgatagatattgg

SEQ ID NO: 7172090 - DNA, 19 bp, Homo sapiens
gtcaataaaagttaggggt

SEQ ID NO: 7172091 - DNA, 22 bp, Homo sapiens
gtcaagttaagataaggtcatg

SEQ ID NO: 7172092 - DNA, 22 bp, Homo sapiens
gtcaagtttatccgctcattca

SEQ ID NO: 7172093 - DNA, 17 bp, Homo sapiens
gtcaacaggatttcttt

SEQ ID NO: 7172094 - DNA, 22 bp, Homo sapiens
gtcaacagtattaggacatttg

SEQ ID NO: 7172095 - DNA, 22 bp, Homo sapiens
gtcaacataggcctcagtgagg

SEQ ID NO: 7172096 - DNA, 22 bp, Homo sapiens
gtcaactttaagatgatctttt

SEQ ID NO: 7172097 - DNA, 22 bp, Homo sapiens
gtcaactttttcatagctctgc

SEQ ID NO: 7172098 - DNA, 22 bp, Homo sapiens
gtcaacttatctctttatctgt

SEQ ID NO: 7172099 - DNA, 22 bp, Homo sapiens
gtcaacttgacaggcagagtgg

SEQ ID NO: 7172100 - DNA, 22 bp, Homo sapiens
gtcaacttgacaggcagagtgg

SEQ ID NO: 7172101 - DNA, 22 bp, Homo sapiens
gtcaacttgcaagatgctgggc

SEQ ID NO: 7172102 - DNA, 22 bp, Homo sapiens
gtcaactttaagatgatctttt

SEQ ID NO: 7172103 - DNA, 22 bp, Homo sapiens
gtaaattatttcaagatcatct

SEQ ID NO: 7172104 - DNA, 22 bp, Homo sapiens
gtaaattatttcaagatcatct

SEQ ID NO: 7172105 - DNA, 22 bp, Homo sapiens
gtaaattatttcaagatcatct

SEQ ID NO: 7172106 - DNA, 22 bp, Homo sapiens
gtaaattatttcaagatcatct

SEQ ID NO: 7172107 - DNA, 22 bp, Homo sapiens
gtaaatgtttgctgatgattct

SEQ ID NO: 7172108 - DNA, 22 bp, Homo sapiens
gtaaattatttcaagatcatct

SEQ ID NO: 7172109 - DNA, 22 bp, Homo sapiens
gtaacaaacggttccaagatgc

SEQ ID NO: 7172110 - DNA, 22 bp, Homo sapiens
gtaacaaacggttccaagatgc

SEQ ID NO: 7172111 - DNA, 22 bp, Homo sapiens
gtaacaaaggataacttggttt

SEQ ID NO: 7172112 - DNA, 22 bp, Homo sapiens
gtaacaaaggataacttggttt

SEQ ID NO: 7172113 - DNA, 22 bp, Homo sapiens
gtaacaaaggataacttggttt

SEQ ID NO: 7172114 - DNA, 22 bp, Homo sapiens
gtaaatgagtcaaatgggggaa

SEQ ID NO: 7172115 - DNA, 22 bp, Homo sapiens
gtaaatgccacttaatgtaaag

SEQ ID NO: 7172116 - DNA, 22 bp, Homo sapiens
gtaaatcccatcctttctctgg

SEQ ID NO: 7172117 - DNA, 22 bp, Homo sapiens
gtaaatcatggtcagaataaat

SEQ ID NO: 7172118 - DNA, 22 bp, Homo sapiens
gtaaatcatggtcagaataaat

SEQ ID NO: 7172119 - DNA, 22 bp, Homo sapiens
gtaaatcatggtcagaataaat

SEQ ID NO: 7172120 - DNA, 22 bp, Homo sapiens
gtaaatcatggtcagaataaat

SEQ ID NO: 7172121 - DNA, 22 bp, Homo sapiens
gtaaatgctagccctttaaagt

SEQ ID NO: 7172122 - DNA, 22 bp, Homo sapiens
gtaaatgtcctgctacagagtg

SEQ ID NO: 7172123 - DNA, 22 bp, Homo sapiens
gtaaatgtgaatgtcatttagc

SEQ ID NO: 7172124 - DNA, 22 bp, Homo sapiens
gtaaatgtgaatgtcatttagc

SEQ ID NO: 7172125 - DNA, 22 bp, Homo sapiens
gtaaatgtgcttcttttaactt

SEQ ID NO: 7172126 - DNA, 22 bp, Homo sapiens
gtaaatattccctcggttccta

SEQ ID NO: 7172127 - DNA, 22 bp, Homo sapiens
gtaaatattccctcggttccta

SEQ ID NO: 7172128 - DNA, 22 bp, Homo sapiens
gtaaatcagtgtcattttagaa

SEQ ID NO: 7172129 - DNA, 22 bp, Homo sapiens
ggtgggcaggcgaggcccaggt

SEQ ID NO: 7172130 - DNA, 22 bp, Homo sapiens
gtaaatattccctcggttccta

SEQ ID NO: 7172131 - DNA, 22 bp, Homo sapiens
ggtgggcagctcttggcaggca

SEQ ID NO: 7172132 - DNA, 22 bp, Homo sapiens
ggtgggcagctcttggcaggca

SEQ ID NO: 7172133 - DNA, 22 bp, Homo sapiens
ggtgggcagctcttggcaggca

SEQ ID NO: 7172134 - DNA, 22 bp, Homo sapiens
ggtgggcagctcttggcaggca

SEQ ID NO: 7172135 - DNA, 22 bp, Homo sapiens
ggtgggcaggcgaggcccaggt

SEQ ID NO: 7172136 - DNA, 22 bp, Homo sapiens
ggtgggcaggcgaggcccaggt

SEQ ID NO: 7172137 - DNA, 21 bp, Homo sapiens
ggtgggcacaggagagcagag

SEQ ID NO: 7172138 - DNA, 21 bp, Homo sapiens
ggtgggcacaggagagcagag

SEQ ID NO: 7172139 - DNA, 22 bp, Homo sapiens
ggtgggcacattcagtctctgt

SEQ ID NO: 7172140 - DNA, 22 bp, Homo sapiens
ggtgggcacattcagtctctgt

SEQ ID NO: 7172141 - DNA, 22 bp, Homo sapiens
ggtgggcacattcagtctctgt

SEQ ID NO: 7172142 - DNA, 22 bp, Homo sapiens
ggtgggcacattcagtctctgt

SEQ ID NO: 7172143 - DNA, 22 bp, Homo sapiens
ggtgggcacccgagactggatc

SEQ ID NO: 7172144 - DNA, 22 bp, Homo sapiens
ggtgggcacccgagactggatc

SEQ ID NO: 7172145 - DNA, 22 bp, Homo sapiens
ggtgggcacccgagactggatc

SEQ ID NO: 7172146 - DNA, 22 bp, Homo sapiens
ggtgggcacccgagactggatc

SEQ ID NO: 7172147 - DNA, 22 bp, Homo sapiens
ggtgggcagctcttggcaggca

SEQ ID NO: 7172148 - DNA, 22 bp, Homo sapiens
ggtgggcagctcttggcaggca

SEQ ID NO: 7172149 - DNA, 22 bp, Homo sapiens
ggtgggcacccgagactggatc

SEQ ID NO: 7172150 - DNA, 22 bp, Homo sapiens
ggtgggcagctcttggcaggca

SEQ ID NO: 7172151 - DNA, 22 bp, Homo sapiens
gtaacattattcatgagataca

SEQ ID NO: 7172152 - DNA, 17 bp, Homo sapiens
gtaaggcttgcagatgc

SEQ ID NO: 7172153 - DNA, 22 bp, Homo sapiens
gtaaggctttttagaagcacat

SEQ ID NO: 7172154 - DNA, 22 bp, Homo sapiens
gtaagggatttgaacataggtt

SEQ ID NO: 7172155 - DNA, 22 bp, Homo sapiens
gtaagggcctaataggacgcag

SEQ ID NO: 7172156 - DNA, 22 bp, Homo sapiens
gtaacacagaaatgaaattcca

SEQ ID NO: 7172157 - DNA, 22 bp, Homo sapiens
gtaacaaagtttctaggtgctg

SEQ ID NO: 7172158 - DNA, 22 bp, Homo sapiens
gtaacagaaagtcatgctcatt

SEQ ID NO: 7172159 - DNA, 22 bp, Homo sapiens
gtaacagagaactcaggtgtta

SEQ ID NO: 7172160 - DNA, 22 bp, Homo sapiens
gtaacagagaactcaggtgtta

SEQ ID NO: 7172161 - DNA, 22 bp, Homo sapiens
gtaacagagggtttgcagatat

SEQ ID NO: 7172162 - DNA, 22 bp, Homo sapiens
gtaacagagggtttgcagatat

SEQ ID NO: 7172163 - DNA, 22 bp, Homo sapiens
gtaatccaaagtaacattaaac

SEQ ID NO: 7172164 - DNA, 22 bp, Homo sapiens
gtaatattcagctattgagttg

SEQ ID NO: 7172165 - DNA, 22 bp, Homo sapiens
gtaatctcagctacttgggagg

SEQ ID NO: 7172166 - DNA, 22 bp, Homo sapiens
gtaatctcagctacttgggagg

SEQ ID NO: 7172167 - DNA, 22 bp, Homo sapiens
gtaatctgtagtaaagcaccat

SEQ ID NO: 7172168 - DNA, 22 bp, Homo sapiens
gtaatgaatagatggtggcagg

SEQ ID NO: 7172169 - DNA, 22 bp, Homo sapiens
gtaataagaaacagcaattatt

SEQ ID NO: 7172170 - DNA, 22 bp, Homo sapiens
gtaataatactagtcagccttg

SEQ ID NO: 7172171 - DNA, 22 bp, Homo sapiens
gtaataatactagtcagccttg

SEQ ID NO: 7172172 - DNA, 22 bp, Homo sapiens
gtaataatggtccccaaacact

SEQ ID NO: 7172173 - DNA, 22 bp, Homo sapiens
gtaataatggtccccaaacact

SEQ ID NO: 7172174 - DNA, 22 bp, Homo sapiens
gtaataatttgctacctggtgg

SEQ ID NO: 7172175 - DNA, 22 bp, Homo sapiens
gtaataatttgctacctggtgg

SEQ ID NO: 7172176 - DNA, 22 bp, Homo sapiens
gtaataatttgctacctggtgg

SEQ ID NO: 7172177 - DNA, 23 bp, Homo sapiens
gtaatactagtcatagtagcagg

SEQ ID NO: 7172178 - DNA, 22 bp, Homo sapiens
gtaatagaacactcagcatgga

SEQ ID NO: 7172179 - DNA, 22 bp, Homo sapiens
gtaatagtctcaaactcctgga

SEQ ID NO: 7172180 - DNA, 17 bp, Homo sapiens
gtaatataataagcctt

SEQ ID NO: 7172181 - DNA, 22 bp, Homo sapiens
gtaatattcagctattgagttg

SEQ ID NO: 7172182 - DNA, 22 bp, Homo sapiens
gtaatattcagctattgagttg

SEQ ID NO: 7172183 - DNA, 22 bp, Homo sapiens
gtcaccagcaccaatgccacat

SEQ ID NO: 7172184 - DNA, 22 bp, Homo sapiens
gtcaccaggtctgatgcagcca

SEQ ID NO: 7172185 - DNA, 22 bp, Homo sapiens
gtcaccagtcccagctcctgaa

SEQ ID NO: 7172186 - DNA, 22 bp, Homo sapiens
gtcaccagtgctaagaggtgga

SEQ ID NO: 7172187 - DNA, 23 bp, Homo sapiens
gtcaccataatccgttagaccag

SEQ ID NO: 7172188 - DNA, 22 bp, Homo sapiens
gtcaggctggggctgctgccag

SEQ ID NO: 7172189 - DNA, 22 bp, Homo sapiens
gtcagggcacagtgacagctcc

SEQ ID NO: 7172190 - DNA, 23 bp, Homo sapiens
gtcagggcagctcccagcccaac

SEQ ID NO: 7172191 - DNA, 22 bp, Homo sapiens
gtcagggctccactcaccctcc

SEQ ID NO: 7172192 - DNA, 22 bp, Homo sapiens
gtcaccagcaccaatgccacat

SEQ ID NO: 7172193 - DNA, 19 bp, Homo sapiens
gtcacatttgtctcccagg

SEQ ID NO: 7172194 - DNA, 19 bp, Homo sapiens
gtcacatttgtctcccagg

SEQ ID NO: 7172195 - DNA, 19 bp, Homo sapiens
gtcacatttgtctcccagg

SEQ ID NO: 7172196 - DNA, 22 bp, Homo sapiens
gtcacattcatgcagaatcaaa

SEQ ID NO: 7172197 - DNA, 22 bp, Homo sapiens
gtcacattcatgcagaatcaaa

SEQ ID NO: 7172198 - DNA, 22 bp, Homo sapiens
gtcacatgccagtgcacacagg

SEQ ID NO: 7172199 - DNA, 22 bp, Homo sapiens
gtcacatgccagtggggatcct

SEQ ID NO: 7172200 - DNA, 22 bp, Homo sapiens
gtcacattcatgcagaatcaaa

SEQ ID NO: 7172201 - DNA, 22 bp, Homo sapiens
gtcacagtgctcccaaagtttg

SEQ ID NO: 7172202 - DNA, 22 bp, Homo sapiens
gtcacagtggggtcacagtgtg

SEQ ID NO: 7172203 - DNA, 22 bp, Homo sapiens
gtcacagtggggtcacagtgtg

SEQ ID NO: 7172204 - DNA, 23 bp, Homo sapiens
gtcacagtgggtggtgcctacat

SEQ ID NO: 7172205 - DNA, 23 bp, Homo sapiens
gtcacagtgggtggtgcctacat

SEQ ID NO: 7172206 - DNA, 22 bp, Homo sapiens
gtcacagtgtatctcttcagct

SEQ ID NO: 7172207 - DNA, 22 bp, Homo sapiens
gtcacagtgtcctacaggttga

SEQ ID NO: 7172208 - DNA, 22 bp, Homo sapiens
gtcacaggtgtggaggtgctgg

SEQ ID NO: 7172209 - DNA, 22 bp, Homo sapiens
gtcacaggtgtggaggtgctgg

SEQ ID NO: 7172210 - DNA, 22 bp, Homo sapiens
gtcacaaatcccctcagcaact

SEQ ID NO: 7172211 - DNA, 22 bp, Homo sapiens
gtcacaaatcccctcagcaact

SEQ ID NO: 7172212 - DNA, 22 bp, Homo sapiens
gtcacagtatcatgtttgaatg

SEQ ID NO: 7172213 - DNA, 22 bp, Homo sapiens
gtcacagtcaaggccatgggca

SEQ ID NO: 7172214 - DNA, 22 bp, Homo sapiens
gtcacagtgacagagatgttag

SEQ ID NO: 7172215 - DNA, 22 bp, Homo sapiens
gtcacagtgccctggtggtgtt

SEQ ID NO: 7172216 - DNA, 22 bp, Homo sapiens
gtcacagtgcctgaagctctga

SEQ ID NO: 7172217 - DNA, 22 bp, Homo sapiens
gtcacagtgcctgccactcaga

SEQ ID NO: 7172218 - DNA, 22 bp, Homo sapiens
gtcaattagtggcaatttcata

SEQ ID NO: 7172219 - DNA, 22 bp, Homo sapiens
gtcaatatcgccaagtgtctct

SEQ ID NO: 7172220 - DNA, 22 bp, Homo sapiens
gtcaatatattctgtctctttg

SEQ ID NO: 7172221 - DNA, 22 bp, Homo sapiens
gtcaatatcttggttgtactat

SEQ ID NO: 7172222 - DNA, 17 bp, Homo sapiens
gtcaatattgttgacag

SEQ ID NO: 7172223 - DNA, 22 bp, Homo sapiens
gtcaatatagatcaatgcacag

SEQ ID NO: 7172224 - DNA, 22 bp, Homo sapiens
gtcaatataggtttcaaacatg

SEQ ID NO: 7172225 - DNA, 22 bp, Homo sapiens
gtcaatatattctgtctctttg

SEQ ID NO: 7172226 - DNA, 22 bp, Homo sapiens
gtcattccttatgttgattcag

SEQ ID NO: 7172227 - DNA, 17 bp, Homo sapiens
gtcattctcagaaaatg

SEQ ID NO: 7172228 - DNA, 22 bp, Homo sapiens
gtcattcttaacaactcagtag

SEQ ID NO: 7172229 - DNA, 22 bp, Homo sapiens
gtcattcaaactgtatcacttg

SEQ ID NO: 7172230 - DNA, 22 bp, Homo sapiens
gtcattcagagatgcaggtaga

SEQ ID NO: 7172231 - DNA, 22 bp, Homo sapiens
gtcataaaaggaccacctattg

SEQ ID NO: 7172232 - DNA, 22 bp, Homo sapiens
gtcattatttaatgtaggctaa

SEQ ID NO: 7172233 - DNA, 22 bp, Homo sapiens
gtcattcaaactgtatcacttg

SEQ ID NO: 7172234 - DNA, 22 bp, Homo sapiens
gtcattcaaactgtatcacttg

SEQ ID NO: 7172235 - DNA, 22 bp, Homo sapiens
gtcagtgtgagttgattccata

SEQ ID NO: 7172236 - DNA, 22 bp, Homo sapiens
gtcagtgtttaacaaccagctc

SEQ ID NO: 7172237 - DNA, 22 bp, Homo sapiens
gtcagttacagccacggcgggt

SEQ ID NO: 7172238 - DNA, 22 bp, Homo sapiens
gtcagttattcaattggtttaa

SEQ ID NO: 7172239 - DNA, 22 bp, Homo sapiens
gtcagttattttgagcaattgg

SEQ ID NO: 7172240 - DNA, 22 bp, Homo sapiens
gtcagttcattagcacttccaa

SEQ ID NO: 7172241 - DNA, 18 bp, Homo sapiens
gtcagttttgaagccaga

SEQ ID NO: 7172242 - DNA, 22 bp, Homo sapiens
gtcagttttgctacagttgctg

SEQ ID NO: 7172243 - DNA, 22 bp, Homo sapiens
gtcataaaaggaccacctattg

SEQ ID NO: 7172244 - DNA, 22 bp, Homo sapiens
gtcataaaatttgtggattaga

SEQ ID NO: 7172245 - DNA, 22 bp, Homo sapiens
gtcaggggatgtgctggtggcc

SEQ ID NO: 7172246 - DNA, 22 bp, Homo sapiens
gtcaggggatgtgctggtggcc

SEQ ID NO: 7172247 - DNA, 23 bp, Homo sapiens
gtcagggctggggtcagagtgac

SEQ ID NO: 7172248 - DNA, 22 bp, Homo sapiens
gtcaggggatgtgctggtggcc

SEQ ID NO: 7172249 - DNA, 22 bp, Homo sapiens
gtcaggggatgtgctggtggcc

SEQ ID NO: 7172250 - DNA, 22 bp, Homo sapiens
gtcaggtggctggtgattcaac

SEQ ID NO: 7172251 - DNA, 22 bp, Homo sapiens
gtcagtgccaccagccactgcc

SEQ ID NO: 7172252 - DNA, 21 bp, Homo sapiens
gtcagtgctgaaacaccttcc

SEQ ID NO: 7172253 - DNA, 22 bp, Homo sapiens
gtcagtgcttgaagggcagaga

SEQ ID NO: 7172254 - DNA, 23 bp, Homo sapiens
gtcagtgctttagttcaggatgg

SEQ ID NO: 7172255 - DNA, 22 bp, Homo sapiens
gtcagtggtgcttaaagtttca

SEQ ID NO: 7172256 - DNA, 22 bp, Homo sapiens
gtcagtgtagcaggtgcaagcc

SEQ ID NO: 7172257 - DNA, 22 bp, Homo sapiens
gtcagtgtaggttcatcagtgg

SEQ ID NO: 7172258 - DNA, 22 bp, Homo sapiens
gtcagtgtcttaacagagatta

SEQ ID NO: 7172259 - DNA, 20 bp, Homo sapiens
gtcagtgtcttcagtagtga

SEQ ID NO: 7172260 - DNA, 22 bp, Homo sapiens
gtccctggatctgggacagctg

SEQ ID NO: 7172261 - DNA, 22 bp, Homo sapiens
gtccctggagctgagcagtgct

SEQ ID NO: 7172262 - DNA, 22 bp, Homo sapiens
gtccctggagctgagcagtgct

SEQ ID NO: 7172263 - DNA, 22 bp, Homo sapiens
gtcattttatgggaacagattt

SEQ ID NO: 7172264 - DNA, 22 bp, Homo sapiens
gtcattttatgggaacagattt

SEQ ID NO: 7172265 - DNA, 22 bp, Homo sapiens
gtcattttatgggaacagattt

SEQ ID NO: 7172266 - DNA, 22 bp, Homo sapiens
gtcattttatgggaacagattt

SEQ ID NO: 7172267 - DNA, 22 bp, Homo sapiens
gtcattgagtcgtcagagtctt

SEQ ID NO: 7172268 - DNA, 22 bp, Homo sapiens
gtcattgactagaattccaaag

SEQ ID NO: 7172269 - DNA, 22 bp, Homo sapiens
gtcattgattttcagtttgtcc

SEQ ID NO: 7172270 - DNA, 22 bp, Homo sapiens
gtcattgggggccatctcagag

SEQ ID NO: 7172271 - DNA, 22 bp, Homo sapiens
gtcattgtaatattctcattta

SEQ ID NO: 7172272 - DNA, 22 bp, Homo sapiens
gtcattgtgtggacatggagaa

SEQ ID NO: 7172273 - DNA, 22 bp, Homo sapiens
gtcatttaaaagggaacacatg

SEQ ID NO: 7172274 - DNA, 22 bp, Homo sapiens
gtcatttaaagaccattgtggg

SEQ ID NO: 7172275 - DNA, 22 bp, Homo sapiens
gtcatttaaagaccattgtggg

SEQ ID NO: 7172276 - DNA, 22 bp, Homo sapiens
gtcatttaggtctgtcagaaat

SEQ ID NO: 7172277 - DNA, 22 bp, Homo sapiens
gtcatttaggtctgtcagaaat

SEQ ID NO: 7172278 - DNA, 22 bp, Homo sapiens
gtcatttatcatcagaagtcat

SEQ ID NO: 7172279 - DNA, 22 bp, Homo sapiens
gtcatttatcatcagaagtcat

SEQ ID NO: 7172280 - DNA, 22 bp, Homo sapiens
gtcatttatcttcagaatttct

SEQ ID NO: 7172281 - DNA, 22 bp, Homo sapiens
gtcatttattctggtcaattca

SEQ ID NO: 7172282 - DNA, 22 bp, Homo sapiens
gtcatttatgaggaagtgggcc

SEQ ID NO: 7172283 - DNA, 22 bp, Homo sapiens
gtcctcagaagcctgcttagct

SEQ ID NO: 7172284 - DNA, 22 bp, Homo sapiens
gtcctcagaagcctgcttagct

SEQ ID NO: 7172285 - DNA, 22 bp, Homo sapiens
gtcctcagagtgggcaggtcct

SEQ ID NO: 7172286 - DNA, 22 bp, Homo sapiens
gtcctcagatgctgctgaaatg

SEQ ID NO: 7172287 - DNA, 22 bp, Homo sapiens
gtcctcagatgctgctgaaatg

SEQ ID NO: 7172288 - DNA, 22 bp, Homo sapiens
gtcctcagcaccagaactaggg

SEQ ID NO: 7172289 - DNA, 22 bp, Homo sapiens
gtcctcagcaccagaactaggg

SEQ ID NO: 7172290 - DNA, 21 bp, Homo sapiens
gtcctcagctgatgggagctg

SEQ ID NO: 7172291 - DNA, 22 bp, Homo sapiens
gtcctcagggaatgtggcgggt

SEQ ID NO: 7172292 - DNA, 22 bp, Homo sapiens
gtcctcagggagtcccagtcat

SEQ ID NO: 7172293 - DNA, 22 bp, Homo sapiens
gtcctctgactcagccttggga

SEQ ID NO: 7172294 - DNA, 22 bp, Homo sapiens
gtcctctgactcagccttggga

SEQ ID NO: 7172295 - DNA, 22 bp, Homo sapiens
gtcctctgactcagccttggga

SEQ ID NO: 7172296 - DNA, 22 bp, Homo sapiens
gtcctctccaggaggctctgat

SEQ ID NO: 7172297 - DNA, 22 bp, Homo sapiens
gtcctctgaaagatgaaccatg

SEQ ID NO: 7172298 - DNA, 19 bp, Homo sapiens
gtcctctcaacaacccggg

SEQ ID NO: 7172299 - DNA, 19 bp, Homo sapiens
gtcctctcaacaacccggg

SEQ ID NO: 7172300 - DNA, 19 bp, Homo sapiens
gtcctctcaacaacccggg

SEQ ID NO: 7172301 - DNA, 22 bp, Homo sapiens
gtcctctccaggaggctctgat

SEQ ID NO: 7172302 - DNA, 22 bp, Homo sapiens
gtcctctccaggaggctctgat

SEQ ID NO: 7172303 - DNA, 22 bp, Homo sapiens
gtcctctgagggggctgcacgc

SEQ ID NO: 7172304 - DNA, 22 bp, Homo sapiens
gtcctctgagggggctgcacgc

SEQ ID NO: 7172305 - DNA, 22 bp, Homo sapiens
gtcctctgactcagccttggga

SEQ ID NO: 7172306 - DNA, 22 bp, Homo sapiens
gtcctctgatttctaggtatat

SEQ ID NO: 7172307 - DNA, 22 bp, Homo sapiens
gtcctctgagggggctgcacgc

SEQ ID NO: 7172308 - DNA, 22 bp, Homo sapiens
gtcctctgcttcatgccctgat

SEQ ID NO: 7172309 - DNA, 22 bp, Homo sapiens
gtcctctgcttcatgccctgat

SEQ ID NO: 7172310 - DNA, 22 bp, Homo sapiens
gtcctctgcttcatgccctgat

SEQ ID NO: 7172311 - DNA, 22 bp, Homo sapiens
gtcctctgcttcatgccctgat

SEQ ID NO: 7172312 - DNA, 22 bp, Homo sapiens
gtctcccactttctggcctctt

SEQ ID NO: 7172313 - DNA, 22 bp, Homo sapiens
gtctcccactttctggcctctt

SEQ ID NO: 7172314 - DNA, 22 bp, Homo sapiens
gtcctctgcttcatgccctgat

SEQ ID NO: 7172315 - DNA, 22 bp, Homo sapiens
gtctcccactttctggcctctt

SEQ ID NO: 7172316 - DNA, 22 bp, Homo sapiens
gtctcccagcctacatctttct

SEQ ID NO: 7172317 - DNA, 23 bp, Homo sapiens
gtctcccatagcgctcccaggct

SEQ ID NO: 7172318 - DNA, 22 bp, Homo sapiens
gtctcccatcgtttgtgaggaa

SEQ ID NO: 7172319 - DNA, 22 bp, Homo sapiens
gtctcccatcgtttgtgaggaa

SEQ ID NO: 7172320 - DNA, 22 bp, Homo sapiens
gtctcccatcgtttgtgaggaa

SEQ ID NO: 7172321 - DNA, 22 bp, Homo sapiens
gtctcccatcgtttgtgaggaa

SEQ ID NO: 7172322 - DNA, 22 bp, Homo sapiens
gtctcccatctctgtccttgtg

SEQ ID NO: 7172323 - DNA, 22 bp, Homo sapiens
gtctcccatctctgtccttgtg

SEQ ID NO: 7172324 - DNA, 22 bp, Homo sapiens
gtctcccatctctgtccttgtg

SEQ ID NO: 7172325 - DNA, 22 bp, Homo sapiens
gtctcccatgtccctgtccagt

SEQ ID NO: 7172326 - DNA, 22 bp, Homo sapiens
gtctcccatgtccctgtccagt

SEQ ID NO: 7172327 - DNA, 22 bp, Homo sapiens
gtctcccatgtccctgtccagt

SEQ ID NO: 7172328 - DNA, 22 bp, Homo sapiens
gtctcccatgtccctgtccagt

SEQ ID NO: 7172329 - DNA, 22 bp, Homo sapiens
gtctccggccgccctggtgctg

SEQ ID NO: 7172330 - DNA, 22 bp, Homo sapiens
gtctcctaaaccatcctggtac

SEQ ID NO: 7172331 - DNA, 22 bp, Homo sapiens
gtctcctaaaccatcctggtac

SEQ ID NO: 7172332 - DNA, 20 bp, Homo sapiens
gtctcctaccctcagctaga

SEQ ID NO: 7172333 - DNA, 22 bp, Homo sapiens
gtctcctatagctgcactgaat

SEQ ID NO: 7172334 - DNA, 22 bp, Homo sapiens
gtctcctatagctgcactgaat

SEQ ID NO: 7172335 - DNA, 22 bp, Homo sapiens
gtctcctccatggagatggtat

SEQ ID NO: 7172336 - DNA, 22 bp, Homo sapiens
gtctcctccatggagatggtat

SEQ ID NO: 7172337 - DNA, 22 bp, Homo sapiens
gtctcctccctttcattcacct

SEQ ID NO: 7172338 - DNA, 22 bp, Homo sapiens
gtctcctcttcatatacctgtt

SEQ ID NO: 7172339 - DNA, 22 bp, Homo sapiens
gtctcctcttcatatacctgtt

SEQ ID NO: 7172340 - DNA, 22 bp, Homo sapiens
gggcctggcatgcagccccgtt

SEQ ID NO: 7172341 - DNA, 21 bp, Homo sapiens
gggcctggctgcgcaggacgg

SEQ ID NO: 7172342 - DNA, 21 bp, Homo sapiens
gggcctggctgcgcaggacgg

SEQ ID NO: 7172343 - DNA, 21 bp, Homo sapiens
gggcctggctgcgcaggacgg

SEQ ID NO: 7172344 - DNA, 21 bp, Homo sapiens
gggcctggctgcgcaggacgg

SEQ ID NO: 7172345 - DNA, 22 bp, Homo sapiens
gggcctggcatgcagccccgtt

SEQ ID NO: 7172346 - DNA, 22 bp, Homo sapiens
gggcctggcatgcagccccgtt

SEQ ID NO: 7172347 - DNA, 22 bp, Homo sapiens
gggcctggcatgcagccccgtt

SEQ ID NO: 7172348 - DNA, 22 bp, Homo sapiens
gggcctgctccccatcgctgct

SEQ ID NO: 7172349 - DNA, 22 bp, Homo sapiens
gggcctgccattgctgccccag

SEQ ID NO: 7172350 - DNA, 22 bp, Homo sapiens
gggcctgctccccatcgctgct

SEQ ID NO: 7172351 - DNA, 22 bp, Homo sapiens
gggcctgccaggctttcagcat

SEQ ID NO: 7172352 - DNA, 22 bp, Homo sapiens
gggcctgccattgctgccccag

SEQ ID NO: 7172353 - DNA, 22 bp, Homo sapiens
gggcctgcaggttctgagaggc

SEQ ID NO: 7172354 - DNA, 22 bp, Homo sapiens
gggcctgagactgagggtgagg

SEQ ID NO: 7172355 - DNA, 22 bp, Homo sapiens
gggcctgagactgagggtgagg

SEQ ID NO: 7172356 - DNA, 22 bp, Homo sapiens
gggcctgattagcaggctagct

SEQ ID NO: 7172357 - DNA, 22 bp, Homo sapiens
gggcctgattagcaggctagct

SEQ ID NO: 7172358 - DNA, 22 bp, Homo sapiens
gggcctgcaggttctgagaggc

SEQ ID NO: 7172359 - DNA, 21 bp, Homo sapiens
gggcctggctgcgcaggacgg

SEQ ID NO: 7172360 - DNA, 22 bp, Homo sapiens
gggcctgggaacttgcatttag

SEQ ID NO: 7172361 - DNA, 22 bp, Homo sapiens
gggcctgggaacttgcatttag

SEQ ID NO: 7172362 - DNA, 22 bp, Homo sapiens
gggcctggtgcttctgactcct

SEQ ID NO: 7172363 - DNA, 22 bp, Homo sapiens
gggcctggtgcttctgactcct

SEQ ID NO: 7172364 - DNA, 22 bp, Homo sapiens
gggcctggtgcttctgactcct

SEQ ID NO: 7172365 - DNA, 22 bp, Homo sapiens
gggcctgggaacttgcatttag

SEQ ID NO: 7172366 - DNA, 22 bp, Homo sapiens
gggcctggggacaccaccatga

SEQ ID NO: 7172367 - DNA, 22 bp, Homo sapiens
gggcctggggacaccaccatga

SEQ ID NO: 7172368 - DNA, 22 bp, Homo sapiens
gggcctggggtgacgtacccct

SEQ ID NO: 7172369 - DNA, 22 bp, Homo sapiens
gggcctggggtgacgtacccct

SEQ ID NO: 7172370 - DNA, 22 bp, Homo sapiens
gggcatgagagggcagctggca

SEQ ID NO: 7172371 - DNA, 22 bp, Homo sapiens
gggcatgagagggcagctggca

SEQ ID NO: 7172372 - DNA, 22 bp, Homo sapiens
gggcatgcaggactgtggcaga

SEQ ID NO: 7172373 - DNA, 22 bp, Homo sapiens
gggcatgacttttggagtggga

SEQ ID NO: 7172374 - DNA, 22 bp, Homo sapiens
gggcatgacttttggagtggga

SEQ ID NO: 7172375 - DNA, 22 bp, Homo sapiens
gggcatcttgtagccttcactt

SEQ ID NO: 7172376 - DNA, 20 bp, Homo sapiens
gggcatctttgctcctgttt

SEQ ID NO: 7172377 - DNA, 20 bp, Homo sapiens
gggcatctttgctcctgttt

SEQ ID NO: 7172378 - DNA, 20 bp, Homo sapiens
gggcatctttgctcctgttt

SEQ ID NO: 7172379 - DNA, 22 bp, Homo sapiens
gggcatgacttttggagtggga

SEQ ID NO: 7172380 - DNA, 22 bp, Homo sapiens
gggcatctggtggagcctcagg

SEQ ID NO: 7172381 - DNA, 22 bp, Homo sapiens
gggcatcttctgtagccatctc

SEQ ID NO: 7172382 - DNA, 18 bp, Homo sapiens
gggcatcattcacaaagt

SEQ ID NO: 7172383 - DNA, 22 bp, Homo sapiens
gggcatccagagggatgcctgg

SEQ ID NO: 7172384 - DNA, 23 bp, Homo sapiens
gggcagttatgttgtccttggct

SEQ ID NO: 7172385 - DNA, 20 bp, Homo sapiens
gggcagttcaatgccactct

SEQ ID NO: 7172386 - DNA, 22 bp, Homo sapiens
gggcagttgatggaggtctgga

SEQ ID NO: 7172387 - DNA, 19 bp, Homo sapiens
gggcatcaaagtgctggtg

SEQ ID NO: 7172388 - DNA, 22 bp, Homo sapiens
gggcatcaccaagaaggaggac

SEQ ID NO: 7172389 - DNA, 22 bp, Homo sapiens
gggcatgcctgcgcagtgcatg

SEQ ID NO: 7172390 - DNA, 22 bp, Homo sapiens
gggcctcagctctgctctgcaa

SEQ ID NO: 7172391 - DNA, 22 bp, Homo sapiens
gggcctcagctctgctctgcaa

SEQ ID NO: 7172392 - DNA, 22 bp, Homo sapiens
gggcctcagctctgctctgcaa

SEQ ID NO: 7172393 - DNA, 22 bp, Homo sapiens
gggcctcagctggagtctgcct

SEQ ID NO: 7172394 - DNA, 22 bp, Homo sapiens
gggcctcagctggagtctgcct

SEQ ID NO: 7172395 - DNA, 22 bp, Homo sapiens
gggcctcagctgccaacaggat

SEQ ID NO: 7172396 - DNA, 22 bp, Homo sapiens
gggcctcatgatggctcaggaa

SEQ ID NO: 7172397 - DNA, 22 bp, Homo sapiens
gggcctcatgatggctcaggaa

SEQ ID NO: 7172398 - DNA, 22 bp, Homo sapiens
gggcctcaggccttgctctgtg

SEQ ID NO: 7172399 - DNA, 22 bp, Homo sapiens
gggcctcagctggagtctgcct

SEQ ID NO: 7172400 - DNA, 22 bp, Homo sapiens
gggcctcaggccttgctctgtg

SEQ ID NO: 7172401 - DNA, 22 bp, Homo sapiens
gggcctgaaaccttcagggctt

SEQ ID NO: 7172402 - DNA, 22 bp, Homo sapiens
gggcctgaaaccttcagggctt

SEQ ID NO: 7172403 - DNA, 22 bp, Homo sapiens
gggcctccggggtgagctgtgg

SEQ ID NO: 7172404 - DNA, 22 bp, Homo sapiens
gggcctccggggtgagctgtgg

SEQ ID NO: 7172405 - DNA, 22 bp, Homo sapiens
gggcctccggggtgagctgtgg

SEQ ID NO: 7172406 - DNA, 22 bp, Homo sapiens
gggcctccgtgtgctggtgctc

SEQ ID NO: 7172407 - DNA, 22 bp, Homo sapiens
gggcctccgtgtgctggtgctc

SEQ ID NO: 7172408 - DNA, 22 bp, Homo sapiens
gggcctccgtgtgctggtgctc

SEQ ID NO: 7172409 - DNA, 22 bp, Homo sapiens
gggctggcgggaaaggcaattc

SEQ ID NO: 7172410 - DNA, 22 bp, Homo sapiens
gggctggcgggaaaggcaattc

SEQ ID NO: 7172411 - DNA, 20 bp, Homo sapiens
gggctggcgcatggggaaag

SEQ ID NO: 7172412 - DNA, 22 bp, Homo sapiens
gggctctcgattagaccctggg

SEQ ID NO: 7172413 - DNA, 22 bp, Homo sapiens
gggctctctttttggcctgccc

SEQ ID NO: 7172414 - DNA, 22 bp, Homo sapiens
gggctctctttttggcctgccc

SEQ ID NO: 7172415 - DNA, 22 bp, Homo sapiens
gggctctctttttggcctgccc

SEQ ID NO: 7172416 - DNA, 22 bp, Homo sapiens
gggctctgaatcccaggtctgc

SEQ ID NO: 7172417 - DNA, 22 bp, Homo sapiens
gggctctgaatcccaggtctgc

SEQ ID NO: 7172418 - DNA, 22 bp, Homo sapiens
gggctctgaatcccaggtctgc

SEQ ID NO: 7172419 - DNA, 20 bp, Homo sapiens
gggctggcgcatggggaaag

SEQ ID NO: 7172420 - DNA, 20 bp, Homo sapiens
gggctggcgcatggggaaag

SEQ ID NO: 7172421 - DNA, 22 bp, Homo sapiens
gggctggctaagacttttctgt

SEQ ID NO: 7172422 - DNA, 20 bp, Homo sapiens
gggctggctcaactggatcc

SEQ ID NO: 7172423 - DNA, 22 bp, Homo sapiens
gggctggctcccaggtgttgaa

SEQ ID NO: 7172424 - DNA, 22 bp, Homo sapiens
gggctggctcccaggtgttgaa

SEQ ID NO: 7172425 - DNA, 22 bp, Homo sapiens
gggctcctgcctcctggcacct

SEQ ID NO: 7172426 - DNA, 22 bp, Homo sapiens
gggctcctgcctcctggcacct

SEQ ID NO: 7172427 - DNA, 22 bp, Homo sapiens
gggctcctgcctcctggcacct

SEQ ID NO: 7172428 - DNA, 22 bp, Homo sapiens
gggctcctcctctgactgtggc

SEQ ID NO: 7172429 - DNA, 22 bp, Homo sapiens
gggctcctggcagtcatgctca

SEQ ID NO: 7172430 - DNA, 19 bp, Homo sapiens
gggctccttgggcctctct

SEQ ID NO: 7172431 - DNA, 22 bp, Homo sapiens
gggctcggcatctgtggactct

SEQ ID NO: 7172432 - DNA, 22 bp, Homo sapiens
gggctcggcatctgtggactct

SEQ ID NO: 7172433 - DNA, 22 bp, Homo sapiens
gggctctcccacaacgtgccag

SEQ ID NO: 7172434 - DNA, 22 bp, Homo sapiens
gggctctcccacaacgtgccag

SEQ ID NO: 7172435 - DNA, 21 bp, Homo sapiens
gggctctcctgaggccatgaa

SEQ ID NO: 7172436 - DNA, 19 bp, Homo sapiens
gggctctcgagcaaccaac

SEQ ID NO: 7172437 - DNA, 22 bp, Homo sapiens
gggctctcaaggcagggcccca

SEQ ID NO: 7172438 - DNA, 22 bp, Homo sapiens
gggctctcatgagtgtgtggta

SEQ ID NO: 7172439 - DNA, 22 bp, Homo sapiens
gggctccagttgtccccaggat

SEQ ID NO: 7172440 - DNA, 22 bp, Homo sapiens
gggctccaggagccctaagaga

SEQ ID NO: 7172441 - DNA, 22 bp, Homo sapiens
gggctccaggcaggcaggaaat

SEQ ID NO: 7172442 - DNA, 17 bp, Homo sapiens
gggctcctcccctgggg

SEQ ID NO: 7172443 - DNA, 22 bp, Homo sapiens
gggctccatcacaggctccatc

SEQ ID NO: 7172444 - DNA, 22 bp, Homo sapiens
gggctccagtttggccaggaag

SEQ ID NO: 7172445 - DNA, 22 bp, Homo sapiens
gggctccagtttggccaggaag

SEQ ID NO: 7172446 - DNA, 22 bp, Homo sapiens
gggctccacagcagtgagtgga

SEQ ID NO: 7172447 - DNA, 22 bp, Homo sapiens
gggctccacagcagtgagtgga

SEQ ID NO: 7172448 - DNA, 22 bp, Homo sapiens
gggctccacgcacgcgagaggt

SEQ ID NO: 7172449 - DNA, 22 bp, Homo sapiens
gggctccacgcacgcgagaggt

SEQ ID NO: 7172450 - DNA, 22 bp, Homo sapiens
gggctccagccagctccttgtg

SEQ ID NO: 7172451 - DNA, 22 bp, Homo sapiens
gggctccagccagctccttgtg

SEQ ID NO: 7172452 - DNA, 22 bp, Homo sapiens
gggctccagcccgggaccaggt

SEQ ID NO: 7172453 - DNA, 22 bp, Homo sapiens
gggctccagcccgggaccaggt

SEQ ID NO: 7172454 - DNA, 20 bp, Homo sapiens
gggctccagctgtgattctt

SEQ ID NO: 7172455 - DNA, 22 bp, Homo sapiens
ggggcaaagggagagtccctac

SEQ ID NO: 7172456 - DNA, 22 bp, Homo sapiens
ggggcaaagtggttgctattgg

SEQ ID NO: 7172457 - DNA, 22 bp, Homo sapiens
ggggcaaagtggttgctattgg

SEQ ID NO: 7172458 - DNA, 22 bp, Homo sapiens
ggggcaatgtccaagtcagttg

SEQ ID NO: 7172459 - DNA, 22 bp, Homo sapiens
ggggcactttactgcctcatct

SEQ ID NO: 7172460 - DNA, 22 bp, Homo sapiens
ggggcactttactgcctcatct

SEQ ID NO: 7172461 - DNA, 22 bp, Homo sapiens
ggggcacttccaggctgaggct

SEQ ID NO: 7172462 - DNA, 22 bp, Homo sapiens
ggggcacttggcacctctgcag

SEQ ID NO: 7172463 - DNA, 22 bp, Homo sapiens
ggggcacacttttggtagatat

SEQ ID NO: 7172464 - DNA, 22 bp, Homo sapiens
ggggcacctcctcttggcaatt

SEQ ID NO: 7172465 - DNA, 22 bp, Homo sapiens
ggggcacttccaggctgaggct

SEQ ID NO: 7172466 - DNA, 22 bp, Homo sapiens
ggggcacttccaggctgaggct

SEQ ID NO: 7172467 - DNA, 22 bp, Homo sapiens
ggggcacctcctcttggcaatt

SEQ ID NO: 7172468 - DNA, 22 bp, Homo sapiens
ggggcagctcccgagggcagga

SEQ ID NO: 7172469 - DNA, 22 bp, Homo sapiens
ggggcagctcccgagggcagga

SEQ ID NO: 7172470 - DNA, 22 bp, Homo sapiens
ggggcagctcccgagggcagga

SEQ ID NO: 7172471 - DNA, 22 bp, Homo sapiens
ggggcagctcccgagggcagga

SEQ ID NO: 7172472 - DNA, 22 bp, Homo sapiens
ggggcagctcccgagggcagga

SEQ ID NO: 7172473 - DNA, 22 bp, Homo sapiens
ggggcagctaccggaagtaggg

SEQ ID NO: 7172474 - DNA, 22 bp, Homo sapiens
ggggcagctaccggaagtaggg

SEQ ID NO: 7172475 - DNA, 22 bp, Homo sapiens
ggggcactttactgcctcatct

SEQ ID NO: 7172476 - DNA, 22 bp, Homo sapiens
ggggcagaaagcccacagagtg

SEQ ID NO: 7172477 - DNA, 22 bp, Homo sapiens
ggggcagaaagcccacagagtg

SEQ ID NO: 7172478 - DNA, 22 bp, Homo sapiens
ggggcagaaagcccacagagtg

SEQ ID NO: 7172479 - DNA, 22 bp, Homo sapiens
ggggcagaaagcccacagagtg

SEQ ID NO: 7172480 - DNA, 16 bp, Homo sapiens
gggctgggggattctg

SEQ ID NO: 7172481 - DNA, 22 bp, Homo sapiens
ggggatggaatgtagtagtgat

SEQ ID NO: 7172482 - DNA, 16 bp, Homo sapiens
gggctgggggattctg

SEQ ID NO: 7172483 - DNA, 16 bp, Homo sapiens
gggctgggggattctg

SEQ ID NO: 7172484 - DNA, 22 bp, Homo sapiens
ggggatggaatgtagtagtgat

SEQ ID NO: 7172485 - DNA, 22 bp, Homo sapiens
ggggatggaatgtagtagtgat

SEQ ID NO: 7172486 - DNA, 22 bp, Homo sapiens
ggggatggaatgtagtagtgat

SEQ ID NO: 7172487 - DNA, 22 bp, Homo sapiens
ggggatggaggcgtgtggtcct

SEQ ID NO: 7172488 - DNA, 22 bp, Homo sapiens
ggggatggaggcgtgtggtcct

SEQ ID NO: 7172489 - DNA, 22 bp, Homo sapiens
ggggatggaggcgtgtggtcct

SEQ ID NO: 7172490 - DNA, 22 bp, Homo sapiens
ggggatggaggcgtgtggtcct

SEQ ID NO: 7172491 - DNA, 22 bp, Homo sapiens
ggggatggaggcgtgtggtcct

SEQ ID NO: 7172492 - DNA, 22 bp, Homo sapiens
ggggatggaatgtagtagtgat

SEQ ID NO: 7172493 - DNA, 22 bp, Homo sapiens
ggggatggaggcgtgtggtcct

SEQ ID NO: 7172494 - DNA, 22 bp, Homo sapiens
ggggatggtgggaaggcaatct

SEQ ID NO: 7172495 - DNA, 22 bp, Homo sapiens
ggggatggtgggaaggcaatct

SEQ ID NO: 7172496 - DNA, 22 bp, Homo sapiens
ggggatggtagaccggtgacgt

SEQ ID NO: 7172497 - DNA, 22 bp, Homo sapiens
ggggatggtggcatttgtaaaa

SEQ ID NO: 7172498 - DNA, 22 bp, Homo sapiens
ggggatggtggcatttgtaaaa

SEQ ID NO: 7172499 - DNA, 22 bp, Homo sapiens
ggggatggtagaccggtgacgt

SEQ ID NO: 7172500 - DNA, 22 bp, Homo sapiens
ggggatggtagaccggtgacgt

SEQ ID NO: 7172501 - DNA, 22 bp, Homo sapiens
ggggatggaggcgtgtggtcct

SEQ ID NO: 7172502 - DNA, 22 bp, Homo sapiens
ggggatggattccgggtccctg

SEQ ID NO: 7172503 - DNA, 22 bp, Homo sapiens
ggggatggattccgggtccctg

SEQ ID NO: 7172504 - DNA, 22 bp, Homo sapiens
ggggatggattccgggtccctg

SEQ ID NO: 7172505 - DNA, 22 bp, Homo sapiens
ggggatggtagaccggtgacgt

SEQ ID NO: 7172506 - DNA, 22 bp, Homo sapiens
ggggatggtagaccggtgacgt

SEQ ID NO: 7172507 - DNA, 22 bp, Homo sapiens
gggctggctctgtctagaaagg

SEQ ID NO: 7172508 - DNA, 22 bp, Homo sapiens
gggctggctgattttcctctct

SEQ ID NO: 7172509 - DNA, 22 bp, Homo sapiens
gggctggctgattttcctctct

SEQ ID NO: 7172510 - DNA, 22 bp, Homo sapiens
gggctgggaatggctaagtatg

SEQ ID NO: 7172511 - DNA, 22 bp, Homo sapiens
gggctgggaatggctaagtatg

SEQ ID NO: 7172512 - DNA, 22 bp, Homo sapiens
gggctgggaatggctaagtatg

SEQ ID NO: 7172513 - DNA, 22 bp, Homo sapiens
gggctgggaatggctaagtatg

SEQ ID NO: 7172514 - DNA, 22 bp, Homo sapiens
gggctgggatggcttgaagatt

SEQ ID NO: 7172515 - DNA, 22 bp, Homo sapiens
gggctgggatggcttgaagatt

SEQ ID NO: 7172516 - DNA, 22 bp, Homo sapiens
gggctgggatggcttgaagatt

SEQ ID NO: 7172517 - DNA, 22 bp, Homo sapiens
gggctgggaatggctaagtatg

SEQ ID NO: 7172518 - DNA, 22 bp, Homo sapiens
gggctgggaatggctaagtatg

SEQ ID NO: 7172519 - DNA, 22 bp, Homo sapiens
gggctgggatggcttgaagatt

SEQ ID NO: 7172520 - DNA, 22 bp, Homo sapiens
gggctgggatggcttgaagatt

SEQ ID NO: 7172521 - DNA, 22 bp, Homo sapiens
gggctgggatggcttgaagatt

SEQ ID NO: 7172522 - DNA, 22 bp, Homo sapiens
gggctgggatggcttgaagatt

SEQ ID NO: 7172523 - DNA, 22 bp, Homo sapiens
gggctgggattgcttgctgtga

SEQ ID NO: 7172524 - DNA, 22 bp, Homo sapiens
gggctgggattgcttgctgtga

SEQ ID NO: 7172525 - DNA, 22 bp, Homo sapiens
gggctgggattgcttgctgtga

SEQ ID NO: 7172526 - DNA, 22 bp, Homo sapiens
gggctgggattgcttgctgtga

SEQ ID NO: 7172527 - DNA, 22 bp, Homo sapiens
gggctgggattgcttgctgtga

SEQ ID NO: 7172528 - DNA, 22 bp, Homo sapiens
gggctgggattgcttgctgtga

SEQ ID NO: 7172529 - DNA, 22 bp, Homo sapiens
gggctgggattgcttgctgtga

SEQ ID NO: 7172530 - DNA, 22 bp, Homo sapiens
gggctgggattgcttgctgtga

SEQ ID NO: 7172531 - DNA, 22 bp, Homo sapiens
gggctgggcatggtgttccctc

SEQ ID NO: 7172532 - DNA, 22 bp, Homo sapiens
gggctgggcatggtgttccctc

SEQ ID NO: 7172533 - DNA, 22 bp, Homo sapiens
gggctgggcatggtgttccctc

SEQ ID NO: 7172534 - DNA, 22 bp, Homo sapiens
gggctgggcatggtgttccctc

SEQ ID NO: 7172535 - DNA, 22 bp, Homo sapiens
gggctgggcatggtgttccctc

SEQ ID NO: 7172536 - DNA, 22 bp, Homo sapiens
gggctgggcatggtgttccctc

SEQ ID NO: 7172537 - DNA, 22 bp, Homo sapiens
gggctggggctcaataatttgt

SEQ ID NO: 7172538 - DNA, 22 bp, Homo sapiens
gggctgggcatggtgttccctc

SEQ ID NO: 7172539 - DNA, 22 bp, Homo sapiens
gggctgggcatggtgttccctc

SEQ ID NO: 7172540 - DNA, 22 bp, Homo sapiens
gggctgggcatggtgttccctc

SEQ ID NO: 7172541 - DNA, 22 bp, Homo sapiens
gggctggggctcaataatttgt

SEQ ID NO: 7172542 - DNA, 22 bp, Homo sapiens
gggctggggctcaataatttgt

SEQ ID NO: 7172543 - DNA, 22 bp, Homo sapiens
gggctggggctcaataatttgt

SEQ ID NO: 7172544 - DNA, 22 bp, Homo sapiens
gggctggggctcaataatttgt

SEQ ID NO: 7172545 - DNA, 22 bp, Homo sapiens
gggctggggctcaataatttgt

SEQ ID NO: 7172546 - DNA, 22 bp, Homo sapiens
gggggaagaaagaacatggcat

SEQ ID NO: 7172547 - DNA, 22 bp, Homo sapiens
gggggaagaaagaacatggcat

SEQ ID NO: 7172548 - DNA, 22 bp, Homo sapiens
gggggaagaaagaacatggcat

SEQ ID NO: 7172549 - DNA, 22 bp, Homo sapiens
gggggaaatagaaatgcttaga

SEQ ID NO: 7172550 - DNA, 22 bp, Homo sapiens
gggggaaagtggaggttcgtga

SEQ ID NO: 7172551 - DNA, 22 bp, Homo sapiens
gggggaagactgggctagtgat

SEQ ID NO: 7172552 - DNA, 22 bp, Homo sapiens
gggggaagactgggctagtgat

SEQ ID NO: 7172553 - DNA, 22 bp, Homo sapiens
gggggaagactgggctagtgat

SEQ ID NO: 7172554 - DNA, 22 bp, Homo sapiens
gggggaagactgggctagtgat

SEQ ID NO: 7172555 - DNA, 22 bp, Homo sapiens
gggggaagactgggctagtgat

SEQ ID NO: 7172556 - DNA, 22 bp, Homo sapiens
gggggaagactgggctagtgat

SEQ ID NO: 7172557 - DNA, 22 bp, Homo sapiens
gggggaagtaattataaaccaa

SEQ ID NO: 7172558 - DNA, 22 bp, Homo sapiens
gggggacaggatgaatatctgt

SEQ ID NO: 7172559 - DNA, 22 bp, Homo sapiens
gggggactggaccgtcctgggt

SEQ ID NO: 7172560 - DNA, 21 bp, Homo sapiens
gggggaagaggagttgctagt

SEQ ID NO: 7172561 - DNA, 22 bp, Homo sapiens
gggggaagactgggctagtgat

SEQ ID NO: 7172562 - DNA, 21 bp, Homo sapiens
gggggaagaggagttgctagt

SEQ ID NO: 7172563 - DNA, 22 bp, Homo sapiens
gggggaagaggcatgaagtcct

SEQ ID NO: 7172564 - DNA, 22 bp, Homo sapiens
gggggaagaggcatgaagtcct

SEQ ID NO: 7172565 - DNA, 22 bp, Homo sapiens
gggggaagtaattataaaccaa

SEQ ID NO: 7172566 - DNA, 22 bp, Homo sapiens
ggggcaggaggtgttctctttt

SEQ ID NO: 7172567 - DNA, 22 bp, Homo sapiens
ggggcaggaggtgttctctttt

SEQ ID NO: 7172568 - DNA, 22 bp, Homo sapiens
ggggctggtggtggtttctcca

SEQ ID NO: 7172569 - DNA, 22 bp, Homo sapiens
ggggctgtttttggaatggctg

SEQ ID NO: 7172570 - DNA, 22 bp, Homo sapiens
ggggcttttgcacgtgggaggc

SEQ ID NO: 7172571 - DNA, 22 bp, Homo sapiens
ggggcttctttctgccaccgac

SEQ ID NO: 7172572 - DNA, 22 bp, Homo sapiens
ggggcttttgcacgtgggaggc

SEQ ID NO: 7172573 - DNA, 22 bp, Homo sapiens
gggggaaagctcaggagcctgt

SEQ ID NO: 7172574 - DNA, 22 bp, Homo sapiens
gggggaaagctcaggagcctgt

SEQ ID NO: 7172575 - DNA, 22 bp, Homo sapiens
ggggcttccagcgcccgccggt

SEQ ID NO: 7172576 - DNA, 22 bp, Homo sapiens
ggggcagctcccgagggcagga

SEQ ID NO: 7172577 - DNA, 22 bp, Homo sapiens
ggggcagctcccgagggcagga

SEQ ID NO: 7172578 - DNA, 22 bp, Homo sapiens
ggggcaggagcccttcttcagc

SEQ ID NO: 7172579 - DNA, 22 bp, Homo sapiens
ggggcagctcccgagggcagga

SEQ ID NO: 7172580 - DNA, 22 bp, Homo sapiens
ggggcagctcccgagggcagga

SEQ ID NO: 7172581 - DNA, 22 bp, Homo sapiens
ggggcaggagcccttcttcagc

SEQ ID NO: 7172582 - DNA, 22 bp, Homo sapiens
ggggcaggagcccttcttcagc

SEQ ID NO: 7172583 - DNA, 22 bp, Homo sapiens
ggggcaggagcccttcttcagc

SEQ ID NO: 7172584 - DNA, 22 bp, Homo sapiens
ggggcaggagcccttcttcagc

SEQ ID NO: 7172585 - DNA, 22 bp, Homo sapiens
ggggcaggagcccttcttcagc

SEQ ID NO: 7172586 - DNA, 22 bp, Homo sapiens
gggggagagacgagcggctctg

SEQ ID NO: 7172587 - DNA, 22 bp, Homo sapiens
gggggagagacgagcggctctg

SEQ ID NO: 7172588 - DNA, 22 bp, Homo sapiens
gggggagagacgagcggctctg

SEQ ID NO: 7172589 - DNA, 22 bp, Homo sapiens
gggggagagacgagcggctctg

SEQ ID NO: 7172590 - DNA, 22 bp, Homo sapiens
gggggagctacaggtcccttgg

SEQ ID NO: 7172591 - DNA, 22 bp, Homo sapiens
gggggagctagtccagctgagg

SEQ ID NO: 7172592 - DNA, 22 bp, Homo sapiens
gggggagctagtccagctgagg

SEQ ID NO: 7172593 - DNA, 22 bp, Homo sapiens
gggggagctagtccagctgagg

SEQ ID NO: 7172594 - DNA, 20 bp, Homo sapiens
gggggccagcagcagacgcc

SEQ ID NO: 7172595 - DNA, 20 bp, Homo sapiens
gggggccagcagcagacgcc

SEQ ID NO: 7172596 - DNA, 22 bp, Homo sapiens
gggggcagtaaggatatggaaa

SEQ ID NO: 7172597 - DNA, 22 bp, Homo sapiens
gggggcagtaaggatatggaaa

SEQ ID NO: 7172598 - DNA, 22 bp, Homo sapiens
gggggcagtaaggatatggaaa

SEQ ID NO: 7172599 - DNA, 20 bp, Homo sapiens
gggggccagcagcagacgcc

SEQ ID NO: 7172600 - DNA, 22 bp, Homo sapiens
gggggccagtcatctcccaaga

SEQ ID NO: 7172601 - DNA, 22 bp, Homo sapiens
gggggccagtcatctcccaaga

SEQ ID NO: 7172602 - DNA, 22 bp, Homo sapiens
gggggccagtcatctcccaaga

SEQ ID NO: 7172603 - DNA, 22 bp, Homo sapiens
gggggccagtcatctcccaaga

SEQ ID NO: 7172604 - DNA, 22 bp, Homo sapiens
gggggccagtgtctcttccttg

SEQ ID NO: 7172605 - DNA, 22 bp, Homo sapiens
gggggccatcttcaaggatgtg

SEQ ID NO: 7172606 - DNA, 22 bp, Homo sapiens
gggggccagtgtctcttccttg

SEQ ID NO: 7172607 - DNA, 22 bp, Homo sapiens
gggggccagtgtctcttccttg

SEQ ID NO: 7172608 - DNA, 22 bp, Homo sapiens
gggggccatcttcaaggatgtg

SEQ ID NO: 7172609 - DNA, 22 bp, Homo sapiens
gggggccatcttcaaggatgtg

SEQ ID NO: 7172610 - DNA, 23 bp, Homo sapiens
gggggccgtcctggggattatag

SEQ ID NO: 7172611 - DNA, 22 bp, Homo sapiens
gggggcgccccatggaggtgag

SEQ ID NO: 7172612 - DNA, 22 bp, Homo sapiens
gggggccttattcatctgccag

SEQ ID NO: 7172613 - DNA, 22 bp, Homo sapiens
gggggccttgttagtggatgga

SEQ ID NO: 7172614 - DNA, 22 bp, Homo sapiens
gggtcagagttcaggtcgaggg

SEQ ID NO: 7172615 - DNA, 22 bp, Homo sapiens
gggtcagagtaagcaaggacaa

SEQ ID NO: 7172616 - DNA, 22 bp, Homo sapiens
gggtcagcgatttcaggggcag

SEQ ID NO: 7172617 - DNA, 22 bp, Homo sapiens
gggtcagcgatttcaggggcag

SEQ ID NO: 7172618 - DNA, 22 bp, Homo sapiens
gggtcagcgatttcaggggcag

SEQ ID NO: 7172619 - DNA, 22 bp, Homo sapiens
gggtcagctccctccccagggc

SEQ ID NO: 7172620 - DNA, 22 bp, Homo sapiens
gggtcagctgctgggggctgac

SEQ ID NO: 7172621 - DNA, 22 bp, Homo sapiens
gggtcaattctgaggtccgttt

SEQ ID NO: 7172622 - DNA, 22 bp, Homo sapiens
gggtcactgtaaggcaataagt

SEQ ID NO: 7172623 - DNA, 22 bp, Homo sapiens
gggtatgatagggaggtgaaat

SEQ ID NO: 7172624 - DNA, 22 bp, Homo sapiens
gggtattaaaatgaaggagaaa

SEQ ID NO: 7172625 - DNA, 22 bp, Homo sapiens
gggtatgagatataggtgaata

SEQ ID NO: 7172626 - DNA, 22 bp, Homo sapiens
gggggcggagcacgtgaccacg

SEQ ID NO: 7172627 - DNA, 22 bp, Homo sapiens
gggggcgggagacagcagtgac

SEQ ID NO: 7172628 - DNA, 22 bp, Homo sapiens
gggggcgggagacagcagtgac

SEQ ID NO: 7172629 - DNA, 22 bp, Homo sapiens
gggggcgggagacagcagtgac

SEQ ID NO: 7172630 - DNA, 22 bp, Homo sapiens
gggggcgggagacagcagtgac

SEQ ID NO: 7172631 - DNA, 22 bp, Homo sapiens
gggggcgggagacagcagtgac

SEQ ID NO: 7172632 - DNA, 23 bp, Homo sapiens
gggggcgtgtcatggagggccac

SEQ ID NO: 7172633 - DNA, 23 bp, Homo sapiens
gggggcgtgtcatggagggccac

SEQ ID NO: 7172634 - DNA, 22 bp, Homo sapiens
ggtgccagtgggtctcaggata

SEQ ID NO: 7172635 - DNA, 22 bp, Homo sapiens
ggtgccagtgggtctcaggata

SEQ ID NO: 7172636 - DNA, 22 bp, Homo sapiens
ggtgccaggctgtagtcagggt

SEQ ID NO: 7172637 - DNA, 22 bp, Homo sapiens
ggtgccaggctgtagtcagggt

SEQ ID NO: 7172638 - DNA, 22 bp, Homo sapiens
ggtgccagcctagtgcagtggt

SEQ ID NO: 7172639 - DNA, 22 bp, Homo sapiens
ggtgccaggctcccagctcagg

SEQ ID NO: 7172640 - DNA, 22 bp, Homo sapiens
ggtgccaggctcccagctcagg

SEQ ID NO: 7172641 - DNA, 22 bp, Homo sapiens
ggtgccagcctagtgcagtggt

SEQ ID NO: 7172642 - DNA, 22 bp, Homo sapiens
ggtgccagagtggcccaggggc

SEQ ID NO: 7172643 - DNA, 22 bp, Homo sapiens
ggtgccagatgaggcccgcgat

SEQ ID NO: 7172644 - DNA, 22 bp, Homo sapiens
ggtgccagatgaggcccgcgat

SEQ ID NO: 7172645 - DNA, 22 bp, Homo sapiens
ggtgccagatgaggcccgcgat

SEQ ID NO: 7172646 - DNA, 22 bp, Homo sapiens
ggtgccaatttatttagccaag

SEQ ID NO: 7172647 - DNA, 22 bp, Homo sapiens
ggtgccaagaactacaggattc

SEQ ID NO: 7172648 - DNA, 23 bp, Homo sapiens
ggtgccaagcttctatgtttagc

SEQ ID NO: 7172649 - DNA, 18 bp, Homo sapiens
ggtgccaagtctgggatc

SEQ ID NO: 7172650 - DNA, 18 bp, Homo sapiens
ggtgccaagtctgggatc

SEQ ID NO: 7172651 - DNA, 22 bp, Homo sapiens
ggtgccaagttgcaactcgcca

SEQ ID NO: 7172652 - DNA, 22 bp, Homo sapiens
ggtgccactgcactctggcctg

SEQ ID NO: 7172653 - DNA, 22 bp, Homo sapiens
ggtgccagagtggcccaggggc

SEQ ID NO: 7172654 - DNA, 20 bp, Homo sapiens
ggtgcgaggccagagcagac

SEQ ID NO: 7172655 - DNA, 20 bp, Homo sapiens
ggtgcgaggccagagcagac

SEQ ID NO: 7172656 - DNA, 22 bp, Homo sapiens
ggtgccttcctgccagccgcaa

SEQ ID NO: 7172657 - DNA, 22 bp, Homo sapiens
ggtgcctttggcccctggctag

SEQ ID NO: 7172658 - DNA, 22 bp, Homo sapiens
ggtgcgggccgcctgcccttgg

SEQ ID NO: 7172659 - DNA, 22 bp, Homo sapiens
ggtggctctgttgtcaactgat

SEQ ID NO: 7172660 - DNA, 22 bp, Homo sapiens
ggtgctcaaggtgacaggacat

SEQ ID NO: 7172661 - DNA, 22 bp, Homo sapiens
ggtgccctgtaaaagccatgca

SEQ ID NO: 7172662 - DNA, 22 bp, Homo sapiens
ggtgcccttcagacagtgggca

SEQ ID NO: 7172663 - DNA, 22 bp, Homo sapiens
ggtgcctgatggtgatgaggtc

SEQ ID NO: 7172664 - DNA, 22 bp, Homo sapiens
ggtgcctgtatttggggcacag

SEQ ID NO: 7172665 - DNA, 22 bp, Homo sapiens
ggtgcccagagccaggaatgag

SEQ ID NO: 7172666 - DNA, 22 bp, Homo sapiens
ggtgcccagcgaagtggctgtg

SEQ ID NO: 7172667 - DNA, 22 bp, Homo sapiens
ggtgcccagcgaagtggctgtg

SEQ ID NO: 7172668 - DNA, 22 bp, Homo sapiens
ggtgcccagcgaagtggctgtg

SEQ ID NO: 7172669 - DNA, 22 bp, Homo sapiens
ggtgggagggctgcgttcctct

SEQ ID NO: 7172670 - DNA, 16 bp, Homo sapiens
ggtgggaggtgaggtg

SEQ ID NO: 7172671 - DNA, 22 bp, Homo sapiens
ggtgggagtggaacgtggaaga

SEQ ID NO: 7172672 - DNA, 16 bp, Homo sapiens
ggtgggaggtgaggtg

SEQ ID NO: 7172673 - DNA, 22 bp, Homo sapiens
ggtgggagtgggcacagttacg

SEQ ID NO: 7172674 - DNA, 22 bp, Homo sapiens
ggtgggagtggaacgtggaaga

SEQ ID NO: 7172675 - DNA, 22 bp, Homo sapiens
ggtgggagtggaacgtggaaga

SEQ ID NO: 7172676 - DNA, 22 bp, Homo sapiens
ggtgggagtggaacgtggaaga

SEQ ID NO: 7172677 - DNA, 22 bp, Homo sapiens
ggtgggatgcctctggagaagt

SEQ ID NO: 7172678 - DNA, 22 bp, Homo sapiens
ggtgggatgcctctggagaagt

SEQ ID NO: 7172679 - DNA, 22 bp, Homo sapiens
ggtgggagtgggcacagttacg

SEQ ID NO: 7172680 - DNA, 22 bp, Homo sapiens
ggtgggatggaggatcttagac

SEQ ID NO: 7172681 - DNA, 22 bp, Homo sapiens
ggtgggcaacatttggcctgag

SEQ ID NO: 7172682 - DNA, 22 bp, Homo sapiens
ggtgggcaacatttggcctgag

SEQ ID NO: 7172683 - DNA, 22 bp, Homo sapiens
ggtgggcaacatttggcctgag

SEQ ID NO: 7172684 - DNA, 22 bp, Homo sapiens
ggtgggcaacatttggcctgag

SEQ ID NO: 7172685 - DNA, 22 bp, Homo sapiens
ggtgggcaacatttggcctgag

SEQ ID NO: 7172686 - DNA, 22 bp, Homo sapiens
ggtgggcaacatttggcctgag

SEQ ID NO: 7172687 - DNA, 21 bp, Homo sapiens
ggtgggcacaggagagcagag

SEQ ID NO: 7172688 - DNA, 21 bp, Homo sapiens
ggtgggcacaggagagcagag

SEQ ID NO: 7172689 - DNA, 21 bp, Homo sapiens
ggtgggcacaggagagcagag

SEQ ID NO: 7172690 - DNA, 22 bp, Homo sapiens
ggtgggagggctgcgttcctct

SEQ ID NO: 7172691 - DNA, 22 bp, Homo sapiens
ggtgggaggcaggctgctccca

SEQ ID NO: 7172692 - DNA, 22 bp, Homo sapiens
ggtgggagggctgcgttcctct

SEQ ID NO: 7172693 - DNA, 22 bp, Homo sapiens
ggtgggagggctgcgttcctct

SEQ ID NO: 7172694 - DNA, 22 bp, Homo sapiens
ggtgggaggcaggctgctccca

SEQ ID NO: 7172695 - DNA, 22 bp, Homo sapiens
ggtgggaggcaggctgctccca

SEQ ID NO: 7172696 - DNA, 22 bp, Homo sapiens
ggtgggaggcaggctgctccca

SEQ ID NO: 7172697 - DNA, 22 bp, Homo sapiens
ggtgggaggactgtttgaggca

SEQ ID NO: 7172698 - DNA, 23 bp, Homo sapiens
ggtgggagattatccagaattat

SEQ ID NO: 7172699 - DNA, 23 bp, Homo sapiens
ggtgggagattatccagaattat

SEQ ID NO: 7172700 - DNA, 23 bp, Homo sapiens
ggtgggagattatccagaattat

SEQ ID NO: 7172701 - DNA, 22 bp, Homo sapiens
ggtgggagagcttgctttgatg

SEQ ID NO: 7172702 - DNA, 22 bp, Homo sapiens
ggtgggagagctctgtctccag

SEQ ID NO: 7172703 - DNA, 22 bp, Homo sapiens
ggtggctgcaatggctaacttc

SEQ ID NO: 7172704 - DNA, 22 bp, Homo sapiens
ggtggctgcaccctggctaact

SEQ ID NO: 7172705 - DNA, 22 bp, Homo sapiens
ggtggctgcaccctggctaact

SEQ ID NO: 7172706 - DNA, 22 bp, Homo sapiens
ggtgggagagctctgtctccag

SEQ ID NO: 7172707 - DNA, 22 bp, Homo sapiens
ggtgaagggccttaggagacag

SEQ ID NO: 7172708 - DNA, 22 bp, Homo sapiens
ggtgaaggcacaagagggcaag

SEQ ID NO: 7172709 - DNA, 22 bp, Homo sapiens
ggtgaagggccttaggagacag

SEQ ID NO: 7172710 - DNA, 22 bp, Homo sapiens
ggtgaagggccttaggagacag

SEQ ID NO: 7172711 - DNA, 22 bp, Homo sapiens
ggtgaagggccttaggagacag

SEQ ID NO: 7172712 - DNA, 22 bp, Homo sapiens
ggtgaaggcacaagagggcaag

SEQ ID NO: 7172713 - DNA, 22 bp, Homo sapiens
ggtgaaggcacaagagggcaag

SEQ ID NO: 7172714 - DNA, 22 bp, Homo sapiens
ggtgaaggcacaagagggcaag

SEQ ID NO: 7172715 - DNA, 22 bp, Homo sapiens
ggtgaaggaggaagctgatgga

SEQ ID NO: 7172716 - DNA, 22 bp, Homo sapiens
ggtgaaggaggaagctgatgga

SEQ ID NO: 7172717 - DNA, 22 bp, Homo sapiens
ggtgaagcgtatttgtggagct

SEQ ID NO: 7172718 - DNA, 22 bp, Homo sapiens
ggtgaagggccttaggagacag

SEQ ID NO: 7172719 - DNA, 22 bp, Homo sapiens
ggtgaagggtgtcatggcattt

SEQ ID NO: 7172720 - DNA, 22 bp, Homo sapiens
ggtgaaggtcagagcaggaaaa

SEQ ID NO: 7172721 - DNA, 22 bp, Homo sapiens
ggtgaaggtcagagcaggaaaa

SEQ ID NO: 7172722 - DNA, 22 bp, Homo sapiens
ggtgaaggtggaacgcagagca

SEQ ID NO: 7172723 - DNA, 22 bp, Homo sapiens
ggtgaagtaataccaggtgtac

SEQ ID NO: 7172724 - DNA, 22 bp, Homo sapiens
ggtgaaggtggaacgcagagca

SEQ ID NO: 7172725 - DNA, 22 bp, Homo sapiens
ggtgaaggtctactgtgtgcca

SEQ ID NO: 7172726 - DNA, 22 bp, Homo sapiens
ggtgaaggtctactgtgtgcca

SEQ ID NO: 7172727 - DNA, 22 bp, Homo sapiens
ggtgcagggagaggcaggcccc

SEQ ID NO: 7172728 - DNA, 22 bp, Homo sapiens
ggtgaataagctgaacacttgg

SEQ ID NO: 7172729 - DNA, 22 bp, Homo sapiens
ggtgaagtaatgaaacagggag

SEQ ID NO: 7172730 - DNA, 22 bp, Homo sapiens
ggtgaagtatgaggaaatggag

SEQ ID NO: 7172731 - DNA, 22 bp, Homo sapiens
ggtgaagtatgaggaaatggag

SEQ ID NO: 7172732 - DNA, 22 bp, Homo sapiens
ggtgaattaatgatggtaaggc

SEQ ID NO: 7172733 - DNA, 22 bp, Homo sapiens
ggtgaattaccaaaggggcaga

SEQ ID NO: 7172734 - DNA, 22 bp, Homo sapiens
ggtgaattgaccaaaatcagac

SEQ ID NO: 7172735 - DNA, 22 bp, Homo sapiens
ggtgcagggagaggcaggcccc

SEQ ID NO: 7172736 - DNA, 22 bp, Homo sapiens
ggtgcagggagaggcaggcccc

SEQ ID NO: 7172737 - DNA, 22 bp, Homo sapiens
ggtgcagggagaggcaggcccc

SEQ ID NO: 7172738 - DNA, 21 bp, Homo sapiens
ggtgcaggtaatgatgatata

SEQ ID NO: 7172739 - DNA, 22 bp, Homo sapiens
ggtgcatggaaagagtaagtaa

SEQ ID NO: 7172740 - DNA, 22 bp, Homo sapiens
ggtgcatgtagccatcaagata

SEQ ID NO: 7172741 - DNA, 22 bp, Homo sapiens
ggtgcatgtgagaaagactggg

SEQ ID NO: 7172742 - DNA, 22 bp, Homo sapiens
ggtgcagggagaggcaggcccc

SEQ ID NO: 7172743 - DNA, 20 bp, Homo sapiens
ggtgcaggtaacgctgtgct

SEQ ID NO: 7172744 - DNA, 20 bp, Homo sapiens
ggtgcaggtaacgctgtgct

SEQ ID NO: 7172745 - DNA, 21 bp, Homo sapiens
ggtgcaggtaatgatgatata

SEQ ID NO: 7172746 - DNA, 22 bp, Homo sapiens
ggtgaaattccttgtggaaagt

SEQ ID NO: 7172747 - DNA, 22 bp, Homo sapiens
ggtgaaattccttgtggaaagt

SEQ ID NO: 7172748 - DNA, 22 bp, Homo sapiens
ggtgaaatgtagtcttgtgaga

SEQ ID NO: 7172749 - DNA, 22 bp, Homo sapiens
ggtgaaatatttttgatatgtt

SEQ ID NO: 7172750 - DNA, 22 bp, Homo sapiens
ggtgaaatatttttgatatgtt

SEQ ID NO: 7172751 - DNA, 22 bp, Homo sapiens
ggtctttctttgatagtggaga

SEQ ID NO: 7172752 - DNA, 22 bp, Homo sapiens
ggtctttcattacatgggttaa

SEQ ID NO: 7172753 - DNA, 18 bp, Homo sapiens
ggtctttaggtcagtgtc

SEQ ID NO: 7172754 - DNA, 17 bp, Homo sapiens
ggtctgtgtctagggaa

SEQ ID NO: 7172755 - DNA, 17 bp, Homo sapiens
ggtctgtgtctagggaa

SEQ ID NO: 7172756 - DNA, 17 bp, Homo sapiens
ggtctgtgtctagggaa

SEQ ID NO: 7172757 - DNA, 22 bp, Homo sapiens
ggtctgtgtgctttgggaagtg

SEQ ID NO: 7172758 - DNA, 22 bp, Homo sapiens
ggtctgtgtgctttgggaagtg

SEQ ID NO: 7172759 - DNA, 22 bp, Homo sapiens
ggtcttcagctttgcatgtctt

SEQ ID NO: 7172760 - DNA, 22 bp, Homo sapiens
ggtcttcagctttgcatgtctt

SEQ ID NO: 7172761 - DNA, 21 bp, Homo sapiens
ggtcttccaaataaggagaaa

SEQ ID NO: 7172762 - DNA, 22 bp, Homo sapiens
ggtcttctctatgagctggtct

SEQ ID NO: 7172763 - DNA, 22 bp, Homo sapiens
ggtcttctctatgagctggtct

SEQ ID NO: 7172764 - DNA, 22 bp, Homo sapiens
ggtcttctggaaagcagactgt

SEQ ID NO: 7172765 - DNA, 22 bp, Homo sapiens
ggtccagtctttcccttctaga

SEQ ID NO: 7172766 - DNA, 22 bp, Homo sapiens
ggtccagtgggttcctccaata

SEQ ID NO: 7172767 - DNA, 22 bp, Homo sapiens
ggtccagttctccctctatgtc

SEQ ID NO: 7172768 - DNA, 22 bp, Homo sapiens
ggtccatgataggaagttccga

SEQ ID NO: 7172769 - DNA, 22 bp, Homo sapiens
ggtcccaagcaatgcccttggc

SEQ ID NO: 7172770 - DNA, 22 bp, Homo sapiens
ggtcccaaggaggatgaggcta

SEQ ID NO: 7172771 - DNA, 22 bp, Homo sapiens
ggtcccaaggaggatgaggcta

SEQ ID NO: 7172772 - DNA, 22 bp, Homo sapiens
ggtcccaagtgcttttcctgca

SEQ ID NO: 7172773 - DNA, 22 bp, Homo sapiens
ggtcccaatctaatcacatgag

SEQ ID NO: 7172774 - DNA, 22 bp, Homo sapiens
ggtctgggcttgagtccttttg

SEQ ID NO: 7172775 - DNA, 22 bp, Homo sapiens
ggtctggggcaggcatctgaca

SEQ ID NO: 7172776 - DNA, 17 bp, Homo sapiens
ggtctggggccattggc

SEQ ID NO: 7172777 - DNA, 22 bp, Homo sapiens
ggtctgggtttccccaccacac

SEQ ID NO: 7172778 - DNA, 22 bp, Homo sapiens
ggtctgtgatcttatggattct

SEQ ID NO: 7172779 - DNA, 22 bp, Homo sapiens
ggtctgtgatcttatggattct

SEQ ID NO: 7172780 - DNA, 22 bp, Homo sapiens
ggtctgtgctctggagcctctg

SEQ ID NO: 7172781 - DNA, 22 bp, Homo sapiens
ggtctgtgctctggagcctctg

SEQ ID NO: 7172782 - DNA, 22 bp, Homo sapiens
ggtctgtgtcataggctgagtt

SEQ ID NO: 7172783 - DNA, 22 bp, Homo sapiens
ggtctgtgtcataggctgagtt

SEQ ID NO: 7172784 - DNA, 22 bp, Homo sapiens
ggtctgtgtcataggctgagtt

SEQ ID NO: 7172785 - DNA, 22 bp, Homo sapiens
ggtctgtgtcataggctgagtt

SEQ ID NO: 7172786 - DNA, 22 bp, Homo sapiens
ggtccaggtatgtggtgtgaat

SEQ ID NO: 7172787 - DNA, 22 bp, Homo sapiens
ggtccaggtcctgtgacagcag

SEQ ID NO: 7172788 - DNA, 22 bp, Homo sapiens
ggtccaggtcctgtgacagcag

SEQ ID NO: 7172789 - DNA, 22 bp, Homo sapiens
ggtccaggtttgctctacttgt

SEQ ID NO: 7172790 - DNA, 22 bp, Homo sapiens
ggtccaggtatgtggtgtgaat

SEQ ID NO: 7172791 - DNA, 22 bp, Homo sapiens
ggtcagggttccaggtatcttc

SEQ ID NO: 7172792 - DNA, 22 bp, Homo sapiens
ggtccagagctgatggtctttt

SEQ ID NO: 7172793 - DNA, 22 bp, Homo sapiens
ggtccagccaggtgctcatgcc

SEQ ID NO: 7172794 - DNA, 23 bp, Homo sapiens
ggtccaggaaaggcagcagcacc

SEQ ID NO: 7172795 - DNA, 23 bp, Homo sapiens
ggtccaggaaaggcagcagcacc

SEQ ID NO: 7172796 - DNA, 22 bp, Homo sapiens
ggtcagggctcttccagtggct

SEQ ID NO: 7172797 - DNA, 22 bp, Homo sapiens
ggtcaggccactcaacccttat

SEQ ID NO: 7172798 - DNA, 22 bp, Homo sapiens
ggtcagggctcttccagtggct

SEQ ID NO: 7172799 - DNA, 22 bp, Homo sapiens
ggtcagggctgggtatgaagag

SEQ ID NO: 7172800 - DNA, 22 bp, Homo sapiens
ggtcagggctgggtatgaagag

SEQ ID NO: 7172801 - DNA, 18 bp, Homo sapiens
ggtcaggggcggagagaa

SEQ ID NO: 7172802 - DNA, 18 bp, Homo sapiens
ggtcaggggcggagagaa

SEQ ID NO: 7172803 - DNA, 18 bp, Homo sapiens
ggtcaggggcggagagaa

SEQ ID NO: 7172804 - DNA, 18 bp, Homo sapiens
ggtcaggggcggagagaa

SEQ ID NO: 7172805 - DNA, 18 bp, Homo sapiens
ggtcaggggcggagagaa

SEQ ID NO: 7172806 - DNA, 22 bp, Homo sapiens
ggtcaggggctgctctacagag

SEQ ID NO: 7172807 - DNA, 22 bp, Homo sapiens
ggtcaggggctgctctacagag

SEQ ID NO: 7172808 - DNA, 22 bp, Homo sapiens
ggtcaggggctgctctacagag

SEQ ID NO: 7172809 - DNA, 22 bp, Homo sapiens
ggtcagggggatctgtgaggta

SEQ ID NO: 7172810 - DNA, 22 bp, Homo sapiens
ggtcagggggatctgtgaggta

SEQ ID NO: 7172811 - DNA, 22 bp, Homo sapiens
ggtcagggggatctgtgaggta

SEQ ID NO: 7172812 - DNA, 22 bp, Homo sapiens
ggtcagggggatctgtgaggta

SEQ ID NO: 7172813 - DNA, 21 bp, Homo sapiens
ggtcagggggtgcctccaggt

SEQ ID NO: 7172814 - DNA, 21 bp, Homo sapiens
ggtcagggggtgcctccaggt

SEQ ID NO: 7172815 - DNA, 21 bp, Homo sapiens
ggtcagggggtgcctccaggt

SEQ ID NO: 7172816 - DNA, 22 bp, Homo sapiens
ggtcagggtataatcaagtgag

SEQ ID NO: 7172817 - DNA, 22 bp, Homo sapiens
ggtcagggtataatcaagtgag

SEQ ID NO: 7172818 - DNA, 23 bp, Homo sapiens
ggtagagccgcgccctgggggaa

SEQ ID NO: 7172819 - DNA, 22 bp, Homo sapiens
ggtagcaagcgcttgccctgcg

SEQ ID NO: 7172820 - DNA, 22 bp, Homo sapiens
ggtagcatctttggatgttatt

SEQ ID NO: 7172821 - DNA, 22 bp, Homo sapiens
ggtagcgttatcaatttgagtg

SEQ ID NO: 7172822 - DNA, 20 bp, Homo sapiens
ggtagctgctgcagttggta

SEQ ID NO: 7172823 - DNA, 20 bp, Homo sapiens
ggtagctgctgcagttggta

SEQ ID NO: 7172824 - DNA, 20 bp, Homo sapiens
ggtagctgctgcagttggta

SEQ ID NO: 7172825 - DNA, 22 bp, Homo sapiens
ggtaggagtattttgcagcagt

SEQ ID NO: 7172826 - DNA, 22 bp, Homo sapiens
ggtaggaagatagagcaaagtt

SEQ ID NO: 7172827 - DNA, 22 bp, Homo sapiens
ggtagggaaggctctgcgggga

SEQ ID NO: 7172828 - DNA, 22 bp, Homo sapiens
ggtaggagtattttgcagcagt

SEQ ID NO: 7172829 - DNA, 22 bp, Homo sapiens
ggtaggagtgaagacttaagat

SEQ ID NO: 7172830 - DNA, 22 bp, Homo sapiens
ggtaggagtgaagacttaagat

SEQ ID NO: 7172831 - DNA, 21 bp, Homo sapiens
ggtcaggcatgtgccctgagc

SEQ ID NO: 7172832 - DNA, 22 bp, Homo sapiens
ggtcaggccactcaacccttat

SEQ ID NO: 7172833 - DNA, 22 bp, Homo sapiens
ggtcaggagcccttggccccct

SEQ ID NO: 7172834 - DNA, 22 bp, Homo sapiens
ggtcagccttggatttggtagc

SEQ ID NO: 7172835 - DNA, 21 bp, Homo sapiens
ggtcagctctatccacgcctt

SEQ ID NO: 7172836 - DNA, 19 bp, Homo sapiens
ggtcagctgggctagaggc

SEQ ID NO: 7172837 - DNA, 22 bp, Homo sapiens
ggtcagccttggatttggtagc

SEQ ID NO: 7172838 - DNA, 22 bp, Homo sapiens
ggtcagccttggatttggtagc

SEQ ID NO: 7172839 - DNA, 22 bp, Homo sapiens
ggtcagcccctgctcaaggccg

SEQ ID NO: 7172840 - DNA, 22 bp, Homo sapiens
ggtagggcaaagtagggcacct

SEQ ID NO: 7172841 - DNA, 22 bp, Homo sapiens
ggtagggcaaagtagggcacct

SEQ ID NO: 7172842 - DNA, 22 bp, Homo sapiens
ggtagggatgggatttggaagt

SEQ ID NO: 7172843 - DNA, 22 bp, Homo sapiens
ggtcagcatctggttgagggca

SEQ ID NO: 7172844 - DNA, 22 bp, Homo sapiens
ggtagggaaggctctgcgggga

SEQ ID NO: 7172845 - DNA, 22 bp, Homo sapiens
ggtagggaaggctctgcgggga

SEQ ID NO: 7172846 - DNA, 22 bp, Homo sapiens
ggtagggaaggctctgcgggga

SEQ ID NO: 7172847 - DNA, 22 bp, Homo sapiens
ggtagggaaggtctcccacatt

SEQ ID NO: 7172848 - DNA, 21 bp, Homo sapiens
ggtagggaaggttcgctggtg

SEQ ID NO: 7172849 - DNA, 21 bp, Homo sapiens
ggtagggaaggttcgctggtg

SEQ ID NO: 7172850 - DNA, 21 bp, Homo sapiens
ggtagggaaggttcgctggtg

SEQ ID NO: 7172851 - DNA, 22 bp, Homo sapiens
ggtacagacagggctgcctggg

SEQ ID NO: 7172852 - DNA, 22 bp, Homo sapiens
ggtacatttttctgtcactttg

SEQ ID NO: 7172853 - DNA, 22 bp, Homo sapiens
ggtacatcattaattgcatgtt

SEQ ID NO: 7172854 - DNA, 22 bp, Homo sapiens
ggtacccagggttgcttcaagt

SEQ ID NO: 7172855 - DNA, 22 bp, Homo sapiens
ggtactttatacatgcatctgc

SEQ ID NO: 7172856 - DNA, 22 bp, Homo sapiens
ggtactttatacatgcatctgc

SEQ ID NO: 7172857 - DNA, 19 bp, Homo sapiens
ggtagaagggaagtgtttt

SEQ ID NO: 7172858 - DNA, 22 bp, Homo sapiens
ggtagacaactttgtaatagcc

SEQ ID NO: 7172859 - DNA, 22 bp, Homo sapiens
ggtacacattgtgactgtatta

SEQ ID NO: 7172860 - DNA, 20 bp, Homo sapiens
ggtacaacttgaatgataac

SEQ ID NO: 7172861 - DNA, 22 bp, Homo sapiens
ggtaagtttataggtccctttg

SEQ ID NO: 7172862 - DNA, 19 bp, Homo sapiens
ggtaatattgtcagtgaca

SEQ ID NO: 7172863 - DNA, 22 bp, Homo sapiens
ggtaattctagtcattgcatca

SEQ ID NO: 7172864 - DNA, 22 bp, Homo sapiens
ggtaacaaggccgatagaaaca

SEQ ID NO: 7172865 - DNA, 22 bp, Homo sapiens
ggtaacaaggccgatagaaaca

SEQ ID NO: 7172866 - DNA, 22 bp, Homo sapiens
ggtaacaaacttctgacttaag

SEQ ID NO: 7172867 - DNA, 22 bp, Homo sapiens
ggtaacaaccctacaaatccac

SEQ ID NO: 7172868 - DNA, 22 bp, Homo sapiens
ggtaacagtatgtagagtaaga

SEQ ID NO: 7172869 - DNA, 22 bp, Homo sapiens
ggtaacttagctcatggctgtg

SEQ ID NO: 7172870 - DNA, 22 bp, Homo sapiens
ggtaacttgagtgtgttgttca

SEQ ID NO: 7172871 - DNA, 22 bp, Homo sapiens
ggtaaggagagagaaattatgc

SEQ ID NO: 7172872 - DNA, 22 bp, Homo sapiens
ggtaaactaaccattttaattt

SEQ ID NO: 7172873 - DNA, 22 bp, Homo sapiens
ggtaaactaaccattttaattt

SEQ ID NO: 7172874 - DNA, 22 bp, Homo sapiens
gggtccagcgacagcaggctca

SEQ ID NO: 7172875 - DNA, 22 bp, Homo sapiens
ggtaaaatgcagattcttagcc

SEQ ID NO: 7172876 - DNA, 23 bp, Homo sapiens
gggtccagccaattccaaggaaa

SEQ ID NO: 7172877 - DNA, 22 bp, Homo sapiens
gggtccagatggtgagagttaa

SEQ ID NO: 7172878 - DNA, 22 bp, Homo sapiens
gggtccagatggtgagagttaa

SEQ ID NO: 7172879 - DNA, 22 bp, Homo sapiens
gggtcaggctagcccagacttc

SEQ ID NO: 7172880 - DNA, 22 bp, Homo sapiens
gggtcaggctagcccagacttc

SEQ ID NO: 7172881 - DNA, 22 bp, Homo sapiens
gggtcaggctagcccagacttc

SEQ ID NO: 7172882 - DNA, 22 bp, Homo sapiens
gggtcaggctagcccagacttc

SEQ ID NO: 7172883 - DNA, 22 bp, Homo sapiens
gggtcaggcctcaaggtgggct

SEQ ID NO: 7172884 - DNA, 22 bp, Homo sapiens
gggtcaggcctcaaggtgggct

SEQ ID NO: 7172885 - DNA, 22 bp, Homo sapiens
gggtcaggcctcaaggtgggct

SEQ ID NO: 7172886 - DNA, 22 bp, Homo sapiens
gggtcaggaagaattctgccaa

SEQ ID NO: 7172887 - DNA, 22 bp, Homo sapiens
gggtcaggaagaattctgccaa

SEQ ID NO: 7172888 - DNA, 22 bp, Homo sapiens
gggtcaggcctcaaggtgggct

SEQ ID NO: 7172889 - DNA, 22 bp, Homo sapiens
gggtcagggaggccccaccatg

SEQ ID NO: 7172890 - DNA, 22 bp, Homo sapiens
gggtcaggctcagcagggcagc

SEQ ID NO: 7172891 - DNA, 22 bp, Homo sapiens
gggtcagggaggccccaccatg

SEQ ID NO: 7172892 - DNA, 22 bp, Homo sapiens
gggtcagggctgcctgggctca

SEQ ID NO: 7172893 - DNA, 22 bp, Homo sapiens
gggtcagggctgcctgggctca

SEQ ID NO: 7172894 - DNA, 22 bp, Homo sapiens
gggtcaggctcagcagggcagc

SEQ ID NO: 7172895 - DNA, 22 bp, Homo sapiens
gggtcaggctcagcagggcagc

SEQ ID NO: 7172896 - DNA, 22 bp, Homo sapiens
gggtcaggctcagcagggcagc

SEQ ID NO: 7172897 - DNA, 22 bp, Homo sapiens
gggtcaggctagcccagacttc

SEQ ID NO: 7172898 - DNA, 22 bp, Homo sapiens
gggtcaggctcagcagggcagc

SEQ ID NO: 7172899 - DNA, 22 bp, Homo sapiens
gggtcaggctcagcagggcagc

SEQ ID NO: 7172900 - DNA, 22 bp, Homo sapiens
gggtccagagcctcagcccaga

SEQ ID NO: 7172901 - DNA, 22 bp, Homo sapiens
gggtccagagttttcccgccct

SEQ ID NO: 7172902 - DNA, 22 bp, Homo sapiens
gggtccagagttttcccgccct

SEQ ID NO: 7172903 - DNA, 22 bp, Homo sapiens
gggtcagtccagggcgctggga

SEQ ID NO: 7172904 - DNA, 22 bp, Homo sapiens
gggtcagtccagggcgctggga

SEQ ID NO: 7172905 - DNA, 22 bp, Homo sapiens
gggtcattctgaaaatgtaaac

SEQ ID NO: 7172906 - DNA, 22 bp, Homo sapiens
gggtcagggctgcctgggctca

SEQ ID NO: 7172907 - DNA, 22 bp, Homo sapiens
gggtcagggctggctgtcgtca

SEQ ID NO: 7172908 - DNA, 22 bp, Homo sapiens
gggtccagacactccagaggaa

SEQ ID NO: 7172909 - DNA, 22 bp, Homo sapiens
gggtccagactatgaagaactt

SEQ ID NO: 7172910 - DNA, 22 bp, Homo sapiens
gggaggtgattaggaccatgta

SEQ ID NO: 7172911 - DNA, 22 bp, Homo sapiens
gggaggtgattaggaccatgta

SEQ ID NO: 7172912 - DNA, 22 bp, Homo sapiens
gggaggtgatggcaagcagcgg

SEQ ID NO: 7172913 - DNA, 22 bp, Homo sapiens
gggaggtgatggcaagcagcgg

SEQ ID NO: 7172914 - DNA, 22 bp, Homo sapiens
gggaggtgatggcaagcagcgg

SEQ ID NO: 7172915 - DNA, 22 bp, Homo sapiens
gggaggtgatggcaagcagcgg

SEQ ID NO: 7172916 - DNA, 22 bp, Homo sapiens
gggaggtgatggcaagcagcgg

SEQ ID NO: 7172917 - DNA, 22 bp, Homo sapiens
gggagggccaggctcacccagg

SEQ ID NO: 7172918 - DNA, 22 bp, Homo sapiens
gggagggccaggctcacccagg

SEQ ID NO: 7172919 - DNA, 22 bp, Homo sapiens
gggaggtgaaaggttgctgcag

SEQ ID NO: 7172920 - DNA, 21 bp, Homo sapiens
gggagggatggaaatgatgtt

SEQ ID NO: 7172921 - DNA, 21 bp, Homo sapiens
gggagggatggaaatgatgtt

SEQ ID NO: 7172922 - DNA, 21 bp, Homo sapiens
gggagggatggaaatgatgtt

SEQ ID NO: 7172923 - DNA, 21 bp, Homo sapiens
gggagggatggaaatgatgtt

SEQ ID NO: 7172924 - DNA, 21 bp, Homo sapiens
gggagggatggaaatgatgtt

SEQ ID NO: 7172925 - DNA, 22 bp, Homo sapiens
gggagggatctgctaggcaatg

SEQ ID NO: 7172926 - DNA, 21 bp, Homo sapiens
gggagggatggaaatgatgtt

SEQ ID NO: 7172927 - DNA, 21 bp, Homo sapiens
gggagggatggaaatgatgtt

SEQ ID NO: 7172928 - DNA, 22 bp, Homo sapiens
gggagggattagttctgcctgg

SEQ ID NO: 7172929 - DNA, 22 bp, Homo sapiens
gggagggattagttctgcctgg

SEQ ID NO: 7172930 - DNA, 22 bp, Homo sapiens
gggagggattagttctgcctgg

SEQ ID NO: 7172931 - DNA, 22 bp, Homo sapiens
gggagggattagttctgcctgg

SEQ ID NO: 7172932 - DNA, 21 bp, Homo sapiens
gggagggatggaaatgatgtt

SEQ ID NO: 7172933 - DNA, 22 bp, Homo sapiens
gggcacaggagaaggatctggc

SEQ ID NO: 7172934 - DNA, 22 bp, Homo sapiens
gggcacagtactccaatcaact

SEQ ID NO: 7172935 - DNA, 22 bp, Homo sapiens
gggaggttgaggctgcagtgag

SEQ ID NO: 7172936 - DNA, 22 bp, Homo sapiens
gggaggtgattaggaccatgta

SEQ ID NO: 7172937 - DNA, 22 bp, Homo sapiens
gggaggtgttccagtgttggta

SEQ ID NO: 7172938 - DNA, 22 bp, Homo sapiens
gggaggtgttccagtgttggta

SEQ ID NO: 7172939 - DNA, 22 bp, Homo sapiens
gggaggtgttccagtgttggta

SEQ ID NO: 7172940 - DNA, 22 bp, Homo sapiens
gggaggtgttccagtgttggta

SEQ ID NO: 7172941 - DNA, 22 bp, Homo sapiens
gggaggtgttccagtgttggta

SEQ ID NO: 7172942 - DNA, 22 bp, Homo sapiens
gggaggtgttccagtgttggta

SEQ ID NO: 7172943 - DNA, 22 bp, Homo sapiens
gggaggtgttctgccaacgcgg

SEQ ID NO: 7172944 - DNA, 22 bp, Homo sapiens
gggaggtgttctgccaacgcgg

SEQ ID NO: 7172945 - DNA, 22 bp, Homo sapiens
gggaggtgttctgccaacgcgg

SEQ ID NO: 7172946 - DNA, 22 bp, Homo sapiens
gggagggatctgctaggcaatg

SEQ ID NO: 7172947 - DNA, 16 bp, Homo sapiens
gggagggagttggtgg

SEQ ID NO: 7172948 - DNA, 22 bp, Homo sapiens
gggagggatctgctaggcaatg

SEQ ID NO: 7172949 - DNA, 22 bp, Homo sapiens
gggagggatctgctaggcaatg

SEQ ID NO: 7172950 - DNA, 22 bp, Homo sapiens
gggagggatctgctaggcaatg

SEQ ID NO: 7172951 - DNA, 22 bp, Homo sapiens
gggagggatctgctaggcaatg

SEQ ID NO: 7172952 - DNA, 22 bp, Homo sapiens
gggagggaggtgctggttcacg

SEQ ID NO: 7172953 - DNA, 22 bp, Homo sapiens
gggagggaggtgctggttcacg

SEQ ID NO: 7172954 - DNA, 22 bp, Homo sapiens
gggagggaggtgctggttcacg

SEQ ID NO: 7172955 - DNA, 22 bp, Homo sapiens
gggagggaggtgatgcttggct

SEQ ID NO: 7172956 - DNA, 22 bp, Homo sapiens
gggagggaggtgatgcttggct

SEQ ID NO: 7172957 - DNA, 22 bp, Homo sapiens
gggagggaggtgctggttcacg

SEQ ID NO: 7172958 - DNA, 22 bp, Homo sapiens
gggagggaggtgatgcttggct

SEQ ID NO: 7172959 - DNA, 22 bp, Homo sapiens
gggagggagaggacagttctat

SEQ ID NO: 7172960 - DNA, 22 bp, Homo sapiens
gggagggagaggacagttctat

SEQ ID NO: 7172961 - DNA, 22 bp, Homo sapiens
gggagggagaggacagttctat

SEQ ID NO: 7172962 - DNA, 22 bp, Homo sapiens
gggagggagaggacagttctat

SEQ ID NO: 7172963 - DNA, 22 bp, Homo sapiens
gggagggagaggacagttctat

SEQ ID NO: 7172964 - DNA, 22 bp, Homo sapiens
gggagggaggtgatgcttggct

SEQ ID NO: 7172965 - DNA, 22 bp, Homo sapiens
gggagggaggtgatgcttggct

SEQ ID NO: 7172966 - DNA, 22 bp, Homo sapiens
gggagggaggtgatgcttggct

SEQ ID NO: 7172967 - DNA, 22 bp, Homo sapiens
gggagctggagctggaagactc

SEQ ID NO: 7172968 - DNA, 22 bp, Homo sapiens
gggagctggagctggaagactc

SEQ ID NO: 7172969 - DNA, 22 bp, Homo sapiens
gggagctggagttgtgttgcct

SEQ ID NO: 7172970 - DNA, 22 bp, Homo sapiens
gggagctggagttgtgttgcct

SEQ ID NO: 7172971 - DNA, 22 bp, Homo sapiens
gggagctggagttgtgttgcct

SEQ ID NO: 7172972 - DNA, 22 bp, Homo sapiens
gggagctggagttgtgttgcct

SEQ ID NO: 7172973 - DNA, 22 bp, Homo sapiens
gggagctggagttgtgttgcct

SEQ ID NO: 7172974 - DNA, 22 bp, Homo sapiens
gggagctggatcgcgcgcccgg

SEQ ID NO: 7172975 - DNA, 22 bp, Homo sapiens
gggagctggatcgcgcgcccgg

SEQ ID NO: 7172976 - DNA, 22 bp, Homo sapiens
gggagctggatcgcgcgcccgg

SEQ ID NO: 7172977 - DNA, 22 bp, Homo sapiens
gggagctggatcgcgcgcccgg

SEQ ID NO: 7172978 - DNA, 22 bp, Homo sapiens
gggagctggatgattgaggcaa

SEQ ID NO: 7172979 - DNA, 22 bp, Homo sapiens
gggagctggatgattgaggcaa

SEQ ID NO: 7172980 - DNA, 22 bp, Homo sapiens
gggagctggatgattgaggcaa

SEQ ID NO: 7172981 - DNA, 22 bp, Homo sapiens
gggagctggcctactattagat

SEQ ID NO: 7172982 - DNA, 22 bp, Homo sapiens
gggagctggcctactattagat

SEQ ID NO: 7172983 - DNA, 22 bp, Homo sapiens
gggagctggcggattccccagg

SEQ ID NO: 7172984 - DNA, 22 bp, Homo sapiens
gggagctggcggattccccagg

SEQ ID NO: 7172985 - DNA, 22 bp, Homo sapiens
gggagctggcggattccccagg

SEQ ID NO: 7172986 - DNA, 22 bp, Homo sapiens
gggagggacacaaagagttccc

SEQ ID NO: 7172987 - DNA, 22 bp, Homo sapiens
gggagggacacaaagagttccc

SEQ ID NO: 7172988 - DNA, 22 bp, Homo sapiens
gggagggacacaaagagttccc

SEQ ID NO: 7172989 - DNA, 21 bp, Homo sapiens
gggcactgaaagggaatagca

SEQ ID NO: 7172990 - DNA, 21 bp, Homo sapiens
gggcactgaaagggaatagca

SEQ ID NO: 7172991 - DNA, 22 bp, Homo sapiens
gggcactgaacaccctcttcgc

SEQ ID NO: 7172992 - DNA, 22 bp, Homo sapiens
gggcactgaatgccaagctagg

SEQ ID NO: 7172993 - DNA, 22 bp, Homo sapiens
gggcactcctctggtccagccc

SEQ ID NO: 7172994 - DNA, 22 bp, Homo sapiens
gggcactcctctggtccagccc

SEQ ID NO: 7172995 - DNA, 22 bp, Homo sapiens
gggcactcctgatcgggacttg

SEQ ID NO: 7172996 - DNA, 22 bp, Homo sapiens
gggcactcctgatcgggacttg

SEQ ID NO: 7172997 - DNA, 22 bp, Homo sapiens
gggcactctgctcccagtgttt

SEQ ID NO: 7172998 - DNA, 22 bp, Homo sapiens
gggcacctggctagtgacagtg

SEQ ID NO: 7172999 - DNA, 22 bp, Homo sapiens
gggcacctggctagtgacagtg

SEQ ID NO: 7173000 - DNA, 22 bp, Homo sapiens
gggcaccttgggtctcaggcaa

SEQ ID NO: 7173001 - DNA, 22 bp, Homo sapiens
gggcactcagctgtagagcagg

SEQ ID NO: 7173002 - DNA, 22 bp, Homo sapiens
gggcaccttgggtctcaggcaa

SEQ ID NO: 7173003 - DNA, 22 bp, Homo sapiens
gggcacatgtaaagctggagaa

SEQ ID NO: 7173004 - DNA, 22 bp, Homo sapiens
gggcacatgcttagggaggaaa

SEQ ID NO: 7173005 - DNA, 22 bp, Homo sapiens
gggcacagtctgcagcccccca

SEQ ID NO: 7173006 - DNA, 22 bp, Homo sapiens
gggcaccagcggccgcactgcc

SEQ ID NO: 7173007 - DNA, 23 bp, Homo sapiens
gggcaccaggagcaccggacagg

SEQ ID NO: 7173008 - DNA, 22 bp, Homo sapiens
gggcacaggagaaggatctggc

SEQ ID NO: 7173009 - DNA, 22 bp, Homo sapiens
gggcacagtctaaagttgggcc

SEQ ID NO: 7173010 - DNA, 22 bp, Homo sapiens
gggcacagtctaaagttgggcc

SEQ ID NO: 7173011 - DNA, 22 bp, Homo sapiens
gggcacagtctgcagcccccca

SEQ ID NO: 7173012 - DNA, 22 bp, Homo sapiens
gggcactgagtggatgatgcag

SEQ ID NO: 7173013 - DNA, 22 bp, Homo sapiens
gggcactgagtggatgatgcag

SEQ ID NO: 7173014 - DNA, 22 bp, Homo sapiens
gggcactgctggaggctccctg

SEQ ID NO: 7173015 - DNA, 22 bp, Homo sapiens
gggcactgctggaggctccctg

SEQ ID NO: 7173016 - DNA, 22 bp, Homo sapiens
gggcactgacagggtcccaact

SEQ ID NO: 7173017 - DNA, 22 bp, Homo sapiens
gggcactgagggcccacaggat

SEQ ID NO: 7173018 - DNA, 22 bp, Homo sapiens
gggcactgagaattttccactt

SEQ ID NO: 7173019 - DNA, 22 bp, Homo sapiens
gggcactgagggcccacaggat

SEQ ID NO: 7173020 - DNA, 22 bp, Homo sapiens
gggcactgaatgccaagctagg

SEQ ID NO: 7173021 - DNA, 22 bp, Homo sapiens
gggcactgaatgccaagctagg

SEQ ID NO: 7173022 - DNA, 22 bp, Homo sapiens
gggcactgctttgctctgtcac

SEQ ID NO: 7173023 - DNA, 22 bp, Homo sapiens
gggcactggaaggctctcaggc

SEQ ID NO: 7173024 - DNA, 22 bp, Homo sapiens
gggcactggaaggctctcaggc

SEQ ID NO: 7173025 - DNA, 22 bp, Homo sapiens
gggcactggaaggctctcaggc

SEQ ID NO: 7173026 - DNA, 22 bp, Homo sapiens
gggcactggaggccaaggagct

SEQ ID NO: 7173027 - DNA, 22 bp, Homo sapiens
gggcactggaaggctctcaggc

SEQ ID NO: 7173028 - DNA, 22 bp, Homo sapiens
gggcactggaggccaaggagct

SEQ ID NO: 7173029 - DNA, 22 bp, Homo sapiens
gggcactggcaccaaagacttg

SEQ ID NO: 7173030 - DNA, 22 bp, Homo sapiens
gggcactggcagtcggggacgc

SEQ ID NO: 7173031 - DNA, 22 bp, Homo sapiens
gggcactggaggccaaggagct

SEQ ID NO: 7173032 - DNA, 22 bp, Homo sapiens
gggcactggaggccaaggagct

SEQ ID NO: 7173033 - DNA, 19 bp, Homo sapiens
gggcagtggcactagggag

SEQ ID NO: 7173034 - DNA, 22 bp, Homo sapiens
gggcagtgacaaaggggatgaa

SEQ ID NO: 7173035 - DNA, 22 bp, Homo sapiens
gggcagtgacaaaggggatgaa

SEQ ID NO: 7173036 - DNA, 22 bp, Homo sapiens
gggcagtgacaaaggggatgaa

SEQ ID NO: 7173037 - DNA, 22 bp, Homo sapiens
gggcagtgaatattggtgggaa

SEQ ID NO: 7173038 - DNA, 22 bp, Homo sapiens
gggcagtgaatattggtgggaa

SEQ ID NO: 7173039 - DNA, 22 bp, Homo sapiens
gggcagtgaatattggtgggaa

SEQ ID NO: 7173040 - DNA, 22 bp, Homo sapiens
gggcagtgaatattggtgggaa

SEQ ID NO: 7173041 - DNA, 22 bp, Homo sapiens
gggcagtcacagtgctggagca

SEQ ID NO: 7173042 - DNA, 21 bp, Homo sapiens
gggcagtctggtggctatggc

SEQ ID NO: 7173043 - DNA, 21 bp, Homo sapiens
gggcagtctggtggctatggc

SEQ ID NO: 7173044 - DNA, 22 bp, Homo sapiens
gggcagtcacagtgctggagca

SEQ ID NO: 7173045 - DNA, 22 bp, Homo sapiens
gggcagtcacagtgctggagca

SEQ ID NO: 7173046 - DNA, 23 bp, Homo sapiens
gggcaggtttttataggcttcag

SEQ ID NO: 7173047 - DNA, 23 bp, Homo sapiens
gggcaggtttttataggcttcag

SEQ ID NO: 7173048 - DNA, 23 bp, Homo sapiens
gggcaggtttttataggcttcag

SEQ ID NO: 7173049 - DNA, 22 bp, Homo sapiens
gggcaggttggcatcccgggca

SEQ ID NO: 7173050 - DNA, 23 bp, Homo sapiens
gggcaggtttttataggcttcag

SEQ ID NO: 7173051 - DNA, 18 bp, Homo sapiens
gggcagtaagtgtggggt

SEQ ID NO: 7173052 - DNA, 18 bp, Homo sapiens
gggcagtaagtgtggggt

SEQ ID NO: 7173053 - DNA, 22 bp, Homo sapiens
gggcaggttggcatcccgggca

SEQ ID NO: 7173054 - DNA, 22 bp, Homo sapiens
gggcaggttattggagtaggga

SEQ ID NO: 7173055 - DNA, 22 bp, Homo sapiens
gggcaggttattggagtaggga

SEQ ID NO: 7173056 - DNA, 22 bp, Homo sapiens
gggcaggttattggagtaggga

SEQ ID NO: 7173057 - DNA, 18 bp, Homo sapiens
gggcactggggactggag

SEQ ID NO: 7173058 - DNA, 18 bp, Homo sapiens
gggcactggggactggag

SEQ ID NO: 7173059 - DNA, 22 bp, Homo sapiens
gggcactggccgcccatccctg

SEQ ID NO: 7173060 - DNA, 22 bp, Homo sapiens
gggcactggcgttttgttaaac

SEQ ID NO: 7173061 - DNA, 22 bp, Homo sapiens
gggcactggcagtcggggacgc

SEQ ID NO: 7173062 - DNA, 22 bp, Homo sapiens
gggcactggcagtcggggacgc

SEQ ID NO: 7173063 - DNA, 18 bp, Homo sapiens
gggcactggggactggag

SEQ ID NO: 7173064 - DNA, 18 bp, Homo sapiens
gggcactggggactggag

SEQ ID NO: 7173065 - DNA, 18 bp, Homo sapiens
gggcactggggactggag

SEQ ID NO: 7173066 - DNA, 22 bp, Homo sapiens
gggcaggttattggagtaggga

SEQ ID NO: 7173067 - DNA, 22 bp, Homo sapiens
gggcaggttattggagtaggga

SEQ ID NO: 7173068 - DNA, 22 bp, Homo sapiens
gggcaggttattggagtaggga

SEQ ID NO: 7173069 - DNA, 22 bp, Homo sapiens
ggctttatttcactgtaccata

SEQ ID NO: 7173070 - DNA, 22 bp, Homo sapiens
ggctttattatgtggccatgtg

SEQ ID NO: 7173071 - DNA, 22 bp, Homo sapiens
ggctttattatgtggccatgtg

SEQ ID NO: 7173072 - DNA, 22 bp, Homo sapiens
ggctttatttgcagccattgtt

SEQ ID NO: 7173073 - DNA, 22 bp, Homo sapiens
ggctttatttgcagccattgtt

SEQ ID NO: 7173074 - DNA, 22 bp, Homo sapiens
ggctttattttgcatgaatgct

SEQ ID NO: 7173075 - DNA, 21 bp, Homo sapiens
ggctttatgctcacccagcct

SEQ ID NO: 7173076 - DNA, 21 bp, Homo sapiens
ggctttatgctcacccagcct

SEQ ID NO: 7173077 - DNA, 22 bp, Homo sapiens
ggctttatgtttttcatgtggt

SEQ ID NO: 7173078 - DNA, 22 bp, Homo sapiens
ggctttattaactcatccgtaa

SEQ ID NO: 7173079 - DNA, 22 bp, Homo sapiens
ggctttattaagcagggtaagt

SEQ ID NO: 7173080 - DNA, 22 bp, Homo sapiens
ggctttatcaaatgagaccctg

SEQ ID NO: 7173081 - DNA, 22 bp, Homo sapiens
ggctttatgcacagcagatggt

SEQ ID NO: 7173082 - DNA, 22 bp, Homo sapiens
ggctttatcaaatgagaccctg

SEQ ID NO: 7173083 - DNA, 22 bp, Homo sapiens
ggctttatgcacagcagatggt

SEQ ID NO: 7173084 - DNA, 22 bp, Homo sapiens
ggctttatgcagggatagaaat

SEQ ID NO: 7173085 - DNA, 22 bp, Homo sapiens
ggctgtgcctcaaggctactca

SEQ ID NO: 7173086 - DNA, 22 bp, Homo sapiens
ggctgtgcctctggcagcacat

SEQ ID NO: 7173087 - DNA, 20 bp, Homo sapiens
ggctgtgcccttccgtggcc

SEQ ID NO: 7173088 - DNA, 22 bp, Homo sapiens
ggctttatattgtttgagcaga

SEQ ID NO: 7173089 - DNA, 22 bp, Homo sapiens
gggaagggagggacctcagtct

SEQ ID NO: 7173090 - DNA, 22 bp, Homo sapiens
gggaagggagggacctcagtct

SEQ ID NO: 7173091 - DNA, 22 bp, Homo sapiens
gggaagggagggcctccagtca

SEQ ID NO: 7173092 - DNA, 22 bp, Homo sapiens
gggaagggagggcctccagtca

SEQ ID NO: 7173093 - DNA, 22 bp, Homo sapiens
gggaagggagggcctccagtca

SEQ ID NO: 7173094 - DNA, 22 bp, Homo sapiens
gggaagggagctgggtatttag

SEQ ID NO: 7173095 - DNA, 22 bp, Homo sapiens
gggaagggagggacctcagtct

SEQ ID NO: 7173096 - DNA, 22 bp, Homo sapiens
gggaagggagggacctcagtct

SEQ ID NO: 7173097 - DNA, 22 bp, Homo sapiens
gggaagggagggacctcagtct

SEQ ID NO: 7173098 - DNA, 22 bp, Homo sapiens
gggaagggagggacctcagtct

SEQ ID NO: 7173099 - DNA, 22 bp, Homo sapiens
gggaagggacttgtttaaggtc

SEQ ID NO: 7173100 - DNA, 22 bp, Homo sapiens
gggaagggacttgtttaaggtc

SEQ ID NO: 7173101 - DNA, 22 bp, Homo sapiens
gggaaggctgcctgagggatgg

SEQ ID NO: 7173102 - DNA, 22 bp, Homo sapiens
gggaagggacttgtttaaggtc

SEQ ID NO: 7173103 - DNA, 22 bp, Homo sapiens
gggaagggacttgtttaaggtc

SEQ ID NO: 7173104 - DNA, 22 bp, Homo sapiens
gggaagggacttgtttaaggtc

SEQ ID NO: 7173105 - DNA, 22 bp, Homo sapiens
gggaagggagctgggtatttag

SEQ ID NO: 7173106 - DNA, 22 bp, Homo sapiens
gggaaggccttgtcagcggatt

SEQ ID NO: 7173107 - DNA, 22 bp, Homo sapiens
gggaaggctgcctgagggatgg

SEQ ID NO: 7173108 - DNA, 22 bp, Homo sapiens
gggaaggctgcctgagggatgg

SEQ ID NO: 7173109 - DNA, 22 bp, Homo sapiens
ggctttgcattttgatggaggt

SEQ ID NO: 7173110 - DNA, 22 bp, Homo sapiens
ggctttgacatgctgaattaaa

SEQ ID NO: 7173111 - DNA, 22 bp, Homo sapiens
ggctttgacatgctgaattaaa

SEQ ID NO: 7173112 - DNA, 22 bp, Homo sapiens
ggctttattttgcatgaatgct

SEQ ID NO: 7173113 - DNA, 22 bp, Homo sapiens
ggctttctagatctagctctgt

SEQ ID NO: 7173114 - DNA, 22 bp, Homo sapiens
ggctttctcacagcatggcagc

SEQ ID NO: 7173115 - DNA, 22 bp, Homo sapiens
ggctttctgtctgcgtctgtgt

SEQ ID NO: 7173116 - DNA, 22 bp, Homo sapiens
ggctttgacatgctgaattaaa

SEQ ID NO: 7173117 - DNA, 22 bp, Homo sapiens
gggagctgagctggaagagaat

SEQ ID NO: 7173118 - DNA, 22 bp, Homo sapiens
gggagctgagctggaagagaat

SEQ ID NO: 7173119 - DNA, 22 bp, Homo sapiens
gggagctgagctggaagagaat

SEQ ID NO: 7173120 - DNA, 22 bp, Homo sapiens
gggagctgagctggaagagaat

SEQ ID NO: 7173121 - DNA, 22 bp, Homo sapiens
gggagctgagctctgagccacg

SEQ ID NO: 7173122 - DNA, 22 bp, Homo sapiens
gggagctgagctggaagagaat

SEQ ID NO: 7173123 - DNA, 22 bp, Homo sapiens
gggagctgacctgcaggttccc

SEQ ID NO: 7173124 - DNA, 21 bp, Homo sapiens
gggagctgacagcagcacggc

SEQ ID NO: 7173125 - DNA, 21 bp, Homo sapiens
gggagctgacagcagcacggc

SEQ ID NO: 7173126 - DNA, 22 bp, Homo sapiens
gggagctgacctgcaggttccc

SEQ ID NO: 7173127 - DNA, 22 bp, Homo sapiens
gggagctgacctgcaggttccc

SEQ ID NO: 7173128 - DNA, 22 bp, Homo sapiens
gggagctgagaaacaacattct

SEQ ID NO: 7173129 - DNA, 22 bp, Homo sapiens
gggagctgagaaacaacattct

SEQ ID NO: 7173130 - DNA, 22 bp, Homo sapiens
gggagctgagctctgagccacg

SEQ ID NO: 7173131 - DNA, 22 bp, Homo sapiens
gggagctgagctctgagccacg

SEQ ID NO: 7173132 - DNA, 22 bp, Homo sapiens
gggagctgagctctgagccacg

SEQ ID NO: 7173133 - DNA, 22 bp, Homo sapiens
gggagctggagctggaagactc

SEQ ID NO: 7173134 - DNA, 22 bp, Homo sapiens
gggagctggagctggaagactc

SEQ ID NO: 7173135 - DNA, 22 bp, Homo sapiens
gggagctggagctggaagactc

SEQ ID NO: 7173136 - DNA, 22 bp, Homo sapiens
gggagctgatcaggtggattca

SEQ ID NO: 7173137 - DNA, 19 bp, Homo sapiens
gggagctgaggtctttggt

SEQ ID NO: 7173138 - DNA, 22 bp, Homo sapiens
gggagctggagctggaagactc

SEQ ID NO: 7173139 - DNA, 22 bp, Homo sapiens
gggagctggagctggaagactc

SEQ ID NO: 7173140 - DNA, 22 bp, Homo sapiens
gggagctggagctggaagactc

SEQ ID NO: 7173141 - DNA, 22 bp, Homo sapiens
gggagctggagctggaagactc

SEQ ID NO: 7173142 - DNA, 19 bp, Homo sapiens
gggagctgaggtctttggt

SEQ ID NO: 7173143 - DNA, 19 bp, Homo sapiens
gggagctgaggtctttggt

SEQ ID NO: 7173144 - DNA, 19 bp, Homo sapiens
gggagctgaggtctttggt

SEQ ID NO: 7173145 - DNA, 22 bp, Homo sapiens
gggagctgaggagccccgtcgg

SEQ ID NO: 7173146 - DNA, 22 bp, Homo sapiens
gggagctgaggagccccgtcgg

SEQ ID NO: 7173147 - DNA, 22 bp, Homo sapiens
gggagctgagctggaagagaat

SEQ ID NO: 7173148 - DNA, 22 bp, Homo sapiens
gggagctgagctggaagagaat

SEQ ID NO: 7173149 - DNA, 22 bp, Homo sapiens
gggagctgagctggaagagaat

SEQ ID NO: 7173150 - DNA, 22 bp, Homo sapiens
gggagctgaggagccccgtcgg

SEQ ID NO: 7173151 - DNA, 22 bp, Homo sapiens
gggagctgaggagccccgtcgg

SEQ ID NO: 7173152 - DNA, 22 bp, Homo sapiens
gggagctgagggacctctgtgg

SEQ ID NO: 7173153 - DNA, 22 bp, Homo sapiens
gggagctgagggacctctgtgg

SEQ ID NO: 7173154 - DNA, 22 bp, Homo sapiens
gggagctgagggacctctgtgg

SEQ ID NO: 7173155 - DNA, 17 bp, Homo sapiens
gggaagtggagaaagct

SEQ ID NO: 7173156 - DNA, 22 bp, Homo sapiens
gggaagttctgatatttgcagg

SEQ ID NO: 7173157 - DNA, 22 bp, Homo sapiens
gggaagtgtggtttctttacag

SEQ ID NO: 7173158 - DNA, 22 bp, Homo sapiens
gggaagtgtggtttctttacag

SEQ ID NO: 7173159 - DNA, 23 bp, Homo sapiens
gggaagtggggatttgaagtcat

SEQ ID NO: 7173160 - DNA, 22 bp, Homo sapiens
gggaagtgtgcagagttctctt

SEQ ID NO: 7173161 - DNA, 22 bp, Homo sapiens
gggaagtgtgcagagttctctt

SEQ ID NO: 7173162 - DNA, 22 bp, Homo sapiens
gggaagtgtgcagagttctctt

SEQ ID NO: 7173163 - DNA, 22 bp, Homo sapiens
gggaatgagagtcagcccagga

SEQ ID NO: 7173164 - DNA, 22 bp, Homo sapiens
gggaatatggaagtggacactt

SEQ ID NO: 7173165 - DNA, 22 bp, Homo sapiens
gggaatatggaagtggacactt

SEQ ID NO: 7173166 - DNA, 21 bp, Homo sapiens
gggaatgagattcttggagat

SEQ ID NO: 7173167 - DNA, 19 bp, Homo sapiens
gggaatgatggaagacttc

SEQ ID NO: 7173168 - DNA, 22 bp, Homo sapiens
gggaatgtaagatatatactag

SEQ ID NO: 7173169 - DNA, 22 bp, Homo sapiens
gggaatgtaagatatatactag

SEQ ID NO: 7173170 - DNA, 21 bp, Homo sapiens
gggagctgacagcagcacggc

SEQ ID NO: 7173171 - DNA, 21 bp, Homo sapiens
gggagctgacagcagcacggc

SEQ ID NO: 7173172 - DNA, 21 bp, Homo sapiens
gggagctgacagcagcacggc

SEQ ID NO: 7173173 - DNA, 22 bp, Homo sapiens
gggaaggtatttagctgctgaa

SEQ ID NO: 7173174 - DNA, 22 bp, Homo sapiens
gggaaggtatttagctgctgaa

SEQ ID NO: 7173175 - DNA, 22 bp, Homo sapiens
gggaagggtgttgtcttatctt

SEQ ID NO: 7173176 - DNA, 22 bp, Homo sapiens
gggaagggctccttttattgca

SEQ ID NO: 7173177 - DNA, 22 bp, Homo sapiens
gggaagggtgttgtcttatctt

SEQ ID NO: 7173178 - DNA, 22 bp, Homo sapiens
gggaagggtgttgtcttatctt

SEQ ID NO: 7173179 - DNA, 22 bp, Homo sapiens
gggaagggagggcctccagtca

SEQ ID NO: 7173180 - DNA, 22 bp, Homo sapiens
gggaagggagggcctccagtca

SEQ ID NO: 7173181 - DNA, 22 bp, Homo sapiens
gggaagggctccttttattgca

SEQ ID NO: 7173182 - DNA, 22 bp, Homo sapiens
gggaagggctccttttattgca

SEQ ID NO: 7173183 - DNA, 22 bp, Homo sapiens
gggaagggctccttttattgca

SEQ ID NO: 7173184 - DNA, 22 bp, Homo sapiens
gggaagtgaagtgtagctgtct

SEQ ID NO: 7173185 - DNA, 22 bp, Homo sapiens
gggaagtgagctggaatcaagg

SEQ ID NO: 7173186 - DNA, 22 bp, Homo sapiens
gggaagtgaggagcccctctgc

SEQ ID NO: 7173187 - DNA, 22 bp, Homo sapiens
gggaagtgatggagccaggatt

SEQ ID NO: 7173188 - DNA, 22 bp, Homo sapiens
gggaagtgatggagccaggatt

SEQ ID NO: 7173189 - DNA, 22 bp, Homo sapiens
gggaagtgatggagccaggatt

SEQ ID NO: 7173190 - DNA, 22 bp, Homo sapiens
gggaagtgatggagccaggatt

SEQ ID NO: 7173191 - DNA, 22 bp, Homo sapiens
gggaagtgatggagccaggatt

SEQ ID NO: 7173192 - DNA, 22 bp, Homo sapiens
ggctgcttctcactcatttgca

SEQ ID NO: 7173193 - DNA, 22 bp, Homo sapiens
ggctgcttctgatttctaatgt

SEQ ID NO: 7173194 - DNA, 22 bp, Homo sapiens
ggctgctgtttcagagactgtt

SEQ ID NO: 7173195 - DNA, 22 bp, Homo sapiens
ggctgcttaaacagatgtgctg

SEQ ID NO: 7173196 - DNA, 20 bp, Homo sapiens
ggctgctgtgggcagagagg

SEQ ID NO: 7173197 - DNA, 20 bp, Homo sapiens
ggctgctgtgggcagagagg

SEQ ID NO: 7173198 - DNA, 20 bp, Homo sapiens
ggctgctgtgggcagagagg

SEQ ID NO: 7173199 - DNA, 20 bp, Homo sapiens
ggctgctgtgggcagagagg

SEQ ID NO: 7173200 - DNA, 22 bp, Homo sapiens
ggctgctgtttcagagactgtt

SEQ ID NO: 7173201 - DNA, 22 bp, Homo sapiens
ggctgctgggtcatgatgcaga

SEQ ID NO: 7173202 - DNA, 22 bp, Homo sapiens
ggctgctgggtcatgatgcaga

SEQ ID NO: 7173203 - DNA, 21 bp, Homo sapiens
ggctgctgggggttggcacag

SEQ ID NO: 7173204 - DNA, 22 bp, Homo sapiens
ggctgctggggacgtgggagag

SEQ ID NO: 7173205 - DNA, 22 bp, Homo sapiens
ggctgctggggacgtgggagag

SEQ ID NO: 7173206 - DNA, 21 bp, Homo sapiens
ggctgctgggggttggcacag

SEQ ID NO: 7173207 - DNA, 22 bp, Homo sapiens
ggctgagttgagaggattactt

SEQ ID NO: 7173208 - DNA, 22 bp, Homo sapiens
ggctgctggggacgtgggagag

SEQ ID NO: 7173209 - DNA, 21 bp, Homo sapiens
ggctggacatcccaggagact

SEQ ID NO: 7173210 - DNA, 21 bp, Homo sapiens
ggctggacatcccaggagact

SEQ ID NO: 7173211 - DNA, 22 bp, Homo sapiens
ggctggaatgtgtggatgtgat

SEQ ID NO: 7173212 - DNA, 22 bp, Homo sapiens
ggctggaatagagactgactgg

SEQ ID NO: 7173213 - DNA, 22 bp, Homo sapiens
ggctggaatgcaactgtgtgtt

SEQ ID NO: 7173214 - DNA, 22 bp, Homo sapiens
ggctggaatgtgtggatgtgat

SEQ ID NO: 7173215 - DNA, 22 bp, Homo sapiens
ggctgcttgtcagcagctggcc

SEQ ID NO: 7173216 - DNA, 22 bp, Homo sapiens
ggctgcttttcttgtatctact

SEQ ID NO: 7173217 - DNA, 22 bp, Homo sapiens
ggctggaaggtagaagatgagg

SEQ ID NO: 7173218 - DNA, 22 bp, Homo sapiens
ggctgagggccagggctagtct

SEQ ID NO: 7173219 - DNA, 22 bp, Homo sapiens
ggctgagggccagggctagtct

SEQ ID NO: 7173220 - DNA, 22 bp, Homo sapiens
ggctgagccccctctgcgtagg

SEQ ID NO: 7173221 - DNA, 22 bp, Homo sapiens
ggctgagggccagggctagtct

SEQ ID NO: 7173222 - DNA, 22 bp, Homo sapiens
ggctgaggggcccagaggaaca

SEQ ID NO: 7173223 - DNA, 22 bp, Homo sapiens
ggctgaggggcccagaggaaca

SEQ ID NO: 7173224 - DNA, 22 bp, Homo sapiens
ggctgagggccagggctagtct

SEQ ID NO: 7173225 - DNA, 22 bp, Homo sapiens
ggctgaggggcccagaggaaca

SEQ ID NO: 7173226 - DNA, 22 bp, Homo sapiens
ggctgaggggcccagaggaaca

SEQ ID NO: 7173227 - DNA, 22 bp, Homo sapiens
ggctgaggggcccagaggaaca

SEQ ID NO: 7173228 - DNA, 22 bp, Homo sapiens
ggctgagggtatagctgtccca

SEQ ID NO: 7173229 - DNA, 22 bp, Homo sapiens
ggctgagggtatagctgtccca

SEQ ID NO: 7173230 - DNA, 22 bp, Homo sapiens
ggctgagggtatagctgtccca

SEQ ID NO: 7173231 - DNA, 22 bp, Homo sapiens
ggctgagggtcccagaccctaa

SEQ ID NO: 7173232 - DNA, 22 bp, Homo sapiens
ggctgagggtcccagaccctaa

SEQ ID NO: 7173233 - DNA, 22 bp, Homo sapiens
ggctgagggtcccagaccctaa

SEQ ID NO: 7173234 - DNA, 18 bp, Homo sapiens
ggctgaggttgactagaa

SEQ ID NO: 7173235 - DNA, 18 bp, Homo sapiens
ggctgaggttgactagaa

SEQ ID NO: 7173236 - DNA, 18 bp, Homo sapiens
ggctgaggttgactagaa

SEQ ID NO: 7173237 - DNA, 22 bp, Homo sapiens
ggctgaggtgtggggaactata

SEQ ID NO: 7173238 - DNA, 18 bp, Homo sapiens
ggctgaggttgactagaa

SEQ ID NO: 7173239 - DNA, 18 bp, Homo sapiens
ggctgaggttgactagaa

SEQ ID NO: 7173240 - DNA, 22 bp, Homo sapiens
ggctgagggttaagatcagaca

SEQ ID NO: 7173241 - DNA, 22 bp, Homo sapiens
ggctgagggtcccagaccctaa

SEQ ID NO: 7173242 - DNA, 22 bp, Homo sapiens
ggctgagggttaagatcagaca

SEQ ID NO: 7173243 - DNA, 22 bp, Homo sapiens
ggctgagggttaagatcagaca

SEQ ID NO: 7173244 - DNA, 22 bp, Homo sapiens
ggctgagggttaagatcagaca

SEQ ID NO: 7173245 - DNA, 22 bp, Homo sapiens
ggctgaggtgtggggaactata

SEQ ID NO: 7173246 - DNA, 22 bp, Homo sapiens
ggctgaggtgtggggaactata

SEQ ID NO: 7173247 - DNA, 22 bp, Homo sapiens
ggctgaggtgtggggaactata

SEQ ID NO: 7173248 - DNA, 22 bp, Homo sapiens
ggctgaggtgtggggaactata

SEQ ID NO: 7173249 - DNA, 22 bp, Homo sapiens
ggctgggtcccagctgggagga

SEQ ID NO: 7173250 - DNA, 22 bp, Homo sapiens
ggctgggtcccagctgggagga

SEQ ID NO: 7173251 - DNA, 19 bp, Homo sapiens
ggctgggtctggcaggttc

SEQ ID NO: 7173252 - DNA, 19 bp, Homo sapiens
ggctgggtctggcaggttc

SEQ ID NO: 7173253 - DNA, 19 bp, Homo sapiens
ggctgggtctggcaggttc

SEQ ID NO: 7173254 - DNA, 19 bp, Homo sapiens
ggctgggtctggcaggttc

SEQ ID NO: 7173255 - DNA, 19 bp, Homo sapiens
ggctgggtctggcaggttc

SEQ ID NO: 7173256 - DNA, 19 bp, Homo sapiens
ggctgggtctggcaggttc

SEQ ID NO: 7173257 - DNA, 22 bp, Homo sapiens
ggctgggttatttatggccaag

SEQ ID NO: 7173258 - DNA, 22 bp, Homo sapiens
ggctgggttatttatggccaag

SEQ ID NO: 7173259 - DNA, 22 bp, Homo sapiens
ggctgggtcccagctgggagga

SEQ ID NO: 7173260 - DNA, 22 bp, Homo sapiens
ggctgggtcccagctgggagga

SEQ ID NO: 7173261 - DNA, 22 bp, Homo sapiens
ggctgggtcccagctgggagga

SEQ ID NO: 7173262 - DNA, 22 bp, Homo sapiens
ggctgggtcccagctgggagga

SEQ ID NO: 7173263 - DNA, 22 bp, Homo sapiens
ggctgggtcccagctgggagga

SEQ ID NO: 7173264 - DNA, 21 bp, Homo sapiens
ggctgggtcatgcagctggcc

SEQ ID NO: 7173265 - DNA, 22 bp, Homo sapiens
ggctgggtacagggcagtgtgc

SEQ ID NO: 7173266 - DNA, 22 bp, Homo sapiens
ggctgggtacagggcagtgtgc

SEQ ID NO: 7173267 - DNA, 22 bp, Homo sapiens
ggctggagaagggtggttgaca

SEQ ID NO: 7173268 - DNA, 22 bp, Homo sapiens
ggctggagacaacgtcctgccc

SEQ ID NO: 7173269 - DNA, 22 bp, Homo sapiens
ggctgggtacagggcagtgtgc

SEQ ID NO: 7173270 - DNA, 22 bp, Homo sapiens
ggctgggtaccctgtttcccct

SEQ ID NO: 7173271 - DNA, 21 bp, Homo sapiens
ggctgggtcatgcagctggcc

SEQ ID NO: 7173272 - DNA, 21 bp, Homo sapiens
ggctgggtcatgcagctggcc

SEQ ID NO: 7173273 - DNA, 21 bp, Homo sapiens
ggctgggtcatgcagctggcc

SEQ ID NO: 7173274 - DNA, 21 bp, Homo sapiens
ggctgggtcatgcagctggcc

SEQ ID NO: 7173275 - DNA, 21 bp, Homo sapiens
ggctgggtcatgcagctggcc

SEQ ID NO: 7173276 - DNA, 21 bp, Homo sapiens
ggctgggtcatgcagctggcc

SEQ ID NO: 7173277 - DNA, 22 bp, Homo sapiens
ggctggagaagggtggttgaca

SEQ ID NO: 7173278 - DNA, 22 bp, Homo sapiens
ggctggagaagggtggttgaca

SEQ ID NO: 7173279 - DNA, 19 bp, Homo sapiens
ggctggagaaaggaatcag

SEQ ID NO: 7173280 - DNA, 19 bp, Homo sapiens
ggctggagaaaggaatcag

SEQ ID NO: 7173281 - DNA, 19 bp, Homo sapiens
ggctggagaaaggaatcag

SEQ ID NO: 7173282 - DNA, 19 bp, Homo sapiens
ggctggagaaaggaatcag

SEQ ID NO: 7173283 - DNA, 19 bp, Homo sapiens
ggctggagaaaggaatcag

SEQ ID NO: 7173284 - DNA, 22 bp, Homo sapiens
ggctggactttctgctgggctc

SEQ ID NO: 7173285 - DNA, 22 bp, Homo sapiens
ggctggactttctgctgggctc

SEQ ID NO: 7173286 - DNA, 21 bp, Homo sapiens
ggctggactgtgctttccttc

SEQ ID NO: 7173287 - DNA, 22 bp, Homo sapiens
ggctggactttttgcaggtcat

SEQ ID NO: 7173288 - DNA, 22 bp, Homo sapiens
ggctggaccatgctgccccttc

SEQ ID NO: 7173289 - DNA, 22 bp, Homo sapiens
ggctggactctgggcctctcca

SEQ ID NO: 7173290 - DNA, 22 bp, Homo sapiens
ggctggactgcctcccagagtc

SEQ ID NO: 7173291 - DNA, 23 bp, Homo sapiens
ggctggtgcccttggccagtcgg

SEQ ID NO: 7173292 - DNA, 22 bp, Homo sapiens
ggctggtggggaaagaggacca

SEQ ID NO: 7173293 - DNA, 23 bp, Homo sapiens
ggctggtgcccttggccagtcgg

SEQ ID NO: 7173294 - DNA, 23 bp, Homo sapiens
ggctggtgcccttggccagtcgg

SEQ ID NO: 7173295 - DNA, 23 bp, Homo sapiens
ggctggtgcccttggccagtcgg

SEQ ID NO: 7173296 - DNA, 23 bp, Homo sapiens
ggctggtgcccttggccagtcgg

SEQ ID NO: 7173297 - DNA, 22 bp, Homo sapiens
ggctggtgagttcagagaaccc

SEQ ID NO: 7173298 - DNA, 22 bp, Homo sapiens
ggctggtcaggaaactaggctc

SEQ ID NO: 7173299 - DNA, 22 bp, Homo sapiens
ggctgggttctgagaaagagta

SEQ ID NO: 7173300 - DNA, 22 bp, Homo sapiens
ggctgggtttgactcctggctt

SEQ ID NO: 7173301 - DNA, 22 bp, Homo sapiens
ggctgggtttgactcctggctt

SEQ ID NO: 7173302 - DNA, 22 bp, Homo sapiens
ggctgggttctgagaaagagta

SEQ ID NO: 7173303 - DNA, 22 bp, Homo sapiens
ggctgggttctgagaaagagta

SEQ ID NO: 7173304 - DNA, 22 bp, Homo sapiens
ggctgtgagcaggcagaatgct

SEQ ID NO: 7173305 - DNA, 22 bp, Homo sapiens
ggctgtgattggtggatgtgaa

SEQ ID NO: 7173306 - DNA, 22 bp, Homo sapiens
ggctggtggggaaagaggacca

SEQ ID NO: 7173307 - DNA, 22 bp, Homo sapiens
ggctggtggggaaagaggacca

SEQ ID NO: 7173308 - DNA, 22 bp, Homo sapiens
ggctggtgttacagtcggcagc

SEQ ID NO: 7173309 - DNA, 22 bp, Homo sapiens
ggctgtgacccccacaggggtg

SEQ ID NO: 7173310 - DNA, 22 bp, Homo sapiens
ggctgtgccctcacatggggca

SEQ ID NO: 7173311 - DNA, 17 bp, Homo sapiens
ggctgtgccaggtgaga

SEQ ID NO: 7173312 - DNA, 22 bp, Homo sapiens
ggctgtgccctcacatggggca

SEQ ID NO: 7173313 - DNA, 22 bp, Homo sapiens
ggctgtgccctcacatggggca

SEQ ID NO: 7173314 - DNA, 17 bp, Homo sapiens
ggctgtgccaggtgaga

SEQ ID NO: 7173315 - DNA, 17 bp, Homo sapiens
ggctgtgccaggtgaga

SEQ ID NO: 7173316 - DNA, 22 bp, Homo sapiens
ggctgtgcagggcagagtctca

SEQ ID NO: 7173317 - DNA, 22 bp, Homo sapiens
ggctccctgggggtcggagagt

SEQ ID NO: 7173318 - DNA, 22 bp, Homo sapiens
ggctccctgggtgctcctgctc

SEQ ID NO: 7173319 - DNA, 22 bp, Homo sapiens
ggctccctgggtgctcctgctc

SEQ ID NO: 7173320 - DNA, 22 bp, Homo sapiens
ggctccctgggggtcggagagt

SEQ ID NO: 7173321 - DNA, 22 bp, Homo sapiens
ggctccctggaaatcccgaggc

SEQ ID NO: 7173322 - DNA, 22 bp, Homo sapiens
ggctccctggaaatcccgaggc

SEQ ID NO: 7173323 - DNA, 21 bp, Homo sapiens
ggctccctggcaggggtctgg

SEQ ID NO: 7173324 - DNA, 22 bp, Homo sapiens
ggctccctggccctggggacac

SEQ ID NO: 7173325 - DNA, 22 bp, Homo sapiens
ggctccctggccctggggacac

SEQ ID NO: 7173326 - DNA, 22 bp, Homo sapiens
ggctccctgcctgtcctcagtc

SEQ ID NO: 7173327 - DNA, 22 bp, Homo sapiens
ggctccctgcctgtcctcagtc

SEQ ID NO: 7173328 - DNA, 22 bp, Homo sapiens
ggctccctgcctgtcctcagtc

SEQ ID NO: 7173329 - DNA, 22 bp, Homo sapiens
ggctccctggaaatcccgaggc

SEQ ID NO: 7173330 - DNA, 22 bp, Homo sapiens
ggctccctgcaacctccgcctc

SEQ ID NO: 7173331 - DNA, 22 bp, Homo sapiens
ggctccctgcaacctccgcctc

SEQ ID NO: 7173332 - DNA, 22 bp, Homo sapiens
ggctccctgcctgtcctcagtc

SEQ ID NO: 7173333 - DNA, 17 bp, Homo sapiens
ggctccctgactatgga

SEQ ID NO: 7173334 - DNA, 22 bp, Homo sapiens
ggctccctgcaacctccgcctc

SEQ ID NO: 7173335 - DNA, 22 bp, Homo sapiens
ggctccctagggagagtgggag

SEQ ID NO: 7173336 - DNA, 22 bp, Homo sapiens
ggctccccaggtccaggagctg

SEQ ID NO: 7173337 - DNA, 22 bp, Homo sapiens
ggctccccaggtccaggagctg

SEQ ID NO: 7173338 - DNA, 22 bp, Homo sapiens
ggctccctagggagagtgggag

SEQ ID NO: 7173339 - DNA, 22 bp, Homo sapiens
ggctccctcaccaccatcacat

SEQ ID NO: 7173340 - DNA, 22 bp, Homo sapiens
ggctccctcaccaccatcacat

SEQ ID NO: 7173341 - DNA, 23 bp, Homo sapiens
ggctccctcctagctttcccaat

SEQ ID NO: 7173342 - DNA, 22 bp, Homo sapiens
ggctaggctcacctggagagtt

SEQ ID NO: 7173343 - DNA, 22 bp, Homo sapiens
ggctaggctcacctggagagtt

SEQ ID NO: 7173344 - DNA, 22 bp, Homo sapiens
ggctaggctcacctggagagtt

SEQ ID NO: 7173345 - DNA, 22 bp, Homo sapiens
ggctaggcgggcacatggtgga

SEQ ID NO: 7173346 - DNA, 23 bp, Homo sapiens
ggctccaggcctgacgggcgcgg

SEQ ID NO: 7173347 - DNA, 22 bp, Homo sapiens
ggctccagggagtggagagaag

SEQ ID NO: 7173348 - DNA, 22 bp, Homo sapiens
ggctccagggagtggagagaag

SEQ ID NO: 7173349 - DNA, 22 bp, Homo sapiens
ggctccagtttgtgccttcagc

SEQ ID NO: 7173350 - DNA, 22 bp, Homo sapiens
ggctccagtttgtgccttcagc

SEQ ID NO: 7173351 - DNA, 22 bp, Homo sapiens
ggctcccacccatagggcgagt

SEQ ID NO: 7173352 - DNA, 22 bp, Homo sapiens
ggctcccaggagggcctggagg

SEQ ID NO: 7173353 - DNA, 22 bp, Homo sapiens
ggctcccaggagggcctggagg

SEQ ID NO: 7173354 - DNA, 22 bp, Homo sapiens
ggctcccaggagggcctggagg

SEQ ID NO: 7173355 - DNA, 22 bp, Homo sapiens
ggctcccaggagggcctggagg

SEQ ID NO: 7173356 - DNA, 22 bp, Homo sapiens
ggctcccaggagggcctggagg

SEQ ID NO: 7173357 - DNA, 22 bp, Homo sapiens
ggctcccaggagggcctggagg

SEQ ID NO: 7173358 - DNA, 22 bp, Homo sapiens
ggctaggcctcaggcctgcctg

SEQ ID NO: 7173359 - DNA, 22 bp, Homo sapiens
ggctaggcaggctcagagccta

SEQ ID NO: 7173360 - DNA, 22 bp, Homo sapiens
ggctagcaaggtagcagaatgc

SEQ ID NO: 7173361 - DNA, 22 bp, Homo sapiens
ggctagcttagagtcatgctag

SEQ ID NO: 7173362 - DNA, 23 bp, Homo sapiens
ggctagagtggaggggaactgca

SEQ ID NO: 7173363 - DNA, 22 bp, Homo sapiens
ggctagcaaggtagcagaatgc

SEQ ID NO: 7173364 - DNA, 22 bp, Homo sapiens
ggctagagtggaactggagcgg

SEQ ID NO: 7173365 - DNA, 22 bp, Homo sapiens
ggctacagggcctggccaaggt

SEQ ID NO: 7173366 - DNA, 22 bp, Homo sapiens
ggctacagtggctcagtgctgg

SEQ ID NO: 7173367 - DNA, 22 bp, Homo sapiens
ggcgtgggaagtggggcttctg

SEQ ID NO: 7173368 - DNA, 22 bp, Homo sapiens
ggcgtgggcgaggtgctctatc

SEQ ID NO: 7173369 - DNA, 22 bp, Homo sapiens
ggcgtgggaagtggggcttctg

SEQ ID NO: 7173370 - DNA, 22 bp, Homo sapiens
ggcgtgggcgaggtgctctatc

SEQ ID NO: 7173371 - DNA, 22 bp, Homo sapiens
ggcggtggcgtgaaggtggctg

SEQ ID NO: 7173372 - DNA, 22 bp, Homo sapiens
ggcggtggttgagaggacggcg

SEQ ID NO: 7173373 - DNA, 22 bp, Homo sapiens
ggcggtggttgagaggacggcg

SEQ ID NO: 7173374 - DNA, 22 bp, Homo sapiens
ggcgtttcaccatgttgaccag

SEQ ID NO: 7173375 - DNA, 22 bp, Homo sapiens
ggcgtggggccttctgcccgct

SEQ ID NO: 7173376 - DNA, 22 bp, Homo sapiens
ggctaaggaacgcaggcttctc

SEQ ID NO: 7173377 - DNA, 22 bp, Homo sapiens
ggctaaggaacgcaggcttctc

SEQ ID NO: 7173378 - DNA, 22 bp, Homo sapiens
ggctaaggacgggcaagtccca

SEQ ID NO: 7173379 - DNA, 22 bp, Homo sapiens
ggctaaggaagaaggatcgtta

SEQ ID NO: 7173380 - DNA, 23 bp, Homo sapiens
ggctaaggccgccggccctgctc

SEQ ID NO: 7173381 - DNA, 14 bp, Homo sapiens
ggctaaggggacag

SEQ ID NO: 7173382 - DNA, 22 bp, Homo sapiens
ggctaagggttatacatgaacc

SEQ ID NO: 7173383 - DNA, 22 bp, Homo sapiens
ggctacagcggggtggagacgg

SEQ ID NO: 7173384 - DNA, 22 bp, Homo sapiens
ggctacagcggggtggagacgg

SEQ ID NO: 7173385 - DNA, 22 bp, Homo sapiens
ggctacagaggccgtgagcctg

SEQ ID NO: 7173386 - DNA, 22 bp, Homo sapiens
ggctacagaggccgtgagcctg

SEQ ID NO: 7173387 - DNA, 22 bp, Homo sapiens
ggctctgggtaaggcgtttgac

SEQ ID NO: 7173388 - DNA, 22 bp, Homo sapiens
ggctctgggtaaggcgtttgac

SEQ ID NO: 7173389 - DNA, 22 bp, Homo sapiens
ggctctgggtaaggcgtttgac

SEQ ID NO: 7173390 - DNA, 22 bp, Homo sapiens
ggctctggggttggcccatctc

SEQ ID NO: 7173391 - DNA, 22 bp, Homo sapiens
ggctctgggtctgtggggagcg

SEQ ID NO: 7173392 - DNA, 22 bp, Homo sapiens
ggctctgggtctgtggggagcg

SEQ ID NO: 7173393 - DNA, 22 bp, Homo sapiens
ggctctggggggaagtctgttg

SEQ ID NO: 7173394 - DNA, 22 bp, Homo sapiens
ggctctggggttggcccatctc

SEQ ID NO: 7173395 - DNA, 22 bp, Homo sapiens
ggctctggggggaagtctgttg

SEQ ID NO: 7173396 - DNA, 22 bp, Homo sapiens
ggctctggggggaagtctgttg

SEQ ID NO: 7173397 - DNA, 22 bp, Homo sapiens
ggctctggggaagctctcttca

SEQ ID NO: 7173398 - DNA, 22 bp, Homo sapiens
ggctctggggaagctctcttca

SEQ ID NO: 7173399 - DNA, 22 bp, Homo sapiens
ggctctgggcctccaaggtctg

SEQ ID NO: 7173400 - DNA, 22 bp, Homo sapiens
ggctctgggcctccaaggtctg

SEQ ID NO: 7173401 - DNA, 22 bp, Homo sapiens
ggctctgggcctccaaggtctg

SEQ ID NO: 7173402 - DNA, 22 bp, Homo sapiens
ggctctgggcctccaaggtctg

SEQ ID NO: 7173403 - DNA, 22 bp, Homo sapiens
ggctctgggccagagttggctt

SEQ ID NO: 7173404 - DNA, 22 bp, Homo sapiens
ggctctgggcctccaaggtctg

SEQ ID NO: 7173405 - DNA, 22 bp, Homo sapiens
ggctctggggaagctctcttca

SEQ ID NO: 7173406 - DNA, 22 bp, Homo sapiens
ggctctggggaagctctcttca

SEQ ID NO: 7173407 - DNA, 22 bp, Homo sapiens
ggctctggggaagctctcttca

SEQ ID NO: 7173408 - DNA, 22 bp, Homo sapiens
ggctctggggcctcctcccttg

SEQ ID NO: 7173409 - DNA, 22 bp, Homo sapiens
ggctctggggcctcctcccttg

SEQ ID NO: 7173410 - DNA, 22 bp, Homo sapiens
ggctctggggcctcctcccttg

SEQ ID NO: 7173411 - DNA, 22 bp, Homo sapiens
ggctctggggggaagtctgttg

SEQ ID NO: 7173412 - DNA, 22 bp, Homo sapiens
ggctccctgggtgctcctgctc

SEQ ID NO: 7173413 - DNA, 22 bp, Homo sapiens
ggctccctgttctattccctgg

SEQ ID NO: 7173414 - DNA, 22 bp, Homo sapiens
ggctccctgttctattccctgg

SEQ ID NO: 7173415 - DNA, 22 bp, Homo sapiens
ggctcctctctggccgctcccg

SEQ ID NO: 7173416 - DNA, 22 bp, Homo sapiens
ggctcctgaaagactatgggaa

SEQ ID NO: 7173417 - DNA, 22 bp, Homo sapiens
ggctcctgagaatgggccatca

SEQ ID NO: 7173418 - DNA, 22 bp, Homo sapiens
ggctcctgaggaccaggcacag

SEQ ID NO: 7173419 - DNA, 22 bp, Homo sapiens
ggctcctgaggaccaggcacag

SEQ ID NO: 7173420 - DNA, 22 bp, Homo sapiens
ggctcctgaggaccaggcacag

SEQ ID NO: 7173421 - DNA, 22 bp, Homo sapiens
ggctcctgaggaccaggcacag

SEQ ID NO: 7173422 - DNA, 22 bp, Homo sapiens
ggctcctgataggagaatgcgg

SEQ ID NO: 7173423 - DNA, 22 bp, Homo sapiens
ggctcctgataggagaatgcgg

SEQ ID NO: 7173424 - DNA, 22 bp, Homo sapiens
ggctcctgatgctcagatttca

SEQ ID NO: 7173425 - DNA, 22 bp, Homo sapiens
ggctgagccatgggcactgcag

SEQ ID NO: 7173426 - DNA, 22 bp, Homo sapiens
ggctgagccatgggcactgcag

SEQ ID NO: 7173427 - DNA, 22 bp, Homo sapiens
ggctgagccatgggcactgcag

SEQ ID NO: 7173428 - DNA, 22 bp, Homo sapiens
ggctgagccatgggcactgcag

SEQ ID NO: 7173429 - DNA, 22 bp, Homo sapiens
ggctgagccactgcgcctggct

SEQ ID NO: 7173430 - DNA, 22 bp, Homo sapiens
ggctcttctacttcagatgggg

SEQ ID NO: 7173431 - DNA, 22 bp, Homo sapiens
ggctgagcactttaggcaggag

SEQ ID NO: 7173432 - DNA, 22 bp, Homo sapiens
ggctcttccgccaccagccaca

SEQ ID NO: 7173433 - DNA, 22 bp, Homo sapiens
ggctctggttgaccatgatggc

SEQ ID NO: 7173434 - DNA, 22 bp, Homo sapiens
ggctctggttgaccatgatggc

SEQ ID NO: 7173435 - DNA, 22 bp, Homo sapiens
ggctctggttgaccatgatggc

SEQ ID NO: 7173436 - DNA, 22 bp, Homo sapiens
ggctctgtgagaacaaaggcta

SEQ ID NO: 7173437 - DNA, 23 bp, Homo sapiens
ggctctgtgctaattgctgaaaa

SEQ ID NO: 7173438 - DNA, 22 bp, Homo sapiens
ggctctgggttctgcaatgcgt

SEQ ID NO: 7173439 - DNA, 22 bp, Homo sapiens
ggctctgggttctgcaatgcgt

SEQ ID NO: 7173440 - DNA, 22 bp, Homo sapiens
ggctctgggttctgcaatgcgt

SEQ ID NO: 7173441 - DNA, 22 bp, Homo sapiens
ggctctggtgtgaagcagcctc

SEQ ID NO: 7173442 - DNA, 22 bp, Homo sapiens
ggctctggtgtgaagcagcctc

SEQ ID NO: 7173443 - DNA, 22 bp, Homo sapiens
ggctctggtgtgaagcagcctc

SEQ ID NO: 7173444 - DNA, 22 bp, Homo sapiens
ggctctggttgaccatgatggc

SEQ ID NO: 7173445 - DNA, 22 bp, Homo sapiens
ggctctggttgaccatgatggc

SEQ ID NO: 7173446 - DNA, 22 bp, Homo sapiens
ggctctggttgaccatgatggc

SEQ ID NO: 7173447 - DNA, 22 bp, Homo sapiens
ggctctggttgaccatgatggc

SEQ ID NO: 7173448 - DNA, 22 bp, Homo sapiens
ggctctggttgaccatgatggc

SEQ ID NO: 7173449 - DNA, 22 bp, Homo sapiens
ggctctgggtctgtggggagcg

SEQ ID NO: 7173450 - DNA, 17 bp, Homo sapiens
ggctctgggtgtcacat

SEQ ID NO: 7173451 - DNA, 17 bp, Homo sapiens
ggctctgggtgtcacat

SEQ ID NO: 7173452 - DNA, 22 bp, Homo sapiens
ggctctgggtctgtggggagcg

SEQ ID NO: 7173453 - DNA, 22 bp, Homo sapiens
ggctctgggtctgtggggagcg

SEQ ID NO: 7173454 - DNA, 22 bp, Homo sapiens
ggctctgggtctgtggggagcg

SEQ ID NO: 7173455 - DNA, 22 bp, Homo sapiens
ggctctgggtctgtggggagcg

SEQ ID NO: 7173456 - DNA, 22 bp, Homo sapiens
ggctctgggtgtgaccttgggt

SEQ ID NO: 7173457 - DNA, 17 bp, Homo sapiens
ggctctgggtgtcacat

SEQ ID NO: 7173458 - DNA, 17 bp, Homo sapiens
ggctctgggtgtcacat

SEQ ID NO: 7173459 - DNA, 17 bp, Homo sapiens
ggctctgggtgtcacat

SEQ ID NO: 7173460 - DNA, 17 bp, Homo sapiens
ggctctgggtgtcacat

SEQ ID NO: 7173461 - DNA, 22 bp, Homo sapiens
ggctctgggtgtgaccttgggt

SEQ ID NO: 7173462 - DNA, 22 bp, Homo sapiens
ggctctgggtgtgaccttgggt

SEQ ID NO: 7173463 - DNA, 22 bp, Homo sapiens
ggctctgggtgtgaccttgggt

SEQ ID NO: 7173464 - DNA, 22 bp, Homo sapiens
ggctctgggtgtgaccttgggt

SEQ ID NO: 7173465 - DNA, 20 bp, Homo sapiens
ggatggccggaccagagcct

SEQ ID NO: 7173466 - DNA, 22 bp, Homo sapiens
ggatggccttcttgctcaggaa

SEQ ID NO: 7173467 - DNA, 22 bp, Homo sapiens
ggatgggaacttggtagggcat

SEQ ID NO: 7173468 - DNA, 22 bp, Homo sapiens
ggatgggaacttggtagggcat

SEQ ID NO: 7173469 - DNA, 22 bp, Homo sapiens
ggatgggaacttggtagggcat

SEQ ID NO: 7173470 - DNA, 22 bp, Homo sapiens
ggatgggaacttggtagggcat

SEQ ID NO: 7173471 - DNA, 22 bp, Homo sapiens
ggatgggaacttggtagggcat

SEQ ID NO: 7173472 - DNA, 22 bp, Homo sapiens
ggattaaggggaaaaagcagct

SEQ ID NO: 7173473 - DNA, 22 bp, Homo sapiens
ggatgttgattgaatggccatt

SEQ ID NO: 7173474 - DNA, 22 bp, Homo sapiens
ggatgtttggcgtttgaattgc

SEQ ID NO: 7173475 - DNA, 22 bp, Homo sapiens
ggattaagacctgtcagtacac

SEQ ID NO: 7173476 - DNA, 22 bp, Homo sapiens
ggattaagacctgtcagtacac

SEQ ID NO: 7173477 - DNA, 22 bp, Homo sapiens
ggattccatggtcaggaaatag

SEQ ID NO: 7173478 - DNA, 22 bp, Homo sapiens
ggattgagagcactggtagctg

SEQ ID NO: 7173479 - DNA, 22 bp, Homo sapiens
ggatggcatgttgggctctgtt

SEQ ID NO: 7173480 - DNA, 22 bp, Homo sapiens
ggatggcatgttgggctctgtt

SEQ ID NO: 7173481 - DNA, 22 bp, Homo sapiens
ggatggcatgttgggctctgtt

SEQ ID NO: 7173482 - DNA, 22 bp, Homo sapiens
ggatggcagtctgcatgagaaa

SEQ ID NO: 7173483 - DNA, 22 bp, Homo sapiens
ggatggcagacagtgagtggct

SEQ ID NO: 7173484 - DNA, 22 bp, Homo sapiens
ggatggaggttctcagatgctc

SEQ ID NO: 7173485 - DNA, 22 bp, Homo sapiens
ggatggagatgaccatggtgac

SEQ ID NO: 7173486 - DNA, 22 bp, Homo sapiens
ggatggagatgaccatggtgac

SEQ ID NO: 7173487 - DNA, 22 bp, Homo sapiens
ggatggagatgaccatggtgac

SEQ ID NO: 7173488 - DNA, 22 bp, Homo sapiens
ggatggagatgaccatggtgac

SEQ ID NO: 7173489 - DNA, 23 bp, Homo sapiens
ggatggagccactttgaaaccac

SEQ ID NO: 7173490 - DNA, 23 bp, Homo sapiens
ggatggagccactttgaaaccac

SEQ ID NO: 7173491 - DNA, 22 bp, Homo sapiens
ggatggaggttctcagatgctc

SEQ ID NO: 7173492 - DNA, 22 bp, Homo sapiens
ggatgaggtagatgaacaaggg

SEQ ID NO: 7173493 - DNA, 22 bp, Homo sapiens
ggatgaggtagatgaacaaggg

SEQ ID NO: 7173494 - DNA, 22 bp, Homo sapiens
ggatgaggtagatgaacaaggg

SEQ ID NO: 7173495 - DNA, 22 bp, Homo sapiens
ggatgaggtagatgaacaaggg

SEQ ID NO: 7173496 - DNA, 22 bp, Homo sapiens
ggatgaggtagatgaacaaggg

SEQ ID NO: 7173497 - DNA, 22 bp, Homo sapiens
ggatgcaggaacacagcgacct

SEQ ID NO: 7173498 - DNA, 22 bp, Homo sapiens
ggatgcaggaacacagcgacct

SEQ ID NO: 7173499 - DNA, 22 bp, Homo sapiens
ggatgcaggaacacagcgacct

SEQ ID NO: 7173500 - DNA, 22 bp, Homo sapiens
ggatgctcagtgcctgtgtcca

SEQ ID NO: 7173501 - DNA, 22 bp, Homo sapiens
ggatgcaggggcagcagagcct

SEQ ID NO: 7173502 - DNA, 22 bp, Homo sapiens
ggatgcaggggcagcagagcct

SEQ ID NO: 7173503 - DNA, 22 bp, Homo sapiens
ggatgcaggggcagcagagcct

SEQ ID NO: 7173504 - DNA, 22 bp, Homo sapiens
ggatgcaggggcagcagagcct

SEQ ID NO: 7173505 - DNA, 22 bp, Homo sapiens
ggatgcaggaggtcggggagca

SEQ ID NO: 7173506 - DNA, 22 bp, Homo sapiens
ggatgcaggacggcatggatgt

SEQ ID NO: 7173507 - DNA, 22 bp, Homo sapiens
ggatgcaggacggcatggatgt

SEQ ID NO: 7173508 - DNA, 22 bp, Homo sapiens
ggatggagatgaccatggtgac

SEQ ID NO: 7173509 - DNA, 22 bp, Homo sapiens
ggatggagatgaccatggtgac

SEQ ID NO: 7173510 - DNA, 18 bp, Homo sapiens
ggatgctgtgtgctcctt

SEQ ID NO: 7173511 - DNA, 22 bp, Homo sapiens
ggatgctgtctaagctgaggac

SEQ ID NO: 7173512 - DNA, 22 bp, Homo sapiens
ggatgctgtctaagctgaggac

SEQ ID NO: 7173513 - DNA, 22 bp, Homo sapiens
ggatgctctgtctcttgctgtt

SEQ ID NO: 7173514 - DNA, 22 bp, Homo sapiens
ggatgctgactttggagcatgg

SEQ ID NO: 7173515 - DNA, 22 bp, Homo sapiens
ggatgctgactttggagcatgg

SEQ ID NO: 7173516 - DNA, 22 bp, Homo sapiens
ggatgctgattccagtctccag

SEQ ID NO: 7173517 - DNA, 22 bp, Homo sapiens
ggatgctgctgcacatcctgca

SEQ ID NO: 7173518 - DNA, 22 bp, Homo sapiens
ggatgctgggagacagcaggca

SEQ ID NO: 7173519 - DNA, 22 bp, Homo sapiens
ggatgctgggagacagcaggca

SEQ ID NO: 7173520 - DNA, 19 bp, Homo sapiens
ggatgagggtcaggcatag

SEQ ID NO: 7173521 - DNA, 19 bp, Homo sapiens
ggatgagggtcaggcatag

SEQ ID NO: 7173522 - DNA, 22 bp, Homo sapiens
ggatgaggaagattactgagaa

SEQ ID NO: 7173523 - DNA, 22 bp, Homo sapiens
ggatgaggaagattactgagaa

SEQ ID NO: 7173524 - DNA, 22 bp, Homo sapiens
ggatgaggaagattactgagaa

SEQ ID NO: 7173525 - DNA, 22 bp, Homo sapiens
ggatgaggaaaccacagtgtcc

SEQ ID NO: 7173526 - DNA, 22 bp, Homo sapiens
ggatgaggaaaccacagtgtcc

SEQ ID NO: 7173527 - DNA, 22 bp, Homo sapiens
ggatgaggaaaccacagtgtcc

SEQ ID NO: 7173528 - DNA, 22 bp, Homo sapiens
ggatgacagcaagggggtgaag

SEQ ID NO: 7173529 - DNA, 22 bp, Homo sapiens
ggatgacagctcttccatgtgg

SEQ ID NO: 7173530 - DNA, 22 bp, Homo sapiens
ggagttggtggcccggaatctc

SEQ ID NO: 7173531 - DNA, 23 bp, Homo sapiens
ggagttggattgtacttgctgct

SEQ ID NO: 7173532 - DNA, 22 bp, Homo sapiens
ggatctggggtagagcagtggg

SEQ ID NO: 7173533 - DNA, 22 bp, Homo sapiens
ggatctggttacgtaagagtct

SEQ ID NO: 7173534 - DNA, 22 bp, Homo sapiens
ggatctttaagttcttttccat

SEQ ID NO: 7173535 - DNA, 22 bp, Homo sapiens
ggatgacaaggaaagcaaacca

SEQ ID NO: 7173536 - DNA, 22 bp, Homo sapiens
ggatgacacagttagaaagaga

SEQ ID NO: 7173537 - DNA, 22 bp, Homo sapiens
ggatgacacagttagaaagaga

SEQ ID NO: 7173538 - DNA, 22 bp, Homo sapiens
ggagttggaggctccagggaac

SEQ ID NO: 7173539 - DNA, 22 bp, Homo sapiens
ggagttggaggctccagggaac

SEQ ID NO: 7173540 - DNA, 22 bp, Homo sapiens
ggagcagatgtcttcatggcct

SEQ ID NO: 7173541 - DNA, 22 bp, Homo sapiens
ggagttggaggctccagggaac

SEQ ID NO: 7173542 - DNA, 22 bp, Homo sapiens
ggagcagatgtcttcatggcct

SEQ ID NO: 7173543 - DNA, 22 bp, Homo sapiens
ggagcagagctgggcttggctg

SEQ ID NO: 7173544 - DNA, 22 bp, Homo sapiens
ggagcagagctgggcttggctg

SEQ ID NO: 7173545 - DNA, 22 bp, Homo sapiens
ggagcagagctgggcttggctg

SEQ ID NO: 7173546 - DNA, 17 bp, Homo sapiens
ggagcagatccaccatt

SEQ ID NO: 7173547 - DNA, 22 bp, Homo sapiens
ggagcagacataaccttacaga

SEQ ID NO: 7173548 - DNA, 22 bp, Homo sapiens
ggagcagagcatttcacagcct

SEQ ID NO: 7173549 - DNA, 22 bp, Homo sapiens
ggagcagagctcttcatctgca

SEQ ID NO: 7173550 - DNA, 22 bp, Homo sapiens
ggagcagagctgggcttggctg

SEQ ID NO: 7173551 - DNA, 22 bp, Homo sapiens
ggagcagagctgggcttggctg

SEQ ID NO: 7173552 - DNA, 22 bp, Homo sapiens
ggagatgtagtgtcactggact

SEQ ID NO: 7173553 - DNA, 21 bp, Homo sapiens
ggagatgttgtgcaggagggt

SEQ ID NO: 7173554 - DNA, 22 bp, Homo sapiens
ggagcaaatgccaagtgggagg

SEQ ID NO: 7173555 - DNA, 22 bp, Homo sapiens
ggagcaaatgccaagtgggagg

SEQ ID NO: 7173556 - DNA, 22 bp, Homo sapiens
ggagcaaatgccaagtgggagg

SEQ ID NO: 7173557 - DNA, 22 bp, Homo sapiens
ggagcaagaggtggtgaaaaat

SEQ ID NO: 7173558 - DNA, 22 bp, Homo sapiens
ggagatggtggaagctggtgca

SEQ ID NO: 7173559 - DNA, 22 bp, Homo sapiens
ggagatggtggaagctggtgca

SEQ ID NO: 7173560 - DNA, 22 bp, Homo sapiens
ggagatggtggaagctggtgca

SEQ ID NO: 7173561 - DNA, 22 bp, Homo sapiens
ggagatggtggaagctggtgca

SEQ ID NO: 7173562 - DNA, 22 bp, Homo sapiens
ggagcaagtcccaggcactagt

SEQ ID NO: 7173563 - DNA, 22 bp, Homo sapiens
ggagcacaccgggagcttgcct

SEQ ID NO: 7173564 - DNA, 22 bp, Homo sapiens
ggagcacagccttgccagtacc

SEQ ID NO: 7173565 - DNA, 22 bp, Homo sapiens
ggagcacagccttgccagtacc

SEQ ID NO: 7173566 - DNA, 22 bp, Homo sapiens
ggagcaccaaagtaactagcac

SEQ ID NO: 7173567 - DNA, 22 bp, Homo sapiens
ggagcaccccagatcagagaac

SEQ ID NO: 7173568 - DNA, 22 bp, Homo sapiens
ggagcaccctgctcagccaagc

SEQ ID NO: 7173569 - DNA, 22 bp, Homo sapiens
ggagcaccctgctcagccaagc

SEQ ID NO: 7173570 - DNA, 22 bp, Homo sapiens
ggagcaccacaggttgagggga

SEQ ID NO: 7173571 - DNA, 22 bp, Homo sapiens
ggagcactttctaggagaagcc

SEQ ID NO: 7173572 - DNA, 22 bp, Homo sapiens
ggagcactttctaggagaagcc

SEQ ID NO: 7173573 - DNA, 22 bp, Homo sapiens
ggagcacctttgtctatttctc

SEQ ID NO: 7173574 - DNA, 22 bp, Homo sapiens
ggagcacctttgtctatttctc

SEQ ID NO: 7173575 - DNA, 22 bp, Homo sapiens
ggagcaccctgctcagccaagc

SEQ ID NO: 7173576 - DNA, 22 bp, Homo sapiens
ggagcaccgctcagacccttgg

SEQ ID NO: 7173577 - DNA, 22 bp, Homo sapiens
ggagcaccgttgggaggtgagg

SEQ ID NO: 7173578 - DNA, 22 bp, Homo sapiens
ggagcacctactttgataacta

SEQ ID NO: 7173579 - DNA, 22 bp, Homo sapiens
ggagatggctggcaggtagatg

SEQ ID NO: 7173580 - DNA, 22 bp, Homo sapiens
ggagatggctggcaggtagatg

SEQ ID NO: 7173581 - DNA, 22 bp, Homo sapiens
ggagatggctctgcaaggtcta

SEQ ID NO: 7173582 - DNA, 22 bp, Homo sapiens
ggagatggctctgcaaggtcta

SEQ ID NO: 7173583 - DNA, 22 bp, Homo sapiens
ggagatggctctgcaaggtcta

SEQ ID NO: 7173584 - DNA, 22 bp, Homo sapiens
ggagatggccacgtcactcagt

SEQ ID NO: 7173585 - DNA, 22 bp, Homo sapiens
ggagatggccacgtcactcagt

SEQ ID NO: 7173586 - DNA, 22 bp, Homo sapiens
ggagatggccacgtcactcagt

SEQ ID NO: 7173587 - DNA, 22 bp, Homo sapiens
ggagaggcttggcccagcctgg

SEQ ID NO: 7173588 - DNA, 22 bp, Homo sapiens
ggagatggagtggattcagcag

SEQ ID NO: 7173589 - DNA, 22 bp, Homo sapiens
ggagatggcaagaagttattag

SEQ ID NO: 7173590 - DNA, 22 bp, Homo sapiens
ggagatggcaagaagttattag

SEQ ID NO: 7173591 - DNA, 22 bp, Homo sapiens
ggagatggccaaaaacacaaat

SEQ ID NO: 7173592 - DNA, 22 bp, Homo sapiens
ggagatggctggcaggtagatg

SEQ ID NO: 7173593 - DNA, 22 bp, Homo sapiens
ggagatggctggcaggtagatg

SEQ ID NO: 7173594 - DNA, 22 bp, Homo sapiens
ggagatggctggcaggtagatg

SEQ ID NO: 7173595 - DNA, 22 bp, Homo sapiens
ggagatggctggcaggtagatg

SEQ ID NO: 7173596 - DNA, 22 bp, Homo sapiens
ggagatggctggcaggtagatg

SEQ ID NO: 7173597 - DNA, 22 bp, Homo sapiens
ggagatgggggattttacagcg

SEQ ID NO: 7173598 - DNA, 21 bp, Homo sapiens
ggagatgggtatcgcctgggc

SEQ ID NO: 7173599 - DNA, 22 bp, Homo sapiens
ggagatggtctgttctcatatt

SEQ ID NO: 7173600 - DNA, 21 bp, Homo sapiens
ggagatgggtatcgcctgggc

SEQ ID NO: 7173601 - DNA, 22 bp, Homo sapiens
ggagatggtggaagctggtgca

SEQ ID NO: 7173602 - DNA, 22 bp, Homo sapiens
ggagatggtctgttctcatatt

SEQ ID NO: 7173603 - DNA, 22 bp, Homo sapiens
ggcagaaggcctcccagctcct

SEQ ID NO: 7173604 - DNA, 22 bp, Homo sapiens
ggcagaaggcctcccagctcct

SEQ ID NO: 7173605 - DNA, 22 bp, Homo sapiens
ggcagaaggcaattagagactg

SEQ ID NO: 7173606 - DNA, 22 bp, Homo sapiens
ggcagaaggcaattagagactg

SEQ ID NO: 7173607 - DNA, 19 bp, Homo sapiens
ggcagaaggtgtaggggga

SEQ ID NO: 7173608 - DNA, 19 bp, Homo sapiens
ggcagaaggtgtaggggga

SEQ ID NO: 7173609 - DNA, 22 bp, Homo sapiens
ggcagaaggcctcccagctcct

SEQ ID NO: 7173610 - DNA, 19 bp, Homo sapiens
ggcagaaggtgtaggggga

SEQ ID NO: 7173611 - DNA, 22 bp, Homo sapiens
ggcagaagaaaggctaagtctc

SEQ ID NO: 7173612 - DNA, 22 bp, Homo sapiens
ggcagaagacaggcaaatcatg

SEQ ID NO: 7173613 - DNA, 22 bp, Homo sapiens
ggcagaagataggacagggaat

SEQ ID NO: 7173614 - DNA, 22 bp, Homo sapiens
ggcagaaggcaattagagactg

SEQ ID NO: 7173615 - DNA, 22 bp, Homo sapiens
ggcagaagataggacagggaat

SEQ ID NO: 7173616 - DNA, 22 bp, Homo sapiens
ggcagaagataggacagggaat

SEQ ID NO: 7173617 - DNA, 22 bp, Homo sapiens
ggcagaaggttgaagtaatttg

SEQ ID NO: 7173618 - DNA, 21 bp, Homo sapiens
ggcagaagtagcatggacggg

SEQ ID NO: 7173619 - DNA, 21 bp, Homo sapiens
ggcagaagtagcatggacggg

SEQ ID NO: 7173620 - DNA, 21 bp, Homo sapiens
ggcagaagtagcatggacggg

SEQ ID NO: 7173621 - DNA, 21 bp, Homo sapiens
ggcagaagtagcatggacggg

SEQ ID NO: 7173622 - DNA, 21 bp, Homo sapiens
ggcagaagtagcatggacggg

SEQ ID NO: 7173623 - DNA, 22 bp, Homo sapiens
ggcagaatgagagggaaacatg

SEQ ID NO: 7173624 - DNA, 22 bp, Homo sapiens
ggcagcagcaaggttggagctg

SEQ ID NO: 7173625 - DNA, 22 bp, Homo sapiens
ggcagcagcaaggttggagctg

SEQ ID NO: 7173626 - DNA, 22 bp, Homo sapiens
ggcagcagcaaggttggagctg

SEQ ID NO: 7173627 - DNA, 22 bp, Homo sapiens
ggcagcagcaaggttggagctg

SEQ ID NO: 7173628 - DNA, 16 bp, Homo sapiens
ggcagcagctccgtgc

SEQ ID NO: 7173629 - DNA, 22 bp, Homo sapiens
ggcagcaggagccatctggtag

SEQ ID NO: 7173630 - DNA, 22 bp, Homo sapiens
ggcagcaggagccatctggtag

SEQ ID NO: 7173631 - DNA, 22 bp, Homo sapiens
ggcagcaggagccatctggtag

SEQ ID NO: 7173632 - DNA, 18 bp, Homo sapiens
ggcactggtgatgcagag

SEQ ID NO: 7173633 - DNA, 18 bp, Homo sapiens
ggcactggtgatgcagag

SEQ ID NO: 7173634 - DNA, 18 bp, Homo sapiens
ggcactggtgatgcagag

SEQ ID NO: 7173635 - DNA, 20 bp, Homo sapiens
ggcacttgatcccctggttc

SEQ ID NO: 7173636 - DNA, 22 bp, Homo sapiens
ggcacttggatcttagttgggg

SEQ ID NO: 7173637 - DNA, 22 bp, Homo sapiens
ggcactgggtgagggtcactgg

SEQ ID NO: 7173638 - DNA, 22 bp, Homo sapiens
ggcactgggttgtaggaattaa

SEQ ID NO: 7173639 - DNA, 22 bp, Homo sapiens
ggcactgggttgtaggaattaa

SEQ ID NO: 7173640 - DNA, 18 bp, Homo sapiens
ggcactggtgatgcagag

SEQ ID NO: 7173641 - DNA, 18 bp, Homo sapiens
ggcactggtgatgcagag

SEQ ID NO: 7173642 - DNA, 18 bp, Homo sapiens
ggcactggtgatgcagag

SEQ ID NO: 7173643 - DNA, 19 bp, Homo sapiens
ggcactggggccaggacca

SEQ ID NO: 7173644 - DNA, 22 bp, Homo sapiens
ggcactgggtgagggtcactgg

SEQ ID NO: 7173645 - DNA, 22 bp, Homo sapiens
ggcactgggtgagggtcactgg

SEQ ID NO: 7173646 - DNA, 22 bp, Homo sapiens
ggcactgggtgagggtcactgg

SEQ ID NO: 7173647 - DNA, 20 bp, Homo sapiens
ggcactgcaccagttagtag

SEQ ID NO: 7173648 - DNA, 20 bp, Homo sapiens
ggcactgcaccagttagtag

SEQ ID NO: 7173649 - DNA, 22 bp, Homo sapiens
ggcactgcaggtaagtgctgtc

SEQ ID NO: 7173650 - DNA, 22 bp, Homo sapiens
ggcactgcaggtaagtgctgtc

SEQ ID NO: 7173651 - DNA, 22 bp, Homo sapiens
ggcactgcaggtaagtgctgtc

SEQ ID NO: 7173652 - DNA, 22 bp, Homo sapiens
ggcactgcccaccctcacaggg

SEQ ID NO: 7173653 - DNA, 22 bp, Homo sapiens
ggcactgccccctgcccaggac

SEQ ID NO: 7173654 - DNA, 22 bp, Homo sapiens
ggcactgccccctgcccaggac

SEQ ID NO: 7173655 - DNA, 21 bp, Homo sapiens
ggcactgctgggccatctgct

SEQ ID NO: 7173656 - DNA, 21 bp, Homo sapiens
ggcactgctgggccatctgct

SEQ ID NO: 7173657 - DNA, 21 bp, Homo sapiens
ggcactgctgggccatctgct

SEQ ID NO: 7173658 - DNA, 22 bp, Homo sapiens
ggcactgctgtaggcagtgagg

SEQ ID NO: 7173659 - DNA, 19 bp, Homo sapiens
ggcactggggccaggacca

SEQ ID NO: 7173660 - DNA, 22 bp, Homo sapiens
ggattgcaacaagctagtttag

SEQ ID NO: 7173661 - DNA, 23 bp, Homo sapiens
ggattggccccaggagtatgggt

SEQ ID NO: 7173662 - DNA, 22 bp, Homo sapiens
ggattttagagtacctaagtgt

SEQ ID NO: 7173663 - DNA, 22 bp, Homo sapiens
ggatttgggcttgcagcagagc

SEQ ID NO: 7173664 - DNA, 22 bp, Homo sapiens
ggcagcagtccatggcccaagg

SEQ ID NO: 7173665 - DNA, 22 bp, Homo sapiens
ggcagcagtccatggcccaagg

SEQ ID NO: 7173666 - DNA, 22 bp, Homo sapiens
ggcagcagtaggagctaatctt

SEQ ID NO: 7173667 - DNA, 22 bp, Homo sapiens
ggcagcagggtctagattgatg

SEQ ID NO: 7173668 - DNA, 22 bp, Homo sapiens
ggcagcagggtagccatttctc

SEQ ID NO: 7173669 - DNA, 22 bp, Homo sapiens
ggcagcagggtctagattgatg

SEQ ID NO: 7173670 - DNA, 22 bp, Homo sapiens
ggcagcagggtagccatttctc

SEQ ID NO: 7173671 - DNA, 22 bp, Homo sapiens
ggcagcagggtctagattgatg

SEQ ID NO: 7173672 - DNA, 22 bp, Homo sapiens
ggcagcagggtctagattgatg

SEQ ID NO: 7173673 - DNA, 22 bp, Homo sapiens
ggcagcagggtctagattgatg

SEQ ID NO: 7173674 - DNA, 22 bp, Homo sapiens
ggcagcagggctgtctccctac

SEQ ID NO: 7173675 - DNA, 22 bp, Homo sapiens
ggcagcagggtagccatttctc

SEQ ID NO: 7173676 - DNA, 22 bp, Homo sapiens
ggcagcagggctgtctccctac

SEQ ID NO: 7173677 - DNA, 22 bp, Homo sapiens
ggcagcagggctgtctccctac

SEQ ID NO: 7173678 - DNA, 22 bp, Homo sapiens
ggcagcagggctgtctccctac

SEQ ID NO: 7173679 - DNA, 22 bp, Homo sapiens
ggcagcaggcgacttccctatt

SEQ ID NO: 7173680 - DNA, 22 bp, Homo sapiens
ggcagccatggacactggctag

SEQ ID NO: 7173681 - DNA, 22 bp, Homo sapiens
ggcagccatgcacgctgcctgg

SEQ ID NO: 7173682 - DNA, 22 bp, Homo sapiens
ggcagccatgcacgctgcctgg

SEQ ID NO: 7173683 - DNA, 22 bp, Homo sapiens
ggcagccatgcacgctgcctgg

SEQ ID NO: 7173684 - DNA, 22 bp, Homo sapiens
ggcagccatactcagacctggg

SEQ ID NO: 7173685 - DNA, 22 bp, Homo sapiens
ggcagccatactcagacctggg

SEQ ID NO: 7173686 - DNA, 22 bp, Homo sapiens
ggcagccatactcagacctggg

SEQ ID NO: 7173687 - DNA, 22 bp, Homo sapiens
ggcagccatactcagacctggg

SEQ ID NO: 7173688 - DNA, 22 bp, Homo sapiens
ggcagccagcacgcagttgatg

SEQ ID NO: 7173689 - DNA, 22 bp, Homo sapiens
ggcagccagcgggtggacgcgc

SEQ ID NO: 7173690 - DNA, 22 bp, Homo sapiens
ggcagccagcgggtggacgcgc

SEQ ID NO: 7173691 - DNA, 22 bp, Homo sapiens
ggcagccagcaatgagaagttt

SEQ ID NO: 7173692 - DNA, 22 bp, Homo sapiens
ggcagccagagggcagctggat

SEQ ID NO: 7173693 - DNA, 22 bp, Homo sapiens
ggcagcagtccatggcccaagg

SEQ ID NO: 7173694 - DNA, 22 bp, Homo sapiens
ggcaggagaatggcgtgaactc

SEQ ID NO: 7173695 - DNA, 22 bp, Homo sapiens
ggcagctttggattcgcggctg

SEQ ID NO: 7173696 - DNA, 22 bp, Homo sapiens
ggcagctttcacctgtcttcct

SEQ ID NO: 7173697 - DNA, 22 bp, Homo sapiens
ggcagctttcacctgtcttcct

SEQ ID NO: 7173698 - DNA, 22 bp, Homo sapiens
ggcagctttccttatcctaggg

SEQ ID NO: 7173699 - DNA, 20 bp, Homo sapiens
ggcagcttgggcagcagtta

SEQ ID NO: 7173700 - DNA, 23 bp, Homo sapiens
ggcagcttgttcctttgcttcca

SEQ ID NO: 7173701 - DNA, 23 bp, Homo sapiens
ggcagcttgttcctttgcttcca

SEQ ID NO: 7173702 - DNA, 22 bp, Homo sapiens
ggcagctttcaatagggttatg

SEQ ID NO: 7173703 - DNA, 22 bp, Homo sapiens
ggcagctgtttgtcctcctgtt

SEQ ID NO: 7173704 - DNA, 22 bp, Homo sapiens
ggcagcttacgttttgctagtg

SEQ ID NO: 7173705 - DNA, 22 bp, Homo sapiens
ggcagcttcctgagccagcagc

SEQ ID NO: 7173706 - DNA, 22 bp, Homo sapiens
ggcagcttcggacggcttataa

SEQ ID NO: 7173707 - DNA, 22 bp, Homo sapiens
ggcagcttcggacggcttataa

SEQ ID NO: 7173708 - DNA, 22 bp, Homo sapiens
ggcagcttctcccaggctgttt

SEQ ID NO: 7173709 - DNA, 22 bp, Homo sapiens
ggcagcttgccctggtctcaac

SEQ ID NO: 7173710 - DNA, 17 bp, Homo sapiens
ggcagctgtgtgcatgc

SEQ ID NO: 7173711 - DNA, 17 bp, Homo sapiens
ggcagctgtgtgcatgc

SEQ ID NO: 7173712 - DNA, 17 bp, Homo sapiens
ggcagctgtgtgcatgc

SEQ ID NO: 7173713 - DNA, 17 bp, Homo sapiens
ggcagctgtgtgcatgc

SEQ ID NO: 7173714 - DNA, 22 bp, Homo sapiens
ggcagctgttggctctctagga

SEQ ID NO: 7173715 - DNA, 22 bp, Homo sapiens
ggcagctgttggctctctagga

SEQ ID NO: 7173716 - DNA, 22 bp, Homo sapiens
ggcagctgtttgtcctcctgtt

SEQ ID NO: 7173717 - DNA, 22 bp, Homo sapiens
ggcagctgtttgtcctcctgtt

SEQ ID NO: 7173718 - DNA, 22 bp, Homo sapiens
ggcatgagtaacgtgagtgagg

SEQ ID NO: 7173719 - DNA, 22 bp, Homo sapiens
ggcatgagtggcagtgggcagt

SEQ ID NO: 7173720 - DNA, 22 bp, Homo sapiens
ggcatgcaaaacaactcagaga

SEQ ID NO: 7173721 - DNA, 22 bp, Homo sapiens
ggcatgcaaatgtgggtgacct

SEQ ID NO: 7173722 - DNA, 22 bp, Homo sapiens
ggcatgcaaagccccttacaga

SEQ ID NO: 7173723 - DNA, 22 bp, Homo sapiens
ggcatgcaaatgtgggtgacct

SEQ ID NO: 7173724 - DNA, 22 bp, Homo sapiens
ggcatgcaaagccccttacaga

SEQ ID NO: 7173725 - DNA, 22 bp, Homo sapiens
ggcatgcaaatgtgggtgacct

SEQ ID NO: 7173726 - DNA, 22 bp, Homo sapiens
ggcatgcaaatgtgggtgacct

SEQ ID NO: 7173727 - DNA, 23 bp, Homo sapiens
ggcatgcaatggacagagctgga

SEQ ID NO: 7173728 - DNA, 23 bp, Homo sapiens
ggcatgcaatggacagagctgga

SEQ ID NO: 7173729 - DNA, 23 bp, Homo sapiens
ggcatgcaatggacagagctgga

SEQ ID NO: 7173730 - DNA, 22 bp, Homo sapiens
ggcatgcacccggtgaccatga

SEQ ID NO: 7173731 - DNA, 22 bp, Homo sapiens
ggcatgcatacgtagtgatttt

SEQ ID NO: 7173732 - DNA, 22 bp, Homo sapiens
ggcatgcatcaccacgccacgc

SEQ ID NO: 7173733 - DNA, 22 bp, Homo sapiens
ggcatgcatcaccacgccacgc

SEQ ID NO: 7173734 - DNA, 22 bp, Homo sapiens
ggcatgcatgcaaggtggtgta

SEQ ID NO: 7173735 - DNA, 22 bp, Homo sapiens
ggcatgcatacgtagtgatttt

SEQ ID NO: 7173736 - DNA, 22 bp, Homo sapiens
ggcatgcatgcaaggtggtgta

SEQ ID NO: 7173737 - DNA, 22 bp, Homo sapiens
ggcatgcatgcatgcacctgtg

SEQ ID NO: 7173738 - DNA, 22 bp, Homo sapiens
ggcatgcatgttgttttaggtg

SEQ ID NO: 7173739 - DNA, 22 bp, Homo sapiens
ggcatgcatgttgttttaggtg

SEQ ID NO: 7173740 - DNA, 22 bp, Homo sapiens
ggcatgcattggcatttcggtt

SEQ ID NO: 7173741 - DNA, 22 bp, Homo sapiens
ggcatgcattggcatttcggtt

SEQ ID NO: 7173742 - DNA, 22 bp, Homo sapiens
ggcatgcttctgagatgtctcc

SEQ ID NO: 7173743 - DNA, 22 bp, Homo sapiens
ggcatgcttgccatgggccagt

SEQ ID NO: 7173744 - DNA, 22 bp, Homo sapiens
ggcatggacgtctctgaggcca

SEQ ID NO: 7173745 - DNA, 22 bp, Homo sapiens
ggcatggacgtctctgaggcca

SEQ ID NO: 7173746 - DNA, 22 bp, Homo sapiens
ggccagctgtaagctgctgaat

SEQ ID NO: 7173747 - DNA, 22 bp, Homo sapiens
ggccaggaacttttgggatggg

SEQ ID NO: 7173748 - DNA, 22 bp, Homo sapiens
ggccagctttgagctgcaggaa

SEQ ID NO: 7173749 - DNA, 22 bp, Homo sapiens
ggccagctttgagctgcaggaa

SEQ ID NO: 7173750 - DNA, 22 bp, Homo sapiens
ggccagcttattagctcagagg

SEQ ID NO: 7173751 - DNA, 22 bp, Homo sapiens
ggccagcttctctgctgcctgt

SEQ ID NO: 7173752 - DNA, 19 bp, Homo sapiens
ggccagctgtctcctgcta

SEQ ID NO: 7173753 - DNA, 22 bp, Homo sapiens
ggccagctgtggggccgagcct

SEQ ID NO: 7173754 - DNA, 22 bp, Homo sapiens
ggccagctgtggggccgagcct

SEQ ID NO: 7173755 - DNA, 21 bp, Homo sapiens
ggcatgagggcagtgagcaga

SEQ ID NO: 7173756 - DNA, 21 bp, Homo sapiens
ggcatgagggcagtgagcaga

SEQ ID NO: 7173757 - DNA, 21 bp, Homo sapiens
ggcatgagggcagtgagcaga

SEQ ID NO: 7173758 - DNA, 20 bp, Homo sapiens
ggcatgagatgtgagggagg

SEQ ID NO: 7173759 - DNA, 18 bp, Homo sapiens
ggcatctgcacagcagcc

SEQ ID NO: 7173760 - DNA, 22 bp, Homo sapiens
ggcatctgagctgtgtatggtt

SEQ ID NO: 7173761 - DNA, 22 bp, Homo sapiens
ggcatctggatctgcttctccc

SEQ ID NO: 7173762 - DNA, 22 bp, Homo sapiens
ggcatctgtccatctctccagc

SEQ ID NO: 7173763 - DNA, 22 bp, Homo sapiens
ggcatgagaggtcctggggatt

SEQ ID NO: 7173764 - DNA, 22 bp, Homo sapiens
ggcatgagaggtcctggggatt

SEQ ID NO: 7173765 - DNA, 22 bp, Homo sapiens
ggcatcttcaaaattgccaaat

SEQ ID NO: 7173766 - DNA, 20 bp, Homo sapiens
ggcatctataaacacatcca

SEQ ID NO: 7173767 - DNA, 19 bp, Homo sapiens
ggcatctccactcctaccc

SEQ ID NO: 7173768 - DNA, 22 bp, Homo sapiens
ggcatcctctagaagctggaaa

SEQ ID NO: 7173769 - DNA, 21 bp, Homo sapiens
ggcatcccaggccagtgactg

SEQ ID NO: 7173770 - DNA, 22 bp, Homo sapiens
ggcatcagggtaggaaggtatc

SEQ ID NO: 7173771 - DNA, 19 bp, Homo sapiens
ggcatccacagctggagag

SEQ ID NO: 7173772 - DNA, 19 bp, Homo sapiens
ggcatccacgaatgcagag

SEQ ID NO: 7173773 - DNA, 22 bp, Homo sapiens
ggcatccaaataccaagatgta

SEQ ID NO: 7173774 - DNA, 22 bp, Homo sapiens
ggcatccaaataccaagatgta

SEQ ID NO: 7173775 - DNA, 19 bp, Homo sapiens
ggcatccacagctggagag

SEQ ID NO: 7173776 - DNA, 22 bp, Homo sapiens
ggcagtggtgggaggctcgctc

SEQ ID NO: 7173777 - DNA, 22 bp, Homo sapiens
ggcagtggtgggaggctcgctc

SEQ ID NO: 7173778 - DNA, 22 bp, Homo sapiens
ggcagtggtgggaggctcgctc

SEQ ID NO: 7173779 - DNA, 22 bp, Homo sapiens
ggcagtggtgggaggctcgctc

SEQ ID NO: 7173780 - DNA, 22 bp, Homo sapiens
ggcagggtttacaatagcaata

SEQ ID NO: 7173781 - DNA, 22 bp, Homo sapiens
ggcagggtgtggagttgggaca

SEQ ID NO: 7173782 - DNA, 22 bp, Homo sapiens
ggcagggtgtggagttgggaca

SEQ ID NO: 7173783 - DNA, 22 bp, Homo sapiens
ggcagggtgtggagttgggaca

SEQ ID NO: 7173784 - DNA, 22 bp, Homo sapiens
ggcagggtgtggagttgggaca

SEQ ID NO: 7173785 - DNA, 22 bp, Homo sapiens
ggcagggtggccctccagtgag

SEQ ID NO: 7173786 - DNA, 22 bp, Homo sapiens
ggcagggtttctccattctgcc

SEQ ID NO: 7173787 - DNA, 22 bp, Homo sapiens
ggcaggtacagcaagaggacaa

SEQ ID NO: 7173788 - DNA, 22 bp, Homo sapiens
ggcaggtacagcaagaggacaa

SEQ ID NO: 7173789 - DNA, 22 bp, Homo sapiens
ggcaggtacagcaagaggacaa

SEQ ID NO: 7173790 - DNA, 19 bp, Homo sapiens
ggcaggtagagggccagtc

SEQ ID NO: 7173791 - DNA, 19 bp, Homo sapiens
ggcaggtagagggccagtc

SEQ ID NO: 7173792 - DNA, 22 bp, Homo sapiens
ggcagggtggccctccagtgag

SEQ ID NO: 7173793 - DNA, 22 bp, Homo sapiens
ggcagggtggccctccagtgag

SEQ ID NO: 7173794 - DNA, 22 bp, Homo sapiens
ggcagggtggcagaggctcaga

SEQ ID NO: 7173795 - DNA, 22 bp, Homo sapiens
ggcagggtggcagaggctcaga

SEQ ID NO: 7173796 - DNA, 17 bp, Homo sapiens
ggcagggtgctgggtat

SEQ ID NO: 7173797 - DNA, 22 bp, Homo sapiens
ggcagggtgcctggctcctgtt

SEQ ID NO: 7173798 - DNA, 17 bp, Homo sapiens
ggcagggtgctgggtat

SEQ ID NO: 7173799 - DNA, 17 bp, Homo sapiens
ggcagggtgctgggtat

SEQ ID NO: 7173800 - DNA, 17 bp, Homo sapiens
ggcagggtgctgggtat

SEQ ID NO: 7173801 - DNA, 17 bp, Homo sapiens
ggcagggtgctgggtat

SEQ ID NO: 7173802 - DNA, 22 bp, Homo sapiens
ggcaggtgacctggcctcccag

SEQ ID NO: 7173803 - DNA, 17 bp, Homo sapiens
ggcaggtgacagacacc

SEQ ID NO: 7173804 - DNA, 22 bp, Homo sapiens
ggcaggtgacctggcctcccag

SEQ ID NO: 7173805 - DNA, 22 bp, Homo sapiens
ggcaggtgacctggcctcccag

SEQ ID NO: 7173806 - DNA, 17 bp, Homo sapiens
ggcaggtgacagacacc

SEQ ID NO: 7173807 - DNA, 17 bp, Homo sapiens
ggcaggtgacagacacc

SEQ ID NO: 7173808 - DNA, 17 bp, Homo sapiens
ggcaggtgacagacacc

SEQ ID NO: 7173809 - DNA, 17 bp, Homo sapiens
ggcaggtgacagacacc

SEQ ID NO: 7173810 - DNA, 22 bp, Homo sapiens
ggcaggtagcctagaggaggtt

SEQ ID NO: 7173811 - DNA, 22 bp, Homo sapiens
ggcaggtagcctagaggaggtt

SEQ ID NO: 7173812 - DNA, 22 bp, Homo sapiens
ggcagtgggtggatctcaggga

SEQ ID NO: 7173813 - DNA, 22 bp, Homo sapiens
ggcagtgggttccccaaggcac

SEQ ID NO: 7173814 - DNA, 22 bp, Homo sapiens
ggcagtgggttccccaaggcac

SEQ ID NO: 7173815 - DNA, 22 bp, Homo sapiens
ggcagtgggttccccaaggcac

SEQ ID NO: 7173816 - DNA, 22 bp, Homo sapiens
ggcaggtgacggggatgagtat

SEQ ID NO: 7173817 - DNA, 22 bp, Homo sapiens
ggcaggtgacggggatgagtat

SEQ ID NO: 7173818 - DNA, 22 bp, Homo sapiens
ggcaggtgagagctctttgaaa

SEQ ID NO: 7173819 - DNA, 22 bp, Homo sapiens
ggcaggtgagagctctttgaaa

SEQ ID NO: 7173820 - DNA, 22 bp, Homo sapiens
ggcaggaggaagagttagcacc

SEQ ID NO: 7173821 - DNA, 22 bp, Homo sapiens
ggcaggagctctccagtttgcc

SEQ ID NO: 7173822 - DNA, 22 bp, Homo sapiens
ggcaggagctctccagtttgcc

SEQ ID NO: 7173823 - DNA, 22 bp, Homo sapiens
ggcaggagctctccagtttgcc

SEQ ID NO: 7173824 - DNA, 22 bp, Homo sapiens
ggcaggagctctccagtttgcc

SEQ ID NO: 7173825 - DNA, 22 bp, Homo sapiens
ggcaggagctctccagtttgcc

SEQ ID NO: 7173826 - DNA, 22 bp, Homo sapiens
ggcaggagctcaggttggttcc

SEQ ID NO: 7173827 - DNA, 22 bp, Homo sapiens
ggcaggagaatggcgtgaactc

SEQ ID NO: 7173828 - DNA, 22 bp, Homo sapiens
ggcaggagaatggcgtgaactc

SEQ ID NO: 7173829 - DNA, 22 bp, Homo sapiens
ggcagggtgcctggctcctgtt

SEQ ID NO: 7173830 - DNA, 22 bp, Homo sapiens
ggcagggtctggactgaaagct

SEQ ID NO: 7173831 - DNA, 22 bp, Homo sapiens
ggcagggtccacacctgggaaa

SEQ ID NO: 7173832 - DNA, 22 bp, Homo sapiens
ggcagggtaaaccgaggtaagt

SEQ ID NO: 7173833 - DNA, 22 bp, Homo sapiens
ggcagggtaaaccgaggtaagt

SEQ ID NO: 7173834 - DNA, 22 bp, Homo sapiens
ggcagggtaaaccgaggtaagt

SEQ ID NO: 7173835 - DNA, 22 bp, Homo sapiens
ggcagggtaaaccgaggtaagt

SEQ ID NO: 7173836 - DNA, 22 bp, Homo sapiens
ggcagggtaaaccgaggtaagt

SEQ ID NO: 7173837 - DNA, 18 bp, Homo sapiens
ggcaggggtgaaccacag

SEQ ID NO: 7173838 - DNA, 22 bp, Homo sapiens
ggcaggggtgaggccactctga

SEQ ID NO: 7173839 - DNA, 22 bp, Homo sapiens
ggcaggggtgaggccactctga

SEQ ID NO: 7173840 - DNA, 22 bp, Homo sapiens
ggcaggggtggccttcctttgg

SEQ ID NO: 7173841 - DNA, 22 bp, Homo sapiens
ggcaggggttcattttgtctta

SEQ ID NO: 7173842 - DNA, 22 bp, Homo sapiens
ggcaggggtgaggccactctga

SEQ ID NO: 7173843 - DNA, 22 bp, Homo sapiens
ggccctggtcctaggggtggaa

SEQ ID NO: 7173844 - DNA, 21 bp, Homo sapiens
ggccctggttacgcctcctct

SEQ ID NO: 7173845 - DNA, 22 bp, Homo sapiens
ggccctggtcctaggggtggaa

SEQ ID NO: 7173846 - DNA, 22 bp, Homo sapiens
ggccctggtcctaggggtggaa

SEQ ID NO: 7173847 - DNA, 22 bp, Homo sapiens
ggccctggtcctaggggtggaa

SEQ ID NO: 7173848 - DNA, 22 bp, Homo sapiens
ggccctgggcagaggagtgggc

SEQ ID NO: 7173849 - DNA, 22 bp, Homo sapiens
ggccctgggatgctcagcagtg

SEQ ID NO: 7173850 - DNA, 22 bp, Homo sapiens
ggccctgggatgctcagcagtg

SEQ ID NO: 7173851 - DNA, 22 bp, Homo sapiens
ggccctgggatgctcagcagtg

SEQ ID NO: 7173852 - DNA, 22 bp, Homo sapiens
ggccctgggatgctcagcagtg

SEQ ID NO: 7173853 - DNA, 22 bp, Homo sapiens
ggccctgggacacaacaccgaa

SEQ ID NO: 7173854 - DNA, 22 bp, Homo sapiens
ggccctgggatgctcagcagtg

SEQ ID NO: 7173855 - DNA, 22 bp, Homo sapiens
ggccctgggatgctcagcagtg

SEQ ID NO: 7173856 - DNA, 22 bp, Homo sapiens
ggccctgggatgctcagcagtg

SEQ ID NO: 7173857 - DNA, 22 bp, Homo sapiens
ggccctgggcagaggagtgggc

SEQ ID NO: 7173858 - DNA, 22 bp, Homo sapiens
ggccctgggcagaggagtgggc

SEQ ID NO: 7173859 - DNA, 22 bp, Homo sapiens
ggccctgggcagaggagtgggc

SEQ ID NO: 7173860 - DNA, 22 bp, Homo sapiens
ggccctgggcagaggagtgggc

SEQ ID NO: 7173861 - DNA, 21 bp, Homo sapiens
ggccctggttacgcctcctct

SEQ ID NO: 7173862 - DNA, 23 bp, Homo sapiens
ggcctaacagaggcagggctgag

SEQ ID NO: 7173863 - DNA, 22 bp, Homo sapiens
ggcctagagcagggctaaggtc

SEQ ID NO: 7173864 - DNA, 22 bp, Homo sapiens
ggcctagcctctcctgagagag

SEQ ID NO: 7173865 - DNA, 22 bp, Homo sapiens
ggcctagggagtggccatgcct

SEQ ID NO: 7173866 - DNA, 22 bp, Homo sapiens
ggcctagggcttggtcatggca

SEQ ID NO: 7173867 - DNA, 22 bp, Homo sapiens
ggcctcacccatcggtgccttt

SEQ ID NO: 7173868 - DNA, 22 bp, Homo sapiens
ggccctggcagccacgaaagcc

SEQ ID NO: 7173869 - DNA, 22 bp, Homo sapiens
ggccctgctgagtggagtggag

SEQ ID NO: 7173870 - DNA, 22 bp, Homo sapiens
ggccctgctgaagccgggtcta

SEQ ID NO: 7173871 - DNA, 22 bp, Homo sapiens
ggccctgctgagtggagtggag

SEQ ID NO: 7173872 - DNA, 22 bp, Homo sapiens
ggccctgctgagtggagtggag

SEQ ID NO: 7173873 - DNA, 22 bp, Homo sapiens
ggccctgctgagtggagtggag

SEQ ID NO: 7173874 - DNA, 22 bp, Homo sapiens
ggccctggcagccacgaaagcc

SEQ ID NO: 7173875 - DNA, 22 bp, Homo sapiens
ggccctggcagccacgaaagcc

SEQ ID NO: 7173876 - DNA, 22 bp, Homo sapiens
ggccctggcagccacgaaagcc

SEQ ID NO: 7173877 - DNA, 19 bp, Homo sapiens
ggccaggctgactgtggtc

SEQ ID NO: 7173878 - DNA, 22 bp, Homo sapiens
ggccaggcgatgacccctccac

SEQ ID NO: 7173879 - DNA, 22 bp, Homo sapiens
ggccctgctcaggctgcgatga

SEQ ID NO: 7173880 - DNA, 22 bp, Homo sapiens
ggccctgctgaagccgggtcta

SEQ ID NO: 7173881 - DNA, 22 bp, Homo sapiens
ggccaggcgatgacccctccac

SEQ ID NO: 7173882 - DNA, 22 bp, Homo sapiens
ggccaggcgatgacccctccac

SEQ ID NO: 7173883 - DNA, 22 bp, Homo sapiens
ggccaggcgatgacccctccac

SEQ ID NO: 7173884 - DNA, 22 bp, Homo sapiens
ggccaggcgatgacccctccac

SEQ ID NO: 7173885 - DNA, 22 bp, Homo sapiens
ggccaggccaagagggttggaa

SEQ ID NO: 7173886 - DNA, 22 bp, Homo sapiens
ggccaggccaagagggttggaa

SEQ ID NO: 7173887 - DNA, 22 bp, Homo sapiens
ggccaggcactgtgtgagatat

SEQ ID NO: 7173888 - DNA, 22 bp, Homo sapiens
ggccaggccaagagggttggaa

SEQ ID NO: 7173889 - DNA, 22 bp, Homo sapiens
ggccaggcactgtgtgagatat

SEQ ID NO: 7173890 - DNA, 22 bp, Homo sapiens
ggccaggcactgtgtgagatat

SEQ ID NO: 7173891 - DNA, 22 bp, Homo sapiens
ggccaggcactgtgtgagatat

SEQ ID NO: 7173892 - DNA, 22 bp, Homo sapiens
ggccaggcactgtgtgagatat

SEQ ID NO: 7173893 - DNA, 22 bp, Homo sapiens
ggccaggagcaagccaggctct

SEQ ID NO: 7173894 - DNA, 22 bp, Homo sapiens
ggccaggagcaagccaggctct

SEQ ID NO: 7173895 - DNA, 22 bp, Homo sapiens
ggccaggagaggagggcactga

SEQ ID NO: 7173896 - DNA, 22 bp, Homo sapiens
ggccaggagatggacaccacat

SEQ ID NO: 7173897 - DNA, 22 bp, Homo sapiens
ggccaggagatggacaccacat

SEQ ID NO: 7173898 - DNA, 22 bp, Homo sapiens
ggccaggagcaagccaggctct

SEQ ID NO: 7173899 - DNA, 22 bp, Homo sapiens
ggccaggagcaagccaggctct

SEQ ID NO: 7173900 - DNA, 22 bp, Homo sapiens
ggccaggagaggagggcactga

SEQ ID NO: 7173901 - DNA, 22 bp, Homo sapiens
ggccaggaagggaagatcagca

SEQ ID NO: 7173902 - DNA, 22 bp, Homo sapiens
ggccaggaggcaggggctcaat

SEQ ID NO: 7173903 - DNA, 22 bp, Homo sapiens
ggccaggagctgcacagggctc

SEQ ID NO: 7173904 - DNA, 22 bp, Homo sapiens
ggccaggaggcaggggctcaat

SEQ ID NO: 7173905 - DNA, 22 bp, Homo sapiens
ggccaggaggcaggggctcaat

SEQ ID NO: 7173906 - DNA, 22 bp, Homo sapiens
ggccaggagctgcacagggctc

SEQ ID NO: 7173907 - DNA, 22 bp, Homo sapiens
ggccaggagcaagccaggctct

SEQ ID NO: 7173908 - DNA, 19 bp, Homo sapiens
ggcctggctatccctgctg

SEQ ID NO: 7173909 - DNA, 19 bp, Homo sapiens
ggcctggctatccctgctg

SEQ ID NO: 7173910 - DNA, 22 bp, Homo sapiens
ggcctggctcttgcccagcctg

SEQ ID NO: 7173911 - DNA, 19 bp, Homo sapiens
ggcctggctatccctgctg

SEQ ID NO: 7173912 - DNA, 22 bp, Homo sapiens
ggcctggcctcccttcctagcg

SEQ ID NO: 7173913 - DNA, 22 bp, Homo sapiens
ggcctggcctcccttcctagcg

SEQ ID NO: 7173914 - DNA, 22 bp, Homo sapiens
ggcctggcctcccttcctagcg

SEQ ID NO: 7173915 - DNA, 22 bp, Homo sapiens
ggcctggctcttgcccagcctg

SEQ ID NO: 7173916 - DNA, 22 bp, Homo sapiens
ggcctggctcttgcccagcctg

SEQ ID NO: 7173917 - DNA, 22 bp, Homo sapiens
ggcctggctggttcagtaccct

SEQ ID NO: 7173918 - DNA, 22 bp, Homo sapiens
ggcctggctggttcagtaccct

SEQ ID NO: 7173919 - DNA, 22 bp, Homo sapiens
ggcgggggtccaggagcctgca

SEQ ID NO: 7173920 - DNA, 22 bp, Homo sapiens
ggcgggtgataggatgagcagg

SEQ ID NO: 7173921 - DNA, 22 bp, Homo sapiens
ggcgggtgataggatgagcagg

SEQ ID NO: 7173922 - DNA, 19 bp, Homo sapiens
ggcgggtggactggagccc

SEQ ID NO: 7173923 - DNA, 19 bp, Homo sapiens
ggcgggtggactggagccc

SEQ ID NO: 7173924 - DNA, 22 bp, Homo sapiens
ggcgggtggcgaggcttctcgg

SEQ ID NO: 7173925 - DNA, 22 bp, Homo sapiens
ggcgggtgtaagtaggacagcg

SEQ ID NO: 7173926 - DNA, 22 bp, Homo sapiens
ggcgggtgtaagtaggacagcg

SEQ ID NO: 7173927 - DNA, 22 bp, Homo sapiens
ggcgggtgtaagtaggacagcg

SEQ ID NO: 7173928 - DNA, 22 bp, Homo sapiens
ggcgggtgtaagtaggacagcg

SEQ ID NO: 7173929 - DNA, 22 bp, Homo sapiens
ggcgggtgtaagtaggacagcg

SEQ ID NO: 7173930 - DNA, 18 bp, Homo sapiens
ggcgggtgttttattcac

SEQ ID NO: 7173931 - DNA, 22 bp, Homo sapiens
ggcggtcagcgtgggagaggct

SEQ ID NO: 7173932 - DNA, 22 bp, Homo sapiens
ggcggtctcagcaccctcttgg

SEQ ID NO: 7173933 - DNA, 22 bp, Homo sapiens
ggcggtggcgtgaaggtggctg

SEQ ID NO: 7173934 - DNA, 22 bp, Homo sapiens
ggcggtggcgtgaaggtggctg

SEQ ID NO: 7173935 - DNA, 22 bp, Homo sapiens
ggcctggagcagagactaggga

SEQ ID NO: 7173936 - DNA, 22 bp, Homo sapiens
ggcctggagcagagactaggga

SEQ ID NO: 7173937 - DNA, 22 bp, Homo sapiens
ggcctggagcagagactaggga

SEQ ID NO: 7173938 - DNA, 22 bp, Homo sapiens
ggcctggagcagagactaggga

SEQ ID NO: 7173939 - DNA, 22 bp, Homo sapiens
ggcctggagaaggcccagggag

SEQ ID NO: 7173940 - DNA, 22 bp, Homo sapiens
ggcctggagaaggcccagggag

SEQ ID NO: 7173941 - DNA, 22 bp, Homo sapiens
ggcctggagaaggcccagggag

SEQ ID NO: 7173942 - DNA, 22 bp, Homo sapiens
ggcctggagcagagactaggga

SEQ ID NO: 7173943 - DNA, 22 bp, Homo sapiens
ggcctggagcagagactaggga

SEQ ID NO: 7173944 - DNA, 22 bp, Homo sapiens
ggcctggagtcagggaaagcaa

SEQ ID NO: 7173945 - DNA, 22 bp, Homo sapiens
ggcctggagtcagggaaagcaa

SEQ ID NO: 7173946 - DNA, 22 bp, Homo sapiens
ggcctggagtcagggaaagcaa

SEQ ID NO: 7173947 - DNA, 22 bp, Homo sapiens
ggcctggagtttggggaataga

SEQ ID NO: 7173948 - DNA, 19 bp, Homo sapiens
ggcctggatttagggctcc

SEQ ID NO: 7173949 - DNA, 19 bp, Homo sapiens
ggcctggatttagggctcc

SEQ ID NO: 7173950 - DNA, 19 bp, Homo sapiens
ggcctggatttagggctcc

SEQ ID NO: 7173951 - DNA, 22 bp, Homo sapiens
ggcctggcagagcgcgcggctg

SEQ ID NO: 7173952 - DNA, 22 bp, Homo sapiens
ggcctggcatggggactaaggg

SEQ ID NO: 7173953 - DNA, 22 bp, Homo sapiens
ggcctggcatggggactaaggg

SEQ ID NO: 7173954 - DNA, 23 bp, Homo sapiens
ggcctggcccagggccctgatga

SEQ ID NO: 7173955 - DNA, 23 bp, Homo sapiens
ggcctggcccagggccctgatga

SEQ ID NO: 7173956 - DNA, 22 bp, Homo sapiens
ggcctggccctcccgggttcaa

SEQ ID NO: 7173957 - DNA, 22 bp, Homo sapiens
ggcctggccctcccgggttcaa

SEQ ID NO: 7173958 - DNA, 22 bp, Homo sapiens
ggcctggcctccagatgtgggc

SEQ ID NO: 7173959 - DNA, 22 bp, Homo sapiens
ggcctggcctccagatgtgggc

SEQ ID NO: 7173960 - DNA, 22 bp, Homo sapiens
ggcctggcctccagatgtgggc

SEQ ID NO: 7173961 - DNA, 22 bp, Homo sapiens
ggcctggcctccagatgtgggc

SEQ ID NO: 7173962 - DNA, 22 bp, Homo sapiens
ggcctggacacctgaggtctta

SEQ ID NO: 7173963 - DNA, 22 bp, Homo sapiens
ggcctggacacctgaggtctta

SEQ ID NO: 7173964 - DNA, 22 bp, Homo sapiens
ggcctggacaaatgcaccaagg

SEQ ID NO: 7173965 - DNA, 22 bp, Homo sapiens
ggcctggacacctgaggtctta

SEQ ID NO: 7173966 - DNA, 22 bp, Homo sapiens
ggcctggacacctgaggtctta

SEQ ID NO: 7173967 - DNA, 22 bp, Homo sapiens
ggcctggaaggacagcgtgatg

SEQ ID NO: 7173968 - DNA, 22 bp, Homo sapiens
ggcctggaatgctttcctacca

SEQ ID NO: 7173969 - DNA, 22 bp, Homo sapiens
ggcctggacaaatgcaccaagg

SEQ ID NO: 7173970 - DNA, 22 bp, Homo sapiens
ggcctggaaggacagcgtgatg

SEQ ID NO: 7173971 - DNA, 22 bp, Homo sapiens
ggcctggaaggacagcgtgatg

SEQ ID NO: 7173972 - DNA, 22 bp, Homo sapiens
ggcctggaaggacagcgtgatg

SEQ ID NO: 7173973 - DNA, 22 bp, Homo sapiens
ggcctggaagaggacagagaaa

SEQ ID NO: 7173974 - DNA, 22 bp, Homo sapiens
ggcctggaagaggacagagaaa

SEQ ID NO: 7173975 - DNA, 22 bp, Homo sapiens
ggcctgctggctccagcgcccg

SEQ ID NO: 7173976 - DNA, 22 bp, Homo sapiens
ggcctgctggggcctcagacac

SEQ ID NO: 7173977 - DNA, 22 bp, Homo sapiens
ggcctgctgtagcttttgttct

SEQ ID NO: 7173978 - DNA, 22 bp, Homo sapiens
ggcctgcttactgattgttgtt

SEQ ID NO: 7173979 - DNA, 22 bp, Homo sapiens
ggcctgctccgggggctgagct

SEQ ID NO: 7173980 - DNA, 22 bp, Homo sapiens
ggcctgctctgtttagaggggg

SEQ ID NO: 7173981 - DNA, 22 bp, Homo sapiens
ggcctgctctgtttagaggggg

SEQ ID NO: 7173982 - DNA, 22 bp, Homo sapiens
ggcctgctgcagtgtgacagtt

SEQ ID NO: 7173983 - DNA, 22 bp, Homo sapiens
ggcctcagaccggagctggcca

SEQ ID NO: 7173984 - DNA, 22 bp, Homo sapiens
ggcctgcctcacagtcagcacc

SEQ ID NO: 7173985 - DNA, 22 bp, Homo sapiens
ggcctgctattggtgggcagac

SEQ ID NO: 7173986 - DNA, 22 bp, Homo sapiens
ggcctgctcagtcctctttctt

SEQ ID NO: 7173987 - DNA, 22 bp, Homo sapiens
ggcctgctccgggggctgagct

SEQ ID NO: 7173988 - DNA, 22 bp, Homo sapiens
gcctggtgaaaggcagagagcg

SEQ ID NO: 7173989 - DNA, 22 bp, Homo sapiens
gcctggtgaaaggcagagagcg

SEQ ID NO: 7173990 - DNA, 22 bp, Homo sapiens
gcctggtctctttcatgtcagt

SEQ ID NO: 7173991 - DNA, 22 bp, Homo sapiens
gcctggtctctttcatgtcagt

SEQ ID NO: 7173992 - DNA, 22 bp, Homo sapiens
gcctggtgaaaggcagagagcg

SEQ ID NO: 7173993 - DNA, 22 bp, Homo sapiens
gcctggtgataagcagtgacct

SEQ ID NO: 7173994 - DNA, 22 bp, Homo sapiens
gcctgggtccactgatcatgct

SEQ ID NO: 7173995 - DNA, 22 bp, Homo sapiens
gcctgggtgagggtctccttca

SEQ ID NO: 7173996 - DNA, 22 bp, Homo sapiens
gcctgggttccatgatctccag

SEQ ID NO: 7173997 - DNA, 22 bp, Homo sapiens
gcctgggttccatgatctccag

SEQ ID NO: 7173998 - DNA, 22 bp, Homo sapiens
gcctggggcatgcagctgatac

SEQ ID NO: 7173999 - DNA, 22 bp, Homo sapiens
gcctggggccagcttgggctga

SEQ ID NO: 7174000 - DNA, 22 bp, Homo sapiens
gcctggggccagcttgggctga

SEQ ID NO: 7174001 - DNA, 22 bp, Homo sapiens
gcctggggccagcttgggctga

SEQ ID NO: 7174002 - DNA, 22 bp, Homo sapiens
gcctggggaacttgatcctgtc

SEQ ID NO: 7174003 - DNA, 22 bp, Homo sapiens
gcctggggaacttgatcctgtc

SEQ ID NO: 7174004 - DNA, 22 bp, Homo sapiens
gcctggggaacttgatcctgtc

SEQ ID NO: 7174005 - DNA, 22 bp, Homo sapiens
gcctggggcatgcagctgatac

SEQ ID NO: 7174006 - DNA, 22 bp, Homo sapiens
gcctggggcatgcagctgatac

SEQ ID NO: 7174007 - DNA, 22 bp, Homo sapiens
gcctggggcatgcagctgatac

SEQ ID NO: 7174008 - DNA, 22 bp, Homo sapiens
gcctggggcatgcagctgatac

SEQ ID NO: 7174009 - DNA, 22 bp, Homo sapiens
gcctggggcatgcagctgatac

SEQ ID NO: 7174010 - DNA, 22 bp, Homo sapiens
gcctggggtcccttgttggcac

SEQ ID NO: 7174011 - DNA, 22 bp, Homo sapiens
gcctggggtctctgactcacag

SEQ ID NO: 7174012 - DNA, 22 bp, Homo sapiens
gcctggggtctctgactcacag

SEQ ID NO: 7174013 - DNA, 22 bp, Homo sapiens
gcctggggtctctgactcacag

SEQ ID NO: 7174014 - DNA, 22 bp, Homo sapiens
gcctggggggcatgtcataata

SEQ ID NO: 7174015 - DNA, 22 bp, Homo sapiens
gcctggggggcatgtcataata

SEQ ID NO: 7174016 - DNA, 22 bp, Homo sapiens
gcctggggggcatgtcataata

SEQ ID NO: 7174017 - DNA, 22 bp, Homo sapiens
gcctggggtcccttgttggcac

SEQ ID NO: 7174018 - DNA, 22 bp, Homo sapiens
gcctggggtcccttgttggcac

SEQ ID NO: 7174019 - DNA, 22 bp, Homo sapiens
gccttcagtagtgtcagctgta

SEQ ID NO: 7174020 - DNA, 22 bp, Homo sapiens
gccttcaggtgtccctgtgggc

SEQ ID NO: 7174021 - DNA, 22 bp, Homo sapiens
gccttcaggtgtccctgtgggc

SEQ ID NO: 7174022 - DNA, 22 bp, Homo sapiens
gccttcagtagtatcctcatga

SEQ ID NO: 7174023 - DNA, 22 bp, Homo sapiens
gccttcaggaaatcagtccttg

SEQ ID NO: 7174024 - DNA, 23 bp, Homo sapiens
gccttcagctcgggaaggctccc

SEQ ID NO: 7174025 - DNA, 22 bp, Homo sapiens
gccttcaggaaatcagtccttg

SEQ ID NO: 7174026 - DNA, 22 bp, Homo sapiens
gccttcaggtgctgccaggcta

SEQ ID NO: 7174027 - DNA, 22 bp, Homo sapiens
gcctggtgtccagaggcgagtg

SEQ ID NO: 7174028 - DNA, 22 bp, Homo sapiens
gcctggtgctatgagggccagc

SEQ ID NO: 7174029 - DNA, 22 bp, Homo sapiens
gcctggtggacactgggcatca

SEQ ID NO: 7174030 - DNA, 22 bp, Homo sapiens
gcctggtggacactgggcatca

SEQ ID NO: 7174031 - DNA, 22 bp, Homo sapiens
gcctggtgctatgagggccagc

SEQ ID NO: 7174032 - DNA, 22 bp, Homo sapiens
gcctggtggacactgggcatca

SEQ ID NO: 7174033 - DNA, 22 bp, Homo sapiens
gcctggtggtatcctggcaaga

SEQ ID NO: 7174034 - DNA, 22 bp, Homo sapiens
gcctggtggtatcctggcaaga

SEQ ID NO: 7174035 - DNA, 22 bp, Homo sapiens
gccttattacctgcactttgaa

SEQ ID NO: 7174036 - DNA, 22 bp, Homo sapiens
gccttagcctgcacttcctgtt

SEQ ID NO: 7174037 - DNA, 22 bp, Homo sapiens
gccttaggggtcagacagagct

SEQ ID NO: 7174038 - DNA, 18 bp, Homo sapiens
gccttcagactgcatgct

SEQ ID NO: 7174039 - DNA, 21 bp, Homo sapiens
gccttcactcccagagtttgt

SEQ ID NO: 7174040 - DNA, 22 bp, Homo sapiens
gccttcagagtaccatgtcctc

SEQ ID NO: 7174041 - DNA, 22 bp, Homo sapiens
gccttcagcggccgctcgctgc

SEQ ID NO: 7174042 - DNA, 22 bp, Homo sapiens
gcctggggaacttgatcctgtc

SEQ ID NO: 7174043 - DNA, 22 bp, Homo sapiens
gcctggggaacttgatcctgtc

SEQ ID NO: 7174044 - DNA, 22 bp, Homo sapiens
gcctggcttggggctcagtggt

SEQ ID NO: 7174045 - DNA, 22 bp, Homo sapiens
gcctggcttggggctcagtggt

SEQ ID NO: 7174046 - DNA, 22 bp, Homo sapiens
gcctggcttggggctcagtggt

SEQ ID NO: 7174047 - DNA, 22 bp, Homo sapiens
gcctggcttgccagccctggcg

SEQ ID NO: 7174048 - DNA, 22 bp, Homo sapiens
gcctggcttggggctcagtggt

SEQ ID NO: 7174049 - DNA, 22 bp, Homo sapiens
gcctggcttggggctcagtggt

SEQ ID NO: 7174050 - DNA, 22 bp, Homo sapiens
gcctggcttgccagccctggcg

SEQ ID NO: 7174051 - DNA, 22 bp, Homo sapiens
gcctggcttcccttggagcatt

SEQ ID NO: 7174052 - DNA, 18 bp, Homo sapiens
gcctggcttcggagccgc

SEQ ID NO: 7174053 - DNA, 18 bp, Homo sapiens
gcctggcttcggagccgc

SEQ ID NO: 7174054 - DNA, 22 bp, Homo sapiens
gcctggcttcccttggagcatt

SEQ ID NO: 7174055 - DNA, 22 bp, Homo sapiens
gcctggcttcccttggagcatt

SEQ ID NO: 7174056 - DNA, 23 bp, Homo sapiens
gcctggcttccaaggtaggggag

SEQ ID NO: 7174057 - DNA, 21 bp, Homo sapiens
gcctggcttcacaggcactga

SEQ ID NO: 7174058 - DNA, 22 bp, Homo sapiens
gcctggctggtcactgcctggc

SEQ ID NO: 7174059 - DNA, 22 bp, Homo sapiens
gcctggctggtcactgcctggc

SEQ ID NO: 7174060 - DNA, 22 bp, Homo sapiens
gcctggctggtagagggggctc

SEQ ID NO: 7174061 - DNA, 22 bp, Homo sapiens
gcctggctggtcactgcctggc

SEQ ID NO: 7174062 - DNA, 22 bp, Homo sapiens
gcctggctgtcaaacccagaag

SEQ ID NO: 7174063 - DNA, 22 bp, Homo sapiens
gcctggctgtcaaacccagaag

SEQ ID NO: 7174064 - DNA, 22 bp, Homo sapiens
gcctggctgtctggcaaggttc

SEQ ID NO: 7174065 - DNA, 22 bp, Homo sapiens
gcctggctgtctggcaaggttc

SEQ ID NO: 7174066 - DNA, 22 bp, Homo sapiens
gcctggctgtctggcaaggttc

SEQ ID NO: 7174067 - DNA, 22 bp, Homo sapiens
gcctggctgcttagcctacttc

SEQ ID NO: 7174068 - DNA, 19 bp, Homo sapiens
gcctggctgggatgagccc

SEQ ID NO: 7174069 - DNA, 19 bp, Homo sapiens
gcctggctgggatgagccc

SEQ ID NO: 7174070 - DNA, 19 bp, Homo sapiens
gcctggctgggatgagccc

SEQ ID NO: 7174071 - DNA, 22 bp, Homo sapiens
gcctggctgggcaccaggggag

SEQ ID NO: 7174072 - DNA, 22 bp, Homo sapiens
gcctggctgggcaccaggggag

SEQ ID NO: 7174073 - DNA, 22 bp, Homo sapiens
gcctggctgggcaccaggggag

SEQ ID NO: 7174074 - DNA, 22 bp, Homo sapiens
gcctggctgggctgaatgctta

SEQ ID NO: 7174075 - DNA, 22 bp, Homo sapiens
gcctggctgggctgaatgctta

SEQ ID NO: 7174076 - DNA, 22 bp, Homo sapiens
gcctggctggtagagggggctc

SEQ ID NO: 7174077 - DNA, 22 bp, Homo sapiens
gcctggctgctagccagaggca

SEQ ID NO: 7174078 - DNA, 22 bp, Homo sapiens
gcctggctgctagccagaggca

SEQ ID NO: 7174079 - DNA, 22 bp, Homo sapiens
gcctggctgctcagccactcac

SEQ ID NO: 7174080 - DNA, 22 bp, Homo sapiens
gcctggctgctcagccactcac

SEQ ID NO: 7174081 - DNA, 22 bp, Homo sapiens
gcctggctgctggttctgagga

SEQ ID NO: 7174082 - DNA, 22 bp, Homo sapiens
gcctggctgctggttctgagga

SEQ ID NO: 7174083 - DNA, 22 bp, Homo sapiens
gcctggctgctggttctgagga

SEQ ID NO: 7174084 - DNA, 22 bp, Homo sapiens
gcctggctgcttagcctacttc

SEQ ID NO: 7174085 - DNA, 22 bp, Homo sapiens
gcctggctagttagtgtcaggt

SEQ ID NO: 7174086 - DNA, 22 bp, Homo sapiens
gcctggctatggcctcccccat

SEQ ID NO: 7174087 - DNA, 21 bp, Homo sapiens
gcctggctagaagctcctagc

SEQ ID NO: 7174088 - DNA, 21 bp, Homo sapiens
gcctggctagaagctcctagc

SEQ ID NO: 7174089 - DNA, 21 bp, Homo sapiens
gcctggctagaagctcctagc

SEQ ID NO: 7174090 - DNA, 22 bp, Homo sapiens
gcctggctgaggtggggaggca

SEQ ID NO: 7174091 - DNA, 22 bp, Homo sapiens
gcctggctgccggccttggcaa

SEQ ID NO: 7174092 - DNA, 22 bp, Homo sapiens
gcctggctgccggccttggcaa

SEQ ID NO: 7174093 - DNA, 22 bp, Homo sapiens
gcctggctgccggccttggcaa

SEQ ID NO: 7174094 - DNA, 22 bp, Homo sapiens
gcctggctgccggccttggcaa

SEQ ID NO: 7174095 - DNA, 22 bp, Homo sapiens
gcctcagggataggatgagcat

SEQ ID NO: 7174096 - DNA, 22 bp, Homo sapiens
gcctcagggataggatgagcat

SEQ ID NO: 7174097 - DNA, 22 bp, Homo sapiens
gcctcagggataggatgagcat

SEQ ID NO: 7174098 - DNA, 22 bp, Homo sapiens
gcctcagggggagaggccagct

SEQ ID NO: 7174099 - DNA, 22 bp, Homo sapiens
gcctcagggataggatgagcat

SEQ ID NO: 7174100 - DNA, 22 bp, Homo sapiens
gcctcagggataggatgagcat

SEQ ID NO: 7174101 - DNA, 22 bp, Homo sapiens
gcctggctaagcagaaggaccc

SEQ ID NO: 7174102 - DNA, 22 bp, Homo sapiens
gcctggctaattttggtatttt

SEQ ID NO: 7174103 - DNA, 21 bp, Homo sapiens
gcctggctagaagctcctagc

SEQ ID NO: 7174104 - DNA, 22 bp, Homo sapiens
gcctcaggccgccctgctgctc

SEQ ID NO: 7174105 - DNA, 22 bp, Homo sapiens
gcctcaggccgccctgctgctc

SEQ ID NO: 7174106 - DNA, 22 bp, Homo sapiens
gcctcaggccgccctgctgctc

SEQ ID NO: 7174107 - DNA, 22 bp, Homo sapiens
gcctcaggcctatagctgctgt

SEQ ID NO: 7174108 - DNA, 22 bp, Homo sapiens
gcctcaggcctatagctgctgt

SEQ ID NO: 7174109 - DNA, 22 bp, Homo sapiens
gcctcaggccgccctgctgctc

SEQ ID NO: 7174110 - DNA, 22 bp, Homo sapiens
gcctcaggcctatagctgctgt

SEQ ID NO: 7174111 - DNA, 22 bp, Homo sapiens
gcctcaggcctatagctgctgt

SEQ ID NO: 7174112 - DNA, 22 bp, Homo sapiens
gcctcaggcctatagctgctgt

SEQ ID NO: 7174113 - DNA, 22 bp, Homo sapiens
gcctcagggataggatgagcat

SEQ ID NO: 7174114 - DNA, 22 bp, Homo sapiens
gcctcagggataggatgagcat

SEQ ID NO: 7174115 - DNA, 22 bp, Homo sapiens
gcctcagggataggatgagcat

SEQ ID NO: 7174116 - DNA, 22 bp, Homo sapiens
gcggggcccccggccgagctct

SEQ ID NO: 7174117 - DNA, 22 bp, Homo sapiens
gcggggcacagtgatggagcac

SEQ ID NO: 7174118 - DNA, 22 bp, Homo sapiens
gcggggccatgtccaacggcct

SEQ ID NO: 7174119 - DNA, 22 bp, Homo sapiens
gcggggcccggacccagcctct

SEQ ID NO: 7174120 - DNA, 22 bp, Homo sapiens
gcggggcctgactctgacccgc

SEQ ID NO: 7174121 - DNA, 22 bp, Homo sapiens
gcgggggcagactgggcagttc

SEQ ID NO: 7174122 - DNA, 22 bp, Homo sapiens
gcgggggcagactgggcagttc

SEQ ID NO: 7174123 - DNA, 22 bp, Homo sapiens
gcgggggcagactgggcagttc

SEQ ID NO: 7174124 - DNA, 22 bp, Homo sapiens
gcgggggcggcgcagacctcag

SEQ ID NO: 7174125 - DNA, 22 bp, Homo sapiens
gcgggggcggcgcagacctcag

SEQ ID NO: 7174126 - DNA, 22 bp, Homo sapiens
gcggggggaggaacatcttgca

SEQ ID NO: 7174127 - DNA, 22 bp, Homo sapiens
gcggggggaggaacatcttgca

SEQ ID NO: 7174128 - DNA, 22 bp, Homo sapiens
gctatacagcaggagaatggaa

SEQ ID NO: 7174129 - DNA, 22 bp, Homo sapiens
gctatagaaagtaatcactatc

SEQ ID NO: 7174130 - DNA, 22 bp, Homo sapiens
gctatattttgaaggagagcca

SEQ ID NO: 7174131 - DNA, 22 bp, Homo sapiens
gctatcatccttgtcagtgact

SEQ ID NO: 7174132 - DNA, 22 bp, Homo sapiens
gctatctaccacatcagccagg

SEQ ID NO: 7174133 - DNA, 22 bp, Homo sapiens
gctatctctttagtactagatt

SEQ ID NO: 7174134 - DNA, 22 bp, Homo sapiens
gctatgaaggagaggaaggttt

SEQ ID NO: 7174135 - DNA, 22 bp, Homo sapiens
gctatgaatatggatggtggtg

SEQ ID NO: 7174136 - DNA, 22 bp, Homo sapiens
gctcaagccttctgcccacctc

SEQ ID NO: 7174137 - DNA, 22 bp, Homo sapiens
gctcaagccttctgcccacctc

SEQ ID NO: 7174138 - DNA, 22 bp, Homo sapiens
gctcaagccttctgcccacctc

SEQ ID NO: 7174139 - DNA, 22 bp, Homo sapiens
gctcaaggcaggcagacatgag

SEQ ID NO: 7174140 - DNA, 22 bp, Homo sapiens
gctcaagggatgggagtgggtg

SEQ ID NO: 7174141 - DNA, 22 bp, Homo sapiens
gctcaaggcaggcagacatgag

SEQ ID NO: 7174142 - DNA, 22 bp, Homo sapiens
gctcaagggatgggagtgggtg

SEQ ID NO: 7174143 - DNA, 21 bp, Homo sapiens
gctcaagtttctctggcaaca

SEQ ID NO: 7174144 - DNA, 21 bp, Homo sapiens
gctcaagtttctctggcaaca

SEQ ID NO: 7174145 - DNA, 22 bp, Homo sapiens
gctcacagaacttctcttccca

SEQ ID NO: 7174146 - DNA, 22 bp, Homo sapiens
gctcaagagagatgcagttctt

SEQ ID NO: 7174147 - DNA, 22 bp, Homo sapiens
gctcaagagccagcgtctcctg

SEQ ID NO: 7174148 - DNA, 22 bp, Homo sapiens
gctcaagactgttagcctggca

SEQ ID NO: 7174149 - DNA, 22 bp, Homo sapiens
gctcaagactgttagcctggca

SEQ ID NO: 7174150 - DNA, 22 bp, Homo sapiens
gctcaagacccctctgtgactg

SEQ ID NO: 7174151 - DNA, 22 bp, Homo sapiens
gctcaagactgttagcctggca

SEQ ID NO: 7174152 - DNA, 22 bp, Homo sapiens
gctcaagactgttagcctggca

SEQ ID NO: 7174153 - DNA, 22 bp, Homo sapiens
gctcaagagccagcgtctcctg

SEQ ID NO: 7174154 - DNA, 20 bp, Homo sapiens
gctcaagagcccattctgaa

SEQ ID NO: 7174155 - DNA, 20 bp, Homo sapiens
gctcaagagcccattctgaa

SEQ ID NO: 7174156 - DNA, 22 bp, Homo sapiens
gctcaagatgtggcctctgaag

SEQ ID NO: 7174157 - DNA, 22 bp, Homo sapiens
gctcaagatgtggcctctgaag

SEQ ID NO: 7174158 - DNA, 22 bp, Homo sapiens
gctcaagatgtggcctctgaag

SEQ ID NO: 7174159 - DNA, 22 bp, Homo sapiens
gctcaagccttctgcccacctc

SEQ ID NO: 7174160 - DNA, 22 bp, Homo sapiens
gctcaagccttctgcccacctc

SEQ ID NO: 7174161 - DNA, 21 bp, Homo sapiens
gctatgaatgtagaaaattat

SEQ ID NO: 7174162 - DNA, 22 bp, Homo sapiens
gctcaaatttcagactcatgaa

SEQ ID NO: 7174163 - DNA, 22 bp, Homo sapiens
gctcaagaccaagggagcgggg

SEQ ID NO: 7174164 - DNA, 22 bp, Homo sapiens
gctcaagaccagacaaagcctg

SEQ ID NO: 7174165 - DNA, 22 bp, Homo sapiens
gctcaagacccctctgtgactg

SEQ ID NO: 7174166 - DNA, 22 bp, Homo sapiens
gctcacagccggctggcagggg

SEQ ID NO: 7174167 - DNA, 22 bp, Homo sapiens
gctcacagccggctggcagggg

SEQ ID NO: 7174168 - DNA, 22 bp, Homo sapiens
gctcacagcccaggccagcgtg

SEQ ID NO: 7174169 - DNA, 22 bp, Homo sapiens
gctcacagcccaggccagcgtg

SEQ ID NO: 7174170 - DNA, 22 bp, Homo sapiens
gctcacagcccaggccagcgtg

SEQ ID NO: 7174171 - DNA, 22 bp, Homo sapiens
gctcacagccggctggcagggg

SEQ ID NO: 7174172 - DNA, 22 bp, Homo sapiens
gctcacagccggctggcagggg

SEQ ID NO: 7174173 - DNA, 22 bp, Homo sapiens
gctcacaggggcagacgagttg

SEQ ID NO: 7174174 - DNA, 22 bp, Homo sapiens
gctcacaggggcagacgagttg

SEQ ID NO: 7174175 - DNA, 22 bp, Homo sapiens
gctcacaggtctgtggctattg

SEQ ID NO: 7174176 - DNA, 23 bp, Homo sapiens
gctcacagggtgtaactcctagt

SEQ ID NO: 7174177 - DNA, 22 bp, Homo sapiens
gctcacaggtctgtggctattg

SEQ ID NO: 7174178 - DNA, 22 bp, Homo sapiens
gctcacaggtctgtggctattg

SEQ ID NO: 7174179 - DNA, 22 bp, Homo sapiens
gctcacagtacagtgctggctc

SEQ ID NO: 7174180 - DNA, 22 bp, Homo sapiens
gctcacagtacagtgctggctc

SEQ ID NO: 7174181 - DNA, 22 bp, Homo sapiens
gctcacagtacagtgctggctc

SEQ ID NO: 7174182 - DNA, 22 bp, Homo sapiens
gctcacagtctgctgagtgcag

SEQ ID NO: 7174183 - DNA, 22 bp, Homo sapiens
gctcacagtctggcatagtctc

SEQ ID NO: 7174184 - DNA, 22 bp, Homo sapiens
gctcaccaagcagagactctgg

SEQ ID NO: 7174185 - DNA, 22 bp, Homo sapiens
gctcacagttctatttttcatg

SEQ ID NO: 7174186 - DNA, 22 bp, Homo sapiens
gctcacagttctatttttcatg

SEQ ID NO: 7174187 - DNA, 22 bp, Homo sapiens
gctcactgcaacctccacctcc

SEQ ID NO: 7174188 - DNA, 22 bp, Homo sapiens
gctcactaaataacaggaagaa

SEQ ID NO: 7174189 - DNA, 21 bp, Homo sapiens
gctcagctgcttggttcctgt

SEQ ID NO: 7174190 - DNA, 22 bp, Homo sapiens
gctcagctggaccatcgtgttt

SEQ ID NO: 7174191 - DNA, 22 bp, Homo sapiens
gctcagctggagagggacgggt

SEQ ID NO: 7174192 - DNA, 22 bp, Homo sapiens
gctcagctgggaccaatgtgtt

SEQ ID NO: 7174193 - DNA, 22 bp, Homo sapiens
gctcagcttgggagcgcccggt

SEQ ID NO: 7174194 - DNA, 23 bp, Homo sapiens
gctcaggcatcattcttcctggc

SEQ ID NO: 7174195 - DNA, 22 bp, Homo sapiens
gctcaggcatgtatgtggttgc

SEQ ID NO: 7174196 - DNA, 22 bp, Homo sapiens
gctcaggcccagcggctggtgt

SEQ ID NO: 7174197 - DNA, 22 bp, Homo sapiens
gctcaggcccagcggctggtgt

SEQ ID NO: 7174198 - DNA, 22 bp, Homo sapiens
gctcaggcccagcggctggtgt

SEQ ID NO: 7174199 - DNA, 18 bp, Homo sapiens
gctcaggccctagtcagt

SEQ ID NO: 7174200 - DNA, 18 bp, Homo sapiens
gctcaggccctagtcagt

SEQ ID NO: 7174201 - DNA, 22 bp, Homo sapiens
gctcaggcccagcggctggtgt

SEQ ID NO: 7174202 - DNA, 22 bp, Homo sapiens
gcgctctgtctcaggggtccag

SEQ ID NO: 7174203 - DNA, 22 bp, Homo sapiens
gcgctcctcccggccctggtgg

SEQ ID NO: 7174204 - DNA, 22 bp, Homo sapiens
gcgctgcctctgctctccccac

SEQ ID NO: 7174205 - DNA, 22 bp, Homo sapiens
gcgctcaggtgccaggcctgcg

SEQ ID NO: 7174206 - DNA, 22 bp, Homo sapiens
gcgctcagaaaagattttcttc

SEQ ID NO: 7174207 - DNA, 22 bp, Homo sapiens
gcgcggggtacacgcggtggcc

SEQ ID NO: 7174208 - DNA, 22 bp, Homo sapiens
gcgcggggtacacgcggtggcc

SEQ ID NO: 7174209 - DNA, 22 bp, Homo sapiens
gcgctaggcaagtcctttcaac

SEQ ID NO: 7174210 - DNA, 22 bp, Homo sapiens
gcggagggcgagcccgcggagc

SEQ ID NO: 7174211 - DNA, 22 bp, Homo sapiens
gcggaggtgaggaagtggggca

SEQ ID NO: 7174212 - DNA, 22 bp, Homo sapiens
gcggcagaggtgttgcgagcga

SEQ ID NO: 7174213 - DNA, 22 bp, Homo sapiens
gcggcaggaagagcgcagcccc

SEQ ID NO: 7174214 - DNA, 22 bp, Homo sapiens
gcggcaggagtaaaggaggaag

SEQ ID NO: 7174215 - DNA, 22 bp, Homo sapiens
gcggcaggagtaaaggaggaag

SEQ ID NO: 7174216 - DNA, 22 bp, Homo sapiens
gcggaaggctgcctggcttgag

SEQ ID NO: 7174217 - DNA, 23 bp, Homo sapiens
gcggaaggggtcataatggagac

SEQ ID NO: 7174218 - DNA, 22 bp, Homo sapiens
gcggagaggcagagactccgcg

SEQ ID NO: 7174219 - DNA, 22 bp, Homo sapiens
gcggaggaaactgaggcaagag

SEQ ID NO: 7174220 - DNA, 22 bp, Homo sapiens
gcggaggaaactgaggcaagag

SEQ ID NO: 7174221 - DNA, 22 bp, Homo sapiens
gcggaggacaggaatgcgggcg

SEQ ID NO: 7174222 - DNA, 22 bp, Homo sapiens
gcggagggagataggccttgct

SEQ ID NO: 7174223 - DNA, 22 bp, Homo sapiens
gcggggcacagtgatggagcac

SEQ ID NO: 7174224 - DNA, 22 bp, Homo sapiens
gcggggcacagtgatggagcac

SEQ ID NO: 7174225 - DNA, 18 bp, Homo sapiens
gcgggcggtgcagtgggc

SEQ ID NO: 7174226 - DNA, 22 bp, Homo sapiens
gcgggcgggggttcccaggtct

SEQ ID NO: 7174227 - DNA, 18 bp, Homo sapiens
gcgggcggtgcagtgggc

SEQ ID NO: 7174228 - DNA, 22 bp, Homo sapiens
gcgggccaccttggagagcgct

SEQ ID NO: 7174229 - DNA, 22 bp, Homo sapiens
gcgggccaccttggagagcgct

SEQ ID NO: 7174230 - DNA, 22 bp, Homo sapiens
gcgggccaccttggagagcgct

SEQ ID NO: 7174231 - DNA, 22 bp, Homo sapiens
gcgggaagaacgaccaggctcg

SEQ ID NO: 7174232 - DNA, 22 bp, Homo sapiens
gcgggccaccttggagagcgct

SEQ ID NO: 7174233 - DNA, 22 bp, Homo sapiens
gcgggccggttcgatccgtatg

SEQ ID NO: 7174234 - DNA, 22 bp, Homo sapiens
gcggcggagacagcaggaagcc

SEQ ID NO: 7174235 - DNA, 22 bp, Homo sapiens
gcggcggagacagcaggaagcc

SEQ ID NO: 7174236 - DNA, 22 bp, Homo sapiens
gcggcgcctaagccccgacctc

SEQ ID NO: 7174237 - DNA, 22 bp, Homo sapiens
gcggcggagacagcaggaagcc

SEQ ID NO: 7174238 - DNA, 22 bp, Homo sapiens
gcgggcagggcactggtcccct

SEQ ID NO: 7174239 - DNA, 22 bp, Homo sapiens
gcggcaggagtaaaggaggaag

SEQ ID NO: 7174240 - DNA, 22 bp, Homo sapiens
gcggcccgagcaggacgggtgg

SEQ ID NO: 7174241 - DNA, 22 bp, Homo sapiens
gcggcccgagcaggacgggtgg

SEQ ID NO: 7174242 - DNA, 22 bp, Homo sapiens
gcggcccgagcaggacgggtgg

SEQ ID NO: 7174243 - DNA, 22 bp, Homo sapiens
gcggcccgagcaggacgggtgg

SEQ ID NO: 7174244 - DNA, 22 bp, Homo sapiens
gcggcccgggtccccagcagca

SEQ ID NO: 7174245 - DNA, 22 bp, Homo sapiens
gccttctgtccaaccccacgat

SEQ ID NO: 7174246 - DNA, 22 bp, Homo sapiens
gccttctgtgctcctggccttt

SEQ ID NO: 7174247 - DNA, 22 bp, Homo sapiens
gccttgaactcatgtatattga

SEQ ID NO: 7174248 - DNA, 19 bp, Homo sapiens
gccttgaagcaactcttgt

SEQ ID NO: 7174249 - DNA, 15 bp, Homo sapiens
gccttgaatgtgaat

SEQ ID NO: 7174250 - DNA, 22 bp, Homo sapiens
gccttctgattgctggactgac

SEQ ID NO: 7174251 - DNA, 22 bp, Homo sapiens
gccttctgatatctcttggcat

SEQ ID NO: 7174252 - DNA, 22 bp, Homo sapiens
gccttctgatatctcttggcat

SEQ ID NO: 7174253 - DNA, 22 bp, Homo sapiens
gccttctgatcgctggactgac

SEQ ID NO: 7174254 - DNA, 22 bp, Homo sapiens
gccttctctgtgagctcctagg

SEQ ID NO: 7174255 - DNA, 22 bp, Homo sapiens
gccttctctgtgagctcctagg

SEQ ID NO: 7174256 - DNA, 17 bp, Homo sapiens
gccttctctgccctcac

SEQ ID NO: 7174257 - DNA, 22 bp, Homo sapiens
gcgcgctgagtgtccgttgggg

SEQ ID NO: 7174258 - DNA, 22 bp, Homo sapiens
gcgcctgccaccatgccaggct

SEQ ID NO: 7174259 - DNA, 22 bp, Homo sapiens
gcgcctggcacacagcaagggc

SEQ ID NO: 7174260 - DNA, 16 bp, Homo sapiens
gcgcctcctcggcctc

SEQ ID NO: 7174261 - DNA, 22 bp, Homo sapiens
gccttgccaaggggcagcagag

SEQ ID NO: 7174262 - DNA, 21 bp, Homo sapiens
gccttgccacatgtgccacag

SEQ ID NO: 7174263 - DNA, 22 bp, Homo sapiens
gccttttgatctataactgtgt

SEQ ID NO: 7174264 - DNA, 22 bp, Homo sapiens
gccttgagaagtcctgcagtga

SEQ ID NO: 7174265 - DNA, 22 bp, Homo sapiens
gccttgagaagtcctgcagtga

SEQ ID NO: 7174266 - DNA, 22 bp, Homo sapiens
gccttgagctgcacggccaggt

SEQ ID NO: 7174267 - DNA, 22 bp, Homo sapiens
gccttgcaggaaggagggacag

SEQ ID NO: 7174268 - DNA, 22 bp, Homo sapiens
gcgaccagggaagcttcttcat

SEQ ID NO: 7174269 - DNA, 22 bp, Homo sapiens
gcgacgcaggcacgacgtgttg

SEQ ID NO: 7174270 - DNA, 22 bp, Homo sapiens
gccttttttgttgctctgtcac

SEQ ID NO: 7174271 - DNA, 22 bp, Homo sapiens
gccttttttaaactccaagtct

SEQ ID NO: 7174272 - DNA, 22 bp, Homo sapiens
gctgatgtcccactgacagcca

SEQ ID NO: 7174273 - DNA, 22 bp, Homo sapiens
gctgatgtgatgtcagaagagg

SEQ ID NO: 7174274 - DNA, 22 bp, Homo sapiens
gctgatgggagctggctcaccc

SEQ ID NO: 7174275 - DNA, 22 bp, Homo sapiens
gctgatgggagctggctcaccc

SEQ ID NO: 7174276 - DNA, 22 bp, Homo sapiens
gctgatggaaggacaggcgccg

SEQ ID NO: 7174277 - DNA, 22 bp, Homo sapiens
gctgatggaaggacaggcgccg

SEQ ID NO: 7174278 - DNA, 22 bp, Homo sapiens
gctgatggaattgtaaaatagt

SEQ ID NO: 7174279 - DNA, 23 bp, Homo sapiens
gctgatggagacttgtggcctcc

SEQ ID NO: 7174280 - DNA, 23 bp, Homo sapiens
gctgatggagacttgtggcctcc

SEQ ID NO: 7174281 - DNA, 22 bp, Homo sapiens
gctgaataatgtgtaatgtctc

SEQ ID NO: 7174282 - DNA, 22 bp, Homo sapiens
gctgaataattctttgttgtgg

SEQ ID NO: 7174283 - DNA, 22 bp, Homo sapiens
gctgaatacagcatgccttatg

SEQ ID NO: 7174284 - DNA, 22 bp, Homo sapiens
gctgaatagaagtcttcaaagg

SEQ ID NO: 7174285 - DNA, 22 bp, Homo sapiens
gctgaataggactgtcatctct

SEQ ID NO: 7174286 - DNA, 22 bp, Homo sapiens
gctgaataggcacagagggcat

SEQ ID NO: 7174287 - DNA, 22 bp, Homo sapiens
gctgatcacatttccaaaaccc

SEQ ID NO: 7174288 - DNA, 22 bp, Homo sapiens
gctgatctcccttttctcacag

SEQ ID NO: 7174289 - DNA, 22 bp, Homo sapiens
gctgcagaatttccttctcatt

SEQ ID NO: 7174290 - DNA, 22 bp, Homo sapiens
gctgcacttgagcctgggagaa

SEQ ID NO: 7174291 - DNA, 22 bp, Homo sapiens
gctgcaccagctccaccagggc

SEQ ID NO: 7174292 - DNA, 22 bp, Homo sapiens
gctgcaatggagtcaggctggt

SEQ ID NO: 7174293 - DNA, 22 bp, Homo sapiens
gctgattaacttcattgtagtt

SEQ ID NO: 7174294 - DNA, 22 bp, Homo sapiens
gctgattattacatgtctgtgg

SEQ ID NO: 7174295 - DNA, 22 bp, Homo sapiens
gctgattttgagaagcacagtc

SEQ ID NO: 7174296 - DNA, 22 bp, Homo sapiens
gctgattttgtcacatagcaag

SEQ ID NO: 7174297 - DNA, 22 bp, Homo sapiens
gctgcaaacctgccacctggtg

SEQ ID NO: 7174298 - DNA, 22 bp, Homo sapiens
gctgcaaacctgccacctggtg

SEQ ID NO: 7174299 - DNA, 21 bp, Homo sapiens
gctgcaaattctaacaattat

SEQ ID NO: 7174300 - DNA, 21 bp, Homo sapiens
gctgcaaattctaacaattat

SEQ ID NO: 7174301 - DNA, 22 bp, Homo sapiens
gctgaagtggcgtgatcagaat

SEQ ID NO: 7174302 - DNA, 22 bp, Homo sapiens
gctgaagtgcttttgaatttgg

SEQ ID NO: 7174303 - DNA, 22 bp, Homo sapiens
gctgaagtgtggagtgacagtt

SEQ ID NO: 7174304 - DNA, 22 bp, Homo sapiens
gctgaagtcctaatcccaagta

SEQ ID NO: 7174305 - DNA, 22 bp, Homo sapiens
gctgaagtctgagaatttgcaa

SEQ ID NO: 7174306 - DNA, 16 bp, Homo sapiens
gctgaagtgagtatag

SEQ ID NO: 7174307 - DNA, 22 bp, Homo sapiens
gctgaagttgaatattctggga

SEQ ID NO: 7174308 - DNA, 22 bp, Homo sapiens
gctgaagttgcctattttaata

SEQ ID NO: 7174309 - DNA, 22 bp, Homo sapiens
gctgaagttgcctattttaata

SEQ ID NO: 7174310 - DNA, 22 bp, Homo sapiens
gctgaagtttatgtcttctttt

SEQ ID NO: 7174311 - DNA, 22 bp, Homo sapiens
gctgaagttttgcagagagtaa

SEQ ID NO: 7174312 - DNA, 22 bp, Homo sapiens
gctgaataagagtctactttgc

SEQ ID NO: 7174313 - DNA, 22 bp, Homo sapiens
gctgaagttttgcagagagtaa

SEQ ID NO: 7174314 - DNA, 22 bp, Homo sapiens
gctgaataatgtgtaatgtctc

SEQ ID NO: 7174315 - DNA, 22 bp, Homo sapiens
gctgaataatgtgtaatgtctc

SEQ ID NO: 7174316 - DNA, 22 bp, Homo sapiens
gctgaaggtctctggagaggtc

SEQ ID NO: 7174317 - DNA, 22 bp, Homo sapiens
gctgaaggtatgagttttatct

SEQ ID NO: 7174318 - DNA, 22 bp, Homo sapiens
gctgaaggtatgagttttatct

SEQ ID NO: 7174319 - DNA, 22 bp, Homo sapiens
gctgaaggtctctggagaggtc

SEQ ID NO: 7174320 - DNA, 20 bp, Homo sapiens
gctgaaggggtgggtttgtt

SEQ ID NO: 7174321 - DNA, 22 bp, Homo sapiens
gctgaaggtatgagttttatct

SEQ ID NO: 7174322 - DNA, 22 bp, Homo sapiens
gctgaaggtctctggagaggtc

SEQ ID NO: 7174323 - DNA, 21 bp, Homo sapiens
gctgaaggtgggttgtacagg

SEQ ID NO: 7174324 - DNA, 22 bp, Homo sapiens
gctgaaggtggttttcaagtat

SEQ ID NO: 7174325 - DNA, 22 bp, Homo sapiens
gctgaaggtgtgtggagagagg

SEQ ID NO: 7174326 - DNA, 22 bp, Homo sapiens
gctgaaggtgtgtggagagagg

SEQ ID NO: 7174327 - DNA, 22 bp, Homo sapiens
gctgaaggtgtgtggagagagg

SEQ ID NO: 7174328 - DNA, 22 bp, Homo sapiens
gctgaagtaactcacatcgtta

SEQ ID NO: 7174329 - DNA, 22 bp, Homo sapiens
gctgaaggcccggaggacaggg

SEQ ID NO: 7174330 - DNA, 22 bp, Homo sapiens
gctgaaggcccggaggacaggg

SEQ ID NO: 7174331 - DNA, 19 bp, Homo sapiens
gctgaaggaggtgcctgca

SEQ ID NO: 7174332 - DNA, 22 bp, Homo sapiens
gctgaaggcccggaggacaggg

SEQ ID NO: 7174333 - DNA, 22 bp, Homo sapiens
gctgaaggcccggaggacaggg

SEQ ID NO: 7174334 - DNA, 19 bp, Homo sapiens
gctgaaggcgctcagaagc

SEQ ID NO: 7174335 - DNA, 22 bp, Homo sapiens
gctgaagggagtgctgagtctg

SEQ ID NO: 7174336 - DNA, 22 bp, Homo sapiens
gctgaagggagtgctgagtctg

SEQ ID NO: 7174337 - DNA, 22 bp, Homo sapiens
gctgaaggagcctggggtggga

SEQ ID NO: 7174338 - DNA, 22 bp, Homo sapiens
gctgaaggaggctctggtacta

SEQ ID NO: 7174339 - DNA, 19 bp, Homo sapiens
gctgaaggaggtgcctgca

SEQ ID NO: 7174340 - DNA, 19 bp, Homo sapiens
gctgaaggaggtgcctgca

SEQ ID NO: 7174341 - DNA, 20 bp, Homo sapiens
gctgaagattcccatgcaag

SEQ ID NO: 7174342 - DNA, 20 bp, Homo sapiens
gctgaagattcccatgcaag

SEQ ID NO: 7174343 - DNA, 22 bp, Homo sapiens
gctgaagatgcatcccttctct

SEQ ID NO: 7174344 - DNA, 22 bp, Homo sapiens
gctgaagataagtgaagaggct

SEQ ID NO: 7174345 - DNA, 22 bp, Homo sapiens
gctgaagataggcatttcagca

SEQ ID NO: 7174346 - DNA, 22 bp, Homo sapiens
gctgaagctaacggctatgtct

SEQ ID NO: 7174347 - DNA, 22 bp, Homo sapiens
gctgaagcccacgtggcttgta

SEQ ID NO: 7174348 - DNA, 22 bp, Homo sapiens
gctgaagcccacgtggcttgta

SEQ ID NO: 7174349 - DNA, 22 bp, Homo sapiens
gctgaagctgcagcaggaggaa

SEQ ID NO: 7174350 - DNA, 22 bp, Homo sapiens
gctgaagatttttgctagcccc

SEQ ID NO: 7174351 - DNA, 22 bp, Homo sapiens
gctgcaggagctggagctgtgg

SEQ ID NO: 7174352 - DNA, 22 bp, Homo sapiens
gctgcaggagattttgagagtc

SEQ ID NO: 7174353 - DNA, 22 bp, Homo sapiens
gctgcaggagattttgagagtc

SEQ ID NO: 7174354 - DNA, 22 bp, Homo sapiens
gctgcaggagattttgagagtc

SEQ ID NO: 7174355 - DNA, 22 bp, Homo sapiens
gctgcaggagctggagctgtgg

SEQ ID NO: 7174356 - DNA, 22 bp, Homo sapiens
gctgcaggagctggagctgtgg

SEQ ID NO: 7174357 - DNA, 23 bp, Homo sapiens
gctgcagctgtggatgttctcag

SEQ ID NO: 7174358 - DNA, 22 bp, Homo sapiens
gctgcagctttaggatccagtg

SEQ ID NO: 7174359 - DNA, 23 bp, Homo sapiens
gctgcagctgtggatgttctcag

SEQ ID NO: 7174360 - DNA, 22 bp, Homo sapiens
gctgcagactgggaggcaggtg

SEQ ID NO: 7174361 - DNA, 22 bp, Homo sapiens
gctgcagaatttccttctcatt

SEQ ID NO: 7174362 - DNA, 22 bp, Homo sapiens
gctgcagacctcatgcaggtgg

SEQ ID NO: 7174363 - DNA, 22 bp, Homo sapiens
gctgcagactgggaggcaggtg

SEQ ID NO: 7174364 - DNA, 22 bp, Homo sapiens
gctgccacttggtcatgtcatg

SEQ ID NO: 7174365 - DNA, 22 bp, Homo sapiens
gctgccacttggtcatgtcatg

SEQ ID NO: 7174366 - DNA, 22 bp, Homo sapiens
gctgccacttggtcatgtcatg

SEQ ID NO: 7174367 - DNA, 22 bp, Homo sapiens
gctgcaggtttgtctagtctgg

SEQ ID NO: 7174368 - DNA, 22 bp, Homo sapiens
gctgcaggtttgtctagtctgg

SEQ ID NO: 7174369 - DNA, 22 bp, Homo sapiens
gctgccacgatctctgctgtag

SEQ ID NO: 7174370 - DNA, 22 bp, Homo sapiens
gctgccactctgagcttgcttc

SEQ ID NO: 7174371 - DNA, 22 bp, Homo sapiens
gctgccagcacagttcagctgt

SEQ ID NO: 7174372 - DNA, 22 bp, Homo sapiens
gctgccagaatgggaaatctga

SEQ ID NO: 7174373 - DNA, 22 bp, Homo sapiens
gctgcaggttgggcaacagagt

SEQ ID NO: 7174374 - DNA, 22 bp, Homo sapiens
gctgcaggttgggcaacagagt

SEQ ID NO: 7174375 - DNA, 22 bp, Homo sapiens
gctgcaggttgggcaacagagt

SEQ ID NO: 7174376 - DNA, 22 bp, Homo sapiens
gctgcagggggtgggcgtctcc

SEQ ID NO: 7174377 - DNA, 22 bp, Homo sapiens
gctgcagggggtgggcgtctcc

SEQ ID NO: 7174378 - DNA, 22 bp, Homo sapiens
gctgcagggggtgggcgtctcc

SEQ ID NO: 7174379 - DNA, 22 bp, Homo sapiens
gctgcaggttgggcaacagagt

SEQ ID NO: 7174380 - DNA, 22 bp, Homo sapiens
gctgcaggagctggagctgtgg

SEQ ID NO: 7174381 - DNA, 22 bp, Homo sapiens
gctgcaggatgaggctctgctc

SEQ ID NO: 7174382 - DNA, 22 bp, Homo sapiens
gctgcaggatgaggctctgctc

SEQ ID NO: 7174383 - DNA, 22 bp, Homo sapiens
gctgccagctttccttggctga

SEQ ID NO: 7174384 - DNA, 22 bp, Homo sapiens
gctgccagctttccttggctga

SEQ ID NO: 7174385 - DNA, 22 bp, Homo sapiens
gctgccaggacggagaggagcg

SEQ ID NO: 7174386 - DNA, 22 bp, Homo sapiens
gctgccaggacggagaggagcg

SEQ ID NO: 7174387 - DNA, 22 bp, Homo sapiens
gctgccagggaggtggtggagg

SEQ ID NO: 7174388 - DNA, 22 bp, Homo sapiens
gctgccagcgtcagacctgggg

SEQ ID NO: 7174389 - DNA, 22 bp, Homo sapiens
gctgccagcgtcagacctgggg

SEQ ID NO: 7174390 - DNA, 22 bp, Homo sapiens
gctgccagctgcggcccacgcg

SEQ ID NO: 7174391 - DNA, 22 bp, Homo sapiens
gctgccagctgcggcccacgcg

SEQ ID NO: 7174392 - DNA, 22 bp, Homo sapiens
gctgccagctgcggcccacgcg

SEQ ID NO: 7174393 - DNA, 22 bp, Homo sapiens
gctgccagcccagcaaggtgtg

SEQ ID NO: 7174394 - DNA, 22 bp, Homo sapiens
gctgccagccctcggggtctga

SEQ ID NO: 7174395 - DNA, 22 bp, Homo sapiens
gctgccagcgtcagacctgggg

SEQ ID NO: 7174396 - DNA, 22 bp, Homo sapiens
gctgccagtagttggagctcca

SEQ ID NO: 7174397 - DNA, 22 bp, Homo sapiens
gctgccagtagttggagctcca

SEQ ID NO: 7174398 - DNA, 22 bp, Homo sapiens
gctgccagtagttggagctcca

SEQ ID NO: 7174399 - DNA, 20 bp, Homo sapiens
gctgccagggcggagacatc

SEQ ID NO: 7174400 - DNA, 20 bp, Homo sapiens
gctgccagggcggagacatc

SEQ ID NO: 7174401 - DNA, 20 bp, Homo sapiens
gctgccagggcggagacatc

SEQ ID NO: 7174402 - DNA, 22 bp, Homo sapiens
gctgccaggggcagctgtctca

SEQ ID NO: 7174403 - DNA, 22 bp, Homo sapiens
gctgccaggggcagctgtctca

SEQ ID NO: 7174404 - DNA, 20 bp, Homo sapiens
gctgccagtgcctgatgctt

SEQ ID NO: 7174405 - DNA, 20 bp, Homo sapiens
gctgccagtgcctgatgctt

SEQ ID NO: 7174406 - DNA, 22 bp, Homo sapiens
gctgccagtgtggcatgatgca

SEQ ID NO: 7174407 - DNA, 22 bp, Homo sapiens
gctgccagtgtggcatgatgca

SEQ ID NO: 7174408 - DNA, 22 bp, Homo sapiens
gctgccagttccttcttactcc

SEQ ID NO: 7174409 - DNA, 21 bp, Homo sapiens
gctctccagggccagcccagg

SEQ ID NO: 7174410 - DNA, 22 bp, Homo sapiens
gctctccagattcaggagggat

SEQ ID NO: 7174411 - DNA, 22 bp, Homo sapiens
gctctccagctacccctttagc

SEQ ID NO: 7174412 - DNA, 21 bp, Homo sapiens
gctctccagggccagcccagg

SEQ ID NO: 7174413 - DNA, 22 bp, Homo sapiens
gctctccaaaccctgtggcttt

SEQ ID NO: 7174414 - DNA, 22 bp, Homo sapiens
gctctccactgaccacggggca

SEQ ID NO: 7174415 - DNA, 22 bp, Homo sapiens
gctctccaaaccctgtggcttt

SEQ ID NO: 7174416 - DNA, 22 bp, Homo sapiens
gctctcaggtacaaagctgtgt

SEQ ID NO: 7174417 - DNA, 22 bp, Homo sapiens
gctctgcccaggaccgtccttg

SEQ ID NO: 7174418 - DNA, 18 bp, Homo sapiens
gctctgcccaggctgccc

SEQ ID NO: 7174419 - DNA, 18 bp, Homo sapiens
gctctgcccaggctgccc

SEQ ID NO: 7174420 - DNA, 18 bp, Homo sapiens
gctctgcccaggctgccc

SEQ ID NO: 7174421 - DNA, 18 bp, Homo sapiens
gctctgcccaggctgccc

SEQ ID NO: 7174422 - DNA, 22 bp, Homo sapiens
gctctgcccagtgccctgagac

SEQ ID NO: 7174423 - DNA, 22 bp, Homo sapiens
gctctgcccagtgccctgagac

SEQ ID NO: 7174424 - DNA, 17 bp, Homo sapiens
gctctgccccagcctct

SEQ ID NO: 7174425 - DNA, 17 bp, Homo sapiens
gctctgccccagcctct

SEQ ID NO: 7174426 - DNA, 17 bp, Homo sapiens
gctctgcctctcccacc

SEQ ID NO: 7174427 - DNA, 22 bp, Homo sapiens
gctctgccctgggccgttgtaa

SEQ ID NO: 7174428 - DNA, 17 bp, Homo sapiens
gctctgccccagcctct

SEQ ID NO: 7174429 - DNA, 22 bp, Homo sapiens
gctctgccccaggaactcagcc

SEQ ID NO: 7174430 - DNA, 22 bp, Homo sapiens
gctctgccccaggaactcagcc

SEQ ID NO: 7174431 - DNA, 17 bp, Homo sapiens
gctctgcctctcccacc

SEQ ID NO: 7174432 - DNA, 17 bp, Homo sapiens
gctctgcctctcccacc

SEQ ID NO: 7174433 - DNA, 22 bp, Homo sapiens
gctctgcctctttgctgcgtca

SEQ ID NO: 7174434 - DNA, 22 bp, Homo sapiens
gctctgcctctttgctgcgtca

SEQ ID NO: 7174435 - DNA, 22 bp, Homo sapiens
gctctgcctctttgctgcgtca

SEQ ID NO: 7174436 - DNA, 22 bp, Homo sapiens
gctctgcctggtcgcgtgctgg

SEQ ID NO: 7174437 - DNA, 22 bp, Homo sapiens
gctctgcctggtcgcgtgctgg

SEQ ID NO: 7174438 - DNA, 22 bp, Homo sapiens
gctctgcctggtcgcgtgctgg

SEQ ID NO: 7174439 - DNA, 22 bp, Homo sapiens
gctctgcctggtcgcgtgctgg

SEQ ID NO: 7174440 - DNA, 22 bp, Homo sapiens
gctctgccttctcactgggttc

SEQ ID NO: 7174441 - DNA, 22 bp, Homo sapiens
gctctgcgattattgggccttt

SEQ ID NO: 7174442 - DNA, 22 bp, Homo sapiens
gctctgctaatattgtagtacc

SEQ ID NO: 7174443 - DNA, 23 bp, Homo sapiens
gctctgctctgtttcatagacag

SEQ ID NO: 7174444 - DNA, 23 bp, Homo sapiens
gctctgctctgtttcatagacag

SEQ ID NO: 7174445 - DNA, 22 bp, Homo sapiens
gctctggcagctgatattagga

SEQ ID NO: 7174446 - DNA, 23 bp, Homo sapiens
gctctggcagcttgtgtcagcac

SEQ ID NO: 7174447 - DNA, 22 bp, Homo sapiens
gctctggccagaccctcagtgg

SEQ ID NO: 7174448 - DNA, 22 bp, Homo sapiens
gctctgctggaagttctctgga

SEQ ID NO: 7174449 - DNA, 17 bp, Homo sapiens
gctctggcacaggattg

SEQ ID NO: 7174450 - DNA, 22 bp, Homo sapiens
gctctggcactggcgcgggatg

SEQ ID NO: 7174451 - DNA, 22 bp, Homo sapiens
gctctgctgacagctgggacag

SEQ ID NO: 7174452 - DNA, 22 bp, Homo sapiens
gctctgctgacagctgggacag

SEQ ID NO: 7174453 - DNA, 22 bp, Homo sapiens
gctctgctgacagctgggacag

SEQ ID NO: 7174454 - DNA, 22 bp, Homo sapiens
gctctgctgagatatctgggag

SEQ ID NO: 7174455 - DNA, 22 bp, Homo sapiens
gctctggctactccaccctgtt

SEQ ID NO: 7174456 - DNA, 21 bp, Homo sapiens
gctctggcctactgttccctc

SEQ ID NO: 7174457 - DNA, 22 bp, Homo sapiens
gctctggctactccaccctgtt

SEQ ID NO: 7174458 - DNA, 22 bp, Homo sapiens
gctctggctactccaccctgtt

SEQ ID NO: 7174459 - DNA, 22 bp, Homo sapiens
gctctggcccaaaccctttcta

SEQ ID NO: 7174460 - DNA, 22 bp, Homo sapiens
gctctggccagaccctcagtgg

SEQ ID NO: 7174461 - DNA, 22 bp, Homo sapiens
gctctggctactgtggctaccg

SEQ ID NO: 7174462 - DNA, 22 bp, Homo sapiens
gctgaagacctccctctccatg

SEQ ID NO: 7174463 - DNA, 22 bp, Homo sapiens
gctgaagagacttctgttcgaa

SEQ ID NO: 7174464 - DNA, 22 bp, Homo sapiens
gctctggctactgtggctaccg

SEQ ID NO: 7174465 - DNA, 22 bp, Homo sapiens
gctgaagataagtgaagaggct

SEQ ID NO: 7174466 - DNA, 22 bp, Homo sapiens
gctgaagagcaaggctgggtct

SEQ ID NO: 7174467 - DNA, 22 bp, Homo sapiens
gctgaagagcaaggctgggtct

SEQ ID NO: 7174468 - DNA, 22 bp, Homo sapiens
gctgaagagaggccttgagcac

SEQ ID NO: 7174469 - DNA, 23 bp, Homo sapiens
gctgaagagcaaaccaggcaaaa

SEQ ID NO: 7174470 - DNA, 22 bp, Homo sapiens
gctgaagagagatgcgtccagc

SEQ ID NO: 7174471 - DNA, 22 bp, Homo sapiens
gctctcagaagagccaggctac

SEQ ID NO: 7174472 - DNA, 22 bp, Homo sapiens
gctctcagaagagccaggctac

SEQ ID NO: 7174473 - DNA, 22 bp, Homo sapiens
gctctcagaagtaacttgtcca

SEQ ID NO: 7174474 - DNA, 22 bp, Homo sapiens
gctctatgttgaccttcagtgg

SEQ ID NO: 7174475 - DNA, 22 bp, Homo sapiens
gctctatgcatgggagcaggag

SEQ ID NO: 7174476 - DNA, 22 bp, Homo sapiens
gctcctgtgaggacacagccgc

SEQ ID NO: 7174477 - DNA, 22 bp, Homo sapiens
gctcctgtttgtttgttcctga

SEQ ID NO: 7174478 - DNA, 21 bp, Homo sapiens
gctcctggtgctgcgtggcgc

SEQ ID NO: 7174479 - DNA, 21 bp, Homo sapiens
gctcctggtgctgcgtggcgc

SEQ ID NO: 7174480 - DNA, 21 bp, Homo sapiens
gctcctggtgctgcgtggcgc

SEQ ID NO: 7174481 - DNA, 21 bp, Homo sapiens
gctcctggtgctgcgtggcgc

SEQ ID NO: 7174482 - DNA, 22 bp, Homo sapiens
gctcctggtgctgtagagattt

SEQ ID NO: 7174483 - DNA, 22 bp, Homo sapiens
gctcctggtgctgtagagattt

SEQ ID NO: 7174484 - DNA, 18 bp, Homo sapiens
gctcctggttggaaagaa

SEQ ID NO: 7174485 - DNA, 18 bp, Homo sapiens
gctcctggttggaaagaa

SEQ ID NO: 7174486 - DNA, 20 bp, Homo sapiens
gctcctgtcctggtggaggg

SEQ ID NO: 7174487 - DNA, 18 bp, Homo sapiens
gctcaggccctagtcagt

SEQ ID NO: 7174488 - DNA, 18 bp, Homo sapiens
gctcaggccctagtcagt

SEQ ID NO: 7174489 - DNA, 22 bp, Homo sapiens
gctcaggcctcactccatttgg

SEQ ID NO: 7174490 - DNA, 22 bp, Homo sapiens
gctcaggcctccagaggggcaa

SEQ ID NO: 7174491 - DNA, 22 bp, Homo sapiens
gctcaggcctccagaggggcaa

SEQ ID NO: 7174492 - DNA, 22 bp, Homo sapiens
gctcaggcctccagaggggcaa

SEQ ID NO: 7174493 - DNA, 22 bp, Homo sapiens
gctcaggcctccagaggggcaa

SEQ ID NO: 7174494 - DNA, 22 bp, Homo sapiens
gctcaggcctccagaggggcaa

SEQ ID NO: 7174495 - DNA, 22 bp, Homo sapiens
gctcaggcctcggacacacaat

SEQ ID NO: 7174496 - DNA, 22 bp, Homo sapiens
gctcaggcctggcccatgggac

SEQ ID NO: 7174497 - DNA, 22 bp, Homo sapiens
gctcaggcctggcccatgggac

SEQ ID NO: 7174498 - DNA, 22 bp, Homo sapiens
gctcaggcctggcccatgggac

SEQ ID NO: 7174499 - DNA, 22 bp, Homo sapiens
gctcaggcctggcccatgggac

SEQ ID NO: 7174500 - DNA, 22 bp, Homo sapiens
gctcaggcctggctatccattg

SEQ ID NO: 7174501 - DNA, 21 bp, Homo sapiens
gctcaggctcaggttcaggtt

SEQ ID NO: 7174502 - DNA, 21 bp, Homo sapiens
gctcaggctcaggttcaggtt

SEQ ID NO: 7174503 - DNA, 22 bp, Homo sapiens
gctcaggctctcccaggggaat

SEQ ID NO: 7174504 - DNA, 22 bp, Homo sapiens
gctcaggctctcccaggggaat

SEQ ID NO: 7174505 - DNA, 22 bp, Homo sapiens
gctcaggctctcccaggggaat

SEQ ID NO: 7174506 - DNA, 22 bp, Homo sapiens
gctcaggctctcccaggggaat

SEQ ID NO: 7174507 - DNA, 22 bp, Homo sapiens
gctcaggctctcccaggggaat

SEQ ID NO: 7174508 - DNA, 21 bp, Homo sapiens
gctcaggctcttgacagagca

SEQ ID NO: 7174509 - DNA, 21 bp, Homo sapiens
gctcaggctcttgacagagca

SEQ ID NO: 7174510 - DNA, 22 bp, Homo sapiens
gctcagggaaagagctcctgtc

SEQ ID NO: 7174511 - DNA, 22 bp, Homo sapiens
gctcagggaaagagctcctgtc

SEQ ID NO: 7174512 - DNA, 19 bp, Homo sapiens
gctcaggctgtgtgtgggg

SEQ ID NO: 7174513 - DNA, 22 bp, Homo sapiens
gctcaggcttcttctataaaga

SEQ ID NO: 7174514 - DNA, 22 bp, Homo sapiens
gctcagggaaagagctcctgtc

SEQ ID NO: 7174515 - DNA, 22 bp, Homo sapiens
gctcagggaaagagctcctgtc

SEQ ID NO: 7174516 - DNA, 21 bp, Homo sapiens
gctcaggctcttgacagagca

SEQ ID NO: 7174517 - DNA, 22 bp, Homo sapiens
gctcaggctggattgcagtggc

SEQ ID NO: 7174518 - DNA, 22 bp, Homo sapiens
gctcaggctggattgcagtggc

SEQ ID NO: 7174519 - DNA, 21 bp, Homo sapiens
gctcaggctcttgacagagca

SEQ ID NO: 7174520 - DNA, 22 bp, Homo sapiens
gctcaggctggattgcagtggc

SEQ ID NO: 7174521 - DNA, 22 bp, Homo sapiens
gctcaggctggattgcagtggc

SEQ ID NO: 7174522 - DNA, 22 bp, Homo sapiens
gctcaggctggattgcagtggc

SEQ ID NO: 7174523 - DNA, 22 bp, Homo sapiens
gctcaggctggattgcagtggc

SEQ ID NO: 7174524 - DNA, 19 bp, Homo sapiens
gctcaggctgtgtgtgggg

SEQ ID NO: 7174525 - DNA, 19 bp, Homo sapiens
gctcaggctgtgtgtgggg

SEQ ID NO: 7174526 - DNA, 22 bp, Homo sapiens
gctcagggaactttttgcaggc

SEQ ID NO: 7174527 - DNA, 22 bp, Homo sapiens
gctcagggaaagagctcctgtc

SEQ ID NO: 7174528 - DNA, 22 bp, Homo sapiens
gctcagggaactttttgcaggc

SEQ ID NO: 7174529 - DNA, 22 bp, Homo sapiens
gctcctggtctggagcttcaag

SEQ ID NO: 7174530 - DNA, 22 bp, Homo sapiens
gctcctggtctggagcttcaag

SEQ ID NO: 7174531 - DNA, 22 bp, Homo sapiens
gctcctggtctggagcttcaag

SEQ ID NO: 7174532 - DNA, 22 bp, Homo sapiens
gctcctggtgcaaagtttcttc

SEQ ID NO: 7174533 - DNA, 21 bp, Homo sapiens
gctcctggtgctgcgtggcgc

SEQ ID NO: 7174534 - DNA, 21 bp, Homo sapiens
gctcctggtgctgcgtggcgc

SEQ ID NO: 7174535 - DNA, 22 bp, Homo sapiens
ggaagccccagacccagagtct

SEQ ID NO: 7174536 - DNA, 22 bp, Homo sapiens
ggaagccatgagggacagttct

SEQ ID NO: 7174537 - DNA, 22 bp, Homo sapiens
ggaagccagttgcttggtgtgg

SEQ ID NO: 7174538 - DNA, 22 bp, Homo sapiens
ggaagccagttgcttggtgtgg

SEQ ID NO: 7174539 - DNA, 19 bp, Homo sapiens
ggaagccaggtcagcccac

SEQ ID NO: 7174540 - DNA, 22 bp, Homo sapiens
ggaagctgttatcatctgtatc

SEQ ID NO: 7174541 - DNA, 21 bp, Homo sapiens
ggaagctgtgtccatgctcct

SEQ ID NO: 7174542 - DNA, 21 bp, Homo sapiens
ggaagctgtgtccatgctcct

SEQ ID NO: 7174543 - DNA, 21 bp, Homo sapiens
ggaagctgtgtccatgctcct

SEQ ID NO: 7174544 - DNA, 22 bp, Homo sapiens
ggaagctgttgtgagtgcagca

SEQ ID NO: 7174545 - DNA, 22 bp, Homo sapiens
ggaagctgttgtgagtgcagca

SEQ ID NO: 7174546 - DNA, 22 bp, Homo sapiens
ggaagctgttgtgagtgcagca

SEQ ID NO: 7174547 - DNA, 21 bp, Homo sapiens
ggacaccagtcacactggatt

SEQ ID NO: 7174548 - DNA, 22 bp, Homo sapiens
ggaaggaagtgaccaggatatc

SEQ ID NO: 7174549 - DNA, 22 bp, Homo sapiens
ggacacagtggaagacagcttg

SEQ ID NO: 7174550 - DNA, 22 bp, Homo sapiens
ggaaggaagtgaccaggatatc

SEQ ID NO: 7174551 - DNA, 22 bp, Homo sapiens
ggaaggaagaggaccgagctgg

SEQ ID NO: 7174552 - DNA, 22 bp, Homo sapiens
ggaaggaagaggaccgagctgg

SEQ ID NO: 7174553 - DNA, 22 bp, Homo sapiens
ggaaggaagattctaactggag

SEQ ID NO: 7174554 - DNA, 22 bp, Homo sapiens
ggaaggaagattctaactggag

SEQ ID NO: 7174555 - DNA, 22 bp, Homo sapiens
ggaaggaagtaaatgatgctat

SEQ ID NO: 7174556 - DNA, 22 bp, Homo sapiens
ggaaggaagtaaatgatgctat

SEQ ID NO: 7174557 - DNA, 22 bp, Homo sapiens
ggaaggaagtaaatgatgctat

SEQ ID NO: 7174558 - DNA, 22 bp, Homo sapiens
ggaaggaagtgaccaggatatc

SEQ ID NO: 7174559 - DNA, 22 bp, Homo sapiens
ggaaggaaattggggcagttgt

SEQ ID NO: 7174560 - DNA, 22 bp, Homo sapiens
ggaaggaaattggggcagttgt

SEQ ID NO: 7174561 - DNA, 22 bp, Homo sapiens
ggaaggaacaaaccctgtgtgg

SEQ ID NO: 7174562 - DNA, 22 bp, Homo sapiens
ggaaggaaagcagcttggccct

SEQ ID NO: 7174563 - DNA, 22 bp, Homo sapiens
ggaaggaaagcagcttggccct

SEQ ID NO: 7174564 - DNA, 22 bp, Homo sapiens
ggaaggaaattggggcagttgt

SEQ ID NO: 7174565 - DNA, 22 bp, Homo sapiens
ggaaggaaattggggcagttgt

SEQ ID NO: 7174566 - DNA, 22 bp, Homo sapiens
ggaaggaacaaaccctgtgtgg

SEQ ID NO: 7174567 - DNA, 18 bp, Homo sapiens
ggaaggaagaatgcattt

SEQ ID NO: 7174568 - DNA, 18 bp, Homo sapiens
ggaaggaagaatgcattt

SEQ ID NO: 7174569 - DNA, 18 bp, Homo sapiens
ggaaggaagaatgcattt

SEQ ID NO: 7174570 - DNA, 20 bp, Homo sapiens
ggaagccagggtgcagggga

SEQ ID NO: 7174571 - DNA, 20 bp, Homo sapiens
ggaagccagggtgcagggga

SEQ ID NO: 7174572 - DNA, 20 bp, Homo sapiens
ggaagccagggtgcagggga

SEQ ID NO: 7174573 - DNA, 22 bp, Homo sapiens
ggaagccaggctgggggatctg

SEQ ID NO: 7174574 - DNA, 22 bp, Homo sapiens
ggaagccaggctgggggatctg

SEQ ID NO: 7174575 - DNA, 22 bp, Homo sapiens
ggaagccaggctgggggatctg

SEQ ID NO: 7174576 - DNA, 22 bp, Homo sapiens
ggaagccaggccaatgagaaca

SEQ ID NO: 7174577 - DNA, 20 bp, Homo sapiens
ggaagccagcatccttgagg

SEQ ID NO: 7174578 - DNA, 22 bp, Homo sapiens
ggaagccaggccaatgagaaca

SEQ ID NO: 7174579 - DNA, 22 bp, Homo sapiens
ggaagccaggccaatgagaaca

SEQ ID NO: 7174580 - DNA, 22 bp, Homo sapiens
ggaagccagagtgctgggcagg

SEQ ID NO: 7174581 - DNA, 22 bp, Homo sapiens
ggaagccagaaagtgagaatat

SEQ ID NO: 7174582 - DNA, 22 bp, Homo sapiens
ggaagccagagtgctgggcagg

SEQ ID NO: 7174583 - DNA, 22 bp, Homo sapiens
ggaagccagaaagtgagaatat

SEQ ID NO: 7174584 - DNA, 22 bp, Homo sapiens
ggaagccacccagctttgatag

SEQ ID NO: 7174585 - DNA, 22 bp, Homo sapiens
ggaagccaaggtggcctctatt

SEQ ID NO: 7174586 - DNA, 22 bp, Homo sapiens
ggaagcaggaggctggggtaaa

SEQ ID NO: 7174587 - DNA, 21 bp, Homo sapiens
ggaagcagtggcggcaactcc

SEQ ID NO: 7174588 - DNA, 21 bp, Homo sapiens
ggaagcagtggcggcaactcc

SEQ ID NO: 7174589 - DNA, 22 bp, Homo sapiens
ggaacccatgattatggttagg

SEQ ID NO: 7174590 - DNA, 22 bp, Homo sapiens
ggaaccttagtgttcttttacc

SEQ ID NO: 7174591 - DNA, 22 bp, Homo sapiens
ggaaccttgataataagttgtt

SEQ ID NO: 7174592 - DNA, 22 bp, Homo sapiens
ggaaccactgtcttctaaagat

SEQ ID NO: 7174593 - DNA, 22 bp, Homo sapiens
ggaaccaggagttacacgagtt

SEQ ID NO: 7174594 - DNA, 22 bp, Homo sapiens
ggaaccagtggaatgatatgct

SEQ ID NO: 7174595 - DNA, 22 bp, Homo sapiens
ggaacattttttaaggcagaaa

SEQ ID NO: 7174596 - DNA, 15 bp, Homo sapiens
ggaacatttctgttt

SEQ ID NO: 7174597 - DNA, 22 bp, Homo sapiens
ggaacatttaaattcttatttg

SEQ ID NO: 7174598 - DNA, 22 bp, Homo sapiens
ggaacatttcctggcagagagg

SEQ ID NO: 7174599 - DNA, 22 bp, Homo sapiens
ggaacattctagagtgttgtga

SEQ ID NO: 7174600 - DNA, 22 bp, Homo sapiens
ggaacattggcattttaaggct

SEQ ID NO: 7174601 - DNA, 21 bp, Homo sapiens
ggaacattgttaatagtctct

SEQ ID NO: 7174602 - DNA, 22 bp, Homo sapiens
ggaacatactgtgtagactttg

SEQ ID NO: 7174603 - DNA, 22 bp, Homo sapiens
ggaacatactgtgtagactttg

SEQ ID NO: 7174604 - DNA, 22 bp, Homo sapiens
ggaacagggatttggcctggtt

SEQ ID NO: 7174605 - DNA, 22 bp, Homo sapiens
ggaacagggatttggcctggtt

SEQ ID NO: 7174606 - DNA, 22 bp, Homo sapiens
ggaacagtagacgatctccttt

SEQ ID NO: 7174607 - DNA, 22 bp, Homo sapiens
ggaacagttgagatgatgtacc

SEQ ID NO: 7174608 - DNA, 17 bp, Homo sapiens
ggaaaggtagagtaatc

SEQ ID NO: 7174609 - DNA, 22 bp, Homo sapiens
ggaaagtggtggtggaaagagg

SEQ ID NO: 7174610 - DNA, 22 bp, Homo sapiens
ggaaatacaaagatacaccact

SEQ ID NO: 7174611 - DNA, 22 bp, Homo sapiens
ggaaagggcatggccttttcac

SEQ ID NO: 7174612 - DNA, 22 bp, Homo sapiens
ggaaagggcagaggccttggag

SEQ ID NO: 7174613 - DNA, 22 bp, Homo sapiens
ggaaagggcagaggccttggag

SEQ ID NO: 7174614 - DNA, 22 bp, Homo sapiens
ggaaatattgattgctctgtat

SEQ ID NO: 7174615 - DNA, 22 bp, Homo sapiens
ggaaatattttgtctaatttgt

SEQ ID NO: 7174616 - DNA, 22 bp, Homo sapiens
ggaaaggagatgaataggatta

SEQ ID NO: 7174617 - DNA, 22 bp, Homo sapiens
ggaaaggagatgaataggatta

SEQ ID NO: 7174618 - DNA, 22 bp, Homo sapiens
ggaaaggcaggggccctgccca

SEQ ID NO: 7174619 - DNA, 22 bp, Homo sapiens
ggaaaggcaggggccctgccca

SEQ ID NO: 7174620 - DNA, 22 bp, Homo sapiens
ggaaaggcctgggtgtcctggg

SEQ ID NO: 7174621 - DNA, 22 bp, Homo sapiens
ggaaaggcctgggtgtcctggg

SEQ ID NO: 7174622 - DNA, 22 bp, Homo sapiens
ggaaaggctaacagtcatggaa

SEQ ID NO: 7174623 - DNA, 22 bp, Homo sapiens
ggaaaggctaacagtcatggaa

SEQ ID NO: 7174624 - DNA, 22 bp, Homo sapiens
ggaaagctcagatcttgttgga

SEQ ID NO: 7174625 - DNA, 22 bp, Homo sapiens
gcttcctgatattcatactgtt

SEQ ID NO: 7174626 - DNA, 22 bp, Homo sapiens
gcttcctgatattcatactgtt

SEQ ID NO: 7174627 - DNA, 22 bp, Homo sapiens
ggaaaggagatattggagagtg

SEQ ID NO: 7174628 - DNA, 22 bp, Homo sapiens
ggaaaggagatattggagagtg

SEQ ID NO: 7174629 - DNA, 22 bp, Homo sapiens
ggaaaggagatattggagagtg

SEQ ID NO: 7174630 - DNA, 22 bp, Homo sapiens
ggaaaggagatattggagagtg

SEQ ID NO: 7174631 - DNA, 22 bp, Homo sapiens
ggaaaggagatattggagagtg

SEQ ID NO: 7174632 - DNA, 22 bp, Homo sapiens
ggaaaggagatattggagagtg

SEQ ID NO: 7174633 - DNA, 22 bp, Homo sapiens
gcttcctgagacaacattgagt

SEQ ID NO: 7174634 - DNA, 22 bp, Homo sapiens
gcttcctgagacaacattgagt

SEQ ID NO: 7174635 - DNA, 22 bp, Homo sapiens
gcttcctgagaaacaatctgat

SEQ ID NO: 7174636 - DNA, 22 bp, Homo sapiens
gcttcctgagagagacagttcc

SEQ ID NO: 7174637 - DNA, 22 bp, Homo sapiens
gcttcctgagagagacagttcc

SEQ ID NO: 7174638 - DNA, 22 bp, Homo sapiens
gcttcctgagagagacagttcc

SEQ ID NO: 7174639 - DNA, 22 bp, Homo sapiens
gcttcctgagtacaccctcatc

SEQ ID NO: 7174640 - DNA, 22 bp, Homo sapiens
gcttcctgagtacaccctcatc

SEQ ID NO: 7174641 - DNA, 22 bp, Homo sapiens
gcttcctgagaaacaatctgat

SEQ ID NO: 7174642 - DNA, 22 bp, Homo sapiens
gcttcctgagaaacaatctgat

SEQ ID NO: 7174643 - DNA, 22 bp, Homo sapiens
gcttcctgagaaacaatctgat

SEQ ID NO: 7174644 - DNA, 18 bp, Homo sapiens
gcttcctgaaagctgccc

SEQ ID NO: 7174645 - DNA, 18 bp, Homo sapiens
gcttcctgaaagctgccc

SEQ ID NO: 7174646 - DNA, 22 bp, Homo sapiens
gcttcctcgctgggcagaggca

SEQ ID NO: 7174647 - DNA, 22 bp, Homo sapiens
gcttcctcgctgggcagaggca

SEQ ID NO: 7174648 - DNA, 18 bp, Homo sapiens
gcttcctgaaagctgccc

SEQ ID NO: 7174649 - DNA, 22 bp, Homo sapiens
gcttcctccctgctgctcacta

SEQ ID NO: 7174650 - DNA, 22 bp, Homo sapiens
gcttcctcctggaggtcactca

SEQ ID NO: 7174651 - DNA, 22 bp, Homo sapiens
gcttcctcctggaggtcactca

SEQ ID NO: 7174652 - DNA, 22 bp, Homo sapiens
gcttcctcgctgggcagaggca

SEQ ID NO: 7174653 - DNA, 22 bp, Homo sapiens
gcttcctcgctgggcagaggca

SEQ ID NO: 7174654 - DNA, 22 bp, Homo sapiens
gcttcctccctgctgctcacta

SEQ ID NO: 7174655 - DNA, 22 bp, Homo sapiens
gcttcctccagggaggggcctg

SEQ ID NO: 7174656 - DNA, 17 bp, Homo sapiens
gcttcctcatgcagttc

SEQ ID NO: 7174657 - DNA, 22 bp, Homo sapiens
gcttcctcaccttctcttgcat

SEQ ID NO: 7174658 - DNA, 20 bp, Homo sapiens
gcttcccaattcttgatctg

SEQ ID NO: 7174659 - DNA, 20 bp, Homo sapiens
gcttcccaattcttgatctg

SEQ ID NO: 7174660 - DNA, 20 bp, Homo sapiens
gcttcccaattcttgatctg

SEQ ID NO: 7174661 - DNA, 22 bp, Homo sapiens
gcttcccacagctggactgggg

SEQ ID NO: 7174662 - DNA, 19 bp, Homo sapiens
gcttcccaccagccagccc

SEQ ID NO: 7174663 - DNA, 23 bp, Homo sapiens
gcttcccagacaatactgcttcc

SEQ ID NO: 7174664 - DNA, 22 bp, Homo sapiens
gcttcccaggcgcctgaccttt

SEQ ID NO: 7174665 - DNA, 22 bp, Homo sapiens
ggagaggcgatgagtcacagcc

SEQ ID NO: 7174666 - DNA, 22 bp, Homo sapiens
ggagaggcgatgagtcacagcc

SEQ ID NO: 7174667 - DNA, 22 bp, Homo sapiens
ggagaggcgatgagtcacagcc

SEQ ID NO: 7174668 - DNA, 22 bp, Homo sapiens
ggagaggcgatgagtcacagcc

SEQ ID NO: 7174669 - DNA, 22 bp, Homo sapiens
ggagaggcgatgagtcacagcc

SEQ ID NO: 7174670 - DNA, 22 bp, Homo sapiens
ggagaggagctattgggggctc

SEQ ID NO: 7174671 - DNA, 22 bp, Homo sapiens
ggagaggagctattgggggctc

SEQ ID NO: 7174672 - DNA, 22 bp, Homo sapiens
ggagaggagctattgggggctc

SEQ ID NO: 7174673 - DNA, 22 bp, Homo sapiens
ggagaggagctattgggggctc

SEQ ID NO: 7174674 - DNA, 22 bp, Homo sapiens
ggagaggatgttttagtaactt

SEQ ID NO: 7174675 - DNA, 22 bp, Homo sapiens
ggagaggatgttttagtaactt

SEQ ID NO: 7174676 - DNA, 19 bp, Homo sapiens
ggagaggctggagggatgc

SEQ ID NO: 7174677 - DNA, 19 bp, Homo sapiens
ggagaggctggagggatgc

SEQ ID NO: 7174678 - DNA, 19 bp, Homo sapiens
ggagaggctggagggatgc

SEQ ID NO: 7174679 - DNA, 19 bp, Homo sapiens
ggagaggctggagggatgc

SEQ ID NO: 7174680 - DNA, 19 bp, Homo sapiens
ggagaggctggagggatgc

SEQ ID NO: 7174681 - DNA, 19 bp, Homo sapiens
ggagaggctggagggatgc

SEQ ID NO: 7174682 - DNA, 19 bp, Homo sapiens
ggagaggctggagggatgc

SEQ ID NO: 7174683 - DNA, 19 bp, Homo sapiens
ggagaggctggagggatgc

SEQ ID NO: 7174684 - DNA, 22 bp, Homo sapiens
ggagaggcttccagagtcgtgc

SEQ ID NO: 7174685 - DNA, 22 bp, Homo sapiens
ggagaggcttccagagtcgtgc

SEQ ID NO: 7174686 - DNA, 22 bp, Homo sapiens
ggagaggcttccagagtcgtgc

SEQ ID NO: 7174687 - DNA, 22 bp, Homo sapiens
ggagaggcttccagagtcgtgc

SEQ ID NO: 7174688 - DNA, 22 bp, Homo sapiens
ggagaggagctattgggggctc

SEQ ID NO: 7174689 - DNA, 22 bp, Homo sapiens
ggagaggagattgtggcatttt

SEQ ID NO: 7174690 - DNA, 22 bp, Homo sapiens
ggagaggagattgtggcatttt

SEQ ID NO: 7174691 - DNA, 22 bp, Homo sapiens
ggagaggacatggctcccacag

SEQ ID NO: 7174692 - DNA, 22 bp, Homo sapiens
ggagaggaaatgccagcacttc

SEQ ID NO: 7174693 - DNA, 22 bp, Homo sapiens
ggagaggaaatgccagcacttc

SEQ ID NO: 7174694 - DNA, 22 bp, Homo sapiens
ggagaggaaatgccagcacttc

SEQ ID NO: 7174695 - DNA, 22 bp, Homo sapiens
ggagaggaaatgccagcacttc

SEQ ID NO: 7174696 - DNA, 22 bp, Homo sapiens
ggagaggaaatgccagcacttc

SEQ ID NO: 7174697 - DNA, 22 bp, Homo sapiens
ggagaggaaatgccagcacttc

SEQ ID NO: 7174698 - DNA, 22 bp, Homo sapiens
ggagaggaaatgccagcacttc

SEQ ID NO: 7174699 - DNA, 22 bp, Homo sapiens
ggagagcttggagtgcgatttt

SEQ ID NO: 7174700 - DNA, 22 bp, Homo sapiens
ggagagcttggagtgcgatttt

SEQ ID NO: 7174701 - DNA, 22 bp, Homo sapiens
ggagagctggtatatgaagaca

SEQ ID NO: 7174702 - DNA, 22 bp, Homo sapiens
ggagagcttggagtgcgatttt

SEQ ID NO: 7174703 - DNA, 22 bp, Homo sapiens
ggactgaggcccacttgaggga

SEQ ID NO: 7174704 - DNA, 22 bp, Homo sapiens
ggactgaggacatgtgaggcat

SEQ ID NO: 7174705 - DNA, 22 bp, Homo sapiens
ggagagaggagcccactgctgt

SEQ ID NO: 7174706 - DNA, 22 bp, Homo sapiens
ggagagaggagcccactgctgt

SEQ ID NO: 7174707 - DNA, 22 bp, Homo sapiens
ggagagaggagcccactgctgt

SEQ ID NO: 7174708 - DNA, 22 bp, Homo sapiens
ggagagagatgccgccttgctc

SEQ ID NO: 7174709 - DNA, 22 bp, Homo sapiens
ggactgcaacaggcttattcaa

SEQ ID NO: 7174710 - DNA, 22 bp, Homo sapiens
ggagagagatgccgccttgctc

SEQ ID NO: 7174711 - DNA, 22 bp, Homo sapiens
ggagagagatgccgccttgctc

SEQ ID NO: 7174712 - DNA, 22 bp, Homo sapiens
ggagagagatgccgccttgctc

SEQ ID NO: 7174713 - DNA, 22 bp, Homo sapiens
ggagagagatgccgccttgctc

SEQ ID NO: 7174714 - DNA, 22 bp, Homo sapiens
ggactcctctagaagttgaggc

SEQ ID NO: 7174715 - DNA, 22 bp, Homo sapiens
ggactctggctcagtgttgctt

SEQ ID NO: 7174716 - DNA, 22 bp, Homo sapiens
ggactctggtatttcactcttg

SEQ ID NO: 7174717 - DNA, 18 bp, Homo sapiens
ggactacaggcacaggga

SEQ ID NO: 7174718 - DNA, 22 bp, Homo sapiens
ggactcagcagccaggagtggc

SEQ ID NO: 7174719 - DNA, 22 bp, Homo sapiens
ggactcaggctggtgttcggac

SEQ ID NO: 7174720 - DNA, 22 bp, Homo sapiens
ggactcaggctggtgttcggac

SEQ ID NO: 7174721 - DNA, 22 bp, Homo sapiens
ggacggggagctggaaagggga

SEQ ID NO: 7174722 - DNA, 22 bp, Homo sapiens
ggacggggagctggaaagggga

SEQ ID NO: 7174723 - DNA, 20 bp, Homo sapiens
ggactacaatttgcagtgtg

SEQ ID NO: 7174724 - DNA, 18 bp, Homo sapiens
ggactacaggcacaggga

SEQ ID NO: 7174725 - DNA, 22 bp, Homo sapiens
ggacggggagctggaaagggga

SEQ ID NO: 7174726 - DNA, 22 bp, Homo sapiens
ggacggggagctggaaagggga

SEQ ID NO: 7174727 - DNA, 22 bp, Homo sapiens
ggacctgccagaactcaggcta

SEQ ID NO: 7174728 - DNA, 22 bp, Homo sapiens
ggacctggaagtttggtgatcc

SEQ ID NO: 7174729 - DNA, 22 bp, Homo sapiens
ggacctggaagtttggtgatcc

SEQ ID NO: 7174730 - DNA, 22 bp, Homo sapiens
ggacctgtgtctacagcatgtg

SEQ ID NO: 7174731 - DNA, 22 bp, Homo sapiens
ggacctttgagggggaattggt

SEQ ID NO: 7174732 - DNA, 22 bp, Homo sapiens
ggacgcagccgagggagcaggg

SEQ ID NO: 7174733 - DNA, 22 bp, Homo sapiens
ggacctttgagggggaattggt

SEQ ID NO: 7174734 - DNA, 22 bp, Homo sapiens
ggacgcagccgagggagcaggg

SEQ ID NO: 7174735 - DNA, 22 bp, Homo sapiens
ggacgcagccgagggagcaggg

SEQ ID NO: 7174736 - DNA, 22 bp, Homo sapiens
ggacgcagcgagggaagcagcc

SEQ ID NO: 7174737 - DNA, 22 bp, Homo sapiens
ggacgcagcgagggaagcagcc

SEQ ID NO: 7174738 - DNA, 22 bp, Homo sapiens
ggacggggagctggaaagggga

SEQ ID NO: 7174739 - DNA, 22 bp, Homo sapiens
ggacggggagctggaaagggga

SEQ ID NO: 7174740 - DNA, 22 bp, Homo sapiens
ggacagagccctggtggcctaa

SEQ ID NO: 7174741 - DNA, 22 bp, Homo sapiens
ggacagagccctggtggcctaa

SEQ ID NO: 7174742 - DNA, 22 bp, Homo sapiens
ggacagagcagacgagcagcgg

SEQ ID NO: 7174743 - DNA, 22 bp, Homo sapiens
ggacagagcagacgagcagcgg

SEQ ID NO: 7174744 - DNA, 22 bp, Homo sapiens
ggacagagcagacgagcagcgg

SEQ ID NO: 7174745 - DNA, 22 bp, Homo sapiens
ggacagagcagacgagcagcgg

SEQ ID NO: 7174746 - DNA, 22 bp, Homo sapiens
ggacagagcagacgagcagcgg

SEQ ID NO: 7174747 - DNA, 22 bp, Homo sapiens
ggacagagccctggtggcctaa

SEQ ID NO: 7174748 - DNA, 22 bp, Homo sapiens
ggacagagccctggtggcctaa

SEQ ID NO: 7174749 - DNA, 22 bp, Homo sapiens
ggacagagccctggtggcctaa

SEQ ID NO: 7174750 - DNA, 22 bp, Homo sapiens
ggacagagccctggtggcctaa

SEQ ID NO: 7174751 - DNA, 22 bp, Homo sapiens
ggacagagcagacgagcagcgg

SEQ ID NO: 7174752 - DNA, 22 bp, Homo sapiens
ggacagagcagacgagcagcgg

SEQ ID NO: 7174753 - DNA, 22 bp, Homo sapiens
ggacagagcagacgagcagcgg

SEQ ID NO: 7174754 - DNA, 22 bp, Homo sapiens
ggacagactttacagccccggg

SEQ ID NO: 7174755 - DNA, 22 bp, Homo sapiens
ggacagacaaaaatagtaagca

SEQ ID NO: 7174756 - DNA, 22 bp, Homo sapiens
ggacagacagtgtgagtgaggc

SEQ ID NO: 7174757 - DNA, 19 bp, Homo sapiens
ggacagacgcagagatctg

SEQ ID NO: 7174758 - DNA, 22 bp, Homo sapiens
ggacagacagtgtgagtgaggc

SEQ ID NO: 7174759 - DNA, 22 bp, Homo sapiens
ggacagacagtgtgagtgaggc

SEQ ID NO: 7174760 - DNA, 22 bp, Homo sapiens
ggacagactttacagccccggg

SEQ ID NO: 7174761 - DNA, 22 bp, Homo sapiens
ggacagagagtgaatatgacat

SEQ ID NO: 7174762 - DNA, 23 bp, Homo sapiens
ggacactgtgcagatgctagtgc

SEQ ID NO: 7174763 - DNA, 23 bp, Homo sapiens
ggacactgtgcagatgctagtgc

SEQ ID NO: 7174764 - DNA, 23 bp, Homo sapiens
ggacactgtgcagatgctagtgc

SEQ ID NO: 7174765 - DNA, 22 bp, Homo sapiens
ggacactggccacatttcaaaa

SEQ ID NO: 7174766 - DNA, 20 bp, Homo sapiens
ggacactgtagatttcaaac

SEQ ID NO: 7174767 - DNA, 22 bp, Homo sapiens
ggacactgtataagttagagta

SEQ ID NO: 7174768 - DNA, 22 bp, Homo sapiens
ggacactgtataagttagagta

SEQ ID NO: 7174769 - DNA, 22 bp, Homo sapiens
ggacactgttcatggggagggg

SEQ ID NO: 7174770 - DNA, 22 bp, Homo sapiens
ggacactgttcatggggagggg

SEQ ID NO: 7174771 - DNA, 22 bp, Homo sapiens
ggacacttagcctcagtttgct

SEQ ID NO: 7174772 - DNA, 22 bp, Homo sapiens
ggacacttggtggcccattgtg

SEQ ID NO: 7174773 - DNA, 22 bp, Homo sapiens
ggacactttgagttgaaggggt

SEQ ID NO: 7174774 - DNA, 22 bp, Homo sapiens
ggacagaaaccatatgagtgta

SEQ ID NO: 7174775 - DNA, 22 bp, Homo sapiens
ggacagaaaccatatgagtgta

SEQ ID NO: 7174776 - DNA, 22 bp, Homo sapiens
ggacagaaattcttgttggaca

SEQ ID NO: 7174777 - DNA, 22 bp, Homo sapiens
ggacactgaagaatctcagatg

SEQ ID NO: 7174778 - DNA, 22 bp, Homo sapiens
ggacactaaatggaagtgtctg

SEQ ID NO: 7174779 - DNA, 21 bp, Homo sapiens
ggacactgataatcttgttgc

SEQ ID NO: 7174780 - DNA, 23 bp, Homo sapiens
ggacactgctataaaggatctgc

SEQ ID NO: 7174781 - DNA, 23 bp, Homo sapiens
ggacactgctataaaggatctgc

SEQ ID NO: 7174782 - DNA, 23 bp, Homo sapiens
ggacactgctataaaggatctgc

SEQ ID NO: 7174783 - DNA, 21 bp, Homo sapiens
ggacaccagtcacactggatt

SEQ ID NO: 7174784 - DNA, 19 bp, Homo sapiens
ggacaccctatcaatacct

SEQ ID NO: 7174785 - DNA, 17 bp, Homo sapiens
ggacacctggagtctcc

SEQ ID NO: 7174786 - DNA, 22 bp, Homo sapiens
ggacacgtggctgaaggcggcc

SEQ ID NO: 7174787 - DNA, 22 bp, Homo sapiens
ggacctgaacataaaacgaggc

SEQ ID NO: 7174788 - DNA, 22 bp, Homo sapiens
ggacctgaacataaaacgaggc

SEQ ID NO: 7174789 - DNA, 22 bp, Homo sapiens
ggacctgaacataaaacgaggc

SEQ ID NO: 7174790 - DNA, 23 bp, Homo sapiens
ggaccctgtggagggtgagagtc

SEQ ID NO: 7174791 - DNA, 23 bp, Homo sapiens
ggaccctgtggagggtgagagtc

SEQ ID NO: 7174792 - DNA, 22 bp, Homo sapiens
ggaccctgcgtgtatccacact

SEQ ID NO: 7174793 - DNA, 22 bp, Homo sapiens
ggaccctggagacccactggga

SEQ ID NO: 7174794 - DNA, 22 bp, Homo sapiens
ggaccctggagacccactggga

SEQ ID NO: 7174795 - DNA, 22 bp, Homo sapiens
ggaccctgggcagctggctgct

SEQ ID NO: 7174796 - DNA, 22 bp, Homo sapiens
ggaccctgggcagctggctgct

SEQ ID NO: 7174797 - DNA, 22 bp, Homo sapiens
ggaccctgggcttgctcctggg

SEQ ID NO: 7174798 - DNA, 22 bp, Homo sapiens
ggacagagggcaggagcccaga

SEQ ID NO: 7174799 - DNA, 22 bp, Homo sapiens
ggacagagggttgacagagtat

SEQ ID NO: 7174800 - DNA, 22 bp, Homo sapiens
ggacagagggttgacagagtat

SEQ ID NO: 7174801 - DNA, 22 bp, Homo sapiens
ggacccagaggggagtctggca

SEQ ID NO: 7174802 - DNA, 22 bp, Homo sapiens
ggacagagggcaggagcccaga

SEQ ID NO: 7174803 - DNA, 22 bp, Homo sapiens
ggacagagggcaggagcccaga

SEQ ID NO: 7174804 - DNA, 22 bp, Homo sapiens
ggacagagggcaggagcccaga

SEQ ID NO: 7174805 - DNA, 21 bp, Homo sapiens
ggacagaggagaaggcaccct

SEQ ID NO: 7174806 - DNA, 21 bp, Homo sapiens
ggacagaggagaaggcaccct

SEQ ID NO: 7174807 - DNA, 21 bp, Homo sapiens
ggacagaggagaaggcaccct

SEQ ID NO: 7174808 - DNA, 21 bp, Homo sapiens
ggacagaggagaaggcaccct

SEQ ID NO: 7174809 - DNA, 21 bp, Homo sapiens
ggacagaggagaaggcaccct

SEQ ID NO: 7174810 - DNA, 22 bp, Homo sapiens
ggacccagctctgagaccctgc

SEQ ID NO: 7174811 - DNA, 22 bp, Homo sapiens
ggacccagctctgagaccctgc

SEQ ID NO: 7174812 - DNA, 22 bp, Homo sapiens
ggacccagctctgagaccctgc

SEQ ID NO: 7174813 - DNA, 18 bp, Homo sapiens
ggacccagggcctcaccc

SEQ ID NO: 7174814 - DNA, 18 bp, Homo sapiens
ggacccagggcctcaccc

SEQ ID NO: 7174815 - DNA, 22 bp, Homo sapiens
ggacccaggtagggaggaagat

SEQ ID NO: 7174816 - DNA, 22 bp, Homo sapiens
ggacccaggtagggaggaagat

SEQ ID NO: 7174817 - DNA, 22 bp, Homo sapiens
ggaccccagagataccagtttt

SEQ ID NO: 7174818 - DNA, 22 bp, Homo sapiens
ggaccctgcagccacccgacat

SEQ ID NO: 7174819 - DNA, 22 bp, Homo sapiens
gctgggttttcttccgggccta

SEQ ID NO: 7174820 - DNA, 22 bp, Homo sapiens
gctgggtttccagcaggcagga

SEQ ID NO: 7174821 - DNA, 22 bp, Homo sapiens
gctgggtgtcacggggctcgtg

SEQ ID NO: 7174822 - DNA, 22 bp, Homo sapiens
gctgggtgtcacggggctcgtg

SEQ ID NO: 7174823 - DNA, 22 bp, Homo sapiens
gctgggtttccagcaggcagga

SEQ ID NO: 7174824 - DNA, 22 bp, Homo sapiens
gctgtctgttcgagcgtgtgtt

SEQ ID NO: 7174825 - DNA, 22 bp, Homo sapiens
gctgtcttcacttcctggtttc

SEQ ID NO: 7174826 - DNA, 22 bp, Homo sapiens
gctggtcagagagaaaggaggc

SEQ ID NO: 7174827 - DNA, 22 bp, Homo sapiens
gctggtcagagagaaaggaggc

SEQ ID NO: 7174828 - DNA, 22 bp, Homo sapiens
gctggtaggaagtgctcctgcc

SEQ ID NO: 7174829 - DNA, 16 bp, Homo sapiens
gctggtcaagcagcag

SEQ ID NO: 7174830 - DNA, 22 bp, Homo sapiens
gctggtcactctgggagctgct

SEQ ID NO: 7174831 - DNA, 22 bp, Homo sapiens
gctggtagacctcactgcactc

SEQ ID NO: 7174832 - DNA, 22 bp, Homo sapiens
gctggtagacctcactgcactc

SEQ ID NO: 7174833 - DNA, 22 bp, Homo sapiens
gctggtagacctcactgcactc

SEQ ID NO: 7174834 - DNA, 22 bp, Homo sapiens
gctgggtggatcggaggctctg

SEQ ID NO: 7174835 - DNA, 22 bp, Homo sapiens
gctgggtggatcggaggctctg

SEQ ID NO: 7174836 - DNA, 22 bp, Homo sapiens
gctgggtggatcggaggctctg

SEQ ID NO: 7174837 - DNA, 22 bp, Homo sapiens
gctgggtggatcggaggctctg

SEQ ID NO: 7174838 - DNA, 22 bp, Homo sapiens
gctgggtggatcggaggctctg

SEQ ID NO: 7174839 - DNA, 22 bp, Homo sapiens
gctgggtggatcggaggctctg

SEQ ID NO: 7174840 - DNA, 19 bp, Homo sapiens
gctgggtggggtccacagc

SEQ ID NO: 7174841 - DNA, 19 bp, Homo sapiens
gctgggtggggtccacagc

SEQ ID NO: 7174842 - DNA, 22 bp, Homo sapiens
gctgggtgtcacggggctcgtg

SEQ ID NO: 7174843 - DNA, 22 bp, Homo sapiens
gctgggtgtcacggggctcgtg

SEQ ID NO: 7174844 - DNA, 22 bp, Homo sapiens
gctgggtgtcacggggctcgtg

SEQ ID NO: 7174845 - DNA, 22 bp, Homo sapiens
gctgggtgtcacggggctcgtg

SEQ ID NO: 7174846 - DNA, 22 bp, Homo sapiens
gctgggtcctatgctggtagag

SEQ ID NO: 7174847 - DNA, 22 bp, Homo sapiens
gctgggtctctccctggtcctg

SEQ ID NO: 7174848 - DNA, 22 bp, Homo sapiens
gctgggtctggatgctcaggtg

SEQ ID NO: 7174849 - DNA, 22 bp, Homo sapiens
gctgggtctggctgtgagccgg

SEQ ID NO: 7174850 - DNA, 19 bp, Homo sapiens
gctgggtgaggtcgttgga

SEQ ID NO: 7174851 - DNA, 19 bp, Homo sapiens
gctgggtgaggtcgttgga

SEQ ID NO: 7174852 - DNA, 19 bp, Homo sapiens
gctgggtgaggtcgttgga

SEQ ID NO: 7174853 - DNA, 20 bp, Homo sapiens
gctgggggtgtgctgagtga

SEQ ID NO: 7174854 - DNA, 20 bp, Homo sapiens
gctgggggtgtgctgagtga

SEQ ID NO: 7174855 - DNA, 22 bp, Homo sapiens
gctggggctgggctgaggaaga

SEQ ID NO: 7174856 - DNA, 20 bp, Homo sapiens
gctgggggtgtgctgagtga

SEQ ID NO: 7174857 - DNA, 20 bp, Homo sapiens
gctgggggtgtgctgagtga

SEQ ID NO: 7174858 - DNA, 20 bp, Homo sapiens
gctgggggtgtgctgagtga

SEQ ID NO: 7174859 - DNA, 20 bp, Homo sapiens
gctgggggtgtgctgagtga

SEQ ID NO: 7174860 - DNA, 22 bp, Homo sapiens
gctgggagtgggcaagatgaga

SEQ ID NO: 7174861 - DNA, 22 bp, Homo sapiens
gctgggagtcgcgtctgtggcc

SEQ ID NO: 7174862 - DNA, 22 bp, Homo sapiens
gctgggagtcgcgtctgtggcc

SEQ ID NO: 7174863 - DNA, 22 bp, Homo sapiens
gctgggagtcgcgtctgtggcc

SEQ ID NO: 7174864 - DNA, 22 bp, Homo sapiens
gctgggagtcgcgtctgtggcc

SEQ ID NO: 7174865 - DNA, 22 bp, Homo sapiens
gctgggagtcgcgtctgtggcc

SEQ ID NO: 7174866 - DNA, 16 bp, Homo sapiens
gctgggagggagaggt

SEQ ID NO: 7174867 - DNA, 16 bp, Homo sapiens
gctgggagggagaggt

SEQ ID NO: 7174868 - DNA, 16 bp, Homo sapiens
gctgggagggagaggt

SEQ ID NO: 7174869 - DNA, 16 bp, Homo sapiens
gctgggagggagaggt

SEQ ID NO: 7174870 - DNA, 22 bp, Homo sapiens
gctgggaggatctctccctgtc

SEQ ID NO: 7174871 - DNA, 18 bp, Homo sapiens
gctggggttgagctctcc

SEQ ID NO: 7174872 - DNA, 18 bp, Homo sapiens
gctggggttgagctctcc

SEQ ID NO: 7174873 - DNA, 22 bp, Homo sapiens
gctggggtctgtgaggagggct

SEQ ID NO: 7174874 - DNA, 22 bp, Homo sapiens
gctggggtgtggtggataagct

SEQ ID NO: 7174875 - DNA, 20 bp, Homo sapiens
gctgggggtgtgctgagtga

SEQ ID NO: 7174876 - DNA, 22 bp, Homo sapiens
gctggggtctgtgaggagggct

SEQ ID NO: 7174877 - DNA, 22 bp, Homo sapiens
gctgggtattttaagaaaggaa

SEQ ID NO: 7174878 - DNA, 18 bp, Homo sapiens
gctggggttgagctctcc

SEQ ID NO: 7174879 - DNA, 22 bp, Homo sapiens
gctgggtccatggtcctcgggt

SEQ ID NO: 7174880 - DNA, 22 bp, Homo sapiens
gctgggtccatggtcctcgggt

SEQ ID NO: 7174881 - DNA, 22 bp, Homo sapiens
gctgggtcccaagcctggggag

SEQ ID NO: 7174882 - DNA, 22 bp, Homo sapiens
gctgggtcccaagcctggggag

SEQ ID NO: 7174883 - DNA, 22 bp, Homo sapiens
gctgggtcctatgctggtagag

SEQ ID NO: 7174884 - DNA, 22 bp, Homo sapiens
gctgggtcctatgctggtagag

SEQ ID NO: 7174885 - DNA, 22 bp, Homo sapiens
gcttcccaaacttgtggataga

SEQ ID NO: 7174886 - DNA, 22 bp, Homo sapiens
gcttccatctatgtcttcatca

SEQ ID NO: 7174887 - DNA, 22 bp, Homo sapiens
gcttccatgtatgctcttgaca

SEQ ID NO: 7174888 - DNA, 22 bp, Homo sapiens
gcttccagtaagttgctgccat

SEQ ID NO: 7174889 - DNA, 22 bp, Homo sapiens
gcttccagtaagttgctgccat

SEQ ID NO: 7174890 - DNA, 22 bp, Homo sapiens
gcttccagtcctcagaggctgg

SEQ ID NO: 7174891 - DNA, 19 bp, Homo sapiens
gctgtgcccctgccgcttg

SEQ ID NO: 7174892 - DNA, 22 bp, Homo sapiens
gcttccaaacaaaattttgatg

SEQ ID NO: 7174893 - DNA, 22 bp, Homo sapiens
gcttccaagcggtagatagcat

SEQ ID NO: 7174894 - DNA, 22 bp, Homo sapiens
gcttccaagtcaatcaatgctg

SEQ ID NO: 7174895 - DNA, 22 bp, Homo sapiens
gcttccacctactaaatgccac

SEQ ID NO: 7174896 - DNA, 22 bp, Homo sapiens
gcttccacctactaaatgccac

SEQ ID NO: 7174897 - DNA, 22 bp, Homo sapiens
gctgtgcagccaagtgcctctg

SEQ ID NO: 7174898 - DNA, 22 bp, Homo sapiens
gctgtgcagccaagtgcctctg

SEQ ID NO: 7174899 - DNA, 22 bp, Homo sapiens
gctgtgcagccaagtgcctctg

SEQ ID NO: 7174900 - DNA, 22 bp, Homo sapiens
gctgtgcaggtccccactgcct

SEQ ID NO: 7174901 - DNA, 22 bp, Homo sapiens
gctgtgcaggtccccactgcct

SEQ ID NO: 7174902 - DNA, 21 bp, Homo sapiens
gctgtgcaggtgcccctgctc

SEQ ID NO: 7174903 - DNA, 22 bp, Homo sapiens
gctgtgcatcttcattctggac

SEQ ID NO: 7174904 - DNA, 22 bp, Homo sapiens
gctgtgcattgagcctgagagt

SEQ ID NO: 7174905 - DNA, 22 bp, Homo sapiens
gctgtgcccagccattctagat

SEQ ID NO: 7174906 - DNA, 22 bp, Homo sapiens
gctgtgcccagctccagctctg

SEQ ID NO: 7174907 - DNA, 22 bp, Homo sapiens
gctgtgcccatattctgctgac

SEQ ID NO: 7174908 - DNA, 22 bp, Homo sapiens
gctgtgagccgctgctgagcat

SEQ ID NO: 7174909 - DNA, 22 bp, Homo sapiens
gctgtgagccgctgctgagcat

SEQ ID NO: 7174910 - DNA, 22 bp, Homo sapiens
gctgtgagctgcctgtgtcaca

SEQ ID NO: 7174911 - DNA, 22 bp, Homo sapiens
gctgtgagcactgctgggtgga

SEQ ID NO: 7174912 - DNA, 22 bp, Homo sapiens
gctgtgagccgctgctgagcat

SEQ ID NO: 7174913 - DNA, 22 bp, Homo sapiens
gctgtgagcactgctgggtgga

SEQ ID NO: 7174914 - DNA, 22 bp, Homo sapiens
gctgtcttggaaaaggcaaaga

SEQ ID NO: 7174915 - DNA, 22 bp, Homo sapiens
gctgtcttgctcactcttgcag

SEQ ID NO: 7174916 - DNA, 22 bp, Homo sapiens
gctgtctttcccctgctccaga

SEQ ID NO: 7174917 - DNA, 22 bp, Homo sapiens
gctgtgagggcttctgaggcat

SEQ ID NO: 7174918 - DNA, 22 bp, Homo sapiens
gctgtgagggtctagtgaggtg

SEQ ID NO: 7174919 - DNA, 22 bp, Homo sapiens
gctgtgagtacaaggccctggg

SEQ ID NO: 7174920 - DNA, 22 bp, Homo sapiens
gctgtgagtgagctgcctaggc

SEQ ID NO: 7174921 - DNA, 22 bp, Homo sapiens
gctgtgagtggaggaggctgag

SEQ ID NO: 7174922 - DNA, 22 bp, Homo sapiens
gctgtgagtggaggaggctgag

SEQ ID NO: 7174923 - DNA, 22 bp, Homo sapiens
gctgtgagtggagttctgtgct

SEQ ID NO: 7174924 - DNA, 22 bp, Homo sapiens
gctgtgattgtcagtcttcaat

SEQ ID NO: 7174925 - DNA, 22 bp, Homo sapiens
gctgtgcaaatcgatttgttgg

SEQ ID NO: 7174926 - DNA, 22 bp, Homo sapiens
gctgtgcactacctatacatcc

SEQ ID NO: 7174927 - DNA, 22 bp, Homo sapiens
gctgtgcagagcacagggtccc

SEQ ID NO: 7174928 - DNA, 21 bp, Homo sapiens
gctgtgcagaggatggagtgg

SEQ ID NO: 7174929 - DNA, 22 bp, Homo sapiens
gctggctctgcacccaggcctc

SEQ ID NO: 7174930 - DNA, 22 bp, Homo sapiens
gctggctctgatgggctccagg

SEQ ID NO: 7174931 - DNA, 22 bp, Homo sapiens
gctggctctgccccacctgttc

SEQ ID NO: 7174932 - DNA, 22 bp, Homo sapiens
gctggctcttcagtggagatag

SEQ ID NO: 7174933 - DNA, 21 bp, Homo sapiens
gctggctctctgacgtgcttt

SEQ ID NO: 7174934 - DNA, 22 bp, Homo sapiens
gctggctcgggaagcaggggat

SEQ ID NO: 7174935 - DNA, 22 bp, Homo sapiens
gctggctcgggaagcaggggat

SEQ ID NO: 7174936 - DNA, 22 bp, Homo sapiens
gctggctcgggaagcaggggat

SEQ ID NO: 7174937 - DNA, 22 bp, Homo sapiens
gctggctcgggaagcaggggat

SEQ ID NO: 7174938 - DNA, 22 bp, Homo sapiens
gctggctgcacaggggctcact

SEQ ID NO: 7174939 - DNA, 22 bp, Homo sapiens
gctggctgcacaggggctcact

SEQ ID NO: 7174940 - DNA, 22 bp, Homo sapiens
gctggctgcacaggggctcact

SEQ ID NO: 7174941 - DNA, 22 bp, Homo sapiens
gctggctgcagattttagaggt

SEQ ID NO: 7174942 - DNA, 22 bp, Homo sapiens
gctggctgccaatttcagagct

SEQ ID NO: 7174943 - DNA, 22 bp, Homo sapiens
gctggctgccttactttgtgga

SEQ ID NO: 7174944 - DNA, 22 bp, Homo sapiens
gctgggaaccatgggaaggcag

SEQ ID NO: 7174945 - DNA, 22 bp, Homo sapiens
gctgggaaccatgggaaggcag

SEQ ID NO: 7174946 - DNA, 22 bp, Homo sapiens
gctgggaagtggcagagctgga

SEQ ID NO: 7174947 - DNA, 22 bp, Homo sapiens
gctgggaagtggcagagctgga

SEQ ID NO: 7174948 - DNA, 22 bp, Homo sapiens
gctgggaagtgcaagatcaagg

SEQ ID NO: 7174949 - DNA, 22 bp, Homo sapiens
gctgggaagtggcagagctgga

SEQ ID NO: 7174950 - DNA, 22 bp, Homo sapiens
gctgggaagtgcaagatcaagg

SEQ ID NO: 7174951 - DNA, 22 bp, Homo sapiens
gctgggaagtgcaagatcaagg

SEQ ID NO: 7174952 - DNA, 22 bp, Homo sapiens
gctgggaagaacaggagagaat

SEQ ID NO: 7174953 - DNA, 22 bp, Homo sapiens
gctgggaagaacaggagagaat

SEQ ID NO: 7174954 - DNA, 22 bp, Homo sapiens
gctgggaagaacaggagagaat

SEQ ID NO: 7174955 - DNA, 22 bp, Homo sapiens
gctgggaagaacaggagagaat

SEQ ID NO: 7174956 - DNA, 22 bp, Homo sapiens
gctgggaagagatgcacatgat

SEQ ID NO: 7174957 - DNA, 22 bp, Homo sapiens
gctgggaagagatgcacatgat

SEQ ID NO: 7174958 - DNA, 22 bp, Homo sapiens
gctgggaaccatgggaaggcag

SEQ ID NO: 7174959 - DNA, 22 bp, Homo sapiens
gctgggaatgattttggagagg

SEQ ID NO: 7174960 - DNA, 22 bp, Homo sapiens
gctgggaatgattttggagagg

SEQ ID NO: 7174961 - DNA, 22 bp, Homo sapiens
gctgggaatgattttggagagg

SEQ ID NO: 7174962 - DNA, 22 bp, Homo sapiens
gctgggaatgattttggagagg

SEQ ID NO: 7174963 - DNA, 22 bp, Homo sapiens
gctgggacaacaggtgagcacc

SEQ ID NO: 7174964 - DNA, 22 bp, Homo sapiens
gctgggacaggcttggccctgt

SEQ ID NO: 7174965 - DNA, 22 bp, Homo sapiens
gctgggacaggcttggccctgt

SEQ ID NO: 7174966 - DNA, 22 bp, Homo sapiens
gctgggacaggcttggccctgt

SEQ ID NO: 7174967 - DNA, 22 bp, Homo sapiens
gctgggactgagacagtgacct

SEQ ID NO: 7174968 - DNA, 22 bp, Homo sapiens
gctgggactgagacagtgacct

SEQ ID NO: 7174969 - DNA, 22 bp, Homo sapiens
gctgggagaggccctgaagtga

SEQ ID NO: 7174970 - DNA, 22 bp, Homo sapiens
gctgggagaggcagctttcgga

SEQ ID NO: 7174971 - DNA, 22 bp, Homo sapiens
gctgggagacagacttggaacc

SEQ ID NO: 7174972 - DNA, 22 bp, Homo sapiens
gctgggagaggccctgaagtga

SEQ ID NO: 7174973 - DNA, 22 bp, Homo sapiens
gctgggagaggccctgaagtga

SEQ ID NO: 7174974 - DNA, 22 bp, Homo sapiens
gctgggagacagacttggaacc

SEQ ID NO: 7174975 - DNA, 22 bp, Homo sapiens
gctgggagacagacttggaacc

SEQ ID NO: 7174976 - DNA, 22 bp, Homo sapiens
gctgggagacagacttggaacc

SEQ ID NO: 7174977 - DNA, 22 bp, Homo sapiens
gctgggagcaaagccatgcata

SEQ ID NO: 7174978 - DNA, 22 bp, Homo sapiens
gctgggagcaaagccatgcata

SEQ ID NO: 7174979 - DNA, 22 bp, Homo sapiens
gctgggaggatctctccctgtc

SEQ ID NO: 7174980 - DNA, 22 bp, Homo sapiens
gctgggaggatctctccctgtc

SEQ ID NO: 7174981 - DNA, 22 bp, Homo sapiens
gctgggaggatctctccctgtc

SEQ ID NO: 7174982 - DNA, 22 bp, Homo sapiens
gctggcagacttcctctggaac

SEQ ID NO: 7174983 - DNA, 22 bp, Homo sapiens
gctggcagacttcctctggaac

SEQ ID NO: 7174984 - DNA, 22 bp, Homo sapiens
gctggcagactgggggcagaac

SEQ ID NO: 7174985 - DNA, 22 bp, Homo sapiens
gctggcagacttcctctggaac

SEQ ID NO: 7174986 - DNA, 22 bp, Homo sapiens
gctggcagacttcctctggaac

SEQ ID NO: 7174987 - DNA, 22 bp, Homo sapiens
gctggcagactgggggcagaac

SEQ ID NO: 7174988 - DNA, 22 bp, Homo sapiens
gctggcagacttcctctggaac

SEQ ID NO: 7174989 - DNA, 22 bp, Homo sapiens
gctggcagactgggggcagaac

SEQ ID NO: 7174990 - DNA, 22 bp, Homo sapiens
gctggcagactgggggcagaac

SEQ ID NO: 7174991 - DNA, 19 bp, Homo sapiens
gctggcagaattttgaacc

SEQ ID NO: 7174992 - DNA, 22 bp, Homo sapiens
gctggcagactgggggcagaac

SEQ ID NO: 7174993 - DNA, 22 bp, Homo sapiens
gctggcagactgggggcagaac

SEQ ID NO: 7174994 - DNA, 22 bp, Homo sapiens
gctggcagactgggggcagaac

SEQ ID NO: 7174995 - DNA, 22 bp, Homo sapiens
gctggcagaatttcttcttgct

SEQ ID NO: 7174996 - DNA, 19 bp, Homo sapiens
gctggcagaattttgaacc

SEQ ID NO: 7174997 - DNA, 22 bp, Homo sapiens
gctggcagaagagctggttcaa

SEQ ID NO: 7174998 - DNA, 22 bp, Homo sapiens
gctggcagaagagctggttcaa

SEQ ID NO: 7174999 - DNA, 22 bp, Homo sapiens
gctggcagaagagctggttcaa

SEQ ID NO: 7175000 - DNA, 22 bp, Homo sapiens
gctggcagaagagctggttcaa

SEQ ID NO: 7175001 - DNA, 22 bp, Homo sapiens
gctggcagaatttcttcttgct

SEQ ID NO: 7175002 - DNA, 22 bp, Homo sapiens
gctggcagaatttcttcttgct

SEQ ID NO: 7175003 - DNA, 22 bp, Homo sapiens
gctggcagaagagctggttcaa

SEQ ID NO: 7175004 - DNA, 22 bp, Homo sapiens
gctggcagaatttcttcttgct

SEQ ID NO: 7175005 - DNA, 22 bp, Homo sapiens
gctggcactgggaaggactgag

SEQ ID NO: 7175006 - DNA, 19 bp, Homo sapiens
gctggcacttcaagggagc

SEQ ID NO: 7175007 - DNA, 22 bp, Homo sapiens
gctggcacctgcaccaagcagg

SEQ ID NO: 7175008 - DNA, 22 bp, Homo sapiens
gctggcacatggctcagggcct

SEQ ID NO: 7175009 - DNA, 22 bp, Homo sapiens
gctggcacatggctcagggcct

SEQ ID NO: 7175010 - DNA, 22 bp, Homo sapiens
gctggcacctatttggacctgg

SEQ ID NO: 7175011 - DNA, 22 bp, Homo sapiens
gctggcaatggtgtggtctggt

SEQ ID NO: 7175012 - DNA, 19 bp, Homo sapiens
gctggatggatcctggagt

SEQ ID NO: 7175013 - DNA, 22 bp, Homo sapiens
gctgcccaatggtagtgtcttt

SEQ ID NO: 7175014 - DNA, 21 bp, Homo sapiens
gctgcccaaccctgcatctcc

SEQ ID NO: 7175015 - DNA, 21 bp, Homo sapiens
gctgcccaaccctgcatctcc

SEQ ID NO: 7175016 - DNA, 22 bp, Homo sapiens
gctgccatgccacagcactcac

SEQ ID NO: 7175017 - DNA, 22 bp, Homo sapiens
gctgccatggcctcctgcaagg

SEQ ID NO: 7175018 - DNA, 21 bp, Homo sapiens
gctgcccaaccctgcatctcc

SEQ ID NO: 7175019 - DNA, 22 bp, Homo sapiens
gctggctcagggactagagttt

SEQ ID NO: 7175020 - DNA, 22 bp, Homo sapiens
gctggctcagggggattagcaa

SEQ ID NO: 7175021 - DNA, 22 bp, Homo sapiens
gctggctcagggactagagttt

SEQ ID NO: 7175022 - DNA, 22 bp, Homo sapiens
gctggctccaaaagcaggggct

SEQ ID NO: 7175023 - DNA, 22 bp, Homo sapiens
gctggctccaaaagcaggggct

SEQ ID NO: 7175024 - DNA, 22 bp, Homo sapiens
gctggctccaaaagcaggggct

SEQ ID NO: 7175025 - DNA, 22 bp, Homo sapiens
gctggctccaaaagcaggggct

SEQ ID NO: 7175026 - DNA, 22 bp, Homo sapiens
gctggcagggtggttgagagag

SEQ ID NO: 7175027 - DNA, 22 bp, Homo sapiens
gctggctcaagaggtccagagg

SEQ ID NO: 7175028 - DNA, 22 bp, Homo sapiens
gctggcagggacagctgcgtgt

SEQ ID NO: 7175029 - DNA, 22 bp, Homo sapiens
gctggcagggacagctgcgtgt

SEQ ID NO: 7175030 - DNA, 22 bp, Homo sapiens
gctggcagggacagctgcgtgt

SEQ ID NO: 7175031 - DNA, 22 bp, Homo sapiens
gctggcagggacagctgcgtgt

SEQ ID NO: 7175032 - DNA, 22 bp, Homo sapiens
gctggcagggacagctgcgtgt

SEQ ID NO: 7175033 - DNA, 22 bp, Homo sapiens
gctggcaggagcctttcccttt

SEQ ID NO: 7175034 - DNA, 22 bp, Homo sapiens
gctggcaggataacttctaagc

SEQ ID NO: 7175035 - DNA, 22 bp, Homo sapiens
gctggcaggataacttctaagc

SEQ ID NO: 7175036 - DNA, 22 bp, Homo sapiens
gctggcaggatagaagtctaat

SEQ ID NO: 7175037 - DNA, 22 bp, Homo sapiens
gctggcaggatagaagtctaat

SEQ ID NO: 7175038 - DNA, 22 bp, Homo sapiens
gctggcaggagaaacggggtgc

SEQ ID NO: 7175039 - DNA, 22 bp, Homo sapiens
gctggcaggagaaacggggtgc

SEQ ID NO: 7175040 - DNA, 22 bp, Homo sapiens
gctggcaggagaccatacccta

SEQ ID NO: 7175041 - DNA, 22 bp, Homo sapiens
gctggcaggagaccatacccta

SEQ ID NO: 7175042 - DNA, 22 bp, Homo sapiens
gctggcaggagaccatacccta

SEQ ID NO: 7175043 - DNA, 22 bp, Homo sapiens
gctggcaggagaccatacccta

SEQ ID NO: 7175044 - DNA, 22 bp, Homo sapiens
gctggcaggagcctttcccttt

SEQ ID NO: 7175045 - DNA, 22 bp, Homo sapiens
gctggcaggagcctttcccttt

SEQ ID NO: 7175046 - DNA, 22 bp, Homo sapiens
gctggcagagacaagaagacta

SEQ ID NO: 7175047 - DNA, 22 bp, Homo sapiens
gctggcagagacaagaagacta

SEQ ID NO: 7175048 - DNA, 22 bp, Homo sapiens
gctggcagagacaagaagacta

SEQ ID NO: 7175049 - DNA, 22 bp, Homo sapiens
gctggcagagacaagaagacta

SEQ ID NO: 7175050 - DNA, 22 bp, Homo sapiens
gctggcagagacaagaagacta

SEQ ID NO: 7175051 - DNA, 22 bp, Homo sapiens
gctggcagagagctggtgagga

SEQ ID NO: 7175052 - DNA, 22 bp, Homo sapiens
gctggcagagagctggtgagga

SEQ ID NO: 7175053 - DNA, 22 bp, Homo sapiens
gctggcagctggaagttgggct

SEQ ID NO: 7175054 - DNA, 22 bp, Homo sapiens
gctggcagctggaagttgggct

SEQ ID NO: 7175055 - DNA, 22 bp, Homo sapiens
gctggcagctggaagttgggct

SEQ ID NO: 7175056 - DNA, 22 bp, Homo sapiens
gctggcagctggaagttgggct

SEQ ID NO: 7175057 - DNA, 22 bp, Homo sapiens
gctggcaggagaaacggggtgc

SEQ ID NO: 7175058 - DNA, 22 bp, Homo sapiens
gctggcaggagaaacggggtgc

SEQ ID NO: 7175059 - DNA, 17 bp, Homo sapiens
gcctactcctatactcc

SEQ ID NO: 7175060 - DNA, 22 bp, Homo sapiens
gcctactgagaccacagacagt

SEQ ID NO: 7175061 - DNA, 22 bp, Homo sapiens
gcctacagttggctgagggcct

SEQ ID NO: 7175062 - DNA, 22 bp, Homo sapiens
gcctacatttcccagttgaatg

SEQ ID NO: 7175063 - DNA, 22 bp, Homo sapiens
gcctagcattgatcagcctgct

SEQ ID NO: 7175064 - DNA, 22 bp, Homo sapiens
gcctagcattgatcagcctgct

SEQ ID NO: 7175065 - DNA, 22 bp, Homo sapiens
gcctcagagctacacacacgca

SEQ ID NO: 7175066 - DNA, 22 bp, Homo sapiens
gcctcagagctacacacacgca

SEQ ID NO: 7175067 - DNA, 23 bp, Homo sapiens
gcctcagagaaacagctgcacac

SEQ ID NO: 7175068 - DNA, 22 bp, Homo sapiens
gcctcagaaagtggcaggtagg

SEQ ID NO: 7175069 - DNA, 22 bp, Homo sapiens
gcctcagaaagtggcaggtagg

SEQ ID NO: 7175070 - DNA, 22 bp, Homo sapiens
gccctgagggtctgggttccca

SEQ ID NO: 7175071 - DNA, 22 bp, Homo sapiens
gccctgagggacctcaccccat

SEQ ID NO: 7175072 - DNA, 22 bp, Homo sapiens
gccctgaggggtggtgtctgta

SEQ ID NO: 7175073 - DNA, 22 bp, Homo sapiens
gccctgaggggtggtgtctgta

SEQ ID NO: 7175074 - DNA, 22 bp, Homo sapiens
gccctgaggggtggtgtctgta

SEQ ID NO: 7175075 - DNA, 22 bp, Homo sapiens
gccctgagggtctgggttccca

SEQ ID NO: 7175076 - DNA, 19 bp, Homo sapiens
gccctgagtaagctaggag

SEQ ID NO: 7175077 - DNA, 19 bp, Homo sapiens
gccctgagtaagctaggag

SEQ ID NO: 7175078 - DNA, 22 bp, Homo sapiens
gcctaagactgaggcttttgtc

SEQ ID NO: 7175079 - DNA, 22 bp, Homo sapiens
gcctaagattgtgttttcctga

SEQ ID NO: 7175080 - DNA, 22 bp, Homo sapiens
gcctcagctgttgcaggggccc

SEQ ID NO: 7175081 - DNA, 22 bp, Homo sapiens
gcctcaggactggcatactcat

SEQ ID NO: 7175082 - DNA, 22 bp, Homo sapiens
gcctcaggccgccctgctgctc

SEQ ID NO: 7175083 - DNA, 22 bp, Homo sapiens
gcctcaggccgccctgctgctc

SEQ ID NO: 7175084 - DNA, 22 bp, Homo sapiens
gcctcagctcccagcccaggct

SEQ ID NO: 7175085 - DNA, 22 bp, Homo sapiens
gcctcagctgttgcaggggccc

SEQ ID NO: 7175086 - DNA, 22 bp, Homo sapiens
gcctcagctcccagcccaggct

SEQ ID NO: 7175087 - DNA, 22 bp, Homo sapiens
gcctcagctcccagcccaggct

SEQ ID NO: 7175088 - DNA, 22 bp, Homo sapiens
gcctcagagggccctagggaca

SEQ ID NO: 7175089 - DNA, 22 bp, Homo sapiens
gcctcagagggccctagggaca

SEQ ID NO: 7175090 - DNA, 20 bp, Homo sapiens
gcctcagccaacccatgggg

SEQ ID NO: 7175091 - DNA, 20 bp, Homo sapiens
gcctcagccaacccatgggg

SEQ ID NO: 7175092 - DNA, 22 bp, Homo sapiens
gcctcagccggcggacgccagg

SEQ ID NO: 7175093 - DNA, 22 bp, Homo sapiens
gcctcagccggcggacgccagg

SEQ ID NO: 7175094 - DNA, 22 bp, Homo sapiens
gcctcagccggcggacgccagg

SEQ ID NO: 7175095 - DNA, 22 bp, Homo sapiens
gcctcagctcccagcccaggct

SEQ ID NO: 7175096 - DNA, 22 bp, Homo sapiens
gccctgaggcaaaagaacagtc

SEQ ID NO: 7175097 - DNA, 22 bp, Homo sapiens
gccctgaggcaaaagaacagtc

SEQ ID NO: 7175098 - DNA, 22 bp, Homo sapiens
gccctgaggatttgcatttcct

SEQ ID NO: 7175099 - DNA, 22 bp, Homo sapiens
gccctgagctagtgtgggcagg

SEQ ID NO: 7175100 - DNA, 22 bp, Homo sapiens
gccctgagctagtgtgggcagg

SEQ ID NO: 7175101 - DNA, 22 bp, Homo sapiens
gccctgagcctatgagcctctc

SEQ ID NO: 7175102 - DNA, 22 bp, Homo sapiens
gccctgagcctatgagcctctc

SEQ ID NO: 7175103 - DNA, 22 bp, Homo sapiens
gccctgagcctatgagcctctc

SEQ ID NO: 7175104 - DNA, 22 bp, Homo sapiens
gccctgagccaccaatgccatt

SEQ ID NO: 7175105 - DNA, 22 bp, Homo sapiens
gccctgagcactgctgctgggg

SEQ ID NO: 7175106 - DNA, 22 bp, Homo sapiens
gccctgagcactgctgctgggg

SEQ ID NO: 7175107 - DNA, 22 bp, Homo sapiens
gccctgagcactgctgctgggg

SEQ ID NO: 7175108 - DNA, 22 bp, Homo sapiens
gccctgagcactgctgctgggg

SEQ ID NO: 7175109 - DNA, 22 bp, Homo sapiens
gccctgagcacacagtagcaaa

SEQ ID NO: 7175110 - DNA, 22 bp, Homo sapiens
gccctgagcacacagtagcaaa

SEQ ID NO: 7175111 - DNA, 22 bp, Homo sapiens
gccctgagattcttggattctg

SEQ ID NO: 7175112 - DNA, 22 bp, Homo sapiens
gccctgagaggcaatgactctt

SEQ ID NO: 7175113 - DNA, 22 bp, Homo sapiens
gccctgagaggcaatgactctt

SEQ ID NO: 7175114 - DNA, 22 bp, Homo sapiens
gccctgaacgaggggtctggag

SEQ ID NO: 7175115 - DNA, 22 bp, Homo sapiens
gccctgaaggcagaggtggagc

SEQ ID NO: 7175116 - DNA, 22 bp, Homo sapiens
gccctgaaggcagaggtggagc

SEQ ID NO: 7175117 - DNA, 22 bp, Homo sapiens
gccctgaataatagagtgggga

SEQ ID NO: 7175118 - DNA, 22 bp, Homo sapiens
gccctgaattcctcaggctgtg

SEQ ID NO: 7175119 - DNA, 22 bp, Homo sapiens
gccctgaattcctcaggctgtg

SEQ ID NO: 7175120 - DNA, 22 bp, Homo sapiens
gccctgacactttgcagctgag

SEQ ID NO: 7175121 - DNA, 22 bp, Homo sapiens
gccctgaccttcactgactctc

SEQ ID NO: 7175122 - DNA, 19 bp, Homo sapiens
gccctgaccttggctgctc

SEQ ID NO: 7175123 - DNA, 19 bp, Homo sapiens
gccctgagagcttgggttc

SEQ ID NO: 7175124 - DNA, 19 bp, Homo sapiens
gccctgagagcttgggttc

SEQ ID NO: 7175125 - DNA, 22 bp, Homo sapiens
gccctgagactgagcatgggtt

SEQ ID NO: 7175126 - DNA, 22 bp, Homo sapiens
gccctgagactgaagaactgtc

SEQ ID NO: 7175127 - DNA, 22 bp, Homo sapiens
gccctgagactgagcatgggtt

SEQ ID NO: 7175128 - DNA, 22 bp, Homo sapiens
gccctgagactgagcatgggtt

SEQ ID NO: 7175129 - DNA, 22 bp, Homo sapiens
gccctgagactgagcatgggtt

SEQ ID NO: 7175130 - DNA, 22 bp, Homo sapiens
gccctgagaatgtgtgtgtcta

SEQ ID NO: 7175131 - DNA, 22 bp, Homo sapiens
gccctgagaagaagtcggaggg

SEQ ID NO: 7175132 - DNA, 22 bp, Homo sapiens
gccctgagaagaagtcggaggg

SEQ ID NO: 7175133 - DNA, 22 bp, Homo sapiens
gccctgagactgaagaactgtc

SEQ ID NO: 7175134 - DNA, 22 bp, Homo sapiens
gccctgagaatgtgtgtgtcta

SEQ ID NO: 7175135 - DNA, 22 bp, Homo sapiens
gcccagggcgatggtcggggcc

SEQ ID NO: 7175136 - DNA, 22 bp, Homo sapiens
gcccagggcgatggtcggggcc

SEQ ID NO: 7175137 - DNA, 22 bp, Homo sapiens
gcccagggcgatggtcggggcc

SEQ ID NO: 7175138 - DNA, 22 bp, Homo sapiens
gcccagggctgcaagtggacgc

SEQ ID NO: 7175139 - DNA, 22 bp, Homo sapiens
gcccagggcgatggtcggggcc

SEQ ID NO: 7175140 - DNA, 22 bp, Homo sapiens
gcccagggctgcaagtggacgc

SEQ ID NO: 7175141 - DNA, 22 bp, Homo sapiens
gcccagggctgcaagtggacgc

SEQ ID NO: 7175142 - DNA, 22 bp, Homo sapiens
gcccagggcagggcaagagtga

SEQ ID NO: 7175143 - DNA, 22 bp, Homo sapiens
gcccagggcagggcaagagtga

SEQ ID NO: 7175144 - DNA, 22 bp, Homo sapiens
gcccagggcagggcaagagtga

SEQ ID NO: 7175145 - DNA, 23 bp, Homo sapiens
gcccagggactgggaatcagtgg

SEQ ID NO: 7175146 - DNA, 23 bp, Homo sapiens
gcccagggactgggaatcagtgg

SEQ ID NO: 7175147 - DNA, 22 bp, Homo sapiens
gcccaggctggagttcagtggt

SEQ ID NO: 7175148 - DNA, 22 bp, Homo sapiens
gcccaggctggagttcagtggt

SEQ ID NO: 7175149 - DNA, 22 bp, Homo sapiens
gcccagagttcaaggctgcagt

SEQ ID NO: 7175150 - DNA, 22 bp, Homo sapiens
gcccagagttcaaggctgcagt

SEQ ID NO: 7175151 - DNA, 22 bp, Homo sapiens
gcccagagtttgaagatacagt

SEQ ID NO: 7175152 - DNA, 21 bp, Homo sapiens
gcccagagttaagcccaccca

SEQ ID NO: 7175153 - DNA, 22 bp, Homo sapiens
gcccagagttcaaggctgcagt

SEQ ID NO: 7175154 - DNA, 22 bp, Homo sapiens
gcccagagttcaaggctgcagt

SEQ ID NO: 7175155 - DNA, 22 bp, Homo sapiens
gcccagagttcaaggctgcagt

SEQ ID NO: 7175156 - DNA, 22 bp, Homo sapiens
gcccagagttcaaggctgcagt

SEQ ID NO: 7175157 - DNA, 22 bp, Homo sapiens
gcccagagttcaaggctgcagt

SEQ ID NO: 7175158 - DNA, 22 bp, Homo sapiens
gcccagcaactgcacccttctt

SEQ ID NO: 7175159 - DNA, 22 bp, Homo sapiens
gcccagagtttgaagatacagt

SEQ ID NO: 7175160 - DNA, 22 bp, Homo sapiens
gcccagcaaggaccaagggccg

SEQ ID NO: 7175161 - DNA, 22 bp, Homo sapiens
gcccagcaaggaccaagggccg

SEQ ID NO: 7175162 - DNA, 22 bp, Homo sapiens
gcccagcaaggaccaagggccg

SEQ ID NO: 7175163 - DNA, 22 bp, Homo sapiens
gcccagcaaggaccaagggccg

SEQ ID NO: 7175164 - DNA, 22 bp, Homo sapiens
gcccaggctggagtgcagtggt

SEQ ID NO: 7175165 - DNA, 22 bp, Homo sapiens
gcccaggctggagtgcagtggt

SEQ ID NO: 7175166 - DNA, 22 bp, Homo sapiens
gcccaggctggagtgcagtggt

SEQ ID NO: 7175167 - DNA, 22 bp, Homo sapiens
gcccaggctggagtgcagtggt

SEQ ID NO: 7175168 - DNA, 22 bp, Homo sapiens
gcccagtggtaaaagcaggcct

SEQ ID NO: 7175169 - DNA, 19 bp, Homo sapiens
gcccaggggcccgatgctg

SEQ ID NO: 7175170 - DNA, 22 bp, Homo sapiens
gcccagtggtaaaagcaggcct

SEQ ID NO: 7175171 - DNA, 22 bp, Homo sapiens
gcccatcttctagcagctgtta

SEQ ID NO: 7175172 - DNA, 22 bp, Homo sapiens
gcccatccatggggtcatggcc

SEQ ID NO: 7175173 - DNA, 22 bp, Homo sapiens
gcccaggggcagcgcatagtgg

SEQ ID NO: 7175174 - DNA, 22 bp, Homo sapiens
gcccaggggcagcgcatagtgg

SEQ ID NO: 7175175 - DNA, 22 bp, Homo sapiens
gcccaggggagtagtcaattta

SEQ ID NO: 7175176 - DNA, 22 bp, Homo sapiens
gcccagggcttcaaagagagaa

SEQ ID NO: 7175177 - DNA, 22 bp, Homo sapiens
gcccagggcttcaaagagagaa

SEQ ID NO: 7175178 - DNA, 23 bp, Homo sapiens
gcccatgctgttgggcccgagca

SEQ ID NO: 7175179 - DNA, 20 bp, Homo sapiens
gcccatgaggactgcagctg

SEQ ID NO: 7175180 - DNA, 20 bp, Homo sapiens
gcccatgaggactgcagctg

SEQ ID NO: 7175181 - DNA, 22 bp, Homo sapiens
gcccatgaggtggaggctgcag

SEQ ID NO: 7175182 - DNA, 22 bp, Homo sapiens
gcccatgcactttctgtgatgg

SEQ ID NO: 7175183 - DNA, 22 bp, Homo sapiens
gcccatgcccctccttctggca

SEQ ID NO: 7175184 - DNA, 22 bp, Homo sapiens
gcccatgcccctccttctggca

SEQ ID NO: 7175185 - DNA, 22 bp, Homo sapiens
gcccatgcccctccttctggca

SEQ ID NO: 7175186 - DNA, 22 bp, Homo sapiens
gcccatgctctcaggcgggcct

SEQ ID NO: 7175187 - DNA, 22 bp, Homo sapiens
gccctctgttattgcatcctta

SEQ ID NO: 7175188 - DNA, 22 bp, Homo sapiens
gccctctggtgggtgagccccg

SEQ ID NO: 7175189 - DNA, 22 bp, Homo sapiens
gccctctggtgggtgagccccg

SEQ ID NO: 7175190 - DNA, 22 bp, Homo sapiens
gccctctggggcacacagagga

SEQ ID NO: 7175191 - DNA, 22 bp, Homo sapiens
gccaggaggctgctgtgtaggc

SEQ ID NO: 7175192 - DNA, 22 bp, Homo sapiens
gccaggagtgtgtggctatgtt

SEQ ID NO: 7175193 - DNA, 22 bp, Homo sapiens
gccaggagccctgggcaagttc

SEQ ID NO: 7175194 - DNA, 22 bp, Homo sapiens
gccaggagccctgggcaagttc

SEQ ID NO: 7175195 - DNA, 22 bp, Homo sapiens
gccaggagccctgggcaagttc

SEQ ID NO: 7175196 - DNA, 22 bp, Homo sapiens
gccaggagagctccttcaggtt

SEQ ID NO: 7175197 - DNA, 22 bp, Homo sapiens
gccaggagactccattcatttg

SEQ ID NO: 7175198 - DNA, 22 bp, Homo sapiens
gccaggagagctccttcaggtt

SEQ ID NO: 7175199 - DNA, 22 bp, Homo sapiens
gccaggagaaaaggcgaatgat

SEQ ID NO: 7175200 - DNA, 22 bp, Homo sapiens
gccaggagaaaaggcgaatgat

SEQ ID NO: 7175201 - DNA, 22 bp, Homo sapiens
gccaggagaaaaggcgaatgat

SEQ ID NO: 7175202 - DNA, 22 bp, Homo sapiens
gccaggacctcagatgcagggc

SEQ ID NO: 7175203 - DNA, 22 bp, Homo sapiens
gccaggacctcccagagctttc

SEQ ID NO: 7175204 - DNA, 22 bp, Homo sapiens
gccaggactcttcctagaaggt

SEQ ID NO: 7175205 - DNA, 22 bp, Homo sapiens
gccagccccttagggctctccc

SEQ ID NO: 7175206 - DNA, 22 bp, Homo sapiens
gccagccccttagggctctccc

SEQ ID NO: 7175207 - DNA, 22 bp, Homo sapiens
gccaggaatggagaggtggcct

SEQ ID NO: 7175208 - DNA, 22 bp, Homo sapiens
gccaggaatggagaggtggcct

SEQ ID NO: 7175209 - DNA, 22 bp, Homo sapiens
gccaggaatggagaggtggcct

SEQ ID NO: 7175210 - DNA, 22 bp, Homo sapiens
gccaggaatttcaagagccact

SEQ ID NO: 7175211 - DNA, 22 bp, Homo sapiens
gccaggaatttcaagagccact

SEQ ID NO: 7175212 - DNA, 19 bp, Homo sapiens
gccaggacatcctcctgct

SEQ ID NO: 7175213 - DNA, 19 bp, Homo sapiens
gccaggacatcctcctgct

SEQ ID NO: 7175214 - DNA, 22 bp, Homo sapiens
gccaggtgtcctcacagtgagg

SEQ ID NO: 7175215 - DNA, 22 bp, Homo sapiens
gccaggtgtcctcacagtgagg

SEQ ID NO: 7175216 - DNA, 22 bp, Homo sapiens
gccaggttctggggaggtacaa

SEQ ID NO: 7175217 - DNA, 22 bp, Homo sapiens
gccaggtgtagtggccacacct

SEQ ID NO: 7175218 - DNA, 22 bp, Homo sapiens
gccaggtgtagtggccacacct

SEQ ID NO: 7175219 - DNA, 22 bp, Homo sapiens
gccaggtgtagtggccacacct

SEQ ID NO: 7175220 - DNA, 22 bp, Homo sapiens
gccaggtgtagtggccacacct

SEQ ID NO: 7175221 - DNA, 22 bp, Homo sapiens
gccaggtggtctggctccagag

SEQ ID NO: 7175222 - DNA, 22 bp, Homo sapiens
gccaggtggtctggctccagag

SEQ ID NO: 7175223 - DNA, 22 bp, Homo sapiens
gccaggtggtctggctccagag

SEQ ID NO: 7175224 - DNA, 22 bp, Homo sapiens
gccaggtgggagacagacagca

SEQ ID NO: 7175225 - DNA, 22 bp, Homo sapiens
gccaggtggctgagtgactgag

SEQ ID NO: 7175226 - DNA, 22 bp, Homo sapiens
gccaggtgggagacagacagca

SEQ ID NO: 7175227 - DNA, 22 bp, Homo sapiens
gccaggtggctgagtgactgag

SEQ ID NO: 7175228 - DNA, 22 bp, Homo sapiens
gccaggtggctgagtgactgag

SEQ ID NO: 7175229 - DNA, 22 bp, Homo sapiens
gccaggtcccctcatggctcct

SEQ ID NO: 7175230 - DNA, 22 bp, Homo sapiens
gccaggtcgtctccatgtccaa

SEQ ID NO: 7175231 - DNA, 22 bp, Homo sapiens
gccaggtcgtctccatgtccaa

SEQ ID NO: 7175232 - DNA, 22 bp, Homo sapiens
gccaggtcgtctccatgtccaa

SEQ ID NO: 7175233 - DNA, 22 bp, Homo sapiens
gccaggtctaagcatcagccac

SEQ ID NO: 7175234 - DNA, 22 bp, Homo sapiens
gccaggtctcataaatgcagct

SEQ ID NO: 7175235 - DNA, 22 bp, Homo sapiens
gccaggtctgcaggcatcctga

SEQ ID NO: 7175236 - DNA, 22 bp, Homo sapiens
gccaggagttcagatgcatgtt

SEQ ID NO: 7175237 - DNA, 22 bp, Homo sapiens
gccaggagttcagatgcatgtt

SEQ ID NO: 7175238 - DNA, 22 bp, Homo sapiens
gccaggagttcagatgcatgtt

SEQ ID NO: 7175239 - DNA, 22 bp, Homo sapiens
gccaggagttcagatgcatgtt

SEQ ID NO: 7175240 - DNA, 22 bp, Homo sapiens
gccaggagttcagatgcatgtt

SEQ ID NO: 7175241 - DNA, 22 bp, Homo sapiens
gccaggatgactatacaacagc

SEQ ID NO: 7175242 - DNA, 22 bp, Homo sapiens
gccaggcaaattaaggaatgca

SEQ ID NO: 7175243 - DNA, 22 bp, Homo sapiens
gccaggcacagttctaggtgct

SEQ ID NO: 7175244 - DNA, 22 bp, Homo sapiens
gccaggcacagttctaggtgct

SEQ ID NO: 7175245 - DNA, 22 bp, Homo sapiens
gccaggcacagttctaggtgct

SEQ ID NO: 7175246 - DNA, 22 bp, Homo sapiens
gccaggcacagttctaggtgct

SEQ ID NO: 7175247 - DNA, 23 bp, Homo sapiens
gccaggcacatggtggacacgca

SEQ ID NO: 7175248 - DNA, 23 bp, Homo sapiens
gccaggcacatggtggacacgca

SEQ ID NO: 7175249 - DNA, 23 bp, Homo sapiens
gccaggcacatggtggacacgca

SEQ ID NO: 7175250 - DNA, 23 bp, Homo sapiens
gccaggcacatggtggacacgca

SEQ ID NO: 7175251 - DNA, 22 bp, Homo sapiens
gccaggtcccctcatggctcct

SEQ ID NO: 7175252 - DNA, 22 bp, Homo sapiens
gcccagagtgagtcctgggccc

SEQ ID NO: 7175253 - DNA, 22 bp, Homo sapiens
gcccagagtgagtcctgggccc

SEQ ID NO: 7175254 - DNA, 22 bp, Homo sapiens
gcccagagtgagtcctgggccc

SEQ ID NO: 7175255 - DNA, 18 bp, Homo sapiens
gcccagaggtctgggccc

SEQ ID NO: 7175256 - DNA, 18 bp, Homo sapiens
gcccagaggtctgggccc

SEQ ID NO: 7175257 - DNA, 21 bp, Homo sapiens
gcccagagtcctcccactcca

SEQ ID NO: 7175258 - DNA, 23 bp, Homo sapiens
gcccagagaggctcaccaggaat

SEQ ID NO: 7175259 - DNA, 23 bp, Homo sapiens
gcccagagaggctcaccaggaat

SEQ ID NO: 7175260 - DNA, 23 bp, Homo sapiens
gcccagagaggctcaccaggaat

SEQ ID NO: 7175261 - DNA, 18 bp, Homo sapiens
gcccagagccctcttatt

SEQ ID NO: 7175262 - DNA, 22 bp, Homo sapiens
gcccagagggaagaggtgtcat

SEQ ID NO: 7175263 - DNA, 22 bp, Homo sapiens
gcccagagggaagaggtgtcat

SEQ ID NO: 7175264 - DNA, 22 bp, Homo sapiens
gcccagagggaagaggtgtcat

SEQ ID NO: 7175265 - DNA, 22 bp, Homo sapiens
gcccagagggaagaggtgtcat

SEQ ID NO: 7175266 - DNA, 21 bp, Homo sapiens
gcccagagggagccaagccca

SEQ ID NO: 7175267 - DNA, 21 bp, Homo sapiens
gcccagagggagccaagccca

SEQ ID NO: 7175268 - DNA, 18 bp, Homo sapiens
gcccagaggtctgggccc

SEQ ID NO: 7175269 - DNA, 18 bp, Homo sapiens
gcccagaggtctgggccc

SEQ ID NO: 7175270 - DNA, 18 bp, Homo sapiens
gcccagaggtctgggccc

SEQ ID NO: 7175271 - DNA, 22 bp, Homo sapiens
gcccactggctggagtgctggt

SEQ ID NO: 7175272 - DNA, 22 bp, Homo sapiens
gcccactggctggagtgctggt

SEQ ID NO: 7175273 - DNA, 19 bp, Homo sapiens
gcccactgtctttgccaac

SEQ ID NO: 7175274 - DNA, 22 bp, Homo sapiens
gcccactttctgccagctcacc

SEQ ID NO: 7175275 - DNA, 22 bp, Homo sapiens
gcccactctggagcctgttccc

SEQ ID NO: 7175276 - DNA, 22 bp, Homo sapiens
gcccactctggagcctgttccc

SEQ ID NO: 7175277 - DNA, 22 bp, Homo sapiens
gcccactgagtgactccctcag

SEQ ID NO: 7175278 - DNA, 22 bp, Homo sapiens
gcccactggctggagtgctggt

SEQ ID NO: 7175279 - DNA, 22 bp, Homo sapiens
gcccagaaagactgcctaacag

SEQ ID NO: 7175280 - DNA, 22 bp, Homo sapiens
gcccagaaagactgcctaacag

SEQ ID NO: 7175281 - DNA, 22 bp, Homo sapiens
gcccagaaagcatcattgtgga

SEQ ID NO: 7175282 - DNA, 22 bp, Homo sapiens
gcccagaaagcatcattgtgga

SEQ ID NO: 7175283 - DNA, 22 bp, Homo sapiens
gcccagaaatgaacttgctgtg

SEQ ID NO: 7175284 - DNA, 22 bp, Homo sapiens
gcccagaacagtgtcacatgtc

SEQ ID NO: 7175285 - DNA, 22 bp, Homo sapiens
gcccagaacagtgtcacatgtc

SEQ ID NO: 7175286 - DNA, 21 bp, Homo sapiens
gcccagaagactggctctgcc

SEQ ID NO: 7175287 - DNA, 21 bp, Homo sapiens
gcccagaagactggctctgcc

SEQ ID NO: 7175288 - DNA, 22 bp, Homo sapiens
gcccagaagtgactcagcactg

SEQ ID NO: 7175289 - DNA, 22 bp, Homo sapiens
gcccagaagttgaggctgcagt

SEQ ID NO: 7175290 - DNA, 22 bp, Homo sapiens
gcccagaagttgaggctgcagt

SEQ ID NO: 7175291 - DNA, 22 bp, Homo sapiens
gcccagagagatgaagtgatgg

SEQ ID NO: 7175292 - DNA, 22 bp, Homo sapiens
gcccagagagatgaagtgatgg

SEQ ID NO: 7175293 - DNA, 22 bp, Homo sapiens
gcccagagagatgaagtgatgg

SEQ ID NO: 7175294 - DNA, 22 bp, Homo sapiens
gcccagagagatgctgtagacc

SEQ ID NO: 7175295 - DNA, 22 bp, Homo sapiens
gcccagagagatgctgtagacc

SEQ ID NO: 7175296 - DNA, 22 bp, Homo sapiens
gccaggttgctgacgacgatct

SEQ ID NO: 7175297 - DNA, 22 bp, Homo sapiens
gccagtaaaacaaaggccatgt

SEQ ID NO: 7175298 - DNA, 22 bp, Homo sapiens
gccagtaaaacaaaggccatgt

SEQ ID NO: 7175299 - DNA, 20 bp, Homo sapiens
gccagtaccattctgccact

SEQ ID NO: 7175300 - DNA, 22 bp, Homo sapiens
gccagtctgctcccacaagttc

SEQ ID NO: 7175301 - DNA, 22 bp, Homo sapiens
gccagtctgctcccacaagttc

SEQ ID NO: 7175302 - DNA, 22 bp, Homo sapiens
gccagtctgataggggagaagt

SEQ ID NO: 7175303 - DNA, 18 bp, Homo sapiens
gccagtcagtctttggta

SEQ ID NO: 7175304 - DNA, 22 bp, Homo sapiens
gccagtcagctggccaggctgg

SEQ ID NO: 7175305 - DNA, 22 bp, Homo sapiens
gccagtggagcacatggtgaag

SEQ ID NO: 7175306 - DNA, 22 bp, Homo sapiens
gccagtggagactgaaacccat

SEQ ID NO: 7175307 - DNA, 22 bp, Homo sapiens
gccagtggagcacatggtgaag

SEQ ID NO: 7175308 - DNA, 22 bp, Homo sapiens
gccagtgcttgtggagctggca

SEQ ID NO: 7175309 - DNA, 22 bp, Homo sapiens
gccagtgcttgtggagctggca

SEQ ID NO: 7175310 - DNA, 22 bp, Homo sapiens
gccagtgcttgtggagctggca

SEQ ID NO: 7175311 - DNA, 18 bp, Homo sapiens
gccagtgccctggctcac

SEQ ID NO: 7175312 - DNA, 18 bp, Homo sapiens
gccagtgccctggctcac

SEQ ID NO: 7175313 - DNA, 22 bp, Homo sapiens
gccagtgcctgctgctcagggc

SEQ ID NO: 7175314 - DNA, 22 bp, Homo sapiens
gccagtgctgtcatggaaatcc

SEQ ID NO: 7175315 - DNA, 22 bp, Homo sapiens
gccagtgctgtcatggaaatcc

SEQ ID NO: 7175316 - DNA, 21 bp, Homo sapiens
gccagtgctgtctgtgtgatc

SEQ ID NO: 7175317 - DNA, 21 bp, Homo sapiens
gccagtgctgtctgtgtgatc

SEQ ID NO: 7175318 - DNA, 22 bp, Homo sapiens
gcccactctggagcctgttccc

SEQ ID NO: 7175319 - DNA, 22 bp, Homo sapiens
gcccactctggagcctgttccc

SEQ ID NO: 7175320 - DNA, 22 bp, Homo sapiens
gcccacagtacgaggctcaggc

SEQ ID NO: 7175321 - DNA, 22 bp, Homo sapiens
gcccacagtacgaggctcaggc

SEQ ID NO: 7175322 - DNA, 22 bp, Homo sapiens
gccagtggcttgccaggcagga

SEQ ID NO: 7175323 - DNA, 22 bp, Homo sapiens
gccagtggcttgccaggcagga

SEQ ID NO: 7175324 - DNA, 22 bp, Homo sapiens
gccagtgggacccgctgtgggc

SEQ ID NO: 7175325 - DNA, 22 bp, Homo sapiens
gcccacagtacgaggctcaggc

SEQ ID NO: 7175326 - DNA, 22 bp, Homo sapiens
gcccacagtacgaggctcaggc

SEQ ID NO: 7175327 - DNA, 22 bp, Homo sapiens
gccagtggcttgccaggcagga

SEQ ID NO: 7175328 - DNA, 22 bp, Homo sapiens
gccagtggccctctggagaagg

SEQ ID NO: 7175329 - DNA, 22 bp, Homo sapiens
gccagtggcttgccaggcagga

SEQ ID NO: 7175330 - DNA, 22 bp, Homo sapiens
gccagtggcttgccaggcagga

SEQ ID NO: 7175331 - DNA, 22 bp, Homo sapiens
gccagtggccctctggagaagg

SEQ ID NO: 7175332 - DNA, 22 bp, Homo sapiens
gccagtggccctctggagaagg

SEQ ID NO: 7175333 - DNA, 22 bp, Homo sapiens
gccagtggccctctggagaagg

SEQ ID NO: 7175334 - DNA, 22 bp, Homo sapiens
gccagtggcatgcggcagggac

SEQ ID NO: 7175335 - DNA, 22 bp, Homo sapiens
gccagtggcatgcggcagggac

SEQ ID NO: 7175336 - DNA, 22 bp, Homo sapiens
gccagtggcatgcggcagggac

SEQ ID NO: 7175337 - DNA, 22 bp, Homo sapiens
gccagtggcatgcggcagggac

SEQ ID NO: 7175338 - DNA, 22 bp, Homo sapiens
gccagtggagcacatggtgaag

SEQ ID NO: 7175339 - DNA, 22 bp, Homo sapiens
gccagtggagcacatggtgaag

SEQ ID NO: 7175340 - DNA, 22 bp, Homo sapiens
gccagtggaggacccatggaga

SEQ ID NO: 7175341 - DNA, 22 bp, Homo sapiens
gccagtggaggacccatggaga

SEQ ID NO: 7175342 - DNA, 22 bp, Homo sapiens
gccagtggaggacccatggaga

SEQ ID NO: 7175343 - DNA, 22 bp, Homo sapiens
gccagtggatgaggacttaact

SEQ ID NO: 7175344 - DNA, 22 bp, Homo sapiens
gccaagggaactgagccggagg

SEQ ID NO: 7175345 - DNA, 22 bp, Homo sapiens
gccaagggaactgagccggagg

SEQ ID NO: 7175346 - DNA, 22 bp, Homo sapiens
gccaagggggcagtgcatgggt

SEQ ID NO: 7175347 - DNA, 21 bp, Homo sapiens
gccaagggggtagctattcct

SEQ ID NO: 7175348 - DNA, 22 bp, Homo sapiens
gccaagggggcagtgcatgggt

SEQ ID NO: 7175349 - DNA, 22 bp, Homo sapiens
gccaagggggcagtgcatgggt

SEQ ID NO: 7175350 - DNA, 22 bp, Homo sapiens
gccaagggggcagtgcatgggt

SEQ ID NO: 7175351 - DNA, 22 bp, Homo sapiens
gccagagagactgatacatgct

SEQ ID NO: 7175352 - DNA, 22 bp, Homo sapiens
gccagagagactgatacatgct

SEQ ID NO: 7175353 - DNA, 22 bp, Homo sapiens
gccagagagagtccctgggcct

SEQ ID NO: 7175354 - DNA, 22 bp, Homo sapiens
gccagagagagtccctgggcct

SEQ ID NO: 7175355 - DNA, 22 bp, Homo sapiens
gccagagcacaggctggtagta

SEQ ID NO: 7175356 - DNA, 22 bp, Homo sapiens
gccagagcacaggctggtagta

SEQ ID NO: 7175357 - DNA, 22 bp, Homo sapiens
gccagagcacaggctggtagta

SEQ ID NO: 7175358 - DNA, 22 bp, Homo sapiens
gccagagcacaggctggtagta

SEQ ID NO: 7175359 - DNA, 22 bp, Homo sapiens
gccagagcacaggctggtagta

SEQ ID NO: 7175360 - DNA, 22 bp, Homo sapiens
gccagagagatggaaaagctta

SEQ ID NO: 7175361 - DNA, 22 bp, Homo sapiens
gccagagaggcaaatcctagca

SEQ ID NO: 7175362 - DNA, 22 bp, Homo sapiens
gccagagaggcaaatcctagca

SEQ ID NO: 7175363 - DNA, 22 bp, Homo sapiens
gccagagaggccgaggtaccca

SEQ ID NO: 7175364 - DNA, 22 bp, Homo sapiens
gccagagaggccgaggtaccca

SEQ ID NO: 7175365 - DNA, 22 bp, Homo sapiens
gccagagctgagacacgagtcc

SEQ ID NO: 7175366 - DNA, 22 bp, Homo sapiens
gccagagccggcttcacaggat

SEQ ID NO: 7175367 - DNA, 22 bp, Homo sapiens
gccagagccggcttcacaggat

SEQ ID NO: 7175368 - DNA, 22 bp, Homo sapiens
gccagagccggcttcacaggat

SEQ ID NO: 7175369 - DNA, 22 bp, Homo sapiens
gccagagcatgcactgcctgca

SEQ ID NO: 7175370 - DNA, 22 bp, Homo sapiens
gccagagcatgcactgcctgca

SEQ ID NO: 7175371 - DNA, 22 bp, Homo sapiens
gccagagccacttttgggtgat

SEQ ID NO: 7175372 - DNA, 21 bp, Homo sapiens
gccagagcagtacaatgaggt

SEQ ID NO: 7175373 - DNA, 22 bp, Homo sapiens
gccagagcatcgcaccctccat

SEQ ID NO: 7175374 - DNA, 22 bp, Homo sapiens
gccagagcatgcactgcctgca

SEQ ID NO: 7175375 - DNA, 22 bp, Homo sapiens
gccagagcatgcactgcctgca

SEQ ID NO: 7175376 - DNA, 22 bp, Homo sapiens
gccagagcatgcactgcctgca

SEQ ID NO: 7175377 - DNA, 22 bp, Homo sapiens
gccagagcatgcactgcctgca

SEQ ID NO: 7175378 - DNA, 21 bp, Homo sapiens
gccagagcagtacaatgaggt

SEQ ID NO: 7175379 - DNA, 21 bp, Homo sapiens
gccagagcagtacaatgaggt

SEQ ID NO: 7175380 - DNA, 22 bp, Homo sapiens
gccagagcagaatagagtggcc

SEQ ID NO: 7175381 - DNA, 22 bp, Homo sapiens
gccagagcagaatagagtggcc

SEQ ID NO: 7175382 - DNA, 22 bp, Homo sapiens
gccagagcagaatagagtggcc

SEQ ID NO: 7175383 - DNA, 22 bp, Homo sapiens
gccagagcagaatagagtggcc

SEQ ID NO: 7175384 - DNA, 22 bp, Homo sapiens
gccaaggcctgcagcacctcat

SEQ ID NO: 7175385 - DNA, 22 bp, Homo sapiens
gccaaggctgaggccctgggct

SEQ ID NO: 7175386 - DNA, 22 bp, Homo sapiens
gccaaggcctgcagcacctcat

SEQ ID NO: 7175387 - DNA, 22 bp, Homo sapiens
gccaaggcctctgcaggatgag

SEQ ID NO: 7175388 - DNA, 22 bp, Homo sapiens
gccaaggcctctgcaggatgag

SEQ ID NO: 7175389 - DNA, 22 bp, Homo sapiens
gccaaggagacacggtgttgta

SEQ ID NO: 7175390 - DNA, 22 bp, Homo sapiens
gccaaggagacacggtgttgta

SEQ ID NO: 7175391 - DNA, 21 bp, Homo sapiens
gccaaggaggctagagaacat

SEQ ID NO: 7175392 - DNA, 22 bp, Homo sapiens
gccaaggataccagctgtgaga

SEQ ID NO: 7175393 - DNA, 22 bp, Homo sapiens
gccaaggcctctgcaggatgag

SEQ ID NO: 7175394 - DNA, 22 bp, Homo sapiens
gccaaggcctctgcaggatgag

SEQ ID NO: 7175395 - DNA, 22 bp, Homo sapiens
gccaaggataccagctgtgaga

SEQ ID NO: 7175396 - DNA, 22 bp, Homo sapiens
gcatttttgatcccactaggat

SEQ ID NO: 7175397 - DNA, 22 bp, Homo sapiens
gccaaaactcccatattttaat

SEQ ID NO: 7175398 - DNA, 22 bp, Homo sapiens
gccaagcctgtagacacaagct

SEQ ID NO: 7175399 - DNA, 22 bp, Homo sapiens
gccaagctctttaaaggccaaa

SEQ ID NO: 7175400 - DNA, 22 bp, Homo sapiens
gccaagcttggaaggatcatgg

SEQ ID NO: 7175401 - DNA, 22 bp, Homo sapiens
gccaaggaaggcttcctggaag

SEQ ID NO: 7175402 - DNA, 22 bp, Homo sapiens
gccaaggaaggcttcctggaag

SEQ ID NO: 7175403 - DNA, 22 bp, Homo sapiens
gcattttataaagagttatttg

SEQ ID NO: 7175404 - DNA, 22 bp, Homo sapiens
gcattttataaagagttatttg

SEQ ID NO: 7175405 - DNA, 22 bp, Homo sapiens
gcattttataaagagttatttg

SEQ ID NO: 7175406 - DNA, 22 bp, Homo sapiens
gcattttaatgaggtttatgag

SEQ ID NO: 7175407 - DNA, 18 bp, Homo sapiens
gcattttaatctgaggca

SEQ ID NO: 7175408 - DNA, 22 bp, Homo sapiens
gcattttaatgaggtttatgag

SEQ ID NO: 7175409 - DNA, 22 bp, Homo sapiens
gcattttaatgaggtttatgag

SEQ ID NO: 7175410 - DNA, 18 bp, Homo sapiens
gcattttaatctgaggca

SEQ ID NO: 7175411 - DNA, 22 bp, Homo sapiens
gcatttgtgtggcggaaggatt

SEQ ID NO: 7175412 - DNA, 22 bp, Homo sapiens
gcatttgtgttcttcctagagc

SEQ ID NO: 7175413 - DNA, 22 bp, Homo sapiens
gcatttgttccgctttgtcatc

SEQ ID NO: 7175414 - DNA, 22 bp, Homo sapiens
gcattttaataagattcatagg

SEQ ID NO: 7175415 - DNA, 22 bp, Homo sapiens
gcattttaataagattcatagg

SEQ ID NO: 7175416 - DNA, 22 bp, Homo sapiens
gccagccaagattgagaaggta

SEQ ID NO: 7175417 - DNA, 22 bp, Homo sapiens
gccagccaagattgagaaggta

SEQ ID NO: 7175418 - DNA, 22 bp, Homo sapiens
gccagccataggccagcactgg

SEQ ID NO: 7175419 - DNA, 22 bp, Homo sapiens
gccagccataggccagcactgg

SEQ ID NO: 7175420 - DNA, 22 bp, Homo sapiens
gccagcattccttggctcctgg

SEQ ID NO: 7175421 - DNA, 22 bp, Homo sapiens
gccagcagtcctgctgtgtgcc

SEQ ID NO: 7175422 - DNA, 22 bp, Homo sapiens
gccagcagtcctgctgtgtgcc

SEQ ID NO: 7175423 - DNA, 22 bp, Homo sapiens
gccagcagtggccaccaccagg

SEQ ID NO: 7175424 - DNA, 22 bp, Homo sapiens
gccagcagtggccaccaccagg

SEQ ID NO: 7175425 - DNA, 22 bp, Homo sapiens
gccagcagtcctgctgtgtgcc

SEQ ID NO: 7175426 - DNA, 22 bp, Homo sapiens
gccagcagtcctgctgtgtgcc

SEQ ID NO: 7175427 - DNA, 22 bp, Homo sapiens
gccagcagtcctgctgtgtgcc

SEQ ID NO: 7175428 - DNA, 22 bp, Homo sapiens
gccagcagtcctgctgtgtgcc

SEQ ID NO: 7175429 - DNA, 22 bp, Homo sapiens
gccagcagtccagtccttagtg

SEQ ID NO: 7175430 - DNA, 22 bp, Homo sapiens
gccagcagtatgtcctggcagt

SEQ ID NO: 7175431 - DNA, 22 bp, Homo sapiens
gccagcagtatgtcctggcagt

SEQ ID NO: 7175432 - DNA, 22 bp, Homo sapiens
gccagccccttagggctctccc

SEQ ID NO: 7175433 - DNA, 22 bp, Homo sapiens
gccagccccttagggctctccc

SEQ ID NO: 7175434 - DNA, 22 bp, Homo sapiens
gccagccccttagggctctccc

SEQ ID NO: 7175435 - DNA, 22 bp, Homo sapiens
gccagccccttagggctctccc

SEQ ID NO: 7175436 - DNA, 22 bp, Homo sapiens
gccagccccttagggctctccc

SEQ ID NO: 7175437 - DNA, 22 bp, Homo sapiens
gccagcccctccatcctgttca

SEQ ID NO: 7175438 - DNA, 22 bp, Homo sapiens
gccagcccctccatcctgttca

SEQ ID NO: 7175439 - DNA, 22 bp, Homo sapiens
gccagccccagacatcctatcg

SEQ ID NO: 7175440 - DNA, 22 bp, Homo sapiens
gccagcccattaacccctgtcc

SEQ ID NO: 7175441 - DNA, 22 bp, Homo sapiens
gccagccccagacatcctatcg

SEQ ID NO: 7175442 - DNA, 22 bp, Homo sapiens
gccagcccattaacccctgtcc

SEQ ID NO: 7175443 - DNA, 22 bp, Homo sapiens
gccagccataggccagcactgg

SEQ ID NO: 7175444 - DNA, 22 bp, Homo sapiens
gccagcccagctccaggggaaa

SEQ ID NO: 7175445 - DNA, 22 bp, Homo sapiens
gccagcccagctccaggggaaa

SEQ ID NO: 7175446 - DNA, 23 bp, Homo sapiens
gccagagctgcctgcccttgctg

SEQ ID NO: 7175447 - DNA, 23 bp, Homo sapiens
gccagagctgcctgcccttgctg

SEQ ID NO: 7175448 - DNA, 22 bp, Homo sapiens
gccagagcttcccccgagtgtg

SEQ ID NO: 7175449 - DNA, 22 bp, Homo sapiens
gccagagcttcccccgagtgtg

SEQ ID NO: 7175450 - DNA, 22 bp, Homo sapiens
gccagagcttcccccgagtgtg

SEQ ID NO: 7175451 - DNA, 22 bp, Homo sapiens
gccagagctgagacacgagtcc

SEQ ID NO: 7175452 - DNA, 22 bp, Homo sapiens
gccagagctgagacacgagtcc

SEQ ID NO: 7175453 - DNA, 22 bp, Homo sapiens
gccagagctgagtgaggttctt

SEQ ID NO: 7175454 - DNA, 22 bp, Homo sapiens
gccagaggaacgctgcgcgccc

SEQ ID NO: 7175455 - DNA, 22 bp, Homo sapiens
gccagaggaacgctgcgcgccc

SEQ ID NO: 7175456 - DNA, 22 bp, Homo sapiens
gccagaggcccaaggacagctg

SEQ ID NO: 7175457 - DNA, 22 bp, Homo sapiens
gccagaggcccaaggacagctg

SEQ ID NO: 7175458 - DNA, 22 bp, Homo sapiens
gccagaggcccaaggacagctg

SEQ ID NO: 7175459 - DNA, 22 bp, Homo sapiens
gccagaggcccaaggacagctg

SEQ ID NO: 7175460 - DNA, 22 bp, Homo sapiens
gccagaggaacgctgcgcgccc

SEQ ID NO: 7175461 - DNA, 22 bp, Homo sapiens
gccagaggaacgctgcgcgccc

SEQ ID NO: 7175462 - DNA, 23 bp, Homo sapiens
gccagaggaacgcagagctttct

SEQ ID NO: 7175463 - DNA, 22 bp, Homo sapiens
gccagaggaacgctgcgcgccc

SEQ ID NO: 7175464 - DNA, 23 bp, Homo sapiens
gccagaggaacgcagagctttct

SEQ ID NO: 7175465 - DNA, 22 bp, Homo sapiens
gccagcaggttgtcaaggagct

SEQ ID NO: 7175466 - DNA, 22 bp, Homo sapiens
gccagcaggttgtcaaggagct

SEQ ID NO: 7175467 - DNA, 22 bp, Homo sapiens
gccagcagtatgtcctggcagt

SEQ ID NO: 7175468 - DNA, 22 bp, Homo sapiens
gccagcagtatgtcctggcagt

SEQ ID NO: 7175469 - DNA, 22 bp, Homo sapiens
gccagcagtatgtcctggcagt

SEQ ID NO: 7175470 - DNA, 22 bp, Homo sapiens
gccagcaggtggagagatcaag

SEQ ID NO: 7175471 - DNA, 22 bp, Homo sapiens
gccagcaggttgtcaaggagct

SEQ ID NO: 7175472 - DNA, 22 bp, Homo sapiens
gccagcaggttgtcaaggagct

SEQ ID NO: 7175473 - DNA, 22 bp, Homo sapiens
gccagcaggttgtcaaggagct

SEQ ID NO: 7175474 - DNA, 22 bp, Homo sapiens
gccagcagggcggagccatcta

SEQ ID NO: 7175475 - DNA, 22 bp, Homo sapiens
gccagcaggtggagagatcaag

SEQ ID NO: 7175476 - DNA, 22 bp, Homo sapiens
gccagcaggtggagagatcaag

SEQ ID NO: 7175477 - DNA, 22 bp, Homo sapiens
gccagaggcccaaggacagctg

SEQ ID NO: 7175478 - DNA, 22 bp, Homo sapiens
gccagaggcccaaggacagctg

SEQ ID NO: 7175479 - DNA, 20 bp, Homo sapiens
gccagaggccggcaggggct

SEQ ID NO: 7175480 - DNA, 20 bp, Homo sapiens
gccagaggccggcaggggct

SEQ ID NO: 7175481 - DNA, 20 bp, Homo sapiens
gccagaggccggcaggggct

SEQ ID NO: 7175482 - DNA, 22 bp, Homo sapiens
gccagcagggcggagccatcta

SEQ ID NO: 7175483 - DNA, 22 bp, Homo sapiens
gccagcagggcggagccatcta

SEQ ID NO: 7175484 - DNA, 22 bp, Homo sapiens
gcatgaggggggttaggaagtt

SEQ ID NO: 7175485 - DNA, 20 bp, Homo sapiens
gcatgaggaatcattgcagc

SEQ ID NO: 7175486 - DNA, 20 bp, Homo sapiens
gcatgaggaatcattgcagc

SEQ ID NO: 7175487 - DNA, 20 bp, Homo sapiens
gcatgaggaatcattgcagc

SEQ ID NO: 7175488 - DNA, 22 bp, Homo sapiens
gcatgaggggggttaggaagtt

SEQ ID NO: 7175489 - DNA, 22 bp, Homo sapiens
gcatgaggggggttaggaagtt

SEQ ID NO: 7175490 - DNA, 22 bp, Homo sapiens
gcatgacattcctaatcacagt

SEQ ID NO: 7175491 - DNA, 22 bp, Homo sapiens
gcatgacatggcctgacttagg

SEQ ID NO: 7175492 - DNA, 22 bp, Homo sapiens
gcatgactggttttcttacaaa

SEQ ID NO: 7175493 - DNA, 22 bp, Homo sapiens
gcatgagactagctcatgagca

SEQ ID NO: 7175494 - DNA, 22 bp, Homo sapiens
gcatgaggggggttaggaagtt

SEQ ID NO: 7175495 - DNA, 22 bp, Homo sapiens
gcatgaggggggttaggaagtt

SEQ ID NO: 7175496 - DNA, 22 bp, Homo sapiens
gcatgaggttcttggccagcat

SEQ ID NO: 7175497 - DNA, 22 bp, Homo sapiens
gcatgaggttcttggccagcat

SEQ ID NO: 7175498 - DNA, 22 bp, Homo sapiens
gcatgaggttcttggccagcat

SEQ ID NO: 7175499 - DNA, 22 bp, Homo sapiens
gcatgataccataggttttgcc

SEQ ID NO: 7175500 - DNA, 23 bp, Homo sapiens
gcatcttaaaacctacatatgtg

SEQ ID NO: 7175501 - DNA, 22 bp, Homo sapiens
gcatctgttagagtgtgcatgc

SEQ ID NO: 7175502 - DNA, 22 bp, Homo sapiens
gcatctctttagaatcagatgg

SEQ ID NO: 7175503 - DNA, 22 bp, Homo sapiens
gcatctgatccaatagatatat

SEQ ID NO: 7175504 - DNA, 22 bp, Homo sapiens
gcatctgatccaatagatatat

SEQ ID NO: 7175505 - DNA, 22 bp, Homo sapiens
gcatcttcacacaaagccagtg

SEQ ID NO: 7175506 - DNA, 22 bp, Homo sapiens
gcatctttagcctctccgtggc

SEQ ID NO: 7175507 - DNA, 22 bp, Homo sapiens
gcatttcatgtagattgagaac

SEQ ID NO: 7175508 - DNA, 22 bp, Homo sapiens
gcatgatagctaactcccctca

SEQ ID NO: 7175509 - DNA, 22 bp, Homo sapiens
gcatgcaaatagtcatgcttcc

SEQ ID NO: 7175510 - DNA, 22 bp, Homo sapiens
gcatttctgtgcatacacatga

SEQ ID NO: 7175511 - DNA, 22 bp, Homo sapiens
gcatttgaaatcctctgtgacg

SEQ ID NO: 7175512 - DNA, 22 bp, Homo sapiens
gcatttggaattgtgtatagaa

SEQ ID NO: 7175513 - DNA, 18 bp, Homo sapiens
gcatttggtgagtttggc

SEQ ID NO: 7175514 - DNA, 22 bp, Homo sapiens
gcatccctctgaggggccaggc

SEQ ID NO: 7175515 - DNA, 20 bp, Homo sapiens
gcatcctcccagcagagctg

SEQ ID NO: 7175516 - DNA, 22 bp, Homo sapiens
gcatcccaaatctgaaagtcca

SEQ ID NO: 7175517 - DNA, 22 bp, Homo sapiens
gcatcctcccggtgctgctggc

SEQ ID NO: 7175518 - DNA, 22 bp, Homo sapiens
gcatcctcccggtgctgctggc

SEQ ID NO: 7175519 - DNA, 22 bp, Homo sapiens
gcatcctctgagagctctagat

SEQ ID NO: 7175520 - DNA, 22 bp, Homo sapiens
gcatcctggctctaggtgtcat

SEQ ID NO: 7175521 - DNA, 22 bp, Homo sapiens
gcatccatggagagcactctga

SEQ ID NO: 7175522 - DNA, 22 bp, Homo sapiens
gcatccttaatccacatcagag

SEQ ID NO: 7175523 - DNA, 22 bp, Homo sapiens
gcatccttctcattcccaagct

SEQ ID NO: 7175524 - DNA, 22 bp, Homo sapiens
gcatccttctcattcccaagct

SEQ ID NO: 7175525 - DNA, 20 bp, Homo sapiens
gcatccttctcttccactcc

SEQ ID NO: 7175526 - DNA, 22 bp, Homo sapiens
gcatccttgggcccagctcctg

SEQ ID NO: 7175527 - DNA, 22 bp, Homo sapiens
gcatccttgggcccagctcctg

SEQ ID NO: 7175528 - DNA, 22 bp, Homo sapiens
gcatcctttcctttccattgtg

SEQ ID NO: 7175529 - DNA, 22 bp, Homo sapiens
gcatccttttttcctgccctgc

SEQ ID NO: 7175530 - DNA, 22 bp, Homo sapiens
gcatccttttttcctgccctgc

SEQ ID NO: 7175531 - DNA, 20 bp, Homo sapiens
gcatcgagattcgttctttt

SEQ ID NO: 7175532 - DNA, 19 bp, Homo sapiens
gcatcgagccccaatcctg

SEQ ID NO: 7175533 - DNA, 21 bp, Homo sapiens
gcatcgaggagcttcctgatg

SEQ ID NO: 7175534 - DNA, 22 bp, Homo sapiens
gcatctaatccagtccagcatc

SEQ ID NO: 7175535 - DNA, 20 bp, Homo sapiens
gcatctccagggctgtctcc

SEQ ID NO: 7175536 - DNA, 20 bp, Homo sapiens
gcatctccagggctgtctcc

SEQ ID NO: 7175537 - DNA, 20 bp, Homo sapiens
gcatctccagggctgtctcc

SEQ ID NO: 7175538 - DNA, 22 bp, Homo sapiens
gcatccagaggtagccactgtg

SEQ ID NO: 7175539 - DNA, 20 bp, Homo sapiens
gcatccagacacccagctgc

SEQ ID NO: 7175540 - DNA, 22 bp, Homo sapiens
gcatccaaatgtttcatttctt

SEQ ID NO: 7175541 - DNA, 22 bp, Homo sapiens
gcatccagaggtagccactgtg

SEQ ID NO: 7175542 - DNA, 22 bp, Homo sapiens
gcatccagaggtagccactgtg

SEQ ID NO: 7175543 - DNA, 22 bp, Homo sapiens
gcatccaggctgcccctctgcg

SEQ ID NO: 7175544 - DNA, 22 bp, Homo sapiens
gcatccagtcttggctcctgga

SEQ ID NO: 7175545 - DNA, 22 bp, Homo sapiens
gcatccagtcttggctcctgga

SEQ ID NO: 7175546 - DNA, 22 bp, Homo sapiens
gcagtgaagccagatctgaaat

SEQ ID NO: 7175547 - DNA, 22 bp, Homo sapiens
gcataaacttaagattttgttt

SEQ ID NO: 7175548 - DNA, 22 bp, Homo sapiens
gcagtgaagcagtccttgttga

SEQ ID NO: 7175549 - DNA, 22 bp, Homo sapiens
gcataaaggactataaggatca

SEQ ID NO: 7175550 - DNA, 19 bp, Homo sapiens
gcataaatacactattgtc

SEQ ID NO: 7175551 - DNA, 22 bp, Homo sapiens
gcataaatgttctttcagattt

SEQ ID NO: 7175552 - DNA, 22 bp, Homo sapiens
gcataacaacagactctgtgtt

SEQ ID NO: 7175553 - DNA, 22 bp, Homo sapiens
gcatccaaatgtttcatttctt

SEQ ID NO: 7175554 - DNA, 18 bp, Homo sapiens
gcagtgaagaaagagctt

SEQ ID NO: 7175555 - DNA, 22 bp, Homo sapiens
gcagtgaacataacacagaagg

SEQ ID NO: 7175556 - DNA, 18 bp, Homo sapiens
gcagtgaagaaagagctt

SEQ ID NO: 7175557 - DNA, 18 bp, Homo sapiens
gcagtgaagaaagagctt

SEQ ID NO: 7175558 - DNA, 18 bp, Homo sapiens
gcagtgaagaaagagctt

SEQ ID NO: 7175559 - DNA, 22 bp, Homo sapiens
gcagtgaagatggcaggttggg

SEQ ID NO: 7175560 - DNA, 22 bp, Homo sapiens
gcagtgaagatttgggctctgg

SEQ ID NO: 7175561 - DNA, 22 bp, Homo sapiens
gcagtgaacataacacagaagg

SEQ ID NO: 7175562 - DNA, 22 bp, Homo sapiens
gcagtgaacataacacagaagg

SEQ ID NO: 7175563 - DNA, 22 bp, Homo sapiens
gcagtgaacataacacagaagg

SEQ ID NO: 7175564 - DNA, 22 bp, Homo sapiens
gcagtgaaacaataggatcaaa

SEQ ID NO: 7175565 - DNA, 22 bp, Homo sapiens
gcagtgaaacaataggatcaaa

SEQ ID NO: 7175566 - DNA, 22 bp, Homo sapiens
gcagtgaaacaataggatcaaa

SEQ ID NO: 7175567 - DNA, 22 bp, Homo sapiens
gcagtgaaaaagtgcaccctgt

SEQ ID NO: 7175568 - DNA, 22 bp, Homo sapiens
gcagtctttttcttctagctaa

SEQ ID NO: 7175569 - DNA, 22 bp, Homo sapiens
gcagtcttttctgtgactggct

SEQ ID NO: 7175570 - DNA, 22 bp, Homo sapiens
gcagtgaaaaagtgcaccctgt

SEQ ID NO: 7175571 - DNA, 22 bp, Homo sapiens
gcagtgaaaaagtgcaccctgt

SEQ ID NO: 7175572 - DNA, 17 bp, Homo sapiens
gcagtgaaaagagatca

SEQ ID NO: 7175573 - DNA, 22 bp, Homo sapiens
gcagtccttaggagaggaagta

SEQ ID NO: 7175574 - DNA, 22 bp, Homo sapiens
gcagtctccatatacatttaca

SEQ ID NO: 7175575 - DNA, 22 bp, Homo sapiens
gcagtctccatatacatttaca

SEQ ID NO: 7175576 - DNA, 22 bp, Homo sapiens
gcagtctctcaggatttaagct

SEQ ID NO: 7175577 - DNA, 22 bp, Homo sapiens
gcagtctctcaggatttaagct

SEQ ID NO: 7175578 - DNA, 18 bp, Homo sapiens
gcagtctctctggtcttc

SEQ ID NO: 7175579 - DNA, 18 bp, Homo sapiens
gcagtctctctggtcttc

SEQ ID NO: 7175580 - DNA, 18 bp, Homo sapiens
gcagtctctctggtcttc

SEQ ID NO: 7175581 - DNA, 18 bp, Homo sapiens
gcagtctctctggtcttc

SEQ ID NO: 7175582 - DNA, 20 bp, Homo sapiens
gcagtctgcctctgtgtggt

SEQ ID NO: 7175583 - DNA, 19 bp, Homo sapiens
gcagtctgttgaagggcag

SEQ ID NO: 7175584 - DNA, 19 bp, Homo sapiens
gcagtctgttgaagggcag

SEQ ID NO: 7175585 - DNA, 22 bp, Homo sapiens
gcagtctttgagtatcttcaaa

SEQ ID NO: 7175586 - DNA, 22 bp, Homo sapiens
gcagtcctcgtaaaggtcgaag

SEQ ID NO: 7175587 - DNA, 22 bp, Homo sapiens
gcagtcctctcattggcctcct

SEQ ID NO: 7175588 - DNA, 22 bp, Homo sapiens
gcagtcctcatcctttagcagt

SEQ ID NO: 7175589 - DNA, 22 bp, Homo sapiens
gcagtcctcctgcctcagcctc

SEQ ID NO: 7175590 - DNA, 22 bp, Homo sapiens
gcagtcctctcattggcctcct

SEQ ID NO: 7175591 - DNA, 22 bp, Homo sapiens
gcagtcctggaggaaggtgtga

SEQ ID NO: 7175592 - DNA, 22 bp, Homo sapiens
gcagtcctgggattctgtcctt

SEQ ID NO: 7175593 - DNA, 22 bp, Homo sapiens
gcagtcctgtagcgactttttt

SEQ ID NO: 7175594 - DNA, 22 bp, Homo sapiens
gcagtcatcagtcctttaatta

SEQ ID NO: 7175595 - DNA, 22 bp, Homo sapiens
gcagtcatctgagctaactact

SEQ ID NO: 7175596 - DNA, 22 bp, Homo sapiens
gcagtcatggaaaaatgtatac

SEQ ID NO: 7175597 - DNA, 22 bp, Homo sapiens
gcagtcatgggtagaactcaag

SEQ ID NO: 7175598 - DNA, 22 bp, Homo sapiens
gcagtcatttaacctctctgtg

SEQ ID NO: 7175599 - DNA, 22 bp, Homo sapiens
gcagtccaaagtggctctcacc

SEQ ID NO: 7175600 - DNA, 22 bp, Homo sapiens
gcagtcccatatctttaacata

SEQ ID NO: 7175601 - DNA, 20 bp, Homo sapiens
gcagtcccatttctgagcct

SEQ ID NO: 7175602 - DNA, 22 bp, Homo sapiens
gcagtcctagggtgctctgcag

SEQ ID NO: 7175603 - DNA, 22 bp, Homo sapiens
gcagggctcattctagtacaat

SEQ ID NO: 7175604 - DNA, 22 bp, Homo sapiens
gcagggctcagccgctcccacc

SEQ ID NO: 7175605 - DNA, 22 bp, Homo sapiens
gcagggctcaacaggacacccc

SEQ ID NO: 7175606 - DNA, 22 bp, Homo sapiens
gcagggctcaacaggacacccc

SEQ ID NO: 7175607 - DNA, 22 bp, Homo sapiens
gcagggctccactgtggccaag

SEQ ID NO: 7175608 - DNA, 22 bp, Homo sapiens
gcagggctccactgtggccaag

SEQ ID NO: 7175609 - DNA, 22 bp, Homo sapiens
gcagggctccactgtggccaag

SEQ ID NO: 7175610 - DNA, 22 bp, Homo sapiens
gcagggctccccaggcccgagg

SEQ ID NO: 7175611 - DNA, 22 bp, Homo sapiens
gcagggctcattgccaggcatt

SEQ ID NO: 7175612 - DNA, 22 bp, Homo sapiens
gcagggctcattgccaggcatt

SEQ ID NO: 7175613 - DNA, 22 bp, Homo sapiens
gcagggctcattgccaggcatt

SEQ ID NO: 7175614 - DNA, 22 bp, Homo sapiens
gcagtcagtaaggcagccagaa

SEQ ID NO: 7175615 - DNA, 22 bp, Homo sapiens
gcagtcagtaaggcagccagaa

SEQ ID NO: 7175616 - DNA, 22 bp, Homo sapiens
gcagtcagtaaggcagccagaa

SEQ ID NO: 7175617 - DNA, 22 bp, Homo sapiens
gcagtcagtaaggcagccagaa

SEQ ID NO: 7175618 - DNA, 22 bp, Homo sapiens
gcagtcataactaatattggtt

SEQ ID NO: 7175619 - DNA, 22 bp, Homo sapiens
gcagtcatatcattccaacagg

SEQ ID NO: 7175620 - DNA, 22 bp, Homo sapiens
gcagtcatcacggcttttaggc

SEQ ID NO: 7175621 - DNA, 22 bp, Homo sapiens
gcagtcagacaggaggagctcc

SEQ ID NO: 7175622 - DNA, 21 bp, Homo sapiens
gcagtcactcggttggctacc

SEQ ID NO: 7175623 - DNA, 21 bp, Homo sapiens
gcagtcactcggttggctacc

SEQ ID NO: 7175624 - DNA, 22 bp, Homo sapiens
gcagggctctgctgtagtccta

SEQ ID NO: 7175625 - DNA, 22 bp, Homo sapiens
gcagggctccccaggcccgagg

SEQ ID NO: 7175626 - DNA, 19 bp, Homo sapiens
gcagggctctcccagatgc

SEQ ID NO: 7175627 - DNA, 22 bp, Homo sapiens
gcagtatatggattttaaacat

SEQ ID NO: 7175628 - DNA, 22 bp, Homo sapiens
gcagtatatggattttaaacat

SEQ ID NO: 7175629 - DNA, 22 bp, Homo sapiens
gcagtatctatgtgatgggttg

SEQ ID NO: 7175630 - DNA, 22 bp, Homo sapiens
gcagtatctatgtgatgggttg

SEQ ID NO: 7175631 - DNA, 22 bp, Homo sapiens
gcagtatgagtgttttagacat

SEQ ID NO: 7175632 - DNA, 22 bp, Homo sapiens
gcagtcacagggagatggtgac

SEQ ID NO: 7175633 - DNA, 22 bp, Homo sapiens
gagggggacgtatcctggtatg

SEQ ID NO: 7175634 - DNA, 22 bp, Homo sapiens
gagggggagatgtgcacacact

SEQ ID NO: 7175635 - DNA, 22 bp, Homo sapiens
gaggggcttgaggccctgatgg

SEQ ID NO: 7175636 - DNA, 22 bp, Homo sapiens
gagggggaaagtccctggagtc

SEQ ID NO: 7175637 - DNA, 22 bp, Homo sapiens
gaggggctgtggagctctctgg

SEQ ID NO: 7175638 - DNA, 22 bp, Homo sapiens
gaggggcttgaggccctgatgg

SEQ ID NO: 7175639 - DNA, 22 bp, Homo sapiens
gaggggctgtggagctctctgg

SEQ ID NO: 7175640 - DNA, 22 bp, Homo sapiens
gaggggctgtggagctctctgg

SEQ ID NO: 7175641 - DNA, 22 bp, Homo sapiens
gaggggctgtggagctctctgg

SEQ ID NO: 7175642 - DNA, 22 bp, Homo sapiens
gaggggctgggtagggcaaccc

SEQ ID NO: 7175643 - DNA, 22 bp, Homo sapiens
gaggggctgtggagctctctgg

SEQ ID NO: 7175644 - DNA, 22 bp, Homo sapiens
gaggggctgtggagctctctgg

SEQ ID NO: 7175645 - DNA, 22 bp, Homo sapiens
gaggggctggggttgactccaa

SEQ ID NO: 7175646 - DNA, 22 bp, Homo sapiens
gaggggctggggttgactccaa

SEQ ID NO: 7175647 - DNA, 22 bp, Homo sapiens
gaggggctgggcagtccctgga

SEQ ID NO: 7175648 - DNA, 22 bp, Homo sapiens
gaggggctggggttgactccaa

SEQ ID NO: 7175649 - DNA, 22 bp, Homo sapiens
gaggggctggggttgactccaa

SEQ ID NO: 7175650 - DNA, 22 bp, Homo sapiens
gaggggctggggttgactccaa

SEQ ID NO: 7175651 - DNA, 22 bp, Homo sapiens
gaggggctgggtagggcaaccc

SEQ ID NO: 7175652 - DNA, 22 bp, Homo sapiens
gaggggctgggtagggcaaccc

SEQ ID NO: 7175653 - DNA, 22 bp, Homo sapiens
gaggggtgggctggaagttata

SEQ ID NO: 7175654 - DNA, 22 bp, Homo sapiens
gaggggtgggctggaagttata

SEQ ID NO: 7175655 - DNA, 22 bp, Homo sapiens
gaggggtggcgttggcatttag

SEQ ID NO: 7175656 - DNA, 22 bp, Homo sapiens
gaggggtggccctggcgtgtac

SEQ ID NO: 7175657 - DNA, 22 bp, Homo sapiens
gaggggtggccctggcgtgtac

SEQ ID NO: 7175658 - DNA, 22 bp, Homo sapiens
gaggggtggccctggcgtgtac

SEQ ID NO: 7175659 - DNA, 22 bp, Homo sapiens
gaggggtggccctggcgtgtac

SEQ ID NO: 7175660 - DNA, 22 bp, Homo sapiens
gaggggtgtggagccatcagtt

SEQ ID NO: 7175661 - DNA, 22 bp, Homo sapiens
gaggggtgtggagccatcagtt

SEQ ID NO: 7175662 - DNA, 22 bp, Homo sapiens
gaggggtgtggagccatcagtt

SEQ ID NO: 7175663 - DNA, 22 bp, Homo sapiens
gaggggtgggctggaagttata

SEQ ID NO: 7175664 - DNA, 22 bp, Homo sapiens
gaggggtgtggagccatcagtt

SEQ ID NO: 7175665 - DNA, 22 bp, Homo sapiens
gaggggtgtggagccatcagtt

SEQ ID NO: 7175666 - DNA, 22 bp, Homo sapiens
gaggggtgtggagccatcagtt

SEQ ID NO: 7175667 - DNA, 22 bp, Homo sapiens
gagggtcagaagggcctggttc

SEQ ID NO: 7175668 - DNA, 22 bp, Homo sapiens
gagggggcgaacagaagcaagg

SEQ ID NO: 7175669 - DNA, 22 bp, Homo sapiens
gagggggagatgtgcacacact

SEQ ID NO: 7175670 - DNA, 22 bp, Homo sapiens
gagggggagatgtgcacacact

SEQ ID NO: 7175671 - DNA, 22 bp, Homo sapiens
gagggggagatgtgcacacact

SEQ ID NO: 7175672 - DNA, 22 bp, Homo sapiens
gagggggcgaacagaagcaagg

SEQ ID NO: 7175673 - DNA, 22 bp, Homo sapiens
gaggggtcacatgggctggctt

SEQ ID NO: 7175674 - DNA, 22 bp, Homo sapiens
gaggggtccaggaggcacttac

SEQ ID NO: 7175675 - DNA, 22 bp, Homo sapiens
gcaagcaaattatttataggca

SEQ ID NO: 7175676 - DNA, 22 bp, Homo sapiens
gcaagagtttctggagcagagt

SEQ ID NO: 7175677 - DNA, 22 bp, Homo sapiens
gcaagacatgtctaaggtttaa

SEQ ID NO: 7175678 - DNA, 22 bp, Homo sapiens
gcaagacctatctagttgctgt

SEQ ID NO: 7175679 - DNA, 22 bp, Homo sapiens
gcaagagacttttatgtctgcc

SEQ ID NO: 7175680 - DNA, 22 bp, Homo sapiens
gcaagagcaactttatggagct

SEQ ID NO: 7175681 - DNA, 22 bp, Homo sapiens
gcaaatgctctccagcctgggt

SEQ ID NO: 7175682 - DNA, 22 bp, Homo sapiens
gcaagaacaggtgcttggcaag

SEQ ID NO: 7175683 - DNA, 21 bp, Homo sapiens
gcaaatgagttaactaactca

SEQ ID NO: 7175684 - DNA, 22 bp, Homo sapiens
gcaaatgagttgtaacataaaa

SEQ ID NO: 7175685 - DNA, 22 bp, Homo sapiens
gcaaatgaaggtggtgctacag

SEQ ID NO: 7175686 - DNA, 22 bp, Homo sapiens
gcaaatgacagactcaccttgg

SEQ ID NO: 7175687 - DNA, 21 bp, Homo sapiens
gcaaatgagttaactaactca

SEQ ID NO: 7175688 - DNA, 22 bp, Homo sapiens
gcaaatgatggcttgctggctg

SEQ ID NO: 7175689 - DNA, 22 bp, Homo sapiens
gcaaatgcactgcatttagatt

SEQ ID NO: 7175690 - DNA, 22 bp, Homo sapiens
gcaaatgctaaagtgtagagac

SEQ ID NO: 7175691 - DNA, 22 bp, Homo sapiens
gcaaatgctaaagtgtagagac

SEQ ID NO: 7175692 - DNA, 22 bp, Homo sapiens
gagggtccctgctcagggccag

SEQ ID NO: 7175693 - DNA, 22 bp, Homo sapiens
gagggtccctgctcagggccag

SEQ ID NO: 7175694 - DNA, 22 bp, Homo sapiens
gagggtccctgctcagggccag

SEQ ID NO: 7175695 - DNA, 22 bp, Homo sapiens
gcaaatcctcctgcctgaagaa

SEQ ID NO: 7175696 - DNA, 22 bp, Homo sapiens
gcaaatcctggaccagcctctt

SEQ ID NO: 7175697 - DNA, 22 bp, Homo sapiens
gcaaatccttctgcgaccaggt

SEQ ID NO: 7175698 - DNA, 19 bp, Homo sapiens
gcaaatctgaccaaatagt

SEQ ID NO: 7175699 - DNA, 22 bp, Homo sapiens
gcaaatgaactgatgccaatgg

SEQ ID NO: 7175700 - DNA, 22 bp, Homo sapiens
gcacaggcacagagggccactg

SEQ ID NO: 7175701 - DNA, 22 bp, Homo sapiens
gcacaggcacagagggccactg

SEQ ID NO: 7175702 - DNA, 22 bp, Homo sapiens
gcacaggcaatagatacagcta

SEQ ID NO: 7175703 - DNA, 22 bp, Homo sapiens
gcacaggcaatagatacagcta

SEQ ID NO: 7175704 - DNA, 22 bp, Homo sapiens
gcacaggcaatagatacagcta

SEQ ID NO: 7175705 - DNA, 22 bp, Homo sapiens
gcacaggcaatagatacagcta

SEQ ID NO: 7175706 - DNA, 22 bp, Homo sapiens
gcacaggaatcttcatttttta

SEQ ID NO: 7175707 - DNA, 22 bp, Homo sapiens
gcacaggaggccgatgctcatg

SEQ ID NO: 7175708 - DNA, 22 bp, Homo sapiens
gcacaggatgatgggttgaggg

SEQ ID NO: 7175709 - DNA, 22 bp, Homo sapiens
gcacaggaaatgactcatgtta

SEQ ID NO: 7175710 - DNA, 19 bp, Homo sapiens
gcacaggacatctgatgga

SEQ ID NO: 7175711 - DNA, 22 bp, Homo sapiens
gcacagccagcatctgagggat

SEQ ID NO: 7175712 - DNA, 22 bp, Homo sapiens
gcacagccctgagcgcatgtct

SEQ ID NO: 7175713 - DNA, 22 bp, Homo sapiens
gcacagccctgagcgcatgtct

SEQ ID NO: 7175714 - DNA, 22 bp, Homo sapiens
gcacagccctggtcggggcccc

SEQ ID NO: 7175715 - DNA, 22 bp, Homo sapiens
gcacagcctgtccctgtcctgg

SEQ ID NO: 7175716 - DNA, 22 bp, Homo sapiens
gcacagcctgtccctgtcctgg

SEQ ID NO: 7175717 - DNA, 22 bp, Homo sapiens
gcacagccttgccctgtgccct

SEQ ID NO: 7175718 - DNA, 18 bp, Homo sapiens
gcacagcgaaaaactagt

SEQ ID NO: 7175719 - DNA, 21 bp, Homo sapiens
gcacagcatgagtgttggcat

SEQ ID NO: 7175720 - DNA, 21 bp, Homo sapiens
gcacagcatgagtgttggcat

SEQ ID NO: 7175721 - DNA, 21 bp, Homo sapiens
gcacagcatgagtgttggcat

SEQ ID NO: 7175722 - DNA, 22 bp, Homo sapiens
gcacagcatgaagagaggaagc

SEQ ID NO: 7175723 - DNA, 22 bp, Homo sapiens
gcacagcatgaagagaggaagc

SEQ ID NO: 7175724 - DNA, 22 bp, Homo sapiens
gcacagcatgaagagaggaagc

SEQ ID NO: 7175725 - DNA, 22 bp, Homo sapiens
gcacagcatgaagagaggaagc

SEQ ID NO: 7175726 - DNA, 22 bp, Homo sapiens
gcacagccacgtaatgtggtca

SEQ ID NO: 7175727 - DNA, 22 bp, Homo sapiens
gcacagccacgtaatgtggtca

SEQ ID NO: 7175728 - DNA, 22 bp, Homo sapiens
gcacagccactgagtgagaacc

SEQ ID NO: 7175729 - DNA, 22 bp, Homo sapiens
gcacagccagcatctgagggat

SEQ ID NO: 7175730 - DNA, 22 bp, Homo sapiens
gcacagccagcatctgagggat

SEQ ID NO: 7175731 - DNA, 22 bp, Homo sapiens
gcacagcagtggcataaacaat

SEQ ID NO: 7175732 - DNA, 22 bp, Homo sapiens
gcaaggaagagcaggtggtgct

SEQ ID NO: 7175733 - DNA, 22 bp, Homo sapiens
gcacagcagtggcataaacaat

SEQ ID NO: 7175734 - DNA, 22 bp, Homo sapiens
gcaaggaacaaatgctctgctt

SEQ ID NO: 7175735 - DNA, 22 bp, Homo sapiens
gcaagctgcttaagctcattgt

SEQ ID NO: 7175736 - DNA, 22 bp, Homo sapiens
gcaagctgtccttttgcatggc

SEQ ID NO: 7175737 - DNA, 22 bp, Homo sapiens
gcaagctgtccttttgcatggc

SEQ ID NO: 7175738 - DNA, 22 bp, Homo sapiens
gcaagctgtgatttatgtgaat

SEQ ID NO: 7175739 - DNA, 22 bp, Homo sapiens
gcaagctgtgatttatgtgaat

SEQ ID NO: 7175740 - DNA, 22 bp, Homo sapiens
gcaagctgtgccttctcaggat

SEQ ID NO: 7175741 - DNA, 22 bp, Homo sapiens
gcaagctgatgtgatagtgaaa

SEQ ID NO: 7175742 - DNA, 22 bp, Homo sapiens
gcaagctgctcttatgtggagg

SEQ ID NO: 7175743 - DNA, 22 bp, Homo sapiens
gcaagctatagaatataagggg

SEQ ID NO: 7175744 - DNA, 22 bp, Homo sapiens
gcaagctctctgcaggcagagc

SEQ ID NO: 7175745 - DNA, 22 bp, Homo sapiens
gcaagcagttgtggcttctgag

SEQ ID NO: 7175746 - DNA, 22 bp, Homo sapiens
gcaagcagttcgcagcccgcct

SEQ ID NO: 7175747 - DNA, 22 bp, Homo sapiens
gcaagcagttgtggcttctgag

SEQ ID NO: 7175748 - DNA, 22 bp, Homo sapiens
gcaagcagcccagaacagctct

SEQ ID NO: 7175749 - DNA, 22 bp, Homo sapiens
gcaagcagggttccttagggca

SEQ ID NO: 7175750 - DNA, 22 bp, Homo sapiens
gcaagcagacattcaggtaggt

SEQ ID NO: 7175751 - DNA, 22 bp, Homo sapiens
gcaagcagactgggcccctgtg

SEQ ID NO: 7175752 - DNA, 22 bp, Homo sapiens
gcaagcagatctccggagggaa

SEQ ID NO: 7175753 - DNA, 22 bp, Homo sapiens
gcaagcagcccagaacagctct

SEQ ID NO: 7175754 - DNA, 22 bp, Homo sapiens
gcactgctttctgagtcattgt

SEQ ID NO: 7175755 - DNA, 23 bp, Homo sapiens
gcactggaaaaatgaagattact

SEQ ID NO: 7175756 - DNA, 22 bp, Homo sapiens
gcactggagaatggctgtattc

SEQ ID NO: 7175757 - DNA, 22 bp, Homo sapiens
gcactgggaatgagggcagctt

SEQ ID NO: 7175758 - DNA, 22 bp, Homo sapiens
gcactgggaatgagggcagctt

SEQ ID NO: 7175759 - DNA, 22 bp, Homo sapiens
gcactgggaagaatgagcctgt

SEQ ID NO: 7175760 - DNA, 22 bp, Homo sapiens
gcactgggaatgagggcagctt

SEQ ID NO: 7175761 - DNA, 22 bp, Homo sapiens
gcactgggaatgagggcagctt

SEQ ID NO: 7175762 - DNA, 22 bp, Homo sapiens
gcactggccgcacgcgtagggc

SEQ ID NO: 7175763 - DNA, 22 bp, Homo sapiens
gcactgggaagaatgagcctgt

SEQ ID NO: 7175764 - DNA, 22 bp, Homo sapiens
gcactgggaagaatgagcctgt

SEQ ID NO: 7175765 - DNA, 22 bp, Homo sapiens
gcactgccatcaatgcatgaca

SEQ ID NO: 7175766 - DNA, 22 bp, Homo sapiens
gcactgccatcaatgcatgaca

SEQ ID NO: 7175767 - DNA, 23 bp, Homo sapiens
gcactgccatgtgctctgcaggc

SEQ ID NO: 7175768 - DNA, 23 bp, Homo sapiens
gcactgccatgtgctctgcaggc

SEQ ID NO: 7175769 - DNA, 22 bp, Homo sapiens
gcactgccacataatctcagca

SEQ ID NO: 7175770 - DNA, 23 bp, Homo sapiens
gcactgccatgtgctctgcaggc

SEQ ID NO: 7175771 - DNA, 23 bp, Homo sapiens
gcactgccatgtgctctgcaggc

SEQ ID NO: 7175772 - DNA, 22 bp, Homo sapiens
gcactgccctcttcggggttcc

SEQ ID NO: 7175773 - DNA, 22 bp, Homo sapiens
gcactgcctatgcaaatgtact

SEQ ID NO: 7175774 - DNA, 22 bp, Homo sapiens
gcactgcctatgcaaatgtact

SEQ ID NO: 7175775 - DNA, 22 bp, Homo sapiens
gcactgcctgtgagccctggtt

SEQ ID NO: 7175776 - DNA, 22 bp, Homo sapiens
gcactgcctcatgctaataaat

SEQ ID NO: 7175777 - DNA, 22 bp, Homo sapiens
gcactgcctgtgagccctggtt

SEQ ID NO: 7175778 - DNA, 22 bp, Homo sapiens
gcactgcctgtgttcagggtaa

SEQ ID NO: 7175779 - DNA, 16 bp, Homo sapiens
gcactgccttgggccc

SEQ ID NO: 7175780 - DNA, 22 bp, Homo sapiens
gcactgctatttagctccatca

SEQ ID NO: 7175781 - DNA, 22 bp, Homo sapiens
gcactgagtctgtcatgctgca

SEQ ID NO: 7175782 - DNA, 22 bp, Homo sapiens
gcactgatgcaaaaatcactca

SEQ ID NO: 7175783 - DNA, 22 bp, Homo sapiens
gcactgcagcctcagatggtgg

SEQ ID NO: 7175784 - DNA, 22 bp, Homo sapiens
gcactgcaggtgggtggagagg

SEQ ID NO: 7175785 - DNA, 22 bp, Homo sapiens
gcactgcaggtgggtggagagg

SEQ ID NO: 7175786 - DNA, 22 bp, Homo sapiens
gcactgcaggtgggtggagagg

SEQ ID NO: 7175787 - DNA, 22 bp, Homo sapiens
gcactgcatctactggcaagta

SEQ ID NO: 7175788 - DNA, 22 bp, Homo sapiens
gcactgccacataatctcagca

SEQ ID NO: 7175789 - DNA, 22 bp, Homo sapiens
gcactgccacataatctcagca

SEQ ID NO: 7175790 - DNA, 22 bp, Homo sapiens
gcactgagcaccagccacagat

SEQ ID NO: 7175791 - DNA, 21 bp, Homo sapiens
gcactgagcatctcctctgcc

SEQ ID NO: 7175792 - DNA, 22 bp, Homo sapiens
gcactgagctttggaggagcag

SEQ ID NO: 7175793 - DNA, 22 bp, Homo sapiens
gcactgagtctgtcatgctgca

SEQ ID NO: 7175794 - DNA, 22 bp, Homo sapiens
gcacctggggtacacagctaca

SEQ ID NO: 7175795 - DNA, 22 bp, Homo sapiens
gcacctgggcaaggattcagag

SEQ ID NO: 7175796 - DNA, 22 bp, Homo sapiens
gcacctgggcaaggattcagag

SEQ ID NO: 7175797 - DNA, 22 bp, Homo sapiens
gcacctgggacccagaggcacc

SEQ ID NO: 7175798 - DNA, 22 bp, Homo sapiens
gcacaggcacagagggccactg

SEQ ID NO: 7175799 - DNA, 22 bp, Homo sapiens
gcacaggccatgggaggacagc

SEQ ID NO: 7175800 - DNA, 22 bp, Homo sapiens
gcacaggccatgggaggacagc

SEQ ID NO: 7175801 - DNA, 17 bp, Homo sapiens
gcactcccccacctcct

SEQ ID NO: 7175802 - DNA, 18 bp, Homo sapiens
gcactctgactgcagagc

SEQ ID NO: 7175803 - DNA, 22 bp, Homo sapiens
gcactctgtgatctgcagagcc

SEQ ID NO: 7175804 - DNA, 22 bp, Homo sapiens
gcacttgatcattgttacagat

SEQ ID NO: 7175805 - DNA, 22 bp, Homo sapiens
gcacttgattacattagtgcct

SEQ ID NO: 7175806 - DNA, 22 bp, Homo sapiens
gcacttgattacattagtgcct

SEQ ID NO: 7175807 - DNA, 21 bp, Homo sapiens
gcacttggaaacttcaactag

SEQ ID NO: 7175808 - DNA, 22 bp, Homo sapiens
gcagagctgcagcgaggcctgg

SEQ ID NO: 7175809 - DNA, 22 bp, Homo sapiens
gcagagctgcagcgaggcctgg

SEQ ID NO: 7175810 - DNA, 22 bp, Homo sapiens
gcagagctctgttcttatctcc

SEQ ID NO: 7175811 - DNA, 22 bp, Homo sapiens
gcagagctgagcggctgcccgg

SEQ ID NO: 7175812 - DNA, 22 bp, Homo sapiens
gcagaggacacaggagggcaag

SEQ ID NO: 7175813 - DNA, 22 bp, Homo sapiens
gcagaggacacaggagggcaag

SEQ ID NO: 7175814 - DNA, 22 bp, Homo sapiens
gcagaggacacaggagggcaag

SEQ ID NO: 7175815 - DNA, 22 bp, Homo sapiens
gcagaggacacaggagggcaag

SEQ ID NO: 7175816 - DNA, 22 bp, Homo sapiens
gcagaggacacaggagggcaag

SEQ ID NO: 7175817 - DNA, 21 bp, Homo sapiens
gcagaggaatggtatacataa

SEQ ID NO: 7175818 - DNA, 22 bp, Homo sapiens
gcagaggacacaggagggcaag

SEQ ID NO: 7175819 - DNA, 22 bp, Homo sapiens
gcagaggacacaggagggcaag

SEQ ID NO: 7175820 - DNA, 21 bp, Homo sapiens
gcagaggaatggtatacataa

SEQ ID NO: 7175821 - DNA, 22 bp, Homo sapiens
gcagaggacacaggagggcaag

SEQ ID NO: 7175822 - DNA, 22 bp, Homo sapiens
gcagaggagatgaagatacttt

SEQ ID NO: 7175823 - DNA, 22 bp, Homo sapiens
gcagaggactcaatcaaggtat

SEQ ID NO: 7175824 - DNA, 22 bp, Homo sapiens
gcagaggacagggatttagatt

SEQ ID NO: 7175825 - DNA, 22 bp, Homo sapiens
gcagaggacagggatttagatt

SEQ ID NO: 7175826 - DNA, 22 bp, Homo sapiens
gcagaggacacaggagggcaag

SEQ ID NO: 7175827 - DNA, 22 bp, Homo sapiens
gcagaggacacaggagggcaag

SEQ ID NO: 7175828 - DNA, 22 bp, Homo sapiens
gcagaggacacaggagggcaag

SEQ ID NO: 7175829 - DNA, 22 bp, Homo sapiens
gcagaggacacaggagggcaag

SEQ ID NO: 7175830 - DNA, 22 bp, Homo sapiens
gcagaggagcaagctggacacc

SEQ ID NO: 7175831 - DNA, 22 bp, Homo sapiens
gcagaggagatgaagatacttt

SEQ ID NO: 7175832 - DNA, 22 bp, Homo sapiens
gcagaggagcaagctggacacc

SEQ ID NO: 7175833 - DNA, 22 bp, Homo sapiens
gcagaggagcaagctggacacc

SEQ ID NO: 7175834 - DNA, 23 bp, Homo sapiens
gcagaggagcaagctggacacca

SEQ ID NO: 7175835 - DNA, 22 bp, Homo sapiens
gcagaggagcaagctggacacc

SEQ ID NO: 7175836 - DNA, 22 bp, Homo sapiens
gcagaggagcaagctggacacc

SEQ ID NO: 7175837 - DNA, 22 bp, Homo sapiens
gcactgggctccaggaaggagg

SEQ ID NO: 7175838 - DNA, 23 bp, Homo sapiens
gcactgggctctcagcaaggtgt

SEQ ID NO: 7175839 - DNA, 22 bp, Homo sapiens
gcactgggctccaggaaggagg

SEQ ID NO: 7175840 - DNA, 22 bp, Homo sapiens
gcactgggctccaggaaggagg

SEQ ID NO: 7175841 - DNA, 16 bp, Homo sapiens
gcactgggatgtcttc

SEQ ID NO: 7175842 - DNA, 22 bp, Homo sapiens
gcactgggagtctgtgggggtt

SEQ ID NO: 7175843 - DNA, 22 bp, Homo sapiens
gcactgggagtctgtgggggtt

SEQ ID NO: 7175844 - DNA, 22 bp, Homo sapiens
gcactgggctccaggaaggagg

SEQ ID NO: 7175845 - DNA, 22 bp, Homo sapiens
gcactgggaatgctgatgggct

SEQ ID NO: 7175846 - DNA, 22 bp, Homo sapiens
gcactgggaatgctgatgggct

SEQ ID NO: 7175847 - DNA, 22 bp, Homo sapiens
gcactgggaatgtgagcagctg

SEQ ID NO: 7175848 - DNA, 22 bp, Homo sapiens
gcactgggaatgtgagcagctg

SEQ ID NO: 7175849 - DNA, 22 bp, Homo sapiens
gcactgggaatgtgagcagctg

SEQ ID NO: 7175850 - DNA, 22 bp, Homo sapiens
gcactgggaatgtgagcagctg

SEQ ID NO: 7175851 - DNA, 22 bp, Homo sapiens
gcactgggagctgcctgccggt

SEQ ID NO: 7175852 - DNA, 22 bp, Homo sapiens
gcactgggagctgcctgccggt

SEQ ID NO: 7175853 - DNA, 22 bp, Homo sapiens
gcactgggagtctgtgggggtt

SEQ ID NO: 7175854 - DNA, 22 bp, Homo sapiens
gcactgggagtctgtgggggtt

SEQ ID NO: 7175855 - DNA, 22 bp, Homo sapiens
gcacttatggcatcttcctgtg

SEQ ID NO: 7175856 - DNA, 22 bp, Homo sapiens
gcacttagggtatgtactgggc

SEQ ID NO: 7175857 - DNA, 22 bp, Homo sapiens
gcacttatgctcaccttgttct

SEQ ID NO: 7175858 - DNA, 22 bp, Homo sapiens
gcactgttctcagagcattaga

SEQ ID NO: 7175859 - DNA, 22 bp, Homo sapiens
gcactgtttatctaagtcttga

SEQ ID NO: 7175860 - DNA, 22 bp, Homo sapiens
gcacttaactggaaaagaattt

SEQ ID NO: 7175861 - DNA, 22 bp, Homo sapiens
gcactgtgctagaagccagggg

SEQ ID NO: 7175862 - DNA, 22 bp, Homo sapiens
gcacttctggcctggcctgtgt

SEQ ID NO: 7175863 - DNA, 22 bp, Homo sapiens
gcacttctcgggggcgctgtct

SEQ ID NO: 7175864 - DNA, 21 bp, Homo sapiens
gcacttctgcagggctgctgg

SEQ ID NO: 7175865 - DNA, 22 bp, Homo sapiens
gcacttcaccactgtcctggtt

SEQ ID NO: 7175866 - DNA, 22 bp, Homo sapiens
gcacttgaaaagatcaggtgca

SEQ ID NO: 7175867 - DNA, 22 bp, Homo sapiens
gcacttgaagaattgaactgga

SEQ ID NO: 7175868 - DNA, 22 bp, Homo sapiens
gcacttgacccccagagctggt

SEQ ID NO: 7175869 - DNA, 22 bp, Homo sapiens
gcacttgacccccagagctggt

SEQ ID NO: 7175870 - DNA, 22 bp, Homo sapiens
gcacttgagccaatgctagtag

SEQ ID NO: 7175871 - DNA, 22 bp, Homo sapiens
gcacttgagccaatgctagtag

SEQ ID NO: 7175872 - DNA, 22 bp, Homo sapiens
gcacttgaggacgactcagctg

SEQ ID NO: 7175873 - DNA, 22 bp, Homo sapiens
gcacttgataaatgttaactga

SEQ ID NO: 7175874 - DNA, 22 bp, Homo sapiens
gcagcaggcacttaccgttgct

SEQ ID NO: 7175875 - DNA, 22 bp, Homo sapiens
gcagcaggcacttaccgttgct

SEQ ID NO: 7175876 - DNA, 22 bp, Homo sapiens
gcagcaggcacggtctcgacat

SEQ ID NO: 7175877 - DNA, 22 bp, Homo sapiens
gcagcaggcacggtctcgacat

SEQ ID NO: 7175878 - DNA, 22 bp, Homo sapiens
gcagcaggcacggtctcgacat

SEQ ID NO: 7175879 - DNA, 22 bp, Homo sapiens
gcagcaggtctgtcaatgtcat

SEQ ID NO: 7175880 - DNA, 22 bp, Homo sapiens
gcagcaggtctgtcaatgtcat

SEQ ID NO: 7175881 - DNA, 22 bp, Homo sapiens
gcagcaggtctgtcaatgtcat

SEQ ID NO: 7175882 - DNA, 22 bp, Homo sapiens
gcagcaggtctgtcaatgtcat

SEQ ID NO: 7175883 - DNA, 22 bp, Homo sapiens
gcagcaggtctgtcaatgtcat

SEQ ID NO: 7175884 - DNA, 22 bp, Homo sapiens
gcagcaggagagtttgtcctgc

SEQ ID NO: 7175885 - DNA, 22 bp, Homo sapiens
gcagcaggagagtttgtcctgc

SEQ ID NO: 7175886 - DNA, 22 bp, Homo sapiens
gcagcaggagagtttgtcctgc

SEQ ID NO: 7175887 - DNA, 22 bp, Homo sapiens
gcagcaggatggccaattgcca

SEQ ID NO: 7175888 - DNA, 22 bp, Homo sapiens
gcagcaggatggccaattgcca

SEQ ID NO: 7175889 - DNA, 22 bp, Homo sapiens
gcagcaggcacggtctcgacat

SEQ ID NO: 7175890 - DNA, 22 bp, Homo sapiens
gcagcaggatggccaattgcca

SEQ ID NO: 7175891 - DNA, 22 bp, Homo sapiens
gcagcaggatggccaattgcca

SEQ ID NO: 7175892 - DNA, 22 bp, Homo sapiens
gcagcaggcacggtctcgacat

SEQ ID NO: 7175893 - DNA, 22 bp, Homo sapiens
gcagcaggagagtttgtcctgc

SEQ ID NO: 7175894 - DNA, 22 bp, Homo sapiens
gcagcaggagagtttgtcctgc

SEQ ID NO: 7175895 - DNA, 22 bp, Homo sapiens
gcagcaggagagtaatagcggt

SEQ ID NO: 7175896 - DNA, 22 bp, Homo sapiens
gcagcaggagagtaatagcggt

SEQ ID NO: 7175897 - DNA, 22 bp, Homo sapiens
gcagcaggagagtttgtcctgc

SEQ ID NO: 7175898 - DNA, 22 bp, Homo sapiens
gcagcaggactgccgttaaagt

SEQ ID NO: 7175899 - DNA, 22 bp, Homo sapiens
gcagcaggaataggataagcaa

SEQ ID NO: 7175900 - DNA, 22 bp, Homo sapiens
gcagcaggaataggataagcaa

SEQ ID NO: 7175901 - DNA, 22 bp, Homo sapiens
gcagcaggaataggataagcaa

SEQ ID NO: 7175902 - DNA, 22 bp, Homo sapiens
gcagcaggaatttaaatttata

SEQ ID NO: 7175903 - DNA, 22 bp, Homo sapiens
gcagcagctgacagtgggtgcc

SEQ ID NO: 7175904 - DNA, 22 bp, Homo sapiens
gcagcagctccctatccaggct

SEQ ID NO: 7175905 - DNA, 22 bp, Homo sapiens
gcagcagctccctatccaggct

SEQ ID NO: 7175906 - DNA, 22 bp, Homo sapiens
gcagcagctcagttctgggagg

SEQ ID NO: 7175907 - DNA, 22 bp, Homo sapiens
gcagcagctcagccgggcactg

SEQ ID NO: 7175908 - DNA, 22 bp, Homo sapiens
gcagcagctcagccgggcactg

SEQ ID NO: 7175909 - DNA, 22 bp, Homo sapiens
gcagcagctcagccgggcactg

SEQ ID NO: 7175910 - DNA, 22 bp, Homo sapiens
gcagcagctcagttctgggagg

SEQ ID NO: 7175911 - DNA, 22 bp, Homo sapiens
gcagcagctcagttctgggagg

SEQ ID NO: 7175912 - DNA, 22 bp, Homo sapiens
gcagcagctcagttctgggagg

SEQ ID NO: 7175913 - DNA, 22 bp, Homo sapiens
gcagcagctctcaaagtggtct

SEQ ID NO: 7175914 - DNA, 22 bp, Homo sapiens
gcagcagctctcaaagtggtct

SEQ ID NO: 7175915 - DNA, 22 bp, Homo sapiens
gcagcagctctgaatgggcccc

SEQ ID NO: 7175916 - DNA, 22 bp, Homo sapiens
gcagcagctctgaatgggcccc

SEQ ID NO: 7175917 - DNA, 22 bp, Homo sapiens
gcagcagctctgaatgggcccc

SEQ ID NO: 7175918 - DNA, 22 bp, Homo sapiens
gcagcagctgacagtgggtgcc

SEQ ID NO: 7175919 - DNA, 22 bp, Homo sapiens
gcagcagctgacagtgggtgcc

SEQ ID NO: 7175920 - DNA, 22 bp, Homo sapiens
gcagcagctgacagtgggtgcc

SEQ ID NO: 7175921 - DNA, 22 bp, Homo sapiens
gcagcagctgacagtgggtgcc

SEQ ID NO: 7175922 - DNA, 22 bp, Homo sapiens
gcagcagctgacagtgggtgcc

SEQ ID NO: 7175923 - DNA, 22 bp, Homo sapiens
gcagcagccgacatggattgca

SEQ ID NO: 7175924 - DNA, 22 bp, Homo sapiens
gcagcagccgacatggattgca

SEQ ID NO: 7175925 - DNA, 22 bp, Homo sapiens
gcagaggaggacccaggaatta

SEQ ID NO: 7175926 - DNA, 22 bp, Homo sapiens
gcagcagccgacatggattgca

SEQ ID NO: 7175927 - DNA, 22 bp, Homo sapiens
gcagcagcggggcccctgcgcg

SEQ ID NO: 7175928 - DNA, 22 bp, Homo sapiens
gcagcagcggggcccctgcgcg

SEQ ID NO: 7175929 - DNA, 22 bp, Homo sapiens
gcagcagcggggcccctgcgcg

SEQ ID NO: 7175930 - DNA, 22 bp, Homo sapiens
gcagaggaggacccaggaatta

SEQ ID NO: 7175931 - DNA, 22 bp, Homo sapiens
gcagaggagcaagttgctacag

SEQ ID NO: 7175932 - DNA, 22 bp, Homo sapiens
gcagaggaggacccaggaatta

SEQ ID NO: 7175933 - DNA, 22 bp, Homo sapiens
gcagaggagcaagttgctacag

SEQ ID NO: 7175934 - DNA, 22 bp, Homo sapiens
gcagaggagcaagttgctacag

SEQ ID NO: 7175935 - DNA, 23 bp, Homo sapiens
gcagaggagcaagctggacacca

SEQ ID NO: 7175936 - DNA, 23 bp, Homo sapiens
gcagaggagcaagctggacacca

SEQ ID NO: 7175937 - DNA, 22 bp, Homo sapiens
gcagctgccagtccccttccag

SEQ ID NO: 7175938 - DNA, 18 bp, Homo sapiens
gcagctgcagttgtagct

SEQ ID NO: 7175939 - DNA, 22 bp, Homo sapiens
gcagctgccagtccccttccag

SEQ ID NO: 7175940 - DNA, 22 bp, Homo sapiens
gcagctgccagtccccttccag

SEQ ID NO: 7175941 - DNA, 22 bp, Homo sapiens
gcagctgcaggtggtcccatgc

SEQ ID NO: 7175942 - DNA, 22 bp, Homo sapiens
gcagctgcaggtggtcccatgc

SEQ ID NO: 7175943 - DNA, 22 bp, Homo sapiens
gcagctgcaggtggtcccatgc

SEQ ID NO: 7175944 - DNA, 22 bp, Homo sapiens
gcagctgcaggcaggcttgctg

SEQ ID NO: 7175945 - DNA, 22 bp, Homo sapiens
gcagctgcaggcaggcttgctg

SEQ ID NO: 7175946 - DNA, 20 bp, Homo sapiens
gcagctgcccccagtccctg

SEQ ID NO: 7175947 - DNA, 20 bp, Homo sapiens
gcagctgcccccagtccctg

SEQ ID NO: 7175948 - DNA, 20 bp, Homo sapiens
gcagctgcccccagtccctg

SEQ ID NO: 7175949 - DNA, 22 bp, Homo sapiens
gcagctgccccgactgtgagtc

SEQ ID NO: 7175950 - DNA, 22 bp, Homo sapiens
gcagctgccccgactgtgagtc

SEQ ID NO: 7175951 - DNA, 22 bp, Homo sapiens
gcagctgccccgactgtgagtc

SEQ ID NO: 7175952 - DNA, 22 bp, Homo sapiens
gcagctgccccgactgtgagtc

SEQ ID NO: 7175953 - DNA, 22 bp, Homo sapiens
gcagctgccgtgagctcacgcc

SEQ ID NO: 7175954 - DNA, 22 bp, Homo sapiens
gcagctgccgtgagctcacgcc

SEQ ID NO: 7175955 - DNA, 22 bp, Homo sapiens
gcagctgccgtgagctcacgcc

SEQ ID NO: 7175956 - DNA, 22 bp, Homo sapiens
gcagctgcctaaagtgctaaga

SEQ ID NO: 7175957 - DNA, 22 bp, Homo sapiens
gcagctgcagaccctcagtgct

SEQ ID NO: 7175958 - DNA, 22 bp, Homo sapiens
gcagctgcagaccctcagtgct

SEQ ID NO: 7175959 - DNA, 22 bp, Homo sapiens
gcagctgcagaccctcagtgct

SEQ ID NO: 7175960 - DNA, 22 bp, Homo sapiens
gcagctgcacttctacctaatt

SEQ ID NO: 7175961 - DNA, 22 bp, Homo sapiens
gcagctgcacttctacctaatt

SEQ ID NO: 7175962 - DNA, 22 bp, Homo sapiens
gcagctgcaataggcatcaagc

SEQ ID NO: 7175963 - DNA, 22 bp, Homo sapiens
gcagctgcaataggcatcaagc

SEQ ID NO: 7175964 - DNA, 22 bp, Homo sapiens
gcagctgcaataggcatcaagc

SEQ ID NO: 7175965 - DNA, 22 bp, Homo sapiens
gcagctgcaagcacttctggca

SEQ ID NO: 7175966 - DNA, 22 bp, Homo sapiens
gcagctgcagaccctcagtgct

SEQ ID NO: 7175967 - DNA, 22 bp, Homo sapiens
gcagctgcagaccctcagtgct

SEQ ID NO: 7175968 - DNA, 22 bp, Homo sapiens
gcagctgcagaccctcagtgct

SEQ ID NO: 7175969 - DNA, 22 bp, Homo sapiens
gcagctgcagagaccgggtggg

SEQ ID NO: 7175970 - DNA, 22 bp, Homo sapiens
gcagctgcagagaccgggtggg

SEQ ID NO: 7175971 - DNA, 22 bp, Homo sapiens
gcagctgcagagaccgggtggg

SEQ ID NO: 7175972 - DNA, 22 bp, Homo sapiens
gcagctgcaagcacttctggca

SEQ ID NO: 7175973 - DNA, 22 bp, Homo sapiens
gcagctgcaagcacttctggca

SEQ ID NO: 7175974 - DNA, 22 bp, Homo sapiens
gcagctgcaagcacttctggca

SEQ ID NO: 7175975 - DNA, 22 bp, Homo sapiens
gcagctgcaagcacttctggca

SEQ ID NO: 7175976 - DNA, 22 bp, Homo sapiens
gcagctgcaagcacttctggca

SEQ ID NO: 7175977 - DNA, 22 bp, Homo sapiens
gcagccacagaggagggatgca

SEQ ID NO: 7175978 - DNA, 22 bp, Homo sapiens
gcagctgatggaagtcctattg

SEQ ID NO: 7175979 - DNA, 22 bp, Homo sapiens
gcagccacactgttacagaatg

SEQ ID NO: 7175980 - DNA, 22 bp, Homo sapiens
gcagccacactgttacagaatg

SEQ ID NO: 7175981 - DNA, 22 bp, Homo sapiens
gcagcattgtgaggtcctgccc

SEQ ID NO: 7175982 - DNA, 23 bp, Homo sapiens
gcagccaagagaccagggcaggc

SEQ ID NO: 7175983 - DNA, 22 bp, Homo sapiens
gcagcagtgtgggctgaaccta

SEQ ID NO: 7175984 - DNA, 21 bp, Homo sapiens
gcagcagtgttctagaatact

SEQ ID NO: 7175985 - DNA, 22 bp, Homo sapiens
gcagcatacagggagagtactc

SEQ ID NO: 7175986 - DNA, 22 bp, Homo sapiens
gcagcagtggcagttaatattt

SEQ ID NO: 7175987 - DNA, 22 bp, Homo sapiens
gcagcagtggctgcaggtccca

SEQ ID NO: 7175988 - DNA, 22 bp, Homo sapiens
gcagcagtggctgcaggtccca

SEQ ID NO: 7175989 - DNA, 22 bp, Homo sapiens
gcagcagtggtctgtagaagga

SEQ ID NO: 7175990 - DNA, 22 bp, Homo sapiens
gcagcagtggtctgtagaagga

SEQ ID NO: 7175991 - DNA, 22 bp, Homo sapiens
gcagcagtggtctgtagaagga

SEQ ID NO: 7175992 - DNA, 22 bp, Homo sapiens
gcagcagtggttttatcatttt

SEQ ID NO: 7175993 - DNA, 22 bp, Homo sapiens
gcagcagtaggaaataacacag

SEQ ID NO: 7175994 - DNA, 22 bp, Homo sapiens
gcagcaggtgtgcttttaatga

SEQ ID NO: 7175995 - DNA, 22 bp, Homo sapiens
gcagcaggtgtgcttttaatga

SEQ ID NO: 7175996 - DNA, 20 bp, Homo sapiens
gcagcagtgcaagtcctctt

SEQ ID NO: 7175997 - DNA, 22 bp, Homo sapiens
gcagcagtggcagttaatattt

SEQ ID NO: 7175998 - DNA, 22 bp, Homo sapiens
gcagcatcaatccatgcttctc

SEQ ID NO: 7175999 - DNA, 22 bp, Homo sapiens
gcagcatccccaggcagcaggg

SEQ ID NO: 7176000 - DNA, 22 bp, Homo sapiens
gcagcatccccaggcagcaggg

SEQ ID NO: 7176001 - DNA, 22 bp, Homo sapiens
gcagcatctagggcactggcct

SEQ ID NO: 7176002 - DNA, 21 bp, Homo sapiens
gcagcatgagaaagccccaaa

SEQ ID NO: 7176003 - DNA, 22 bp, Homo sapiens
gcagcatggagaagtagctaga

SEQ ID NO: 7176004 - DNA, 22 bp, Homo sapiens
gcagcatggagttgtggaatga

SEQ ID NO: 7176005 - DNA, 22 bp, Homo sapiens
gcagcatggagttgtggaatga

SEQ ID NO: 7176006 - DNA, 22 bp, Homo sapiens
gcagcatggagttgtggaatga

SEQ ID NO: 7176007 - DNA, 22 bp, Homo sapiens
gcagcatggagttgtggaatga

SEQ ID NO: 7176008 - DNA, 22 bp, Homo sapiens
gcagcatgtgccttaaatcatt

SEQ ID NO: 7176009 - DNA, 22 bp, Homo sapiens
gcagcatgtgccttaaatcatt

SEQ ID NO: 7176010 - DNA, 22 bp, Homo sapiens
gcagcatgttgaaagggccaca

SEQ ID NO: 7176011 - DNA, 22 bp, Homo sapiens
gcagcatgttgaaagggccaca

SEQ ID NO: 7176012 - DNA, 22 bp, Homo sapiens
gcagcatgttgaaagggccaca

SEQ ID NO: 7176013 - DNA, 22 bp, Homo sapiens
gcagcatgttgaaagggccaca

SEQ ID NO: 7176014 - DNA, 22 bp, Homo sapiens
gcagcatgttgaaagggccaca

SEQ ID NO: 7176015 - DNA, 22 bp, Homo sapiens
gcagcatgttgaaagggccaca

SEQ ID NO: 7176016 - DNA, 22 bp, Homo sapiens
gcagcattaccaagacatggca

SEQ ID NO: 7176017 - DNA, 22 bp, Homo sapiens
gcagcattaccaagacatggca

SEQ ID NO: 7176018 - DNA, 22 bp, Homo sapiens
gcaggctgatagaggattccat

SEQ ID NO: 7176019 - DNA, 22 bp, Homo sapiens
gcaggctgagttgggaaaccaa

SEQ ID NO: 7176020 - DNA, 22 bp, Homo sapiens
gcaggctgagttgggaaaccaa

SEQ ID NO: 7176021 - DNA, 22 bp, Homo sapiens
gcaggctgagagtccaagaagg

SEQ ID NO: 7176022 - DNA, 22 bp, Homo sapiens
gcaggctgagtattaccctagt

SEQ ID NO: 7176023 - DNA, 22 bp, Homo sapiens
gcaggctgagtattaccctagt

SEQ ID NO: 7176024 - DNA, 22 bp, Homo sapiens
gcaggctgagtattaccctagt

SEQ ID NO: 7176025 - DNA, 22 bp, Homo sapiens
gcaggctgaaactcggggtcta

SEQ ID NO: 7176026 - DNA, 22 bp, Homo sapiens
gcaggctgaaactcggggtcta

SEQ ID NO: 7176027 - DNA, 22 bp, Homo sapiens
gcaggctgaaactcggggtcta

SEQ ID NO: 7176028 - DNA, 22 bp, Homo sapiens
gcaggctgaaactcggggtcta

SEQ ID NO: 7176029 - DNA, 22 bp, Homo sapiens
gcaggctgaaactcggggtcta

SEQ ID NO: 7176030 - DNA, 22 bp, Homo sapiens
gcaggctcgttggaagtcccct

SEQ ID NO: 7176031 - DNA, 22 bp, Homo sapiens
gcaggctcttctttctgcccag

SEQ ID NO: 7176032 - DNA, 22 bp, Homo sapiens
gcaggctcttctttctgcccag

SEQ ID NO: 7176033 - DNA, 22 bp, Homo sapiens
gcaggctcttctttctgcccag

SEQ ID NO: 7176034 - DNA, 19 bp, Homo sapiens
gcaggcctcttgggaatta

SEQ ID NO: 7176035 - DNA, 22 bp, Homo sapiens
gcaggctcaaaagctggtagga

SEQ ID NO: 7176036 - DNA, 22 bp, Homo sapiens
gcaggctcaaaagctggtagga

SEQ ID NO: 7176037 - DNA, 22 bp, Homo sapiens
gcaggctcactctgtttggctc

SEQ ID NO: 7176038 - DNA, 22 bp, Homo sapiens
gcaggctcagagcagattagca

SEQ ID NO: 7176039 - DNA, 22 bp, Homo sapiens
gcaggctcagagcagattagca

SEQ ID NO: 7176040 - DNA, 22 bp, Homo sapiens
gcaggctccaactggaggagtt

SEQ ID NO: 7176041 - DNA, 22 bp, Homo sapiens
gcaggctccaactggaggagtt

SEQ ID NO: 7176042 - DNA, 22 bp, Homo sapiens
gcaggctccaactggaggagtt

SEQ ID NO: 7176043 - DNA, 22 bp, Homo sapiens
gcaggctccaactggaggagtt

SEQ ID NO: 7176044 - DNA, 22 bp, Homo sapiens
gcaggctccaaggcctgggaga

SEQ ID NO: 7176045 - DNA, 22 bp, Homo sapiens
gcaggctccaaggcctgggaga

SEQ ID NO: 7176046 - DNA, 22 bp, Homo sapiens
gcaggctccaaggcctgggaga

SEQ ID NO: 7176047 - DNA, 22 bp, Homo sapiens
gcaggctccaggccggcccctt

SEQ ID NO: 7176048 - DNA, 22 bp, Homo sapiens
gcaggctccaggccggcccctt

SEQ ID NO: 7176049 - DNA, 22 bp, Homo sapiens
gcaggctcccttgcagagcagg

SEQ ID NO: 7176050 - DNA, 22 bp, Homo sapiens
gcaggctcccttgcagagcagg

SEQ ID NO: 7176051 - DNA, 20 bp, Homo sapiens
gcaggctccgggcttgggag

SEQ ID NO: 7176052 - DNA, 20 bp, Homo sapiens
gcaggctccgggcttgggag

SEQ ID NO: 7176053 - DNA, 22 bp, Homo sapiens
gcaggctcgttggaagtcccct

SEQ ID NO: 7176054 - DNA, 22 bp, Homo sapiens
gcaggctgatgactggagttgg

SEQ ID NO: 7176055 - DNA, 22 bp, Homo sapiens
gcaggctgatgactggagttgg

SEQ ID NO: 7176056 - DNA, 22 bp, Homo sapiens
gcaggctgatgactggagttgg

SEQ ID NO: 7176057 - DNA, 22 bp, Homo sapiens
gcaggctgatgactggagttgg

SEQ ID NO: 7176058 - DNA, 22 bp, Homo sapiens
gcaggctgatagaggattccat

SEQ ID NO: 7176059 - DNA, 22 bp, Homo sapiens
gcaggctgatagaggattccat

SEQ ID NO: 7176060 - DNA, 22 bp, Homo sapiens
gcaggctgatgactggagttgg

SEQ ID NO: 7176061 - DNA, 22 bp, Homo sapiens
gcaggctgatagaggattccat

SEQ ID NO: 7176062 - DNA, 22 bp, Homo sapiens
gcaggctgatagaggattccat

SEQ ID NO: 7176063 - DNA, 22 bp, Homo sapiens
gcagggccttggtcatcttttt

SEQ ID NO: 7176064 - DNA, 20 bp, Homo sapiens
gcagggcgacacgggggagg

SEQ ID NO: 7176065 - DNA, 22 bp, Homo sapiens
gcagggccttagcagcggctgc

SEQ ID NO: 7176066 - DNA, 22 bp, Homo sapiens
gcagggccttagcagcggctgc

SEQ ID NO: 7176067 - DNA, 22 bp, Homo sapiens
gcaggctgccaccttctgagtt

SEQ ID NO: 7176068 - DNA, 22 bp, Homo sapiens
gcaggctgccaccttctgagtt

SEQ ID NO: 7176069 - DNA, 22 bp, Homo sapiens
gcagggctattggaaggagatg

SEQ ID NO: 7176070 - DNA, 22 bp, Homo sapiens
gcagggctaggtcttctagggc

SEQ ID NO: 7176071 - DNA, 22 bp, Homo sapiens
gcagggctaatggggcaagtag

SEQ ID NO: 7176072 - DNA, 22 bp, Homo sapiens
gcagggctaggtcttctagggc

SEQ ID NO: 7176073 - DNA, 22 bp, Homo sapiens
gcagggctaggtcttctagggc

SEQ ID NO: 7176074 - DNA, 22 bp, Homo sapiens
gcagggctaatggggcaagtag

SEQ ID NO: 7176075 - DNA, 22 bp, Homo sapiens
gcagggctaatggggcaagtag

SEQ ID NO: 7176076 - DNA, 22 bp, Homo sapiens
gcagggcggcccagagcaggcc

SEQ ID NO: 7176077 - DNA, 22 bp, Homo sapiens
gcagggcggcccagagcaggcc

SEQ ID NO: 7176078 - DNA, 22 bp, Homo sapiens
gcagggctaatggggcaagtag

SEQ ID NO: 7176079 - DNA, 22 bp, Homo sapiens
gcagggcggcccagagcaggcc

SEQ ID NO: 7176080 - DNA, 22 bp, Homo sapiens
gcagggcggcccagagcaggcc

SEQ ID NO: 7176081 - DNA, 20 bp, Homo sapiens
gcagggcgacacgggggagg

SEQ ID NO: 7176082 - DNA, 22 bp, Homo sapiens
gcagggcgcgtttgagcgggct

SEQ ID NO: 7176083 - DNA, 22 bp, Homo sapiens
gcagggcgcgtttgagcgggct

SEQ ID NO: 7176084 - DNA, 22 bp, Homo sapiens
gcagggcgcgtttgagcgggct

SEQ ID NO: 7176085 - DNA, 22 bp, Homo sapiens
gcagctggagccagccagacac

SEQ ID NO: 7176086 - DNA, 22 bp, Homo sapiens
gcagctggagccagccagacac

SEQ ID NO: 7176087 - DNA, 22 bp, Homo sapiens
gcagctggagcatcttctcatc

SEQ ID NO: 7176088 - DNA, 22 bp, Homo sapiens
gcagctggagccagccagacac

SEQ ID NO: 7176089 - DNA, 22 bp, Homo sapiens
gcagctggatttcaagagggag

SEQ ID NO: 7176090 - DNA, 22 bp, Homo sapiens
gcagctggatttcaagagggag

SEQ ID NO: 7176091 - DNA, 22 bp, Homo sapiens
gcagctggatttcaagagggag

SEQ ID NO: 7176092 - DNA, 22 bp, Homo sapiens
gcagctgcctattcagggcttg

SEQ ID NO: 7176093 - DNA, 22 bp, Homo sapiens
gcagctgcctaaagtgctaaga

SEQ ID NO: 7176094 - DNA, 22 bp, Homo sapiens
gcagctgcctattcagggcttg

SEQ ID NO: 7176095 - DNA, 22 bp, Homo sapiens
gcagctgcctattcagggcttg

SEQ ID NO: 7176096 - DNA, 22 bp, Homo sapiens
gcagctggacccacacggctta

SEQ ID NO: 7176097 - DNA, 22 bp, Homo sapiens
gcagctggagaaataccaccct

SEQ ID NO: 7176098 - DNA, 22 bp, Homo sapiens
gcagctggagaaataccaccct

SEQ ID NO: 7176099 - DNA, 22 bp, Homo sapiens
gcagctggagcatcttctcatc

SEQ ID NO: 7176100 - DNA, 22 bp, Homo sapiens
gcaggaggatcacttgagccca

SEQ ID NO: 7176101 - DNA, 22 bp, Homo sapiens
gcaggaggatcacttgagccca

SEQ ID NO: 7176102 - DNA, 22 bp, Homo sapiens
gcaggaggccaggtatgcttta

SEQ ID NO: 7176103 - DNA, 22 bp, Homo sapiens
gcaggaggccaggtatgcttta

SEQ ID NO: 7176104 - DNA, 22 bp, Homo sapiens
gcaggagctggaaagtgatgtt

SEQ ID NO: 7176105 - DNA, 22 bp, Homo sapiens
gcaggagctttgcttactgctg

SEQ ID NO: 7176106 - DNA, 22 bp, Homo sapiens
gcaggagctttgcttactgctg

SEQ ID NO: 7176107 - DNA, 22 bp, Homo sapiens
gcaggaggagcattaactgagc

SEQ ID NO: 7176108 - DNA, 22 bp, Homo sapiens
gcaggaggagcattaactgagc

SEQ ID NO: 7176109 - DNA, 22 bp, Homo sapiens
gcagctggccctgacacgcaga

SEQ ID NO: 7176110 - DNA, 22 bp, Homo sapiens
gcagctggccctgacacgcaga

SEQ ID NO: 7176111 - DNA, 22 bp, Homo sapiens
gcaggagctggaaagtgatgtt

SEQ ID NO: 7176112 - DNA, 22 bp, Homo sapiens
gcaggagtgacatggatgtgga

SEQ ID NO: 7176113 - DNA, 22 bp, Homo sapiens
gcaggagtgacatggatgtgga

SEQ ID NO: 7176114 - DNA, 22 bp, Homo sapiens
gcaggagtcactgacttggtcc

SEQ ID NO: 7176115 - DNA, 22 bp, Homo sapiens
gcaggagtcagccctaccttga

SEQ ID NO: 7176116 - DNA, 22 bp, Homo sapiens
gcaggagtcccagaaggttttg

SEQ ID NO: 7176117 - DNA, 22 bp, Homo sapiens
gcaggagtatctatacattaaa

SEQ ID NO: 7176118 - DNA, 22 bp, Homo sapiens
gcaggagtatctatacattaaa

SEQ ID NO: 7176119 - DNA, 22 bp, Homo sapiens
gcaggagtatgcagctatggtt

SEQ ID NO: 7176120 - DNA, 22 bp, Homo sapiens
gcaggagtatgcagctatggtt

SEQ ID NO: 7176121 - DNA, 22 bp, Homo sapiens
gcaggagtatgcagctatggtt

SEQ ID NO: 7176122 - DNA, 22 bp, Homo sapiens
gcaggaggttgagccaggactg

SEQ ID NO: 7176123 - DNA, 22 bp, Homo sapiens
gcaggaggttgagccaggactg

SEQ ID NO: 7176124 - DNA, 22 bp, Homo sapiens
gcaggaggttgagccaggactg

SEQ ID NO: 7176125 - DNA, 22 bp, Homo sapiens
gcaggaggttgagccaggactg

SEQ ID NO: 7176126 - DNA, 22 bp, Homo sapiens
gcaggaggttgagccaggactg

SEQ ID NO: 7176127 - DNA, 22 bp, Homo sapiens
gcaggaggttgagccaggactg

SEQ ID NO: 7176128 - DNA, 16 bp, Homo sapiens
gcaggagtaccacttg

SEQ ID NO: 7176129 - DNA, 22 bp, Homo sapiens
gcaggaggccaggtatgcttta

SEQ ID NO: 7176130 - DNA, 22 bp, Homo sapiens
gcaggaggccaggtatgcttta

SEQ ID NO: 7176131 - DNA, 22 bp, Homo sapiens
gcaggaggttgagccaggactg

SEQ ID NO: 7176132 - DNA, 22 bp, Homo sapiens
gcaggaggttgagccaggactg

SEQ ID NO: 7176133 - DNA, 22 bp, Homo sapiens
gcaggagttagaggtttaatct

SEQ ID NO: 7176134 - DNA, 22 bp, Homo sapiens
gcaggagttaggcgtcgtggat

SEQ ID NO: 7176135 - DNA, 22 bp, Homo sapiens
gcaggagtgtgtctaatactca

SEQ ID NO: 7176136 - DNA, 22 bp, Homo sapiens
gcaggagttaaaatatgtaatg

SEQ ID NO: 7176137 - DNA, 22 bp, Homo sapiens
gcaggagttagaggtttaatct

SEQ ID NO: 7176138 - DNA, 22 bp, Homo sapiens
gcaggagttaggcgtcgtggat

SEQ ID NO: 7176139 - DNA, 22 bp, Homo sapiens
gcaggcctctaattcaccgcag

SEQ ID NO: 7176140 - DNA, 22 bp, Homo sapiens
gcaggcctctgttgagggcctt

SEQ ID NO: 7176141 - DNA, 22 bp, Homo sapiens
gcaggcctctgttgagggcctt

SEQ ID NO: 7176142 - DNA, 19 bp, Homo sapiens
gcaggcctcttgggaatta

SEQ ID NO: 7176143 - DNA, 22 bp, Homo sapiens
gcaggagtgtatttgcatgtaa

SEQ ID NO: 7176144 - DNA, 22 bp, Homo sapiens
gcaggagtgtatttgcatgtaa

SEQ ID NO: 7176145 - DNA, 22 bp, Homo sapiens
gcaggagtgtggtgggacatcc

SEQ ID NO: 7176146 - DNA, 22 bp, Homo sapiens
gcaggagtgtggtgggacatcc

SEQ ID NO: 7176147 - DNA, 22 bp, Homo sapiens
gcaggagtgtggtgggacatcc

SEQ ID NO: 7176148 - DNA, 22 bp, Homo sapiens
gcaggagtggagaccatgggga

SEQ ID NO: 7176149 - DNA, 22 bp, Homo sapiens
gcaggagtgacatggatgtgga

SEQ ID NO: 7176150 - DNA, 22 bp, Homo sapiens
gcaggagtgacatggatgtgga

SEQ ID NO: 7176151 - DNA, 22 bp, Homo sapiens
gcaggagtgacatggatgtgga

SEQ ID NO: 7176152 - DNA, 22 bp, Homo sapiens
gaagggctttctgggagaagag

SEQ ID NO: 7176153 - DNA, 22 bp, Homo sapiens
gaagggcttggctgggaggcca

SEQ ID NO: 7176154 - DNA, 22 bp, Homo sapiens
gaagggctttctgggagaagag

SEQ ID NO: 7176155 - DNA, 22 bp, Homo sapiens
gaagggcttggctgggaggcca

SEQ ID NO: 7176156 - DNA, 22 bp, Homo sapiens
gaagggctcatcaggtggccgc

SEQ ID NO: 7176157 - DNA, 22 bp, Homo sapiens
gaagggctcatcaggtggccgc

SEQ ID NO: 7176158 - DNA, 22 bp, Homo sapiens
gaagggctgcaggtctgggccc

SEQ ID NO: 7176159 - DNA, 22 bp, Homo sapiens
gaagggctgcaggtctgggccc

SEQ ID NO: 7176160 - DNA, 22 bp, Homo sapiens
gaagggctgcaggtctgggccc

SEQ ID NO: 7176161 - DNA, 18 bp, Homo sapiens
gaagggagctggaatgca

SEQ ID NO: 7176162 - DNA, 18 bp, Homo sapiens
gaagggagctggaatgca

SEQ ID NO: 7176163 - DNA, 18 bp, Homo sapiens
gaagggagctggaatgca

SEQ ID NO: 7176164 - DNA, 22 bp, Homo sapiens
gaaggggactggcagctgcaga

SEQ ID NO: 7176165 - DNA, 22 bp, Homo sapiens
gaaggggactggcagctgcaga

SEQ ID NO: 7176166 - DNA, 22 bp, Homo sapiens
gaaggggagtggctagtgtgtg

SEQ ID NO: 7176167 - DNA, 22 bp, Homo sapiens
gaaggggaaagttgagcaaata

SEQ ID NO: 7176168 - DNA, 22 bp, Homo sapiens
gaaggggaaagttgagcaaata

SEQ ID NO: 7176169 - DNA, 19 bp, Homo sapiens
gaaggggaaggtgggtacc

SEQ ID NO: 7176170 - DNA, 19 bp, Homo sapiens
gaaggggaaggtgggtacc

SEQ ID NO: 7176171 - DNA, 22 bp, Homo sapiens
gaaggtggcgagcggattgctg

SEQ ID NO: 7176172 - DNA, 22 bp, Homo sapiens
gaaggtgtcagcaagtcaaagc

SEQ ID NO: 7176173 - DNA, 22 bp, Homo sapiens
gaaggtgtcagcaagtcaaagc

SEQ ID NO: 7176174 - DNA, 22 bp, Homo sapiens
gaaggtgcaggcaaggttggtt

SEQ ID NO: 7176175 - DNA, 22 bp, Homo sapiens
gaagggtgtgtgtgagggacac

SEQ ID NO: 7176176 - DNA, 22 bp, Homo sapiens
gaagggtgtgatttgcctgaga

SEQ ID NO: 7176177 - DNA, 22 bp, Homo sapiens
gaagggtgtgtgtgagggacac

SEQ ID NO: 7176178 - DNA, 22 bp, Homo sapiens
gaagggtgtgtgtgagggacac

SEQ ID NO: 7176179 - DNA, 22 bp, Homo sapiens
gaagggtgtgtgtgagggacac

SEQ ID NO: 7176180 - DNA, 22 bp, Homo sapiens
gaagggtgtgtgtgagggacac

SEQ ID NO: 7176181 - DNA, 22 bp, Homo sapiens
gaagggtgtgtgtgagggacac

SEQ ID NO: 7176182 - DNA, 22 bp, Homo sapiens
gaagggtgtgatttgcctgaga

SEQ ID NO: 7176183 - DNA, 22 bp, Homo sapiens
gaagggtgcatggagggaagtc

SEQ ID NO: 7176184 - DNA, 22 bp, Homo sapiens
gaagggtgcatggagggaagtc

SEQ ID NO: 7176185 - DNA, 22 bp, Homo sapiens
gaagggtgcatggagggaagtc

SEQ ID NO: 7176186 - DNA, 22 bp, Homo sapiens
gaagggtgcatggagggaagtc

SEQ ID NO: 7176187 - DNA, 22 bp, Homo sapiens
gaagggtgcatggagggaagtc

SEQ ID NO: 7176188 - DNA, 22 bp, Homo sapiens
gaagggtgcatggagggaagtc

SEQ ID NO: 7176189 - DNA, 22 bp, Homo sapiens
gaagggggaaaatgacaacaga

SEQ ID NO: 7176190 - DNA, 22 bp, Homo sapiens
gaagggggaaaatgacaacaga

SEQ ID NO: 7176191 - DNA, 22 bp, Homo sapiens
gaagggggagctcttcctaatt

SEQ ID NO: 7176192 - DNA, 22 bp, Homo sapiens
gaagggggttgcagtctagggt

SEQ ID NO: 7176193 - DNA, 22 bp, Homo sapiens
gaagggggttgcagtctagggt

SEQ ID NO: 7176194 - DNA, 22 bp, Homo sapiens
gaaggtgtgcagggccaaagtt

SEQ ID NO: 7176195 - DNA, 22 bp, Homo sapiens
gaaggtgtgcagggccaaagtt

SEQ ID NO: 7176196 - DNA, 22 bp, Homo sapiens
gaaggtttactgaagatttaaa

SEQ ID NO: 7176197 - DNA, 22 bp, Homo sapiens
gaaggttatgggggttggatta

SEQ ID NO: 7176198 - DNA, 22 bp, Homo sapiens
gaaggtttgaaataggtataga

SEQ ID NO: 7176199 - DNA, 17 bp, Homo sapiens
gaaggtttctcttaggt

SEQ ID NO: 7176200 - DNA, 22 bp, Homo sapiens
gaaggttatgggggttggatta

SEQ ID NO: 7176201 - DNA, 22 bp, Homo sapiens
gaatatttgtaattactgttga

SEQ ID NO: 7176202 - DNA, 22 bp, Homo sapiens
gaaggtttgatccttatttata

SEQ ID NO: 7176203 - DNA, 22 bp, Homo sapiens
gaaggtttgatccttatttata

SEQ ID NO: 7176204 - DNA, 22 bp, Homo sapiens
gaatatttgtaattactgttga

SEQ ID NO: 7176205 - DNA, 22 bp, Homo sapiens
gaatatttgtaattactgttga

SEQ ID NO: 7176206 - DNA, 22 bp, Homo sapiens
gaatattttcagtacagatggt

SEQ ID NO: 7176207 - DNA, 22 bp, Homo sapiens
gaatcattcattgctcaattaa

SEQ ID NO: 7176208 - DNA, 22 bp, Homo sapiens
gaatcattcattgctcaattaa

SEQ ID NO: 7176209 - DNA, 22 bp, Homo sapiens
gaatcattcattgctcaattaa

SEQ ID NO: 7176210 - DNA, 22 bp, Homo sapiens
gaatcattggaaccacatccaa

SEQ ID NO: 7176211 - DNA, 22 bp, Homo sapiens
gaatcattggaaccacatccaa

SEQ ID NO: 7176212 - DNA, 22 bp, Homo sapiens
gaatcattcattgctcaattaa

SEQ ID NO: 7176213 - DNA, 22 bp, Homo sapiens
gaatcatttagctctgcatgga

SEQ ID NO: 7176214 - DNA, 22 bp, Homo sapiens
gaatcatttagctctgcatgga

SEQ ID NO: 7176215 - DNA, 22 bp, Homo sapiens
gaatcatttatttttgacagca

SEQ ID NO: 7176216 - DNA, 22 bp, Homo sapiens
gaatcatttatttttgacagca

SEQ ID NO: 7176217 - DNA, 22 bp, Homo sapiens
gaatcatttcttctgaaaggta

SEQ ID NO: 7176218 - DNA, 22 bp, Homo sapiens
gaatcatttcttctgaaaggta

SEQ ID NO: 7176219 - DNA, 22 bp, Homo sapiens
gaatctatgcctcatatagacc

SEQ ID NO: 7176220 - DNA, 22 bp, Homo sapiens
gaatctatgcctcatatagacc

SEQ ID NO: 7176221 - DNA, 22 bp, Homo sapiens
gaatctcaaattaagaatttta

SEQ ID NO: 7176222 - DNA, 22 bp, Homo sapiens
gaatctcaggaagatctctgca

SEQ ID NO: 7176223 - DNA, 22 bp, Homo sapiens
gaatctcaggggagttactgga

SEQ ID NO: 7176224 - DNA, 22 bp, Homo sapiens
gaatcccttgcaagttgttgta

SEQ ID NO: 7176225 - DNA, 22 bp, Homo sapiens
gaatcccttgcaagttgttgta

SEQ ID NO: 7176226 - DNA, 22 bp, Homo sapiens
gaatcccaatctgttattgaca

SEQ ID NO: 7176227 - DNA, 22 bp, Homo sapiens
gaatccctaagatttttataaa

SEQ ID NO: 7176228 - DNA, 22 bp, Homo sapiens
gaatcccttgcattatcccttt

SEQ ID NO: 7176229 - DNA, 22 bp, Homo sapiens
gaatctcagtggaagcaggaag

SEQ ID NO: 7176230 - DNA, 22 bp, Homo sapiens
gaatctcattctaactagtagg

SEQ ID NO: 7176231 - DNA, 22 bp, Homo sapiens
gaatctgggtgactggttcttt

SEQ ID NO: 7176232 - DNA, 20 bp, Homo sapiens
gaatctggtcaaatgtctat

SEQ ID NO: 7176233 - DNA, 22 bp, Homo sapiens
gacagacaggaggcattcaggg

SEQ ID NO: 7176234 - DNA, 22 bp, Homo sapiens
gacagacaggagctcacaggca

SEQ ID NO: 7176235 - DNA, 22 bp, Homo sapiens
gacagacaggaggcattcaggg

SEQ ID NO: 7176236 - DNA, 22 bp, Homo sapiens
gacagacaggaggcattcaggg

SEQ ID NO: 7176237 - DNA, 22 bp, Homo sapiens
gacagacaggagctcacaggca

SEQ ID NO: 7176238 - DNA, 22 bp, Homo sapiens
gacagacaggagctcacaggca

SEQ ID NO: 7176239 - DNA, 22 bp, Homo sapiens
gacagacactattggtatgcct

SEQ ID NO: 7176240 - DNA, 22 bp, Homo sapiens
gacagacactgtgtcctcactt

SEQ ID NO: 7176241 - DNA, 22 bp, Homo sapiens
gacagacactgtgtcctcactt

SEQ ID NO: 7176242 - DNA, 22 bp, Homo sapiens
gacagacactgtgtcctcactt

SEQ ID NO: 7176243 - DNA, 22 bp, Homo sapiens
gacagacagagaatgggcttga

SEQ ID NO: 7176244 - DNA, 22 bp, Homo sapiens
gacagacaggaggcattcaggg

SEQ ID NO: 7176245 - DNA, 22 bp, Homo sapiens
gacagacaggaggccacctgct

SEQ ID NO: 7176246 - DNA, 22 bp, Homo sapiens
gacagacaggaggccacctgct

SEQ ID NO: 7176247 - DNA, 22 bp, Homo sapiens
gacagacaggaggccacctgct

SEQ ID NO: 7176248 - DNA, 22 bp, Homo sapiens
gacagacaggaggccacctgct

SEQ ID NO: 7176249 - DNA, 22 bp, Homo sapiens
gacagacaggaggccacctgct

SEQ ID NO: 7176250 - DNA, 22 bp, Homo sapiens
gacagacaggggttctcctgga

SEQ ID NO: 7176251 - DNA, 22 bp, Homo sapiens
gacagacaggggttctcctgga

SEQ ID NO: 7176252 - DNA, 22 bp, Homo sapiens
gacagacaggtgtggtaggcac

SEQ ID NO: 7176253 - DNA, 22 bp, Homo sapiens
gacagacaggtgtggtaggcac

SEQ ID NO: 7176254 - DNA, 22 bp, Homo sapiens
gacagacatgggacttcatact

SEQ ID NO: 7176255 - DNA, 22 bp, Homo sapiens
gacagacatgggacttcatact

SEQ ID NO: 7176256 - DNA, 22 bp, Homo sapiens
gacagacaaatgtttttaactt

SEQ ID NO: 7176257 - DNA, 22 bp, Homo sapiens
gacagaattttccatcatgtgg

SEQ ID NO: 7176258 - DNA, 22 bp, Homo sapiens
gacagacacaattgatccatga

SEQ ID NO: 7176259 - DNA, 22 bp, Homo sapiens
gacagacacagggccatgattg

SEQ ID NO: 7176260 - DNA, 22 bp, Homo sapiens
gacagacacagggccatgattg

SEQ ID NO: 7176261 - DNA, 22 bp, Homo sapiens
gacagacacctggggggttgct

SEQ ID NO: 7176262 - DNA, 22 bp, Homo sapiens
gacagacacagggccatgattg

SEQ ID NO: 7176263 - DNA, 22 bp, Homo sapiens
gacagacactattggtatgcct

SEQ ID NO: 7176264 - DNA, 22 bp, Homo sapiens
gacactttggtgctttgtggtt

SEQ ID NO: 7176265 - DNA, 22 bp, Homo sapiens
gacagaactcaaacatgagaag

SEQ ID NO: 7176266 - DNA, 22 bp, Homo sapiens
gacagaactcaaacatgagaag

SEQ ID NO: 7176267 - DNA, 22 bp, Homo sapiens
gacactttgggactcagcccta

SEQ ID NO: 7176268 - DNA, 22 bp, Homo sapiens
gacactttattaagctgttgtt

SEQ ID NO: 7176269 - DNA, 22 bp, Homo sapiens
gacagaagaggaacttggacag

SEQ ID NO: 7176270 - DNA, 22 bp, Homo sapiens
gacagaagaggaacttggacag

SEQ ID NO: 7176271 - DNA, 22 bp, Homo sapiens
gacagaaggcatctagggcacg

SEQ ID NO: 7176272 - DNA, 22 bp, Homo sapiens
gacagaaggcatctagggcacg

SEQ ID NO: 7176273 - DNA, 22 bp, Homo sapiens
gacagaaggcatctagggcacg

SEQ ID NO: 7176274 - DNA, 22 bp, Homo sapiens
gacagaatcatctcctgggact

SEQ ID NO: 7176275 - DNA, 22 bp, Homo sapiens
gacagaattttccatcatgtgg

SEQ ID NO: 7176276 - DNA, 22 bp, Homo sapiens
gaatgaacaaatgtggtggaga

SEQ ID NO: 7176277 - DNA, 22 bp, Homo sapiens
gaatgaacaaggatgttcatcc

SEQ ID NO: 7176278 - DNA, 22 bp, Homo sapiens
gaatgaacaaggatgttcatcc

SEQ ID NO: 7176279 - DNA, 22 bp, Homo sapiens
gaatgaagcaggtcacacagtt

SEQ ID NO: 7176280 - DNA, 22 bp, Homo sapiens
gaatgatatattagcagatttt

SEQ ID NO: 7176281 - DNA, 22 bp, Homo sapiens
gaatgatagagctgccttcgga

SEQ ID NO: 7176282 - DNA, 22 bp, Homo sapiens
gaatgatagagctgccttcgga

SEQ ID NO: 7176283 - DNA, 22 bp, Homo sapiens
gaatgataaatggaagcagcat

SEQ ID NO: 7176284 - DNA, 22 bp, Homo sapiens
gaatgaggtcatcttgtaatct

SEQ ID NO: 7176285 - DNA, 22 bp, Homo sapiens
gaatgagttaatatttgcttgg

SEQ ID NO: 7176286 - DNA, 22 bp, Homo sapiens
gaatgagttaatatttgcttgg

SEQ ID NO: 7176287 - DNA, 22 bp, Homo sapiens
gaatgataaatggaagcagcat

SEQ ID NO: 7176288 - DNA, 22 bp, Homo sapiens
gaatgacattgaaaagacattg

SEQ ID NO: 7176289 - DNA, 22 bp, Homo sapiens
gaatgacattgagccataacat

SEQ ID NO: 7176290 - DNA, 22 bp, Homo sapiens
gaatgacgccctgtggtcactt

SEQ ID NO: 7176291 - DNA, 22 bp, Homo sapiens
gaatgagactatgcgagtgtga

SEQ ID NO: 7176292 - DNA, 22 bp, Homo sapiens
gaatgagggagatgttggtgca

SEQ ID NO: 7176293 - DNA, 22 bp, Homo sapiens
gacactggaaatattgaattgg

SEQ ID NO: 7176294 - DNA, 22 bp, Homo sapiens
gacactggatttctagaaatgt

SEQ ID NO: 7176295 - DNA, 22 bp, Homo sapiens
gacactggcttgtcccgccatc

SEQ ID NO: 7176296 - DNA, 22 bp, Homo sapiens
gacactgtcccacagaattcga

SEQ ID NO: 7176297 - DNA, 22 bp, Homo sapiens
gacactgtcccacagaattcga

SEQ ID NO: 7176298 - DNA, 22 bp, Homo sapiens
gacactgtgctagctgggctta

SEQ ID NO: 7176299 - DNA, 22 bp, Homo sapiens
gacactgttatggtgaggtaag

SEQ ID NO: 7176300 - DNA, 22 bp, Homo sapiens
gacacttgacatccagcagcaa

SEQ ID NO: 7176301 - DNA, 22 bp, Homo sapiens
gacacttgtgctgtttctgagc

SEQ ID NO: 7176302 - DNA, 22 bp, Homo sapiens
gacactttaggatttaaaagtc

SEQ ID NO: 7176303 - DNA, 22 bp, Homo sapiens
gacactttaggccaccatgcaa

SEQ ID NO: 7176304 - DNA, 22 bp, Homo sapiens
gacacagttacttattttgcct

SEQ ID NO: 7176305 - DNA, 22 bp, Homo sapiens
gacacagttctgttctagtagg

SEQ ID NO: 7176306 - DNA, 22 bp, Homo sapiens
gaatgatttagtgttcaaggaa

SEQ ID NO: 7176307 - DNA, 22 bp, Homo sapiens
gaatgatttggttgtttagatt

SEQ ID NO: 7176308 - DNA, 22 bp, Homo sapiens
gaatgatatattagcagatttt

SEQ ID NO: 7176309 - DNA, 22 bp, Homo sapiens
gaatgatatattagcagatttt

SEQ ID NO: 7176310 - DNA, 22 bp, Homo sapiens
gaatgatattatttcgtgctgg

SEQ ID NO: 7176311 - DNA, 22 bp, Homo sapiens
gaatgatattatttcgtgctgg

SEQ ID NO: 7176312 - DNA, 22 bp, Homo sapiens
gaatgattaactagttgataca

SEQ ID NO: 7176313 - DNA, 22 bp, Homo sapiens
gaatgattaactagttgataca

SEQ ID NO: 7176314 - DNA, 22 bp, Homo sapiens
gaaggcaggtttttcaaaactg

SEQ ID NO: 7176315 - DNA, 22 bp, Homo sapiens
gaaggcagtaaatggctgtttt

SEQ ID NO: 7176316 - DNA, 22 bp, Homo sapiens
gaaggcagtaaatggctgtttt

SEQ ID NO: 7176317 - DNA, 22 bp, Homo sapiens
gaaggcagtaaatggctgtttt

SEQ ID NO: 7176318 - DNA, 22 bp, Homo sapiens
gaaggccacaaaaaatgtcata

SEQ ID NO: 7176319 - DNA, 22 bp, Homo sapiens
gaaggccacaagagaagttaag

SEQ ID NO: 7176320 - DNA, 22 bp, Homo sapiens
gaaggccactttgtgttgagaa

SEQ ID NO: 7176321 - DNA, 22 bp, Homo sapiens
gaaggccagttttgagataggt

SEQ ID NO: 7176322 - DNA, 22 bp, Homo sapiens
gaaggcccagcttgaatgctgc

SEQ ID NO: 7176323 - DNA, 22 bp, Homo sapiens
gaaggccatttttaggtagaat

SEQ ID NO: 7176324 - DNA, 22 bp, Homo sapiens
gaaggccatttttaggtagaat

SEQ ID NO: 7176325 - DNA, 22 bp, Homo sapiens
gaaggccagttttgagataggt

SEQ ID NO: 7176326 - DNA, 22 bp, Homo sapiens
gaaggccattagagcctgtgcc

SEQ ID NO: 7176327 - DNA, 22 bp, Homo sapiens
gaagggagaaggttgggtgacg

SEQ ID NO: 7176328 - DNA, 22 bp, Homo sapiens
gaagggagaaggttgggtgacg

SEQ ID NO: 7176329 - DNA, 22 bp, Homo sapiens
gaagggagaaggttgggtgacg

SEQ ID NO: 7176330 - DNA, 22 bp, Homo sapiens
gaagggagaaggttgggtgacg

SEQ ID NO: 7176331 - DNA, 22 bp, Homo sapiens
gaagggagaaggttgggtgacg

SEQ ID NO: 7176332 - DNA, 22 bp, Homo sapiens
gaagggagaaggttgggtgacg

SEQ ID NO: 7176333 - DNA, 22 bp, Homo sapiens
gaagggagaaggttgggtgacg

SEQ ID NO: 7176334 - DNA, 18 bp, Homo sapiens
gaagggagctggaatgca

SEQ ID NO: 7176335 - DNA, 18 bp, Homo sapiens
gaagggagctggaatgca

SEQ ID NO: 7176336 - DNA, 18 bp, Homo sapiens
gaagggagctggaatgca

SEQ ID NO: 7176337 - DNA, 22 bp, Homo sapiens
gaaggcagggaatgtggtgcta

SEQ ID NO: 7176338 - DNA, 22 bp, Homo sapiens
gaaggcagggaatgtggtgcta

SEQ ID NO: 7176339 - DNA, 22 bp, Homo sapiens
gaaggcaggcttctgattaggt

SEQ ID NO: 7176340 - DNA, 22 bp, Homo sapiens
gaaggcagggaatgtggtgcta

SEQ ID NO: 7176341 - DNA, 22 bp, Homo sapiens
gaaggcaggtttttcaaaactg

SEQ ID NO: 7176342 - DNA, 22 bp, Homo sapiens
gaaggcagggaatgtggtgcta

SEQ ID NO: 7176343 - DNA, 22 bp, Homo sapiens
gaaggcactgaactccttctgg

SEQ ID NO: 7176344 - DNA, 22 bp, Homo sapiens
gaaggcacagatggcagtccac

SEQ ID NO: 7176345 - DNA, 22 bp, Homo sapiens
gaaggcaaggagggaagccacc

SEQ ID NO: 7176346 - DNA, 22 bp, Homo sapiens
gaaggcaaggagggaagccacc

SEQ ID NO: 7176347 - DNA, 22 bp, Homo sapiens
gaagccactatagatattctaa

SEQ ID NO: 7176348 - DNA, 22 bp, Homo sapiens
gaagccactatagatattctaa

SEQ ID NO: 7176349 - DNA, 22 bp, Homo sapiens
gaagccaccctccttccagccc

SEQ ID NO: 7176350 - DNA, 22 bp, Homo sapiens
gaagccacagggaaggagaaca

SEQ ID NO: 7176351 - DNA, 22 bp, Homo sapiens
gaagccacagagattgtggggg

SEQ ID NO: 7176352 - DNA, 23 bp, Homo sapiens
gaagccacacaaaggtcgccaag

SEQ ID NO: 7176353 - DNA, 23 bp, Homo sapiens
gaagccacacaaaggtcgccaag

SEQ ID NO: 7176354 - DNA, 22 bp, Homo sapiens
gaagccacaactttttcttagc

SEQ ID NO: 7176355 - DNA, 20 bp, Homo sapiens
gaagccagaggggaaaggag

SEQ ID NO: 7176356 - DNA, 20 bp, Homo sapiens
gaagccagaggggaaaggag

SEQ ID NO: 7176357 - DNA, 20 bp, Homo sapiens
gaagccagaggggaaaggag

SEQ ID NO: 7176358 - DNA, 22 bp, Homo sapiens
gaagccactatagatattctaa

SEQ ID NO: 7176359 - DNA, 16 bp, Homo sapiens
gaaggagattcagaaa

SEQ ID NO: 7176360 - DNA, 22 bp, Homo sapiens
gaaggagccgagctcttcccca

SEQ ID NO: 7176361 - DNA, 22 bp, Homo sapiens
gaaggagccgagctcttcccca

SEQ ID NO: 7176362 - DNA, 22 bp, Homo sapiens
gaaggagctaaagggagccctg

SEQ ID NO: 7176363 - DNA, 22 bp, Homo sapiens
gaaggagctaaagggagccctg

SEQ ID NO: 7176364 - DNA, 22 bp, Homo sapiens
gaaggagctaccaagactgaat

SEQ ID NO: 7176365 - DNA, 22 bp, Homo sapiens
gaaaggaaatattctaagcact

SEQ ID NO: 7176366 - DNA, 22 bp, Homo sapiens
gaaaggaaatattctaagcact

SEQ ID NO: 7176367 - DNA, 22 bp, Homo sapiens
gaaagcttccattttgtacatt

SEQ ID NO: 7176368 - DNA, 22 bp, Homo sapiens
gaaaggaaatattctaagcact

SEQ ID NO: 7176369 - DNA, 22 bp, Homo sapiens
gaaagctgaaccaggaaccatg

SEQ ID NO: 7176370 - DNA, 22 bp, Homo sapiens
gaaaggaaattgagggacgcat

SEQ ID NO: 7176371 - DNA, 22 bp, Homo sapiens
gaaaggaaattgagggacgcat

SEQ ID NO: 7176372 - DNA, 22 bp, Homo sapiens
gaaaggaacttgtgagtgggag

SEQ ID NO: 7176373 - DNA, 22 bp, Homo sapiens
gaaaggaacttgtgagtgggag

SEQ ID NO: 7176374 - DNA, 22 bp, Homo sapiens
gaaaggaacttgtgagtgggag

SEQ ID NO: 7176375 - DNA, 22 bp, Homo sapiens
gaaaggaacttgtgagtgggag

SEQ ID NO: 7176376 - DNA, 22 bp, Homo sapiens
gaaaggaagaaaggtcatttta

SEQ ID NO: 7176377 - DNA, 18 bp, Homo sapiens
gaaaggagagacagtagg

SEQ ID NO: 7176378 - DNA, 18 bp, Homo sapiens
gaaaggagagacagtagg

SEQ ID NO: 7176379 - DNA, 18 bp, Homo sapiens
gaaaggagagacagtagg

SEQ ID NO: 7176380 - DNA, 18 bp, Homo sapiens
gaaaggagagacagtagg

SEQ ID NO: 7176381 - DNA, 22 bp, Homo sapiens
gaaaggagagggttaaggagct

SEQ ID NO: 7176382 - DNA, 22 bp, Homo sapiens
gaaaggagagggttaaggagct

SEQ ID NO: 7176383 - DNA, 18 bp, Homo sapiens
gaaaggagagacagtagg

SEQ ID NO: 7176384 - DNA, 22 bp, Homo sapiens
gaaaggagagggttaaggagct

SEQ ID NO: 7176385 - DNA, 22 bp, Homo sapiens
gaaaggagagggttaaggagct

SEQ ID NO: 7176386 - DNA, 22 bp, Homo sapiens
gaaaggagagggttaaggagct

SEQ ID NO: 7176387 - DNA, 17 bp, Homo sapiens
gaaaggaggcaacactg

SEQ ID NO: 7176388 - DNA, 17 bp, Homo sapiens
gaaaggaggcaacactg

SEQ ID NO: 7176389 - DNA, 22 bp, Homo sapiens
gaaaggagggaaacagagcggt

SEQ ID NO: 7176390 - DNA, 22 bp, Homo sapiens
gaaaggagggaaacagagcggt

SEQ ID NO: 7176391 - DNA, 22 bp, Homo sapiens
gaaaggagggaaacagagcggt

SEQ ID NO: 7176392 - DNA, 22 bp, Homo sapiens
gaaaggagggaaacagagcggt

SEQ ID NO: 7176393 - DNA, 22 bp, Homo sapiens
gaaaggagggctcacaaaagtg

SEQ ID NO: 7176394 - DNA, 22 bp, Homo sapiens
gaaaggagggctcacaaaagtg

SEQ ID NO: 7176395 - DNA, 22 bp, Homo sapiens
gaaaggagggctcacaaaagtg

SEQ ID NO: 7176396 - DNA, 22 bp, Homo sapiens
gaaaggagtcagtcttactgaa

SEQ ID NO: 7176397 - DNA, 22 bp, Homo sapiens
gaaaggagtcagtcttactgaa

SEQ ID NO: 7176398 - DNA, 22 bp, Homo sapiens
gaaaggagtgaatatttgtgac

SEQ ID NO: 7176399 - DNA, 22 bp, Homo sapiens
gaaaggagtgaatatttgtgac

SEQ ID NO: 7176400 - DNA, 22 bp, Homo sapiens
gaaaggagtgctttccaggtct

SEQ ID NO: 7176401 - DNA, 22 bp, Homo sapiens
gaagccaagtcctcgagtttca

SEQ ID NO: 7176402 - DNA, 22 bp, Homo sapiens
gaagccaagccagctgatggag

SEQ ID NO: 7176403 - DNA, 22 bp, Homo sapiens
gaagcatgctaaggattctcag

SEQ ID NO: 7176404 - DNA, 22 bp, Homo sapiens
gaagcatcagcaatggctggaa

SEQ ID NO: 7176405 - DNA, 18 bp, Homo sapiens
gaagcatatttgttcttc

SEQ ID NO: 7176406 - DNA, 22 bp, Homo sapiens
gaagcagtgtgaacccatgtaa

SEQ ID NO: 7176407 - DNA, 22 bp, Homo sapiens
gaagcagtgtgaacccatgtaa

SEQ ID NO: 7176408 - DNA, 22 bp, Homo sapiens
gaagcagttcgaaagcagttgg

SEQ ID NO: 7176409 - DNA, 22 bp, Homo sapiens
gaagcagttcgaaagcagttgg

SEQ ID NO: 7176410 - DNA, 22 bp, Homo sapiens
gaagcagttcgaaagcagttgg

SEQ ID NO: 7176411 - DNA, 22 bp, Homo sapiens
gaagcagtttctgtaatgaaat

SEQ ID NO: 7176412 - DNA, 22 bp, Homo sapiens
gaagcagtttctgtaatgaaat

SEQ ID NO: 7176413 - DNA, 22 bp, Homo sapiens
gaagcagctggtgagatggagc

SEQ ID NO: 7176414 - DNA, 22 bp, Homo sapiens
gaagcagctggtgagatggagc

SEQ ID NO: 7176415 - DNA, 20 bp, Homo sapiens
gaagcagcttcatgtagaca

SEQ ID NO: 7176416 - DNA, 20 bp, Homo sapiens
gaagcagcttcatgtagaca

SEQ ID NO: 7176417 - DNA, 22 bp, Homo sapiens
gaagcagctttctggtgaggag

SEQ ID NO: 7176418 - DNA, 22 bp, Homo sapiens
gaagcagctttctggtgaggag

SEQ ID NO: 7176419 - DNA, 22 bp, Homo sapiens
gaagcagctttctggtgaggag

SEQ ID NO: 7176420 - DNA, 22 bp, Homo sapiens
gaagcagggagcagtctttgca

SEQ ID NO: 7176421 - DNA, 22 bp, Homo sapiens
gaagcagtagattcctactcat

SEQ ID NO: 7176422 - DNA, 22 bp, Homo sapiens
gaagcagtagattcctactcat

SEQ ID NO: 7176423 - DNA, 22 bp, Homo sapiens
gaagcagtagcaactgtgtctt

SEQ ID NO: 7176424 - DNA, 22 bp, Homo sapiens
gaagcagtagcaactgtgtctt

SEQ ID NO: 7176425 - DNA, 22 bp, Homo sapiens
gaagcagtagcaactgtgtctt

SEQ ID NO: 7176426 - DNA, 22 bp, Homo sapiens
gaagcagtatcctgacagcacc

SEQ ID NO: 7176427 - DNA, 22 bp, Homo sapiens
gaagcagtcagcagcacctttg

SEQ ID NO: 7176428 - DNA, 22 bp, Homo sapiens
gaagcagtgtgaacccatgtaa

SEQ ID NO: 7176429 - DNA, 22 bp, Homo sapiens
gaagcagtgtgaacccatgtaa

SEQ ID NO: 7176430 - DNA, 22 bp, Homo sapiens
gaagcagtgtgaacccatgtaa

SEQ ID NO: 7176431 - DNA, 22 bp, Homo sapiens
gaagcaaagagctagtgccgct

SEQ ID NO: 7176432 - DNA, 20 bp, Homo sapiens
gaaaggagtgtccctgtgag

SEQ ID NO: 7176433 - DNA, 22 bp, Homo sapiens
gaaaggcaggcagggtgtccat

SEQ ID NO: 7176434 - DNA, 22 bp, Homo sapiens
gaagcaagtgcaaggaagaggc

SEQ ID NO: 7176435 - DNA, 22 bp, Homo sapiens
gaagcaagtgcaaggaagaggc

SEQ ID NO: 7176436 - DNA, 22 bp, Homo sapiens
gaagcaagtggcctgattcaga

SEQ ID NO: 7176437 - DNA, 22 bp, Homo sapiens
gaagcagcagctggggacagtt

SEQ ID NO: 7176438 - DNA, 22 bp, Homo sapiens
gaagcagcagctggggacagtt

SEQ ID NO: 7176439 - DNA, 22 bp, Homo sapiens
gaagcagcagctggggacagtt

SEQ ID NO: 7176440 - DNA, 22 bp, Homo sapiens
gaagcagccacggggagacaga

SEQ ID NO: 7176441 - DNA, 22 bp, Homo sapiens
gaagcagccacggggagacaga

SEQ ID NO: 7176442 - DNA, 22 bp, Homo sapiens
gaagcagccacggggagacaga

SEQ ID NO: 7176443 - DNA, 22 bp, Homo sapiens
gaagcagcgaagtggaagggac

SEQ ID NO: 7176444 - DNA, 22 bp, Homo sapiens
gaagcagctggtgagatggagc

SEQ ID NO: 7176445 - DNA, 22 bp, Homo sapiens
gagactgcattgtccaagggtt

SEQ ID NO: 7176446 - DNA, 22 bp, Homo sapiens
gagactgctggtaaagatggga

SEQ ID NO: 7176447 - DNA, 22 bp, Homo sapiens
gagactgcatagatggccacaa

SEQ ID NO: 7176448 - DNA, 22 bp, Homo sapiens
gagactgcattgtccaagggtt

SEQ ID NO: 7176449 - DNA, 20 bp, Homo sapiens
gagactggatctggagagac

SEQ ID NO: 7176450 - DNA, 20 bp, Homo sapiens
gagactggatctggagagac

SEQ ID NO: 7176451 - DNA, 20 bp, Homo sapiens
gagactggatctggagagac

SEQ ID NO: 7176452 - DNA, 22 bp, Homo sapiens
gagactgggggcttggcctttt

SEQ ID NO: 7176453 - DNA, 22 bp, Homo sapiens
gagacccaggggtctgctgccc

SEQ ID NO: 7176454 - DNA, 22 bp, Homo sapiens
gagaccccagctcagcctccag

SEQ ID NO: 7176455 - DNA, 22 bp, Homo sapiens
gagaccccctgagttatggcct

SEQ ID NO: 7176456 - DNA, 22 bp, Homo sapiens
gagaccctcttcctccctacag

SEQ ID NO: 7176457 - DNA, 22 bp, Homo sapiens
gagacctctgatgtccctgggg

SEQ ID NO: 7176458 - DNA, 22 bp, Homo sapiens
gagacctgagtcaccctgtctg

SEQ ID NO: 7176459 - DNA, 22 bp, Homo sapiens
gagacctgcagctgtagtctgc

SEQ ID NO: 7176460 - DNA, 22 bp, Homo sapiens
gagaccttaagagatgtcagct

SEQ ID NO: 7176461 - DNA, 22 bp, Homo sapiens
gagaccttaggaacagcctcaa

SEQ ID NO: 7176462 - DNA, 22 bp, Homo sapiens
gagacggggccctggccaggcg

SEQ ID NO: 7176463 - DNA, 22 bp, Homo sapiens
gagacggggccctggccaggcg

SEQ ID NO: 7176464 - DNA, 22 bp, Homo sapiens
gagactggtgtttgctgggctg

SEQ ID NO: 7176465 - DNA, 22 bp, Homo sapiens
gagactggtgtttgctgggctg

SEQ ID NO: 7176466 - DNA, 22 bp, Homo sapiens
gagactggtgtttgctgggctg

SEQ ID NO: 7176467 - DNA, 22 bp, Homo sapiens
gagactgtaagctccttgagga

SEQ ID NO: 7176468 - DNA, 22 bp, Homo sapiens
gagagaaaaatgagcttcattg

SEQ ID NO: 7176469 - DNA, 22 bp, Homo sapiens
gagagaaaaatgagcttcattg

SEQ ID NO: 7176470 - DNA, 22 bp, Homo sapiens
gagagaaaacaagttctccatt

SEQ ID NO: 7176471 - DNA, 22 bp, Homo sapiens
gagagaaaacaagttctccatt

SEQ ID NO: 7176472 - DNA, 22 bp, Homo sapiens
gagagaaaagggggaattgatt

SEQ ID NO: 7176473 - DNA, 22 bp, Homo sapiens
gagagaaaagggggaattgatt

SEQ ID NO: 7176474 - DNA, 22 bp, Homo sapiens
gagagaaagcccctgcatccct

SEQ ID NO: 7176475 - DNA, 22 bp, Homo sapiens
gagagaaaggataacagctcaa

SEQ ID NO: 7176476 - DNA, 22 bp, Homo sapiens
gagagaaaggataacagctcaa

SEQ ID NO: 7176477 - DNA, 22 bp, Homo sapiens
gagagaaaggataacagctcaa

SEQ ID NO: 7176478 - DNA, 22 bp, Homo sapiens
gagagggcaaacttgtagctaa

SEQ ID NO: 7176479 - DNA, 18 bp, Homo sapiens
gagagggatccctcagga

SEQ ID NO: 7176480 - DNA, 18 bp, Homo sapiens
gagagggatccctcagga

SEQ ID NO: 7176481 - DNA, 18 bp, Homo sapiens
gagagggatccctcagga

SEQ ID NO: 7176482 - DNA, 18 bp, Homo sapiens
gagagggatccctcagga

SEQ ID NO: 7176483 - DNA, 18 bp, Homo sapiens
gagagggatccctcagga

SEQ ID NO: 7176484 - DNA, 18 bp, Homo sapiens
gagagggatccctcagga

SEQ ID NO: 7176485 - DNA, 18 bp, Homo sapiens
gagagggatccctcagga

SEQ ID NO: 7176486 - DNA, 22 bp, Homo sapiens
gagagaaccctaaatgagatat

SEQ ID NO: 7176487 - DNA, 22 bp, Homo sapiens
gagagaaccctaaatgagatat

SEQ ID NO: 7176488 - DNA, 22 bp, Homo sapiens
gagagaaccctaaatgagatat

SEQ ID NO: 7176489 - DNA, 22 bp, Homo sapiens
gagagaagaaagccatggtcct

SEQ ID NO: 7176490 - DNA, 22 bp, Homo sapiens
gagagaaaggcttgcaggctgt

SEQ ID NO: 7176491 - DNA, 22 bp, Homo sapiens
gagagaaaggcttgcaggctgt

SEQ ID NO: 7176492 - DNA, 22 bp, Homo sapiens
gagagaaatgtgcagtttgggc

SEQ ID NO: 7176493 - DNA, 22 bp, Homo sapiens
gagagaaatgtgcagtttgggc

SEQ ID NO: 7176494 - DNA, 22 bp, Homo sapiens
gagagggctgcctggtgtgagg

SEQ ID NO: 7176495 - DNA, 22 bp, Homo sapiens
gagagggctctgtgtgggtact

SEQ ID NO: 7176496 - DNA, 22 bp, Homo sapiens
gagagggctctgtgtgggtact

SEQ ID NO: 7176497 - DNA, 22 bp, Homo sapiens
gagagggctctgtgtgggtact

SEQ ID NO: 7176498 - DNA, 22 bp, Homo sapiens
gagagggctctgtgtgggtact

SEQ ID NO: 7176499 - DNA, 22 bp, Homo sapiens
gagagggccagggtgagaacta

SEQ ID NO: 7176500 - DNA, 22 bp, Homo sapiens
gagagggccgggggccagctcc

SEQ ID NO: 7176501 - DNA, 22 bp, Homo sapiens
gagagggccgggggccagctcc

SEQ ID NO: 7176502 - DNA, 22 bp, Homo sapiens
gagagggccagggtgagaacta

SEQ ID NO: 7176503 - DNA, 21 bp, Homo sapiens
gagagggcattataggaagtg

SEQ ID NO: 7176504 - DNA, 22 bp, Homo sapiens
gagagggccagggtgagaacta

SEQ ID NO: 7176505 - DNA, 21 bp, Homo sapiens
gagagggcattataggaagtg

SEQ ID NO: 7176506 - DNA, 21 bp, Homo sapiens
gagagggcattataggaagtg

SEQ ID NO: 7176507 - DNA, 21 bp, Homo sapiens
gagagggcattataggaagtg

SEQ ID NO: 7176508 - DNA, 21 bp, Homo sapiens
gagagggcattataggaagtg

SEQ ID NO: 7176509 - DNA, 22 bp, Homo sapiens
gagagggcaaggtagatgctac

SEQ ID NO: 7176510 - DNA, 22 bp, Homo sapiens
gagagggcaaggtagatgctac

SEQ ID NO: 7176511 - DNA, 22 bp, Homo sapiens
gagaaagatggaatcttacagg

SEQ ID NO: 7176512 - DNA, 22 bp, Homo sapiens
gagaaagatggaatcttacagg

SEQ ID NO: 7176513 - DNA, 22 bp, Homo sapiens
gagaaagatggaatcttacagg

SEQ ID NO: 7176514 - DNA, 22 bp, Homo sapiens
gagaaagatgaagagtggcgtt

SEQ ID NO: 7176515 - DNA, 22 bp, Homo sapiens
gagaaagatgaagagtggcgtt

SEQ ID NO: 7176516 - DNA, 22 bp, Homo sapiens
gagaaagatgaagagtggcgtt

SEQ ID NO: 7176517 - DNA, 22 bp, Homo sapiens
gagaaagacgtaggctgggagg

SEQ ID NO: 7176518 - DNA, 22 bp, Homo sapiens
gagaaagacgtaggctgggagg

SEQ ID NO: 7176519 - DNA, 22 bp, Homo sapiens
gagaaagaaagggaagtttgtt

SEQ ID NO: 7176520 - DNA, 22 bp, Homo sapiens
gagaaagacgtaggctgggagg

SEQ ID NO: 7176521 - DNA, 22 bp, Homo sapiens
gagaaagacgtaggctgggagg

SEQ ID NO: 7176522 - DNA, 22 bp, Homo sapiens
gagaaagacgtaggctgggagg

SEQ ID NO: 7176523 - DNA, 22 bp, Homo sapiens
gagaaagacgtaggctgggagg

SEQ ID NO: 7176524 - DNA, 22 bp, Homo sapiens
gagaaactaacatctgaaggtg

SEQ ID NO: 7176525 - DNA, 22 bp, Homo sapiens
gagaaacctgtaaggaaggaag

SEQ ID NO: 7176526 - DNA, 18 bp, Homo sapiens
gagaaacctgtgaatgct

SEQ ID NO: 7176527 - DNA, 22 bp, Homo sapiens
gagaaacctgtaaggaaggaag

SEQ ID NO: 7176528 - DNA, 22 bp, Homo sapiens
gagaaacaggaattgagtcgct

SEQ ID NO: 7176529 - DNA, 22 bp, Homo sapiens
gagaaacaggaattgagtcgct

SEQ ID NO: 7176530 - DNA, 22 bp, Homo sapiens
gagaaacaggaattgagtcgct

SEQ ID NO: 7176531 - DNA, 19 bp, Homo sapiens
gagaaaccccgtctttagg

SEQ ID NO: 7176532 - DNA, 22 bp, Homo sapiens
gagaaaccgattctgcatgtca

SEQ ID NO: 7176533 - DNA, 23 bp, Homo sapiens
gagaaacctcggtaagcaggagg

SEQ ID NO: 7176534 - DNA, 22 bp, Homo sapiens
gagaaacactgttagtttatta

SEQ ID NO: 7176535 - DNA, 22 bp, Homo sapiens
gagaaacactgttagtttatta

SEQ ID NO: 7176536 - DNA, 22 bp, Homo sapiens
gagaaacactgttagtttatta

SEQ ID NO: 7176537 - DNA, 22 bp, Homo sapiens
gagaaacactgttagtttatta

SEQ ID NO: 7176538 - DNA, 22 bp, Homo sapiens
gagaaacactgttagtttatta

SEQ ID NO: 7176539 - DNA, 22 bp, Homo sapiens
gactgaggtgcccagaggtgac

SEQ ID NO: 7176540 - DNA, 22 bp, Homo sapiens
gactgcaaccttagactagaaa

SEQ ID NO: 7176541 - DNA, 22 bp, Homo sapiens
gactgaggtgcccagaggtgac

SEQ ID NO: 7176542 - DNA, 22 bp, Homo sapiens
gactgaggtgacctaggactac

SEQ ID NO: 7176543 - DNA, 22 bp, Homo sapiens
gactgcagtgaaggcacatggg

SEQ ID NO: 7176544 - DNA, 22 bp, Homo sapiens
gactgcagtgaaggcacatggg

SEQ ID NO: 7176545 - DNA, 22 bp, Homo sapiens
gactgcagtaagcctcatgact

SEQ ID NO: 7176546 - DNA, 22 bp, Homo sapiens
gactgcagtaagcctcatgact

SEQ ID NO: 7176547 - DNA, 22 bp, Homo sapiens
gagaaacaacacttgatgcctt

SEQ ID NO: 7176548 - DNA, 22 bp, Homo sapiens
gagaccaggaagtacagcagcc

SEQ ID NO: 7176549 - DNA, 22 bp, Homo sapiens
gagaccaggaagtacagcagcc

SEQ ID NO: 7176550 - DNA, 22 bp, Homo sapiens
gagaccaggaagtacagcagcc

SEQ ID NO: 7176551 - DNA, 22 bp, Homo sapiens
gagaccaggaagtacagcagcc

SEQ ID NO: 7176552 - DNA, 23 bp, Homo sapiens
gagaccagggccagctgtgtcat

SEQ ID NO: 7176553 - DNA, 23 bp, Homo sapiens
gagaccagggccagctgtgtcat

SEQ ID NO: 7176554 - DNA, 20 bp, Homo sapiens
gagacagcaaaagcctctcc

SEQ ID NO: 7176555 - DNA, 20 bp, Homo sapiens
gagacagcaaaagcctctcc

SEQ ID NO: 7176556 - DNA, 22 bp, Homo sapiens
gagacagatgctgctggagcat

SEQ ID NO: 7176557 - DNA, 22 bp, Homo sapiens
gagaaaggcattcctatgcaaa

SEQ ID NO: 7176558 - DNA, 22 bp, Homo sapiens
gagacagatgctgctggagcat

SEQ ID NO: 7176559 - DNA, 22 bp, Homo sapiens
gagaaaggcatccttggcttca

SEQ ID NO: 7176560 - DNA, 22 bp, Homo sapiens
gagaaaggcattcctatgcaaa

SEQ ID NO: 7176561 - DNA, 22 bp, Homo sapiens
gagaaagatggaatcttacagg

SEQ ID NO: 7176562 - DNA, 22 bp, Homo sapiens
gagaaagatgtaggctgggagg

SEQ ID NO: 7176563 - DNA, 22 bp, Homo sapiens
gagaaagatgtaggctgggagg

SEQ ID NO: 7176564 - DNA, 22 bp, Homo sapiens
gagaaagatgtaggctgggagg

SEQ ID NO: 7176565 - DNA, 22 bp, Homo sapiens
gagaaagatgtaggctgggagg

SEQ ID NO: 7176566 - DNA, 22 bp, Homo sapiens
gagaaagatgtaggctgggagg

SEQ ID NO: 7176567 - DNA, 22 bp, Homo sapiens
gagaaagatgtaggctgggagg

SEQ ID NO: 7176568 - DNA, 22 bp, Homo sapiens
gagaaagattgtccttcagggg

SEQ ID NO: 7176569 - DNA, 22 bp, Homo sapiens
gagaaagattgtccttcagggg

SEQ ID NO: 7176570 - DNA, 22 bp, Homo sapiens
gagaaagattgtccttcagggg

SEQ ID NO: 7176571 - DNA, 22 bp, Homo sapiens
gagaaagattgtccttcagggg

SEQ ID NO: 7176572 - DNA, 19 bp, Homo sapiens
gagaaagcaggcacagcac

SEQ ID NO: 7176573 - DNA, 18 bp, Homo sapiens
gagaaagcagggaatgtt

SEQ ID NO: 7176574 - DNA, 23 bp, Homo sapiens
gagaaagccggctatgatcctgg

SEQ ID NO: 7176575 - DNA, 22 bp, Homo sapiens
gagaaagctaaataagttgatt

SEQ ID NO: 7176576 - DNA, 22 bp, Homo sapiens
gagaaagctaataggaatccta

SEQ ID NO: 7176577 - DNA, 22 bp, Homo sapiens
gaccagaaatgattctccagct

SEQ ID NO: 7176578 - DNA, 22 bp, Homo sapiens
gaccagaaagtcatgagtcagt

SEQ ID NO: 7176579 - DNA, 22 bp, Homo sapiens
gaccagaaatcaacacagaatg

SEQ ID NO: 7176580 - DNA, 22 bp, Homo sapiens
gaccagaatctggactctgatt

SEQ ID NO: 7176581 - DNA, 22 bp, Homo sapiens
gaccagagaaaggcactggaag

SEQ ID NO: 7176582 - DNA, 22 bp, Homo sapiens
gaccactggggtgagggccatc

SEQ ID NO: 7176583 - DNA, 22 bp, Homo sapiens
gaccacagtccagtcatcatgg

SEQ ID NO: 7176584 - DNA, 22 bp, Homo sapiens
gaccacagtccagtcatcatgg

SEQ ID NO: 7176585 - DNA, 22 bp, Homo sapiens
gaccacagtccagtcatcatgg

SEQ ID NO: 7176586 - DNA, 22 bp, Homo sapiens
gaccacaggtatgggcttggca

SEQ ID NO: 7176587 - DNA, 22 bp, Homo sapiens
gacatttagctgttttgcattt

SEQ ID NO: 7176588 - DNA, 22 bp, Homo sapiens
gacatttagaagttagattcaa

SEQ ID NO: 7176589 - DNA, 22 bp, Homo sapiens
gacatttaggtagcttccagtt

SEQ ID NO: 7176590 - DNA, 22 bp, Homo sapiens
gaccacagcagtgcaagaggag

SEQ ID NO: 7176591 - DNA, 22 bp, Homo sapiens
gaccacagctacaagggcaagg

SEQ ID NO: 7176592 - DNA, 21 bp, Homo sapiens
gaccacagggaaggtcttgca

SEQ ID NO: 7176593 - DNA, 22 bp, Homo sapiens
gactcccctgggccccatccag

SEQ ID NO: 7176594 - DNA, 22 bp, Homo sapiens
gactcccctgggccccatccag

SEQ ID NO: 7176595 - DNA, 22 bp, Homo sapiens
gactcccctgggccccatccag

SEQ ID NO: 7176596 - DNA, 22 bp, Homo sapiens
gactcctcagtcaccctcagct

SEQ ID NO: 7176597 - DNA, 22 bp, Homo sapiens
gactcctcagtcaccctcagct

SEQ ID NO: 7176598 - DNA, 22 bp, Homo sapiens
gactccaggtgtccaggcctcc

SEQ ID NO: 7176599 - DNA, 22 bp, Homo sapiens
gactccagtgattgtcctgtct

SEQ ID NO: 7176600 - DNA, 22 bp, Homo sapiens
gactccatccaatctgtgttct

SEQ ID NO: 7176601 - DNA, 22 bp, Homo sapiens
gactccatccaatctgtgttct

SEQ ID NO: 7176602 - DNA, 22 bp, Homo sapiens
gactcccaagcttggaggaagg

SEQ ID NO: 7176603 - DNA, 22 bp, Homo sapiens
gactcccaagcttggaggaagg

SEQ ID NO: 7176604 - DNA, 22 bp, Homo sapiens
gactccagggattggaagatgt

SEQ ID NO: 7176605 - DNA, 22 bp, Homo sapiens
gactccagggattggaagatgt

SEQ ID NO: 7176606 - DNA, 22 bp, Homo sapiens
gactccaggtgtccaggcctcc

SEQ ID NO: 7176607 - DNA, 22 bp, Homo sapiens
gaccaggagatttgagctaggc

SEQ ID NO: 7176608 - DNA, 22 bp, Homo sapiens
gaccaggctagttcagagcttc

SEQ ID NO: 7176609 - DNA, 22 bp, Homo sapiens
gaccaggaaagagtgtgactaa

SEQ ID NO: 7176610 - DNA, 22 bp, Homo sapiens
gaccagctggtcctgtcctggg

SEQ ID NO: 7176611 - DNA, 22 bp, Homo sapiens
gaccagctggtcctgtcctggg

SEQ ID NO: 7176612 - DNA, 22 bp, Homo sapiens
gaccagctggtgaaaaccaatt

SEQ ID NO: 7176613 - DNA, 22 bp, Homo sapiens
gaccagctacttgtacagttca

SEQ ID NO: 7176614 - DNA, 22 bp, Homo sapiens
gaccagctctctgaagaaagag

SEQ ID NO: 7176615 - DNA, 22 bp, Homo sapiens
gaccagctgataaggcatataa

SEQ ID NO: 7176616 - DNA, 22 bp, Homo sapiens
gaccagctggtcctgtcctggg

SEQ ID NO: 7176617 - DNA, 22 bp, Homo sapiens
gactctggtgtcagaagtgccc

SEQ ID NO: 7176618 - DNA, 22 bp, Homo sapiens
gactctggtgtcagaagtgccc

SEQ ID NO: 7176619 - DNA, 22 bp, Homo sapiens
gactctggtgtcagaagtgccc

SEQ ID NO: 7176620 - DNA, 22 bp, Homo sapiens
gactctgggctgagccagggcc

SEQ ID NO: 7176621 - DNA, 22 bp, Homo sapiens
gactcctcccgctcccatgccg

SEQ ID NO: 7176622 - DNA, 22 bp, Homo sapiens
gactcctctctaacccactgga

SEQ ID NO: 7176623 - DNA, 22 bp, Homo sapiens
gactcctgggcctctgagaggc

SEQ ID NO: 7176624 - DNA, 22 bp, Homo sapiens
gactcctgggcctctgagaggc

SEQ ID NO: 7176625 - DNA, 22 bp, Homo sapiens
gactcgctcccttttgtcttat

SEQ ID NO: 7176626 - DNA, 22 bp, Homo sapiens
gactctagattcatggtggagt

SEQ ID NO: 7176627 - DNA, 22 bp, Homo sapiens
gactcggcacttgtcttggagt

SEQ ID NO: 7176628 - DNA, 22 bp, Homo sapiens
gactctcaagcacaagtccacc

SEQ ID NO: 7176629 - DNA, 22 bp, Homo sapiens
gactctgctgactagttgacta

SEQ ID NO: 7176630 - DNA, 22 bp, Homo sapiens
gactctttccctgtgacagagt

SEQ ID NO: 7176631 - DNA, 22 bp, Homo sapiens
gactgagggacagggcagtgga

SEQ ID NO: 7176632 - DNA, 22 bp, Homo sapiens
gactgaggctcccctaggctca

SEQ ID NO: 7176633 - DNA, 17 bp, Homo sapiens
gactgaggtaaggtgag

SEQ ID NO: 7176634 - DNA, 22 bp, Homo sapiens
gactgaggtattaagatggctt

SEQ ID NO: 7176635 - DNA, 22 bp, Homo sapiens
gactgaggtattaagatggctt

SEQ ID NO: 7176636 - DNA, 22 bp, Homo sapiens
gacagacatttcctgatccaat

SEQ ID NO: 7176637 - DNA, 22 bp, Homo sapiens
gacagacatgggacttcatact

SEQ ID NO: 7176638 - DNA, 22 bp, Homo sapiens
gacagacatttcctgatccaat

SEQ ID NO: 7176639 - DNA, 22 bp, Homo sapiens
gacagagaggctgagcagtaca

SEQ ID NO: 7176640 - DNA, 22 bp, Homo sapiens
gacagagaggctgagcagtaca

SEQ ID NO: 7176641 - DNA, 22 bp, Homo sapiens
gacagagaggctgagcagtaca

SEQ ID NO: 7176642 - DNA, 22 bp, Homo sapiens
gacagagaggctgagcagtaca

SEQ ID NO: 7176643 - DNA, 22 bp, Homo sapiens
gacagagaggctgagcagtaca

SEQ ID NO: 7176644 - DNA, 22 bp, Homo sapiens
gacagactgcgtagtccccaaa

SEQ ID NO: 7176645 - DNA, 22 bp, Homo sapiens
gacagagaggctgagcagtaca

SEQ ID NO: 7176646 - DNA, 22 bp, Homo sapiens
gacagaggagaagatgctgtgg

SEQ ID NO: 7176647 - DNA, 22 bp, Homo sapiens
gacagagctgctctagattctg

SEQ ID NO: 7176648 - DNA, 22 bp, Homo sapiens
gacagagattgaatcaggaaat

SEQ ID NO: 7176649 - DNA, 22 bp, Homo sapiens
gacagagcagcacccagcccct

SEQ ID NO: 7176650 - DNA, 22 bp, Homo sapiens
gacagagattgaatcaggaaat

SEQ ID NO: 7176651 - DNA, 22 bp, Homo sapiens
gacagagattgaatcaggaaat

SEQ ID NO: 7176652 - DNA, 22 bp, Homo sapiens
gacagagattgaatcaggaaat

SEQ ID NO: 7176653 - DNA, 22 bp, Homo sapiens
gacagagaggctgagcagtaca

SEQ ID NO: 7176654 - DNA, 22 bp, Homo sapiens
gacagagattgaatcaggaaat

SEQ ID NO: 7176655 - DNA, 22 bp, Homo sapiens
gacagcagacaaaccatgtttt

SEQ ID NO: 7176656 - DNA, 22 bp, Homo sapiens
gacagcagacagaactacctgc

SEQ ID NO: 7176657 - DNA, 22 bp, Homo sapiens
gacagcagaatccattcccagt

SEQ ID NO: 7176658 - DNA, 22 bp, Homo sapiens
gacagcagacaaaccatgtttt

SEQ ID NO: 7176659 - DNA, 22 bp, Homo sapiens
gacagcagaatccattcccagt

SEQ ID NO: 7176660 - DNA, 22 bp, Homo sapiens
gacagcagaaaacttttgtgct

SEQ ID NO: 7176661 - DNA, 22 bp, Homo sapiens
gacagcagacagaactacctgc

SEQ ID NO: 7176662 - DNA, 22 bp, Homo sapiens
gacagcagacagaactacctgc

SEQ ID NO: 7176663 - DNA, 22 bp, Homo sapiens
gacagcagacagcctggcccct

SEQ ID NO: 7176664 - DNA, 22 bp, Homo sapiens
gacagcagacagcctggcccct

SEQ ID NO: 7176665 - DNA, 22 bp, Homo sapiens
gacagcagacagcctggcccct

SEQ ID NO: 7176666 - DNA, 22 bp, Homo sapiens
gacagcagacagcctggcccct

SEQ ID NO: 7176667 - DNA, 22 bp, Homo sapiens
gacagcagagcagactaatgga

SEQ ID NO: 7176668 - DNA, 22 bp, Homo sapiens
gacagaggcaagaccagaagcc

SEQ ID NO: 7176669 - DNA, 22 bp, Homo sapiens
gacagaggcaagaccagaagcc

SEQ ID NO: 7176670 - DNA, 22 bp, Homo sapiens
gacagaggcaagaccagaagcc

SEQ ID NO: 7176671 - DNA, 22 bp, Homo sapiens
gacagaggcaagaccagaagcc

SEQ ID NO: 7176672 - DNA, 21 bp, Homo sapiens
gacagcaactgtagtcctctt

SEQ ID NO: 7176673 - DNA, 21 bp, Homo sapiens
gacagcaactgtagtcctctt

SEQ ID NO: 7176674 - DNA, 21 bp, Homo sapiens
gacagcaactgtagtcctctt

SEQ ID NO: 7176675 - DNA, 22 bp, Homo sapiens
gacagcaagagacagagcatcc

SEQ ID NO: 7176676 - DNA, 22 bp, Homo sapiens
gacagcaatgacggggcagctg

SEQ ID NO: 7176677 - DNA, 22 bp, Homo sapiens
gacagcaatgacggggcagctg

SEQ ID NO: 7176678 - DNA, 22 bp, Homo sapiens
gacatttagaagtctaatggcc

SEQ ID NO: 7176679 - DNA, 22 bp, Homo sapiens
gacatttactgaatactgatta

SEQ ID NO: 7176680 - DNA, 22 bp, Homo sapiens
gacatttactgaatactgatta

SEQ ID NO: 7176681 - DNA, 22 bp, Homo sapiens
gacatttaaggcagtcacttaa

SEQ ID NO: 7176682 - DNA, 22 bp, Homo sapiens
gacatttaaattgcaggcagcc

SEQ ID NO: 7176683 - DNA, 22 bp, Homo sapiens
gacattgggtgtacaattggca

SEQ ID NO: 7176684 - DNA, 20 bp, Homo sapiens
gacattgtaattaatgatga

SEQ ID NO: 7176685 - DNA, 22 bp, Homo sapiens
gacattctgtcaatgttgactc

SEQ ID NO: 7176686 - DNA, 22 bp, Homo sapiens
gacattgaacaagtttcctgac

SEQ ID NO: 7176687 - DNA, 22 bp, Homo sapiens
gacattgacagtcctccttata

SEQ ID NO: 7176688 - DNA, 22 bp, Homo sapiens
gacattgagtatttcttttctc

SEQ ID NO: 7176689 - DNA, 22 bp, Homo sapiens
gacattctaaaaaatatggaag

SEQ ID NO: 7176690 - DNA, 19 bp, Homo sapiens
gacattcctgacactggct

SEQ ID NO: 7176691 - DNA, 20 bp, Homo sapiens
gacattcatagttattacca

SEQ ID NO: 7176692 - DNA, 22 bp, Homo sapiens
gacagcagcatgtttacaggcc

SEQ ID NO: 7176693 - DNA, 22 bp, Homo sapiens
gacagcagcatgtttacaggcc

SEQ ID NO: 7176694 - DNA, 22 bp, Homo sapiens
gacagcagcatgtttacaggcc

SEQ ID NO: 7176695 - DNA, 22 bp, Homo sapiens
gacattcacaggtaaacattcc

SEQ ID NO: 7176696 - DNA, 22 bp, Homo sapiens
gacattcacagtttccgatggt

SEQ ID NO: 7176697 - DNA, 22 bp, Homo sapiens
gacagcagataagacctcatca

SEQ ID NO: 7176698 - DNA, 22 bp, Homo sapiens
gacagcagataagacctcatca

SEQ ID NO: 7176699 - DNA, 22 bp, Homo sapiens
gacagcagatgaagcctgcaga

SEQ ID NO: 7176700 - DNA, 22 bp, Homo sapiens
gacagcagatgaagcctgcaga

SEQ ID NO: 7176701 - DNA, 22 bp, Homo sapiens
gacagcagatactttcattgaa

SEQ ID NO: 7176702 - DNA, 22 bp, Homo sapiens
gacagcagatgaagcctgcaga

SEQ ID NO: 7176703 - DNA, 22 bp, Homo sapiens
gacagcagatgaagcctgcaga

SEQ ID NO: 7176704 - DNA, 22 bp, Homo sapiens
gacagcagatgaagcctgcaga

SEQ ID NO: 7176705 - DNA, 22 bp, Homo sapiens
gacagcagcataatacatgaac

SEQ ID NO: 7176706 - DNA, 22 bp, Homo sapiens
gagggagggactagcattctct

SEQ ID NO: 7176707 - DNA, 22 bp, Homo sapiens
gagggagggaaagtttaacact

SEQ ID NO: 7176708 - DNA, 22 bp, Homo sapiens
gagggagggaaagtttaacact

SEQ ID NO: 7176709 - DNA, 22 bp, Homo sapiens
gagggagggaaagtttaacact

SEQ ID NO: 7176710 - DNA, 22 bp, Homo sapiens
gagggagggactagcattctct

SEQ ID NO: 7176711 - DNA, 22 bp, Homo sapiens
gagggagggactagcattctct

SEQ ID NO: 7176712 - DNA, 22 bp, Homo sapiens
gagggagggactagcattctct

SEQ ID NO: 7176713 - DNA, 22 bp, Homo sapiens
gagggagggactagcattctct

SEQ ID NO: 7176714 - DNA, 22 bp, Homo sapiens
gagggagggactagcattctct

SEQ ID NO: 7176715 - DNA, 22 bp, Homo sapiens
gagggagggactagcattctct

SEQ ID NO: 7176716 - DNA, 22 bp, Homo sapiens
gagggagggactagcattctct

SEQ ID NO: 7176717 - DNA, 22 bp, Homo sapiens
gagggagggccaggtcccaacc

SEQ ID NO: 7176718 - DNA, 22 bp, Homo sapiens
gagggagggccaggtcccaacc

SEQ ID NO: 7176719 - DNA, 22 bp, Homo sapiens
gagggagggccaggtcccaacc

SEQ ID NO: 7176720 - DNA, 22 bp, Homo sapiens
gagggagggccaggtcccaacc

SEQ ID NO: 7176721 - DNA, 22 bp, Homo sapiens
gagggagggccaggtcccaacc

SEQ ID NO: 7176722 - DNA, 22 bp, Homo sapiens
gagggaggggagctccaccctc

SEQ ID NO: 7176723 - DNA, 22 bp, Homo sapiens
gagggaggggagctccaccctc

SEQ ID NO: 7176724 - DNA, 22 bp, Homo sapiens
gagggaggggagctccaccctc

SEQ ID NO: 7176725 - DNA, 22 bp, Homo sapiens
gagggagggccaggtcccaacc

SEQ ID NO: 7176726 - DNA, 22 bp, Homo sapiens
gagggaggggagctccaccctc

SEQ ID NO: 7176727 - DNA, 22 bp, Homo sapiens
gagggagccgccacagactggg

SEQ ID NO: 7176728 - DNA, 22 bp, Homo sapiens
gagggagagtgatggaccattg

SEQ ID NO: 7176729 - DNA, 22 bp, Homo sapiens
gagggagagtgatggaccattg

SEQ ID NO: 7176730 - DNA, 22 bp, Homo sapiens
gagggagctatgaatagaagaa

SEQ ID NO: 7176731 - DNA, 22 bp, Homo sapiens
gagggagagtgatggaccattg

SEQ ID NO: 7176732 - DNA, 22 bp, Homo sapiens
gagggagaattgcagccagcgt

SEQ ID NO: 7176733 - DNA, 22 bp, Homo sapiens
gagggagaattgcagccagcgt

SEQ ID NO: 7176734 - DNA, 22 bp, Homo sapiens
gagggagagtgatggaccattg

SEQ ID NO: 7176735 - DNA, 22 bp, Homo sapiens
gagggagagtgatggaccattg

SEQ ID NO: 7176736 - DNA, 22 bp, Homo sapiens
gagggagagtgatggaccattg

SEQ ID NO: 7176737 - DNA, 22 bp, Homo sapiens
gagggagctggagcagacgccg

SEQ ID NO: 7176738 - DNA, 22 bp, Homo sapiens
gagggagctggagcagacgccg

SEQ ID NO: 7176739 - DNA, 22 bp, Homo sapiens
gagggagctggagcagacgccg

SEQ ID NO: 7176740 - DNA, 22 bp, Homo sapiens
gagggaggcatcatgaatccag

SEQ ID NO: 7176741 - DNA, 22 bp, Homo sapiens
gagggaggcatcatgaatccag

SEQ ID NO: 7176742 - DNA, 22 bp, Homo sapiens
gagggaggcatcatgaatccag

SEQ ID NO: 7176743 - DNA, 22 bp, Homo sapiens
gagggaggcatcatgaatccag

SEQ ID NO: 7176744 - DNA, 22 bp, Homo sapiens
gagggaggcatcatgaatccag

SEQ ID NO: 7176745 - DNA, 22 bp, Homo sapiens
gaggctgcattcttcccactgc

SEQ ID NO: 7176746 - DNA, 22 bp, Homo sapiens
gaggctgcaggcaatgctgccc

SEQ ID NO: 7176747 - DNA, 22 bp, Homo sapiens
gaggctgcaggcaatgctgccc

SEQ ID NO: 7176748 - DNA, 22 bp, Homo sapiens
gaggctgcaggcaatgctgccc

SEQ ID NO: 7176749 - DNA, 22 bp, Homo sapiens
gaggctgcattcttcccactgc

SEQ ID NO: 7176750 - DNA, 22 bp, Homo sapiens
gaggctgccaatgtgtgcatgt

SEQ ID NO: 7176751 - DNA, 22 bp, Homo sapiens
gaggctgccaatgtgtgcatgt

SEQ ID NO: 7176752 - DNA, 22 bp, Homo sapiens
gaggctgcccaactggagtgga

SEQ ID NO: 7176753 - DNA, 22 bp, Homo sapiens
gagggagaattgcagccagcgt

SEQ ID NO: 7176754 - DNA, 22 bp, Homo sapiens
gaggctgcactggctaaaggct

SEQ ID NO: 7176755 - DNA, 22 bp, Homo sapiens
gaggctgcactggctaaaggct

SEQ ID NO: 7176756 - DNA, 22 bp, Homo sapiens
gaggctgcactggctaaaggct

SEQ ID NO: 7176757 - DNA, 22 bp, Homo sapiens
gaggctgattcggggaacagca

SEQ ID NO: 7176758 - DNA, 22 bp, Homo sapiens
gaggctgattcggggaacagca

SEQ ID NO: 7176759 - DNA, 22 bp, Homo sapiens
gaggctgatgctgcctcacaga

SEQ ID NO: 7176760 - DNA, 22 bp, Homo sapiens
gaggctgaggttgcagtgagct

SEQ ID NO: 7176761 - DNA, 22 bp, Homo sapiens
gaggctgaggttgcagtgagct

SEQ ID NO: 7176762 - DNA, 22 bp, Homo sapiens
gaggctgagtagctttgtgctc

SEQ ID NO: 7176763 - DNA, 22 bp, Homo sapiens
gaggctgaggttgcagtgagct

SEQ ID NO: 7176764 - DNA, 22 bp, Homo sapiens
gaggctgaggttgcagtgagct

SEQ ID NO: 7176765 - DNA, 22 bp, Homo sapiens
gaggctgaggttgcagtgagcc

SEQ ID NO: 7176766 - DNA, 22 bp, Homo sapiens
gaggctgaggttgcagtgagcc

SEQ ID NO: 7176767 - DNA, 22 bp, Homo sapiens
gaggctgaggttgcagtgagcc

SEQ ID NO: 7176768 - DNA, 22 bp, Homo sapiens
gaggctgaggttgcagtgagcc

SEQ ID NO: 7176769 - DNA, 22 bp, Homo sapiens
gaggctgagggttagagagtca

SEQ ID NO: 7176770 - DNA, 22 bp, Homo sapiens
gaggctgagggttagagagtca

SEQ ID NO: 7176771 - DNA, 22 bp, Homo sapiens
gaggctgagggttagagagtca

SEQ ID NO: 7176772 - DNA, 22 bp, Homo sapiens
gaggctgaggcggatggatcac

SEQ ID NO: 7176773 - DNA, 22 bp, Homo sapiens
gaggctgaggcaggaggatcac

SEQ ID NO: 7176774 - DNA, 22 bp, Homo sapiens
gaggctgaggcaggaggatcac

SEQ ID NO: 7176775 - DNA, 22 bp, Homo sapiens
gaggggctggctgtggtcccat

SEQ ID NO: 7176776 - DNA, 22 bp, Homo sapiens
gaggggctggctgtggtcccat

SEQ ID NO: 7176777 - DNA, 22 bp, Homo sapiens
gaggggctggcacgatggctgc

SEQ ID NO: 7176778 - DNA, 22 bp, Homo sapiens
gaggggctggcacgatggctgc

SEQ ID NO: 7176779 - DNA, 22 bp, Homo sapiens
gaggggctggcacgatggctgc

SEQ ID NO: 7176780 - DNA, 22 bp, Homo sapiens
gaggggctggctgtggtcccat

SEQ ID NO: 7176781 - DNA, 22 bp, Homo sapiens
gaggggctggctgtggtcccat

SEQ ID NO: 7176782 - DNA, 22 bp, Homo sapiens
gaggggctggctgtggtcccat

SEQ ID NO: 7176783 - DNA, 22 bp, Homo sapiens
gaggggctgggcagtccctgga

SEQ ID NO: 7176784 - DNA, 22 bp, Homo sapiens
gaggggctgggcagtccctgga

SEQ ID NO: 7176785 - DNA, 22 bp, Homo sapiens
gaggggctgccctggtgtcagg

SEQ ID NO: 7176786 - DNA, 22 bp, Homo sapiens
gaggggctgccctggtgtcagg

SEQ ID NO: 7176787 - DNA, 22 bp, Homo sapiens
gaggggctctttaatagtaaca

SEQ ID NO: 7176788 - DNA, 22 bp, Homo sapiens
gaggggctctttaatagtaaca

SEQ ID NO: 7176789 - DNA, 22 bp, Homo sapiens
gaggggaaagtgtgaggctgcg

SEQ ID NO: 7176790 - DNA, 22 bp, Homo sapiens
gagggcttgtaagtgggtggag

SEQ ID NO: 7176791 - DNA, 22 bp, Homo sapiens
gaggggaaaacaggaattaaca

SEQ ID NO: 7176792 - DNA, 22 bp, Homo sapiens
gaggggctgccctggtgtcagg

SEQ ID NO: 7176793 - DNA, 22 bp, Homo sapiens
gaggggctggcacgatggctgc

SEQ ID NO: 7176794 - DNA, 22 bp, Homo sapiens
gaggggctggcacgatggctgc

SEQ ID NO: 7176795 - DNA, 22 bp, Homo sapiens
gaggggctggcacgatggctgc

SEQ ID NO: 7176796 - DNA, 22 bp, Homo sapiens
gagggctgtggggcatgaccag

SEQ ID NO: 7176797 - DNA, 22 bp, Homo sapiens
gagggctgtggggcatgaccag

SEQ ID NO: 7176798 - DNA, 22 bp, Homo sapiens
gagggctgtggggcatgaccag

SEQ ID NO: 7176799 - DNA, 22 bp, Homo sapiens
gagggctgtggggcatgaccag

SEQ ID NO: 7176800 - DNA, 22 bp, Homo sapiens
gagggctgtggggcatgaccag

SEQ ID NO: 7176801 - DNA, 22 bp, Homo sapiens
gagggctgtggggcatgaccag

SEQ ID NO: 7176802 - DNA, 22 bp, Homo sapiens
gagggcttccatggggagcccc

SEQ ID NO: 7176803 - DNA, 22 bp, Homo sapiens
gagggctggggcttaggcttag

SEQ ID NO: 7176804 - DNA, 22 bp, Homo sapiens
gagggctggggcttaggcttag

SEQ ID NO: 7176805 - DNA, 22 bp, Homo sapiens
gagggctgctggaaaaatgcag

SEQ ID NO: 7176806 - DNA, 22 bp, Homo sapiens
gagggctgctggaaaaatgcag

SEQ ID NO: 7176807 - DNA, 22 bp, Homo sapiens
gagggctgctggaaaaatgcag

SEQ ID NO: 7176808 - DNA, 22 bp, Homo sapiens
gagggctgtgaaggagcgggtt

SEQ ID NO: 7176809 - DNA, 22 bp, Homo sapiens
gagggctgtgaaggagcgggtt

SEQ ID NO: 7176810 - DNA, 22 bp, Homo sapiens
gagggctgtgaaggagcgggtt

SEQ ID NO: 7176811 - DNA, 22 bp, Homo sapiens
gagggctgtgaaggagcgggtt

SEQ ID NO: 7176812 - DNA, 22 bp, Homo sapiens
gagggctgtgaaggagcgggtt

SEQ ID NO: 7176813 - DNA, 22 bp, Homo sapiens
gagggctggggcttaggcttag

SEQ ID NO: 7176814 - DNA, 18 bp, Homo sapiens
gagggagtagctgaggtt

SEQ ID NO: 7176815 - DNA, 18 bp, Homo sapiens
gagggagtagctgaggtt

SEQ ID NO: 7176816 - DNA, 22 bp, Homo sapiens
gagggagtaacgtactacagtg

SEQ ID NO: 7176817 - DNA, 22 bp, Homo sapiens
gagggagtaacgtactacagtg

SEQ ID NO: 7176818 - DNA, 22 bp, Homo sapiens
gagggaggtgatactgaacgta

SEQ ID NO: 7176819 - DNA, 22 bp, Homo sapiens
gagggaggggagctccaccctc

SEQ ID NO: 7176820 - DNA, 22 bp, Homo sapiens
gagggaggtgatactgaacgta

SEQ ID NO: 7176821 - DNA, 22 bp, Homo sapiens
gagggaggtgatactgaacgta

SEQ ID NO: 7176822 - DNA, 22 bp, Homo sapiens
gagggaggtgatactgaacgta

SEQ ID NO: 7176823 - DNA, 22 bp, Homo sapiens
gagggaggtgatactgaacgta

SEQ ID NO: 7176824 - DNA, 22 bp, Homo sapiens
gagggagtgccagagggccagc

SEQ ID NO: 7176825 - DNA, 22 bp, Homo sapiens
gagggagtgctttctgatagtt

SEQ ID NO: 7176826 - DNA, 22 bp, Homo sapiens
gagggatctttaggcagcctca

SEQ ID NO: 7176827 - DNA, 22 bp, Homo sapiens
gagggctgatgttgccacctca

SEQ ID NO: 7176828 - DNA, 22 bp, Homo sapiens
gagggctgatgttgccacctca

SEQ ID NO: 7176829 - DNA, 22 bp, Homo sapiens
gagggctgatgttgccacctca

SEQ ID NO: 7176830 - DNA, 22 bp, Homo sapiens
gagggctgatgttgccacctca

SEQ ID NO: 7176831 - DNA, 22 bp, Homo sapiens
gagggagtgccagagggccagc

SEQ ID NO: 7176832 - DNA, 22 bp, Homo sapiens
gagggagtgccagagggccagc

SEQ ID NO: 7176833 - DNA, 22 bp, Homo sapiens
gagggagtgagacacaaaagaa

SEQ ID NO: 7176834 - DNA, 22 bp, Homo sapiens
gagggagtctgtgcaaagaatt

SEQ ID NO: 7176835 - DNA, 18 bp, Homo sapiens
gagggagtagctgaggtt

SEQ ID NO: 7176836 - DNA, 22 bp, Homo sapiens
gagggctgcaatgagacagaga

SEQ ID NO: 7176837 - DNA, 22 bp, Homo sapiens
gagggctgcaatgagacagaga

SEQ ID NO: 7176838 - DNA, 22 bp, Homo sapiens
gagggctgcaatgagacagaga

SEQ ID NO: 7176839 - DNA, 22 bp, Homo sapiens
gagggctgatgttgccacctca

SEQ ID NO: 7176840 - DNA, 22 bp, Homo sapiens
gagggctgcaatgagacagaga

SEQ ID NO: 7176841 - DNA, 22 bp, Homo sapiens
gagggctgcaatgagacagaga

SEQ ID NO: 7176842 - DNA, 22 bp, Homo sapiens
gagggctgcaatgagacagaga

SEQ ID NO: 7176843 - DNA, 22 bp, Homo sapiens
gagggctgcaatgagacagaga

SEQ ID NO: 7176844 - DNA, 22 bp, Homo sapiens
gagggctgctgccagatatgcc

SEQ ID NO: 7176845 - DNA, 22 bp, Homo sapiens
gagggctgccacgttgggcgag

SEQ ID NO: 7176846 - DNA, 22 bp, Homo sapiens
gagggctgccacgttgggcgag

SEQ ID NO: 7176847 - DNA, 22 bp, Homo sapiens
gagggctgctgccagatatgcc

SEQ ID NO: 7176848 - DNA, 22 bp, Homo sapiens
gagggctgctgccagatatgcc

SEQ ID NO: 7176849 - DNA, 22 bp, Homo sapiens
gagggctgctgccagatatgcc

SEQ ID NO: 7176850 - DNA, 22 bp, Homo sapiens
gagggctgctggaaaaatgcag

SEQ ID NO: 7176851 - DNA, 22 bp, Homo sapiens
gagggctgctgccagatatgcc

SEQ ID NO: 7176852 - DNA, 22 bp, Homo sapiens
gaggcagtgttgaaaaggagag

SEQ ID NO: 7176853 - DNA, 22 bp, Homo sapiens
gaggcagtggtctgatgcaagg

SEQ ID NO: 7176854 - DNA, 22 bp, Homo sapiens
gaggcagtgtcggtggcaggat

SEQ ID NO: 7176855 - DNA, 22 bp, Homo sapiens
gaggcagggtgttgattacaga

SEQ ID NO: 7176856 - DNA, 22 bp, Homo sapiens
gaggcagggtgttgattacaga

SEQ ID NO: 7176857 - DNA, 22 bp, Homo sapiens
gaggcagggtgttgattacaga

SEQ ID NO: 7176858 - DNA, 22 bp, Homo sapiens
gaggcagggtgttgattacaga

SEQ ID NO: 7176859 - DNA, 22 bp, Homo sapiens
gaggcagggtgttgattacaga

SEQ ID NO: 7176860 - DNA, 22 bp, Homo sapiens
gaggcaggccctgaatgagtca

SEQ ID NO: 7176861 - DNA, 22 bp, Homo sapiens
gaggcaggccctgaatgagtca

SEQ ID NO: 7176862 - DNA, 22 bp, Homo sapiens
gaggcagtttgccatgccagga

SEQ ID NO: 7176863 - DNA, 22 bp, Homo sapiens
gaggctcaacccacaggggttg

SEQ ID NO: 7176864 - DNA, 22 bp, Homo sapiens
gaggctcaacccacaggggttg

SEQ ID NO: 7176865 - DNA, 22 bp, Homo sapiens
gaggcataagtagaagagattg

SEQ ID NO: 7176866 - DNA, 22 bp, Homo sapiens
gaggcataagtagaagagattg

SEQ ID NO: 7176867 - DNA, 22 bp, Homo sapiens
gaggcatctgggcacagaagtg

SEQ ID NO: 7176868 - DNA, 22 bp, Homo sapiens
gaggcatctgggcacagaagtg

SEQ ID NO: 7176869 - DNA, 22 bp, Homo sapiens
gaggctcacctagggagcactg

SEQ ID NO: 7176870 - DNA, 22 bp, Homo sapiens
gaggctcactaggcatcctggg

SEQ ID NO: 7176871 - DNA, 22 bp, Homo sapiens
gaggctcactaggcatcctggg

SEQ ID NO: 7176872 - DNA, 22 bp, Homo sapiens
gaggctcacgacgggacgaact

SEQ ID NO: 7176873 - DNA, 22 bp, Homo sapiens
gaggctcacctagggagcactg

SEQ ID NO: 7176874 - DNA, 22 bp, Homo sapiens
gaggctcagagaagtcatggta

SEQ ID NO: 7176875 - DNA, 22 bp, Homo sapiens
gaggctcagagaagtcatggta

SEQ ID NO: 7176876 - DNA, 22 bp, Homo sapiens
gaggctcagagaagtcatggta

SEQ ID NO: 7176877 - DNA, 22 bp, Homo sapiens
gaggctcactgggcaaagactc

SEQ ID NO: 7176878 - DNA, 22 bp, Homo sapiens
gaggctcactgggcaaagactc

SEQ ID NO: 7176879 - DNA, 22 bp, Homo sapiens
gaggctcactttcatcctcttc

SEQ ID NO: 7176880 - DNA, 22 bp, Homo sapiens
gaggctcactttcatcctcttc

SEQ ID NO: 7176881 - DNA, 22 bp, Homo sapiens
gaggctgaggcaggaggatcac

SEQ ID NO: 7176882 - DNA, 22 bp, Homo sapiens
gaggctgagagtttgttctact

SEQ ID NO: 7176883 - DNA, 22 bp, Homo sapiens
gaggctgagagtttgttctact

SEQ ID NO: 7176884 - DNA, 22 bp, Homo sapiens
gaggctgaatggccagaagcca

SEQ ID NO: 7176885 - DNA, 22 bp, Homo sapiens
gaggctgacggcaccatcttct

SEQ ID NO: 7176886 - DNA, 22 bp, Homo sapiens
gaggctgaatggccagaagcca

SEQ ID NO: 7176887 - DNA, 22 bp, Homo sapiens
gaggctgaatggccagaagcca

SEQ ID NO: 7176888 - DNA, 22 bp, Homo sapiens
gaggctgaatggccagaagcca

SEQ ID NO: 7176889 - DNA, 22 bp, Homo sapiens
gaggctgaatggccagaagcca

SEQ ID NO: 7176890 - DNA, 22 bp, Homo sapiens
gaggctgaagtgtacatgggtg

SEQ ID NO: 7176891 - DNA, 20 bp, Homo sapiens
gaggctgaagtgtttttgct

SEQ ID NO: 7176892 - DNA, 22 bp, Homo sapiens
gaggctcagagggactttcaag

SEQ ID NO: 7176893 - DNA, 22 bp, Homo sapiens
gaggctcagagaggtccacata

SEQ ID NO: 7176894 - DNA, 22 bp, Homo sapiens
gaggctcagagggagcatggtc

SEQ ID NO: 7176895 - DNA, 22 bp, Homo sapiens
gaggctcagagactttaagttt

SEQ ID NO: 7176896 - DNA, 22 bp, Homo sapiens
gaggctcagagggagcatggtc

SEQ ID NO: 7176897 - DNA, 22 bp, Homo sapiens
gaggctcagagggagcatggtc

SEQ ID NO: 7176898 - DNA, 22 bp, Homo sapiens
gaggctcagagtggttaaataa

SEQ ID NO: 7176899 - DNA, 22 bp, Homo sapiens
gaggctcagttatgtcatcagg

SEQ ID NO: 7176900 - DNA, 22 bp, Homo sapiens
gaggctcagttattttagcctg

SEQ ID NO: 7176901 - DNA, 22 bp, Homo sapiens
gaggctcattgcattgtgcatt

SEQ ID NO: 7176902 - DNA, 22 bp, Homo sapiens
gaggctcagggaaacagcgcag

SEQ ID NO: 7176903 - DNA, 22 bp, Homo sapiens
gaggctcagggagtatatgaat

SEQ ID NO: 7176904 - DNA, 22 bp, Homo sapiens
gaggctcagttatgtcatcagg

SEQ ID NO: 7176905 - DNA, 22 bp, Homo sapiens
gaggctccagcgacacctaggc

SEQ ID NO: 7176906 - DNA, 22 bp, Homo sapiens
gaggctccagcgacacctaggc

SEQ ID NO: 7176907 - DNA, 22 bp, Homo sapiens
gaggctcattgcattgtgcatt

SEQ ID NO: 7176908 - DNA, 22 bp, Homo sapiens
gaggctgaagtgtacatgggtg

SEQ ID NO: 7176909 - DNA, 22 bp, Homo sapiens
gaggagccaaggtatgtgtgtt

SEQ ID NO: 7176910 - DNA, 22 bp, Homo sapiens
gaggagccaggaggtctccctg

SEQ ID NO: 7176911 - DNA, 22 bp, Homo sapiens
gaggagccaaggtatgtgtgtt

SEQ ID NO: 7176912 - DNA, 22 bp, Homo sapiens
gaggagcatgggaaggctctgg

SEQ ID NO: 7176913 - DNA, 22 bp, Homo sapiens
gaggagcatgggaaggctctgg

SEQ ID NO: 7176914 - DNA, 22 bp, Homo sapiens
gaggagcacatgaggctgaggg

SEQ ID NO: 7176915 - DNA, 22 bp, Homo sapiens
gaggagcacatgaggctgaggg

SEQ ID NO: 7176916 - DNA, 22 bp, Homo sapiens
gaggagcatgggaaggctctgg

SEQ ID NO: 7176917 - DNA, 22 bp, Homo sapiens
gaggagcacatgaggctgaggg

SEQ ID NO: 7176918 - DNA, 22 bp, Homo sapiens
gaggagcacatgaggctgaggg

SEQ ID NO: 7176919 - DNA, 22 bp, Homo sapiens
gaggagcacatgaggctgaggg

SEQ ID NO: 7176920 - DNA, 22 bp, Homo sapiens
gaggagcaagaaatagtgccca

SEQ ID NO: 7176921 - DNA, 22 bp, Homo sapiens
gaggagaggggctcccaagagc

SEQ ID NO: 7176922 - DNA, 22 bp, Homo sapiens
gaggagaggggctcccaagagc

SEQ ID NO: 7176923 - DNA, 22 bp, Homo sapiens
gaggagaggggctcccaagagc

SEQ ID NO: 7176924 - DNA, 22 bp, Homo sapiens
gaggagcaagaaatagtgccca

SEQ ID NO: 7176925 - DNA, 22 bp, Homo sapiens
gaggagagggctgcgggcccac

SEQ ID NO: 7176926 - DNA, 22 bp, Homo sapiens
gaggagagggctgcgggcccac

SEQ ID NO: 7176927 - DNA, 22 bp, Homo sapiens
gaggagagggctgcgggcccac

SEQ ID NO: 7176928 - DNA, 22 bp, Homo sapiens
gaggagaggctggacgcggtga

SEQ ID NO: 7176929 - DNA, 22 bp, Homo sapiens
gaggagagggctgcgggcccac

SEQ ID NO: 7176930 - DNA, 22 bp, Homo sapiens
gaggagaggctggacgcggtga

SEQ ID NO: 7176931 - DNA, 22 bp, Homo sapiens
gaggagagcctgcactttgacc

SEQ ID NO: 7176932 - DNA, 22 bp, Homo sapiens
gaggagagcctgcactttgacc

SEQ ID NO: 7176933 - DNA, 22 bp, Homo sapiens
gaggagagcctgcactttgacc

SEQ ID NO: 7176934 - DNA, 22 bp, Homo sapiens
gaggagagcctgcactttgacc

SEQ ID NO: 7176935 - DNA, 22 bp, Homo sapiens
gaggagaggccatcgttgttat

SEQ ID NO: 7176936 - DNA, 22 bp, Homo sapiens
gaggagagatggtagattgggt

SEQ ID NO: 7176937 - DNA, 22 bp, Homo sapiens
gaggagagatggtagattgggt

SEQ ID NO: 7176938 - DNA, 22 bp, Homo sapiens
gaggagagatggtagattgggt

SEQ ID NO: 7176939 - DNA, 22 bp, Homo sapiens
gaggcaggccctgaatgagtca

SEQ ID NO: 7176940 - DNA, 22 bp, Homo sapiens
gaggcaggccctgaatgagtca

SEQ ID NO: 7176941 - DNA, 22 bp, Homo sapiens
gaggcaggccctgaatgagtca

SEQ ID NO: 7176942 - DNA, 22 bp, Homo sapiens
gaggcaggcagattgcttgagg

SEQ ID NO: 7176943 - DNA, 22 bp, Homo sapiens
gaggcaggcagattgcttgagg

SEQ ID NO: 7176944 - DNA, 22 bp, Homo sapiens
gaggcaggcagattgcttgagg

SEQ ID NO: 7176945 - DNA, 22 bp, Homo sapiens
gaggcaggcagattgcttgagg

SEQ ID NO: 7176946 - DNA, 22 bp, Homo sapiens
gaggcaggcagattgcttgagg

SEQ ID NO: 7176947 - DNA, 22 bp, Homo sapiens
gaggcaggcactgttatcagca

SEQ ID NO: 7176948 - DNA, 22 bp, Homo sapiens
gaggcaggaggattgcttgagc

SEQ ID NO: 7176949 - DNA, 22 bp, Homo sapiens
gaggcaggcactgttatcagca

SEQ ID NO: 7176950 - DNA, 22 bp, Homo sapiens
gaggcaggcactgttatcagca

SEQ ID NO: 7176951 - DNA, 22 bp, Homo sapiens
gaggcaggcactgttatcagca

SEQ ID NO: 7176952 - DNA, 22 bp, Homo sapiens
gaggcaggcactgttatcagca

SEQ ID NO: 7176953 - DNA, 22 bp, Homo sapiens
gaggcaggcactgttatcagca

SEQ ID NO: 7176954 - DNA, 22 bp, Homo sapiens
gaggcaggaggattgcttgagc

SEQ ID NO: 7176955 - DNA, 22 bp, Homo sapiens
gaggcagcttggggctgtgggt

SEQ ID NO: 7176956 - DNA, 22 bp, Homo sapiens
gaggcaggaggattgcttgagc

SEQ ID NO: 7176957 - DNA, 22 bp, Homo sapiens
gaggcaggaggattgcttgagc

SEQ ID NO: 7176958 - DNA, 22 bp, Homo sapiens
gaggcaggaggattgcttgagc

SEQ ID NO: 7176959 - DNA, 22 bp, Homo sapiens
gaggcagcttggggctgtgggt

SEQ ID NO: 7176960 - DNA, 22 bp, Homo sapiens
gaggcagcttggggctgtgggt

SEQ ID NO: 7176961 - DNA, 16 bp, Homo sapiens
gaggagcccctctgcc

SEQ ID NO: 7176962 - DNA, 22 bp, Homo sapiens
gaggcagcttagggtactgact

SEQ ID NO: 7176963 - DNA, 22 bp, Homo sapiens
gaggagcccccactgggctcac

SEQ ID NO: 7176964 - DNA, 22 bp, Homo sapiens
gaggagcccccactgggctcac

SEQ ID NO: 7176965 - DNA, 22 bp, Homo sapiens
gaggagccatagatagtgctgc

SEQ ID NO: 7176966 - DNA, 22 bp, Homo sapiens
gaggagccatagatagtgctgc

SEQ ID NO: 7176967 - DNA, 22 bp, Homo sapiens
gagcatggtgcttcagtgaagg

SEQ ID NO: 7176968 - DNA, 16 bp, Homo sapiens
gagcatggtggcgggc

SEQ ID NO: 7176969 - DNA, 16 bp, Homo sapiens
gagcatggtggcgggc

SEQ ID NO: 7176970 - DNA, 22 bp, Homo sapiens
gagcatggtgcttcagtgaagg

SEQ ID NO: 7176971 - DNA, 22 bp, Homo sapiens
gagcatggtgcttcagtgaagg

SEQ ID NO: 7176972 - DNA, 18 bp, Homo sapiens
gagcatgggcagtgggga

SEQ ID NO: 7176973 - DNA, 18 bp, Homo sapiens
gagcatgggcagtgggga

SEQ ID NO: 7176974 - DNA, 18 bp, Homo sapiens
gagcatgggcagtgggga

SEQ ID NO: 7176975 - DNA, 22 bp, Homo sapiens
gagcatggcagctgagggcagg

SEQ ID NO: 7176976 - DNA, 22 bp, Homo sapiens
gagcatggatcatgtgctgggt

SEQ ID NO: 7176977 - DNA, 22 bp, Homo sapiens
gagcatggcagctgagggcagg

SEQ ID NO: 7176978 - DNA, 22 bp, Homo sapiens
gagcatggctgcctccctgtgc

SEQ ID NO: 7176979 - DNA, 22 bp, Homo sapiens
gagcatggctgcctccctgtgc

SEQ ID NO: 7176980 - DNA, 21 bp, Homo sapiens
gagcatggcttacatcagcag

SEQ ID NO: 7176981 - DNA, 22 bp, Homo sapiens
gagcatcttgttcccaacttct

SEQ ID NO: 7176982 - DNA, 22 bp, Homo sapiens
gagcatcttgttcccaacttct

SEQ ID NO: 7176983 - DNA, 22 bp, Homo sapiens
gagcatctggctagaggagtga

SEQ ID NO: 7176984 - DNA, 20 bp, Homo sapiens
gagcatctgtctgctgtgca

SEQ ID NO: 7176985 - DNA, 20 bp, Homo sapiens
gagcatctgtctgctgtgca

SEQ ID NO: 7176986 - DNA, 22 bp, Homo sapiens
gagcatctgtggtccatcagaa

SEQ ID NO: 7176987 - DNA, 22 bp, Homo sapiens
gagcatctgtggtccatcagaa

SEQ ID NO: 7176988 - DNA, 22 bp, Homo sapiens
gagcatggatagaaggtgggat

SEQ ID NO: 7176989 - DNA, 22 bp, Homo sapiens
gagcatggatagaaggtgggat

SEQ ID NO: 7176990 - DNA, 22 bp, Homo sapiens
gagcatggatagaaggtgggat

SEQ ID NO: 7176991 - DNA, 22 bp, Homo sapiens
gagcatggatagaaggtgggat

SEQ ID NO: 7176992 - DNA, 22 bp, Homo sapiens
gagcatggatcatgtgctgggt

SEQ ID NO: 7176993 - DNA, 22 bp, Homo sapiens
gagcatggatcatgtgctgggt

SEQ ID NO: 7176994 - DNA, 22 bp, Homo sapiens
gagcatggatcatgtgctgggt

SEQ ID NO: 7176995 - DNA, 22 bp, Homo sapiens
gagcagtgtttgtggacctgga

SEQ ID NO: 7176996 - DNA, 22 bp, Homo sapiens
gagcagtggtggtgtgttagag

SEQ ID NO: 7176997 - DNA, 22 bp, Homo sapiens
gagcagtggttgaacagaggca

SEQ ID NO: 7176998 - DNA, 22 bp, Homo sapiens
gagcagtggttgaacagaggca

SEQ ID NO: 7176999 - DNA, 22 bp, Homo sapiens
gagcagtggtcacagggaggga

SEQ ID NO: 7177000 - DNA, 22 bp, Homo sapiens
gagcagtggtcacagggaggga

SEQ ID NO: 7177001 - DNA, 22 bp, Homo sapiens
gagcagtggtcacagggaggga

SEQ ID NO: 7177002 - DNA, 22 bp, Homo sapiens
gagcagtggtcacagggaggga

SEQ ID NO: 7177003 - DNA, 22 bp, Homo sapiens
gagcataggacacagaggtgtg

SEQ ID NO: 7177004 - DNA, 22 bp, Homo sapiens
gagcatcactgtcctctccccg

SEQ ID NO: 7177005 - DNA, 22 bp, Homo sapiens
gagcatccacaaagtttggtgt

SEQ ID NO: 7177006 - DNA, 22 bp, Homo sapiens
gagcatccagaggtgttttctc

SEQ ID NO: 7177007 - DNA, 22 bp, Homo sapiens
gagcatccatgactttggcttt

SEQ ID NO: 7177008 - DNA, 22 bp, Homo sapiens
gagcatcgctgagatcccagac

SEQ ID NO: 7177009 - DNA, 22 bp, Homo sapiens
gagcatcgctgagatcccagac

SEQ ID NO: 7177010 - DNA, 22 bp, Homo sapiens
gagcatctatgtgctgggtact

SEQ ID NO: 7177011 - DNA, 22 bp, Homo sapiens
gagcatctcctacctactcctt

SEQ ID NO: 7177012 - DNA, 22 bp, Homo sapiens
gagcatctcctacctactcctt

SEQ ID NO: 7177013 - DNA, 21 bp, Homo sapiens
gagcatctccttcctcctgct

SEQ ID NO: 7177014 - DNA, 21 bp, Homo sapiens
gagcatctccttcctcctgct

SEQ ID NO: 7177015 - DNA, 22 bp, Homo sapiens
gagcatctctatagtgactgtg

SEQ ID NO: 7177016 - DNA, 22 bp, Homo sapiens
gagcatctgatgagattggatt

SEQ ID NO: 7177017 - DNA, 22 bp, Homo sapiens
gagagggctgcctggtgtgagg

SEQ ID NO: 7177018 - DNA, 22 bp, Homo sapiens
gagagggctgcctggtgtgagg

SEQ ID NO: 7177019 - DNA, 22 bp, Homo sapiens
gagagggctgcctggtgtgagg

SEQ ID NO: 7177020 - DNA, 22 bp, Homo sapiens
gagagggctggaaacttcctgg

SEQ ID NO: 7177021 - DNA, 22 bp, Homo sapiens
gagaggggacctgtgtgtctag

SEQ ID NO: 7177022 - DNA, 22 bp, Homo sapiens
gagaggggacctgtgtgtctag

SEQ ID NO: 7177023 - DNA, 22 bp, Homo sapiens
gagaggggcccaagccacatag

SEQ ID NO: 7177024 - DNA, 22 bp, Homo sapiens
gagaggggcgcgcagctcgcga

SEQ ID NO: 7177025 - DNA, 22 bp, Homo sapiens
gagaggggcccaagccacatag

SEQ ID NO: 7177026 - DNA, 22 bp, Homo sapiens
gagaggggcgcgcagctcgcga

SEQ ID NO: 7177027 - DNA, 22 bp, Homo sapiens
gagaggggcccaagccacatag

SEQ ID NO: 7177028 - DNA, 22 bp, Homo sapiens
gagaggggcgcgcagctcgcga

SEQ ID NO: 7177029 - DNA, 22 bp, Homo sapiens
gagaggggcgcgcagctcgcga

SEQ ID NO: 7177030 - DNA, 22 bp, Homo sapiens
gagaggtaatttgaagtgcaaa

SEQ ID NO: 7177031 - DNA, 22 bp, Homo sapiens
gagcaggctctgcctgtgtgtc

SEQ ID NO: 7177032 - DNA, 22 bp, Homo sapiens
gagcaggctctgcctgtgtgtc

SEQ ID NO: 7177033 - DNA, 22 bp, Homo sapiens
gagcaggcttgcagagaagggg

SEQ ID NO: 7177034 - DNA, 22 bp, Homo sapiens
gagcaggcttgcagagaagggg

SEQ ID NO: 7177035 - DNA, 22 bp, Homo sapiens
gagcaggcttgcagagaagggg

SEQ ID NO: 7177036 - DNA, 22 bp, Homo sapiens
gagcaggcttgcagagaagggg

SEQ ID NO: 7177037 - DNA, 22 bp, Homo sapiens
gagaggggtttgccatcctatg

SEQ ID NO: 7177038 - DNA, 22 bp, Homo sapiens
gagaggggtttgccatcctatg

SEQ ID NO: 7177039 - DNA, 22 bp, Homo sapiens
gagagggtgcctggaagccagg

SEQ ID NO: 7177040 - DNA, 22 bp, Homo sapiens
gagagggtgcctggaagccagg

SEQ ID NO: 7177041 - DNA, 22 bp, Homo sapiens
gagcagtgatgggaggacgtca

SEQ ID NO: 7177042 - DNA, 22 bp, Homo sapiens
gagcagtgatgggaggacgtca

SEQ ID NO: 7177043 - DNA, 22 bp, Homo sapiens
gagcagtgagtgaatgttgcct

SEQ ID NO: 7177044 - DNA, 19 bp, Homo sapiens
gagcagtgaggaccaccag

SEQ ID NO: 7177045 - DNA, 22 bp, Homo sapiens
gagcagggagacaactctggtg

SEQ ID NO: 7177046 - DNA, 22 bp, Homo sapiens
gagcaggcttgcagagaagggg

SEQ ID NO: 7177047 - DNA, 22 bp, Homo sapiens
gagcaggcttgcagagaagggg

SEQ ID NO: 7177048 - DNA, 22 bp, Homo sapiens
gagcagggagacaactctggtg

SEQ ID NO: 7177049 - DNA, 22 bp, Homo sapiens
gagcagggagacaactctggtg

SEQ ID NO: 7177050 - DNA, 22 bp, Homo sapiens
gagcatggttccataggttggt

SEQ ID NO: 7177051 - DNA, 22 bp, Homo sapiens
gagcatggttccataggttggt

SEQ ID NO: 7177052 - DNA, 22 bp, Homo sapiens
gagcatttggttatagtaattt

SEQ ID NO: 7177053 - DNA, 22 bp, Homo sapiens
gagccagtgatcagacagggag

SEQ ID NO: 7177054 - DNA, 22 bp, Homo sapiens
gagccagtgatcagacagggag

SEQ ID NO: 7177055 - DNA, 22 bp, Homo sapiens
gagccatgagatagttggttcg

SEQ ID NO: 7177056 - DNA, 22 bp, Homo sapiens
gagccattgtccaagcctgttt

SEQ ID NO: 7177057 - DNA, 22 bp, Homo sapiens
gagcccagattggaatttccca

SEQ ID NO: 7177058 - DNA, 22 bp, Homo sapiens
gagcccagcccagagccatatg

SEQ ID NO: 7177059 - DNA, 22 bp, Homo sapiens
gagcccagcccagagccatatg

SEQ ID NO: 7177060 - DNA, 22 bp, Homo sapiens
gagcccagctaaatttatataa

SEQ ID NO: 7177061 - DNA, 22 bp, Homo sapiens
gagcccagctctacctcagact

SEQ ID NO: 7177062 - DNA, 22 bp, Homo sapiens
gagcccagctctacctcagact

SEQ ID NO: 7177063 - DNA, 22 bp, Homo sapiens
gagcccagctgcggccctcagc

SEQ ID NO: 7177064 - DNA, 22 bp, Homo sapiens
gagcccagctgcggccctcagc

SEQ ID NO: 7177065 - DNA, 22 bp, Homo sapiens
gagcccaggaagtggaggctga

SEQ ID NO: 7177066 - DNA, 22 bp, Homo sapiens
gagcccaggaagtggaggctga

SEQ ID NO: 7177067 - DNA, 22 bp, Homo sapiens
gagcccaggagtttgatgctgc

SEQ ID NO: 7177068 - DNA, 22 bp, Homo sapiens
gagcccaggagtttgatgctgc

SEQ ID NO: 7177069 - DNA, 22 bp, Homo sapiens
gagcccaggagtttgatgctgc

SEQ ID NO: 7177070 - DNA, 22 bp, Homo sapiens
gagcccaggagtttgatgctgc

SEQ ID NO: 7177071 - DNA, 22 bp, Homo sapiens
gagcccaggatggtgtatggct

SEQ ID NO: 7177072 - DNA, 22 bp, Homo sapiens
gagcccaggatggtgtatggct

SEQ ID NO: 7177073 - DNA, 22 bp, Homo sapiens
gagcccaggaagtggaggctga

SEQ ID NO: 7177074 - DNA, 22 bp, Homo sapiens
gagcccagctgtccttggcaaa

SEQ ID NO: 7177075 - DNA, 22 bp, Homo sapiens
gagcccagctgtccttggcaaa

SEQ ID NO: 7177076 - DNA, 22 bp, Homo sapiens
gagcccagctgtccttggcaaa

SEQ ID NO: 7177077 - DNA, 22 bp, Homo sapiens
gagcccagcttgcacatggagc

SEQ ID NO: 7177078 - DNA, 22 bp, Homo sapiens
gagcccagctgtccttggcaaa

SEQ ID NO: 7177079 - DNA, 22 bp, Homo sapiens
gagcccagcttgcacatggagc

SEQ ID NO: 7177080 - DNA, 22 bp, Homo sapiens
gagcccagcttgcacatggagc

SEQ ID NO: 7177081 - DNA, 22 bp, Homo sapiens
gagcccaggaagtggaggctga

SEQ ID NO: 7177082 - DNA, 22 bp, Homo sapiens
gagcccaggaagtggaggctga

SEQ ID NO: 7177083 - DNA, 22 bp, Homo sapiens
gagcccaggaagtggaggctga

SEQ ID NO: 7177084 - DNA, 22 bp, Homo sapiens
gagccctgacactgagggagtt

SEQ ID NO: 7177085 - DNA, 22 bp, Homo sapiens
gagccctgagagttgtgaggcc

SEQ ID NO: 7177086 - DNA, 22 bp, Homo sapiens
gagccctgaacaacagcaggaa

SEQ ID NO: 7177087 - DNA, 22 bp, Homo sapiens
gagccctgacactgagggagtt

SEQ ID NO: 7177088 - DNA, 22 bp, Homo sapiens
gagccctgacactgagggagtt

SEQ ID NO: 7177089 - DNA, 22 bp, Homo sapiens
gagccctgaacaacagcaggaa

SEQ ID NO: 7177090 - DNA, 22 bp, Homo sapiens
gagcccagtctgctcctgcgcc

SEQ ID NO: 7177091 - DNA, 22 bp, Homo sapiens
gagcccaggttctgcttccagc

SEQ ID NO: 7177092 - DNA, 22 bp, Homo sapiens
gagcccaggttctgcttccagc

SEQ ID NO: 7177093 - DNA, 22 bp, Homo sapiens
gagcccaggttctgcttccagc

SEQ ID NO: 7177094 - DNA, 22 bp, Homo sapiens
gagcccagtaggcaaagctgca

SEQ ID NO: 7177095 - DNA, 22 bp, Homo sapiens
gagcccagtaggcaaagctgca

SEQ ID NO: 7177096 - DNA, 22 bp, Homo sapiens
gagcccagtaggcaaagctgca

SEQ ID NO: 7177097 - DNA, 22 bp, Homo sapiens
gagcccagtaggcaaagctgca

SEQ ID NO: 7177098 - DNA, 22 bp, Homo sapiens
gagcccagtaggcaaagctgca

SEQ ID NO: 7177099 - DNA, 22 bp, Homo sapiens
gagcccagtaggcaaagctgca

SEQ ID NO: 7177100 - DNA, 22 bp, Homo sapiens
gagcccagtaggcaaagctgca

SEQ ID NO: 7177101 - DNA, 22 bp, Homo sapiens
gagcccagtctgctcctgcgcc

SEQ ID NO: 7177102 - DNA, 22 bp, Homo sapiens
gagcccagtctgctcctgcgcc

SEQ ID NO: 7177103 - DNA, 22 bp, Homo sapiens
gagcccaggatggtgtatggct

SEQ ID NO: 7177104 - DNA, 22 bp, Homo sapiens
gagcccaggatggtgtatggct

SEQ ID NO: 7177105 - DNA, 22 bp, Homo sapiens
gagcccaggcagaggttgcagt

SEQ ID NO: 7177106 - DNA, 22 bp, Homo sapiens
gagcccaggcagaggttgcagt

SEQ ID NO: 7177107 - DNA, 22 bp, Homo sapiens
gagcccaggcagaggttgcagt

SEQ ID NO: 7177108 - DNA, 21 bp, Homo sapiens
gagcccaggcatctcattaat

SEQ ID NO: 7177109 - DNA, 21 bp, Homo sapiens
gagcccaggcatctcattaat

SEQ ID NO: 7177110 - DNA, 22 bp, Homo sapiens
gagcccaggctggggttcagag

SEQ ID NO: 7177111 - DNA, 22 bp, Homo sapiens
gagcccaggctggggttcagag

SEQ ID NO: 7177112 - DNA, 22 bp, Homo sapiens
gagcccaggctggggttcagag

SEQ ID NO: 7177113 - DNA, 22 bp, Homo sapiens
gagcccaggctggggttcagag

SEQ ID NO: 7177114 - DNA, 22 bp, Homo sapiens
gagcccaggctggggttcagag

SEQ ID NO: 7177115 - DNA, 22 bp, Homo sapiens
gagcccagggcaggcaaggcag

SEQ ID NO: 7177116 - DNA, 22 bp, Homo sapiens
gagcccagggcaggcaaggcag

SEQ ID NO: 7177117 - DNA, 22 bp, Homo sapiens
gagcccagggcaggcaaggcag

SEQ ID NO: 7177118 - DNA, 22 bp, Homo sapiens
gagcccagggcaggcaaggcag

SEQ ID NO: 7177119 - DNA, 22 bp, Homo sapiens
gagcccagggcaggcaaggcag

SEQ ID NO: 7177120 - DNA, 22 bp, Homo sapiens
gagcccagggtgaaatagcagc

SEQ ID NO: 7177121 - DNA, 22 bp, Homo sapiens
gagcccagggtgaaatagcagc

SEQ ID NO: 7177122 - DNA, 22 bp, Homo sapiens
gagcccagggtgaaatagcagc

SEQ ID NO: 7177123 - DNA, 22 bp, Homo sapiens
gagcccagggtgaaatagcagc

SEQ ID NO: 7177124 - DNA, 22 bp, Homo sapiens
gagctgagggtctaggagggtt

SEQ ID NO: 7177125 - DNA, 22 bp, Homo sapiens
gagctgagggtctaggagggtt

SEQ ID NO: 7177126 - DNA, 22 bp, Homo sapiens
gagctgaggtgatgtggtcgtt

SEQ ID NO: 7177127 - DNA, 22 bp, Homo sapiens
gagctgagggtctaggagggtt

SEQ ID NO: 7177128 - DNA, 22 bp, Homo sapiens
gagctgagtatcccactgaagt

SEQ ID NO: 7177129 - DNA, 22 bp, Homo sapiens
gagctgagtatgaaggatgtga

SEQ ID NO: 7177130 - DNA, 22 bp, Homo sapiens
gagctgagtatgaaggatgtga

SEQ ID NO: 7177131 - DNA, 22 bp, Homo sapiens
gagctgagtagaggctgctccc

SEQ ID NO: 7177132 - DNA, 22 bp, Homo sapiens
gagctgagtatcccactgaagt

SEQ ID NO: 7177133 - DNA, 22 bp, Homo sapiens
gagctgagtatcccactgaagt

SEQ ID NO: 7177134 - DNA, 22 bp, Homo sapiens
gagctgcctgtgtgccatgatg

SEQ ID NO: 7177135 - DNA, 22 bp, Homo sapiens
gagctgcctgaacaagcagcag

SEQ ID NO: 7177136 - DNA, 22 bp, Homo sapiens
gagctgcctacattgccaagag

SEQ ID NO: 7177137 - DNA, 22 bp, Homo sapiens
gagctgcctacattgccaagag

SEQ ID NO: 7177138 - DNA, 22 bp, Homo sapiens
gagctgcctgaacaagcagcag

SEQ ID NO: 7177139 - DNA, 23 bp, Homo sapiens
gagctgagtgtagggagactagg

SEQ ID NO: 7177140 - DNA, 22 bp, Homo sapiens
gagctgcctacattgccaagag

SEQ ID NO: 7177141 - DNA, 22 bp, Homo sapiens
gagctgcctacattgccaagag

SEQ ID NO: 7177142 - DNA, 22 bp, Homo sapiens
gagctgagggtctaggagggtt

SEQ ID NO: 7177143 - DNA, 22 bp, Homo sapiens
gagctgagggtctaggagggtt

SEQ ID NO: 7177144 - DNA, 22 bp, Homo sapiens
gagctgaggctgaggcctcact

SEQ ID NO: 7177145 - DNA, 22 bp, Homo sapiens
gagctgaggctcaggctggcgt

SEQ ID NO: 7177146 - DNA, 22 bp, Homo sapiens
gagctgaggccagagtcttctg

SEQ ID NO: 7177147 - DNA, 22 bp, Homo sapiens
gagctgaggccagagtcttctg

SEQ ID NO: 7177148 - DNA, 22 bp, Homo sapiens
gagctgaggatacatcagtgaa

SEQ ID NO: 7177149 - DNA, 22 bp, Homo sapiens
gagctgaggatacatcagtgaa

SEQ ID NO: 7177150 - DNA, 22 bp, Homo sapiens
gagctgagcttaactccttgaa

SEQ ID NO: 7177151 - DNA, 22 bp, Homo sapiens
gagctgagcttaactccttgaa

SEQ ID NO: 7177152 - DNA, 22 bp, Homo sapiens
gagctgagatttgaagcaagtt

SEQ ID NO: 7177153 - DNA, 22 bp, Homo sapiens
gagctgagatttgaagcaagtt

SEQ ID NO: 7177154 - DNA, 22 bp, Homo sapiens
gagccctggcagtctgggatgg

SEQ ID NO: 7177155 - DNA, 22 bp, Homo sapiens
gagccctgcttccaagggggca

SEQ ID NO: 7177156 - DNA, 22 bp, Homo sapiens
gagccctggcagtctgggatgg

SEQ ID NO: 7177157 - DNA, 22 bp, Homo sapiens
gagccctggcagtctgggatgg

SEQ ID NO: 7177158 - DNA, 22 bp, Homo sapiens
gagccctgctgggccttgtctc

SEQ ID NO: 7177159 - DNA, 22 bp, Homo sapiens
gagccctgcttccaagggggca

SEQ ID NO: 7177160 - DNA, 22 bp, Homo sapiens
gagccctgcgtgtctgggggca

SEQ ID NO: 7177161 - DNA, 22 bp, Homo sapiens
gagccctgctgggccttgtctc

SEQ ID NO: 7177162 - DNA, 22 bp, Homo sapiens
gagccctgctgggccttgtctc

SEQ ID NO: 7177163 - DNA, 22 bp, Homo sapiens
gagccctgcgtgtctgggggca

SEQ ID NO: 7177164 - DNA, 22 bp, Homo sapiens
gagccctgcggagccccgaggc

SEQ ID NO: 7177165 - DNA, 22 bp, Homo sapiens
gagccctgcggagccccgaggc

SEQ ID NO: 7177166 - DNA, 18 bp, Homo sapiens
gagccctgagtctgcaca

SEQ ID NO: 7177167 - DNA, 18 bp, Homo sapiens
gagccctgagtctgcaca

SEQ ID NO: 7177168 - DNA, 18 bp, Homo sapiens
gagccctgagtctgcaca

SEQ ID NO: 7177169 - DNA, 22 bp, Homo sapiens
gagccctgtagcaagtcatgtc

SEQ ID NO: 7177170 - DNA, 22 bp, Homo sapiens
gagccctgtagcaagtcatgtc

SEQ ID NO: 7177171 - DNA, 22 bp, Homo sapiens
gagccctggcagtctgggatgg

SEQ ID NO: 7177172 - DNA, 18 bp, Homo sapiens
gagccctgggagatctct

SEQ ID NO: 7177173 - DNA, 22 bp, Homo sapiens
gagccctgtagcaagtcatgtc

SEQ ID NO: 7177174 - DNA, 22 bp, Homo sapiens
gagccctgtagcaagtcatgtc

SEQ ID NO: 7177175 - DNA, 22 bp, Homo sapiens
gagccctgtagcaagtcatgtc

SEQ ID NO: 7177176 - DNA, 22 bp, Homo sapiens
gagccctgttcaggcctcctca

SEQ ID NO: 7177177 - DNA, 22 bp, Homo sapiens
gagctgagatcatgtacactag

SEQ ID NO: 7177178 - DNA, 22 bp, Homo sapiens
gagctgagatttgaagcaagtt

SEQ ID NO: 7177179 - DNA, 22 bp, Homo sapiens
gagccctgtaggaatctctcaa

SEQ ID NO: 7177180 - DNA, 22 bp, Homo sapiens
gagccctgtgaggaaagagggt

SEQ ID NO: 7177181 - DNA, 22 bp, Homo sapiens
gaggaaaatgggacaggctgta

SEQ ID NO: 7177182 - DNA, 22 bp, Homo sapiens
gaggaaaatgggacaggctgta

SEQ ID NO: 7177183 - DNA, 22 bp, Homo sapiens
gaggaaaatgggacaggctgta

SEQ ID NO: 7177184 - DNA, 22 bp, Homo sapiens
gaggaaaatgcaacaggaatgc

SEQ ID NO: 7177185 - DNA, 22 bp, Homo sapiens
gaggaaaatggagtgtaattaa

SEQ ID NO: 7177186 - DNA, 22 bp, Homo sapiens
gaggaaaatggagtgtaattaa

SEQ ID NO: 7177187 - DNA, 22 bp, Homo sapiens
gagctgctggatatgtggcctg

SEQ ID NO: 7177188 - DNA, 22 bp, Homo sapiens
gagctgctggctcctcaggtta

SEQ ID NO: 7177189 - DNA, 22 bp, Homo sapiens
gagctgctggttgctggtgcct

SEQ ID NO: 7177190 - DNA, 22 bp, Homo sapiens
gagctgctggttgctggtgcct

SEQ ID NO: 7177191 - DNA, 22 bp, Homo sapiens
gagctgctgtgaggggagcttc

SEQ ID NO: 7177192 - DNA, 22 bp, Homo sapiens
gagctgctgtgaggggagcttc

SEQ ID NO: 7177193 - DNA, 22 bp, Homo sapiens
gagctgctgtgaggggagcttc

SEQ ID NO: 7177194 - DNA, 19 bp, Homo sapiens
gagctgccttttgaagacc

SEQ ID NO: 7177195 - DNA, 19 bp, Homo sapiens
gagctgccttttgaagacc

SEQ ID NO: 7177196 - DNA, 22 bp, Homo sapiens
gagctgctggaagtggagccct

SEQ ID NO: 7177197 - DNA, 22 bp, Homo sapiens
gagctgctgaagggaaaatgaa

SEQ ID NO: 7177198 - DNA, 22 bp, Homo sapiens
gagctgctggaagtggagccct

SEQ ID NO: 7177199 - DNA, 22 bp, Homo sapiens
gagctgctggatatgtggcctg

SEQ ID NO: 7177200 - DNA, 22 bp, Homo sapiens
gagctgctggcctcctgcggga

SEQ ID NO: 7177201 - DNA, 22 bp, Homo sapiens
gagctgcctgtgtgccatgatg

SEQ ID NO: 7177202 - DNA, 22 bp, Homo sapiens
gagctgcctgtgtgccatgatg

SEQ ID NO: 7177203 - DNA, 22 bp, Homo sapiens
gagctgcctgtgtgccatgatg

SEQ ID NO: 7177204 - DNA, 22 bp, Homo sapiens
gagctgcctgttgcatagcaac

SEQ ID NO: 7177205 - DNA, 22 bp, Homo sapiens
gagctgcctgttgcatagcaac

SEQ ID NO: 7177206 - DNA, 22 bp, Homo sapiens
gaggaaagaaccccagtcaata

SEQ ID NO: 7177207 - DNA, 22 bp, Homo sapiens
gaggaaacattgtagaagcagt

SEQ ID NO: 7177208 - DNA, 22 bp, Homo sapiens
gaggaaagaaccccagtcaata

SEQ ID NO: 7177209 - DNA, 22 bp, Homo sapiens
gaggaaagaaccccagtcaata

SEQ ID NO: 7177210 - DNA, 18 bp, Homo sapiens
gaggaaacaaggcagagg

SEQ ID NO: 7177211 - DNA, 18 bp, Homo sapiens
gaggaaacaaggcagagg

SEQ ID NO: 7177212 - DNA, 22 bp, Homo sapiens
gaggaaacattgtagaagcagt

SEQ ID NO: 7177213 - DNA, 23 bp, Homo sapiens
gaggaaagaatatagatgcaatc

SEQ ID NO: 7177214 - DNA, 23 bp, Homo sapiens
gaggaaagaatatagatgcaatc

SEQ ID NO: 7177215 - DNA, 23 bp, Homo sapiens
gaggaaagaatatagatgcaatc

SEQ ID NO: 7177216 - DNA, 22 bp, Homo sapiens
gaggaaagagtcaaatctgaag

SEQ ID NO: 7177217 - DNA, 22 bp, Homo sapiens
gaggaaagctggtttaaagtat

SEQ ID NO: 7177218 - DNA, 22 bp, Homo sapiens
gaggaaagctggtttaaagtat

SEQ ID NO: 7177219 - DNA, 22 bp, Homo sapiens
gaggaaatcttaggccccaacc

SEQ ID NO: 7177220 - DNA, 22 bp, Homo sapiens
gaggaagaaagcataggtgggg

SEQ ID NO: 7177221 - DNA, 22 bp, Homo sapiens
gaggaagaaagcataggtgggg

SEQ ID NO: 7177222 - DNA, 22 bp, Homo sapiens
gaggaacttatgatattctact

SEQ ID NO: 7177223 - DNA, 22 bp, Homo sapiens
gaggaacttatgatattctact

SEQ ID NO: 7177224 - DNA, 22 bp, Homo sapiens
gaggaagaaagcataggtgggg

SEQ ID NO: 7177225 - DNA, 18 bp, Homo sapiens
gaggaacattcacctcct

SEQ ID NO: 7177226 - DNA, 18 bp, Homo sapiens
gaggaacattcacctcct

SEQ ID NO: 7177227 - DNA, 22 bp, Homo sapiens
gaggaacagcagccacatgtcc

SEQ ID NO: 7177228 - DNA, 22 bp, Homo sapiens
gaggaacagcagccacatgtcc

SEQ ID NO: 7177229 - DNA, 22 bp, Homo sapiens
gaggaacatgaggtgacctggg

SEQ ID NO: 7177230 - DNA, 21 bp, Homo sapiens
gaggaaatgctctggtgttca

SEQ ID NO: 7177231 - DNA, 22 bp, Homo sapiens
gaggaacagagacgggatcgct

SEQ ID NO: 7177232 - DNA, 22 bp, Homo sapiens
gaggagagatggtagattgggt

SEQ ID NO: 7177233 - DNA, 22 bp, Homo sapiens
gaggagagatggtagattgggt

SEQ ID NO: 7177234 - DNA, 22 bp, Homo sapiens
gaggagagatggtagattgggt

SEQ ID NO: 7177235 - DNA, 22 bp, Homo sapiens
gaggagagagggactgtctgca

SEQ ID NO: 7177236 - DNA, 22 bp, Homo sapiens
gaggaagaattggttattggag

SEQ ID NO: 7177237 - DNA, 22 bp, Homo sapiens
gaggaagaatcagggtggtgag

SEQ ID NO: 7177238 - DNA, 22 bp, Homo sapiens
gaggaagaatcagggtggtgag

SEQ ID NO: 7177239 - DNA, 22 bp, Homo sapiens
gaggaagaatcagggtggtgag

SEQ ID NO: 7177240 - DNA, 22 bp, Homo sapiens
gaggaagaattggttattggag

SEQ ID NO: 7177241 - DNA, 22 bp, Homo sapiens
gaggaagaattggttattggag

SEQ ID NO: 7177242 - DNA, 22 bp, Homo sapiens
gaggaagaagggattagaactc

SEQ ID NO: 7177243 - DNA, 22 bp, Homo sapiens
gaggaagaagggattagaactc

SEQ ID NO: 7177244 - DNA, 22 bp, Homo sapiens
gaggaagaagggattagaactc

SEQ ID NO: 7177245 - DNA, 22 bp, Homo sapiens
gaggaagaagcaaaccagctaa

SEQ ID NO: 7177246 - DNA, 22 bp, Homo sapiens
gaggaagaagcaaaccagctaa

SEQ ID NO: 7177247 - DNA, 22 bp, Homo sapiens
gaggaagaagcaaaccagctaa

SEQ ID NO: 7177248 - DNA, 22 bp, Homo sapiens
gaggaagaaagcataggtgggg

SEQ ID NO: 7177249 - DNA, 22 bp, Homo sapiens
gaggaagaaagcataggtgggg

SEQ ID NO: 7177250 - DNA, 22 bp, Homo sapiens
gaggaagaaagcataggtgggg

SEQ ID NO: 7177251 - DNA, 22 bp, Homo sapiens
ctggtgcacattcgctctcata

SEQ ID NO: 7177252 - DNA, 22 bp, Homo sapiens
ctggtgcacgtggctgcagtcg

SEQ ID NO: 7177253 - DNA, 22 bp, Homo sapiens
ctggtgcacgtggctgcagtcg

SEQ ID NO: 7177254 - DNA, 22 bp, Homo sapiens
ctggtgcactacagcctggaac

SEQ ID NO: 7177255 - DNA, 22 bp, Homo sapiens
ctggtgcaggaaggagctggca

SEQ ID NO: 7177256 - DNA, 22 bp, Homo sapiens
ctggtgcaggaaggagctggca

SEQ ID NO: 7177257 - DNA, 22 bp, Homo sapiens
ctggtgcatgtggccttgctct

SEQ ID NO: 7177258 - DNA, 22 bp, Homo sapiens
ctggtgagactcagggatgctt

SEQ ID NO: 7177259 - DNA, 22 bp, Homo sapiens
ctggtgagacggttgacaggag

SEQ ID NO: 7177260 - DNA, 22 bp, Homo sapiens
ctggtgcaaaagtaattgtggt

SEQ ID NO: 7177261 - DNA, 22 bp, Homo sapiens
ctggtgcaagattccctgcttc

SEQ ID NO: 7177262 - DNA, 22 bp, Homo sapiens
ctggtgcaaggctttggaatcc

SEQ ID NO: 7177263 - DNA, 22 bp, Homo sapiens
ctggtgcaaggctttggaatcc

SEQ ID NO: 7177264 - DNA, 22 bp, Homo sapiens
ctggtgcacatgaaagagaagg

SEQ ID NO: 7177265 - DNA, 22 bp, Homo sapiens
ctggtgccattctgtggcctag

SEQ ID NO: 7177266 - DNA, 22 bp, Homo sapiens
ctggtgccctgtgtggcaggag

SEQ ID NO: 7177267 - DNA, 22 bp, Homo sapiens
ctgtaaaacactgtagtatctg

SEQ ID NO: 7177268 - DNA, 22 bp, Homo sapiens
ctgtaaaacactgtagtatctg

SEQ ID NO: 7177269 - DNA, 22 bp, Homo sapiens
ctgtaaaacactgtagtatctg

SEQ ID NO: 7177270 - DNA, 22 bp, Homo sapiens
ctgtaaaactgcttaagtatgc

SEQ ID NO: 7177271 - DNA, 22 bp, Homo sapiens
ctgtaaaactgcttaagtatgc

SEQ ID NO: 7177272 - DNA, 22 bp, Homo sapiens
ctgtaaaactgcttaagtatgc

SEQ ID NO: 7177273 - DNA, 22 bp, Homo sapiens
ctgtaaaatgaacctagtcatc

SEQ ID NO: 7177274 - DNA, 20 bp, Homo sapiens
ctgtaaaccaggcttcttgg

SEQ ID NO: 7177275 - DNA, 22 bp, Homo sapiens
ctgtaattttccagccaatatg

SEQ ID NO: 7177276 - DNA, 22 bp, Homo sapiens
ctgtacaaaagaaagttcctat

SEQ ID NO: 7177277 - DNA, 22 bp, Homo sapiens
ctgtacaaaagaaagttcctat

SEQ ID NO: 7177278 - DNA, 22 bp, Homo sapiens
ctgtacaaaagaaagttcctat

SEQ ID NO: 7177279 - DNA, 22 bp, Homo sapiens
ctgtacaaagtagctgctggga

SEQ ID NO: 7177280 - DNA, 22 bp, Homo sapiens
ctgtacaaagtagctgctggga

SEQ ID NO: 7177281 - DNA, 20 bp, Homo sapiens
ctgtagagcacaagtggagg

SEQ ID NO: 7177282 - DNA, 22 bp, Homo sapiens
ctgtagcaagttattcaataaa

SEQ ID NO: 7177283 - DNA, 22 bp, Homo sapiens
ctgtagcaagttattcaataaa

SEQ ID NO: 7177284 - DNA, 22 bp, Homo sapiens
ctgtagaacgatccaggcattt

SEQ ID NO: 7177285 - DNA, 22 bp, Homo sapiens
ctgtactcaaggtaaaccagga

SEQ ID NO: 7177286 - DNA, 22 bp, Homo sapiens
ctgtagagaaagcatggaagct

SEQ ID NO: 7177287 - DNA, 22 bp, Homo sapiens
ctgtagccagaagcagaaggcc

SEQ ID NO: 7177288 - DNA, 22 bp, Homo sapiens
ctgtagcagacagaccctaggt

SEQ ID NO: 7177289 - DNA, 22 bp, Homo sapiens
ctgtagcagctgacctggctaa

SEQ ID NO: 7177290 - DNA, 22 bp, Homo sapiens
ctgtagcagtgtgctctttttc

SEQ ID NO: 7177291 - DNA, 22 bp, Homo sapiens
ctgtagcagtgttccagcattg

SEQ ID NO: 7177292 - DNA, 22 bp, Homo sapiens
ctgtagcatttgttatggcaat

SEQ ID NO: 7177293 - DNA, 22 bp, Homo sapiens
ctgtacatcccgagagccagta

SEQ ID NO: 7177294 - DNA, 22 bp, Homo sapiens
ctgtacatctctgaggacagta

SEQ ID NO: 7177295 - DNA, 22 bp, Homo sapiens
ctgtacatctctgaggacagta

SEQ ID NO: 7177296 - DNA, 22 bp, Homo sapiens
ctgtacatctctgaggacagta

SEQ ID NO: 7177297 - DNA, 22 bp, Homo sapiens
ctgtacatctctgaggacagta

SEQ ID NO: 7177298 - DNA, 22 bp, Homo sapiens
ctgtacatcttaaatggaaaaa

SEQ ID NO: 7177299 - DNA, 22 bp, Homo sapiens
ctgtacatcttaaatggaaaaa

SEQ ID NO: 7177300 - DNA, 18 bp, Homo sapiens
ctgtacttcagcctgggt

SEQ ID NO: 7177301 - DNA, 22 bp, Homo sapiens
ctgtacatatgtctccagagtg

SEQ ID NO: 7177302 - DNA, 22 bp, Homo sapiens
ctgtacatatgtctccagagtg

SEQ ID NO: 7177303 - DNA, 22 bp, Homo sapiens
ctgtacatatgtctccagagtg

SEQ ID NO: 7177304 - DNA, 20 bp, Homo sapiens
ctgtacatcaccaaggtgac

SEQ ID NO: 7177305 - DNA, 22 bp, Homo sapiens
ctgtacatcccaagatatttct

SEQ ID NO: 7177306 - DNA, 22 bp, Homo sapiens
ctgtacatcccaagatatttct

SEQ ID NO: 7177307 - DNA, 22 bp, Homo sapiens
ctgtacatcccaagatatttct

SEQ ID NO: 7177308 - DNA, 22 bp, Homo sapiens
ctgtacatcccgagagccagta

SEQ ID NO: 7177309 - DNA, 22 bp, Homo sapiens
ctgtacatcccgagagccagta

SEQ ID NO: 7177310 - DNA, 22 bp, Homo sapiens
ctgtacatcccgagagccagta

SEQ ID NO: 7177311 - DNA, 22 bp, Homo sapiens
ctgtacatcccgagagccagta

SEQ ID NO: 7177312 - DNA, 22 bp, Homo sapiens
ctgtacaatgttacctatttat

SEQ ID NO: 7177313 - DNA, 22 bp, Homo sapiens
ctgtacaagtccttcatcaggg

SEQ ID NO: 7177314 - DNA, 22 bp, Homo sapiens
ctgtacacttcagtgagttttg

SEQ ID NO: 7177315 - DNA, 22 bp, Homo sapiens
ctgtacagaagctagagcaaat

SEQ ID NO: 7177316 - DNA, 22 bp, Homo sapiens
ctgtacagaagctagagcaaat

SEQ ID NO: 7177317 - DNA, 22 bp, Homo sapiens
ctgtacacttcagtgagttttg

SEQ ID NO: 7177318 - DNA, 22 bp, Homo sapiens
ctgtacagaagctagagcaaat

SEQ ID NO: 7177319 - DNA, 22 bp, Homo sapiens
ctgtacagacctattagcccag

SEQ ID NO: 7177320 - DNA, 22 bp, Homo sapiens
ctgtacagagttctgagtgtac

SEQ ID NO: 7177321 - DNA, 22 bp, Homo sapiens
ctgtacagcaagttcaccttgg

SEQ ID NO: 7177322 - DNA, 22 bp, Homo sapiens
ctgtacaggagacgtctgtgca

SEQ ID NO: 7177323 - DNA, 22 bp, Homo sapiens
ctgtacaggtcaatgataagat

SEQ ID NO: 7177324 - DNA, 22 bp, Homo sapiens
ctgtacaggtgaggagggggct

SEQ ID NO: 7177325 - DNA, 19 bp, Homo sapiens
ctgtacaggttgcttctgg

SEQ ID NO: 7177326 - DNA, 19 bp, Homo sapiens
ctgtacaggttgcttctgg

SEQ ID NO: 7177327 - DNA, 22 bp, Homo sapiens
ctgtacataaaggaataggtgt

SEQ ID NO: 7177328 - DNA, 22 bp, Homo sapiens
ctggtctgggatgagggatgta

SEQ ID NO: 7177329 - DNA, 21 bp, Homo sapiens
ctggtctggccaataaggtcc

SEQ ID NO: 7177330 - DNA, 22 bp, Homo sapiens
ctggtctggctacccagcgaat

SEQ ID NO: 7177331 - DNA, 22 bp, Homo sapiens
ctggtctggctacccagcgaat

SEQ ID NO: 7177332 - DNA, 22 bp, Homo sapiens
ctggtctgaaaaggaggcatgc

SEQ ID NO: 7177333 - DNA, 22 bp, Homo sapiens
ctggtctgcgggaaggcgtggg

SEQ ID NO: 7177334 - DNA, 22 bp, Homo sapiens
ctggtctgcgggaaggcgtggg

SEQ ID NO: 7177335 - DNA, 22 bp, Homo sapiens
ctggtctgctagaaagatgcat

SEQ ID NO: 7177336 - DNA, 19 bp, Homo sapiens
ctggtctgctgcttccagg

SEQ ID NO: 7177337 - DNA, 22 bp, Homo sapiens
ctggtccttgctacccagcaag

SEQ ID NO: 7177338 - DNA, 22 bp, Homo sapiens
ctggtcactggtctcatccagc

SEQ ID NO: 7177339 - DNA, 22 bp, Homo sapiens
ctggtcagagcaactgctcaca

SEQ ID NO: 7177340 - DNA, 23 bp, Homo sapiens
ctggtcagaggctgctggaaggg

SEQ ID NO: 7177341 - DNA, 23 bp, Homo sapiens
ctggtcagaggctgctggaaggg

SEQ ID NO: 7177342 - DNA, 22 bp, Homo sapiens
ctggtcagctgaagccccacac

SEQ ID NO: 7177343 - DNA, 22 bp, Homo sapiens
ctggtcaggaaggtggggacag

SEQ ID NO: 7177344 - DNA, 20 bp, Homo sapiens
ctggggagctgctcccacga

SEQ ID NO: 7177345 - DNA, 20 bp, Homo sapiens
ctggggagctgctcccacga

SEQ ID NO: 7177346 - DNA, 20 bp, Homo sapiens
ctggggagctgctcccacga

SEQ ID NO: 7177347 - DNA, 20 bp, Homo sapiens
ctggggagctgctcccacga

SEQ ID NO: 7177348 - DNA, 22 bp, Homo sapiens
ctggggagacgatcgatgttct

SEQ ID NO: 7177349 - DNA, 20 bp, Homo sapiens
ctggggagcctcgcggtggc

SEQ ID NO: 7177350 - DNA, 20 bp, Homo sapiens
ctggggagcctcgcggtggc

SEQ ID NO: 7177351 - DNA, 20 bp, Homo sapiens
ctggggagcctcgcggtggc

SEQ ID NO: 7177352 - DNA, 20 bp, Homo sapiens
ctggggagcctcgcggtggc

SEQ ID NO: 7177353 - DNA, 20 bp, Homo sapiens
ctggggagcctcgcggtggc

SEQ ID NO: 7177354 - DNA, 20 bp, Homo sapiens
ctggggagcctcgcggtggc

SEQ ID NO: 7177355 - DNA, 20 bp, Homo sapiens
ctggggagcctcgcggtggc

SEQ ID NO: 7177356 - DNA, 22 bp, Homo sapiens
ctgggcttgagttcctgctcgt

SEQ ID NO: 7177357 - DNA, 19 bp, Homo sapiens
ctgggcttgatgttgagtt

SEQ ID NO: 7177358 - DNA, 22 bp, Homo sapiens
ctgggctttggtactgtgatta

SEQ ID NO: 7177359 - DNA, 22 bp, Homo sapiens
ctggggaacaatttgccacact

SEQ ID NO: 7177360 - DNA, 22 bp, Homo sapiens
ctggggaacgcagcgagcagcg

SEQ ID NO: 7177361 - DNA, 22 bp, Homo sapiens
ctggggaacgcagcgagcagcg

SEQ ID NO: 7177362 - DNA, 22 bp, Homo sapiens
ctggggaacgcagcgagcagcg

SEQ ID NO: 7177363 - DNA, 22 bp, Homo sapiens
ctggggaaggcggtgactgcgc

SEQ ID NO: 7177364 - DNA, 22 bp, Homo sapiens
ctggggaaggcggtgactgcgc

SEQ ID NO: 7177365 - DNA, 22 bp, Homo sapiens
ctggggaatagagctggagacc

SEQ ID NO: 7177366 - DNA, 20 bp, Homo sapiens
ctggggacagcaatggctgt

SEQ ID NO: 7177367 - DNA, 22 bp, Homo sapiens
ctggggaccgagcaagctctgg

SEQ ID NO: 7177368 - DNA, 22 bp, Homo sapiens
ctggggacgtcgggcagtgttc

SEQ ID NO: 7177369 - DNA, 22 bp, Homo sapiens
ctggggacgtcgggcagtgttc

SEQ ID NO: 7177370 - DNA, 22 bp, Homo sapiens
ctggggacgtcgggcagtgttc

SEQ ID NO: 7177371 - DNA, 22 bp, Homo sapiens
ctggggactcattcagagcata

SEQ ID NO: 7177372 - DNA, 22 bp, Homo sapiens
ctggggactgaaggatgttgct

SEQ ID NO: 7177373 - DNA, 22 bp, Homo sapiens
ctggggactttggttctccatg

SEQ ID NO: 7177374 - DNA, 22 bp, Homo sapiens
ctggggagaagcgactcggctg

SEQ ID NO: 7177375 - DNA, 22 bp, Homo sapiens
ctggggagaagcgactcggctg

SEQ ID NO: 7177376 - DNA, 22 bp, Homo sapiens
ctggggagaagcgactcggctg

SEQ ID NO: 7177377 - DNA, 22 bp, Homo sapiens
ctggggagaagcgactcggctg

SEQ ID NO: 7177378 - DNA, 22 bp, Homo sapiens
ctggggagaagcgactcggctg

SEQ ID NO: 7177379 - DNA, 22 bp, Homo sapiens
ctggggagaagcgactcggctg

SEQ ID NO: 7177380 - DNA, 22 bp, Homo sapiens
ctggggagaagcgactcggctg

SEQ ID NO: 7177381 - DNA, 22 bp, Homo sapiens
ctggggagaagcgactcggctg

SEQ ID NO: 7177382 - DNA, 22 bp, Homo sapiens
ctggggagaagcgactcggctg

SEQ ID NO: 7177383 - DNA, 22 bp, Homo sapiens
ctggggagaagcgactcggctg

SEQ ID NO: 7177384 - DNA, 22 bp, Homo sapiens
ctggggagacgatcgatgttct

SEQ ID NO: 7177385 - DNA, 22 bp, Homo sapiens
ctggggagacgatcgatgttct

SEQ ID NO: 7177386 - DNA, 22 bp, Homo sapiens
ctggggagacgatcgatgttct

SEQ ID NO: 7177387 - DNA, 22 bp, Homo sapiens
ctgtcacctctgccctttgccc

SEQ ID NO: 7177388 - DNA, 22 bp, Homo sapiens
ctgtcactctggcaacccagta

SEQ ID NO: 7177389 - DNA, 22 bp, Homo sapiens
ctgtcactgatgggctcaccag

SEQ ID NO: 7177390 - DNA, 22 bp, Homo sapiens
ctgtcacttaaattcaggctga

SEQ ID NO: 7177391 - DNA, 22 bp, Homo sapiens
ctgtcagagatggggagtcaga

SEQ ID NO: 7177392 - DNA, 22 bp, Homo sapiens
ctgtcagagatggggagtcaga

SEQ ID NO: 7177393 - DNA, 22 bp, Homo sapiens
ctgtcagcactctactacagat

SEQ ID NO: 7177394 - DNA, 19 bp, Homo sapiens
ctgtcaggggctggatgtt

SEQ ID NO: 7177395 - DNA, 22 bp, Homo sapiens
ctgtcaggggcgggtggagcgg

SEQ ID NO: 7177396 - DNA, 22 bp, Homo sapiens
ctgtctgccaataatctatggc

SEQ ID NO: 7177397 - DNA, 22 bp, Homo sapiens
ctgtctgccaataatctatggc

SEQ ID NO: 7177398 - DNA, 22 bp, Homo sapiens
ctgtctgcaggatagtaccctc

SEQ ID NO: 7177399 - DNA, 22 bp, Homo sapiens
ctgtcctgtgtcagcctgaaat

SEQ ID NO: 7177400 - DNA, 22 bp, Homo sapiens
ctgtccttactgcttctggctt

SEQ ID NO: 7177401 - DNA, 22 bp, Homo sapiens
ctgtccttactgcttctggctt

SEQ ID NO: 7177402 - DNA, 22 bp, Homo sapiens
ctgtcctgtggacctgaggacg

SEQ ID NO: 7177403 - DNA, 22 bp, Homo sapiens
ctgtcctgtggtgacaggtaca

SEQ ID NO: 7177404 - DNA, 22 bp, Homo sapiens
ctgtcaggtttcccatctgcaa

SEQ ID NO: 7177405 - DNA, 22 bp, Homo sapiens
ctgtattttcatgcctacgtac

SEQ ID NO: 7177406 - DNA, 22 bp, Homo sapiens
ctgtattttttaagaatatctc

SEQ ID NO: 7177407 - DNA, 22 bp, Homo sapiens
ctgtattttttaagaatatctc

SEQ ID NO: 7177408 - DNA, 22 bp, Homo sapiens
ctgtattttttaagtgatctgg

SEQ ID NO: 7177409 - DNA, 22 bp, Homo sapiens
ctgtattttttaagtgatctgg

SEQ ID NO: 7177410 - DNA, 22 bp, Homo sapiens
ctgtcaaatggaaacttatcct

SEQ ID NO: 7177411 - DNA, 22 bp, Homo sapiens
ctgtcaaattcataacacttat

SEQ ID NO: 7177412 - DNA, 22 bp, Homo sapiens
ctgtcacaggttcaaactcccc

SEQ ID NO: 7177413 - DNA, 22 bp, Homo sapiens
ctgtcacccacccagcctgtca

SEQ ID NO: 7177414 - DNA, 22 bp, Homo sapiens
ctgtcaccatttgagccctgga

SEQ ID NO: 7177415 - DNA, 22 bp, Homo sapiens
ctgtcacactgatatcaggctt

SEQ ID NO: 7177416 - DNA, 22 bp, Homo sapiens
ctgtcacagcccgcgtctcctc

SEQ ID NO: 7177417 - DNA, 18 bp, Homo sapiens
ctgtcaactcaacaagag

SEQ ID NO: 7177418 - DNA, 20 bp, Homo sapiens
ctgtcacaaaggatgtgtca

SEQ ID NO: 7177419 - DNA, 17 bp, Homo sapiens
ctgtcacaatacctcgc

SEQ ID NO: 7177420 - DNA, 17 bp, Homo sapiens
ctgtcacaatacctcgc

SEQ ID NO: 7177421 - DNA, 22 bp, Homo sapiens
ctgtcacactaaaacaagaagt

SEQ ID NO: 7177422 - DNA, 22 bp, Homo sapiens
ctgtcacactaaaacaagaagt

SEQ ID NO: 7177423 - DNA, 22 bp, Homo sapiens
ctgtcacactgatatcaggctt

SEQ ID NO: 7177424 - DNA, 22 bp, Homo sapiens
ctgtatttgtcctctatttatt

SEQ ID NO: 7177425 - DNA, 22 bp, Homo sapiens
ctgtatttgtcctctatttatt

SEQ ID NO: 7177426 - DNA, 22 bp, Homo sapiens
ctgtatttgaaagaaaagattt

SEQ ID NO: 7177427 - DNA, 23 bp, Homo sapiens
ctgtatttgacttgagcggaaat

SEQ ID NO: 7177428 - DNA, 22 bp, Homo sapiens
ctgtatatcatggttttgcagt

SEQ ID NO: 7177429 - DNA, 22 bp, Homo sapiens
ctgtatatggcttactttatat

SEQ ID NO: 7177430 - DNA, 22 bp, Homo sapiens
ctgtatatggcttactttatat

SEQ ID NO: 7177431 - DNA, 22 bp, Homo sapiens
ctgtatttgaaagaaaagattt

SEQ ID NO: 7177432 - DNA, 22 bp, Homo sapiens
ctgtagttgggcattataatag

SEQ ID NO: 7177433 - DNA, 20 bp, Homo sapiens
ctgtagggtgcagcaggctc

SEQ ID NO: 7177434 - DNA, 22 bp, Homo sapiens
ctgtagctccagcctgtctaca

SEQ ID NO: 7177435 - DNA, 22 bp, Homo sapiens
ctgtaggagtgggaatttattg

SEQ ID NO: 7177436 - DNA, 22 bp, Homo sapiens
ctgtagctgacaggatcactta

SEQ ID NO: 7177437 - DNA, 20 bp, Homo sapiens
ctgtagggtgcagcaggctc

SEQ ID NO: 7177438 - DNA, 22 bp, Homo sapiens
ctgtataaacatattttcaagt

SEQ ID NO: 7177439 - DNA, 19 bp, Homo sapiens
ctgtctggttcatgtgttc

SEQ ID NO: 7177440 - DNA, 22 bp, Homo sapiens
ctgtctgtacaaatgtggggcc

SEQ ID NO: 7177441 - DNA, 22 bp, Homo sapiens
ctgtctgtacaaatgtggggcc

SEQ ID NO: 7177442 - DNA, 22 bp, Homo sapiens
ctgtctgtacaaatgtggggcc

SEQ ID NO: 7177443 - DNA, 22 bp, Homo sapiens
ctgtctggtgtccctgtctaca

SEQ ID NO: 7177444 - DNA, 22 bp, Homo sapiens
ctgtctggtgtccctgtctaca

SEQ ID NO: 7177445 - DNA, 22 bp, Homo sapiens
ctgtctggtgtccctgtctaca

SEQ ID NO: 7177446 - DNA, 22 bp, Homo sapiens
ctgtctgtactgagagttctgt

SEQ ID NO: 7177447 - DNA, 22 bp, Homo sapiens
ctgtctgtagacatttttggtt

SEQ ID NO: 7177448 - DNA, 22 bp, Homo sapiens
ctgtctgtatccctgttggtaa

SEQ ID NO: 7177449 - DNA, 22 bp, Homo sapiens
ctgtctgtcaagttcatctcca

SEQ ID NO: 7177450 - DNA, 22 bp, Homo sapiens
ctgtctgtcaagttcatctcca

SEQ ID NO: 7177451 - DNA, 22 bp, Homo sapiens
ctgtctgtcaccaaaacagact

SEQ ID NO: 7177452 - DNA, 22 bp, Homo sapiens
ctgtctgtcaagttcatctcca

SEQ ID NO: 7177453 - DNA, 22 bp, Homo sapiens
ctgtctgtcaccaaaacagact

SEQ ID NO: 7177454 - DNA, 22 bp, Homo sapiens
ctgtctgtcaccaaaacagact

SEQ ID NO: 7177455 - DNA, 22 bp, Homo sapiens
ctgtctgtcccgtcaccgcccc

SEQ ID NO: 7177456 - DNA, 22 bp, Homo sapiens
ctgtctgtcctgagttcaacca

SEQ ID NO: 7177457 - DNA, 22 bp, Homo sapiens
ctgtctgtgacctctgcatgtc

SEQ ID NO: 7177458 - DNA, 19 bp, Homo sapiens
ctgtctgtgcagagatgtg

SEQ ID NO: 7177459 - DNA, 19 bp, Homo sapiens
ctgtctgtgcagagatgtg

SEQ ID NO: 7177460 - DNA, 19 bp, Homo sapiens
ctgtctgtgcagagatgtg

SEQ ID NO: 7177461 - DNA, 22 bp, Homo sapiens
ctgtctgtgcctcttctcccag

SEQ ID NO: 7177462 - DNA, 22 bp, Homo sapiens
ctgtctggtcaacaactgagtg

SEQ ID NO: 7177463 - DNA, 22 bp, Homo sapiens
ctgtctggtcaacaactgagtg

SEQ ID NO: 7177464 - DNA, 22 bp, Homo sapiens
ctgtctgggtctacatcctctg

SEQ ID NO: 7177465 - DNA, 22 bp, Homo sapiens
ctgtctgggtctacatcctctg

SEQ ID NO: 7177466 - DNA, 22 bp, Homo sapiens
ctgtctgggtctacatcctctg

SEQ ID NO: 7177467 - DNA, 22 bp, Homo sapiens
ctgtctggccggcccagcttcc

SEQ ID NO: 7177468 - DNA, 22 bp, Homo sapiens
ctgtctggatgtgagtcaccta

SEQ ID NO: 7177469 - DNA, 22 bp, Homo sapiens
ctgtctggatataccttggcca

SEQ ID NO: 7177470 - DNA, 22 bp, Homo sapiens
ctgtctggatgtgagtcaccta

SEQ ID NO: 7177471 - DNA, 21 bp, Homo sapiens
ctgtctggccgcgggctccgc

SEQ ID NO: 7177472 - DNA, 21 bp, Homo sapiens
ctgtctggccgcgggctccgc

SEQ ID NO: 7177473 - DNA, 21 bp, Homo sapiens
ctgtctggccgcgggctccgc

SEQ ID NO: 7177474 - DNA, 21 bp, Homo sapiens
ctgtctggccgcgggctccgc

SEQ ID NO: 7177475 - DNA, 22 bp, Homo sapiens
ctgtctggccggcccagcttcc

SEQ ID NO: 7177476 - DNA, 22 bp, Homo sapiens
ctgtctggaatgcagtacatag

SEQ ID NO: 7177477 - DNA, 22 bp, Homo sapiens
ctgtctggaatgcagtacatag

SEQ ID NO: 7177478 - DNA, 22 bp, Homo sapiens
ctgtctggaatttaagataaag

SEQ ID NO: 7177479 - DNA, 22 bp, Homo sapiens
ctgtctggagttatgtaaatag

SEQ ID NO: 7177480 - DNA, 22 bp, Homo sapiens
ctgtctggaatgcagtacatag

SEQ ID NO: 7177481 - DNA, 22 bp, Homo sapiens
ctgtctgctatgcttgttgtca

SEQ ID NO: 7177482 - DNA, 22 bp, Homo sapiens
ctgtctgctagaacatctatac

SEQ ID NO: 7177483 - DNA, 22 bp, Homo sapiens
ctgtctgctagaacatctatac

SEQ ID NO: 7177484 - DNA, 22 bp, Homo sapiens
ctgtgctgcagacgcagtagct

SEQ ID NO: 7177485 - DNA, 22 bp, Homo sapiens
ctgtgctgcagacgcagtagct

SEQ ID NO: 7177486 - DNA, 22 bp, Homo sapiens
ctgtgctggagatgggccagag

SEQ ID NO: 7177487 - DNA, 22 bp, Homo sapiens
ctgtgctggagatgggccagag

SEQ ID NO: 7177488 - DNA, 22 bp, Homo sapiens
ctgtgctggcagacctggagtt

SEQ ID NO: 7177489 - DNA, 23 bp, Homo sapiens
ctgtgctgggtcccatcttgggc

SEQ ID NO: 7177490 - DNA, 22 bp, Homo sapiens
ctgtgctgggtgtgcttatgat

SEQ ID NO: 7177491 - DNA, 22 bp, Homo sapiens
ctgtgctggtccagggagctgg

SEQ ID NO: 7177492 - DNA, 22 bp, Homo sapiens
ctgtgctggtccagggagctgg

SEQ ID NO: 7177493 - DNA, 22 bp, Homo sapiens
ctgtgctggtccagggagctgg

SEQ ID NO: 7177494 - DNA, 22 bp, Homo sapiens
ctgtgctgtcttgggagcctta

SEQ ID NO: 7177495 - DNA, 22 bp, Homo sapiens
ctgtgctgaggatgcagtttct

SEQ ID NO: 7177496 - DNA, 17 bp, Homo sapiens
ctgtgctcgagtgatgg

SEQ ID NO: 7177497 - DNA, 22 bp, Homo sapiens
ctgtgctctggcatcgctgcaa

SEQ ID NO: 7177498 - DNA, 22 bp, Homo sapiens
ctgtgctctggcatcgctgcaa

SEQ ID NO: 7177499 - DNA, 22 bp, Homo sapiens
ctgtgctgattcagcacaggcc

SEQ ID NO: 7177500 - DNA, 22 bp, Homo sapiens
ctgtgctgattcagcacaggcc

SEQ ID NO: 7177501 - DNA, 22 bp, Homo sapiens
ctgtgctgattcagcacaggcc

SEQ ID NO: 7177502 - DNA, 22 bp, Homo sapiens
ctgtgctgagtgatgtgactta

SEQ ID NO: 7177503 - DNA, 22 bp, Homo sapiens
ctgtgctgattcagcacaggcc

SEQ ID NO: 7177504 - DNA, 22 bp, Homo sapiens
ctgtctgtgcctcttctcccag

SEQ ID NO: 7177505 - DNA, 22 bp, Homo sapiens
ctgtctgtggagcttctgatgt

SEQ ID NO: 7177506 - DNA, 22 bp, Homo sapiens
ctgtctgtggagcttctgatgt

SEQ ID NO: 7177507 - DNA, 22 bp, Homo sapiens
ctgtctgtggtctcagtaggcc

SEQ ID NO: 7177508 - DNA, 22 bp, Homo sapiens
ctgtgccctgtggctggcacct

SEQ ID NO: 7177509 - DNA, 22 bp, Homo sapiens
ctgtgccctgtggctggcacct

SEQ ID NO: 7177510 - DNA, 22 bp, Homo sapiens
ctgtgccctgtggctggcacct

SEQ ID NO: 7177511 - DNA, 22 bp, Homo sapiens
ctgtgccctttcgctgcactgt

SEQ ID NO: 7177512 - DNA, 17 bp, Homo sapiens
ctgtgctcgagtgatgg

SEQ ID NO: 7177513 - DNA, 22 bp, Homo sapiens
ctgggctagaaggaccaggatg

SEQ ID NO: 7177514 - DNA, 22 bp, Homo sapiens
ctgggctaattaagcacagctg

SEQ ID NO: 7177515 - DNA, 22 bp, Homo sapiens
ctgggctagaaggaccaggatg

SEQ ID NO: 7177516 - DNA, 22 bp, Homo sapiens
ctgggctagaaggaccaggatg

SEQ ID NO: 7177517 - DNA, 22 bp, Homo sapiens
ctgggctacgtgttgacagcat

SEQ ID NO: 7177518 - DNA, 22 bp, Homo sapiens
ctgggcgcgtcccctgaggcgg

SEQ ID NO: 7177519 - DNA, 22 bp, Homo sapiens
ctgggcgcgtcccctgaggcgg

SEQ ID NO: 7177520 - DNA, 22 bp, Homo sapiens
ctgggccttggattgacactgt

SEQ ID NO: 7177521 - DNA, 22 bp, Homo sapiens
ctgggcctttgcttattaattt

SEQ ID NO: 7177522 - DNA, 22 bp, Homo sapiens
ctgggcctttgggagttcggtg

SEQ ID NO: 7177523 - DNA, 22 bp, Homo sapiens
ctgggctcaaatcctatctcca

SEQ ID NO: 7177524 - DNA, 22 bp, Homo sapiens
ctgggctcaaatcctatctcca

SEQ ID NO: 7177525 - DNA, 22 bp, Homo sapiens
ctgggctagaaggaccaggatg

SEQ ID NO: 7177526 - DNA, 22 bp, Homo sapiens
ctgggctggcgcatccgacacg

SEQ ID NO: 7177527 - DNA, 21 bp, Homo sapiens
ctgggctggcaggcattacct

SEQ ID NO: 7177528 - DNA, 22 bp, Homo sapiens
ctgggctggagtgcaatggcgc

SEQ ID NO: 7177529 - DNA, 22 bp, Homo sapiens
ctgggctggataattctttgct

SEQ ID NO: 7177530 - DNA, 22 bp, Homo sapiens
ctgggctggataattctttgct

SEQ ID NO: 7177531 - DNA, 22 bp, Homo sapiens
ctgggctggcgcatccgacacg

SEQ ID NO: 7177532 - DNA, 22 bp, Homo sapiens
ctgggctgtttgttctggtctc

SEQ ID NO: 7177533 - DNA, 22 bp, Homo sapiens
ctgggctgtttgttctggtctc

SEQ ID NO: 7177534 - DNA, 22 bp, Homo sapiens
ctgggctgtttgttctggtctc

SEQ ID NO: 7177535 - DNA, 22 bp, Homo sapiens
ctgggctgtttgtttagaatgg

SEQ ID NO: 7177536 - DNA, 22 bp, Homo sapiens
ctgggcttagcagctcctggtc

SEQ ID NO: 7177537 - DNA, 22 bp, Homo sapiens
ctgggcttagcagctcctggtc

SEQ ID NO: 7177538 - DNA, 22 bp, Homo sapiens
ctgggccttatgagtacctgga

SEQ ID NO: 7177539 - DNA, 22 bp, Homo sapiens
ctgggccttcattgctctccca

SEQ ID NO: 7177540 - DNA, 22 bp, Homo sapiens
ctgggccttatgagtacctgga

SEQ ID NO: 7177541 - DNA, 22 bp, Homo sapiens
ctgggccttgatcacacaggtg

SEQ ID NO: 7177542 - DNA, 22 bp, Homo sapiens
ctgggccttcattgctctccca

SEQ ID NO: 7177543 - DNA, 22 bp, Homo sapiens
ctgggccttgagaatcatgttt

SEQ ID NO: 7177544 - DNA, 22 bp, Homo sapiens
ctgggccttgccttgcccacag

SEQ ID NO: 7177545 - DNA, 22 bp, Homo sapiens
ctgggccttgcatcccagagcc

SEQ ID NO: 7177546 - DNA, 22 bp, Homo sapiens
ctgggccttgatcacacaggtg

SEQ ID NO: 7177547 - DNA, 22 bp, Homo sapiens
ctgggccttgcatcccagagcc

SEQ ID NO: 7177548 - DNA, 22 bp, Homo sapiens
ctgggccttgatcacacaggtg

SEQ ID NO: 7177549 - DNA, 22 bp, Homo sapiens
ctgggccttgcatcccagagcc

SEQ ID NO: 7177550 - DNA, 22 bp, Homo sapiens
ctgggccttgcatcccagagcc

SEQ ID NO: 7177551 - DNA, 22 bp, Homo sapiens
ctgggcctgtgggcacacggac

SEQ ID NO: 7177552 - DNA, 22 bp, Homo sapiens
ctgggcctgtgactcccatcct

SEQ ID NO: 7177553 - DNA, 22 bp, Homo sapiens
ctgggcctgtgggcacacggac

SEQ ID NO: 7177554 - DNA, 22 bp, Homo sapiens
ctgggcctgtgggcacacggac

SEQ ID NO: 7177555 - DNA, 22 bp, Homo sapiens
ctgggcctgtccctgattgagg

SEQ ID NO: 7177556 - DNA, 22 bp, Homo sapiens
ctgggcctggtgtggcacctgc

SEQ ID NO: 7177557 - DNA, 22 bp, Homo sapiens
ctgggcctggtgtggcacctgc

SEQ ID NO: 7177558 - DNA, 22 bp, Homo sapiens
ctgggcctcctctgcccaagct

SEQ ID NO: 7177559 - DNA, 22 bp, Homo sapiens
ctgggcctcctctgcccaagct

SEQ ID NO: 7177560 - DNA, 22 bp, Homo sapiens
ctgggcctcctctgcccaagct

SEQ ID NO: 7177561 - DNA, 22 bp, Homo sapiens
ctgggcctccagctctgccagc

SEQ ID NO: 7177562 - DNA, 22 bp, Homo sapiens
ctgggcacctttgcagcaggct

SEQ ID NO: 7177563 - DNA, 22 bp, Homo sapiens
ctgggcaaattgtgccagctat

SEQ ID NO: 7177564 - DNA, 22 bp, Homo sapiens
ctgggcactgcagcaggcatca

SEQ ID NO: 7177565 - DNA, 22 bp, Homo sapiens
ctgggcactgcagggtgttgag

SEQ ID NO: 7177566 - DNA, 22 bp, Homo sapiens
ctgggcactgcagggtgttgag

SEQ ID NO: 7177567 - DNA, 22 bp, Homo sapiens
ctgggcacttgctcacagctct

SEQ ID NO: 7177568 - DNA, 22 bp, Homo sapiens
ctgggcacttgctcacagctct

SEQ ID NO: 7177569 - DNA, 17 bp, Homo sapiens
ctgggatgtggactctt

SEQ ID NO: 7177570 - DNA, 17 bp, Homo sapiens
ctgggatgtggactctt

SEQ ID NO: 7177571 - DNA, 17 bp, Homo sapiens
ctgggatgtggactctt

SEQ ID NO: 7177572 - DNA, 17 bp, Homo sapiens
ctgggatgtggactctt

SEQ ID NO: 7177573 - DNA, 22 bp, Homo sapiens
ctgggagcggctgtcactggtt

SEQ ID NO: 7177574 - DNA, 22 bp, Homo sapiens
ctgggagctagctctgagctga

SEQ ID NO: 7177575 - DNA, 22 bp, Homo sapiens
ctgggagcggctgtcactggtt

SEQ ID NO: 7177576 - DNA, 22 bp, Homo sapiens
ctgggagcaagaggctgcaaat

SEQ ID NO: 7177577 - DNA, 22 bp, Homo sapiens
ctgggagcaagaggctgcaaat

SEQ ID NO: 7177578 - DNA, 22 bp, Homo sapiens
ctgggagattgctagagatgca

SEQ ID NO: 7177579 - DNA, 22 bp, Homo sapiens
ctgggagattgctagagatgca

SEQ ID NO: 7177580 - DNA, 22 bp, Homo sapiens
ctgggagattgctagagatgca

SEQ ID NO: 7177581 - DNA, 22 bp, Homo sapiens
ctgggagattgctagagatgca

SEQ ID NO: 7177582 - DNA, 22 bp, Homo sapiens
ctgggagcaagtcaggaaaggt

SEQ ID NO: 7177583 - DNA, 22 bp, Homo sapiens
ctgggagcccgcgtcctggtgg

SEQ ID NO: 7177584 - DNA, 22 bp, Homo sapiens
ctgggagcccgcgtcctggtgg

SEQ ID NO: 7177585 - DNA, 22 bp, Homo sapiens
ctgggagccctgactagcctgg

SEQ ID NO: 7177586 - DNA, 22 bp, Homo sapiens
ctgggagcgcagcaggcacaac

SEQ ID NO: 7177587 - DNA, 22 bp, Homo sapiens
ctgggagcgcagcaggcacaac

SEQ ID NO: 7177588 - DNA, 22 bp, Homo sapiens
ctgggagcgcagcaggcacaac

SEQ ID NO: 7177589 - DNA, 22 bp, Homo sapiens
ctgggcactttggggagcctac

SEQ ID NO: 7177590 - DNA, 22 bp, Homo sapiens
ctgggcactttggggagcctac

SEQ ID NO: 7177591 - DNA, 22 bp, Homo sapiens
ctgggcactttggggagcctac

SEQ ID NO: 7177592 - DNA, 22 bp, Homo sapiens
ctgggcagagctaacacctgag

SEQ ID NO: 7177593 - DNA, 22 bp, Homo sapiens
ctgggcagaattttaggatggc

SEQ ID NO: 7177594 - DNA, 22 bp, Homo sapiens
ctgggcagaattttaggatggc

SEQ ID NO: 7177595 - DNA, 22 bp, Homo sapiens
ctgggcagaattttaggatggc

SEQ ID NO: 7177596 - DNA, 22 bp, Homo sapiens
ctgggcagaattttaggatggc

SEQ ID NO: 7177597 - DNA, 22 bp, Homo sapiens
ctgggcagaattttaggatggc

SEQ ID NO: 7177598 - DNA, 22 bp, Homo sapiens
ctgggcagaattttaggatggc

SEQ ID NO: 7177599 - DNA, 22 bp, Homo sapiens
ctgggcagagtccggaagatgg

SEQ ID NO: 7177600 - DNA, 22 bp, Homo sapiens
ctgggcagagtccggaagatgg

SEQ ID NO: 7177601 - DNA, 22 bp, Homo sapiens
ctgggcagagctaacacctgag

SEQ ID NO: 7177602 - DNA, 22 bp, Homo sapiens
ctgggcagagctaacacctgag

SEQ ID NO: 7177603 - DNA, 22 bp, Homo sapiens
ctgggcagagctaacacctgag

SEQ ID NO: 7177604 - DNA, 22 bp, Homo sapiens
ctgggcagcctcacacaatgtt

SEQ ID NO: 7177605 - DNA, 22 bp, Homo sapiens
ctgggcagcacatcatcgtatc

SEQ ID NO: 7177606 - DNA, 22 bp, Homo sapiens
ctgggcagcacatcatcgtatc

SEQ ID NO: 7177607 - DNA, 22 bp, Homo sapiens
ctgggcagagtccggaagatgg

SEQ ID NO: 7177608 - DNA, 22 bp, Homo sapiens
ctgggcagagtccggaagatgg

SEQ ID NO: 7177609 - DNA, 22 bp, Homo sapiens
ctgggcagagtccggaagatgg

SEQ ID NO: 7177610 - DNA, 22 bp, Homo sapiens
ctgggcagcctcacacaatgtt

SEQ ID NO: 7177611 - DNA, 22 bp, Homo sapiens
ctgggcagcctcacacaatgtt

SEQ ID NO: 7177612 - DNA, 22 bp, Homo sapiens
ctgggcagcctcacacaatgtt

SEQ ID NO: 7177613 - DNA, 22 bp, Homo sapiens
ctgggcagctaccaccactgct

SEQ ID NO: 7177614 - DNA, 22 bp, Homo sapiens
ctgggcagctccataccaccca

SEQ ID NO: 7177615 - DNA, 22 bp, Homo sapiens
ctgggcagctccataccaccca

SEQ ID NO: 7177616 - DNA, 22 bp, Homo sapiens
ctgggcagctaccaccactgct

SEQ ID NO: 7177617 - DNA, 22 bp, Homo sapiens
ctgggcagctaccaccactgct

SEQ ID NO: 7177618 - DNA, 22 bp, Homo sapiens
ctgggcagctccataccaccca

SEQ ID NO: 7177619 - DNA, 22 bp, Homo sapiens
ctgggcagctccataccaccca

SEQ ID NO: 7177620 - DNA, 22 bp, Homo sapiens
ctgggcagctgtatcagggagt

SEQ ID NO: 7177621 - DNA, 22 bp, Homo sapiens
ctgggcagctgtatcagggagt

SEQ ID NO: 7177622 - DNA, 22 bp, Homo sapiens
ctgggcagctgtatcagggagt

SEQ ID NO: 7177623 - DNA, 22 bp, Homo sapiens
ctgggcagctgtatcagggagt

SEQ ID NO: 7177624 - DNA, 22 bp, Homo sapiens
ctgggcagctgtatcagggagt

SEQ ID NO: 7177625 - DNA, 22 bp, Homo sapiens
ctgggcagctgtatcagggagt

SEQ ID NO: 7177626 - DNA, 22 bp, Homo sapiens
ctgggcagctgtatcagggagt

SEQ ID NO: 7177627 - DNA, 22 bp, Homo sapiens
ctgggcagctgtgcaaacaata

SEQ ID NO: 7177628 - DNA, 22 bp, Homo sapiens
ctgggcagctgtatcagggagt

SEQ ID NO: 7177629 - DNA, 22 bp, Homo sapiens
ctgggcagctgtatcagggagt

SEQ ID NO: 7177630 - DNA, 22 bp, Homo sapiens
ctgggcagctgtatcagggagt

SEQ ID NO: 7177631 - DNA, 22 bp, Homo sapiens
ctgggcagctgtgcaaacaata

SEQ ID NO: 7177632 - DNA, 22 bp, Homo sapiens
ctgggcagctgtgcaaacaata

SEQ ID NO: 7177633 - DNA, 22 bp, Homo sapiens
ctgggcagctgtgcaaacaata

SEQ ID NO: 7177634 - DNA, 22 bp, Homo sapiens
ctgctgtgtggattcaatggct

SEQ ID NO: 7177635 - DNA, 22 bp, Homo sapiens
ctgctgtgcacccaggaaggct

SEQ ID NO: 7177636 - DNA, 22 bp, Homo sapiens
ctgctgtgtgcttacttgggtt

SEQ ID NO: 7177637 - DNA, 22 bp, Homo sapiens
ctgctgtgattgggagaaaccg

SEQ ID NO: 7177638 - DNA, 22 bp, Homo sapiens
ctgctgtgagtttggaggtcta

SEQ ID NO: 7177639 - DNA, 20 bp, Homo sapiens
ctgctgtgattccctcctcc

SEQ ID NO: 7177640 - DNA, 22 bp, Homo sapiens
ctgctgtgattgggagaaaccg

SEQ ID NO: 7177641 - DNA, 22 bp, Homo sapiens
ctgctgtgcacccaggaaggct

SEQ ID NO: 7177642 - DNA, 22 bp, Homo sapiens
ctgctgtgcaacattgcaccta

SEQ ID NO: 7177643 - DNA, 22 bp, Homo sapiens
ctgctgtgttagcaggtttagt

SEQ ID NO: 7177644 - DNA, 20 bp, Homo sapiens
ctgctgtgtgtgcctcagcc

SEQ ID NO: 7177645 - DNA, 20 bp, Homo sapiens
ctgctgtgtgtgcctcagcc

SEQ ID NO: 7177646 - DNA, 22 bp, Homo sapiens
ctgctgtgtggtgaaactcagt

SEQ ID NO: 7177647 - DNA, 20 bp, Homo sapiens
ctgctgtgttattgtagaac

SEQ ID NO: 7177648 - DNA, 22 bp, Homo sapiens
ctgctgtgttcctcctgcatct

SEQ ID NO: 7177649 - DNA, 22 bp, Homo sapiens
ctgcttcacccaactttgggat

SEQ ID NO: 7177650 - DNA, 22 bp, Homo sapiens
ctgcttatggagatgagtaaga

SEQ ID NO: 7177651 - DNA, 20 bp, Homo sapiens
ctgcttaagtaagtgacaca

SEQ ID NO: 7177652 - DNA, 22 bp, Homo sapiens
ctgcttaaaatgcagattctgt

SEQ ID NO: 7177653 - DNA, 20 bp, Homo sapiens
ctgcttaagtaagtgacaca

SEQ ID NO: 7177654 - DNA, 22 bp, Homo sapiens
ctgctgtttggtgagtgagaaa

SEQ ID NO: 7177655 - DNA, 23 bp, Homo sapiens
ctgctgtgttggtctcgatggga

SEQ ID NO: 7177656 - DNA, 22 bp, Homo sapiens
ctgctgtgttggcattggatag

SEQ ID NO: 7177657 - DNA, 23 bp, Homo sapiens
ctgctgtgttggtctcgatggga

SEQ ID NO: 7177658 - DNA, 22 bp, Homo sapiens
ctgctgtgttgccagtgtcacc

SEQ ID NO: 7177659 - DNA, 22 bp, Homo sapiens
ctgctgtgtttcacacctctgg

SEQ ID NO: 7177660 - DNA, 22 bp, Homo sapiens
ctgctgttctgaagcaacaagc

SEQ ID NO: 7177661 - DNA, 22 bp, Homo sapiens
ctgctgtgtttctgctagaaaa

SEQ ID NO: 7177662 - DNA, 22 bp, Homo sapiens
ctgcttccataaataatgtgct

SEQ ID NO: 7177663 - DNA, 20 bp, Homo sapiens
ctgcttccaggctcaccccc

SEQ ID NO: 7177664 - DNA, 20 bp, Homo sapiens
ctgcttccaggctcaccccc

SEQ ID NO: 7177665 - DNA, 20 bp, Homo sapiens
ctgcttccaggctcaccccc

SEQ ID NO: 7177666 - DNA, 22 bp, Homo sapiens
ctgcttcctccctgtaaaggca

SEQ ID NO: 7177667 - DNA, 21 bp, Homo sapiens
ctgcttcctctcttcatggca

SEQ ID NO: 7177668 - DNA, 22 bp, Homo sapiens
ctgcttcatatttcatagtgat

SEQ ID NO: 7177669 - DNA, 22 bp, Homo sapiens
ctgcttcatagccctggtctct

SEQ ID NO: 7177670 - DNA, 22 bp, Homo sapiens
ctgcttcatatttcatagtgat

SEQ ID NO: 7177671 - DNA, 22 bp, Homo sapiens
ctgcttccaagaaagagatagg

SEQ ID NO: 7177672 - DNA, 22 bp, Homo sapiens
ctgcttccacacaagcaaagct

SEQ ID NO: 7177673 - DNA, 22 bp, Homo sapiens
ctgcttcacttcggttgcatag

SEQ ID NO: 7177674 - DNA, 19 bp, Homo sapiens
ctgcttcaggcgccttgcc

SEQ ID NO: 7177675 - DNA, 22 bp, Homo sapiens
ctgcttcacgttgtgccttgtt

SEQ ID NO: 7177676 - DNA, 22 bp, Homo sapiens
ctgcttcaccctgcctgagaac

SEQ ID NO: 7177677 - DNA, 22 bp, Homo sapiens
ctgggacagagcagcagtgggg

SEQ ID NO: 7177678 - DNA, 22 bp, Homo sapiens
ctgggacagagcagcagtgggg

SEQ ID NO: 7177679 - DNA, 22 bp, Homo sapiens
ctgggacagagcagcagtgggg

SEQ ID NO: 7177680 - DNA, 22 bp, Homo sapiens
ctgggacagagcagcagtgggg

SEQ ID NO: 7177681 - DNA, 22 bp, Homo sapiens
ctgggacagagcagcagtgggg

SEQ ID NO: 7177682 - DNA, 22 bp, Homo sapiens
ctgggacagagcagcagtgggg

SEQ ID NO: 7177683 - DNA, 22 bp, Homo sapiens
ctgggacagagcagcagtgggg

SEQ ID NO: 7177684 - DNA, 22 bp, Homo sapiens
ctgggacacccaaggaaagagc

SEQ ID NO: 7177685 - DNA, 22 bp, Homo sapiens
ctgggacacccagagctgcaga

SEQ ID NO: 7177686 - DNA, 22 bp, Homo sapiens
ctgggacacccagagctgcaga

SEQ ID NO: 7177687 - DNA, 22 bp, Homo sapiens
ctgggacacccagagctgcaga

SEQ ID NO: 7177688 - DNA, 22 bp, Homo sapiens
ctgggacacccagagctgcaga

SEQ ID NO: 7177689 - DNA, 22 bp, Homo sapiens
ctgggacacccagagctgcaga

SEQ ID NO: 7177690 - DNA, 22 bp, Homo sapiens
ctgggaagaagtgggctacatt

SEQ ID NO: 7177691 - DNA, 22 bp, Homo sapiens
ctgggaagaatccaagggccct

SEQ ID NO: 7177692 - DNA, 22 bp, Homo sapiens
ctgggaagatggtgacagaatt

SEQ ID NO: 7177693 - DNA, 22 bp, Homo sapiens
ctgggaagatggtgacagaatt

SEQ ID NO: 7177694 - DNA, 22 bp, Homo sapiens
ctgcttcctgctgggatactga

SEQ ID NO: 7177695 - DNA, 22 bp, Homo sapiens
ctgggaagaagggacaacagcg

SEQ ID NO: 7177696 - DNA, 22 bp, Homo sapiens
ctgggaagaagggacaacagcg

SEQ ID NO: 7177697 - DNA, 22 bp, Homo sapiens
ctgggagatctcctgagggcag

SEQ ID NO: 7177698 - DNA, 22 bp, Homo sapiens
ctgggagatctgttgggactgg

SEQ ID NO: 7177699 - DNA, 22 bp, Homo sapiens
ctgggagatctgttgggactgg

SEQ ID NO: 7177700 - DNA, 22 bp, Homo sapiens
ctgggagatctgttgggactgg

SEQ ID NO: 7177701 - DNA, 22 bp, Homo sapiens
ctgggagatctcctgagggcag

SEQ ID NO: 7177702 - DNA, 22 bp, Homo sapiens
ctgggagatctcctgagggcag

SEQ ID NO: 7177703 - DNA, 22 bp, Homo sapiens
ctgggagatctcctgagggcag

SEQ ID NO: 7177704 - DNA, 22 bp, Homo sapiens
ctgggagatctcctgagggcag

SEQ ID NO: 7177705 - DNA, 22 bp, Homo sapiens
ctgggagatctgttgggactgg

SEQ ID NO: 7177706 - DNA, 22 bp, Homo sapiens
ctgggagatctgttgggactgg

SEQ ID NO: 7177707 - DNA, 22 bp, Homo sapiens
ctgggagatctgttgggactgg

SEQ ID NO: 7177708 - DNA, 22 bp, Homo sapiens
ctgggagatgactcagagcagg

SEQ ID NO: 7177709 - DNA, 22 bp, Homo sapiens
ctgggagatgactcagagcagg

SEQ ID NO: 7177710 - DNA, 22 bp, Homo sapiens
ctgggagatgactcagagcagg

SEQ ID NO: 7177711 - DNA, 22 bp, Homo sapiens
ctgggagattcaggtgaagttt

SEQ ID NO: 7177712 - DNA, 22 bp, Homo sapiens
ctgggagattcaggtgaagttt

SEQ ID NO: 7177713 - DNA, 22 bp, Homo sapiens
ctgggagattcaggtgaagttt

SEQ ID NO: 7177714 - DNA, 22 bp, Homo sapiens
ctgggagattgaggccatggtg

SEQ ID NO: 7177715 - DNA, 22 bp, Homo sapiens
ctgggagattgaggccatggtg

SEQ ID NO: 7177716 - DNA, 22 bp, Homo sapiens
ctgggagattgaggccatggtg

SEQ ID NO: 7177717 - DNA, 22 bp, Homo sapiens
ctgggagattgaggccatggtg

SEQ ID NO: 7177718 - DNA, 22 bp, Homo sapiens
ctgggagattgaggccatggtg

SEQ ID NO: 7177719 - DNA, 22 bp, Homo sapiens
ctgggagattgaggccatggtg

SEQ ID NO: 7177720 - DNA, 22 bp, Homo sapiens
ctgggagattgctagagatgca

SEQ ID NO: 7177721 - DNA, 22 bp, Homo sapiens
ctgggagattgctagagatgca

SEQ ID NO: 7177722 - DNA, 22 bp, Homo sapiens
ctgggacttgggctatgctctg

SEQ ID NO: 7177723 - DNA, 22 bp, Homo sapiens
ctgggagaggctgctccgctct

SEQ ID NO: 7177724 - DNA, 22 bp, Homo sapiens
ctgggacttgcagagcaggagg

SEQ ID NO: 7177725 - DNA, 22 bp, Homo sapiens
ctgggacttgcagagcaggagg

SEQ ID NO: 7177726 - DNA, 22 bp, Homo sapiens
ctgggacttgatgaaatgactg

SEQ ID NO: 7177727 - DNA, 22 bp, Homo sapiens
ctgggactgggtcctcaggaca

SEQ ID NO: 7177728 - DNA, 22 bp, Homo sapiens
ctgggactgggtcctcaggaca

SEQ ID NO: 7177729 - DNA, 22 bp, Homo sapiens
ctgggagaggtggtgggaagta

SEQ ID NO: 7177730 - DNA, 22 bp, Homo sapiens
ctgggagaggtggtgggaagta

SEQ ID NO: 7177731 - DNA, 22 bp, Homo sapiens
ctgggagaggtggtgggaagta

SEQ ID NO: 7177732 - DNA, 22 bp, Homo sapiens
ctgggagaggtggtgggaagta

SEQ ID NO: 7177733 - DNA, 22 bp, Homo sapiens
ctgggagaggtggtgggaagta

SEQ ID NO: 7177734 - DNA, 22 bp, Homo sapiens
ctgggagaggtggtgggaagta

SEQ ID NO: 7177735 - DNA, 22 bp, Homo sapiens
ctgggagaggtggtgggaagta

SEQ ID NO: 7177736 - DNA, 22 bp, Homo sapiens
ctgggagatatgaggatctgga

SEQ ID NO: 7177737 - DNA, 22 bp, Homo sapiens
ctgggagatatgaggatctgga

SEQ ID NO: 7177738 - DNA, 22 bp, Homo sapiens
ctgggagatatgaggatctgga

SEQ ID NO: 7177739 - DNA, 22 bp, Homo sapiens
ctgggagatatgaggatctgga

SEQ ID NO: 7177740 - DNA, 22 bp, Homo sapiens
ctgggagatatgaggatctgga

SEQ ID NO: 7177741 - DNA, 22 bp, Homo sapiens
ctgggagatatgaggatctgga

SEQ ID NO: 7177742 - DNA, 22 bp, Homo sapiens
ctgggagatatgaggatctgga

SEQ ID NO: 7177743 - DNA, 22 bp, Homo sapiens
ctgggagatctcctgagggcag

SEQ ID NO: 7177744 - DNA, 22 bp, Homo sapiens
ctgggagatctcctgagggcag

SEQ ID NO: 7177745 - DNA, 22 bp, Homo sapiens
ctgggagatctcctgagggcag

SEQ ID NO: 7177746 - DNA, 19 bp, Homo sapiens
ctgggactcctgatacctt

SEQ ID NO: 7177747 - DNA, 22 bp, Homo sapiens
ctgggactgccattcacagcca

SEQ ID NO: 7177748 - DNA, 22 bp, Homo sapiens
ctgggactggacctctgcctgg

SEQ ID NO: 7177749 - DNA, 18 bp, Homo sapiens
ctgggactcaatgctact

SEQ ID NO: 7177750 - DNA, 22 bp, Homo sapiens
ctgggacccacacctggaatct

SEQ ID NO: 7177751 - DNA, 22 bp, Homo sapiens
ctgggaccatctgtgtctactt

SEQ ID NO: 7177752 - DNA, 22 bp, Homo sapiens
ctgggacccccactgcgtagct

SEQ ID NO: 7177753 - DNA, 22 bp, Homo sapiens
ctgggaccctgccctgtggcct

SEQ ID NO: 7177754 - DNA, 22 bp, Homo sapiens
ctgggacctcctcactgttcta

SEQ ID NO: 7177755 - DNA, 22 bp, Homo sapiens
ctgggaccctgccctgtggcct

SEQ ID NO: 7177756 - DNA, 22 bp, Homo sapiens
ctgggacctcctcactgttcta

SEQ ID NO: 7177757 - DNA, 22 bp, Homo sapiens
ctgggacctcctgaggtggagc

SEQ ID NO: 7177758 - DNA, 22 bp, Homo sapiens
ctgggacctcctgaggtggagc

SEQ ID NO: 7177759 - DNA, 22 bp, Homo sapiens
ctgggacctcggggtgatcaaa

SEQ ID NO: 7177760 - DNA, 22 bp, Homo sapiens
ctgggacctgtgtgcctgggcc

SEQ ID NO: 7177761 - DNA, 22 bp, Homo sapiens
ctgggacagctgagacaggaga

SEQ ID NO: 7177762 - DNA, 22 bp, Homo sapiens
ctgggacagctgagacaggaga

SEQ ID NO: 7177763 - DNA, 22 bp, Homo sapiens
ctgggacagctgagacaggaga

SEQ ID NO: 7177764 - DNA, 22 bp, Homo sapiens
ctgggacagctgagacaggaga

SEQ ID NO: 7177765 - DNA, 22 bp, Homo sapiens
ctgggacagctgagacaggaga

SEQ ID NO: 7177766 - DNA, 22 bp, Homo sapiens
ctgggacagctgagacaggaga

SEQ ID NO: 7177767 - DNA, 22 bp, Homo sapiens
ctgggacatattgctagtgttg

SEQ ID NO: 7177768 - DNA, 22 bp, Homo sapiens
ctgggacatattgctagtgttg

SEQ ID NO: 7177769 - DNA, 22 bp, Homo sapiens
ctgggacagttcaggtagggca

SEQ ID NO: 7177770 - DNA, 22 bp, Homo sapiens
ctgggacagttcaggtagggca

SEQ ID NO: 7177771 - DNA, 22 bp, Homo sapiens
ctgggacagttcaggtagggca

SEQ ID NO: 7177772 - DNA, 22 bp, Homo sapiens
ctgggacatattgctagtgttg

SEQ ID NO: 7177773 - DNA, 22 bp, Homo sapiens
ctgggacatgatagaaacagat

SEQ ID NO: 7177774 - DNA, 22 bp, Homo sapiens
ctgggacatgatagaaacagat

SEQ ID NO: 7177775 - DNA, 23 bp, Homo sapiens
ctgggacatggtaggggcacaac

SEQ ID NO: 7177776 - DNA, 22 bp, Homo sapiens
ctgggacatggtgctgtcttta

SEQ ID NO: 7177777 - DNA, 23 bp, Homo sapiens
ctgggacatggtaggggcacaac

SEQ ID NO: 7177778 - DNA, 22 bp, Homo sapiens
ctgggacattataagaaacatt

SEQ ID NO: 7177779 - DNA, 22 bp, Homo sapiens
ctgggacattataagaaacatt

SEQ ID NO: 7177780 - DNA, 22 bp, Homo sapiens
ctgggaccagtgaagcaactca

SEQ ID NO: 7177781 - DNA, 22 bp, Homo sapiens
cttctcagaggccagaagctat

SEQ ID NO: 7177782 - DNA, 22 bp, Homo sapiens
cttctcaaagttgtgaatcagg

SEQ ID NO: 7177783 - DNA, 23 bp, Homo sapiens
cttctcagaagtctgtgccagga

SEQ ID NO: 7177784 - DNA, 22 bp, Homo sapiens
cttctcaactgcacttgccagg

SEQ ID NO: 7177785 - DNA, 23 bp, Homo sapiens
cttctcagaagtctgtgccagga

SEQ ID NO: 7177786 - DNA, 23 bp, Homo sapiens
cttctcagaagtctgtgccagga

SEQ ID NO: 7177787 - DNA, 22 bp, Homo sapiens
cttctattcactggtcacagtt

SEQ ID NO: 7177788 - DNA, 22 bp, Homo sapiens
cttctattttcatgcctgggtc

SEQ ID NO: 7177789 - DNA, 22 bp, Homo sapiens
cttctcaaacctgaaaggacaa

SEQ ID NO: 7177790 - DNA, 22 bp, Homo sapiens
cttctcaaactgagactgtcta

SEQ ID NO: 7177791 - DNA, 22 bp, Homo sapiens
cttctcaaactgagactgtcta

SEQ ID NO: 7177792 - DNA, 22 bp, Homo sapiens
cttctcagcttaggtatggttt

SEQ ID NO: 7177793 - DNA, 21 bp, Homo sapiens
cttctcaggaccacactagga

SEQ ID NO: 7177794 - DNA, 21 bp, Homo sapiens
cttctcaggaccacactagga

SEQ ID NO: 7177795 - DNA, 22 bp, Homo sapiens
cttctcagtcacctgtgagtct

SEQ ID NO: 7177796 - DNA, 22 bp, Homo sapiens
cttctcagtcacctgtgagtct

SEQ ID NO: 7177797 - DNA, 22 bp, Homo sapiens
cttctcagtcacctgtgagtct

SEQ ID NO: 7177798 - DNA, 22 bp, Homo sapiens
cttctcagatctcagctttgag

SEQ ID NO: 7177799 - DNA, 22 bp, Homo sapiens
cttctcagcatggttactgtga

SEQ ID NO: 7177800 - DNA, 22 bp, Homo sapiens
cttctcagatctcagctttgag

SEQ ID NO: 7177801 - DNA, 22 bp, Homo sapiens
cttctagagtttctgatgcaac

SEQ ID NO: 7177802 - DNA, 22 bp, Homo sapiens
cttctataaactgtgatctttc

SEQ ID NO: 7177803 - DNA, 22 bp, Homo sapiens
cttctataggttgttgtgactt

SEQ ID NO: 7177804 - DNA, 19 bp, Homo sapiens
cttctagaccttataccac

SEQ ID NO: 7177805 - DNA, 22 bp, Homo sapiens
cttctagagctggagcaaatgt

SEQ ID NO: 7177806 - DNA, 23 bp, Homo sapiens
cttctagagtcagctccaagttt

SEQ ID NO: 7177807 - DNA, 23 bp, Homo sapiens
cttctagagtcagctccaagttt

SEQ ID NO: 7177808 - DNA, 22 bp, Homo sapiens
cttctaattcttatgtaagctt

SEQ ID NO: 7177809 - DNA, 22 bp, Homo sapiens
cttctacaaggttgtcctctat

SEQ ID NO: 7177810 - DNA, 22 bp, Homo sapiens
cttctacaaggttgtcctctat

SEQ ID NO: 7177811 - DNA, 22 bp, Homo sapiens
cttctacacatccctcttgctt

SEQ ID NO: 7177812 - DNA, 22 bp, Homo sapiens
cttctacacgtggctgtgccaa

SEQ ID NO: 7177813 - DNA, 22 bp, Homo sapiens
cttctacaggcccagcgagtgt

SEQ ID NO: 7177814 - DNA, 22 bp, Homo sapiens
cttctacaggcccagcgagtgt

SEQ ID NO: 7177815 - DNA, 22 bp, Homo sapiens
cttctagaaccctctattcttt

SEQ ID NO: 7177816 - DNA, 17 bp, Homo sapiens
cttctagaaggcaaact

SEQ ID NO: 7177817 - DNA, 22 bp, Homo sapiens
cttcctgttgtcacagtctgcg

SEQ ID NO: 7177818 - DNA, 22 bp, Homo sapiens
cttcctgttgtcacagtctgcg

SEQ ID NO: 7177819 - DNA, 22 bp, Homo sapiens
cttcctggtttgaagctcgccg

SEQ ID NO: 7177820 - DNA, 22 bp, Homo sapiens
cttcctgttgtcacagtctgcg

SEQ ID NO: 7177821 - DNA, 22 bp, Homo sapiens
cttcctgttgtcacagtctgcg

SEQ ID NO: 7177822 - DNA, 22 bp, Homo sapiens
cttccttccacaccttcagaat

SEQ ID NO: 7177823 - DNA, 22 bp, Homo sapiens
cttccagctgattacaggctat

SEQ ID NO: 7177824 - DNA, 22 bp, Homo sapiens
cttccagctgattggcatccag

SEQ ID NO: 7177825 - DNA, 22 bp, Homo sapiens
cttccaggacaccagggtagta

SEQ ID NO: 7177826 - DNA, 22 bp, Homo sapiens
cttcctgggtctggagactgga

SEQ ID NO: 7177827 - DNA, 22 bp, Homo sapiens
cttcctggtttgaagctcgccg

SEQ ID NO: 7177828 - DNA, 22 bp, Homo sapiens
cttccttccacaccttcagaat

SEQ ID NO: 7177829 - DNA, 22 bp, Homo sapiens
cttcctttccccaatcatatcg

SEQ ID NO: 7177830 - DNA, 22 bp, Homo sapiens
cttcctttccccaatcatatcg

SEQ ID NO: 7177831 - DNA, 22 bp, Homo sapiens
cttcctttgctgttcggaggtt

SEQ ID NO: 7177832 - DNA, 22 bp, Homo sapiens
cttcctttgctgttcggaggtt

SEQ ID NO: 7177833 - DNA, 22 bp, Homo sapiens
cttccaagtggggcacgtgcca

SEQ ID NO: 7177834 - DNA, 22 bp, Homo sapiens
cttccaagatgaacagcaagcg

SEQ ID NO: 7177835 - DNA, 22 bp, Homo sapiens
cttccaagatgaacagcaagcg

SEQ ID NO: 7177836 - DNA, 20 bp, Homo sapiens
cttccacacaagaagcacag

SEQ ID NO: 7177837 - DNA, 20 bp, Homo sapiens
cttccacacaagaagcacag

SEQ ID NO: 7177838 - DNA, 20 bp, Homo sapiens
cttccacacaagaagcacag

SEQ ID NO: 7177839 - DNA, 22 bp, Homo sapiens
cttccacattatttaggaatcc

SEQ ID NO: 7177840 - DNA, 20 bp, Homo sapiens
cttccaccagggccgctgat

SEQ ID NO: 7177841 - DNA, 20 bp, Homo sapiens
cttccaccagggccgctgat

SEQ ID NO: 7177842 - DNA, 22 bp, Homo sapiens
cttccactactcttagatctgc

SEQ ID NO: 7177843 - DNA, 22 bp, Homo sapiens
cttccactctgagtccaccctg

SEQ ID NO: 7177844 - DNA, 22 bp, Homo sapiens
cttccagagaagcactacgggt

SEQ ID NO: 7177845 - DNA, 22 bp, Homo sapiens
cttccagagatagggcctcaag

SEQ ID NO: 7177846 - DNA, 22 bp, Homo sapiens
cttccagagctgggctgacctt

SEQ ID NO: 7177847 - DNA, 22 bp, Homo sapiens
cttccagaggaactctgcagtg

SEQ ID NO: 7177848 - DNA, 22 bp, Homo sapiens
cttccagaggaactctgcagtg

SEQ ID NO: 7177849 - DNA, 22 bp, Homo sapiens
cttccagaggaactctgcagtg

SEQ ID NO: 7177850 - DNA, 22 bp, Homo sapiens
cttccagctgattacaggctat

SEQ ID NO: 7177851 - DNA, 22 bp, Homo sapiens
cttagtttctctgtatgtttac

SEQ ID NO: 7177852 - DNA, 22 bp, Homo sapiens
cttagtttctgtttctgattaa

SEQ ID NO: 7177853 - DNA, 22 bp, Homo sapiens
cttagtatctatgaagtgaaaa

SEQ ID NO: 7177854 - DNA, 22 bp, Homo sapiens
cttaggatttaatttcagactc

SEQ ID NO: 7177855 - DNA, 22 bp, Homo sapiens
cttaggcaagcagagcccatcc

SEQ ID NO: 7177856 - DNA, 22 bp, Homo sapiens
cttaggcaaccaggtcaatgct

SEQ ID NO: 7177857 - DNA, 22 bp, Homo sapiens
cttaggcaagcagagcccatcc

SEQ ID NO: 7177858 - DNA, 22 bp, Homo sapiens
cttaggcagactgctgatgcag

SEQ ID NO: 7177859 - DNA, 22 bp, Homo sapiens
cttaggcagggctggaagatct

SEQ ID NO: 7177860 - DNA, 22 bp, Homo sapiens
cttaggcagtttaggaaagaga

SEQ ID NO: 7177861 - DNA, 22 bp, Homo sapiens
cttaggcatccagggttcttcc

SEQ ID NO: 7177862 - DNA, 22 bp, Homo sapiens
cttataaagtccatctgaacaa

SEQ ID NO: 7177863 - DNA, 22 bp, Homo sapiens
cttataaagtccatctgaacaa

SEQ ID NO: 7177864 - DNA, 22 bp, Homo sapiens
cttagtttttgccctggagttt

SEQ ID NO: 7177865 - DNA, 22 bp, Homo sapiens
cttatacacgaacacaaggtgt

SEQ ID NO: 7177866 - DNA, 22 bp, Homo sapiens
cttaggaatatccacagcaggt

SEQ ID NO: 7177867 - DNA, 22 bp, Homo sapiens
cttaggaatatccacagcaggt

SEQ ID NO: 7177868 - DNA, 22 bp, Homo sapiens
cttagctttgtcctaggtctct

SEQ ID NO: 7177869 - DNA, 22 bp, Homo sapiens
cttagctttgtttaacacaggg

SEQ ID NO: 7177870 - DNA, 22 bp, Homo sapiens
cttagcttttccagcttctaga

SEQ ID NO: 7177871 - DNA, 22 bp, Homo sapiens
cttaggaaagttggctgatttc

SEQ ID NO: 7177872 - DNA, 22 bp, Homo sapiens
cttaggaaagtttctgcttatg

SEQ ID NO: 7177873 - DNA, 22 bp, Homo sapiens
cttaggaaatatatactaaact

SEQ ID NO: 7177874 - DNA, 22 bp, Homo sapiens
cttaggaaagttttctgctgca

SEQ ID NO: 7177875 - DNA, 22 bp, Homo sapiens
cttaggaacacttactggtact

SEQ ID NO: 7177876 - DNA, 22 bp, Homo sapiens
cttagctttaaaagtgagatct

SEQ ID NO: 7177877 - DNA, 22 bp, Homo sapiens
cttagcttctctgcatctgtgt

SEQ ID NO: 7177878 - DNA, 22 bp, Homo sapiens
cttagcttctctgcatctgtgt

SEQ ID NO: 7177879 - DNA, 20 bp, Homo sapiens
cttagcttctaaggttctgg

SEQ ID NO: 7177880 - DNA, 22 bp, Homo sapiens
cttagcttcattattggtggcc

SEQ ID NO: 7177881 - DNA, 20 bp, Homo sapiens
cttagcttctaaggttctgg

SEQ ID NO: 7177882 - DNA, 22 bp, Homo sapiens
cttagcttcactgggtctcagt

SEQ ID NO: 7177883 - DNA, 22 bp, Homo sapiens
cttagcatgcagtgttctgccc

SEQ ID NO: 7177884 - DNA, 22 bp, Homo sapiens
cttagcagataaaaaccttcag

SEQ ID NO: 7177885 - DNA, 22 bp, Homo sapiens
cttagcagataaaaaccttcag

SEQ ID NO: 7177886 - DNA, 22 bp, Homo sapiens
cttagcatgtggtgtccttgta

SEQ ID NO: 7177887 - DNA, 22 bp, Homo sapiens
cttagccagctaacttaagcac

SEQ ID NO: 7177888 - DNA, 22 bp, Homo sapiens
cttagccagctaacttaagcac

SEQ ID NO: 7177889 - DNA, 22 bp, Homo sapiens
cttagccctgagagttctgagc

SEQ ID NO: 7177890 - DNA, 22 bp, Homo sapiens
cttagccctgagagttctgagc

SEQ ID NO: 7177891 - DNA, 20 bp, Homo sapiens
cttagctagtaagaagctgt

SEQ ID NO: 7177892 - DNA, 20 bp, Homo sapiens
cttagctagtaagaagctgt

SEQ ID NO: 7177893 - DNA, 22 bp, Homo sapiens
cttatatttgtcaactttacaa

SEQ ID NO: 7177894 - DNA, 22 bp, Homo sapiens
cttatagtatgatgttgagaat

SEQ ID NO: 7177895 - DNA, 22 bp, Homo sapiens
cttatagtatgatgttgagaat

SEQ ID NO: 7177896 - DNA, 22 bp, Homo sapiens
cttatatttgtcaactttacaa

SEQ ID NO: 7177897 - DNA, 22 bp, Homo sapiens
cttatatttgtcaactttacaa

SEQ ID NO: 7177898 - DNA, 22 bp, Homo sapiens
cttatactgaaaaattatttgt

SEQ ID NO: 7177899 - DNA, 22 bp, Homo sapiens
cttatagaatgtttttatatgt

SEQ ID NO: 7177900 - DNA, 22 bp, Homo sapiens
cttatagaattagagagatttt

SEQ ID NO: 7177901 - DNA, 23 bp, Homo sapiens
cttcattgtagtgttggggagat

SEQ ID NO: 7177902 - DNA, 22 bp, Homo sapiens
cttcatttcaggctgaagaata

SEQ ID NO: 7177903 - DNA, 22 bp, Homo sapiens
cttcatttcaggctgaagaata

SEQ ID NO: 7177904 - DNA, 22 bp, Homo sapiens
cttcatttcaggctgaagaata

SEQ ID NO: 7177905 - DNA, 22 bp, Homo sapiens
cttccaaaatttatatgttgaa

SEQ ID NO: 7177906 - DNA, 22 bp, Homo sapiens
cttccaaagcactttatggacc

SEQ ID NO: 7177907 - DNA, 22 bp, Homo sapiens
cttcatttcaggctgaagaata

SEQ ID NO: 7177908 - DNA, 22 bp, Homo sapiens
cttcatttccatccaactggga

SEQ ID NO: 7177909 - DNA, 22 bp, Homo sapiens
cttcatttggagaactgtgctt

SEQ ID NO: 7177910 - DNA, 18 bp, Homo sapiens
cttcatttgtagagttcc

SEQ ID NO: 7177911 - DNA, 22 bp, Homo sapiens
ctgtttaatgaggtgtaacaac

SEQ ID NO: 7177912 - DNA, 22 bp, Homo sapiens
ctgtttaatgcaatgaaatgag

SEQ ID NO: 7177913 - DNA, 22 bp, Homo sapiens
ctgtggaaggtttagataggta

SEQ ID NO: 7177914 - DNA, 22 bp, Homo sapiens
ctgtggaaggcctgtcctgaaa

SEQ ID NO: 7177915 - DNA, 19 bp, Homo sapiens
ctgtttctgagcttgcttt

SEQ ID NO: 7177916 - DNA, 22 bp, Homo sapiens
ctgtttatcatgtacatttcca

SEQ ID NO: 7177917 - DNA, 22 bp, Homo sapiens
ctgtttatactcaaaagataca

SEQ ID NO: 7177918 - DNA, 22 bp, Homo sapiens
ctgtggaaataaacaatgctaa

SEQ ID NO: 7177919 - DNA, 22 bp, Homo sapiens
ctgtggaagagggtcaccagta

SEQ ID NO: 7177920 - DNA, 22 bp, Homo sapiens
ctgtgctttcaggccgctgtgt

SEQ ID NO: 7177921 - DNA, 20 bp, Homo sapiens
ctgtgctttggaacctggaa

SEQ ID NO: 7177922 - DNA, 22 bp, Homo sapiens
ctgtggaaaatgctttacatat

SEQ ID NO: 7177923 - DNA, 22 bp, Homo sapiens
ctgtgcttcgcaactccaaggt

SEQ ID NO: 7177924 - DNA, 22 bp, Homo sapiens
ctgtgcttgacagtgggaagca

SEQ ID NO: 7177925 - DNA, 22 bp, Homo sapiens
ctgtgcttgacagtgggaagca

SEQ ID NO: 7177926 - DNA, 22 bp, Homo sapiens
ctgtgcttgcgggtgtggagcc

SEQ ID NO: 7177927 - DNA, 22 bp, Homo sapiens
ctgtgcttgcgggtgtggagcc

SEQ ID NO: 7177928 - DNA, 22 bp, Homo sapiens
ctgtgcttgcgggtgtggagcc

SEQ ID NO: 7177929 - DNA, 22 bp, Homo sapiens
ctgtgcttgtgttcattgttaa

SEQ ID NO: 7177930 - DNA, 19 bp, Homo sapiens
ctgtgctttaaactcctat

SEQ ID NO: 7177931 - DNA, 22 bp, Homo sapiens
ctgttttccctggagttcagca

SEQ ID NO: 7177932 - DNA, 22 bp, Homo sapiens
ctgttttcaaagagagagaatg

SEQ ID NO: 7177933 - DNA, 22 bp, Homo sapiens
ctgttttccctggagttcagca

SEQ ID NO: 7177934 - DNA, 22 bp, Homo sapiens
ctgttttcctgggttccatgag

SEQ ID NO: 7177935 - DNA, 22 bp, Homo sapiens
ctgttttctacagtctgggtct

SEQ ID NO: 7177936 - DNA, 22 bp, Homo sapiens
ctgttttctagggctgaggtga

SEQ ID NO: 7177937 - DNA, 22 bp, Homo sapiens
ctgttttatctcaagagttcaa

SEQ ID NO: 7177938 - DNA, 22 bp, Homo sapiens
ctgttttatctcaagagttcaa

SEQ ID NO: 7177939 - DNA, 22 bp, Homo sapiens
ctgttttatctcaagagttcaa

SEQ ID NO: 7177940 - DNA, 22 bp, Homo sapiens
ctgtttgttggctattgacagt

SEQ ID NO: 7177941 - DNA, 22 bp, Homo sapiens
ctgttttaatggagactgatgt

SEQ ID NO: 7177942 - DNA, 22 bp, Homo sapiens
ctgttttaatggagactgatgt

SEQ ID NO: 7177943 - DNA, 22 bp, Homo sapiens
ctgttttaatggagactgatgt

SEQ ID NO: 7177944 - DNA, 22 bp, Homo sapiens
ctgttttataaagtccaaaagt

SEQ ID NO: 7177945 - DNA, 22 bp, Homo sapiens
ctgtttctttgctgtcagagag

SEQ ID NO: 7177946 - DNA, 22 bp, Homo sapiens
ctgtttgctggctatgaactcc

SEQ ID NO: 7177947 - DNA, 22 bp, Homo sapiens
ctgtttgcccacatttttatta

SEQ ID NO: 7177948 - DNA, 22 bp, Homo sapiens
ctgtttgtccaacttgtcccga

SEQ ID NO: 7177949 - DNA, 22 bp, Homo sapiens
ctgtttgtccaacttgtcccga

SEQ ID NO: 7177950 - DNA, 22 bp, Homo sapiens
ctgtttgtctctctcctgaccc

SEQ ID NO: 7177951 - DNA, 22 bp, Homo sapiens
ctgtttgtctctctcctgaccc

SEQ ID NO: 7177952 - DNA, 22 bp, Homo sapiens
ctgtttgtccaacttgtcccga

SEQ ID NO: 7177953 - DNA, 22 bp, Homo sapiens
ctgtttgtgattagcagtgggt

SEQ ID NO: 7177954 - DNA, 22 bp, Homo sapiens
ctgtttgtgattagcagtgggt

SEQ ID NO: 7177955 - DNA, 22 bp, Homo sapiens
ctgtttgtgatttctacgattt

SEQ ID NO: 7177956 - DNA, 22 bp, Homo sapiens
ctgtttgtgatttctacgattt

SEQ ID NO: 7177957 - DNA, 17 bp, Homo sapiens
ctgtttgttctgggagc

SEQ ID NO: 7177958 - DNA, 17 bp, Homo sapiens
ctgtttgttctgggagc

SEQ ID NO: 7177959 - DNA, 22 bp, Homo sapiens
ctgtttgttggctattgacagt

SEQ ID NO: 7177960 - DNA, 22 bp, Homo sapiens
ctgtttttgtgctgtgtctccc

SEQ ID NO: 7177961 - DNA, 22 bp, Homo sapiens
cttaaaatctggcagttagcta

SEQ ID NO: 7177962 - DNA, 18 bp, Homo sapiens
cttaaactgtccccagta

SEQ ID NO: 7177963 - DNA, 22 bp, Homo sapiens
cttaaacaggaaagagccaggt

SEQ ID NO: 7177964 - DNA, 22 bp, Homo sapiens
cttaaaatctggcagttagcta

SEQ ID NO: 7177965 - DNA, 20 bp, Homo sapiens
cttaaacacagagatagatt

SEQ ID NO: 7177966 - DNA, 22 bp, Homo sapiens
cttaattacccaatgtggtagg

SEQ ID NO: 7177967 - DNA, 22 bp, Homo sapiens
cttaaattttcatctacaagaa

SEQ ID NO: 7177968 - DNA, 22 bp, Homo sapiens
cttaaagtagaatacaagacct

SEQ ID NO: 7177969 - DNA, 22 bp, Homo sapiens
cttaaagagtatttaatataat

SEQ ID NO: 7177970 - DNA, 22 bp, Homo sapiens
cttaaagagtatttaatataat

SEQ ID NO: 7177971 - DNA, 22 bp, Homo sapiens
cttaaagtattggtttaaccaa

SEQ ID NO: 7177972 - DNA, 22 bp, Homo sapiens
cttaaagtctatcctttctaga

SEQ ID NO: 7177973 - DNA, 22 bp, Homo sapiens
cttaaagttgacacagtccctg

SEQ ID NO: 7177974 - DNA, 22 bp, Homo sapiens
cttaaagttgacacagtccctg

SEQ ID NO: 7177975 - DNA, 22 bp, Homo sapiens
cttaaatccatcatttctaatc

SEQ ID NO: 7177976 - DNA, 22 bp, Homo sapiens
cttacaaatacacttaggagag

SEQ ID NO: 7177977 - DNA, 22 bp, Homo sapiens
cttacaaaggagaggagatagg

SEQ ID NO: 7177978 - DNA, 22 bp, Homo sapiens
cttacaaatacacttaggagag

SEQ ID NO: 7177979 - DNA, 22 bp, Homo sapiens
cttacaaatacacttaggagag

SEQ ID NO: 7177980 - DNA, 22 bp, Homo sapiens
cttaatttaaaatagttcaggc

SEQ ID NO: 7177981 - DNA, 22 bp, Homo sapiens
cttaatttaaaatagttcaggc

SEQ ID NO: 7177982 - DNA, 22 bp, Homo sapiens
cttaatttaagcctagaatgca

SEQ ID NO: 7177983 - DNA, 22 bp, Homo sapiens
cttaatttaagcctagaatgca

SEQ ID NO: 7177984 - DNA, 22 bp, Homo sapiens
cttaatttcaaactgctagtga

SEQ ID NO: 7177985 - DNA, 22 bp, Homo sapiens
cttaatttcaaactgctagtga

SEQ ID NO: 7177986 - DNA, 22 bp, Homo sapiens
cttaatttttgtagtagatgga

SEQ ID NO: 7177987 - DNA, 22 bp, Homo sapiens
cttaatttttgtagtagatgga

SEQ ID NO: 7177988 - DNA, 22 bp, Homo sapiens
cttacaaaggagaggagatagg

SEQ ID NO: 7177989 - DNA, 22 bp, Homo sapiens
cttacaaaggagaggagatagg

SEQ ID NO: 7177990 - DNA, 22 bp, Homo sapiens
cttacaaaggagaggagatagg

SEQ ID NO: 7177991 - DNA, 22 bp, Homo sapiens
cttacaagcaaaacaactgtag

SEQ ID NO: 7177992 - DNA, 22 bp, Homo sapiens
cttacagagaagaaaatgtagt

SEQ ID NO: 7177993 - DNA, 22 bp, Homo sapiens
cttacaggaaagaagaaagcat

SEQ ID NO: 7177994 - DNA, 22 bp, Homo sapiens
cttacattgtctcttgctgagc

SEQ ID NO: 7177995 - DNA, 22 bp, Homo sapiens
cttacattaagtaagagattga

SEQ ID NO: 7177996 - DNA, 22 bp, Homo sapiens
cttacattaagtaagagattga

SEQ ID NO: 7177997 - DNA, 22 bp, Homo sapiens
cttacatactgagaaaatatcc

SEQ ID NO: 7177998 - DNA, 22 bp, Homo sapiens
cttagaaatgcagattctcagg

SEQ ID NO: 7177999 - DNA, 22 bp, Homo sapiens
cttagaaatgcagattctcagg

SEQ ID NO: 7178000 - DNA, 22 bp, Homo sapiens
cttagaaattgttactcattca

SEQ ID NO: 7178001 - DNA, 22 bp, Homo sapiens
cttagaaattgttactcattca

SEQ ID NO: 7178002 - DNA, 22 bp, Homo sapiens
cttagcaatttaactgactcta

SEQ ID NO: 7178003 - DNA, 22 bp, Homo sapiens
cttagcacatatcagaaaatag

SEQ ID NO: 7178004 - DNA, 22 bp, Homo sapiens
cttagcagaagcttcagcttca

SEQ ID NO: 7178005 - DNA, 22 bp, Homo sapiens
cttagcagaattccaagcttga

SEQ ID NO: 7178006 - DNA, 22 bp, Homo sapiens
cttaccatgtgagaaacaaaca

SEQ ID NO: 7178007 - DNA, 22 bp, Homo sapiens
cttaccatgtgagaaacaaaca

SEQ ID NO: 7178008 - DNA, 22 bp, Homo sapiens
cttacatttaatcatgtgtcat

SEQ ID NO: 7178009 - DNA, 22 bp, Homo sapiens
cttacattgtgtgcatgagggg

SEQ ID NO: 7178010 - DNA, 22 bp, Homo sapiens
cttacattgtcttagttttcaa

SEQ ID NO: 7178011 - DNA, 22 bp, Homo sapiens
cttacattgtgtgcatgagggg

SEQ ID NO: 7178012 - DNA, 22 bp, Homo sapiens
cttacattgtgtgcatgagggg

SEQ ID NO: 7178013 - DNA, 22 bp, Homo sapiens
cttacatttaatcatgtgtcat

SEQ ID NO: 7178014 - DNA, 22 bp, Homo sapiens
cttagaaagagttttctcccct

SEQ ID NO: 7178015 - DNA, 22 bp, Homo sapiens
cttagaaataatggtttcagtt

SEQ ID NO: 7178016 - DNA, 22 bp, Homo sapiens
cttagaaatcgaactcaggtta

SEQ ID NO: 7178017 - DNA, 22 bp, Homo sapiens
cttctgggttgcaggtcttggc

SEQ ID NO: 7178018 - DNA, 22 bp, Homo sapiens
cttctgggtgcctgtgagtgtt

SEQ ID NO: 7178019 - DNA, 22 bp, Homo sapiens
cttctgggtaattcttcttcat

SEQ ID NO: 7178020 - DNA, 22 bp, Homo sapiens
cttctgggtaattcttcttcat

SEQ ID NO: 7178021 - DNA, 22 bp, Homo sapiens
cttctggttccagcttctgttg

SEQ ID NO: 7178022 - DNA, 22 bp, Homo sapiens
cttgtttttaagagatgtttac

SEQ ID NO: 7178023 - DNA, 22 bp, Homo sapiens
ctttaaataatacaaggtccag

SEQ ID NO: 7178024 - DNA, 22 bp, Homo sapiens
cttgttttggctagtatgatgt

SEQ ID NO: 7178025 - DNA, 22 bp, Homo sapiens
cttgttttggctagtatgatgt

SEQ ID NO: 7178026 - DNA, 22 bp, Homo sapiens
cttgtttttaagagatgtttac

SEQ ID NO: 7178027 - DNA, 22 bp, Homo sapiens
cttgttttggaacagagtgaat

SEQ ID NO: 7178028 - DNA, 22 bp, Homo sapiens
cttgttttggaacagagtgaat

SEQ ID NO: 7178029 - DNA, 22 bp, Homo sapiens
cttgttttggctagtatgatgt

SEQ ID NO: 7178030 - DNA, 21 bp, Homo sapiens
cttgttttgaaaggactggcc

SEQ ID NO: 7178031 - DNA, 21 bp, Homo sapiens
cttgttttgaaaggactggcc

SEQ ID NO: 7178032 - DNA, 22 bp, Homo sapiens
cttgttttggaacagagtgaat

SEQ ID NO: 7178033 - DNA, 22 bp, Homo sapiens
cttgttttcttctgcagtctat

SEQ ID NO: 7178034 - DNA, 22 bp, Homo sapiens
cttgttttgaaagcagtggcca

SEQ ID NO: 7178035 - DNA, 22 bp, Homo sapiens
cttgttttgaaagcagtggcca

SEQ ID NO: 7178036 - DNA, 22 bp, Homo sapiens
cttgttttctaaaacatcattt

SEQ ID NO: 7178037 - DNA, 22 bp, Homo sapiens
cttgttttctaaaacatcattt

SEQ ID NO: 7178038 - DNA, 22 bp, Homo sapiens
cttgttttctaaaacatcattt

SEQ ID NO: 7178039 - DNA, 22 bp, Homo sapiens
cttgttttctaaaacatcattt

SEQ ID NO: 7178040 - DNA, 22 bp, Homo sapiens
cttgttttcttctgcagtctat

SEQ ID NO: 7178041 - DNA, 22 bp, Homo sapiens
cttctgggccatggccttcctc

SEQ ID NO: 7178042 - DNA, 22 bp, Homo sapiens
cttctgggccatggccttcctc

SEQ ID NO: 7178043 - DNA, 22 bp, Homo sapiens
cttctggggatggagcccagaa

SEQ ID NO: 7178044 - DNA, 22 bp, Homo sapiens
cttctgggcattcagctgcaca

SEQ ID NO: 7178045 - DNA, 22 bp, Homo sapiens
cttctggggatggagcccagaa

SEQ ID NO: 7178046 - DNA, 22 bp, Homo sapiens
cttctgggcatggcagagcctg

SEQ ID NO: 7178047 - DNA, 22 bp, Homo sapiens
cttctgggcagaagttttgaga

SEQ ID NO: 7178048 - DNA, 22 bp, Homo sapiens
cttctgggcattcagctgcaca

SEQ ID NO: 7178049 - DNA, 22 bp, Homo sapiens
cttctgggatttttgaagactc

SEQ ID NO: 7178050 - DNA, 22 bp, Homo sapiens
cttctgggagagcttttgcttc

SEQ ID NO: 7178051 - DNA, 22 bp, Homo sapiens
cttctgggattaatttttcctg

SEQ ID NO: 7178052 - DNA, 20 bp, Homo sapiens
cttctggctggtcaaggact

SEQ ID NO: 7178053 - DNA, 23 bp, Homo sapiens
cttctggctctatatcagaattc

SEQ ID NO: 7178054 - DNA, 22 bp, Homo sapiens
cttctggcaaaacaggcagaaa

SEQ ID NO: 7178055 - DNA, 19 bp, Homo sapiens
cttctggccctgagccacc

SEQ ID NO: 7178056 - DNA, 22 bp, Homo sapiens
cttctgaatggctgtgtatgct

SEQ ID NO: 7178057 - DNA, 22 bp, Homo sapiens
cttctggaaacttttccaattt

SEQ ID NO: 7178058 - DNA, 22 bp, Homo sapiens
cttctggagctcaccaacttcc

SEQ ID NO: 7178059 - DNA, 22 bp, Homo sapiens
cttctggaggacactggcccca

SEQ ID NO: 7178060 - DNA, 22 bp, Homo sapiens
cttctggaggctccagggaggt

SEQ ID NO: 7178061 - DNA, 22 bp, Homo sapiens
cttctggaggctccagggaggt

SEQ ID NO: 7178062 - DNA, 22 bp, Homo sapiens
cttctggatttattcattcctt

SEQ ID NO: 7178063 - DNA, 22 bp, Homo sapiens
ctttgacctcatatgacacatt

SEQ ID NO: 7178064 - DNA, 22 bp, Homo sapiens
ctttgaattccagtacaataac

SEQ ID NO: 7178065 - DNA, 22 bp, Homo sapiens
ctttgaattccagtacaataac

SEQ ID NO: 7178066 - DNA, 22 bp, Homo sapiens
ctttgaattgccgtttcatctg

SEQ ID NO: 7178067 - DNA, 22 bp, Homo sapiens
ctttgatctactcactaaacaa

SEQ ID NO: 7178068 - DNA, 22 bp, Homo sapiens
ctttgatgagcatgcaatattt

SEQ ID NO: 7178069 - DNA, 22 bp, Homo sapiens
ctttgatgagcatgcaatattt

SEQ ID NO: 7178070 - DNA, 22 bp, Homo sapiens
ctttgatgccagataactgcag

SEQ ID NO: 7178071 - DNA, 22 bp, Homo sapiens
ctttgaagatcacatgttgctc

SEQ ID NO: 7178072 - DNA, 22 bp, Homo sapiens
ctttgaagatcacatgttgctc

SEQ ID NO: 7178073 - DNA, 22 bp, Homo sapiens
ctttgaagatcacatgttgctc

SEQ ID NO: 7178074 - DNA, 22 bp, Homo sapiens
ctttctttgtccaccaacaatg

SEQ ID NO: 7178075 - DNA, 22 bp, Homo sapiens
ctttctttgtccaccaacaatg

SEQ ID NO: 7178076 - DNA, 22 bp, Homo sapiens
ctttctttgtccaccaacaatg

SEQ ID NO: 7178077 - DNA, 22 bp, Homo sapiens
ctttctttgtccaccaacaatg

SEQ ID NO: 7178078 - DNA, 22 bp, Homo sapiens
ctttctttgtccaccaacaatg

SEQ ID NO: 7178079 - DNA, 22 bp, Homo sapiens
ctttctcttcagcacccagccc

SEQ ID NO: 7178080 - DNA, 22 bp, Homo sapiens
ctttctcttcagcacccagccc

SEQ ID NO: 7178081 - DNA, 22 bp, Homo sapiens
ctttctcttcgaaaacctgccc

SEQ ID NO: 7178082 - DNA, 22 bp, Homo sapiens
ctttctcttcgaaaacctgccc

SEQ ID NO: 7178083 - DNA, 22 bp, Homo sapiens
ctttgaaaaatggtttcctaga

SEQ ID NO: 7178084 - DNA, 22 bp, Homo sapiens
ctttgaaaacttaaataacagc

SEQ ID NO: 7178085 - DNA, 22 bp, Homo sapiens
ctttaaggtgatgagagatgct

SEQ ID NO: 7178086 - DNA, 22 bp, Homo sapiens
ctttaagactaaattagagttt

SEQ ID NO: 7178087 - DNA, 22 bp, Homo sapiens
ctttaacagttccattcaattt

SEQ ID NO: 7178088 - DNA, 22 bp, Homo sapiens
ctttaaataatacaaggtccag

SEQ ID NO: 7178089 - DNA, 22 bp, Homo sapiens
ctttaaataatacaaggtccag

SEQ ID NO: 7178090 - DNA, 22 bp, Homo sapiens
ctttaattaggaagtataatga

SEQ ID NO: 7178091 - DNA, 22 bp, Homo sapiens
ctttaatgagtctttctgctgt

SEQ ID NO: 7178092 - DNA, 22 bp, Homo sapiens
ctttaatgagtctttctgctgt

SEQ ID NO: 7178093 - DNA, 22 bp, Homo sapiens
ctttaaggtgatgagagatgct

SEQ ID NO: 7178094 - DNA, 22 bp, Homo sapiens
ctttaatcaagataagtatact

SEQ ID NO: 7178095 - DNA, 23 bp, Homo sapiens
ctttaatgaaattctctgtgaag

SEQ ID NO: 7178096 - DNA, 22 bp, Homo sapiens
ctttaattaggaagtataatga

SEQ ID NO: 7178097 - DNA, 22 bp, Homo sapiens
ctttaattaggaagtataatga

SEQ ID NO: 7178098 - DNA, 22 bp, Homo sapiens
ctttaattcagatttgaaggga

SEQ ID NO: 7178099 - DNA, 22 bp, Homo sapiens
ctttaattcagatttgaaggga

SEQ ID NO: 7178100 - DNA, 22 bp, Homo sapiens
ctttaattcagatttgaaggga

SEQ ID NO: 7178101 - DNA, 22 bp, Homo sapiens
ctttaattctcaggtgcacata

SEQ ID NO: 7178102 - DNA, 22 bp, Homo sapiens
ctttacaaagcaattttgtctc

SEQ ID NO: 7178103 - DNA, 22 bp, Homo sapiens
ctttacaaactataaagtgcgg

SEQ ID NO: 7178104 - DNA, 22 bp, Homo sapiens
ctttaattctcaggtgcacata

SEQ ID NO: 7178105 - DNA, 22 bp, Homo sapiens
ctttaattctcaggtgcacata

SEQ ID NO: 7178106 - DNA, 22 bp, Homo sapiens
ctttaattgtagctcccataat

SEQ ID NO: 7178107 - DNA, 22 bp, Homo sapiens
ctttaattgtagctcccataat

SEQ ID NO: 7178108 - DNA, 22 bp, Homo sapiens
ctttacaaattagctctcggga

SEQ ID NO: 7178109 - DNA, 22 bp, Homo sapiens
ctttctcttcagcacccagccc

SEQ ID NO: 7178110 - DNA, 22 bp, Homo sapiens
ctttacaaatagggagggagtg

SEQ ID NO: 7178111 - DNA, 22 bp, Homo sapiens
ctttacaaatagggagggagtg

SEQ ID NO: 7178112 - DNA, 22 bp, Homo sapiens
cttttccactgagcctcacaaa

SEQ ID NO: 7178113 - DNA, 18 bp, Homo sapiens
cttttcccctttggactc

SEQ ID NO: 7178114 - DNA, 22 bp, Homo sapiens
cttttccaaagtccatctggtc

SEQ ID NO: 7178115 - DNA, 22 bp, Homo sapiens
cttttccaaagtccatctggtc

SEQ ID NO: 7178116 - DNA, 22 bp, Homo sapiens
cttttccaaagtccatctggtc

SEQ ID NO: 7178117 - DNA, 22 bp, Homo sapiens
cttttccactgagcctcacaaa

SEQ ID NO: 7178118 - DNA, 21 bp, Homo sapiens
cttttacattcagtcatgatg

SEQ ID NO: 7178119 - DNA, 22 bp, Homo sapiens
cttttacatttgttgaagagta

SEQ ID NO: 7178120 - DNA, 22 bp, Homo sapiens
cttttacatttgttgaagagta

SEQ ID NO: 7178121 - DNA, 22 bp, Homo sapiens
cttttacatttgttgaagagta

SEQ ID NO: 7178122 - DNA, 22 bp, Homo sapiens
cttttcattgtttgtacatgca

SEQ ID NO: 7178123 - DNA, 22 bp, Homo sapiens
cttttcattgtttgtacatgca

SEQ ID NO: 7178124 - DNA, 22 bp, Homo sapiens
ctttgcagctctaggtggaagc

SEQ ID NO: 7178125 - DNA, 20 bp, Homo sapiens
ctttgcaggagaacagagaa

SEQ ID NO: 7178126 - DNA, 22 bp, Homo sapiens
ctttgcaggagtatgtgataat

SEQ ID NO: 7178127 - DNA, 19 bp, Homo sapiens
ctttgcaggggatgggtga

SEQ ID NO: 7178128 - DNA, 19 bp, Homo sapiens
ctttgcaggggatgggtga

SEQ ID NO: 7178129 - DNA, 19 bp, Homo sapiens
ctttgcaggggatgggtga

SEQ ID NO: 7178130 - DNA, 22 bp, Homo sapiens
ctttgcagtatagcctagtaga

SEQ ID NO: 7178131 - DNA, 22 bp, Homo sapiens
ctttgcagtgaatccataaata

SEQ ID NO: 7178132 - DNA, 18 bp, Homo sapiens
ctttgcagttacagggca

SEQ ID NO: 7178133 - DNA, 22 bp, Homo sapiens
ctttgcagtgattgttcttgga

SEQ ID NO: 7178134 - DNA, 22 bp, Homo sapiens
ctttgcagttagcctaggattg

SEQ ID NO: 7178135 - DNA, 22 bp, Homo sapiens
ctttgcagtttcagaaccctga

SEQ ID NO: 7178136 - DNA, 22 bp, Homo sapiens
cttttacagtggacctgccatt

SEQ ID NO: 7178137 - DNA, 22 bp, Homo sapiens
cttttacagtggacctgccatt

SEQ ID NO: 7178138 - DNA, 22 bp, Homo sapiens
cttttacagtggacctgccatt

SEQ ID NO: 7178139 - DNA, 22 bp, Homo sapiens
cttttacagtggacctgccatt

SEQ ID NO: 7178140 - DNA, 21 bp, Homo sapiens
cttttacattcagtcatgatg

SEQ ID NO: 7178141 - DNA, 21 bp, Homo sapiens
cttttacattcagtcatgatg

SEQ ID NO: 7178142 - DNA, 22 bp, Homo sapiens
ctttgcagaaataaacttgatg

SEQ ID NO: 7178143 - DNA, 22 bp, Homo sapiens
ctttgcagaagaaacctacaaa

SEQ ID NO: 7178144 - DNA, 22 bp, Homo sapiens
ctttgcagagggggtgggagct

SEQ ID NO: 7178145 - DNA, 22 bp, Homo sapiens
ctttgcagatttgtttagtgct

SEQ ID NO: 7178146 - DNA, 22 bp, Homo sapiens
ctttgcagcaatttctgttaaa

SEQ ID NO: 7178147 - DNA, 22 bp, Homo sapiens
ctttgcagcaatttctgttaaa

SEQ ID NO: 7178148 - DNA, 22 bp, Homo sapiens
ctttgcagcaatttctgttaaa

SEQ ID NO: 7178149 - DNA, 17 bp, Homo sapiens
ctttgcagcagacatgt

SEQ ID NO: 7178150 - DNA, 21 bp, Homo sapiens
ctttgcaagatgtctatgaaa

SEQ ID NO: 7178151 - DNA, 21 bp, Homo sapiens
ctttgcaagatgtctatgaaa

SEQ ID NO: 7178152 - DNA, 22 bp, Homo sapiens
ctttgcagaaataaacttgatg

SEQ ID NO: 7178153 - DNA, 22 bp, Homo sapiens
ctttgattccaggcacatgttt

SEQ ID NO: 7178154 - DNA, 21 bp, Homo sapiens
ctttgcaagatgtctatgaaa

SEQ ID NO: 7178155 - DNA, 22 bp, Homo sapiens
cttttctcttacattccactgg

SEQ ID NO: 7178156 - DNA, 22 bp, Homo sapiens
cttttctcttacattccactgg

SEQ ID NO: 7178157 - DNA, 22 bp, Homo sapiens
cttttctctgtaccgtatatct

SEQ ID NO: 7178158 - DNA, 22 bp, Homo sapiens
cttttctctgtaccgtatatct

SEQ ID NO: 7178159 - DNA, 22 bp, Homo sapiens
cttttctggaatcatctctaac

SEQ ID NO: 7178160 - DNA, 22 bp, Homo sapiens
cttttctggccaggaacttgcc

SEQ ID NO: 7178161 - DNA, 22 bp, Homo sapiens
cttttctgggccccacgctgga

SEQ ID NO: 7178162 - DNA, 22 bp, Homo sapiens
cttttctgtgatgctgacagtc

SEQ ID NO: 7178163 - DNA, 22 bp, Homo sapiens
cttttctctgcgggtctttcat

SEQ ID NO: 7178164 - DNA, 22 bp, Homo sapiens
cttttctctgcgggtctttcat

SEQ ID NO: 7178165 - DNA, 21 bp, Homo sapiens
cttttctctccgcaggacatt

SEQ ID NO: 7178166 - DNA, 22 bp, Homo sapiens
cttttctctgcaccatgtgtga

SEQ ID NO: 7178167 - DNA, 21 bp, Homo sapiens
cttttctctccgcaggacatt

SEQ ID NO: 7178168 - DNA, 21 bp, Homo sapiens
cttttctctccgcaggacatt

SEQ ID NO: 7178169 - DNA, 22 bp, Homo sapiens
cttttcctattgattctgttac

SEQ ID NO: 7178170 - DNA, 22 bp, Homo sapiens
cttttcctcaggaggagacgcg

SEQ ID NO: 7178171 - DNA, 22 bp, Homo sapiens
cttttctagagccgcagcccta

SEQ ID NO: 7178172 - DNA, 22 bp, Homo sapiens
cttttcttgtattggatgcccc

SEQ ID NO: 7178173 - DNA, 22 bp, Homo sapiens
cttttcttgtattggatgcccc

SEQ ID NO: 7178174 - DNA, 22 bp, Homo sapiens
cttttgattgagcagtttcaaa

SEQ ID NO: 7178175 - DNA, 22 bp, Homo sapiens
cttttgattgagcagtttcaaa

SEQ ID NO: 7178176 - DNA, 22 bp, Homo sapiens
cttttgatggagttcaagaagc

SEQ ID NO: 7178177 - DNA, 22 bp, Homo sapiens
cttttcttctcacggctgtcag

SEQ ID NO: 7178178 - DNA, 22 bp, Homo sapiens
cttttcttctcacggctgtcag

SEQ ID NO: 7178179 - DNA, 22 bp, Homo sapiens
cttttcttctcacggctgtcag

SEQ ID NO: 7178180 - DNA, 22 bp, Homo sapiens
cttttcttctcacggctgtcag

SEQ ID NO: 7178181 - DNA, 22 bp, Homo sapiens
cttttcttctcacggctgtcag

SEQ ID NO: 7178182 - DNA, 22 bp, Homo sapiens
cttttcttgtattggatgcccc

SEQ ID NO: 7178183 - DNA, 22 bp, Homo sapiens
cttttcttgtattggatgcccc

SEQ ID NO: 7178184 - DNA, 22 bp, Homo sapiens
cttttcttgtattggatgcccc

SEQ ID NO: 7178185 - DNA, 22 bp, Homo sapiens
cttttcttatgtggacgtacct

SEQ ID NO: 7178186 - DNA, 22 bp, Homo sapiens
cttttcttatgtggacgtacct

SEQ ID NO: 7178187 - DNA, 22 bp, Homo sapiens
cttttcttatgtggacgtacct

SEQ ID NO: 7178188 - DNA, 22 bp, Homo sapiens
cttttcttctcacggctgtcag

SEQ ID NO: 7178189 - DNA, 22 bp, Homo sapiens
cttttcttatgtggacgtacct

SEQ ID NO: 7178190 - DNA, 22 bp, Homo sapiens
cttttcttactcccgcaaggca

SEQ ID NO: 7178191 - DNA, 22 bp, Homo sapiens
cttttcttactcccgcaaggca

SEQ ID NO: 7178192 - DNA, 22 bp, Homo sapiens
cttttcttactcccgcaaggca

SEQ ID NO: 7178193 - DNA, 22 bp, Homo sapiens
gaaagccatctggctgctggga

SEQ ID NO: 7178194 - DNA, 22 bp, Homo sapiens
gaaagccatctggctgctggga

SEQ ID NO: 7178195 - DNA, 22 bp, Homo sapiens
gaaagccatagcccagctttac

SEQ ID NO: 7178196 - DNA, 22 bp, Homo sapiens
gaaagccagagagaaagggctc

SEQ ID NO: 7178197 - DNA, 22 bp, Homo sapiens
gaaagccatagcccagctttac

SEQ ID NO: 7178198 - DNA, 18 bp, Homo sapiens
gaaagccatgcagcagtg

SEQ ID NO: 7178199 - DNA, 22 bp, Homo sapiens
gaaagagaggggctgagatgca

SEQ ID NO: 7178200 - DNA, 22 bp, Homo sapiens
gaaagagaggggctgagatgca

SEQ ID NO: 7178201 - DNA, 22 bp, Homo sapiens
gaaagagaggggctgagatgca

SEQ ID NO: 7178202 - DNA, 22 bp, Homo sapiens
gaaagagaggggctgagatgca

SEQ ID NO: 7178203 - DNA, 22 bp, Homo sapiens
gaaagagaggggctgagatgca

SEQ ID NO: 7178204 - DNA, 22 bp, Homo sapiens
gaaagagaggggctgagatgca

SEQ ID NO: 7178205 - DNA, 22 bp, Homo sapiens
gaaagagaggggctgagatgca

SEQ ID NO: 7178206 - DNA, 22 bp, Homo sapiens
gaaagaggaaggagatgtatta

SEQ ID NO: 7178207 - DNA, 22 bp, Homo sapiens
gaaagaggaaggagatgtatta

SEQ ID NO: 7178208 - DNA, 22 bp, Homo sapiens
gaaagaggaaggagatgtatta

SEQ ID NO: 7178209 - DNA, 22 bp, Homo sapiens
gaaagagtatgggagctttact

SEQ ID NO: 7178210 - DNA, 22 bp, Homo sapiens
gaaagagtatgggagctttact

SEQ ID NO: 7178211 - DNA, 22 bp, Homo sapiens
gaaagataatcaattactcctt

SEQ ID NO: 7178212 - DNA, 22 bp, Homo sapiens
gaaagatatttattggcaacag

SEQ ID NO: 7178213 - DNA, 22 bp, Homo sapiens
gaaagcatccgcctggaggtgg

SEQ ID NO: 7178214 - DNA, 22 bp, Homo sapiens
gaaagcatccgcctggaggtgg

SEQ ID NO: 7178215 - DNA, 22 bp, Homo sapiens
gaaacagcacgtttggagagat

SEQ ID NO: 7178216 - DNA, 22 bp, Homo sapiens
gaaacagattaacagcatattt

SEQ ID NO: 7178217 - DNA, 22 bp, Homo sapiens
gaaacagattaacagcatattt

SEQ ID NO: 7178218 - DNA, 22 bp, Homo sapiens
gaaacagattaacagcatattt

SEQ ID NO: 7178219 - DNA, 22 bp, Homo sapiens
gaaacactatgccaagacaggg

SEQ ID NO: 7178220 - DNA, 22 bp, Homo sapiens
gaaacactatgccaagacaggg

SEQ ID NO: 7178221 - DNA, 22 bp, Homo sapiens
gaaacactcaatttagtaattc

SEQ ID NO: 7178222 - DNA, 22 bp, Homo sapiens
gaaacactggtaaagactgccg

SEQ ID NO: 7178223 - DNA, 22 bp, Homo sapiens
gaaacacatgcagctccataga

SEQ ID NO: 7178224 - DNA, 22 bp, Homo sapiens
gaaacacatatgaacagttgat

SEQ ID NO: 7178225 - DNA, 22 bp, Homo sapiens
gaaacaatttttgttgtctaag

SEQ ID NO: 7178226 - DNA, 19 bp, Homo sapiens
gaaacaagtcattccagag

SEQ ID NO: 7178227 - DNA, 22 bp, Homo sapiens
gaaaatttctgccacatgtgtg

SEQ ID NO: 7178228 - DNA, 22 bp, Homo sapiens
gaaaattgaatcagtagctgat

SEQ ID NO: 7178229 - DNA, 22 bp, Homo sapiens
gaaaatttaattctcttctgtg

SEQ ID NO: 7178230 - DNA, 22 bp, Homo sapiens
gaaaatttagaactgaacttct

SEQ ID NO: 7178231 - DNA, 22 bp, Homo sapiens
gaaaatttagaactgaacttct

SEQ ID NO: 7178232 - DNA, 22 bp, Homo sapiens
gaaaattattgaaaatggctct

SEQ ID NO: 7178233 - DNA, 22 bp, Homo sapiens
gaaaattattgaaaatggctct

SEQ ID NO: 7178234 - DNA, 22 bp, Homo sapiens
cttttgcacccagagttatttg

SEQ ID NO: 7178235 - DNA, 22 bp, Homo sapiens
cttttgcaccttttaagtaatg

SEQ ID NO: 7178236 - DNA, 22 bp, Homo sapiens
cttttgcagccattattgctgc

SEQ ID NO: 7178237 - DNA, 22 bp, Homo sapiens
gaaaatagcagatagaccaatg

SEQ ID NO: 7178238 - DNA, 22 bp, Homo sapiens
tttcaaagttgggaattgtaat

SEQ ID NO: 7178239 - DNA, 22 bp, Homo sapiens
tttcaaagttgggaattgtaat

SEQ ID NO: 7178240 - DNA, 22 bp, Homo sapiens
tttcaaataccataaacctaat

SEQ ID NO: 7178241 - DNA, 22 bp, Homo sapiens
tttcaaataccataaacctaat

SEQ ID NO: 7178242 - DNA, 22 bp, Homo sapiens
tttcaaataccataaacctaat

SEQ ID NO: 7178243 - DNA, 22 bp, Homo sapiens
tttcaaataccataaacctaat

SEQ ID NO: 7178244 - DNA, 22 bp, Homo sapiens
tttcaaagtggagaattagaca

SEQ ID NO: 7178245 - DNA, 22 bp, Homo sapiens
tttcaaagtggagaattagaca

SEQ ID NO: 7178246 - DNA, 22 bp, Homo sapiens
tttcaaatggagtcgtgaaatg

SEQ ID NO: 7178247 - DNA, 22 bp, Homo sapiens
tttcaaatagaatctttccaaa

SEQ ID NO: 7178248 - DNA, 22 bp, Homo sapiens
tttcaaatagaatctttccaaa

SEQ ID NO: 7178249 - DNA, 22 bp, Homo sapiens
tttcaaataccataaacctaat

SEQ ID NO: 7178250 - DNA, 22 bp, Homo sapiens
tttcaaataccataaacctaat

SEQ ID NO: 7178251 - DNA, 22 bp, Homo sapiens
ctcgtgatccgcccacctcagc

SEQ ID NO: 7178252 - DNA, 22 bp, Homo sapiens
ctcggtggacatttcagaggtg

SEQ ID NO: 7178253 - DNA, 22 bp, Homo sapiens
tttcaaatggagtcgtgaaatg

SEQ ID NO: 7178254 - DNA, 22 bp, Homo sapiens
ctccttcctggttagcacctta

SEQ ID NO: 7178255 - DNA, 22 bp, Homo sapiens
ctccttctcctcgggaggccag

SEQ ID NO: 7178256 - DNA, 22 bp, Homo sapiens
ctctaaatccaaataagtgtcc

SEQ ID NO: 7178257 - DNA, 22 bp, Homo sapiens
ctctaaatccacggtatagttg

SEQ ID NO: 7178258 - DNA, 22 bp, Homo sapiens
ctctaagtgttcctttatctat

SEQ ID NO: 7178259 - DNA, 22 bp, Homo sapiens
ctctaatactgaccaagtcacc

SEQ ID NO: 7178260 - DNA, 22 bp, Homo sapiens
ctctaacaccacagtgtggttt

SEQ ID NO: 7178261 - DNA, 22 bp, Homo sapiens
ctctaatactgaccaagtcacc

SEQ ID NO: 7178262 - DNA, 20 bp, Homo sapiens
ctctaattgctttatgtgtg

SEQ ID NO: 7178263 - DNA, 21 bp, Homo sapiens
ctctacattcccagcaactct

SEQ ID NO: 7178264 - DNA, 22 bp, Homo sapiens
tttcaaagtcaatatcattacc

SEQ ID NO: 7178265 - DNA, 22 bp, Homo sapiens
tttcaaagtcaatatcattacc

SEQ ID NO: 7178266 - DNA, 22 bp, Homo sapiens
tttcaaagtcaatatcattacc

SEQ ID NO: 7178267 - DNA, 22 bp, Homo sapiens
ctcctgtggtcaagggtgggac

SEQ ID NO: 7178268 - DNA, 22 bp, Homo sapiens
tttcaaagtaaggattttcatc

SEQ ID NO: 7178269 - DNA, 22 bp, Homo sapiens
tttcaaagtcaagaaggatact

SEQ ID NO: 7178270 - DNA, 22 bp, Homo sapiens
ctcctgtggtactcccagggcc

SEQ ID NO: 7178271 - DNA, 22 bp, Homo sapiens
ctcctgtgattcatttaacata

SEQ ID NO: 7178272 - DNA, 22 bp, Homo sapiens
ctcctgtgcacctccagcggca

SEQ ID NO: 7178273 - DNA, 22 bp, Homo sapiens
ctcctgtcagaagcatcctgag

SEQ ID NO: 7178274 - DNA, 22 bp, Homo sapiens
ctcctgtcagaagcatcctgag

SEQ ID NO: 7178275 - DNA, 22 bp, Homo sapiens
ctcctgtgaggcttaagcccag

SEQ ID NO: 7178276 - DNA, 22 bp, Homo sapiens
ctcctgtgggtcaccaataggc

SEQ ID NO: 7178277 - DNA, 22 bp, Homo sapiens
ctcctgtcagaagcatcctgag

SEQ ID NO: 7178278 - DNA, 22 bp, Homo sapiens
ctcctgtcagaagcatcctgag

SEQ ID NO: 7178279 - DNA, 22 bp, Homo sapiens
ctcctgtcagaagcatcctgag

SEQ ID NO: 7178280 - DNA, 22 bp, Homo sapiens
ctcctgtcagaagcatcctgag

SEQ ID NO: 7178281 - DNA, 22 bp, Homo sapiens
ctcctgtcagaagcatcctgag

SEQ ID NO: 7178282 - DNA, 22 bp, Homo sapiens
ctcctgtcagaagcatcctgag

SEQ ID NO: 7178283 - DNA, 22 bp, Homo sapiens
ctcctgtcaataggctcctggc

SEQ ID NO: 7178284 - DNA, 22 bp, Homo sapiens
ctcctgtcaataggctcctggc

SEQ ID NO: 7178285 - DNA, 22 bp, Homo sapiens
ctcctgtcaataggctcctggc

SEQ ID NO: 7178286 - DNA, 22 bp, Homo sapiens
ctcctgtcaataggctcctggc

SEQ ID NO: 7178287 - DNA, 22 bp, Homo sapiens
ctcctgtcaataggctcctggc

SEQ ID NO: 7178288 - DNA, 22 bp, Homo sapiens
ctcctgtcaataggctcctggc

SEQ ID NO: 7178289 - DNA, 22 bp, Homo sapiens
ctcctgtcaataggctcctggc

SEQ ID NO: 7178290 - DNA, 22 bp, Homo sapiens
tttatattacctggaatagctt

SEQ ID NO: 7178291 - DNA, 22 bp, Homo sapiens
tttatattacctggaatagctt

SEQ ID NO: 7178292 - DNA, 22 bp, Homo sapiens
tttatattacctggaatagctt

SEQ ID NO: 7178293 - DNA, 22 bp, Homo sapiens
tttatattacctggaatagctt

SEQ ID NO: 7178294 - DNA, 22 bp, Homo sapiens
tttatatgtttgtacaattaag

SEQ ID NO: 7178295 - DNA, 22 bp, Homo sapiens
ctcctgggctgtcggcgctctg

SEQ ID NO: 7178296 - DNA, 22 bp, Homo sapiens
ctcctgggcttcgaaggctccc

SEQ ID NO: 7178297 - DNA, 22 bp, Homo sapiens
ctcctgctgaatggccaggagc

SEQ ID NO: 7178298 - DNA, 22 bp, Homo sapiens
ctcctgctcctgcttgcaagga

SEQ ID NO: 7178299 - DNA, 22 bp, Homo sapiens
ctcctgcttcacgggcaccgcc

SEQ ID NO: 7178300 - DNA, 22 bp, Homo sapiens
ctcctggaagcccgccctgctg

SEQ ID NO: 7178301 - DNA, 22 bp, Homo sapiens
ctcctggaagcccgccctgctg

SEQ ID NO: 7178302 - DNA, 22 bp, Homo sapiens
ctcctgagctctgaggaagctt

SEQ ID NO: 7178303 - DNA, 22 bp, Homo sapiens
ctcctgagctgcagccttgtgt

SEQ ID NO: 7178304 - DNA, 22 bp, Homo sapiens
ctcctgagctgcagccttgtgt

SEQ ID NO: 7178305 - DNA, 22 bp, Homo sapiens
ctcctgcctgtgggactgagga

SEQ ID NO: 7178306 - DNA, 22 bp, Homo sapiens
ctcctgcctgtgggactgagga

SEQ ID NO: 7178307 - DNA, 22 bp, Homo sapiens
ctcctgcgggagctccgcctag

SEQ ID NO: 7178308 - DNA, 22 bp, Homo sapiens
tttacacataaatgtgtagaca

SEQ ID NO: 7178309 - DNA, 22 bp, Homo sapiens
tttacacagaggacactgggct

SEQ ID NO: 7178310 - DNA, 22 bp, Homo sapiens
tttacacatacctctttaaagt

SEQ ID NO: 7178311 - DNA, 22 bp, Homo sapiens
tttacacatacctctttaaagt

SEQ ID NO: 7178312 - DNA, 22 bp, Homo sapiens
tttacacatacctctttaaagt

SEQ ID NO: 7178313 - DNA, 22 bp, Homo sapiens
tttacacagaggacactgggct

SEQ ID NO: 7178314 - DNA, 22 bp, Homo sapiens
tttacacagaggacactgggct

SEQ ID NO: 7178315 - DNA, 22 bp, Homo sapiens
tttacacaaaatgttagtagat

SEQ ID NO: 7178316 - DNA, 22 bp, Homo sapiens
tttacacaaaagatagcacacc

SEQ ID NO: 7178317 - DNA, 22 bp, Homo sapiens
tttacacaaaatgttagtagat

SEQ ID NO: 7178318 - DNA, 20 bp, Homo sapiens
ctcctcagttccatgggagg

SEQ ID NO: 7178319 - DNA, 20 bp, Homo sapiens
ctcctcagttccatgggagg

SEQ ID NO: 7178320 - DNA, 22 bp, Homo sapiens
ctcctcagttgtcccatggaga

SEQ ID NO: 7178321 - DNA, 22 bp, Homo sapiens
ctcctcagttgtcccatggaga

SEQ ID NO: 7178322 - DNA, 22 bp, Homo sapiens
ctcctcagttgtcccatggaga

SEQ ID NO: 7178323 - DNA, 22 bp, Homo sapiens
tttacaatagggtctgaatgaa

SEQ ID NO: 7178324 - DNA, 22 bp, Homo sapiens
tttacaattctctaccagtgtt

SEQ ID NO: 7178325 - DNA, 22 bp, Homo sapiens
tttacaattctctaccagtgtt

SEQ ID NO: 7178326 - DNA, 22 bp, Homo sapiens
tttacacaaaagatagcacacc

SEQ ID NO: 7178327 - DNA, 22 bp, Homo sapiens
tttacaattggttttctctaat

SEQ ID NO: 7178328 - DNA, 22 bp, Homo sapiens
tttacacaaaagatagcacacc

SEQ ID NO: 7178329 - DNA, 22 bp, Homo sapiens
tttacacaaaagatagcacacc

SEQ ID NO: 7178330 - DNA, 22 bp, Homo sapiens
tttacaattggttttctctaat

SEQ ID NO: 7178331 - DNA, 22 bp, Homo sapiens
tttacaattggttttctctaat

SEQ ID NO: 7178332 - DNA, 22 bp, Homo sapiens
tttacaattggttttctctaat

SEQ ID NO: 7178333 - DNA, 22 bp, Homo sapiens
tttatatgtttgtacaattaag

SEQ ID NO: 7178334 - DNA, 22 bp, Homo sapiens
tttatatgtttgtacaattaag

SEQ ID NO: 7178335 - DNA, 22 bp, Homo sapiens
tttatatgtttgtacaattaag

SEQ ID NO: 7178336 - DNA, 22 bp, Homo sapiens
tttatatgtttgtacaattaag

SEQ ID NO: 7178337 - DNA, 22 bp, Homo sapiens
tttatatgtttgtacaattaag

SEQ ID NO: 7178338 - DNA, 22 bp, Homo sapiens
tttatatgtttgtacaattaag

SEQ ID NO: 7178339 - DNA, 22 bp, Homo sapiens
tttatatgtttgtacaattaag

SEQ ID NO: 7178340 - DNA, 22 bp, Homo sapiens
tttatatgtttgtacaattaag

SEQ ID NO: 7178341 - DNA, 22 bp, Homo sapiens
tttatatgtttgtacaattaag

SEQ ID NO: 7178342 - DNA, 22 bp, Homo sapiens
tttatatggttgactatgagtt

SEQ ID NO: 7178343 - DNA, 22 bp, Homo sapiens
tttatatggttgactatgagtt

SEQ ID NO: 7178344 - DNA, 22 bp, Homo sapiens
tttatatggttgactatgagtt

SEQ ID NO: 7178345 - DNA, 22 bp, Homo sapiens
tttatatgtattgactttgatg

SEQ ID NO: 7178346 - DNA, 22 bp, Homo sapiens
tttatatgtattgactttgatg

SEQ ID NO: 7178347 - DNA, 22 bp, Homo sapiens
tttatatgtattgactttgatg

SEQ ID NO: 7178348 - DNA, 22 bp, Homo sapiens
tttatatgtgaaggtttgcaga

SEQ ID NO: 7178349 - DNA, 22 bp, Homo sapiens
tttatatgtgaaggtttgcaga

SEQ ID NO: 7178350 - DNA, 22 bp, Homo sapiens
tttatatgtgaaggtttgcaga

SEQ ID NO: 7178351 - DNA, 18 bp, Homo sapiens
tttatatggatagagacc

SEQ ID NO: 7178352 - DNA, 18 bp, Homo sapiens
tttatatggatagagacc

SEQ ID NO: 7178353 - DNA, 18 bp, Homo sapiens
tttatatggatagagacc

SEQ ID NO: 7178354 - DNA, 22 bp, Homo sapiens
tttatatgaaagtgaccagtgg

SEQ ID NO: 7178355 - DNA, 22 bp, Homo sapiens
tttatatgaaagtgaccagtgg

SEQ ID NO: 7178356 - DNA, 22 bp, Homo sapiens
tttatatgaaagtgaccagtgg

SEQ ID NO: 7178357 - DNA, 18 bp, Homo sapiens
tttatatggatagagacc

SEQ ID NO: 7178358 - DNA, 18 bp, Homo sapiens
tttatatggatagagacc

SEQ ID NO: 7178359 - DNA, 18 bp, Homo sapiens
tttatatggatagagacc

SEQ ID NO: 7178360 - DNA, 22 bp, Homo sapiens
tttatatctggagttgctagga

SEQ ID NO: 7178361 - DNA, 22 bp, Homo sapiens
tttatatcttatgtcatttcaa

SEQ ID NO: 7178362 - DNA, 22 bp, Homo sapiens
tttatatccatctttgaagtaa

SEQ ID NO: 7178363 - DNA, 22 bp, Homo sapiens
ctcctggacatggagcggagga

SEQ ID NO: 7178364 - DNA, 22 bp, Homo sapiens
ctcctggaagcccgccctgctg

SEQ ID NO: 7178365 - DNA, 22 bp, Homo sapiens
ctcctggaagcccgccctgctg

SEQ ID NO: 7178366 - DNA, 22 bp, Homo sapiens
ctcctggaccaccttgtggcca

SEQ ID NO: 7178367 - DNA, 22 bp, Homo sapiens
ctcctggagcagcaggcgcagg

SEQ ID NO: 7178368 - DNA, 22 bp, Homo sapiens
ctcctggagcagcaggcgcagg

SEQ ID NO: 7178369 - DNA, 22 bp, Homo sapiens
ctcctggaggatagtgactggg

SEQ ID NO: 7178370 - DNA, 22 bp, Homo sapiens
ctcctggaggatagtgactggg

SEQ ID NO: 7178371 - DNA, 22 bp, Homo sapiens
ctcctggaggctccaagggaga

SEQ ID NO: 7178372 - DNA, 23 bp, Homo sapiens
ctcctggagggtccggccctgcc

SEQ ID NO: 7178373 - DNA, 23 bp, Homo sapiens
ctcctggagggtccggccctgcc

SEQ ID NO: 7178374 - DNA, 23 bp, Homo sapiens
ctcctggagggtccggccctgcc

SEQ ID NO: 7178375 - DNA, 22 bp, Homo sapiens
ctcctggatgcaggctgtctgc

SEQ ID NO: 7178376 - DNA, 22 bp, Homo sapiens
ctcctggatgcaggctgtctgc

SEQ ID NO: 7178377 - DNA, 22 bp, Homo sapiens
ctcaggctgccctgacagcccc

SEQ ID NO: 7178378 - DNA, 22 bp, Homo sapiens
ctcaggctctggccatccaagg

SEQ ID NO: 7178379 - DNA, 21 bp, Homo sapiens
ctcaggctggcagcaggctag

SEQ ID NO: 7178380 - DNA, 21 bp, Homo sapiens
ctcaggctggcagcaggctag

SEQ ID NO: 7178381 - DNA, 21 bp, Homo sapiens
ctcaggctggcagcaggctag

SEQ ID NO: 7178382 - DNA, 22 bp, Homo sapiens
ctcaggctggtccttagtgaca

SEQ ID NO: 7178383 - DNA, 22 bp, Homo sapiens
ctcaggctggtccttagtgaca

SEQ ID NO: 7178384 - DNA, 22 bp, Homo sapiens
ctcaggctgtgatgtgatggca

SEQ ID NO: 7178385 - DNA, 22 bp, Homo sapiens
ctcaggctgtgatgtgatggca

SEQ ID NO: 7178386 - DNA, 22 bp, Homo sapiens
ctcaggcttgggaggaggccca

SEQ ID NO: 7178387 - DNA, 22 bp, Homo sapiens
ctcaggcttgggaggaggccca

SEQ ID NO: 7178388 - DNA, 22 bp, Homo sapiens
ctccccaagtcatggagccagg

SEQ ID NO: 7178389 - DNA, 22 bp, Homo sapiens
ctcccattgcttcaaagatcct

SEQ ID NO: 7178390 - DNA, 22 bp, Homo sapiens
ctcccaggggaactatcaagta

SEQ ID NO: 7178391 - DNA, 22 bp, Homo sapiens
ctcccaggggaactatcaagta

SEQ ID NO: 7178392 - DNA, 22 bp, Homo sapiens
ctcccaggggaactatcaagta

SEQ ID NO: 7178393 - DNA, 22 bp, Homo sapiens
ctcccagtgttgttttctgatg

SEQ ID NO: 7178394 - DNA, 22 bp, Homo sapiens
ctcccagtgttgttttctgatg

SEQ ID NO: 7178395 - DNA, 22 bp, Homo sapiens
ctccccacacactaggcctgat

SEQ ID NO: 7178396 - DNA, 22 bp, Homo sapiens
ctccccacatttctccctgtct

SEQ ID NO: 7178397 - DNA, 22 bp, Homo sapiens
ctccccacatttctccctgtct

SEQ ID NO: 7178398 - DNA, 22 bp, Homo sapiens
ctccccacatttctccctgtct

SEQ ID NO: 7178399 - DNA, 22 bp, Homo sapiens
ctccccaccttcgcggtccctg

SEQ ID NO: 7178400 - DNA, 22 bp, Homo sapiens
ctccccaccttcgcggtccctg

SEQ ID NO: 7178401 - DNA, 22 bp, Homo sapiens
ctccccacgcctggactaagag

SEQ ID NO: 7178402 - DNA, 22 bp, Homo sapiens
ctccccagcattctgacttcct

SEQ ID NO: 7178403 - DNA, 22 bp, Homo sapiens
ctccccagcattctgacttcct

SEQ ID NO: 7178404 - DNA, 22 bp, Homo sapiens
ctccccagctcgcgggtgacgg

SEQ ID NO: 7178405 - DNA, 22 bp, Homo sapiens
ctccccagctcgcgggtgacgg

SEQ ID NO: 7178406 - DNA, 18 bp, Homo sapiens
ctccccagctgcccccag

SEQ ID NO: 7178407 - DNA, 18 bp, Homo sapiens
ctccccagctgcccccag

SEQ ID NO: 7178408 - DNA, 18 bp, Homo sapiens
ctccccagctgcccccag

SEQ ID NO: 7178409 - DNA, 22 bp, Homo sapiens
ctccccagcattctgacttcct

SEQ ID NO: 7178410 - DNA, 22 bp, Homo sapiens
ctccccagcattctgacttcct

SEQ ID NO: 7178411 - DNA, 22 bp, Homo sapiens
ctccccagcattctgacttcct

SEQ ID NO: 7178412 - DNA, 22 bp, Homo sapiens
ctccccagccctggtattctga

SEQ ID NO: 7178413 - DNA, 22 bp, Homo sapiens
ctccccagccctggtattctga

SEQ ID NO: 7178414 - DNA, 22 bp, Homo sapiens
ctccccaggttcaggaggtggg

SEQ ID NO: 7178415 - DNA, 22 bp, Homo sapiens
ctccccaggttcaggaggtggg

SEQ ID NO: 7178416 - DNA, 22 bp, Homo sapiens
ctccccaggttcaggaggtggg

SEQ ID NO: 7178417 - DNA, 22 bp, Homo sapiens
ttgtttaatatcgtgaagtact

SEQ ID NO: 7178418 - DNA, 22 bp, Homo sapiens
ttgtttaatatcgtgaagtact

SEQ ID NO: 7178419 - DNA, 23 bp, Homo sapiens
ctccccagtgtcctcatgcatct

SEQ ID NO: 7178420 - DNA, 22 bp, Homo sapiens
ttgtttaatatcgtgaagtact

SEQ ID NO: 7178421 - DNA, 22 bp, Homo sapiens
ttgtttaatgcctcatacatct

SEQ ID NO: 7178422 - DNA, 22 bp, Homo sapiens
ttgtttaatgcctcatacatct

SEQ ID NO: 7178423 - DNA, 22 bp, Homo sapiens
ttgtttaatgcctcatacatct

SEQ ID NO: 7178424 - DNA, 22 bp, Homo sapiens
ttgtttaatgcctcatacatct

SEQ ID NO: 7178425 - DNA, 22 bp, Homo sapiens
ttgtttaatgcctcatacatct

SEQ ID NO: 7178426 - DNA, 22 bp, Homo sapiens
ttgtttaatatcgtgaagtact

SEQ ID NO: 7178427 - DNA, 22 bp, Homo sapiens
ttgtttcaaatatttcagaata

SEQ ID NO: 7178428 - DNA, 22 bp, Homo sapiens
ttgtttcagcccagatctttac

SEQ ID NO: 7178429 - DNA, 22 bp, Homo sapiens
ttgtttcagcccagatctttac

SEQ ID NO: 7178430 - DNA, 22 bp, Homo sapiens
ttgtttcaaatatttcagaata

SEQ ID NO: 7178431 - DNA, 22 bp, Homo sapiens
ttgtttcaaatatttcagaata

SEQ ID NO: 7178432 - DNA, 22 bp, Homo sapiens
ttgtttcagcccagatctttac

SEQ ID NO: 7178433 - DNA, 22 bp, Homo sapiens
ttgtttcagcccagatctttac

SEQ ID NO: 7178434 - DNA, 22 bp, Homo sapiens
ttgtttcagctgtatgctatgt

SEQ ID NO: 7178435 - DNA, 22 bp, Homo sapiens
ttgtttcagctgtatgctatgt

SEQ ID NO: 7178436 - DNA, 22 bp, Homo sapiens
ctccctcacaaagcattctctt

SEQ ID NO: 7178437 - DNA, 22 bp, Homo sapiens
ttgtttatgtgttgtctatggc

SEQ ID NO: 7178438 - DNA, 22 bp, Homo sapiens
ttgtttatgtgttgtctatggc

SEQ ID NO: 7178439 - DNA, 22 bp, Homo sapiens
ttgtttatgtgttgtctatggc

SEQ ID NO: 7178440 - DNA, 20 bp, Homo sapiens
ttgtttattatgttctgatc

SEQ ID NO: 7178441 - DNA, 22 bp, Homo sapiens
ttgtttatcgcttgctcacata

SEQ ID NO: 7178442 - DNA, 22 bp, Homo sapiens
ttgtttatcgcttgctcacata

SEQ ID NO: 7178443 - DNA, 22 bp, Homo sapiens
ttgtttaatgcctcatacatct

SEQ ID NO: 7178444 - DNA, 22 bp, Homo sapiens
ttgtttacactgcagaattggg

SEQ ID NO: 7178445 - DNA, 22 bp, Homo sapiens
ctccctgcttgtttcccttcag

SEQ ID NO: 7178446 - DNA, 22 bp, Homo sapiens
ctccctgcttgtttcccttcag

SEQ ID NO: 7178447 - DNA, 22 bp, Homo sapiens
ctccctggaggtgagctggcac

SEQ ID NO: 7178448 - DNA, 22 bp, Homo sapiens
ctccctggaggtgagctggcac

SEQ ID NO: 7178449 - DNA, 22 bp, Homo sapiens
ctccctgaggacaggccctgtc

SEQ ID NO: 7178450 - DNA, 22 bp, Homo sapiens
ctccctgacctggattccaggc

SEQ ID NO: 7178451 - DNA, 22 bp, Homo sapiens
ctccctgccctgtgagttggcc

SEQ ID NO: 7178452 - DNA, 22 bp, Homo sapiens
ctccctgaggacaggccctgtc

SEQ ID NO: 7178453 - DNA, 22 bp, Homo sapiens
ctccctgagtttgtggctaagt

SEQ ID NO: 7178454 - DNA, 22 bp, Homo sapiens
ctccctcacacccttgcccaga

SEQ ID NO: 7178455 - DNA, 22 bp, Homo sapiens
ctccctcacacccttgcccaga

SEQ ID NO: 7178456 - DNA, 22 bp, Homo sapiens
ctccctcacacccttgcccaga

SEQ ID NO: 7178457 - DNA, 22 bp, Homo sapiens
ctccctctgtcttgtccagaaa

SEQ ID NO: 7178458 - DNA, 22 bp, Homo sapiens
ctccctctgtcttgtccagaaa

SEQ ID NO: 7178459 - DNA, 22 bp, Homo sapiens
ctccctctgtcttgtccagaaa

SEQ ID NO: 7178460 - DNA, 23 bp, Homo sapiens
ctccctggagtttctggaagatg

SEQ ID NO: 7178461 - DNA, 22 bp, Homo sapiens
ctccctggcacagcgagaggtt

SEQ ID NO: 7178462 - DNA, 22 bp, Homo sapiens
ctccctggcagccgcactcctg

SEQ ID NO: 7178463 - DNA, 22 bp, Homo sapiens
ctccctggcagccgcactcctg

SEQ ID NO: 7178464 - DNA, 23 bp, Homo sapiens
ctccctggcccttgggagacctg

SEQ ID NO: 7178465 - DNA, 22 bp, Homo sapiens
ctccctggctttgtcctgaggc

SEQ ID NO: 7178466 - DNA, 22 bp, Homo sapiens
ctccctgggcagatgtggctct

SEQ ID NO: 7178467 - DNA, 22 bp, Homo sapiens
ctccctgggcctcagtttctct

SEQ ID NO: 7178468 - DNA, 22 bp, Homo sapiens
ctccctgggcagatgtggctct

SEQ ID NO: 7178469 - DNA, 19 bp, Homo sapiens
ctcctcagtcccagaggtc

SEQ ID NO: 7178470 - DNA, 19 bp, Homo sapiens
ctcctcagtcccagaggtc

SEQ ID NO: 7178471 - DNA, 20 bp, Homo sapiens
ctcctcagttccatgggagg

SEQ ID NO: 7178472 - DNA, 20 bp, Homo sapiens
ctcctcagttccatgggagg

SEQ ID NO: 7178473 - DNA, 22 bp, Homo sapiens
ctcctcagtcaggtctagggtc

SEQ ID NO: 7178474 - DNA, 19 bp, Homo sapiens
ctcctcagtcccagaggtc

SEQ ID NO: 7178475 - DNA, 19 bp, Homo sapiens
ctcctcagtcccagaggtc

SEQ ID NO: 7178476 - DNA, 21 bp, Homo sapiens
ctcctcaggaccagccacagg

SEQ ID NO: 7178477 - DNA, 22 bp, Homo sapiens
ctcctcagggctggttacatgg

SEQ ID NO: 7178478 - DNA, 22 bp, Homo sapiens
ctcctcagtcaggtctagggtc

SEQ ID NO: 7178479 - DNA, 22 bp, Homo sapiens
ctcctcagtcaggtctagggtc

SEQ ID NO: 7178480 - DNA, 21 bp, Homo sapiens
ctcctcaggaccagccacagg

SEQ ID NO: 7178481 - DNA, 21 bp, Homo sapiens
ctcctcaggaccagccacagg

SEQ ID NO: 7178482 - DNA, 21 bp, Homo sapiens
ctcctcaggaccagccacagg

SEQ ID NO: 7178483 - DNA, 22 bp, Homo sapiens
ctcctcagctgggaggagtccc

SEQ ID NO: 7178484 - DNA, 22 bp, Homo sapiens
ctcctcaggaagtagcatgtgt

SEQ ID NO: 7178485 - DNA, 21 bp, Homo sapiens
ctcctcaggaccagccacagg

SEQ ID NO: 7178486 - DNA, 22 bp, Homo sapiens
ctccggagagcagacgagggca

SEQ ID NO: 7178487 - DNA, 22 bp, Homo sapiens
ctccgaacagtggctccaaggc

SEQ ID NO: 7178488 - DNA, 22 bp, Homo sapiens
ctcccttcaggagaggctcaca

SEQ ID NO: 7178489 - DNA, 22 bp, Homo sapiens
ctcccttcaggagaggctcaca

SEQ ID NO: 7178490 - DNA, 22 bp, Homo sapiens
ctcccttccaatgactatgctt

SEQ ID NO: 7178491 - DNA, 22 bp, Homo sapiens
ctccctggtgtcccctccagga

SEQ ID NO: 7178492 - DNA, 22 bp, Homo sapiens
ctccctgtgctcagagccctgc

SEQ ID NO: 7178493 - DNA, 22 bp, Homo sapiens
ctccctgtgctcagagccctgc

SEQ ID NO: 7178494 - DNA, 22 bp, Homo sapiens
ctccctggtgtcccctccagga

SEQ ID NO: 7178495 - DNA, 22 bp, Homo sapiens
ctccctggtgtcccctccagga

SEQ ID NO: 7178496 - DNA, 22 bp, Homo sapiens
ctccctggggctcctcctattt

SEQ ID NO: 7178497 - DNA, 22 bp, Homo sapiens
ctccctggtctttcccatcatt

SEQ ID NO: 7178498 - DNA, 22 bp, Homo sapiens
ctccctggtgactcccaaagct

SEQ ID NO: 7178499 - DNA, 19 bp, Homo sapiens
ctctggagcagacactgga

SEQ ID NO: 7178500 - DNA, 22 bp, Homo sapiens
ctctggaattgacctgggaggg

SEQ ID NO: 7178501 - DNA, 22 bp, Homo sapiens
ctctggaattgacctgggaggg

SEQ ID NO: 7178502 - DNA, 22 bp, Homo sapiens
ctctggaattgacctgggaggg

SEQ ID NO: 7178503 - DNA, 19 bp, Homo sapiens
ctctggagcagacactgga

SEQ ID NO: 7178504 - DNA, 19 bp, Homo sapiens
ctctggagcagacactgga

SEQ ID NO: 7178505 - DNA, 22 bp, Homo sapiens
ctctggagcatttcacctacat

SEQ ID NO: 7178506 - DNA, 22 bp, Homo sapiens
ctctggagcatttcacctacat

SEQ ID NO: 7178507 - DNA, 22 bp, Homo sapiens
ctctggagcgctgcttcccgcg

SEQ ID NO: 7178508 - DNA, 22 bp, Homo sapiens
tttgaataaacggttaatgttc

SEQ ID NO: 7178509 - DNA, 22 bp, Homo sapiens
tttgaataaacggttaatgttc

SEQ ID NO: 7178510 - DNA, 22 bp, Homo sapiens
ctctggaattaaggaagcctgt

SEQ ID NO: 7178511 - DNA, 22 bp, Homo sapiens
ctctggaattgacctgggaggg

SEQ ID NO: 7178512 - DNA, 22 bp, Homo sapiens
tttgaataaacggttaatgttc

SEQ ID NO: 7178513 - DNA, 22 bp, Homo sapiens
tttgaataaacggttaatgttc

SEQ ID NO: 7178514 - DNA, 22 bp, Homo sapiens
tttgaagttcccccatatcaga

SEQ ID NO: 7178515 - DNA, 22 bp, Homo sapiens
tttgaagtgttatttctatcac

SEQ ID NO: 7178516 - DNA, 22 bp, Homo sapiens
tttgaagtgtatgaaaatacag

SEQ ID NO: 7178517 - DNA, 22 bp, Homo sapiens
tttgaagtgtatgaaaatacag

SEQ ID NO: 7178518 - DNA, 22 bp, Homo sapiens
tttgaagtgggcattagaacct

SEQ ID NO: 7178519 - DNA, 22 bp, Homo sapiens
tttgaagtgggcattagaacct

SEQ ID NO: 7178520 - DNA, 22 bp, Homo sapiens
tttgaagtggatcccttcagtg

SEQ ID NO: 7178521 - DNA, 22 bp, Homo sapiens
tttgaagtgctctggtgatctg

SEQ ID NO: 7178522 - DNA, 22 bp, Homo sapiens
tttgaagtggaaaaggatttaa

SEQ ID NO: 7178523 - DNA, 22 bp, Homo sapiens
tttgaagtcaggctttctaccc

SEQ ID NO: 7178524 - DNA, 22 bp, Homo sapiens
tttgaagtgcaatgaggattct

SEQ ID NO: 7178525 - DNA, 22 bp, Homo sapiens
tttgaagtgcctcttgtggatt

SEQ ID NO: 7178526 - DNA, 22 bp, Homo sapiens
tttgaagtcagacactgctttg

SEQ ID NO: 7178527 - DNA, 22 bp, Homo sapiens
tttgaagtcagatggtctgagt

SEQ ID NO: 7178528 - DNA, 22 bp, Homo sapiens
tttgaagtcagatggtctgagt

SEQ ID NO: 7178529 - DNA, 22 bp, Homo sapiens
tttgaagtcaggctttctaccc

SEQ ID NO: 7178530 - DNA, 22 bp, Homo sapiens
tttgaagggcacgacaatagtt

SEQ ID NO: 7178531 - DNA, 22 bp, Homo sapiens
tttgaagggcacgacaatagtt

SEQ ID NO: 7178532 - DNA, 22 bp, Homo sapiens
tttgaagggcacgacaatagtt

SEQ ID NO: 7178533 - DNA, 22 bp, Homo sapiens
tttgaagggcacgacaatagtt

SEQ ID NO: 7178534 - DNA, 22 bp, Homo sapiens
tttgaagtacctggttctgact

SEQ ID NO: 7178535 - DNA, 22 bp, Homo sapiens
tttgaagtacctggttctgact

SEQ ID NO: 7178536 - DNA, 22 bp, Homo sapiens
tttgaagtcaaagattgattcc

SEQ ID NO: 7178537 - DNA, 22 bp, Homo sapiens
tttgaagtcaaagattgattcc

SEQ ID NO: 7178538 - DNA, 22 bp, Homo sapiens
tttgaagtcaaagattgattcc

SEQ ID NO: 7178539 - DNA, 22 bp, Homo sapiens
ctctggagtcaggcagccctgg

SEQ ID NO: 7178540 - DNA, 21 bp, Homo sapiens
ctctggagtcaagagcttcca

SEQ ID NO: 7178541 - DNA, 22 bp, Homo sapiens
ctctggagtaagagctatgaaa

SEQ ID NO: 7178542 - DNA, 21 bp, Homo sapiens
ctctggagtcaagagcttcca

SEQ ID NO: 7178543 - DNA, 22 bp, Homo sapiens
ctctggagtcaggcagccctgg

SEQ ID NO: 7178544 - DNA, 22 bp, Homo sapiens
ctctggagtcaggcagccctgg

SEQ ID NO: 7178545 - DNA, 19 bp, Homo sapiens
ctctggagtcattgctccc

SEQ ID NO: 7178546 - DNA, 22 bp, Homo sapiens
ctctggagtaagagctatgaaa

SEQ ID NO: 7178547 - DNA, 22 bp, Homo sapiens
ctctggaggttgagcccagcaa

SEQ ID NO: 7178548 - DNA, 22 bp, Homo sapiens
ctctggaggttgagcccagcaa

SEQ ID NO: 7178549 - DNA, 22 bp, Homo sapiens
ctctggaggtggaggttgcagt

SEQ ID NO: 7178550 - DNA, 22 bp, Homo sapiens
ctctggaggttgagcccagcaa

SEQ ID NO: 7178551 - DNA, 22 bp, Homo sapiens
ctctggaggtcaggtgtggtgg

SEQ ID NO: 7178552 - DNA, 22 bp, Homo sapiens
ctctggaggtcaggtgtggtgg

SEQ ID NO: 7178553 - DNA, 22 bp, Homo sapiens
ctctggaggcctaaggaagtgg

SEQ ID NO: 7178554 - DNA, 22 bp, Homo sapiens
ctctggaggcctaaggaagtgg

SEQ ID NO: 7178555 - DNA, 22 bp, Homo sapiens
ctctggaggcctaaggaagtgg

SEQ ID NO: 7178556 - DNA, 19 bp, Homo sapiens
ctctggagggaccgccgtt

SEQ ID NO: 7178557 - DNA, 19 bp, Homo sapiens
ctctggagggaccgccgtt

SEQ ID NO: 7178558 - DNA, 22 bp, Homo sapiens
ctctggagggaggctgagctgg

SEQ ID NO: 7178559 - DNA, 22 bp, Homo sapiens
ctctggagggaggctgagctgg

SEQ ID NO: 7178560 - DNA, 22 bp, Homo sapiens
ctctggaggccgttggccctta

SEQ ID NO: 7178561 - DNA, 22 bp, Homo sapiens
ctctggaggcagcaccagccag

SEQ ID NO: 7178562 - DNA, 22 bp, Homo sapiens
ctctggaggcagcaccagccag

SEQ ID NO: 7178563 - DNA, 22 bp, Homo sapiens
ctctggaggccgttggccctta

SEQ ID NO: 7178564 - DNA, 22 bp, Homo sapiens
ctctggagcgctgcttcccgcg

SEQ ID NO: 7178565 - DNA, 21 bp, Homo sapiens
ctctggaggcaagggagagtg

SEQ ID NO: 7178566 - DNA, 21 bp, Homo sapiens
ctctggaggcaagggagagtg

SEQ ID NO: 7178567 - DNA, 21 bp, Homo sapiens
ctctggaggcaagggagagtg

SEQ ID NO: 7178568 - DNA, 21 bp, Homo sapiens
ctctggaggcaagggagagtg

SEQ ID NO: 7178569 - DNA, 21 bp, Homo sapiens
ctctggaggcaagggagagtg

SEQ ID NO: 7178570 - DNA, 22 bp, Homo sapiens
ctctggaggcagcaccagccag

SEQ ID NO: 7178571 - DNA, 22 bp, Homo sapiens
ctctgcttgtatcacatttgct

SEQ ID NO: 7178572 - DNA, 22 bp, Homo sapiens
ctctgcttgtgtcaggcatgct

SEQ ID NO: 7178573 - DNA, 22 bp, Homo sapiens
ctctgcttggaactggacagaa

SEQ ID NO: 7178574 - DNA, 19 bp, Homo sapiens
ctctgcttggtccatatgc

SEQ ID NO: 7178575 - DNA, 22 bp, Homo sapiens
ctctgcttctgagatggaagct

SEQ ID NO: 7178576 - DNA, 22 bp, Homo sapiens
ctctgcttctgagatggaagct

SEQ ID NO: 7178577 - DNA, 22 bp, Homo sapiens
ctctgctgttttgtatacaggc

SEQ ID NO: 7178578 - DNA, 22 bp, Homo sapiens
ctctgctgtgccgccagggcct

SEQ ID NO: 7178579 - DNA, 22 bp, Homo sapiens
ctctgctgtgccgccagggcct

SEQ ID NO: 7178580 - DNA, 22 bp, Homo sapiens
ctctgctgtgccgccagggcct

SEQ ID NO: 7178581 - DNA, 22 bp, Homo sapiens
ctctgctggtgaccactgggcc

SEQ ID NO: 7178582 - DNA, 21 bp, Homo sapiens
ctctgctgtctaccagctgtt

SEQ ID NO: 7178583 - DNA, 21 bp, Homo sapiens
ctctgctgtctaccagctgtt

SEQ ID NO: 7178584 - DNA, 22 bp, Homo sapiens
ctctgctggcagcccccgggcc

SEQ ID NO: 7178585 - DNA, 22 bp, Homo sapiens
ctctgctggccatgaagagaga

SEQ ID NO: 7178586 - DNA, 22 bp, Homo sapiens
ctctgctgctttgccagtggaa

SEQ ID NO: 7178587 - DNA, 22 bp, Homo sapiens
ctctgctgctttgccagtggaa

SEQ ID NO: 7178588 - DNA, 20 bp, Homo sapiens
ctctgctgcccgccggctgc

SEQ ID NO: 7178589 - DNA, 20 bp, Homo sapiens
ctctgctgcgcatcccactt

SEQ ID NO: 7178590 - DNA, 22 bp, Homo sapiens
ctctgctgcccaggcctgctag

SEQ ID NO: 7178591 - DNA, 22 bp, Homo sapiens
ctctgcctgccactgttcaggc

SEQ ID NO: 7178592 - DNA, 22 bp, Homo sapiens
ctctgcctgccactgttcaggc

SEQ ID NO: 7178593 - DNA, 22 bp, Homo sapiens
ctctgctgcccaggcctgctag

SEQ ID NO: 7178594 - DNA, 22 bp, Homo sapiens
ctctgctgcccatgatggtata

SEQ ID NO: 7178595 - DNA, 22 bp, Homo sapiens
tttcttgagtgatgcttagtgt

SEQ ID NO: 7178596 - DNA, 22 bp, Homo sapiens
tttcttgagtgatgcttagtgt

SEQ ID NO: 7178597 - DNA, 22 bp, Homo sapiens
tttcttgattagctgtggctca

SEQ ID NO: 7178598 - DNA, 22 bp, Homo sapiens
tttcttgattagctgtggctca

SEQ ID NO: 7178599 - DNA, 19 bp, Homo sapiens
ctctgcctctggctgtggc

SEQ ID NO: 7178600 - DNA, 22 bp, Homo sapiens
tttcttgactgcttaggaatgc

SEQ ID NO: 7178601 - DNA, 22 bp, Homo sapiens
tttcttgactgcttaggaatgc

SEQ ID NO: 7178602 - DNA, 22 bp, Homo sapiens
tttcttgagcccaggaggtgga

SEQ ID NO: 7178603 - DNA, 22 bp, Homo sapiens
tttcttgaccactatgttgata

SEQ ID NO: 7178604 - DNA, 22 bp, Homo sapiens
tttcttctttcccagtgatggg

SEQ ID NO: 7178605 - DNA, 22 bp, Homo sapiens
tttcttcttgatttaaacaggg

SEQ ID NO: 7178606 - DNA, 22 bp, Homo sapiens
tttcttcttgatttaaacaggg

SEQ ID NO: 7178607 - DNA, 22 bp, Homo sapiens
tttcttcttaatactggctgct

SEQ ID NO: 7178608 - DNA, 22 bp, Homo sapiens
tttcttcttgagtaaccagatt

SEQ ID NO: 7178609 - DNA, 22 bp, Homo sapiens
tttcttcttgagtaaccagatt

SEQ ID NO: 7178610 - DNA, 22 bp, Homo sapiens
tttcttagggactgtaaaatag

SEQ ID NO: 7178611 - DNA, 22 bp, Homo sapiens
tttcttagtcctagagtgattt

SEQ ID NO: 7178612 - DNA, 22 bp, Homo sapiens
tttcttaggctctaaaatgact

SEQ ID NO: 7178613 - DNA, 21 bp, Homo sapiens
tttcttaggctctaaaatgac

SEQ ID NO: 7178614 - DNA, 21 bp, Homo sapiens
tttcttaggctctaaaatgac

SEQ ID NO: 7178615 - DNA, 21 bp, Homo sapiens
tttcttaggctctaaaatgac

SEQ ID NO: 7178616 - DNA, 22 bp, Homo sapiens
tttcttagcgatgcttgataaa

SEQ ID NO: 7178617 - DNA, 22 bp, Homo sapiens
tttcttagcgatgcttgataaa

SEQ ID NO: 7178618 - DNA, 22 bp, Homo sapiens
tttcttagcgatgcttgataaa

SEQ ID NO: 7178619 - DNA, 19 bp, Homo sapiens
tttctgtttgcttctggtt

SEQ ID NO: 7178620 - DNA, 22 bp, Homo sapiens
tttcttaatttgagttccacta

SEQ ID NO: 7178621 - DNA, 22 bp, Homo sapiens
tttcttatactatattgtcatc

SEQ ID NO: 7178622 - DNA, 22 bp, Homo sapiens
tttcttatactatattgtcatc

SEQ ID NO: 7178623 - DNA, 22 bp, Homo sapiens
tttcttatactatattgtcatc

SEQ ID NO: 7178624 - DNA, 22 bp, Homo sapiens
tttcttatattctgtcattgtt

SEQ ID NO: 7178625 - DNA, 22 bp, Homo sapiens
tttcttatattctgtcattgtt

SEQ ID NO: 7178626 - DNA, 22 bp, Homo sapiens
tttcttatattctgtcattgtt

SEQ ID NO: 7178627 - DNA, 22 bp, Homo sapiens
tttcttctgtttgtagttacac

SEQ ID NO: 7178628 - DNA, 22 bp, Homo sapiens
tttcttctgtttgtagttacac

SEQ ID NO: 7178629 - DNA, 22 bp, Homo sapiens
tttcttctgtttgtagttacac

SEQ ID NO: 7178630 - DNA, 22 bp, Homo sapiens
tttcttctgtttgtagttacac

SEQ ID NO: 7178631 - DNA, 22 bp, Homo sapiens
tttctctattaggggctagctt

SEQ ID NO: 7178632 - DNA, 22 bp, Homo sapiens
ctctcaaagtaaggtgtataca

SEQ ID NO: 7178633 - DNA, 22 bp, Homo sapiens
ctctcaaatgtaatttgaggtt

SEQ ID NO: 7178634 - DNA, 22 bp, Homo sapiens
ctctcaaatgtcattcctctat

SEQ ID NO: 7178635 - DNA, 22 bp, Homo sapiens
ctctcaaatgtcattcctctat

SEQ ID NO: 7178636 - DNA, 20 bp, Homo sapiens
ctctcacagctccctcagcc

SEQ ID NO: 7178637 - DNA, 20 bp, Homo sapiens
ctctcacagctccctcagcc

SEQ ID NO: 7178638 - DNA, 20 bp, Homo sapiens
ctctcacagctccctcagcc

SEQ ID NO: 7178639 - DNA, 20 bp, Homo sapiens
ctctcacagctccctcagcc

SEQ ID NO: 7178640 - DNA, 22 bp, Homo sapiens
tttctcacccaagagttatttt

SEQ ID NO: 7178641 - DNA, 22 bp, Homo sapiens
ctctcaaagaaattgcctgtca

SEQ ID NO: 7178642 - DNA, 22 bp, Homo sapiens
ctctatttatggcatctttatg

SEQ ID NO: 7178643 - DNA, 22 bp, Homo sapiens
ctctattctaatggattctggg

SEQ ID NO: 7178644 - DNA, 22 bp, Homo sapiens
ctctatttatggcatctttatg

SEQ ID NO: 7178645 - DNA, 22 bp, Homo sapiens
ctctattagtctttgctaaata

SEQ ID NO: 7178646 - DNA, 20 bp, Homo sapiens
ctctattattaatttcttaa

SEQ ID NO: 7178647 - DNA, 22 bp, Homo sapiens
ctctagtgtagtgcaggaagga

SEQ ID NO: 7178648 - DNA, 19 bp, Homo sapiens
ctctagggtctaagggcag

SEQ ID NO: 7178649 - DNA, 22 bp, Homo sapiens
ctctacagctgctgcccctggt

SEQ ID NO: 7178650 - DNA, 21 bp, Homo sapiens
ctctacattcccagcaactct

SEQ ID NO: 7178651 - DNA, 22 bp, Homo sapiens
ctctaccttcctgtccactgaa

SEQ ID NO: 7178652 - DNA, 22 bp, Homo sapiens
ctctactccaaaaggctacaat

SEQ ID NO: 7178653 - DNA, 22 bp, Homo sapiens
ctctactccaaaaggctacaat

SEQ ID NO: 7178654 - DNA, 22 bp, Homo sapiens
ctctactcttaacacagctagg

SEQ ID NO: 7178655 - DNA, 22 bp, Homo sapiens
ctctagaaagattgttgaccaa

SEQ ID NO: 7178656 - DNA, 21 bp, Homo sapiens
ctctagaaatcgaataacctt

SEQ ID NO: 7178657 - DNA, 21 bp, Homo sapiens
ctctagaaatcgaataacctt

SEQ ID NO: 7178658 - DNA, 22 bp, Homo sapiens
ctctagaacagtgctgagcctt

SEQ ID NO: 7178659 - DNA, 22 bp, Homo sapiens
ctctagaactgattgggaagaa

SEQ ID NO: 7178660 - DNA, 22 bp, Homo sapiens
ctctagaacagtgctgagcctt

SEQ ID NO: 7178661 - DNA, 22 bp, Homo sapiens
ctctagaactgattgggaagaa

SEQ ID NO: 7178662 - DNA, 22 bp, Homo sapiens
ctctagaagctgaggggcccaa

SEQ ID NO: 7178663 - DNA, 22 bp, Homo sapiens
ctctagaaggtctccctgccag

SEQ ID NO: 7178664 - DNA, 22 bp, Homo sapiens
ctctagaatgaattagcgcagg

SEQ ID NO: 7178665 - DNA, 22 bp, Homo sapiens
ctctagaatgaattagcgcagg

SEQ ID NO: 7178666 - DNA, 18 bp, Homo sapiens
ctctagaatgggagattt

SEQ ID NO: 7178667 - DNA, 22 bp, Homo sapiens
ctctagaggcttgaatgggcga

SEQ ID NO: 7178668 - DNA, 22 bp, Homo sapiens
ctctagcagcagcccttcctta

SEQ ID NO: 7178669 - DNA, 22 bp, Homo sapiens
ctctagctcccagggagcgtct

SEQ ID NO: 7178670 - DNA, 22 bp, Homo sapiens
ctctagctgaggtcactgctat

SEQ ID NO: 7178671 - DNA, 22 bp, Homo sapiens
ctctagcttttgataccagtgt

SEQ ID NO: 7178672 - DNA, 22 bp, Homo sapiens
ctctagcttttgataccagtgt

SEQ ID NO: 7178673 - DNA, 22 bp, Homo sapiens
ctctaggccatccagggccatt

SEQ ID NO: 7178674 - DNA, 22 bp, Homo sapiens
ctctaggctgcccaggagctga

SEQ ID NO: 7178675 - DNA, 22 bp, Homo sapiens
tttctctcttaaggagtttaaa

SEQ ID NO: 7178676 - DNA, 22 bp, Homo sapiens
tttctctctggccctgattgtc

SEQ ID NO: 7178677 - DNA, 22 bp, Homo sapiens
tttctctctggccctgattgtc

SEQ ID NO: 7178678 - DNA, 22 bp, Homo sapiens
tttctctctatttagacaggta

SEQ ID NO: 7178679 - DNA, 22 bp, Homo sapiens
tttctctctacagtactttcat

SEQ ID NO: 7178680 - DNA, 19 bp, Homo sapiens
tttctctccctcatcccga

SEQ ID NO: 7178681 - DNA, 22 bp, Homo sapiens
tttctctcctccaaaccaaaga

SEQ ID NO: 7178682 - DNA, 19 bp, Homo sapiens
tttctctccctcatcccga

SEQ ID NO: 7178683 - DNA, 22 bp, Homo sapiens
tttctctccccaagtggaattg

SEQ ID NO: 7178684 - DNA, 22 bp, Homo sapiens
tttctctcagcctgtagaaact

SEQ ID NO: 7178685 - DNA, 22 bp, Homo sapiens
tttctctgctgtgttggcagct

SEQ ID NO: 7178686 - DNA, 20 bp, Homo sapiens
ctctctggaaggtgggagcc

SEQ ID NO: 7178687 - DNA, 20 bp, Homo sapiens
ctctctggaaggtgggagcc

SEQ ID NO: 7178688 - DNA, 22 bp, Homo sapiens
ctctctggaagggggagctgat

SEQ ID NO: 7178689 - DNA, 22 bp, Homo sapiens
tttctctggcattaggtataaa

SEQ ID NO: 7178690 - DNA, 22 bp, Homo sapiens
tttctctggcctcagtttaaca

SEQ ID NO: 7178691 - DNA, 22 bp, Homo sapiens
ctctctggacttgagtatcagc

SEQ ID NO: 7178692 - DNA, 22 bp, Homo sapiens
ctctctggacttgagtatcagc

SEQ ID NO: 7178693 - DNA, 22 bp, Homo sapiens
ctctctggacttgagtatcagc

SEQ ID NO: 7178694 - DNA, 22 bp, Homo sapiens
ctctctggaattaaagcccaat

SEQ ID NO: 7178695 - DNA, 22 bp, Homo sapiens
ctctctggacctcaactatttt

SEQ ID NO: 7178696 - DNA, 20 bp, Homo sapiens
ctctctggaaggtgggagcc

SEQ ID NO: 7178697 - DNA, 20 bp, Homo sapiens
ctctctggaaggtgggagcc

SEQ ID NO: 7178698 - DNA, 20 bp, Homo sapiens
ctctctggaaggtgggagcc

SEQ ID NO: 7178699 - DNA, 22 bp, Homo sapiens
ctctctggaattaaagcccaat

SEQ ID NO: 7178700 - DNA, 22 bp, Homo sapiens
ctctgagctcgtgcagtacttc

SEQ ID NO: 7178701 - DNA, 22 bp, Homo sapiens
ctctgagctcgtgcagtacttc

SEQ ID NO: 7178702 - DNA, 22 bp, Homo sapiens
ctctgagctgaaacatgagcat

SEQ ID NO: 7178703 - DNA, 22 bp, Homo sapiens
ctctgagctcgtgcagtacttc

SEQ ID NO: 7178704 - DNA, 22 bp, Homo sapiens
ctctgagctgaaacatgagcat

SEQ ID NO: 7178705 - DNA, 22 bp, Homo sapiens
ctctctggcccatcctgttgcc

SEQ ID NO: 7178706 - DNA, 22 bp, Homo sapiens
ctctctggcccatcctgttgcc

SEQ ID NO: 7178707 - DNA, 22 bp, Homo sapiens
ctctctggcacttcattgctgt

SEQ ID NO: 7178708 - DNA, 22 bp, Homo sapiens
ctctctggcacttcattgctgt

SEQ ID NO: 7178709 - DNA, 22 bp, Homo sapiens
ctctctggatatttgtatgctg

SEQ ID NO: 7178710 - DNA, 22 bp, Homo sapiens
ctctctggcacttcattgctgt

SEQ ID NO: 7178711 - DNA, 22 bp, Homo sapiens
ctctgagctgaaacatgagcat

SEQ ID NO: 7178712 - DNA, 22 bp, Homo sapiens
ctctgagctttgcagcccctgg

SEQ ID NO: 7178713 - DNA, 22 bp, Homo sapiens
ctctgaggctccatgcaggctt

SEQ ID NO: 7178714 - DNA, 22 bp, Homo sapiens
ctctgaggctccatgcaggctt

SEQ ID NO: 7178715 - DNA, 22 bp, Homo sapiens
ctctgaggctccatgcaggctt

SEQ ID NO: 7178716 - DNA, 22 bp, Homo sapiens
ctctgaggctccatgcaggctt

SEQ ID NO: 7178717 - DNA, 22 bp, Homo sapiens
ctctgagggctcgagggacgcg

SEQ ID NO: 7178718 - DNA, 22 bp, Homo sapiens
ctctgagggtctaaggagtcac

SEQ ID NO: 7178719 - DNA, 22 bp, Homo sapiens
ctctgagggtctaaggagtcac

SEQ ID NO: 7178720 - DNA, 22 bp, Homo sapiens
ctctgagggtctaaggagtcac

SEQ ID NO: 7178721 - DNA, 22 bp, Homo sapiens
ctctgaggtcagggcccggcaa

SEQ ID NO: 7178722 - DNA, 22 bp, Homo sapiens
ctctgaggtcctacagtgaccc

SEQ ID NO: 7178723 - DNA, 19 bp, Homo sapiens
tttctgtttgcttctggtt

SEQ ID NO: 7178724 - DNA, 22 bp, Homo sapiens
tttctgttgtacttaaactagg

SEQ ID NO: 7178725 - DNA, 22 bp, Homo sapiens
tttctgttgtatggcttctgca

SEQ ID NO: 7178726 - DNA, 22 bp, Homo sapiens
tttctgttgtatggcttctgca

SEQ ID NO: 7178727 - DNA, 22 bp, Homo sapiens
tttctgttgttggtgtctggct

SEQ ID NO: 7178728 - DNA, 22 bp, Homo sapiens
tttctgcatatgtatgtatgga

SEQ ID NO: 7178729 - DNA, 22 bp, Homo sapiens
tttctgcatctctacagttgtt

SEQ ID NO: 7178730 - DNA, 22 bp, Homo sapiens
tttctgcatctctacagttgtt

SEQ ID NO: 7178731 - DNA, 19 bp, Homo sapiens
tttctgcagcccagcagca

SEQ ID NO: 7178732 - DNA, 22 bp, Homo sapiens
tttctgcaggtattgcataagt

SEQ ID NO: 7178733 - DNA, 22 bp, Homo sapiens
tttctgcaggtattgcataagt

SEQ ID NO: 7178734 - DNA, 20 bp, Homo sapiens
tttctgcagatgtttacatg

SEQ ID NO: 7178735 - DNA, 20 bp, Homo sapiens
tttctgcagatgtttacatg

SEQ ID NO: 7178736 - DNA, 19 bp, Homo sapiens
tttctgcagcccagcagca

SEQ ID NO: 7178737 - DNA, 22 bp, Homo sapiens
tttctgatattcatttagaaga

SEQ ID NO: 7178738 - DNA, 22 bp, Homo sapiens
tttctgataattttgtgaaatc

SEQ ID NO: 7178739 - DNA, 22 bp, Homo sapiens
ctctgaggtccttcccagctct

SEQ ID NO: 7178740 - DNA, 22 bp, Homo sapiens
ctctgaggtcctacagtgaccc

SEQ ID NO: 7178741 - DNA, 22 bp, Homo sapiens
ctctgaggtccttcccagctct

SEQ ID NO: 7178742 - DNA, 21 bp, Homo sapiens
tttctgcaatgcacgttgagg

SEQ ID NO: 7178743 - DNA, 22 bp, Homo sapiens
tttctgcaacgagtctttgact

SEQ ID NO: 7178744 - DNA, 22 bp, Homo sapiens
tttctgcaaacttccacgtctc

SEQ ID NO: 7178745 - DNA, 22 bp, Homo sapiens
tttctgcaagtgtagataccca

SEQ ID NO: 7178746 - DNA, 22 bp, Homo sapiens
tttctgatttgacttgaagtat

SEQ ID NO: 7178747 - DNA, 22 bp, Homo sapiens
tttctgcaaaatctaagttaga

SEQ ID NO: 7178748 - DNA, 22 bp, Homo sapiens
tttctgcaaaatctaagttaga

SEQ ID NO: 7178749 - DNA, 22 bp, Homo sapiens
tttctgcaaacttccacgtctc

SEQ ID NO: 7178750 - DNA, 22 bp, Homo sapiens
ctgagggaccctgtgagtacct

SEQ ID NO: 7178751 - DNA, 22 bp, Homo sapiens
ctgaggctgggcatggggtcca

SEQ ID NO: 7178752 - DNA, 22 bp, Homo sapiens
ctgaggctgggcatggggtcca

SEQ ID NO: 7178753 - DNA, 22 bp, Homo sapiens
ctgagggagacagtgcggacta

SEQ ID NO: 7178754 - DNA, 22 bp, Homo sapiens
ctgagggagacagtgcggacta

SEQ ID NO: 7178755 - DNA, 22 bp, Homo sapiens
ctgagggagacagtgcggacta

SEQ ID NO: 7178756 - DNA, 22 bp, Homo sapiens
ctgagggagaagtcacgggcag

SEQ ID NO: 7178757 - DNA, 22 bp, Homo sapiens
ctgagggagaagtcacgggcag

SEQ ID NO: 7178758 - DNA, 22 bp, Homo sapiens
ctgagggagaagtcacgggcag

SEQ ID NO: 7178759 - DNA, 22 bp, Homo sapiens
ctgagggagagaatggggcaaa

SEQ ID NO: 7178760 - DNA, 22 bp, Homo sapiens
ctgagggagagaatggggcaaa

SEQ ID NO: 7178761 - DNA, 22 bp, Homo sapiens
ctgagggagagaatggggcaaa

SEQ ID NO: 7178762 - DNA, 22 bp, Homo sapiens
ctgagggagctgctggccttgg

SEQ ID NO: 7178763 - DNA, 22 bp, Homo sapiens
ctgagggccctgaagcttggca

SEQ ID NO: 7178764 - DNA, 21 bp, Homo sapiens
ctgagggccgcagctgggctc

SEQ ID NO: 7178765 - DNA, 21 bp, Homo sapiens
ctgagggccgcagctgggctc

SEQ ID NO: 7178766 - DNA, 22 bp, Homo sapiens
ctgagggcatgaacattccata

SEQ ID NO: 7178767 - DNA, 22 bp, Homo sapiens
ctgagggcatgaacattccata

SEQ ID NO: 7178768 - DNA, 18 bp, Homo sapiens
ctgagggcagcccctggg

SEQ ID NO: 7178769 - DNA, 18 bp, Homo sapiens
ctgagggcagcccctggg

SEQ ID NO: 7178770 - DNA, 22 bp, Homo sapiens
ctgagggcaccgacagagtgga

SEQ ID NO: 7178771 - DNA, 22 bp, Homo sapiens
ctgagggagttcctgagcccac

SEQ ID NO: 7178772 - DNA, 22 bp, Homo sapiens
ctgagggatgggctgggccgcc

SEQ ID NO: 7178773 - DNA, 22 bp, Homo sapiens
ctgagggatgggctgggccgcc

SEQ ID NO: 7178774 - DNA, 22 bp, Homo sapiens
ctgagctggtgtttcagggtca

SEQ ID NO: 7178775 - DNA, 22 bp, Homo sapiens
ctgagctggttctcttgtgaaa

SEQ ID NO: 7178776 - DNA, 22 bp, Homo sapiens
ctgagctgttactctgtcctcg

SEQ ID NO: 7178777 - DNA, 22 bp, Homo sapiens
ctgagctgttactctgtcctcg

SEQ ID NO: 7178778 - DNA, 22 bp, Homo sapiens
ctgagctgtgtggtcctgggca

SEQ ID NO: 7178779 - DNA, 22 bp, Homo sapiens
ctgagctgtgtggtcctgggca

SEQ ID NO: 7178780 - DNA, 22 bp, Homo sapiens
ctgaggaaggagttaggcagtt

SEQ ID NO: 7178781 - DNA, 22 bp, Homo sapiens
ctgaggaagaggtaccatttgt

SEQ ID NO: 7178782 - DNA, 22 bp, Homo sapiens
ctgaggaagaggtaccatttgt

SEQ ID NO: 7178783 - DNA, 22 bp, Homo sapiens
ctgaggaagacagcagctgtgt

SEQ ID NO: 7178784 - DNA, 22 bp, Homo sapiens
ctgaggaaagctgcagcggtac

SEQ ID NO: 7178785 - DNA, 22 bp, Homo sapiens
ctgagctgtttaatcccagata

SEQ ID NO: 7178786 - DNA, 22 bp, Homo sapiens
ctgagctgtttaatcccagata

SEQ ID NO: 7178787 - DNA, 22 bp, Homo sapiens
ctgagcttggccaggaatgaat

SEQ ID NO: 7178788 - DNA, 21 bp, Homo sapiens
ctgagcttattgaaaggaaga

SEQ ID NO: 7178789 - DNA, 22 bp, Homo sapiens
ctgagctgggagcctggcacca

SEQ ID NO: 7178790 - DNA, 22 bp, Homo sapiens
ctgagctgggagcctggcacca

SEQ ID NO: 7178791 - DNA, 22 bp, Homo sapiens
ctgagctgggagtggatagtgg

SEQ ID NO: 7178792 - DNA, 22 bp, Homo sapiens
ctgagctgggcaactcttagat

SEQ ID NO: 7178793 - DNA, 22 bp, Homo sapiens
ctgagctgggctctcttgaggg

SEQ ID NO: 7178794 - DNA, 22 bp, Homo sapiens
ctgagctgggctctcttgaggg

SEQ ID NO: 7178795 - DNA, 22 bp, Homo sapiens
ctgagcaatttcagctctcact

SEQ ID NO: 7178796 - DNA, 23 bp, Homo sapiens
ctgagcaaagggggaagctgctt

SEQ ID NO: 7178797 - DNA, 22 bp, Homo sapiens
ctgagcacagaaataagatatt

SEQ ID NO: 7178798 - DNA, 22 bp, Homo sapiens
ctgagcacagaaataagatatt

SEQ ID NO: 7178799 - DNA, 22 bp, Homo sapiens
ctgagcaatttcagctctcact

SEQ ID NO: 7178800 - DNA, 23 bp, Homo sapiens
ctgagcacagctctgtgggcctc

SEQ ID NO: 7178801 - DNA, 22 bp, Homo sapiens
ctgagcaccccaggacctgcgc

SEQ ID NO: 7178802 - DNA, 22 bp, Homo sapiens
ctgagcacctgctgtgtgccag

SEQ ID NO: 7178803 - DNA, 22 bp, Homo sapiens
ctgagcacctgctgtgtgccag

SEQ ID NO: 7178804 - DNA, 22 bp, Homo sapiens
ctgagcacctgctgtgtgccag

SEQ ID NO: 7178805 - DNA, 22 bp, Homo sapiens
ctgagcacctgttataggttag

SEQ ID NO: 7178806 - DNA, 22 bp, Homo sapiens
ctgagcacctgttataggttag

SEQ ID NO: 7178807 - DNA, 22 bp, Homo sapiens
ctgagatggccactgggtctca

SEQ ID NO: 7178808 - DNA, 22 bp, Homo sapiens
ctgagatggtagatggatgtta

SEQ ID NO: 7178809 - DNA, 22 bp, Homo sapiens
ctgagatggtctctttgttact

SEQ ID NO: 7178810 - DNA, 22 bp, Homo sapiens
ctgagatggtctctttgttact

SEQ ID NO: 7178811 - DNA, 22 bp, Homo sapiens
ctgagagtgtggcttccaggcc

SEQ ID NO: 7178812 - DNA, 22 bp, Homo sapiens
ctgagagtgcttgaaaggccag

SEQ ID NO: 7178813 - DNA, 22 bp, Homo sapiens
ctgagagtgcttgaaaggccag

SEQ ID NO: 7178814 - DNA, 22 bp, Homo sapiens
ctgagagtgtggcttccaggcc

SEQ ID NO: 7178815 - DNA, 22 bp, Homo sapiens
ctgagagttaagagatggggct

SEQ ID NO: 7178816 - DNA, 22 bp, Homo sapiens
ctgagagttaagagatggggct

SEQ ID NO: 7178817 - DNA, 22 bp, Homo sapiens
ctgagagttcgttccaccctcc

SEQ ID NO: 7178818 - DNA, 22 bp, Homo sapiens
ctgagagtgctctttgatgtca

SEQ ID NO: 7178819 - DNA, 22 bp, Homo sapiens
ctgagagtcagtggagtggtgt

SEQ ID NO: 7178820 - DNA, 22 bp, Homo sapiens
ctgagagtctacatttttagca

SEQ ID NO: 7178821 - DNA, 22 bp, Homo sapiens
ctgagagtctgcatttctaaca

SEQ ID NO: 7178822 - DNA, 22 bp, Homo sapiens
ctgagagtctgcatttctaaca

SEQ ID NO: 7178823 - DNA, 20 bp, Homo sapiens
ctgagagtctgtgcttagtc

SEQ ID NO: 7178824 - DNA, 22 bp, Homo sapiens
ctgagagtcagcttctcctcct

SEQ ID NO: 7178825 - DNA, 22 bp, Homo sapiens
ctgagagtattggcaggcttgg

SEQ ID NO: 7178826 - DNA, 22 bp, Homo sapiens
ctgagagtaattttctacttga

SEQ ID NO: 7178827 - DNA, 22 bp, Homo sapiens
ctgagagtagctggagaacatt

SEQ ID NO: 7178828 - DNA, 22 bp, Homo sapiens
ctgagaggtgacagcgtgctgg

SEQ ID NO: 7178829 - DNA, 22 bp, Homo sapiens
ctgagaggtgctggtggctgca

SEQ ID NO: 7178830 - DNA, 22 bp, Homo sapiens
ctgagaggtgctggtggctgca

SEQ ID NO: 7178831 - DNA, 22 bp, Homo sapiens
ctgagagtaattttctacttga

SEQ ID NO: 7178832 - DNA, 22 bp, Homo sapiens
ctgagaggtaatcacacaaaat

SEQ ID NO: 7178833 - DNA, 22 bp, Homo sapiens
ctgagaggtaagcagcgcagtg

SEQ ID NO: 7178834 - DNA, 22 bp, Homo sapiens
ctgagaggtaagcagcgcagtg

SEQ ID NO: 7178835 - DNA, 22 bp, Homo sapiens
ctgagaggtaagcagcgcagtg

SEQ ID NO: 7178836 - DNA, 22 bp, Homo sapiens
ctgagaggtaagcagcgcagtg

SEQ ID NO: 7178837 - DNA, 22 bp, Homo sapiens
ctgagaggtaagcagcgcagtg

SEQ ID NO: 7178838 - DNA, 22 bp, Homo sapiens
ctgagaggtaagcagcgcagtg

SEQ ID NO: 7178839 - DNA, 22 bp, Homo sapiens
ctgagaggtaagcagcgcagtg

SEQ ID NO: 7178840 - DNA, 22 bp, Homo sapiens
ctgagaggggaccagggtgttt

SEQ ID NO: 7178841 - DNA, 22 bp, Homo sapiens
ctgagaggggaccagggtgttt

SEQ ID NO: 7178842 - DNA, 19 bp, Homo sapiens
ctgagagatgcttcacaca

SEQ ID NO: 7178843 - DNA, 19 bp, Homo sapiens
ctgagagatgcttcacaca

SEQ ID NO: 7178844 - DNA, 19 bp, Homo sapiens
ctgagagatgcttcacaca

SEQ ID NO: 7178845 - DNA, 22 bp, Homo sapiens
ctgagagatcaagccacaggat

SEQ ID NO: 7178846 - DNA, 22 bp, Homo sapiens
ctgagagatgatatagcttaat

SEQ ID NO: 7178847 - DNA, 22 bp, Homo sapiens
ctgaatatcatttacatttgga

SEQ ID NO: 7178848 - DNA, 22 bp, Homo sapiens
ctgaataattttctgttgtatg

SEQ ID NO: 7178849 - DNA, 22 bp, Homo sapiens
ctgagagatcaagccacaggat

SEQ ID NO: 7178850 - DNA, 22 bp, Homo sapiens
ctgaataattttatagttgctg

SEQ ID NO: 7178851 - DNA, 22 bp, Homo sapiens
ctgaataatgttctcttgtatg

SEQ ID NO: 7178852 - DNA, 22 bp, Homo sapiens
ctgaataattttatagttgctg

SEQ ID NO: 7178853 - DNA, 22 bp, Homo sapiens
ctgaataattttctgttgtatg

SEQ ID NO: 7178854 - DNA, 22 bp, Homo sapiens
ctgaataatattccattatgag

SEQ ID NO: 7178855 - DNA, 22 bp, Homo sapiens
ctgaataatattccattatgag

SEQ ID NO: 7178856 - DNA, 22 bp, Homo sapiens
ctgaataatattccattatgag

SEQ ID NO: 7178857 - DNA, 22 bp, Homo sapiens
ctgaataatgttctcttgtatg

SEQ ID NO: 7178858 - DNA, 22 bp, Homo sapiens
ctgaataatgttctcttgtatg

SEQ ID NO: 7178859 - DNA, 22 bp, Homo sapiens
ctgaagtttttcaatttatgtt

SEQ ID NO: 7178860 - DNA, 22 bp, Homo sapiens
ctgaataaagccctcgcgcgct

SEQ ID NO: 7178861 - DNA, 22 bp, Homo sapiens
ctgaataatacagactagcttc

SEQ ID NO: 7178862 - DNA, 22 bp, Homo sapiens
ctgaataatacagactagcttc

SEQ ID NO: 7178863 - DNA, 22 bp, Homo sapiens
ctgaagttcatacaatggccat

SEQ ID NO: 7178864 - DNA, 22 bp, Homo sapiens
ctgaagttcatacaatggccat

SEQ ID NO: 7178865 - DNA, 22 bp, Homo sapiens
ctgaagttcgccagactcgggc

SEQ ID NO: 7178866 - DNA, 22 bp, Homo sapiens
ctgaagttctacaagcctcagg

SEQ ID NO: 7178867 - DNA, 22 bp, Homo sapiens
ctgaagttctacaagcctcagg

SEQ ID NO: 7178868 - DNA, 22 bp, Homo sapiens
ctgaagtttatgcttttcgggt

SEQ ID NO: 7178869 - DNA, 22 bp, Homo sapiens
ctgaagtttcgagatggatgtg

SEQ ID NO: 7178870 - DNA, 22 bp, Homo sapiens
ctgaagttttgacatctcattt

SEQ ID NO: 7178871 - DNA, 22 bp, Homo sapiens
ctgaagtccagagtaagggact

SEQ ID NO: 7178872 - DNA, 22 bp, Homo sapiens
ctgaagtgccaaatcataatca

SEQ ID NO: 7178873 - DNA, 22 bp, Homo sapiens
ctgaagttaaagtagtttttat

SEQ ID NO: 7178874 - DNA, 22 bp, Homo sapiens
ctgaagttaacatcttgatgtc

SEQ ID NO: 7178875 - DNA, 22 bp, Homo sapiens
ctgaagttaatcagaggtacaa

SEQ ID NO: 7178876 - DNA, 22 bp, Homo sapiens
ctgaagttaatcagaggtacaa

SEQ ID NO: 7178877 - DNA, 22 bp, Homo sapiens
ctgaagttagttatgcctaaaa

SEQ ID NO: 7178878 - DNA, 22 bp, Homo sapiens
ctgaagttagttatgcctaaaa

SEQ ID NO: 7178879 - DNA, 22 bp, Homo sapiens
ctgaagttattcagtgggctga

SEQ ID NO: 7178880 - DNA, 22 bp, Homo sapiens
ctgaagttattgtacaaatttg

SEQ ID NO: 7178881 - DNA, 22 bp, Homo sapiens
ctgaagttattgtacaaatttg

SEQ ID NO: 7178882 - DNA, 22 bp, Homo sapiens
ctgaagttattgtacaaatttg

SEQ ID NO: 7178883 - DNA, 22 bp, Homo sapiens
ctgaagttcatacaatggccat

SEQ ID NO: 7178884 - DNA, 22 bp, Homo sapiens
ctgaaggctaaaatggactgaa

SEQ ID NO: 7178885 - DNA, 22 bp, Homo sapiens
ctgaaggctgaggctgtgttgt

SEQ ID NO: 7178886 - DNA, 22 bp, Homo sapiens
ctgaaggcttgttgttttctta

SEQ ID NO: 7178887 - DNA, 22 bp, Homo sapiens
ctgaagggatgtgatttctaca

SEQ ID NO: 7178888 - DNA, 22 bp, Homo sapiens
ctgaagtcagatggcacaaggt

SEQ ID NO: 7178889 - DNA, 22 bp, Homo sapiens
ctgaagggtctggggctgtgcc

SEQ ID NO: 7178890 - DNA, 22 bp, Homo sapiens
ctgaagtcagatggcacaaggt

SEQ ID NO: 7178891 - DNA, 18 bp, Homo sapiens
ctgaaggcaccagggcag

SEQ ID NO: 7178892 - DNA, 22 bp, Homo sapiens
ctgaaggcaccaggggtgccag

SEQ ID NO: 7178893 - DNA, 22 bp, Homo sapiens
ctgaaggcatttttgctgattt

SEQ ID NO: 7178894 - DNA, 22 bp, Homo sapiens
ctgaaggcatttttgctgattt

SEQ ID NO: 7178895 - DNA, 22 bp, Homo sapiens
ctgaaggctaaaatggactgaa

SEQ ID NO: 7178896 - DNA, 22 bp, Homo sapiens
ctgaaggacacgtgaggagcca

SEQ ID NO: 7178897 - DNA, 22 bp, Homo sapiens
ctgaagatttttggtaatcatg

SEQ ID NO: 7178898 - DNA, 22 bp, Homo sapiens
ctgaagcaaaggatcgagctaa

SEQ ID NO: 7178899 - DNA, 22 bp, Homo sapiens
ctgaagatttttggtaatcatg

SEQ ID NO: 7178900 - DNA, 22 bp, Homo sapiens
ctgaagattcgcctttgtttat

SEQ ID NO: 7178901 - DNA, 22 bp, Homo sapiens
ctgaagattcgcctttgtttat

SEQ ID NO: 7178902 - DNA, 22 bp, Homo sapiens
ctgaagattataaacagacata

SEQ ID NO: 7178903 - DNA, 22 bp, Homo sapiens
ctgaagatgttctttttggttc

SEQ ID NO: 7178904 - DNA, 22 bp, Homo sapiens
ctgaagatgttctttttggttc

SEQ ID NO: 7178905 - DNA, 20 bp, Homo sapiens
ctgaaagacgtaacagtgca

SEQ ID NO: 7178906 - DNA, 22 bp, Homo sapiens
ctgaaagcaaagtaattcttaa

SEQ ID NO: 7178907 - DNA, 22 bp, Homo sapiens
ctgaaggagcatagtcagtttt

SEQ ID NO: 7178908 - DNA, 22 bp, Homo sapiens
ctgaaggaggtagagtgacata

SEQ ID NO: 7178909 - DNA, 22 bp, Homo sapiens
ttttttgttgggtagaacggaa

SEQ ID NO: 7178910 - DNA, 22 bp, Homo sapiens
ttttttgttgggtagaacggaa

SEQ ID NO: 7178911 - DNA, 23 bp, Homo sapiens
ttttttgtcttgctaggctgccc

SEQ ID NO: 7178912 - DNA, 22 bp, Homo sapiens
tttttcttgtgctggatctaat

SEQ ID NO: 7178913 - DNA, 22 bp, Homo sapiens
tttttcttgtgctggatctaat

SEQ ID NO: 7178914 - DNA, 22 bp, Homo sapiens
tttttcttgtgctggatctaat

SEQ ID NO: 7178915 - DNA, 22 bp, Homo sapiens
tttttcttaaatgtgggttggc

SEQ ID NO: 7178916 - DNA, 22 bp, Homo sapiens
tttttcttaaatgtgggttggc

SEQ ID NO: 7178917 - DNA, 22 bp, Homo sapiens
tttttcttaaatgtgggttggc

SEQ ID NO: 7178918 - DNA, 22 bp, Homo sapiens
tttttcttaaatgtgggttggc

SEQ ID NO: 7178919 - DNA, 22 bp, Homo sapiens
tttttcttaaatgtgggttggc

SEQ ID NO: 7178920 - DNA, 22 bp, Homo sapiens
tttttcttgtgctggatctaat

SEQ ID NO: 7178921 - DNA, 22 bp, Homo sapiens
tttttcttgtgctggatctaat

SEQ ID NO: 7178922 - DNA, 22 bp, Homo sapiens
tttttcttgtgctggatctaat

SEQ ID NO: 7178923 - DNA, 22 bp, Homo sapiens
tttttctgtctcttacattgca

SEQ ID NO: 7178924 - DNA, 22 bp, Homo sapiens
tttttctgtctcttacattgca

SEQ ID NO: 7178925 - DNA, 22 bp, Homo sapiens
tttttctgtctcttacattgca

SEQ ID NO: 7178926 - DNA, 22 bp, Homo sapiens
tttttctgtctcttacattgca

SEQ ID NO: 7178927 - DNA, 22 bp, Homo sapiens
tttttcttaaatgtgggttggc

SEQ ID NO: 7178928 - DNA, 22 bp, Homo sapiens
tttttcttaaatgtgggttggc

SEQ ID NO: 7178929 - DNA, 22 bp, Homo sapiens
tttttcttaaatgtgggttggc

SEQ ID NO: 7178930 - DNA, 22 bp, Homo sapiens
tttttcttaaatgtgggttggc

SEQ ID NO: 7178931 - DNA, 22 bp, Homo sapiens
tttttcttaaatgtgggttggc

SEQ ID NO: 7178932 - DNA, 20 bp, Homo sapiens
tttttctgggcttccatagc

SEQ ID NO: 7178933 - DNA, 22 bp, Homo sapiens
tttttctgtaaagggccagaga

SEQ ID NO: 7178934 - DNA, 22 bp, Homo sapiens
tttttctgtctcttacattgca

SEQ ID NO: 7178935 - DNA, 20 bp, Homo sapiens
tttttctgggcttccatagc

SEQ ID NO: 7178936 - DNA, 20 bp, Homo sapiens
tttttctgggcttccatagc

SEQ ID NO: 7178937 - DNA, 22 bp, Homo sapiens
tttttctggataactgtatctc

SEQ ID NO: 7178938 - DNA, 22 bp, Homo sapiens
ctgaaacattgcaataacaaag

SEQ ID NO: 7178939 - DNA, 22 bp, Homo sapiens
ctgaaacattgcaataacaaag

SEQ ID NO: 7178940 - DNA, 22 bp, Homo sapiens
ctgaaacattgcaataacaaag

SEQ ID NO: 7178941 - DNA, 22 bp, Homo sapiens
ctgaaactacagtaaggagaac

SEQ ID NO: 7178942 - DNA, 22 bp, Homo sapiens
ctgaaactatggggaggggagc

SEQ ID NO: 7178943 - DNA, 22 bp, Homo sapiens
ctgaaactccatgagaaattgc

SEQ ID NO: 7178944 - DNA, 22 bp, Homo sapiens
ctgaaactccatgagaaattgc

SEQ ID NO: 7178945 - DNA, 22 bp, Homo sapiens
ctgaaactgctcccagccccat

SEQ ID NO: 7178946 - DNA, 22 bp, Homo sapiens
ctgaaactggagtccttatatc

SEQ ID NO: 7178947 - DNA, 22 bp, Homo sapiens
ctgaaactggtcaattaatctg

SEQ ID NO: 7178948 - DNA, 22 bp, Homo sapiens
ctgaaactggtcaattaatctg

SEQ ID NO: 7178949 - DNA, 22 bp, Homo sapiens
ctgaaactgtcttcctagccat

SEQ ID NO: 7178950 - DNA, 22 bp, Homo sapiens
ctgaaactttagttctgcaaca

SEQ ID NO: 7178951 - DNA, 22 bp, Homo sapiens
ctgaaagaataagatgtttaca

SEQ ID NO: 7178952 - DNA, 22 bp, Homo sapiens
ctgaaagaataagatgtttaca

SEQ ID NO: 7178953 - DNA, 20 bp, Homo sapiens
ctgaaagacgtaacagtgca

SEQ ID NO: 7178954 - DNA, 22 bp, Homo sapiens
ctgaaaatgttacacaggaaga

SEQ ID NO: 7178955 - DNA, 22 bp, Homo sapiens
ctgaaaatgttagtgatacgaa

SEQ ID NO: 7178956 - DNA, 22 bp, Homo sapiens
ctgaaaatgttacacaggaaga

SEQ ID NO: 7178957 - DNA, 22 bp, Homo sapiens
ctgaaaatgttacacaggaaga

SEQ ID NO: 7178958 - DNA, 22 bp, Homo sapiens
ttttctcaggtgcttatctaag

SEQ ID NO: 7178959 - DNA, 22 bp, Homo sapiens
ttttctcaggtgcttatctaag

SEQ ID NO: 7178960 - DNA, 21 bp, Homo sapiens
ttttctccagctgtgatttta

SEQ ID NO: 7178961 - DNA, 21 bp, Homo sapiens
ttttctccagctgtgatttta

SEQ ID NO: 7178962 - DNA, 20 bp, Homo sapiens
ttttcctgtggtttgatatg

SEQ ID NO: 7178963 - DNA, 23 bp, Homo sapiens
ttttcctgtggagacatgactgg

SEQ ID NO: 7178964 - DNA, 20 bp, Homo sapiens
ttttcctgtggtttgatatg

SEQ ID NO: 7178965 - DNA, 22 bp, Homo sapiens
ttttccttaacagagggagaaa

SEQ ID NO: 7178966 - DNA, 22 bp, Homo sapiens
ttttcctgtccaggcaattatt

SEQ ID NO: 7178967 - DNA, 22 bp, Homo sapiens
ttttcctggggcttctggactc

SEQ ID NO: 7178968 - DNA, 22 bp, Homo sapiens
ttttcctgggctttctgtgtaa

SEQ ID NO: 7178969 - DNA, 22 bp, Homo sapiens
ttttcctgggctttctgtgtaa

SEQ ID NO: 7178970 - DNA, 22 bp, Homo sapiens
ttttcctgcctgtctctagagg

SEQ ID NO: 7178971 - DNA, 22 bp, Homo sapiens
ttttcctgcctgtctctagagg

SEQ ID NO: 7178972 - DNA, 22 bp, Homo sapiens
ttttcctgcctgtctctagagg

SEQ ID NO: 7178973 - DNA, 19 bp, Homo sapiens
ttttcctgcctcattgttt

SEQ ID NO: 7178974 - DNA, 19 bp, Homo sapiens
ttttcctgcctcattgttt

SEQ ID NO: 7178975 - DNA, 22 bp, Homo sapiens
ttttcctctgttattagtgtga

SEQ ID NO: 7178976 - DNA, 22 bp, Homo sapiens
ttttcctctgttattagtgtga

SEQ ID NO: 7178977 - DNA, 22 bp, Homo sapiens
ttttcctctgtatttgaaatgc

SEQ ID NO: 7178978 - DNA, 22 bp, Homo sapiens
ttttcagtttgcactgcagtgc

SEQ ID NO: 7178979 - DNA, 22 bp, Homo sapiens
ctctggagtcctgtatcactcc

SEQ ID NO: 7178980 - DNA, 22 bp, Homo sapiens
ctctggagtgcagcctggtggc

SEQ ID NO: 7178981 - DNA, 22 bp, Homo sapiens
ctctggagtgcagcctggtggc

SEQ ID NO: 7178982 - DNA, 22 bp, Homo sapiens
ctctggagtgcagcctggtggc

SEQ ID NO: 7178983 - DNA, 22 bp, Homo sapiens
ctctggagtgcagcctggtggc

SEQ ID NO: 7178984 - DNA, 22 bp, Homo sapiens
ctctggagtgcagcctggtggc

SEQ ID NO: 7178985 - DNA, 22 bp, Homo sapiens
ctctggagtgcagcctggtggc

SEQ ID NO: 7178986 - DNA, 22 bp, Homo sapiens
ttttctctacaaaataaccagc

SEQ ID NO: 7178987 - DNA, 22 bp, Homo sapiens
ttttctctatattgtctgtgaa

SEQ ID NO: 7178988 - DNA, 22 bp, Homo sapiens
ttttctctatattgtctgtgaa

SEQ ID NO: 7178989 - DNA, 22 bp, Homo sapiens
ttttctcctttcaagatagcat

SEQ ID NO: 7178990 - DNA, 22 bp, Homo sapiens
ttttctctacaaaataaccagc

SEQ ID NO: 7178991 - DNA, 22 bp, Homo sapiens
ttttctctacaaaataaccagc

SEQ ID NO: 7178992 - DNA, 22 bp, Homo sapiens
tttttctgccattcaaagagga

SEQ ID NO: 7178993 - DNA, 22 bp, Homo sapiens
tttttctgccattcaaagagga

SEQ ID NO: 7178994 - DNA, 22 bp, Homo sapiens
tttttctgccattcaaagagga

SEQ ID NO: 7178995 - DNA, 18 bp, Homo sapiens
tttttctgataaaacaag

SEQ ID NO: 7178996 - DNA, 18 bp, Homo sapiens
tttttctgataaaacaag

SEQ ID NO: 7178997 - DNA, 22 bp, Homo sapiens
tttttctgagaatatgagagga

SEQ ID NO: 7178998 - DNA, 22 bp, Homo sapiens
tttttctgagcggtaatcatca

SEQ ID NO: 7178999 - DNA, 22 bp, Homo sapiens
tttttctgagcggtaatcatca

SEQ ID NO: 7179000 - DNA, 22 bp, Homo sapiens
tttttctcttctgtaaagtggt

SEQ ID NO: 7179001 - DNA, 22 bp, Homo sapiens
tttttctcttctgtaaagtggt

SEQ ID NO: 7179002 - DNA, 22 bp, Homo sapiens
tttttctcttctgtaaagtggt

SEQ ID NO: 7179003 - DNA, 19 bp, Homo sapiens
tttttacaagtaggtgtga

SEQ ID NO: 7179004 - DNA, 19 bp, Homo sapiens
tttttacaagtaggtgtga

SEQ ID NO: 7179005 - DNA, 22 bp, Homo sapiens
tttttctagaccttaaaggcca

SEQ ID NO: 7179006 - DNA, 19 bp, Homo sapiens
tttttacaagtaggtgtga

SEQ ID NO: 7179007 - DNA, 19 bp, Homo sapiens
tttttacaagtaggtgtga

SEQ ID NO: 7179008 - DNA, 22 bp, Homo sapiens
tttttctagctcaaagattcta

SEQ ID NO: 7179009 - DNA, 22 bp, Homo sapiens
tttttctagctcaaagattcta

SEQ ID NO: 7179010 - DNA, 22 bp, Homo sapiens
tttttctctaagtagtcccaaa

SEQ ID NO: 7179011 - DNA, 22 bp, Homo sapiens
tttttctctaagtagtcccaaa

SEQ ID NO: 7179012 - DNA, 22 bp, Homo sapiens
tttttctctatgccaggggcct

SEQ ID NO: 7179013 - DNA, 22 bp, Homo sapiens
ctgcagtgttctggaatgcatt

SEQ ID NO: 7179014 - DNA, 22 bp, Homo sapiens
ctgcagtgcctgccactgagcc

SEQ ID NO: 7179015 - DNA, 22 bp, Homo sapiens
ctgcagtgcctgccactgagcc

SEQ ID NO: 7179016 - DNA, 22 bp, Homo sapiens
ctgcagtgcaagcccagatgga

SEQ ID NO: 7179017 - DNA, 22 bp, Homo sapiens
ctgcagtgaaatcaggaagcaa

SEQ ID NO: 7179018 - DNA, 22 bp, Homo sapiens
ctgcagtgaggattcttaggtg

SEQ ID NO: 7179019 - DNA, 22 bp, Homo sapiens
ctgcagtcagcttttaagatct

SEQ ID NO: 7179020 - DNA, 22 bp, Homo sapiens
ctgcagtcagcttttaagatct

SEQ ID NO: 7179021 - DNA, 22 bp, Homo sapiens
ctgcagtcagtgctaatgggta

SEQ ID NO: 7179022 - DNA, 22 bp, Homo sapiens
ctgcagtcagtgctaatgggta

SEQ ID NO: 7179023 - DNA, 22 bp, Homo sapiens
ctgcagtacaagaagcatctct

SEQ ID NO: 7179024 - DNA, 22 bp, Homo sapiens
ctgcagtagcacctgtggcttt

SEQ ID NO: 7179025 - DNA, 22 bp, Homo sapiens
ctgcagtagcagagctgagtag

SEQ ID NO: 7179026 - DNA, 22 bp, Homo sapiens
ctgcagtagtttttgactctag

SEQ ID NO: 7179027 - DNA, 22 bp, Homo sapiens
ctgcagtatctgctttgggtag

SEQ ID NO: 7179028 - DNA, 22 bp, Homo sapiens
ctgcagtatcttaaaatttgta

SEQ ID NO: 7179029 - DNA, 22 bp, Homo sapiens
ctgcagtcatctgaagattttg

SEQ ID NO: 7179030 - DNA, 20 bp, Homo sapiens
ctgcagtcccctctgaatca

SEQ ID NO: 7179031 - DNA, 20 bp, Homo sapiens
ctgcagtcccctctgaatca

SEQ ID NO: 7179032 - DNA, 23 bp, Homo sapiens
ctgcagtcgccggcctgggtgcc

SEQ ID NO: 7179033 - DNA, 20 bp, Homo sapiens
ctgcagtcccctctgaatca

SEQ ID NO: 7179034 - DNA, 23 bp, Homo sapiens
ctgcagtcgccggcctgggtgcc

SEQ ID NO: 7179035 - DNA, 23 bp, Homo sapiens
ctgcagtcgccggcctgggtgcc

SEQ ID NO: 7179036 - DNA, 23 bp, Homo sapiens
ctgcagtcgccggcctgggtgcc

SEQ ID NO: 7179037 - DNA, 22 bp, Homo sapiens
ctgcagtctacctggattttta

SEQ ID NO: 7179038 - DNA, 22 bp, Homo sapiens
ctgcagtctacctggattttta

SEQ ID NO: 7179039 - DNA, 22 bp, Homo sapiens
ctgcagtctacctggattttta

SEQ ID NO: 7179040 - DNA, 23 bp, Homo sapiens
ctgcatatggaggttagcaactc

SEQ ID NO: 7179041 - DNA, 22 bp, Homo sapiens
ctgcatatgatagatgccttgc

SEQ ID NO: 7179042 - DNA, 22 bp, Homo sapiens
ctgcatatgagaataggagaaa

SEQ ID NO: 7179043 - DNA, 22 bp, Homo sapiens
ctgcatatcaaattactcctgg

SEQ ID NO: 7179044 - DNA, 22 bp, Homo sapiens
ctgcatatgagaataggagaaa

SEQ ID NO: 7179045 - DNA, 22 bp, Homo sapiens
ctgcatcactcttactggcttt

SEQ ID NO: 7179046 - DNA, 22 bp, Homo sapiens
ctgcatcacagcaggaggcaca

SEQ ID NO: 7179047 - DNA, 22 bp, Homo sapiens
ctgcccctgctcatggctgtcc

SEQ ID NO: 7179048 - DNA, 22 bp, Homo sapiens
ctgcagtttgctaagagacaaa

SEQ ID NO: 7179049 - DNA, 22 bp, Homo sapiens
ctgcagtttcagcctttctggc

SEQ ID NO: 7179050 - DNA, 22 bp, Homo sapiens
ctgcagtttgaccttgttttct

SEQ ID NO: 7179051 - DNA, 22 bp, Homo sapiens
ctgcagtttgctaagagacaaa

SEQ ID NO: 7179052 - DNA, 22 bp, Homo sapiens
ctgcagtttgtaaacattttaa

SEQ ID NO: 7179053 - DNA, 22 bp, Homo sapiens
ctgcatatcaaattactcctgg

SEQ ID NO: 7179054 - DNA, 22 bp, Homo sapiens
ctgcagttggataaagatactt

SEQ ID NO: 7179055 - DNA, 22 bp, Homo sapiens
ctgcagttggataaagatactt

SEQ ID NO: 7179056 - DNA, 22 bp, Homo sapiens
ctgcagttggctgagacccccc

SEQ ID NO: 7179057 - DNA, 22 bp, Homo sapiens
ctgcagttgggtgacccaatat

SEQ ID NO: 7179058 - DNA, 22 bp, Homo sapiens
ctgcagttgggtgacccaatat

SEQ ID NO: 7179059 - DNA, 22 bp, Homo sapiens
ctgcagttggtgggtcctcggt

SEQ ID NO: 7179060 - DNA, 22 bp, Homo sapiens
ctgcagtttcagcctttctggc

SEQ ID NO: 7179061 - DNA, 22 bp, Homo sapiens
ctgcagttctcaatttctattg

SEQ ID NO: 7179062 - DNA, 22 bp, Homo sapiens
ctgcagttcttctcctcaaggc

SEQ ID NO: 7179063 - DNA, 22 bp, Homo sapiens
ctgcagttcttctcctcaaggc

SEQ ID NO: 7179064 - DNA, 22 bp, Homo sapiens
ctgcagttctttggcttttaga

SEQ ID NO: 7179065 - DNA, 22 bp, Homo sapiens
ctgcagttgactccctgtttgc

SEQ ID NO: 7179066 - DNA, 22 bp, Homo sapiens
ctgcagtgttctggaatgcatt

SEQ ID NO: 7179067 - DNA, 22 bp, Homo sapiens
ctgagggcttccttgtcccggg

SEQ ID NO: 7179068 - DNA, 22 bp, Homo sapiens
ctgagggctggagctgaggcct

SEQ ID NO: 7179069 - DNA, 22 bp, Homo sapiens
ctgagggctggagctgaggcct

SEQ ID NO: 7179070 - DNA, 22 bp, Homo sapiens
ctgagggctggagctgaggcct

SEQ ID NO: 7179071 - DNA, 22 bp, Homo sapiens
ctgagggccttggctcctgccc

SEQ ID NO: 7179072 - DNA, 22 bp, Homo sapiens
ctgagggccttggctcctgccc

SEQ ID NO: 7179073 - DNA, 22 bp, Homo sapiens
ctgagggctggagctgaggcct

SEQ ID NO: 7179074 - DNA, 22 bp, Homo sapiens
ctgagggccttggctcctgccc

SEQ ID NO: 7179075 - DNA, 22 bp, Homo sapiens
ctgagggcctgaggacctagat

SEQ ID NO: 7179076 - DNA, 22 bp, Homo sapiens
ctgagggccttctatgctgagc

SEQ ID NO: 7179077 - DNA, 21 bp, Homo sapiens
ctgagggccgcagctgggctc

SEQ ID NO: 7179078 - DNA, 21 bp, Homo sapiens
ctgagggccgcagctgggctc

SEQ ID NO: 7179079 - DNA, 22 bp, Homo sapiens
ctgagggccgggacccagtttc

SEQ ID NO: 7179080 - DNA, 22 bp, Homo sapiens
ctgagggcctgaggacctagat

SEQ ID NO: 7179081 - DNA, 21 bp, Homo sapiens
ctgagggctttgaatccagac

SEQ ID NO: 7179082 - DNA, 22 bp, Homo sapiens
ctgcaggggcctcgagcacagg

SEQ ID NO: 7179083 - DNA, 22 bp, Homo sapiens
ctgcaggggctggagttggctt

SEQ ID NO: 7179084 - DNA, 22 bp, Homo sapiens
ctgcaggggctggagttggctt

SEQ ID NO: 7179085 - DNA, 22 bp, Homo sapiens
ctgcaggggcctcgagcacagg

SEQ ID NO: 7179086 - DNA, 22 bp, Homo sapiens
ctgcaggggcctcgagcacagg

SEQ ID NO: 7179087 - DNA, 22 bp, Homo sapiens
ctgcaggggcctcgagcacagg

SEQ ID NO: 7179088 - DNA, 22 bp, Homo sapiens
ctgcaggggctggagttggctt

SEQ ID NO: 7179089 - DNA, 21 bp, Homo sapiens
ctgcaggtgctgccatcaggg

SEQ ID NO: 7179090 - DNA, 21 bp, Homo sapiens
ctgcaggtgctgccatcaggg

SEQ ID NO: 7179091 - DNA, 22 bp, Homo sapiens
ctgcaggttaggagcactcctt

SEQ ID NO: 7179092 - DNA, 22 bp, Homo sapiens
ctgcagggtttttcaaggacaa

SEQ ID NO: 7179093 - DNA, 22 bp, Homo sapiens
ctgcagggtttttcaaggacaa

SEQ ID NO: 7179094 - DNA, 22 bp, Homo sapiens
ctgcagggtttttcaaggacaa

SEQ ID NO: 7179095 - DNA, 22 bp, Homo sapiens
ctgcaggttgagcagccaggtt

SEQ ID NO: 7179096 - DNA, 22 bp, Homo sapiens
ctgcaggttgagcagccaggtt

SEQ ID NO: 7179097 - DNA, 22 bp, Homo sapiens
ctgcaggttaggagcactcctt

SEQ ID NO: 7179098 - DNA, 22 bp, Homo sapiens
ctgcagtaaccactgtaggtgt

SEQ ID NO: 7179099 - DNA, 22 bp, Homo sapiens
ctgcagtaacgatcatggtgcc

SEQ ID NO: 7179100 - DNA, 22 bp, Homo sapiens
ctgcaggttgagcagccaggtt

SEQ ID NO: 7179101 - DNA, 18 bp, Homo sapiens
ctgccccttctctgagat

SEQ ID NO: 7179102 - DNA, 22 bp, Homo sapiens
ctgccctgagggcctgtgtgtt

SEQ ID NO: 7179103 - DNA, 22 bp, Homo sapiens
ctgccctgagggcctgtgtgtt

SEQ ID NO: 7179104 - DNA, 22 bp, Homo sapiens
ctgcccctggtgatggacgcca

SEQ ID NO: 7179105 - DNA, 18 bp, Homo sapiens
ctgccccttctctgagat

SEQ ID NO: 7179106 - DNA, 18 bp, Homo sapiens
ctgccccttctctgagat

SEQ ID NO: 7179107 - DNA, 18 bp, Homo sapiens
ctgccccttctctgagat

SEQ ID NO: 7179108 - DNA, 22 bp, Homo sapiens
ctgccctgcagctccacggact

SEQ ID NO: 7179109 - DNA, 22 bp, Homo sapiens
ctgccctgcagctccacggact

SEQ ID NO: 7179110 - DNA, 22 bp, Homo sapiens
ctgccctgcagctccacggact

SEQ ID NO: 7179111 - DNA, 22 bp, Homo sapiens
ctgccctgcagctccacggact

SEQ ID NO: 7179112 - DNA, 22 bp, Homo sapiens
ctgccctgagtcatgccagatg

SEQ ID NO: 7179113 - DNA, 22 bp, Homo sapiens
ctgccctgagtcatgccagatg

SEQ ID NO: 7179114 - DNA, 22 bp, Homo sapiens
ctgccctgagtcatgccagatg

SEQ ID NO: 7179115 - DNA, 22 bp, Homo sapiens
ctgccctgcttgatgacagcga

SEQ ID NO: 7179116 - DNA, 22 bp, Homo sapiens
ctgccctgcttctgagggaagc

SEQ ID NO: 7179117 - DNA, 22 bp, Homo sapiens
ctgccctgcttctgagggaagc

SEQ ID NO: 7179118 - DNA, 22 bp, Homo sapiens
ctgccctgcttgatgacagcga

SEQ ID NO: 7179119 - DNA, 22 bp, Homo sapiens
ctgccctgcttgatgacagcga

SEQ ID NO: 7179120 - DNA, 22 bp, Homo sapiens
ctgccctgctggagatcacagt

SEQ ID NO: 7179121 - DNA, 22 bp, Homo sapiens
ctgccctgctaatgagttccaa

SEQ ID NO: 7179122 - DNA, 22 bp, Homo sapiens
ctgccctgctctccgggatctt

SEQ ID NO: 7179123 - DNA, 22 bp, Homo sapiens
ctgccctgctggagatcacagt

SEQ ID NO: 7179124 - DNA, 22 bp, Homo sapiens
ctgccctgcccaggccttgggc

SEQ ID NO: 7179125 - DNA, 22 bp, Homo sapiens
ctgccctgcccaggccttgggc

SEQ ID NO: 7179126 - DNA, 22 bp, Homo sapiens
ctgccctgcccaggccttgggc

SEQ ID NO: 7179127 - DNA, 22 bp, Homo sapiens
ctgccctgcccaggccttgggc

SEQ ID NO: 7179128 - DNA, 22 bp, Homo sapiens
ctgccctgcccaggccttgggc

SEQ ID NO: 7179129 - DNA, 22 bp, Homo sapiens
ctgccctgcccaggccttgggc

SEQ ID NO: 7179130 - DNA, 22 bp, Homo sapiens
ctgccctgcccaggccttgggc

SEQ ID NO: 7179131 - DNA, 20 bp, Homo sapiens
ctgccctgccctgggtcctg

SEQ ID NO: 7179132 - DNA, 20 bp, Homo sapiens
ctgccctgccctgggtcctg

SEQ ID NO: 7179133 - DNA, 20 bp, Homo sapiens
ctgccctgccctgggtcctg

SEQ ID NO: 7179134 - DNA, 22 bp, Homo sapiens
ctgcctctggttttggtccctg

SEQ ID NO: 7179135 - DNA, 22 bp, Homo sapiens
ctgcctctggttttggtccctg

SEQ ID NO: 7179136 - DNA, 22 bp, Homo sapiens
ctgcctctggttttggtccctg

SEQ ID NO: 7179137 - DNA, 22 bp, Homo sapiens
ctgcctctattcactgaggcag

SEQ ID NO: 7179138 - DNA, 22 bp, Homo sapiens
ctgcctctggcctcaggcccag

SEQ ID NO: 7179139 - DNA, 22 bp, Homo sapiens
ctgcctctattcactgaggcag

SEQ ID NO: 7179140 - DNA, 22 bp, Homo sapiens
ctgcctctattcactgaggcag

SEQ ID NO: 7179141 - DNA, 22 bp, Homo sapiens
ctgcctctattcactgaggcag

SEQ ID NO: 7179142 - DNA, 22 bp, Homo sapiens
ctgcctctattcactgaggcag

SEQ ID NO: 7179143 - DNA, 22 bp, Homo sapiens
ctgccctgggatggtctgtgcg

SEQ ID NO: 7179144 - DNA, 22 bp, Homo sapiens
ctgccctgggccaggaagcggc

SEQ ID NO: 7179145 - DNA, 22 bp, Homo sapiens
ctgccctgggccaggaagcggc

SEQ ID NO: 7179146 - DNA, 22 bp, Homo sapiens
ctgcctctataggagtccacca

SEQ ID NO: 7179147 - DNA, 22 bp, Homo sapiens
ctgccctgggagtacctgtcct

SEQ ID NO: 7179148 - DNA, 22 bp, Homo sapiens
ctgccctgggagtacctgtcct

SEQ ID NO: 7179149 - DNA, 22 bp, Homo sapiens
ctgccctggccactgtgcccag

SEQ ID NO: 7179150 - DNA, 22 bp, Homo sapiens
ctgccctggccactgtgcccag

SEQ ID NO: 7179151 - DNA, 22 bp, Homo sapiens
ctgccctggccactgtgcccag

SEQ ID NO: 7179152 - DNA, 22 bp, Homo sapiens
ctgccctggcagcctaccatgg

SEQ ID NO: 7179153 - DNA, 22 bp, Homo sapiens
ctgccctgggatggtctgtgcg

SEQ ID NO: 7179154 - DNA, 22 bp, Homo sapiens
ctgccctgcttgatgacagcga

SEQ ID NO: 7179155 - DNA, 22 bp, Homo sapiens
ctgccctgcttgatgacagcga

SEQ ID NO: 7179156 - DNA, 22 bp, Homo sapiens
ctgccctgcttgtttccagtgg

SEQ ID NO: 7179157 - DNA, 22 bp, Homo sapiens
ctgccctgcttgtttccagtgg

SEQ ID NO: 7179158 - DNA, 22 bp, Homo sapiens
ctgccctggcagcctaccatgg

SEQ ID NO: 7179159 - DNA, 21 bp, Homo sapiens
ctgctctgacagtgaggccag

SEQ ID NO: 7179160 - DNA, 22 bp, Homo sapiens
ctgctgagcatttgcagggaca

SEQ ID NO: 7179161 - DNA, 22 bp, Homo sapiens
ctgctgagcatttgcagggaca

SEQ ID NO: 7179162 - DNA, 22 bp, Homo sapiens
ctgctgagcatttgcagggaca

SEQ ID NO: 7179163 - DNA, 22 bp, Homo sapiens
ctgctgagccctggcacaggtg

SEQ ID NO: 7179164 - DNA, 22 bp, Homo sapiens
ctgctgagccctggcacaggtg

SEQ ID NO: 7179165 - DNA, 19 bp, Homo sapiens
ctgctctccttgacttgga

SEQ ID NO: 7179166 - DNA, 19 bp, Homo sapiens
ctgctctccttgacttgga

SEQ ID NO: 7179167 - DNA, 22 bp, Homo sapiens
ctgctctccccaggccagtctg

SEQ ID NO: 7179168 - DNA, 22 bp, Homo sapiens
ctgctctctgttcccctggatc

SEQ ID NO: 7179169 - DNA, 22 bp, Homo sapiens
ctgctctccccaggccagtctg

SEQ ID NO: 7179170 - DNA, 22 bp, Homo sapiens
ctgctctaggttcctgcatatg

SEQ ID NO: 7179171 - DNA, 22 bp, Homo sapiens
ctgctctaggttcctgcatatg

SEQ ID NO: 7179172 - DNA, 22 bp, Homo sapiens
ctgctctagagagcattagtca

SEQ ID NO: 7179173 - DNA, 22 bp, Homo sapiens
ctgctctaggggcagggccctt

SEQ ID NO: 7179174 - DNA, 22 bp, Homo sapiens
ctgctctaatatcagatagact

SEQ ID NO: 7179175 - DNA, 22 bp, Homo sapiens
ctgctctaactgcattagtttt

SEQ ID NO: 7179176 - DNA, 22 bp, Homo sapiens
ctgctctaactgcattagtttt

SEQ ID NO: 7179177 - DNA, 22 bp, Homo sapiens
ctgctcctgtgggccagtggcc

SEQ ID NO: 7179178 - DNA, 22 bp, Homo sapiens
ctgctcctgtgggccagtggcc

SEQ ID NO: 7179179 - DNA, 22 bp, Homo sapiens
ctgctcctgtgggccagtggcc

SEQ ID NO: 7179180 - DNA, 22 bp, Homo sapiens
ctgctgcccctgagctcagcct

SEQ ID NO: 7179181 - DNA, 22 bp, Homo sapiens
ctgctgccctagacccagtcct

SEQ ID NO: 7179182 - DNA, 22 bp, Homo sapiens
ctgctgccctagacccagtcct

SEQ ID NO: 7179183 - DNA, 22 bp, Homo sapiens
ctgctgagccctggcacaggtg

SEQ ID NO: 7179184 - DNA, 22 bp, Homo sapiens
ctgctgagccctggcacaggtg

SEQ ID NO: 7179185 - DNA, 22 bp, Homo sapiens
ctgctgagcctggtgcgggatg

SEQ ID NO: 7179186 - DNA, 22 bp, Homo sapiens
ctgctgagcctggtgcgggatg

SEQ ID NO: 7179187 - DNA, 19 bp, Homo sapiens
ctgctgccggagactcgtc

SEQ ID NO: 7179188 - DNA, 22 bp, Homo sapiens
ctgctgccggcgagcctccctt

SEQ ID NO: 7179189 - DNA, 22 bp, Homo sapiens
ctgctgccggcgagcctccctt

SEQ ID NO: 7179190 - DNA, 20 bp, Homo sapiens
ctgctgccctgtcagcctct

SEQ ID NO: 7179191 - DNA, 20 bp, Homo sapiens
ctgctgccctgtcagcctct

SEQ ID NO: 7179192 - DNA, 20 bp, Homo sapiens
ctgctgccctgtcagcctct

SEQ ID NO: 7179193 - DNA, 19 bp, Homo sapiens
ctgctgccggagactcgtc

SEQ ID NO: 7179194 - DNA, 22 bp, Homo sapiens
ctgctgctgctatctacccagg

SEQ ID NO: 7179195 - DNA, 22 bp, Homo sapiens
ctgctgctgagaatgcctcagg

SEQ ID NO: 7179196 - DNA, 22 bp, Homo sapiens
ctgctgctgagagctcagcctg

SEQ ID NO: 7179197 - DNA, 22 bp, Homo sapiens
ctgctgctgtaaggcagaatta

SEQ ID NO: 7179198 - DNA, 21 bp, Homo sapiens
ctgctgctggggtctgggcag

SEQ ID NO: 7179199 - DNA, 22 bp, Homo sapiens
ctgctgcttagcatagcagagg

SEQ ID NO: 7179200 - DNA, 22 bp, Homo sapiens
ctgctgcttttgcgggagaaca

SEQ ID NO: 7179201 - DNA, 22 bp, Homo sapiens
ctgctgcctgattgcagacctc

SEQ ID NO: 7179202 - DNA, 22 bp, Homo sapiens
ctgctgctcagtgtcatcatgt

SEQ ID NO: 7179203 - DNA, 22 bp, Homo sapiens
ctgctgctcagtgtcatcatgt

SEQ ID NO: 7179204 - DNA, 22 bp, Homo sapiens
ctgctgctcgaccagtcccagg

SEQ ID NO: 7179205 - DNA, 22 bp, Homo sapiens
ctgctgctcgaccagtcccagg

SEQ ID NO: 7179206 - DNA, 22 bp, Homo sapiens
ctgctgctcttgtgcattagtg

SEQ ID NO: 7179207 - DNA, 22 bp, Homo sapiens
ctgctgctgagaatgcctcagg

SEQ ID NO: 7179208 - DNA, 22 bp, Homo sapiens
ctgctggcaagcccagttggag

SEQ ID NO: 7179209 - DNA, 22 bp, Homo sapiens
ctgctggcaagcccagttggag

SEQ ID NO: 7179210 - DNA, 22 bp, Homo sapiens
ctgctggaagtttgctgtggat

SEQ ID NO: 7179211 - DNA, 22 bp, Homo sapiens
ctgctggaagtttgctgtggat

SEQ ID NO: 7179212 - DNA, 22 bp, Homo sapiens
ctgctggaaggtacacatcttg

SEQ ID NO: 7179213 - DNA, 22 bp, Homo sapiens
ctgctggaagtttgctgtggat

SEQ ID NO: 7179214 - DNA, 22 bp, Homo sapiens
ctgctggactacaggaagagtt

SEQ ID NO: 7179215 - DNA, 22 bp, Homo sapiens
ctgctgggaaggtctgctcagt

SEQ ID NO: 7179216 - DNA, 22 bp, Homo sapiens
ctgctgggaaggtctgctcagt

SEQ ID NO: 7179217 - DNA, 22 bp, Homo sapiens
ctgctggcttctagtcattcaa

SEQ ID NO: 7179218 - DNA, 22 bp, Homo sapiens
ctgctggcttctagtcattcaa

SEQ ID NO: 7179219 - DNA, 22 bp, Homo sapiens
ctgctggcctcggccatgcctg

SEQ ID NO: 7179220 - DNA, 22 bp, Homo sapiens
ctgctggcctcggccatgcctg

SEQ ID NO: 7179221 - DNA, 22 bp, Homo sapiens
ctgctggcctagcccatcctct

SEQ ID NO: 7179222 - DNA, 22 bp, Homo sapiens
ctgcctgccttggcctccagga

SEQ ID NO: 7179223 - DNA, 22 bp, Homo sapiens
ctgcctgcgccaccaccacgtc

SEQ ID NO: 7179224 - DNA, 22 bp, Homo sapiens
ctgcctgcgccaccaccacgtc

SEQ ID NO: 7179225 - DNA, 22 bp, Homo sapiens
ctgcctgccttggcctccagga

SEQ ID NO: 7179226 - DNA, 22 bp, Homo sapiens
ctgcgggctgtcaggcgtgcca

SEQ ID NO: 7179227 - DNA, 22 bp, Homo sapiens
ctgcggtgggctgggctgtccc

SEQ ID NO: 7179228 - DNA, 22 bp, Homo sapiens
ctgcggtgggctgggctgtccc

SEQ ID NO: 7179229 - DNA, 22 bp, Homo sapiens
ctgcgtgcatgtctgcgtgcat

SEQ ID NO: 7179230 - DNA, 22 bp, Homo sapiens
ctgcgtgcattaatatttcctt

SEQ ID NO: 7179231 - DNA, 22 bp, Homo sapiens
ctgcgtgtctccttggggcaga

SEQ ID NO: 7179232 - DNA, 22 bp, Homo sapiens
ctgcgtgtctctgtctcatggc

SEQ ID NO: 7179233 - DNA, 22 bp, Homo sapiens
ctgcctgcctggagacagatgg

SEQ ID NO: 7179234 - DNA, 22 bp, Homo sapiens
ctgcctgccacgttcagctgta

SEQ ID NO: 7179235 - DNA, 22 bp, Homo sapiens
ctgcctgcctggagacagatgg

SEQ ID NO: 7179236 - DNA, 22 bp, Homo sapiens
ctgcctgcctggagacagatgg

SEQ ID NO: 7179237 - DNA, 22 bp, Homo sapiens
ctgcctgccttggcctccagga

SEQ ID NO: 7179238 - DNA, 22 bp, Homo sapiens
ctgcctgccttggcctccagga

SEQ ID NO: 7179239 - DNA, 22 bp, Homo sapiens
ctgcctgcatgctgccatagct

SEQ ID NO: 7179240 - DNA, 22 bp, Homo sapiens
ctgcctgcatgctgccatagct

SEQ ID NO: 7179241 - DNA, 22 bp, Homo sapiens
ctgcctgcatcccacagtgggg

SEQ ID NO: 7179242 - DNA, 22 bp, Homo sapiens
ctgcctgcatcccacagtgggg

SEQ ID NO: 7179243 - DNA, 22 bp, Homo sapiens
ctgcctgcactgcctggctcca

SEQ ID NO: 7179244 - DNA, 22 bp, Homo sapiens
ctgcctgaagaattgtgttgca

SEQ ID NO: 7179245 - DNA, 22 bp, Homo sapiens
ctgcctgactgataatctctga

SEQ ID NO: 7179246 - DNA, 22 bp, Homo sapiens
ctgcctgactgataatctctga

SEQ ID NO: 7179247 - DNA, 22 bp, Homo sapiens
ctgcctgagtacaagtcccaga

SEQ ID NO: 7179248 - DNA, 22 bp, Homo sapiens
ctgcctgagtggaggtcgaggg

SEQ ID NO: 7179249 - DNA, 22 bp, Homo sapiens
ctgcctgcactgcctggctcca

SEQ ID NO: 7179250 - DNA, 22 bp, Homo sapiens
ctgcctgcactgcctggctcca

SEQ ID NO: 7179251 - DNA, 22 bp, Homo sapiens
ctgcctgcactgcctggctcca

SEQ ID NO: 7179252 - DNA, 22 bp, Homo sapiens
ctgcctgcactgcctggctcca

SEQ ID NO: 7179253 - DNA, 22 bp, Homo sapiens
ctgcctgcactgcctggctcca

SEQ ID NO: 7179254 - DNA, 22 bp, Homo sapiens
ctgcctcttaagtggatggagt

SEQ ID NO: 7179255 - DNA, 22 bp, Homo sapiens
ctgcctcttaagtggatggagt

SEQ ID NO: 7179256 - DNA, 22 bp, Homo sapiens
ctgcctcttgacagatcgtggc

SEQ ID NO: 7179257 - DNA, 22 bp, Homo sapiens
ctgcctctgttgggcatggtct

SEQ ID NO: 7179258 - DNA, 22 bp, Homo sapiens
ctgcctctgttgggcatggtct

SEQ ID NO: 7179259 - DNA, 22 bp, Homo sapiens
ctgctccagacacctgcagggg

SEQ ID NO: 7179260 - DNA, 22 bp, Homo sapiens
ctgctccaggaacagagctgct

SEQ ID NO: 7179261 - DNA, 22 bp, Homo sapiens
ctgctccaggaacagagctgct

SEQ ID NO: 7179262 - DNA, 22 bp, Homo sapiens
ctgctccaggaacagagctgct

SEQ ID NO: 7179263 - DNA, 22 bp, Homo sapiens
ctgctccacctccgggtcaggc

SEQ ID NO: 7179264 - DNA, 22 bp, Homo sapiens
ctgctccagacacctgcagggg

SEQ ID NO: 7179265 - DNA, 22 bp, Homo sapiens
ctgctccagacacctgcagggg

SEQ ID NO: 7179266 - DNA, 22 bp, Homo sapiens
ctgctccagacacctgcagggg

SEQ ID NO: 7179267 - DNA, 22 bp, Homo sapiens
ctgctccaggaacagagctgct

SEQ ID NO: 7179268 - DNA, 23 bp, Homo sapiens
ctgctccaggacagcatggaggt

SEQ ID NO: 7179269 - DNA, 23 bp, Homo sapiens
ctgctccaggacagcatggaggt

SEQ ID NO: 7179270 - DNA, 23 bp, Homo sapiens
ctgctccaggacagcatggaggt

SEQ ID NO: 7179271 - DNA, 23 bp, Homo sapiens
ctgctccaggacagcatggaggt

SEQ ID NO: 7179272 - DNA, 19 bp, Homo sapiens
ctgctccaggagctgggga

SEQ ID NO: 7179273 - DNA, 19 bp, Homo sapiens
ctgctccaggagctgggga

SEQ ID NO: 7179274 - DNA, 22 bp, Homo sapiens
ctgctccaggatttcaggccag

SEQ ID NO: 7179275 - DNA, 22 bp, Homo sapiens
ctgctccacaccgtccatactc

SEQ ID NO: 7179276 - DNA, 20 bp, Homo sapiens
ctgctccacccggctctcag

SEQ ID NO: 7179277 - DNA, 20 bp, Homo sapiens
ctgctccacccggctctcag

SEQ ID NO: 7179278 - DNA, 22 bp, Homo sapiens
ctgctccacctccgggtcaggc

SEQ ID NO: 7179279 - DNA, 22 bp, Homo sapiens
ctgcgtgttcctgaagcgcgct

SEQ ID NO: 7179280 - DNA, 22 bp, Homo sapiens
ctgcgtgtttgcaccctgtctg

SEQ ID NO: 7179281 - DNA, 22 bp, Homo sapiens
ctgcgttctgcctggcggccta

SEQ ID NO: 7179282 - DNA, 22 bp, Homo sapiens
ctgctcctggtcatcctccact

SEQ ID NO: 7179283 - DNA, 22 bp, Homo sapiens
ctgctcctggtcatcctccact

SEQ ID NO: 7179284 - DNA, 22 bp, Homo sapiens
ctgctcctctgaggtagccaca

SEQ ID NO: 7179285 - DNA, 22 bp, Homo sapiens
ctgctcctggtcatcctccact

SEQ ID NO: 7179286 - DNA, 22 bp, Homo sapiens
ctgctcctgtccagcagggcca

SEQ ID NO: 7179287 - DNA, 22 bp, Homo sapiens
ctgctcctgtccagcagggcca

SEQ ID NO: 7179288 - DNA, 18 bp, Homo sapiens
ctgctccagtctggccag

SEQ ID NO: 7179289 - DNA, 22 bp, Homo sapiens
ctgctccaggatttcaggccag

SEQ ID NO: 7179290 - DNA, 22 bp, Homo sapiens
ctgctccagtagccccatgtgg

SEQ ID NO: 7179291 - DNA, 22 bp, Homo sapiens
ctgctccccagcctgcgccttt

SEQ ID NO: 7179292 - DNA, 19 bp, Homo sapiens
ctgctccctccttctggca

SEQ ID NO: 7179293 - DNA, 19 bp, Homo sapiens
ctgctccctccttctggca

SEQ ID NO: 7179294 - DNA, 22 bp, Homo sapiens
ctgctccccagcctgcgccttt

SEQ ID NO: 7179295 - DNA, 22 bp, Homo sapiens
ctgctcctccccatcaggcagc

SEQ ID NO: 7179296 - DNA, 22 bp, Homo sapiens
ttattattgtgacctgagaatg

SEQ ID NO: 7179297 - DNA, 22 bp, Homo sapiens
ttattattgtgacctgagaatg

SEQ ID NO: 7179298 - DNA, 22 bp, Homo sapiens
ttattattgtggttgcattatc

SEQ ID NO: 7179299 - DNA, 22 bp, Homo sapiens
ttattattgtggttgcattatc

SEQ ID NO: 7179300 - DNA, 22 bp, Homo sapiens
ttattcaccagtgtaaaacact

SEQ ID NO: 7179301 - DNA, 22 bp, Homo sapiens
ttattattttgtgtacagcaaa

SEQ ID NO: 7179302 - DNA, 22 bp, Homo sapiens
ttattattttgtgtacagcaaa

SEQ ID NO: 7179303 - DNA, 22 bp, Homo sapiens
ttattattttgtgtacagcaaa

SEQ ID NO: 7179304 - DNA, 22 bp, Homo sapiens
ttattattttgtgtacagcaaa

SEQ ID NO: 7179305 - DNA, 22 bp, Homo sapiens
ttattattttgtgtacagcaaa

SEQ ID NO: 7179306 - DNA, 22 bp, Homo sapiens
ttatttcatgtaaaatttatgt

SEQ ID NO: 7179307 - DNA, 22 bp, Homo sapiens
ttattcactcatttaacattat

SEQ ID NO: 7179308 - DNA, 22 bp, Homo sapiens
ttattcactcatttaacattat

SEQ ID NO: 7179309 - DNA, 22 bp, Homo sapiens
ttattcactcatttaacattat

SEQ ID NO: 7179310 - DNA, 22 bp, Homo sapiens
ttattcaccagtgtaaaacact

SEQ ID NO: 7179311 - DNA, 22 bp, Homo sapiens
ttattcacctctattagactca

SEQ ID NO: 7179312 - DNA, 22 bp, Homo sapiens
ttattcacctctattagactca

SEQ ID NO: 7179313 - DNA, 22 bp, Homo sapiens
ttattcactcattaaagcagga

SEQ ID NO: 7179314 - DNA, 22 bp, Homo sapiens
ttatttcattgatttctaagac

SEQ ID NO: 7179315 - DNA, 22 bp, Homo sapiens
ttatttcatgtaaaatttatgt

SEQ ID NO: 7179316 - DNA, 23 bp, Homo sapiens
ttattttgtcagaagggactttt

SEQ ID NO: 7179317 - DNA, 23 bp, Homo sapiens
ttattttgtcagaagggactttt

SEQ ID NO: 7179318 - DNA, 22 bp, Homo sapiens
ttatttttaaaagttcacacag

SEQ ID NO: 7179319 - DNA, 22 bp, Homo sapiens
ttatttttaaaagttcacacag

SEQ ID NO: 7179320 - DNA, 22 bp, Homo sapiens
ttatttttaaaagttcacacag

SEQ ID NO: 7179321 - DNA, 22 bp, Homo sapiens
ttatttttaaaagttcacacag

SEQ ID NO: 7179322 - DNA, 19 bp, Homo sapiens
cgcagagggcttctgagag

SEQ ID NO: 7179323 - DNA, 22 bp, Homo sapiens
cgcagcagccccgtggtaggtg

SEQ ID NO: 7179324 - DNA, 22 bp, Homo sapiens
cgcagagggcaggcagtgctgg

SEQ ID NO: 7179325 - DNA, 22 bp, Homo sapiens
cgcagagggcaggcagtgctgg

SEQ ID NO: 7179326 - DNA, 22 bp, Homo sapiens
cgcagagggagccgcgggctgc

SEQ ID NO: 7179327 - DNA, 22 bp, Homo sapiens
cgcagagggcaggcagtgctgg

SEQ ID NO: 7179328 - DNA, 22 bp, Homo sapiens
cgcagagggcaggcagtgctgg

SEQ ID NO: 7179329 - DNA, 22 bp, Homo sapiens
cgcagagggagccgcgggctgc

SEQ ID NO: 7179330 - DNA, 22 bp, Homo sapiens
cgcagagggagccgcgggctgc

SEQ ID NO: 7179331 - DNA, 21 bp, Homo sapiens
cgcagagcgaacttgcggcgc

SEQ ID NO: 7179332 - DNA, 22 bp, Homo sapiens
cgcactggagctggaacgagtc

SEQ ID NO: 7179333 - DNA, 21 bp, Homo sapiens
cgcagagcgaacttgcggcgc

SEQ ID NO: 7179334 - DNA, 21 bp, Homo sapiens
cgcagagcgaacttgcggcgc

SEQ ID NO: 7179335 - DNA, 21 bp, Homo sapiens
cgcagagcgaacttgcggcgc

SEQ ID NO: 7179336 - DNA, 21 bp, Homo sapiens
cgcagagcgaacttgcggcgc

SEQ ID NO: 7179337 - DNA, 21 bp, Homo sapiens
cgcagagcgaacttgcggcgc

SEQ ID NO: 7179338 - DNA, 22 bp, Homo sapiens
ttcaaaacagctagatattgga

SEQ ID NO: 7179339 - DNA, 22 bp, Homo sapiens
ttcaaaacagctagatattgga

SEQ ID NO: 7179340 - DNA, 22 bp, Homo sapiens
ttcaaaacagctagatattgga

SEQ ID NO: 7179341 - DNA, 22 bp, Homo sapiens
cgcaccactgaattccagcctg

SEQ ID NO: 7179342 - DNA, 22 bp, Homo sapiens
ttatttttaaaagttcacacag

SEQ ID NO: 7179343 - DNA, 22 bp, Homo sapiens
ttatttttaaaagttcacacag

SEQ ID NO: 7179344 - DNA, 22 bp, Homo sapiens
ttatttttaaaagttcacacag

SEQ ID NO: 7179345 - DNA, 17 bp, Homo sapiens
ttattttttgggctgag

SEQ ID NO: 7179346 - DNA, 22 bp, Homo sapiens
ttatttttaaaagttcacacag

SEQ ID NO: 7179347 - DNA, 22 bp, Homo sapiens
ttatttttaaaagttcacacag

SEQ ID NO: 7179348 - DNA, 22 bp, Homo sapiens
ttatttttaaaagttcacacag

SEQ ID NO: 7179349 - DNA, 22 bp, Homo sapiens
ttcaaaaaggtatgttcaagtc

SEQ ID NO: 7179350 - DNA, 22 bp, Homo sapiens
ttcaaaaaggtatgttcaagtc

SEQ ID NO: 7179351 - DNA, 22 bp, Homo sapiens
ttcaaaaaggtatgttcaagtc

SEQ ID NO: 7179352 - DNA, 22 bp, Homo sapiens
ttcaaaacaatctgtttgcatt

SEQ ID NO: 7179353 - DNA, 22 bp, Homo sapiens
ttcaaaaaggtatgttcaagtc

SEQ ID NO: 7179354 - DNA, 17 bp, Homo sapiens
ttattttttgggctgag

SEQ ID NO: 7179355 - DNA, 17 bp, Homo sapiens
ttattttttgggctgag

SEQ ID NO: 7179356 - DNA, 17 bp, Homo sapiens
ttattttttgggctgag

SEQ ID NO: 7179357 - DNA, 17 bp, Homo sapiens
ttattttttgggctgag

SEQ ID NO: 7179358 - DNA, 22 bp, Homo sapiens
cgatggaattggaaagaggaat

SEQ ID NO: 7179359 - DNA, 22 bp, Homo sapiens
cgatggagaggtcctgatagtt

SEQ ID NO: 7179360 - DNA, 22 bp, Homo sapiens
cgatgggggcagtgttacattg

SEQ ID NO: 7179361 - DNA, 22 bp, Homo sapiens
cgatggtatcggccagccccgg

SEQ ID NO: 7179362 - DNA, 18 bp, Homo sapiens
cgatgtgtatgtgatttg

SEQ ID NO: 7179363 - DNA, 18 bp, Homo sapiens
cgatgtgtatgtgatttg

SEQ ID NO: 7179364 - DNA, 22 bp, Homo sapiens
cgagtccagggttaggagtccg

SEQ ID NO: 7179365 - DNA, 21 bp, Homo sapiens
cgaggtgagctcttggctcag

SEQ ID NO: 7179366 - DNA, 22 bp, Homo sapiens
cgaggtgatggcatttagactc

SEQ ID NO: 7179367 - DNA, 22 bp, Homo sapiens
cgatcaccgtggccactttgag

SEQ ID NO: 7179368 - DNA, 22 bp, Homo sapiens
cgatgacagtgagttccttctt

SEQ ID NO: 7179369 - DNA, 22 bp, Homo sapiens
cgcaaagagctctaaatcagac

SEQ ID NO: 7179370 - DNA, 22 bp, Homo sapiens
cgcaacctgacagagccacgtc

SEQ ID NO: 7179371 - DNA, 22 bp, Homo sapiens
cgcaactcagcaacttaactgc

SEQ ID NO: 7179372 - DNA, 19 bp, Homo sapiens
cgcacagcctgccaggcgc

SEQ ID NO: 7179373 - DNA, 19 bp, Homo sapiens
cgcacagcctgccaggcgc

SEQ ID NO: 7179374 - DNA, 22 bp, Homo sapiens
cgcacagctgcaaggagttgca

SEQ ID NO: 7179375 - DNA, 22 bp, Homo sapiens
cgcacagctgcaaggagttgca

SEQ ID NO: 7179376 - DNA, 22 bp, Homo sapiens
cgcacattagaagtaactaatg

SEQ ID NO: 7179377 - DNA, 22 bp, Homo sapiens
cgcaccactgaattccagcctg

SEQ ID NO: 7179378 - DNA, 22 bp, Homo sapiens
cgcaccactgaattccagcctg

SEQ ID NO: 7179379 - DNA, 17 bp, Homo sapiens
cgagggcttgctggctc

SEQ ID NO: 7179380 - DNA, 22 bp, Homo sapiens
cgaggtagtggcggccgcggcc

SEQ ID NO: 7179381 - DNA, 22 bp, Homo sapiens
cgaggtgactttggtttagaca

SEQ ID NO: 7179382 - DNA, 22 bp, Homo sapiens
cgagcagaagcctggtggtctg

SEQ ID NO: 7179383 - DNA, 22 bp, Homo sapiens
cgagcagaatggagggtgccga

SEQ ID NO: 7179384 - DNA, 22 bp, Homo sapiens
cgagcagagcagagacgtctgg

SEQ ID NO: 7179385 - DNA, 22 bp, Homo sapiens
cgaggctagaggcaggctcggc

SEQ ID NO: 7179386 - DNA, 22 bp, Homo sapiens
cgaggctcagagagggtgactt

SEQ ID NO: 7179387 - DNA, 22 bp, Homo sapiens
cgagggctgtgttgctctcctt

SEQ ID NO: 7179388 - DNA, 22 bp, Homo sapiens
cctttgggaataggttccggct

SEQ ID NO: 7179389 - DNA, 22 bp, Homo sapiens
cctttggggctttactgtggaa

SEQ ID NO: 7179390 - DNA, 22 bp, Homo sapiens
cctttggggctttactgtggaa

SEQ ID NO: 7179391 - DNA, 22 bp, Homo sapiens
cctttggggtcctgcctgggct

SEQ ID NO: 7179392 - DNA, 22 bp, Homo sapiens
cctttggggtcctgcctgggct

SEQ ID NO: 7179393 - DNA, 22 bp, Homo sapiens
ttatgggagcaattggggaggt

SEQ ID NO: 7179394 - DNA, 23 bp, Homo sapiens
ttatggggaaggtgactgggaca

SEQ ID NO: 7179395 - DNA, 22 bp, Homo sapiens
ttatggggttgctgaattaggg

SEQ ID NO: 7179396 - DNA, 22 bp, Homo sapiens
ttatggggttgctgaattaggg

SEQ ID NO: 7179397 - DNA, 22 bp, Homo sapiens
ttatggcttgtgcaggatctag

SEQ ID NO: 7179398 - DNA, 22 bp, Homo sapiens
ttatgggagcaattggggaggt

SEQ ID NO: 7179399 - DNA, 22 bp, Homo sapiens
ttatgggagcaattggggaggt

SEQ ID NO: 7179400 - DNA, 22 bp, Homo sapiens
ttatgtaagtggagtcatatag

SEQ ID NO: 7179401 - DNA, 22 bp, Homo sapiens
ttatgtaagtggagtcatatag

SEQ ID NO: 7179402 - DNA, 22 bp, Homo sapiens
ttatgtaatttgtttgctcttc

SEQ ID NO: 7179403 - DNA, 22 bp, Homo sapiens
ttatgtacaatgttaatgtaaa

SEQ ID NO: 7179404 - DNA, 22 bp, Homo sapiens
ttatgtacctgaattagtaaag

SEQ ID NO: 7179405 - DNA, 22 bp, Homo sapiens
ttatgtactctgcaatgtttga

SEQ ID NO: 7179406 - DNA, 22 bp, Homo sapiens
ttatgtactctgcaatgtttga

SEQ ID NO: 7179407 - DNA, 22 bp, Homo sapiens
ttatgtagcagaaagatgtttg

SEQ ID NO: 7179408 - DNA, 22 bp, Homo sapiens
ttatgtatgaatatagtagaag

SEQ ID NO: 7179409 - DNA, 22 bp, Homo sapiens
ttatgtatgaatatagtagaag

SEQ ID NO: 7179410 - DNA, 22 bp, Homo sapiens
ttatgtatgaatatagtagaag

SEQ ID NO: 7179411 - DNA, 22 bp, Homo sapiens
cctttctgatggcctcccagcc

SEQ ID NO: 7179412 - DNA, 22 bp, Homo sapiens
cctttctgatggcctcccagcc

SEQ ID NO: 7179413 - DNA, 17 bp, Homo sapiens
cctttcttcccagaggg

SEQ ID NO: 7179414 - DNA, 17 bp, Homo sapiens
cctttcttcccagaggg

SEQ ID NO: 7179415 - DNA, 22 bp, Homo sapiens
cctttcttgctaagagtttatg

SEQ ID NO: 7179416 - DNA, 22 bp, Homo sapiens
cctttcttgctaagagtttatg

SEQ ID NO: 7179417 - DNA, 22 bp, Homo sapiens
cctttgcattctagatgtttag

SEQ ID NO: 7179418 - DNA, 22 bp, Homo sapiens
cctttcttttatccaccagcca

SEQ ID NO: 7179419 - DNA, 22 bp, Homo sapiens
cctttcttttatccaccagcca

SEQ ID NO: 7179420 - DNA, 22 bp, Homo sapiens
cctttgagcctgggcgcggacc

SEQ ID NO: 7179421 - DNA, 21 bp, Homo sapiens
cctttgagtgtgtttgaagta

SEQ ID NO: 7179422 - DNA, 22 bp, Homo sapiens
ccttctggagggtgtacgagag

SEQ ID NO: 7179423 - DNA, 22 bp, Homo sapiens
ccttctggagggtgtacgagag

SEQ ID NO: 7179424 - DNA, 22 bp, Homo sapiens
ccttctgctggtcatcccagtg

SEQ ID NO: 7179425 - DNA, 22 bp, Homo sapiens
ccttctgagcttcaatttcagt

SEQ ID NO: 7179426 - DNA, 21 bp, Homo sapiens
ccttctcttgcttcagcttca

SEQ ID NO: 7179427 - DNA, 18 bp, Homo sapiens
ccttctgacgcttgagaa

SEQ ID NO: 7179428 - DNA, 22 bp, Homo sapiens
ccttctgagtgtggacccctgt

SEQ ID NO: 7179429 - DNA, 22 bp, Homo sapiens
ccttctgagtgtggacccctgt

SEQ ID NO: 7179430 - DNA, 22 bp, Homo sapiens
ccttctgataactgtgaaattg

SEQ ID NO: 7179431 - DNA, 22 bp, Homo sapiens
ccttctgataactgtgaaattg

SEQ ID NO: 7179432 - DNA, 22 bp, Homo sapiens
ccttctgataactgtgaaattg

SEQ ID NO: 7179433 - DNA, 22 bp, Homo sapiens
ccttctgatactgacatcattt

SEQ ID NO: 7179434 - DNA, 22 bp, Homo sapiens
ccttctgatactgacatcattt

SEQ ID NO: 7179435 - DNA, 22 bp, Homo sapiens
ccttctgtctccctcatattga

SEQ ID NO: 7179436 - DNA, 22 bp, Homo sapiens
ccttctgtgtgcccacgtttat

SEQ ID NO: 7179437 - DNA, 22 bp, Homo sapiens
ccttctggatgtgctaaggaag

SEQ ID NO: 7179438 - DNA, 23 bp, Homo sapiens
ccttctgttaaccatctgggggg

SEQ ID NO: 7179439 - DNA, 22 bp, Homo sapiens
ttaccattgttccccatgtgta

SEQ ID NO: 7179440 - DNA, 22 bp, Homo sapiens
ttaccattttataagttaaagt

SEQ ID NO: 7179441 - DNA, 22 bp, Homo sapiens
ttacccagtgtggtttatagca

SEQ ID NO: 7179442 - DNA, 22 bp, Homo sapiens
ttaccgagaacatgactggaat

SEQ ID NO: 7179443 - DNA, 22 bp, Homo sapiens
ttacctaaaatagctcaattta

SEQ ID NO: 7179444 - DNA, 22 bp, Homo sapiens
ttacctgaaaggttaatttcca

SEQ ID NO: 7179445 - DNA, 22 bp, Homo sapiens
ttaccaagctctgcatgttaag

SEQ ID NO: 7179446 - DNA, 22 bp, Homo sapiens
ttaccaagctctgcatgttaag

SEQ ID NO: 7179447 - DNA, 22 bp, Homo sapiens
ttaccacagtgcctgtctaatg

SEQ ID NO: 7179448 - DNA, 22 bp, Homo sapiens
ttaccacctgtatcacattttt

SEQ ID NO: 7179449 - DNA, 22 bp, Homo sapiens
ttaccagatgggggactatgag

SEQ ID NO: 7179450 - DNA, 22 bp, Homo sapiens
ttaccaggaggcattctctgaa

SEQ ID NO: 7179451 - DNA, 22 bp, Homo sapiens
ttaccaggaggcattctctgaa

SEQ ID NO: 7179452 - DNA, 22 bp, Homo sapiens
ttaccagtggtacacatgacct

SEQ ID NO: 7179453 - DNA, 22 bp, Homo sapiens
ttaccataaagtttatctttct

SEQ ID NO: 7179454 - DNA, 21 bp, Homo sapiens
ccttctcttgcttcagcttca

SEQ ID NO: 7179455 - DNA, 21 bp, Homo sapiens
ccttctcttgcttcagcttca

SEQ ID NO: 7179456 - DNA, 21 bp, Homo sapiens
ccttctcttgcttcagcttca

SEQ ID NO: 7179457 - DNA, 20 bp, Homo sapiens
ccttctctggaattgcctcc

SEQ ID NO: 7179458 - DNA, 22 bp, Homo sapiens
ttacagaagtattgagagatcc

SEQ ID NO: 7179459 - DNA, 21 bp, Homo sapiens
ccttctccacagggtctccgg

SEQ ID NO: 7179460 - DNA, 20 bp, Homo sapiens
ccttctccagcttgttcttg

SEQ ID NO: 7179461 - DNA, 20 bp, Homo sapiens
ccttctccagcttgttcttg

SEQ ID NO: 7179462 - DNA, 22 bp, Homo sapiens
ttacagaagagtaacttggcaa

SEQ ID NO: 7179463 - DNA, 22 bp, Homo sapiens
ttacagaagagtaacttggcaa

SEQ ID NO: 7179464 - DNA, 22 bp, Homo sapiens
ttacagaagagtaacttggcaa

SEQ ID NO: 7179465 - DNA, 22 bp, Homo sapiens
ttacagaagagaaagaattcag

SEQ ID NO: 7179466 - DNA, 22 bp, Homo sapiens
ttacagaagagaaagaattcag

SEQ ID NO: 7179467 - DNA, 22 bp, Homo sapiens
ttacagaagagaaagaattcag

SEQ ID NO: 7179468 - DNA, 22 bp, Homo sapiens
ttacagaagagaaagaattcag

SEQ ID NO: 7179469 - DNA, 22 bp, Homo sapiens
ttacagaagagaaagaattcag

SEQ ID NO: 7179470 - DNA, 22 bp, Homo sapiens
ttacagaagtattgagagatcc

SEQ ID NO: 7179471 - DNA, 22 bp, Homo sapiens
ttacagaagtattgagagatcc

SEQ ID NO: 7179472 - DNA, 22 bp, Homo sapiens
ttacagaaggaacactactcag

SEQ ID NO: 7179473 - DNA, 22 bp, Homo sapiens
ttacagaagagtaacttggcaa

SEQ ID NO: 7179474 - DNA, 22 bp, Homo sapiens
ttacagaaggaacactactcag

SEQ ID NO: 7179475 - DNA, 22 bp, Homo sapiens
ttacagaaggaacactactcag

SEQ ID NO: 7179476 - DNA, 22 bp, Homo sapiens
ttacagaaggaacactactcag

SEQ ID NO: 7179477 - DNA, 22 bp, Homo sapiens
ttacagaaggaacactactcag

SEQ ID NO: 7179478 - DNA, 22 bp, Homo sapiens
ttacagaactgtcttgaaattt

SEQ ID NO: 7179479 - DNA, 22 bp, Homo sapiens
ttacagaactgtcttgaaattt

SEQ ID NO: 7179480 - DNA, 22 bp, Homo sapiens
ttacagaactgtcttgaaattt

SEQ ID NO: 7179481 - DNA, 22 bp, Homo sapiens
ttacagaactgtcttgaaattt

SEQ ID NO: 7179482 - DNA, 20 bp, Homo sapiens
ttacagaaatgatgttattt

SEQ ID NO: 7179483 - DNA, 20 bp, Homo sapiens
ttacagaaatgatgttattt

SEQ ID NO: 7179484 - DNA, 20 bp, Homo sapiens
ttacagaaatgatgttattt

SEQ ID NO: 7179485 - DNA, 22 bp, Homo sapiens
ttacagaactgccctagttggc

SEQ ID NO: 7179486 - DNA, 22 bp, Homo sapiens
ttacagaactgccctagttggc

SEQ ID NO: 7179487 - DNA, 22 bp, Homo sapiens
ttacagaactgccctagttggc

SEQ ID NO: 7179488 - DNA, 20 bp, Homo sapiens
ttacagaaatgatgttattt

SEQ ID NO: 7179489 - DNA, 20 bp, Homo sapiens
ttacagaaatgatgttattt

SEQ ID NO: 7179490 - DNA, 22 bp, Homo sapiens
ttacagaaagtttcccatgccg

SEQ ID NO: 7179491 - DNA, 22 bp, Homo sapiens
ttacagaaaggttgtgggatag

SEQ ID NO: 7179492 - DNA, 22 bp, Homo sapiens
ttacagaaaggttgtgggatag

SEQ ID NO: 7179493 - DNA, 23 bp, Homo sapiens
ttacagaaagtatgcttttgttt

SEQ ID NO: 7179494 - DNA, 23 bp, Homo sapiens
ttacagaaagtatgcttttgttt

SEQ ID NO: 7179495 - DNA, 19 bp, Homo sapiens
ttacaatgacccaatctgg

SEQ ID NO: 7179496 - DNA, 22 bp, Homo sapiens
ttacaatgagaaatggttggca

SEQ ID NO: 7179497 - DNA, 22 bp, Homo sapiens
ttacaatgatgaataaatggca

SEQ ID NO: 7179498 - DNA, 22 bp, Homo sapiens
ttacaatgatgaataaatggca

SEQ ID NO: 7179499 - DNA, 22 bp, Homo sapiens
ttacaatgatgggattcagcca

SEQ ID NO: 7179500 - DNA, 22 bp, Homo sapiens
ttacagaaaatgtgttttaact

SEQ ID NO: 7179501 - DNA, 22 bp, Homo sapiens
ttacagaaaggaaggactgact

SEQ ID NO: 7179502 - DNA, 22 bp, Homo sapiens
ttacagaaaggaaggactgact

SEQ ID NO: 7179503 - DNA, 22 bp, Homo sapiens
ccttgggaggctcccagggaga

SEQ ID NO: 7179504 - DNA, 22 bp, Homo sapiens
ccttgggaggctcccagggaga

SEQ ID NO: 7179505 - DNA, 22 bp, Homo sapiens
ccttgggaccctgctggaggtt

SEQ ID NO: 7179506 - DNA, 21 bp, Homo sapiens
ccttgggatgcaagtgagact

SEQ ID NO: 7179507 - DNA, 22 bp, Homo sapiens
ccttgggcttgggcatagcttt

SEQ ID NO: 7179508 - DNA, 22 bp, Homo sapiens
ccttggggaactggacgtgctg

SEQ ID NO: 7179509 - DNA, 22 bp, Homo sapiens
ccttggggaactggacgtgctg

SEQ ID NO: 7179510 - DNA, 22 bp, Homo sapiens
ccttgggaccctgctggaggtt

SEQ ID NO: 7179511 - DNA, 22 bp, Homo sapiens
ccttggcttgtgggctgcagcc

SEQ ID NO: 7179512 - DNA, 19 bp, Homo sapiens
ccttggctttaactatgaa

SEQ ID NO: 7179513 - DNA, 22 bp, Homo sapiens
ccttggcttgtgggctgcagcc

SEQ ID NO: 7179514 - DNA, 22 bp, Homo sapiens
ccttggcttgtgggctgcagcc

SEQ ID NO: 7179515 - DNA, 22 bp, Homo sapiens
ccttggcttgcacacggccacc

SEQ ID NO: 7179516 - DNA, 22 bp, Homo sapiens
ccttggcttccttccctctaga

SEQ ID NO: 7179517 - DNA, 22 bp, Homo sapiens
ccttggcttccttccctctaga

SEQ ID NO: 7179518 - DNA, 22 bp, Homo sapiens
ccttggcttaccttctgtgtgg

SEQ ID NO: 7179519 - DNA, 20 bp, Homo sapiens
ccttggcttaataataggga

SEQ ID NO: 7179520 - DNA, 22 bp, Homo sapiens
ccttggctgtgttgcctgccct

SEQ ID NO: 7179521 - DNA, 21 bp, Homo sapiens
ccttggctggcatctagcacc

SEQ ID NO: 7179522 - DNA, 22 bp, Homo sapiens
ccttggctgtgctgccctttgc

SEQ ID NO: 7179523 - DNA, 22 bp, Homo sapiens
ccttggctgtgctgccctttgc

SEQ ID NO: 7179524 - DNA, 22 bp, Homo sapiens
ccttggctggaattactctggg

SEQ ID NO: 7179525 - DNA, 22 bp, Homo sapiens
ccttggctggaattactctggg

SEQ ID NO: 7179526 - DNA, 22 bp, Homo sapiens
ccttggctggaattactctggg

SEQ ID NO: 7179527 - DNA, 19 bp, Homo sapiens
ccttgcctgtccctgcagc

SEQ ID NO: 7179528 - DNA, 22 bp, Homo sapiens
ccttggctgcttatatgtctgt

SEQ ID NO: 7179529 - DNA, 21 bp, Homo sapiens
ttactaaacaaaacatgcagg

SEQ ID NO: 7179530 - DNA, 22 bp, Homo sapiens
ttacgaatgttagattgcatct

SEQ ID NO: 7179531 - DNA, 21 bp, Homo sapiens
ttactaaacaaaacatgcagg

SEQ ID NO: 7179532 - DNA, 22 bp, Homo sapiens
ttacctgtgtcagtatatgaga

SEQ ID NO: 7179533 - DNA, 19 bp, Homo sapiens
ccttgtttggtctttgagc

SEQ ID NO: 7179534 - DNA, 22 bp, Homo sapiens
ccttgtgtttacacctgtcttt

SEQ ID NO: 7179535 - DNA, 22 bp, Homo sapiens
ccttgttttcaaggtaggttct

SEQ ID NO: 7179536 - DNA, 22 bp, Homo sapiens
cctttaaagactgcataacttc

SEQ ID NO: 7179537 - DNA, 22 bp, Homo sapiens
ccttgtgtttacacctgtcttt

SEQ ID NO: 7179538 - DNA, 22 bp, Homo sapiens
ccttgtcctctggtttcctgtt

SEQ ID NO: 7179539 - DNA, 23 bp, Homo sapiens
ccttgtctggctggctggacttt

SEQ ID NO: 7179540 - DNA, 22 bp, Homo sapiens
ccttggtgatctgggctggaag

SEQ ID NO: 7179541 - DNA, 22 bp, Homo sapiens
ccttgggttccaagtcactgaa

SEQ ID NO: 7179542 - DNA, 22 bp, Homo sapiens
ccttggtccaaccctgcacagc

SEQ ID NO: 7179543 - DNA, 22 bp, Homo sapiens
ccttggtccctccccagaccaa

SEQ ID NO: 7179544 - DNA, 22 bp, Homo sapiens
ccttggttctgcctggcctgga

SEQ ID NO: 7179545 - DNA, 22 bp, Homo sapiens
ccttggtttccaggatgaggct

SEQ ID NO: 7179546 - DNA, 22 bp, Homo sapiens
ccttggtttccaggatgaggct

SEQ ID NO: 7179547 - DNA, 22 bp, Homo sapiens
ccttggttttaccaggtgttca

SEQ ID NO: 7179548 - DNA, 22 bp, Homo sapiens
ccttggggaatatccattcttc

SEQ ID NO: 7179549 - DNA, 22 bp, Homo sapiens
ccttggggaatatccattcttc

SEQ ID NO: 7179550 - DNA, 22 bp, Homo sapiens
ccttggggtgttggaggcagcc

SEQ ID NO: 7179551 - DNA, 22 bp, Homo sapiens
ccttggggtgttggaggcagcc

SEQ ID NO: 7179552 - DNA, 22 bp, Homo sapiens
ccttggggaatatccattcttc

SEQ ID NO: 7179553 - DNA, 22 bp, Homo sapiens
cctttaaatggatgttcaactg

SEQ ID NO: 7179554 - DNA, 22 bp, Homo sapiens
cctttaatttacaatgttaatt

SEQ ID NO: 7179555 - DNA, 21 bp, Homo sapiens
cctttacaattttgcattcct

SEQ ID NO: 7179556 - DNA, 21 bp, Homo sapiens
cctttacaattttgcattcct

SEQ ID NO: 7179557 - DNA, 22 bp, Homo sapiens
cctttacagtatggttgtatca

SEQ ID NO: 7179558 - DNA, 22 bp, Homo sapiens
ttatctagatgtgttatcagac

SEQ ID NO: 7179559 - DNA, 22 bp, Homo sapiens
ttatctacgtatttaaactctt

SEQ ID NO: 7179560 - DNA, 22 bp, Homo sapiens
ttatctacgtatttaaactctt

SEQ ID NO: 7179561 - DNA, 22 bp, Homo sapiens
ttatggctagactagtttttga

SEQ ID NO: 7179562 - DNA, 22 bp, Homo sapiens
ttatggctaggatatgtgtgta

SEQ ID NO: 7179563 - DNA, 20 bp, Homo sapiens
ttatggctcctaccttgtga

SEQ ID NO: 7179564 - DNA, 22 bp, Homo sapiens
ttatggctgaataaattatggt

SEQ ID NO: 7179565 - DNA, 21 bp, Homo sapiens
tggttcagttcgttacgtgtg

SEQ ID NO: 7179566 - DNA, 17 bp, Homo sapiens
tggttccaaccatacgc

SEQ ID NO: 7179567 - DNA, 22 bp, Homo sapiens
tggttcctcaagcgctggcggc

SEQ ID NO: 7179568 - DNA, 22 bp, Homo sapiens
cctgcgggctggtaagaggctt

SEQ ID NO: 7179569 - DNA, 22 bp, Homo sapiens
cctgcgggctgtgctgaagcct

SEQ ID NO: 7179570 - DNA, 22 bp, Homo sapiens
cctgcgtcgtgtgggcagtgac

SEQ ID NO: 7179571 - DNA, 22 bp, Homo sapiens
cctgctaataaggtagaaatat

SEQ ID NO: 7179572 - DNA, 22 bp, Homo sapiens
cctgccttgacgtaacgcatga

SEQ ID NO: 7179573 - DNA, 22 bp, Homo sapiens
cctgcctttctcagtaatcttt

SEQ ID NO: 7179574 - DNA, 22 bp, Homo sapiens
cctgctccatgctcaccatcag

SEQ ID NO: 7179575 - DNA, 22 bp, Homo sapiens
cctgctcatgggtccctggcag

SEQ ID NO: 7179576 - DNA, 23 bp, Homo sapiens
cctgctcaggcgtgtgccctgct

SEQ ID NO: 7179577 - DNA, 23 bp, Homo sapiens
cctgctcaggcgtgtgccctgct

SEQ ID NO: 7179578 - DNA, 22 bp, Homo sapiens
cctgctcagctgtcctcacgct

SEQ ID NO: 7179579 - DNA, 22 bp, Homo sapiens
cctgctcagctgtcctcacgct

SEQ ID NO: 7179580 - DNA, 22 bp, Homo sapiens
cctgctcagctgtcctcacgct

SEQ ID NO: 7179581 - DNA, 22 bp, Homo sapiens
cctgctcagccccagctcaccc

SEQ ID NO: 7179582 - DNA, 22 bp, Homo sapiens
cctgctcagccccagctcaccc

SEQ ID NO: 7179583 - DNA, 22 bp, Homo sapiens
cctgctcagctgtcctcacgct

SEQ ID NO: 7179584 - DNA, 22 bp, Homo sapiens
cctgctcacctgatgtggcaac

SEQ ID NO: 7179585 - DNA, 22 bp, Homo sapiens
tgttggcatctctgagagagtt

SEQ ID NO: 7179586 - DNA, 23 bp, Homo sapiens
tgttgctgcctttctaggatcag

SEQ ID NO: 7179587 - DNA, 19 bp, Homo sapiens
tgttggaggtgctgaatta

SEQ ID NO: 7179588 - DNA, 19 bp, Homo sapiens
tgttgccaggtatcatgtt

SEQ ID NO: 7179589 - DNA, 22 bp, Homo sapiens
tgttgcccaggttctctcctgc

SEQ ID NO: 7179590 - DNA, 22 bp, Homo sapiens
tgttgcctggggaagctctgat

SEQ ID NO: 7179591 - DNA, 22 bp, Homo sapiens
tgttgcctaactgccctctgaa

SEQ ID NO: 7179592 - DNA, 22 bp, Homo sapiens
tgttgcctgactttaaaatgtg

SEQ ID NO: 7179593 - DNA, 22 bp, Homo sapiens
tgttgctaaggggaatgagagc

SEQ ID NO: 7179594 - DNA, 22 bp, Homo sapiens
tgttgctcttcatacatcaatg

SEQ ID NO: 7179595 - DNA, 22 bp, Homo sapiens
tgttgctgacaagagaggagca

SEQ ID NO: 7179596 - DNA, 20 bp, Homo sapiens
tgttgattggtgtcatctca

SEQ ID NO: 7179597 - DNA, 20 bp, Homo sapiens
tgttgattggtgtcatctca

SEQ ID NO: 7179598 - DNA, 20 bp, Homo sapiens
tgttgattggtgtcatctca

SEQ ID NO: 7179599 - DNA, 20 bp, Homo sapiens
tgttgattggtgtcatctca

SEQ ID NO: 7179600 - DNA, 22 bp, Homo sapiens
tgttgatttgtgggctgcaaaa

SEQ ID NO: 7179601 - DNA, 22 bp, Homo sapiens
tgttgatttgtgggctgcaaaa

SEQ ID NO: 7179602 - DNA, 22 bp, Homo sapiens
tgttgcagtagcagtagttgca

SEQ ID NO: 7179603 - DNA, 22 bp, Homo sapiens
tgttgcagtagcagtagttgca

SEQ ID NO: 7179604 - DNA, 22 bp, Homo sapiens
tgttcccacaccagcctcagcc

SEQ ID NO: 7179605 - DNA, 22 bp, Homo sapiens
tgttcccacaccagcctcagcc

SEQ ID NO: 7179606 - DNA, 22 bp, Homo sapiens
tgttgattagtgtttagactta

SEQ ID NO: 7179607 - DNA, 22 bp, Homo sapiens
cctgctcctatctgggctcatt

SEQ ID NO: 7179608 - DNA, 22 bp, Homo sapiens
cctgctcctatctgggctcatt

SEQ ID NO: 7179609 - DNA, 22 bp, Homo sapiens
cctgctccatgctcaccatcag

SEQ ID NO: 7179610 - DNA, 22 bp, Homo sapiens
cctggggagagaaagcccagcc

SEQ ID NO: 7179611 - DNA, 22 bp, Homo sapiens
cctggggagagaaagcccagcc

SEQ ID NO: 7179612 - DNA, 22 bp, Homo sapiens
cctggggagagaaagcccagcc

SEQ ID NO: 7179613 - DNA, 22 bp, Homo sapiens
cctggggagccgcctgagcccc

SEQ ID NO: 7179614 - DNA, 22 bp, Homo sapiens
cctggggagagaaagcccagcc

SEQ ID NO: 7179615 - DNA, 22 bp, Homo sapiens
cctggggagaagagcttccccc

SEQ ID NO: 7179616 - DNA, 22 bp, Homo sapiens
cctggggagaagagcttccccc

SEQ ID NO: 7179617 - DNA, 22 bp, Homo sapiens
cctggggagagaaagcccagcc

SEQ ID NO: 7179618 - DNA, 22 bp, Homo sapiens
cctggggagccgcctgagcccc

SEQ ID NO: 7179619 - DNA, 22 bp, Homo sapiens
cctggggagccgcctgagcccc

SEQ ID NO: 7179620 - DNA, 23 bp, Homo sapiens
cctggggagctgtatccagagtg

SEQ ID NO: 7179621 - DNA, 23 bp, Homo sapiens
cctggggagctgtatccagagtg

SEQ ID NO: 7179622 - DNA, 23 bp, Homo sapiens
cctggggagctgtatccagagtg

SEQ ID NO: 7179623 - DNA, 22 bp, Homo sapiens
cctggggattctgacacggagt

SEQ ID NO: 7179624 - DNA, 22 bp, Homo sapiens
cctggggattctgacacggagt

SEQ ID NO: 7179625 - DNA, 22 bp, Homo sapiens
cctggggattctgacacggagt

SEQ ID NO: 7179626 - DNA, 22 bp, Homo sapiens
cctggggattctgacacggagt

SEQ ID NO: 7179627 - DNA, 22 bp, Homo sapiens
cctggggattctgacacggagt

SEQ ID NO: 7179628 - DNA, 23 bp, Homo sapiens
cctggggcacttgagtcctcatc

SEQ ID NO: 7179629 - DNA, 23 bp, Homo sapiens
cctggggcacttgagtcctcatc

SEQ ID NO: 7179630 - DNA, 22 bp, Homo sapiens
cctggggattctgacacggagt

SEQ ID NO: 7179631 - DNA, 23 bp, Homo sapiens
cctggggcacttgagtcctcatc

SEQ ID NO: 7179632 - DNA, 22 bp, Homo sapiens
tgtttctaggtcaataattttt

SEQ ID NO: 7179633 - DNA, 22 bp, Homo sapiens
tgtttctaggtcaataattttt

SEQ ID NO: 7179634 - DNA, 22 bp, Homo sapiens
tgtttctagagaaaatatttac

SEQ ID NO: 7179635 - DNA, 22 bp, Homo sapiens
tgtttctataacctctgaagca

SEQ ID NO: 7179636 - DNA, 22 bp, Homo sapiens
tgtttctatctggatcaataga

SEQ ID NO: 7179637 - DNA, 22 bp, Homo sapiens
tgtttataccttggtataacca

SEQ ID NO: 7179638 - DNA, 22 bp, Homo sapiens
tgtttctagagaaaatatttac

SEQ ID NO: 7179639 - DNA, 22 bp, Homo sapiens
tgtttatacctgcaacctgtca

SEQ ID NO: 7179640 - DNA, 22 bp, Homo sapiens
tgtttatacctgcaacctgtca

SEQ ID NO: 7179641 - DNA, 22 bp, Homo sapiens
tgtttataccttggtataacca

SEQ ID NO: 7179642 - DNA, 22 bp, Homo sapiens
tgtttataccttggtataacca

SEQ ID NO: 7179643 - DNA, 22 bp, Homo sapiens
cctggggctcaagatggcgccg

SEQ ID NO: 7179644 - DNA, 22 bp, Homo sapiens
cctggggctcaagatggcgccg

SEQ ID NO: 7179645 - DNA, 23 bp, Homo sapiens
cctggggcacttgagtcctcatc

SEQ ID NO: 7179646 - DNA, 23 bp, Homo sapiens
cctggggcacttgagtcctcatc

SEQ ID NO: 7179647 - DNA, 22 bp, Homo sapiens
cctggggccccgagccagaagc

SEQ ID NO: 7179648 - DNA, 22 bp, Homo sapiens
cctggggccccgagccagaagc

SEQ ID NO: 7179649 - DNA, 22 bp, Homo sapiens
cctggggccccgagccagaagc

SEQ ID NO: 7179650 - DNA, 22 bp, Homo sapiens
tgtttcttatccaagtggtctg

SEQ ID NO: 7179651 - DNA, 22 bp, Homo sapiens
tgtttcttatccaagtggtctg

SEQ ID NO: 7179652 - DNA, 22 bp, Homo sapiens
tgtttcttacgtttttagaggc

SEQ ID NO: 7179653 - DNA, 22 bp, Homo sapiens
tgtttcttacgtttttagaggc

SEQ ID NO: 7179654 - DNA, 20 bp, Homo sapiens
tgtttctgacggtaggagag

SEQ ID NO: 7179655 - DNA, 22 bp, Homo sapiens
tgtttcttgagagtattaccct

SEQ ID NO: 7179656 - DNA, 19 bp, Homo sapiens
tgtttcttcctccatctga

SEQ ID NO: 7179657 - DNA, 19 bp, Homo sapiens
tgtttcttcctccatctga

SEQ ID NO: 7179658 - DNA, 22 bp, Homo sapiens
tgtttcttctcacacaaactca

SEQ ID NO: 7179659 - DNA, 22 bp, Homo sapiens
tgtttcttctcacacaaactca

SEQ ID NO: 7179660 - DNA, 22 bp, Homo sapiens
tgtttcttctcacacaaactca

SEQ ID NO: 7179661 - DNA, 19 bp, Homo sapiens
tgtttcttcctccatctga

SEQ ID NO: 7179662 - DNA, 19 bp, Homo sapiens
tgtttcttcctccatctga

SEQ ID NO: 7179663 - DNA, 22 bp, Homo sapiens
tgttttcatttgatgtaacaaa

SEQ ID NO: 7179664 - DNA, 17 bp, Homo sapiens
tgttttcattcattgct

SEQ ID NO: 7179665 - DNA, 22 bp, Homo sapiens
tgttttcatttgatgtaacaaa

SEQ ID NO: 7179666 - DNA, 22 bp, Homo sapiens
tgttttcatttgatgtaacaaa

SEQ ID NO: 7179667 - DNA, 22 bp, Homo sapiens
tgttttcatttgatgtaacaaa

SEQ ID NO: 7179668 - DNA, 22 bp, Homo sapiens
tgttttcctcctggtttctgcc

SEQ ID NO: 7179669 - DNA, 22 bp, Homo sapiens
tgttttcctcctggtttctgcc

SEQ ID NO: 7179670 - DNA, 21 bp, Homo sapiens
tgttttctaaagggcggatca

SEQ ID NO: 7179671 - DNA, 21 bp, Homo sapiens
tgttttctaaagggcggatca

SEQ ID NO: 7179672 - DNA, 22 bp, Homo sapiens
tgttttcatggttatgtgtcta

SEQ ID NO: 7179673 - DNA, 22 bp, Homo sapiens
tgttttcatcacagaatgtaac

SEQ ID NO: 7179674 - DNA, 22 bp, Homo sapiens
tgttttcatggagatggtggcg

SEQ ID NO: 7179675 - DNA, 22 bp, Homo sapiens
tgttttcagtcatatagcaggt

SEQ ID NO: 7179676 - DNA, 22 bp, Homo sapiens
tgttttcatcacagaatgtaac

SEQ ID NO: 7179677 - DNA, 22 bp, Homo sapiens
tgttttcatggttatgtgtcta

SEQ ID NO: 7179678 - DNA, 17 bp, Homo sapiens
tgttttcattcattgct

SEQ ID NO: 7179679 - DNA, 17 bp, Homo sapiens
tgttttcattcattgct

SEQ ID NO: 7179680 - DNA, 17 bp, Homo sapiens
tgttttcattcattgct

SEQ ID NO: 7179681 - DNA, 17 bp, Homo sapiens
tgttttcattcattgct

SEQ ID NO: 7179682 - DNA, 17 bp, Homo sapiens
tgttttcattcattgct

SEQ ID NO: 7179683 - DNA, 17 bp, Homo sapiens
tgttttcattcattgct

SEQ ID NO: 7179684 - DNA, 17 bp, Homo sapiens
tgttttcattcattgct

SEQ ID NO: 7179685 - DNA, 22 bp, Homo sapiens
cctgtggctctctttggaggtc

SEQ ID NO: 7179686 - DNA, 18 bp, Homo sapiens
cctgtggctcagcccaca

SEQ ID NO: 7179687 - DNA, 18 bp, Homo sapiens
cctgtggctcagcccaca

SEQ ID NO: 7179688 - DNA, 22 bp, Homo sapiens
cctgtggcgggggccagtgcct

SEQ ID NO: 7179689 - DNA, 18 bp, Homo sapiens
cctgtggctcagcccaca

SEQ ID NO: 7179690 - DNA, 22 bp, Homo sapiens
ttacaagtatttaagatgctgt

SEQ ID NO: 7179691 - DNA, 21 bp, Homo sapiens
ttacaaagctacagatgttgc

SEQ ID NO: 7179692 - DNA, 21 bp, Homo sapiens
ttacaaagctacagatgttgc

SEQ ID NO: 7179693 - DNA, 21 bp, Homo sapiens
ttacaaagctacagatgttgc

SEQ ID NO: 7179694 - DNA, 22 bp, Homo sapiens
cctgtggctggtcaggccagca

SEQ ID NO: 7179695 - DNA, 22 bp, Homo sapiens
ttacaataccacatcacctcat

SEQ ID NO: 7179696 - DNA, 22 bp, Homo sapiens
ttacaagtttctggcttcatcc

SEQ ID NO: 7179697 - DNA, 22 bp, Homo sapiens
ttacaagtttctggcttcatcc

SEQ ID NO: 7179698 - DNA, 22 bp, Homo sapiens
ttacaagtgtcaggtactggca

SEQ ID NO: 7179699 - DNA, 22 bp, Homo sapiens
ttacaatagttccttcttttgt

SEQ ID NO: 7179700 - DNA, 22 bp, Homo sapiens
ttacaatagttccttcttttgt

SEQ ID NO: 7179701 - DNA, 22 bp, Homo sapiens
ttacaatagttccttcttttgt

SEQ ID NO: 7179702 - DNA, 22 bp, Homo sapiens
ttacaatagttccttcttttgt

SEQ ID NO: 7179703 - DNA, 22 bp, Homo sapiens
ttacaataccacatcacctcat

SEQ ID NO: 7179704 - DNA, 22 bp, Homo sapiens
ttacaataccacatcacctcat

SEQ ID NO: 7179705 - DNA, 22 bp, Homo sapiens
ttacaatagttccttcttttgt

SEQ ID NO: 7179706 - DNA, 22 bp, Homo sapiens
ttacaatagttccttcttttgt

SEQ ID NO: 7179707 - DNA, 22 bp, Homo sapiens
ttacaatgacaggtgtatcatt

SEQ ID NO: 7179708 - DNA, 22 bp, Homo sapiens
ttacaatgacaggtgtatcatt

SEQ ID NO: 7179709 - DNA, 22 bp, Homo sapiens
ttaatccatggcagttattaaa

SEQ ID NO: 7179710 - DNA, 22 bp, Homo sapiens
ttaatctcttagcaaattaatg

SEQ ID NO: 7179711 - DNA, 22 bp, Homo sapiens
ttaatctgaatcagtaaacact

SEQ ID NO: 7179712 - DNA, 22 bp, Homo sapiens
ttaatcttatatgtaaaggtaa

SEQ ID NO: 7179713 - DNA, 22 bp, Homo sapiens
ttaatcttatatgtaaaggtaa

SEQ ID NO: 7179714 - DNA, 22 bp, Homo sapiens
ttaatccaatatcctggctatt

SEQ ID NO: 7179715 - DNA, 22 bp, Homo sapiens
ttaatccaataacaaggttcaa

SEQ ID NO: 7179716 - DNA, 22 bp, Homo sapiens
ttaatccaataacaaggttcaa

SEQ ID NO: 7179717 - DNA, 23 bp, Homo sapiens
ttaatcagatgagttgaaagaga

SEQ ID NO: 7179718 - DNA, 22 bp, Homo sapiens
ttaatcaagagtggggactgtg

SEQ ID NO: 7179719 - DNA, 22 bp, Homo sapiens
ttaatgaatgtgtgctaacgtt

SEQ ID NO: 7179720 - DNA, 22 bp, Homo sapiens
ttaatgaatatgacaggagagg

SEQ ID NO: 7179721 - DNA, 22 bp, Homo sapiens
ttaatgaaaggcagtttggaac

SEQ ID NO: 7179722 - DNA, 22 bp, Homo sapiens
ttaatcttcagggactcttgct

SEQ ID NO: 7179723 - DNA, 22 bp, Homo sapiens
ttaatgaaacattgactatgat

SEQ ID NO: 7179724 - DNA, 22 bp, Homo sapiens
ttaatgaaacattgactatgat

SEQ ID NO: 7179725 - DNA, 22 bp, Homo sapiens
ttaatgatacctatgttaattt

SEQ ID NO: 7179726 - DNA, 22 bp, Homo sapiens
ttaatgatgaagtctggctgta

SEQ ID NO: 7179727 - DNA, 22 bp, Homo sapiens
ttaatgcagctctaccacacag

SEQ ID NO: 7179728 - DNA, 21 bp, Homo sapiens
ttaatgctatgcagaaaatct

SEQ ID NO: 7179729 - DNA, 21 bp, Homo sapiens
ttaatgctatgcagaaaatct

SEQ ID NO: 7179730 - DNA, 22 bp, Homo sapiens
cctgtgcttcagctggaggagg

SEQ ID NO: 7179731 - DNA, 22 bp, Homo sapiens
cctgtgcttggccagagaggtt

SEQ ID NO: 7179732 - DNA, 22 bp, Homo sapiens
cctgtgcttggccagagaggtt

SEQ ID NO: 7179733 - DNA, 22 bp, Homo sapiens
cctgtgcttggccagagaggtt

SEQ ID NO: 7179734 - DNA, 22 bp, Homo sapiens
cctgtgctttaggcctcaaact

SEQ ID NO: 7179735 - DNA, 20 bp, Homo sapiens
cctgtggagctgcctcctcc

SEQ ID NO: 7179736 - DNA, 22 bp, Homo sapiens
cctgtggacattctgtgtggaa

SEQ ID NO: 7179737 - DNA, 22 bp, Homo sapiens
cctgtggacattctgtgtggaa

SEQ ID NO: 7179738 - DNA, 22 bp, Homo sapiens
cctgtgctttaggcctcaaact

SEQ ID NO: 7179739 - DNA, 22 bp, Homo sapiens
cctgtggaccaggaggcagccc

SEQ ID NO: 7179740 - DNA, 22 bp, Homo sapiens
cctgtggaccaggaggcagccc

SEQ ID NO: 7179741 - DNA, 22 bp, Homo sapiens
cctgtggagctttcagcagctc

SEQ ID NO: 7179742 - DNA, 22 bp, Homo sapiens
cctgtggagttcccatctgaat

SEQ ID NO: 7179743 - DNA, 21 bp, Homo sapiens
cctgtggattttaaaattgga

SEQ ID NO: 7179744 - DNA, 23 bp, Homo sapiens
cctgtggcaagtagatgagatga

SEQ ID NO: 7179745 - DNA, 19 bp, Homo sapiens
cctgtggcagagtggaaac

SEQ ID NO: 7179746 - DNA, 22 bp, Homo sapiens
ttaatatgttgaaatttattag

SEQ ID NO: 7179747 - DNA, 22 bp, Homo sapiens
ttaatatgttgaaatttattag

SEQ ID NO: 7179748 - DNA, 22 bp, Homo sapiens
ttaatatacaattttacgggct

SEQ ID NO: 7179749 - DNA, 22 bp, Homo sapiens
ttaatatacaattttacgggct

SEQ ID NO: 7179750 - DNA, 22 bp, Homo sapiens
ttaatactataatttgaagtac

SEQ ID NO: 7179751 - DNA, 22 bp, Homo sapiens
ttaatagatatgcctctagagt

SEQ ID NO: 7179752 - DNA, 22 bp, Homo sapiens
ttaatagatttgattttaaagg

SEQ ID NO: 7179753 - DNA, 22 bp, Homo sapiens
ttaatagatttgattttaaagg

SEQ ID NO: 7179754 - DNA, 22 bp, Homo sapiens
ttaatagatttgattttaaagg

SEQ ID NO: 7179755 - DNA, 22 bp, Homo sapiens
ttaagcgccttctctttgtctt

SEQ ID NO: 7179756 - DNA, 21 bp, Homo sapiens
ttaagccagcttcttctccta

SEQ ID NO: 7179757 - DNA, 22 bp, Homo sapiens
ttaagctcccagaagagggaga

SEQ ID NO: 7179758 - DNA, 22 bp, Homo sapiens
ttaatactataatttgaagtac

SEQ ID NO: 7179759 - DNA, 22 bp, Homo sapiens
cctgtacaagctcttggtgaca

SEQ ID NO: 7179760 - DNA, 22 bp, Homo sapiens
cctgtacacaattccgaggata

SEQ ID NO: 7179761 - DNA, 22 bp, Homo sapiens
cctgtacacggtctatgcctcc

SEQ ID NO: 7179762 - DNA, 22 bp, Homo sapiens
cctgtacagtgaatgaatgtga

SEQ ID NO: 7179763 - DNA, 22 bp, Homo sapiens
cctgtacatctgctctcattgc

SEQ ID NO: 7179764 - DNA, 22 bp, Homo sapiens
cctgtacatggccatctttacc

SEQ ID NO: 7179765 - DNA, 22 bp, Homo sapiens
cctgtacattagctgtgaattg

SEQ ID NO: 7179766 - DNA, 19 bp, Homo sapiens
cctgtacattattctcccc

SEQ ID NO: 7179767 - DNA, 22 bp, Homo sapiens
cctgtactagggtctcattgcc

SEQ ID NO: 7179768 - DNA, 22 bp, Homo sapiens
cctgtactagggtctcattgcc

SEQ ID NO: 7179769 - DNA, 22 bp, Homo sapiens
cctgtattaggtagacaactat

SEQ ID NO: 7179770 - DNA, 21 bp, Homo sapiens
ttaaaatgaggaagtggtggc

SEQ ID NO: 7179771 - DNA, 21 bp, Homo sapiens
ttaaaatgaggaagtggtggc

SEQ ID NO: 7179772 - DNA, 22 bp, Homo sapiens
ttaaaatgcagattatgactca

SEQ ID NO: 7179773 - DNA, 22 bp, Homo sapiens
ttaaaatgaatattgattagca

SEQ ID NO: 7179774 - DNA, 22 bp, Homo sapiens
ttaaaatgaatattgattagca

SEQ ID NO: 7179775 - DNA, 22 bp, Homo sapiens
ttaaaatgcagattatgactca

SEQ ID NO: 7179776 - DNA, 22 bp, Homo sapiens
ttaaaatgcagattatgactca

SEQ ID NO: 7179777 - DNA, 22 bp, Homo sapiens
cctggtttgggtgccagtgagt

SEQ ID NO: 7179778 - DNA, 22 bp, Homo sapiens
cctgtacaagagccatctggat

SEQ ID NO: 7179779 - DNA, 22 bp, Homo sapiens
ttaaaatctaaagcagttgtct

SEQ ID NO: 7179780 - DNA, 22 bp, Homo sapiens
ttaaaatctaaagcagttgtct

SEQ ID NO: 7179781 - DNA, 22 bp, Homo sapiens
ttaaaatgaatattgattagca

SEQ ID NO: 7179782 - DNA, 22 bp, Homo sapiens
ttaaaatagccagtgcccctct

SEQ ID NO: 7179783 - DNA, 22 bp, Homo sapiens
ttaaaatagccagtgcccctct

SEQ ID NO: 7179784 - DNA, 22 bp, Homo sapiens
ttaaaatcacagtcacccagta

SEQ ID NO: 7179785 - DNA, 22 bp, Homo sapiens
ttaaaatccagtgttggtggat

SEQ ID NO: 7179786 - DNA, 22 bp, Homo sapiens
ttaaaatcgctgttgcttctgt

SEQ ID NO: 7179787 - DNA, 22 bp, Homo sapiens
tgttttctagaaacaatgccta

SEQ ID NO: 7179788 - DNA, 22 bp, Homo sapiens
tgttttctagaaacaatgccta

SEQ ID NO: 7179789 - DNA, 22 bp, Homo sapiens
tgttttctagaaacaatgccta

SEQ ID NO: 7179790 - DNA, 22 bp, Homo sapiens
tgttttctattacctgagattg

SEQ ID NO: 7179791 - DNA, 22 bp, Homo sapiens
tgttttctagaaacaatgccta

SEQ ID NO: 7179792 - DNA, 22 bp, Homo sapiens
tgttttctattacctgagattg

SEQ ID NO: 7179793 - DNA, 22 bp, Homo sapiens
tgttttctattacctgagattg

SEQ ID NO: 7179794 - DNA, 22 bp, Homo sapiens
tgttttctattacctgagattg

SEQ ID NO: 7179795 - DNA, 22 bp, Homo sapiens
tgttttctcttgaaaagcagtc

SEQ ID NO: 7179796 - DNA, 22 bp, Homo sapiens
ttaaaagtctgatgatttacat

SEQ ID NO: 7179797 - DNA, 22 bp, Homo sapiens
ttaaaatagccagtgcccctct

SEQ ID NO: 7179798 - DNA, 22 bp, Homo sapiens
ttaaaatagccagtgcccctct

SEQ ID NO: 7179799 - DNA, 22 bp, Homo sapiens
cgggaggaaaggcgaggctctg

SEQ ID NO: 7179800 - DNA, 22 bp, Homo sapiens
cgggagcacgggaggcggagct

SEQ ID NO: 7179801 - DNA, 22 bp, Homo sapiens
cgggaaggtggaggttgcagtg

SEQ ID NO: 7179802 - DNA, 20 bp, Homo sapiens
cgggacactcaagctctggg

SEQ ID NO: 7179803 - DNA, 22 bp, Homo sapiens
cgggaaagttccacagatggat

SEQ ID NO: 7179804 - DNA, 22 bp, Homo sapiens
cgggaaagttccacagatggat

SEQ ID NO: 7179805 - DNA, 21 bp, Homo sapiens
cgggaaggaggttctgaccct

SEQ ID NO: 7179806 - DNA, 21 bp, Homo sapiens
cgggaaggaggttctgaccct

SEQ ID NO: 7179807 - DNA, 22 bp, Homo sapiens
cgggaaggtggaggttgcagtg

SEQ ID NO: 7179808 - DNA, 22 bp, Homo sapiens
cgggaaggtggaggttgcagtg

SEQ ID NO: 7179809 - DNA, 22 bp, Homo sapiens
cgggaaggtggaggttgcagtg

SEQ ID NO: 7179810 - DNA, 22 bp, Homo sapiens
ttccaaattaaaatgtacaatg

SEQ ID NO: 7179811 - DNA, 22 bp, Homo sapiens
ttccacggtggcaaaggctgga

SEQ ID NO: 7179812 - DNA, 22 bp, Homo sapiens
ttccactcatgcaaaggtccca

SEQ ID NO: 7179813 - DNA, 22 bp, Homo sapiens
ttccactcctcctggtggggtg

SEQ ID NO: 7179814 - DNA, 22 bp, Homo sapiens
ttccactctacacactgctggc

SEQ ID NO: 7179815 - DNA, 22 bp, Homo sapiens
ttccactctacacactgctggc

SEQ ID NO: 7179816 - DNA, 22 bp, Homo sapiens
ttccactctactctggccagtc

SEQ ID NO: 7179817 - DNA, 22 bp, Homo sapiens
cggctggtgtcgggcacagcaa

SEQ ID NO: 7179818 - DNA, 22 bp, Homo sapiens
cggctggtgtcgggcacagcaa

SEQ ID NO: 7179819 - DNA, 22 bp, Homo sapiens
cggctgggttcggctgcaggcc

SEQ ID NO: 7179820 - DNA, 22 bp, Homo sapiens
cggctgggttcggctgcaggcc

SEQ ID NO: 7179821 - DNA, 22 bp, Homo sapiens
cggctgggtagaggtgccgggt

SEQ ID NO: 7179822 - DNA, 22 bp, Homo sapiens
cggctgggttcggctgcaggcc

SEQ ID NO: 7179823 - DNA, 22 bp, Homo sapiens
cggctgggtagaggtgccgggt

SEQ ID NO: 7179824 - DNA, 22 bp, Homo sapiens
cggctgggttcggctgcaggcc

SEQ ID NO: 7179825 - DNA, 22 bp, Homo sapiens
cggctgggttcggctgcaggcc

SEQ ID NO: 7179826 - DNA, 22 bp, Homo sapiens
cggctgggttcggctgcaggcc

SEQ ID NO: 7179827 - DNA, 22 bp, Homo sapiens
cggctggtgtcgggcacagcaa

SEQ ID NO: 7179828 - DNA, 22 bp, Homo sapiens
cggctggtgtcgggcacagcaa

SEQ ID NO: 7179829 - DNA, 22 bp, Homo sapiens
cggctggtgtcgggcacagcaa

SEQ ID NO: 7179830 - DNA, 22 bp, Homo sapiens
cggctgtgtcttcacaggagcc

SEQ ID NO: 7179831 - DNA, 22 bp, Homo sapiens
cggctgtgtcttcacaggagcc

SEQ ID NO: 7179832 - DNA, 22 bp, Homo sapiens
cggcttaattctaactgtaagg

SEQ ID NO: 7179833 - DNA, 22 bp, Homo sapiens
ttcagtttcgttatctatgaga

SEQ ID NO: 7179834 - DNA, 22 bp, Homo sapiens
ttcagtttctaaatgctcctct

SEQ ID NO: 7179835 - DNA, 22 bp, Homo sapiens
ttcagtttcgttatctatgaga

SEQ ID NO: 7179836 - DNA, 22 bp, Homo sapiens
ttcagtttcgttatctatgaga

SEQ ID NO: 7179837 - DNA, 22 bp, Homo sapiens
ttcagtttgaattctgtagaac

SEQ ID NO: 7179838 - DNA, 22 bp, Homo sapiens
ttcagtttccacttacatttaa

SEQ ID NO: 7179839 - DNA, 22 bp, Homo sapiens
ttcagtttccacttacatttaa

SEQ ID NO: 7179840 - DNA, 23 bp, Homo sapiens
ttcagggcctcagaggtgaagct

SEQ ID NO: 7179841 - DNA, 20 bp, Homo sapiens
cgcagcagtggaagtggaat

SEQ ID NO: 7179842 - DNA, 21 bp, Homo sapiens
cgcagctgagaaatatacaga

SEQ ID NO: 7179843 - DNA, 22 bp, Homo sapiens
cgcagctgcaaaggaaacattt

SEQ ID NO: 7179844 - DNA, 22 bp, Homo sapiens
ctaaatgatggatttaaacttt

SEQ ID NO: 7179845 - DNA, 22 bp, Homo sapiens
ttcctctggaggctctaggaga

SEQ ID NO: 7179846 - DNA, 22 bp, Homo sapiens
ttcctctctcttgccagaatgt

SEQ ID NO: 7179847 - DNA, 22 bp, Homo sapiens
ttcctctcgctctccggggccc

SEQ ID NO: 7179848 - DNA, 22 bp, Homo sapiens
ttcctctcgctctccggggccc

SEQ ID NO: 7179849 - DNA, 22 bp, Homo sapiens
ttcctctctcttgccagaatgt

SEQ ID NO: 7179850 - DNA, 22 bp, Homo sapiens
ttcctctcctcacatgagtcac

SEQ ID NO: 7179851 - DNA, 22 bp, Homo sapiens
ttcctctcctcacatgagtcac

SEQ ID NO: 7179852 - DNA, 17 bp, Homo sapiens
ttcctctcacatttttt

SEQ ID NO: 7179853 - DNA, 17 bp, Homo sapiens
ttcctctcacatttttt

SEQ ID NO: 7179854 - DNA, 22 bp, Homo sapiens
ttcctctcctcacatgagtcac

SEQ ID NO: 7179855 - DNA, 22 bp, Homo sapiens
ttcctctcctcccaccaggtga

SEQ ID NO: 7179856 - DNA, 22 bp, Homo sapiens
ttcctctcctcccaccaggtga

SEQ ID NO: 7179857 - DNA, 22 bp, Homo sapiens
ttcctctcaacatgcctgccgg

SEQ ID NO: 7179858 - DNA, 22 bp, Homo sapiens
ttcctccttgtcctagttactg

SEQ ID NO: 7179859 - DNA, 22 bp, Homo sapiens
ttcctccagtcagagctgtccc

SEQ ID NO: 7179860 - DNA, 22 bp, Homo sapiens
ttcctccatccttagggagagc

SEQ ID NO: 7179861 - DNA, 17 bp, Homo sapiens
ttcctcctcaccatgtt

SEQ ID NO: 7179862 - DNA, 17 bp, Homo sapiens
ttcctcctcaccatgtt

SEQ ID NO: 7179863 - DNA, 21 bp, Homo sapiens
ttcctcctctggagaagaaga

SEQ ID NO: 7179864 - DNA, 22 bp, Homo sapiens
ttcctcctctgtaaaacgggca

SEQ ID NO: 7179865 - DNA, 22 bp, Homo sapiens
ttcctccttcccattcctgggg

SEQ ID NO: 7179866 - DNA, 22 bp, Homo sapiens
ttcctccagcctggagcacttc

SEQ ID NO: 7179867 - DNA, 22 bp, Homo sapiens
ttcctaacaaacttcagtgaat

SEQ ID NO: 7179868 - DNA, 22 bp, Homo sapiens
ttcctaacaaacttcagtgaat

SEQ ID NO: 7179869 - DNA, 22 bp, Homo sapiens
cgtgaaatgagttgaattattg

SEQ ID NO: 7179870 - DNA, 22 bp, Homo sapiens
cgtctggacgggaaggagaagt

SEQ ID NO: 7179871 - DNA, 22 bp, Homo sapiens
cgtctctggcccggcccctggg

SEQ ID NO: 7179872 - DNA, 22 bp, Homo sapiens
cgtccttgcaagatctgtacaa

SEQ ID NO: 7179873 - DNA, 22 bp, Homo sapiens
cgtctagacagtttccaaaaga

SEQ ID NO: 7179874 - DNA, 22 bp, Homo sapiens
cgtctaggccgtgccctgaggt

SEQ ID NO: 7179875 - DNA, 22 bp, Homo sapiens
cgtcccgggttcacgccattct

SEQ ID NO: 7179876 - DNA, 22 bp, Homo sapiens
cgtcctcagaggccatccgaaa

SEQ ID NO: 7179877 - DNA, 22 bp, Homo sapiens
cgtcctctagagggaagcactt

SEQ ID NO: 7179878 - DNA, 22 bp, Homo sapiens
cgtcctgctcggcgcgcctcgg

SEQ ID NO: 7179879 - DNA, 22 bp, Homo sapiens
cgtcctgggtctgggaaggcat

SEQ ID NO: 7179880 - DNA, 22 bp, Homo sapiens
cgtccttgcaagatctgtacaa

SEQ ID NO: 7179881 - DNA, 22 bp, Homo sapiens
cgtcatcacggcaagcatctcc

SEQ ID NO: 7179882 - DNA, 22 bp, Homo sapiens
cgtcatcacggcaagcatctcc

SEQ ID NO: 7179883 - DNA, 22 bp, Homo sapiens
cgtcatttgtaaatgatcaaga

SEQ ID NO: 7179884 - DNA, 22 bp, Homo sapiens
ttccactgattttggttgacct

SEQ ID NO: 7179885 - DNA, 22 bp, Homo sapiens
ttccactctgtcccctgtggga

SEQ ID NO: 7179886 - DNA, 22 bp, Homo sapiens
ttccactcttctctggacttat

SEQ ID NO: 7179887 - DNA, 22 bp, Homo sapiens
ttccactcttctctggacttat

SEQ ID NO: 7179888 - DNA, 22 bp, Homo sapiens
ttccactctccagtcaatttca

SEQ ID NO: 7179889 - DNA, 22 bp, Homo sapiens
ttccactctccagtcaatttca

SEQ ID NO: 7179890 - DNA, 22 bp, Homo sapiens
ttccactctgtcccctgtggga

SEQ ID NO: 7179891 - DNA, 22 bp, Homo sapiens
ttccactctatgatagaagggt

SEQ ID NO: 7179892 - DNA, 22 bp, Homo sapiens
ttccactctatgatagaagggt

SEQ ID NO: 7179893 - DNA, 22 bp, Homo sapiens
ttccactctatgatagaagggt

SEQ ID NO: 7179894 - DNA, 22 bp, Homo sapiens
ttccacttagtggaagggcatg

SEQ ID NO: 7179895 - DNA, 22 bp, Homo sapiens
ttccacttagtggaagggcatg

SEQ ID NO: 7179896 - DNA, 19 bp, Homo sapiens
ttccacttgggttagaatt

SEQ ID NO: 7179897 - DNA, 22 bp, Homo sapiens
ttccactttgggtctgtgcagg

SEQ ID NO: 7179898 - DNA, 22 bp, Homo sapiens
ttccacttttctctctcatgcc

SEQ ID NO: 7179899 - DNA, 22 bp, Homo sapiens
ttccagaaaaaaatgtatatct

SEQ ID NO: 7179900 - DNA, 22 bp, Homo sapiens
ttccacttttctctctcatgcc

SEQ ID NO: 7179901 - DNA, 22 bp, Homo sapiens
ttccagaaaacgctttatttag

SEQ ID NO: 7179902 - DNA, 22 bp, Homo sapiens
ttccagaaaacgctttatttag

SEQ ID NO: 7179903 - DNA, 22 bp, Homo sapiens
ttccagaaagttctggaactgg

SEQ ID NO: 7179904 - DNA, 21 bp, Homo sapiens
ttccagaaatctctttcttca

SEQ ID NO: 7179905 - DNA, 21 bp, Homo sapiens
ttctcctgttttgcaccacag

SEQ ID NO: 7179906 - DNA, 22 bp, Homo sapiens
ttctcctggggccgtgatgtga

SEQ ID NO: 7179907 - DNA, 21 bp, Homo sapiens
ttctcctgttttgcaccacag

SEQ ID NO: 7179908 - DNA, 22 bp, Homo sapiens
ttctccttattcatagttgtct

SEQ ID NO: 7179909 - DNA, 22 bp, Homo sapiens
ttctccttattcatagttgtct

SEQ ID NO: 7179910 - DNA, 22 bp, Homo sapiens
ttctcctgggaggggttgccca

SEQ ID NO: 7179911 - DNA, 21 bp, Homo sapiens
ttctccttcttgatccaagca

SEQ ID NO: 7179912 - DNA, 21 bp, Homo sapiens
ttctccttcttgatccaagca

SEQ ID NO: 7179913 - DNA, 22 bp, Homo sapiens
ttctccttcctggttttcaggc

SEQ ID NO: 7179914 - DNA, 22 bp, Homo sapiens
ttctccttcctggttttcaggc

SEQ ID NO: 7179915 - DNA, 21 bp, Homo sapiens
ttctccttcttgatccaagca

SEQ ID NO: 7179916 - DNA, 22 bp, Homo sapiens
ttctccttgaaaagctgcatct

SEQ ID NO: 7179917 - DNA, 19 bp, Homo sapiens
ctagggcttggcagcaggc

SEQ ID NO: 7179918 - DNA, 22 bp, Homo sapiens
ctagggcttccaagatgccttc

SEQ ID NO: 7179919 - DNA, 22 bp, Homo sapiens
ttctcctttgtaattctcatcc

SEQ ID NO: 7179920 - DNA, 22 bp, Homo sapiens
ttctcctttcattccctgtaga

SEQ ID NO: 7179921 - DNA, 22 bp, Homo sapiens
ttctcctttcattccctgtaga

SEQ ID NO: 7179922 - DNA, 22 bp, Homo sapiens
ttctccttggtttatgggacat

SEQ ID NO: 7179923 - DNA, 22 bp, Homo sapiens
ttctccttggtttatgggacat

SEQ ID NO: 7179924 - DNA, 22 bp, Homo sapiens
ttctccttgttcccttcaattg

SEQ ID NO: 7179925 - DNA, 22 bp, Homo sapiens
ctagtggaaactaactggaatt

SEQ ID NO: 7179926 - DNA, 22 bp, Homo sapiens
ctagtgtagctcttgtaagcag

SEQ ID NO: 7179927 - DNA, 22 bp, Homo sapiens
ctagtgtgtctatgtctgttcc

SEQ ID NO: 7179928 - DNA, 22 bp, Homo sapiens
ctagtgaacgtggtactatgga

SEQ ID NO: 7179929 - DNA, 22 bp, Homo sapiens
ctagttctagatccctgaggaa

SEQ ID NO: 7179930 - DNA, 22 bp, Homo sapiens
ctagttctaaatctgttgtcca

SEQ ID NO: 7179931 - DNA, 22 bp, Homo sapiens
ctagttctagatccctgaggaa

SEQ ID NO: 7179932 - DNA, 22 bp, Homo sapiens
ctagtgtttattaatcatgagg

SEQ ID NO: 7179933 - DNA, 22 bp, Homo sapiens
ctagttctcctgaaatgtttgg

SEQ ID NO: 7179934 - DNA, 22 bp, Homo sapiens
ctagttctgccattcagtgtca

SEQ ID NO: 7179935 - DNA, 22 bp, Homo sapiens
ctagttcttaactgttatgatt

SEQ ID NO: 7179936 - DNA, 22 bp, Homo sapiens
ctagtttaaagcagctgaaagg

SEQ ID NO: 7179937 - DNA, 22 bp, Homo sapiens
ctagtttagagtatgcgtgtgt

SEQ ID NO: 7179938 - DNA, 22 bp, Homo sapiens
ctagtttagtcagagccttgct

SEQ ID NO: 7179939 - DNA, 22 bp, Homo sapiens
ctagtttggttagataagtctc

SEQ ID NO: 7179940 - DNA, 22 bp, Homo sapiens
ctagttttaagctccttgaggt

SEQ ID NO: 7179941 - DNA, 22 bp, Homo sapiens
ctagttttaagctccttgaggt

SEQ ID NO: 7179942 - DNA, 22 bp, Homo sapiens
ctataaatctacccagcattgg

SEQ ID NO: 7179943 - DNA, 22 bp, Homo sapiens
ctacatttacacagttaggctt

SEQ ID NO: 7179944 - DNA, 22 bp, Homo sapiens
ctacattatgtttattgggact

SEQ ID NO: 7179945 - DNA, 22 bp, Homo sapiens
ctacattctgggaaatcagatg

SEQ ID NO: 7179946 - DNA, 22 bp, Homo sapiens
ttctcaggtgaggctgaggctg

SEQ ID NO: 7179947 - DNA, 22 bp, Homo sapiens
ttctatttttgtggaactgtag

SEQ ID NO: 7179948 - DNA, 22 bp, Homo sapiens
ttctatttttgtggaactgtag

SEQ ID NO: 7179949 - DNA, 22 bp, Homo sapiens
ttctcaaaactcagggtatctg

SEQ ID NO: 7179950 - DNA, 22 bp, Homo sapiens
ttctcaggtcaccagggtgcca

SEQ ID NO: 7179951 - DNA, 22 bp, Homo sapiens
ttctcaggtgaggctgaggctg

SEQ ID NO: 7179952 - DNA, 22 bp, Homo sapiens
ttctcaggtgaggctgaggctg

SEQ ID NO: 7179953 - DNA, 19 bp, Homo sapiens
ttctcagttcaggagaaga

SEQ ID NO: 7179954 - DNA, 22 bp, Homo sapiens
ttctcagtttcatagctgagca

SEQ ID NO: 7179955 - DNA, 22 bp, Homo sapiens
ttctcatacaggatctcttatt

SEQ ID NO: 7179956 - DNA, 22 bp, Homo sapiens
ttctcatacaggatctcttatt

SEQ ID NO: 7179957 - DNA, 22 bp, Homo sapiens
ttctcatagagacatgattata

SEQ ID NO: 7179958 - DNA, 22 bp, Homo sapiens
ttctcatagagacatgattata

SEQ ID NO: 7179959 - DNA, 22 bp, Homo sapiens
ttctcatgtaaatgccatcatc

SEQ ID NO: 7179960 - DNA, 22 bp, Homo sapiens
ttctcatgaaactcgcttcctc

SEQ ID NO: 7179961 - DNA, 22 bp, Homo sapiens
ttctcatgatgcaattcatccc

SEQ ID NO: 7179962 - DNA, 21 bp, Homo sapiens
ttctcatgggataagtacatg

SEQ ID NO: 7179963 - DNA, 21 bp, Homo sapiens
ttctcatgggataagtacatg

SEQ ID NO: 7179964 - DNA, 22 bp, Homo sapiens
ttctcatagatgctatagacag

SEQ ID NO: 7179965 - DNA, 22 bp, Homo sapiens
ttctcatatgcactctatttga

SEQ ID NO: 7179966 - DNA, 22 bp, Homo sapiens
ttctcatatgcactctatttga

SEQ ID NO: 7179967 - DNA, 22 bp, Homo sapiens
ttctcatatgcactctatttga

SEQ ID NO: 7179968 - DNA, 22 bp, Homo sapiens
ttctcatgaaactcgcttcctc

SEQ ID NO: 7179969 - DNA, 19 bp, Homo sapiens
ttctcattcctttccactt

SEQ ID NO: 7179970 - DNA, 22 bp, Homo sapiens
ttctcattctgactcagtgtag

SEQ ID NO: 7179971 - DNA, 22 bp, Homo sapiens
ttctcctgcccttggacttcca

SEQ ID NO: 7179972 - DNA, 22 bp, Homo sapiens
ttctcctgcgcaggcccaggga

SEQ ID NO: 7179973 - DNA, 22 bp, Homo sapiens
ttctcctgcgcaggcccaggga

SEQ ID NO: 7179974 - DNA, 22 bp, Homo sapiens
ttctcctgcgcaggcccaggga

SEQ ID NO: 7179975 - DNA, 22 bp, Homo sapiens
ttctcctggagtgcttgttggg

SEQ ID NO: 7179976 - DNA, 22 bp, Homo sapiens
ctaactacaagcggggcatcct

SEQ ID NO: 7179977 - DNA, 22 bp, Homo sapiens
ctaacgaatatgtatgcatgtt

SEQ ID NO: 7179978 - DNA, 22 bp, Homo sapiens
ctaacgaaatacctcagacttt

SEQ ID NO: 7179979 - DNA, 22 bp, Homo sapiens
ctaaattatttgcacattagag

SEQ ID NO: 7179980 - DNA, 22 bp, Homo sapiens
ctaaatgttcacatgcaatttt

SEQ ID NO: 7179981 - DNA, 22 bp, Homo sapiens
ctaaattatcatgagaattatg

SEQ ID NO: 7179982 - DNA, 22 bp, Homo sapiens
ctaaatgtctcagagggagaca

SEQ ID NO: 7179983 - DNA, 22 bp, Homo sapiens
ttctacagaataaatgtttaca

SEQ ID NO: 7179984 - DNA, 22 bp, Homo sapiens
ttctacagactataactgtgat

SEQ ID NO: 7179985 - DNA, 21 bp, Homo sapiens
ttctacaggatgaatgaaaac

SEQ ID NO: 7179986 - DNA, 22 bp, Homo sapiens
ttctacaggtactgaagtacat

SEQ ID NO: 7179987 - DNA, 22 bp, Homo sapiens
ttctacaggtactgaagtacat

SEQ ID NO: 7179988 - DNA, 22 bp, Homo sapiens
ttctacagttggtggaggtctt

SEQ ID NO: 7179989 - DNA, 22 bp, Homo sapiens
ttctacagttggtggaggtctt

SEQ ID NO: 7179990 - DNA, 22 bp, Homo sapiens
ttctacagttggtggaggtctt

SEQ ID NO: 7179991 - DNA, 22 bp, Homo sapiens
ttctacatagtctcttggagct

SEQ ID NO: 7179992 - DNA, 22 bp, Homo sapiens
ttctacatatatttttctcact

SEQ ID NO: 7179993 - DNA, 22 bp, Homo sapiens
ctaacttcccctctggcagaaa

SEQ ID NO: 7179994 - DNA, 22 bp, Homo sapiens
ctacagtctggcaggaatgtta

SEQ ID NO: 7179995 - DNA, 22 bp, Homo sapiens
ctacagtgaagactagctatag

SEQ ID NO: 7179996 - DNA, 22 bp, Homo sapiens
ctacagtgaagactagctatag

SEQ ID NO: 7179997 - DNA, 22 bp, Homo sapiens
ttctacatttaaaaggaaaatc

SEQ ID NO: 7179998 - DNA, 22 bp, Homo sapiens
ttctacatttaaaaggaaaatc

SEQ ID NO: 7179999 - DNA, 22 bp, Homo sapiens
ttctacatttaaaaggaaaatc

SEQ ID NO: 7180000 - DNA, 22 bp, Homo sapiens
ttctacatttaaaaggaaaatc

SEQ ID NO: 7180001 - DNA, 22 bp, Homo sapiens
ttctacatttgaggagagtcag

SEQ ID NO: 7180002 - DNA, 22 bp, Homo sapiens
ttctaccagaccccagacttgt

SEQ ID NO: 7180003 - DNA, 22 bp, Homo sapiens
ttctaccagaccccagacttgt

SEQ ID NO: 7180004 - DNA, 22 bp, Homo sapiens
ttctacatttgaggagagtcag

SEQ ID NO: 7180005 - DNA, 22 bp, Homo sapiens
ttctacattcatgtattacctc

SEQ ID NO: 7180006 - DNA, 22 bp, Homo sapiens
ttctacattgtgaagttcttta

SEQ ID NO: 7180007 - DNA, 22 bp, Homo sapiens
ttctacattgtgaagttcttta

SEQ ID NO: 7180008 - DNA, 22 bp, Homo sapiens
ttctacatgagaaaatgtattt

SEQ ID NO: 7180009 - DNA, 22 bp, Homo sapiens
ttctacatggaagagccttctt

SEQ ID NO: 7180010 - DNA, 22 bp, Homo sapiens
ttctacatggaagagccttctt

SEQ ID NO: 7180011 - DNA, 22 bp, Homo sapiens
ttctacatggttgctcagaggg

SEQ ID NO: 7180012 - DNA, 22 bp, Homo sapiens
ttctacatggttgctcagaggg

SEQ ID NO: 7180013 - DNA, 22 bp, Homo sapiens
ttctacatggttgctcagaggg

SEQ ID NO: 7180014 - DNA, 22 bp, Homo sapiens
ttctacatgtcaagtctccaag

SEQ ID NO: 7180015 - DNA, 22 bp, Homo sapiens
ttctacatgtcaagtctccaag

SEQ ID NO: 7180016 - DNA, 22 bp, Homo sapiens
ttctacatgtgatgcgtgcctg

SEQ ID NO: 7180017 - DNA, 22 bp, Homo sapiens
ttctacatatatttttctcact

SEQ ID NO: 7180018 - DNA, 22 bp, Homo sapiens
ttctacatcacttaacatgcta

SEQ ID NO: 7180019 - DNA, 22 bp, Homo sapiens
ttctacatgagaaaatgtattt

SEQ ID NO: 7180020 - DNA, 22 bp, Homo sapiens
ttctacatgagaaaatgtattt

SEQ ID NO: 7180021 - DNA, 22 bp, Homo sapiens
ctacattaaattggcttactta

SEQ ID NO: 7180022 - DNA, 22 bp, Homo sapiens
ctacattaaattggcttactta

SEQ ID NO: 7180023 - DNA, 22 bp, Homo sapiens
ctacattaaattggcttactta

SEQ ID NO: 7180024 - DNA, 15 bp, Homo sapiens
ctacatgctggagca

SEQ ID NO: 7180025 - DNA, 22 bp, Homo sapiens
ctacatgtaggtttccttaatt

SEQ ID NO: 7180026 - DNA, 22 bp, Homo sapiens
ctacatctcaccttccaggaca

SEQ ID NO: 7180027 - DNA, 22 bp, Homo sapiens
ctacataatctggatttgtctg

SEQ ID NO: 7180028 - DNA, 22 bp, Homo sapiens
ctacatacatatacatgcagtt

SEQ ID NO: 7180029 - DNA, 22 bp, Homo sapiens
ctacatcaagtaatcttcaaaa

SEQ ID NO: 7180030 - DNA, 22 bp, Homo sapiens
ctacatcaagtaatcttcaaaa

SEQ ID NO: 7180031 - DNA, 22 bp, Homo sapiens
ctacatcacttaattcttagaa

SEQ ID NO: 7180032 - DNA, 22 bp, Homo sapiens
ctacagtgtgacaggcttggtg

SEQ ID NO: 7180033 - DNA, 22 bp, Homo sapiens
ctacataaatttatcacagact

SEQ ID NO: 7180034 - DNA, 22 bp, Homo sapiens
ctacataaatttatcacagact

SEQ ID NO: 7180035 - DNA, 22 bp, Homo sapiens
ttcttcccagccagcacagccc

SEQ ID NO: 7180036 - DNA, 22 bp, Homo sapiens
ttcttcccttcattccaccacc

SEQ ID NO: 7180037 - DNA, 22 bp, Homo sapiens
ttcttcatgctgttgctgcttg

SEQ ID NO: 7180038 - DNA, 22 bp, Homo sapiens
ttcttcatgggttcttttagga

SEQ ID NO: 7180039 - DNA, 21 bp, Homo sapiens
ttcttcatgatgattaatggc

SEQ ID NO: 7180040 - DNA, 22 bp, Homo sapiens
ttgaaggaggctcctttttaaa

SEQ ID NO: 7180041 - DNA, 22 bp, Homo sapiens
ttgaaatatcaagttattagtg

SEQ ID NO: 7180042 - DNA, 22 bp, Homo sapiens
ttgaaatatcaagttattagtg

SEQ ID NO: 7180043 - DNA, 22 bp, Homo sapiens
ttgaagtcagagttttcaagca

SEQ ID NO: 7180044 - DNA, 22 bp, Homo sapiens
ttgaagtcagttcatattttta

SEQ ID NO: 7180045 - DNA, 22 bp, Homo sapiens
ttgaagtccttgcctcttgcac

SEQ ID NO: 7180046 - DNA, 23 bp, Homo sapiens
ttgaagtctcagttttctcatag

SEQ ID NO: 7180047 - DNA, 22 bp, Homo sapiens
ttgaagtctcatgatttaaaga

SEQ ID NO: 7180048 - DNA, 19 bp, Homo sapiens
ttgaagttacagtcatgcc

SEQ ID NO: 7180049 - DNA, 18 bp, Homo sapiens
ttgaagttatttacattc

SEQ ID NO: 7180050 - DNA, 18 bp, Homo sapiens
ttgaagttatttacattc

SEQ ID NO: 7180051 - DNA, 23 bp, Homo sapiens
ttgaagttctgctgtgttatagg

SEQ ID NO: 7180052 - DNA, 22 bp, Homo sapiens
ttgaagttgcacattataattt

SEQ ID NO: 7180053 - DNA, 20 bp, Homo sapiens
ctcacttacctttttctata

SEQ ID NO: 7180054 - DNA, 22 bp, Homo sapiens
ctcacttagcaggttaatatca

SEQ ID NO: 7180055 - DNA, 22 bp, Homo sapiens
ctcactggcaagactacaggtg

SEQ ID NO: 7180056 - DNA, 22 bp, Homo sapiens
ctcactgcaagctccgcctccc

SEQ ID NO: 7180057 - DNA, 22 bp, Homo sapiens
ctcactgcaagctctgcctcca

SEQ ID NO: 7180058 - DNA, 22 bp, Homo sapiens
ctcactgcaagctctgcctccc

SEQ ID NO: 7180059 - DNA, 22 bp, Homo sapiens
ctcactgcaagttccacctacc

SEQ ID NO: 7180060 - DNA, 22 bp, Homo sapiens
ctcactgcaatctccgtctccc

SEQ ID NO: 7180061 - DNA, 22 bp, Homo sapiens
ctcactggcaagactacaggtg

SEQ ID NO: 7180062 - DNA, 22 bp, Homo sapiens
ctcactggcaagactacaggtg

SEQ ID NO: 7180063 - DNA, 19 bp, Homo sapiens
ttgaatatgcaaactgaag

SEQ ID NO: 7180064 - DNA, 22 bp, Homo sapiens
ttgaatcattacaatagataag

SEQ ID NO: 7180065 - DNA, 22 bp, Homo sapiens
ttgaatctataatttcagtatt

SEQ ID NO: 7180066 - DNA, 22 bp, Homo sapiens
ttgaatctatgtattcagtgta

SEQ ID NO: 7180067 - DNA, 22 bp, Homo sapiens
ttgaatctctctgagattcagt

SEQ ID NO: 7180068 - DNA, 22 bp, Homo sapiens
ttgaatctcttgaatctctgtt

SEQ ID NO: 7180069 - DNA, 22 bp, Homo sapiens
ttgaatcttagctctgccactt

SEQ ID NO: 7180070 - DNA, 22 bp, Homo sapiens
ttgaatgaagtccctttttact

SEQ ID NO: 7180071 - DNA, 22 bp, Homo sapiens
ctcactgcaagctccacctctt

SEQ ID NO: 7180072 - DNA, 23 bp, Homo sapiens
ttgaagttctgctgtgttatagg

SEQ ID NO: 7180073 - DNA, 22 bp, Homo sapiens
ttgaagttggtgtggaaagtag

SEQ ID NO: 7180074 - DNA, 22 bp, Homo sapiens
ttgaagttggtgtggaaagtag

SEQ ID NO: 7180075 - DNA, 22 bp, Homo sapiens
ttgaagttgtagttcagtgaag

SEQ ID NO: 7180076 - DNA, 22 bp, Homo sapiens
ttgaagtttaatggtagattcc

SEQ ID NO: 7180077 - DNA, 22 bp, Homo sapiens
ttgaagtttaatggtagattcc

SEQ ID NO: 7180078 - DNA, 22 bp, Homo sapiens
ttgaagttgtagttcagtgaag

SEQ ID NO: 7180079 - DNA, 22 bp, Homo sapiens
ttgaagttgtagttcagtgaag

SEQ ID NO: 7180080 - DNA, 22 bp, Homo sapiens
ttgaataaatgagcagtgaatt

SEQ ID NO: 7180081 - DNA, 22 bp, Homo sapiens
ttgaataatatgcttcgttctc

SEQ ID NO: 7180082 - DNA, 22 bp, Homo sapiens
ttgaataatatgttcaggagga

SEQ ID NO: 7180083 - DNA, 22 bp, Homo sapiens
ttgaataatgtgtatgttgtta

SEQ ID NO: 7180084 - DNA, 22 bp, Homo sapiens
ttgaataattaattacactcag

SEQ ID NO: 7180085 - DNA, 22 bp, Homo sapiens
ttgaatacaagtagagaagaca

SEQ ID NO: 7180086 - DNA, 22 bp, Homo sapiens
ttgaatactcagaaaatgacat

SEQ ID NO: 7180087 - DNA, 16 bp, Homo sapiens
ttgaatactcatagca

SEQ ID NO: 7180088 - DNA, 22 bp, Homo sapiens
ttctgaaagccaattcattgaa

SEQ ID NO: 7180089 - DNA, 22 bp, Homo sapiens
ttctgaaaccttcagtatgaag

SEQ ID NO: 7180090 - DNA, 22 bp, Homo sapiens
ttctgaaaccttcagtatgaag

SEQ ID NO: 7180091 - DNA, 22 bp, Homo sapiens
ttctgaaaccttcagtatgaag

SEQ ID NO: 7180092 - DNA, 22 bp, Homo sapiens
ttctgaaaattgggtcatactt

SEQ ID NO: 7180093 - DNA, 22 bp, Homo sapiens
ctataaatctacccagcattgg

SEQ ID NO: 7180094 - DNA, 22 bp, Homo sapiens
ttctctttttgcatctcaacct

SEQ ID NO: 7180095 - DNA, 22 bp, Homo sapiens
ttctctttttgcatctcaacct

SEQ ID NO: 7180096 - DNA, 22 bp, Homo sapiens
ttctctttttgcatctcaacct

SEQ ID NO: 7180097 - DNA, 22 bp, Homo sapiens
ttctgaaatgagatataaggta

SEQ ID NO: 7180098 - DNA, 22 bp, Homo sapiens
ttctgaaagtctttttaagtta

SEQ ID NO: 7180099 - DNA, 22 bp, Homo sapiens
ttctgtctccctgatgtagagc

SEQ ID NO: 7180100 - DNA, 22 bp, Homo sapiens
ttctgtctctgtgtttacatta

SEQ ID NO: 7180101 - DNA, 20 bp, Homo sapiens
ttcttaaagacctcactttg

SEQ ID NO: 7180102 - DNA, 22 bp, Homo sapiens
ttctgtctctgtgtttacatta

SEQ ID NO: 7180103 - DNA, 22 bp, Homo sapiens
ttctgaaatttcaactttacta

SEQ ID NO: 7180104 - DNA, 22 bp, Homo sapiens
ttcttaagcgtatgataatgaa

SEQ ID NO: 7180105 - DNA, 22 bp, Homo sapiens
ttcttaagtatgatcttaacgg

SEQ ID NO: 7180106 - DNA, 22 bp, Homo sapiens
ttcttaagtgagaaagcaggag

SEQ ID NO: 7180107 - DNA, 22 bp, Homo sapiens
ttcttaagaggaacatttttgt

SEQ ID NO: 7180108 - DNA, 22 bp, Homo sapiens
ttcttaagaaaccatcacattc

SEQ ID NO: 7180109 - DNA, 22 bp, Homo sapiens
ttcttaaagaggcaaaacacag

SEQ ID NO: 7180110 - DNA, 22 bp, Homo sapiens
ttcttaaagaggcaaaacacag

SEQ ID NO: 7180111 - DNA, 22 bp, Homo sapiens
ttcttcagtcccactagccaca

SEQ ID NO: 7180112 - DNA, 22 bp, Homo sapiens
ttcttcagtcccactagccaca

SEQ ID NO: 7180113 - DNA, 22 bp, Homo sapiens
ttcttacaagtattccaggtcc

SEQ ID NO: 7180114 - DNA, 22 bp, Homo sapiens
ttcttacaagtattccaggtcc

SEQ ID NO: 7180115 - DNA, 22 bp, Homo sapiens
ttcttaatctgtgtgggttcga

SEQ ID NO: 7180116 - DNA, 22 bp, Homo sapiens
ttcttaatcccacaaatcttca

SEQ ID NO: 7180117 - DNA, 19 bp, Homo sapiens
ttcttacaacaccctggga

SEQ ID NO: 7180118 - DNA, 22 bp, Homo sapiens
ttcttaatggcaaaggatttta

SEQ ID NO: 7180119 - DNA, 22 bp, Homo sapiens
ttcttacaaacaagatcattga

SEQ ID NO: 7180120 - DNA, 22 bp, Homo sapiens
ttgctgagctttggcaaggaag

SEQ ID NO: 7180121 - DNA, 22 bp, Homo sapiens
ttgctgaggacgcagtgcagtg

SEQ ID NO: 7180122 - DNA, 22 bp, Homo sapiens
ttgctgagtgaccaataaatat

SEQ ID NO: 7180123 - DNA, 22 bp, Homo sapiens
ttgctgataccatgaatgttaa

SEQ ID NO: 7180124 - DNA, 22 bp, Homo sapiens
ttgctgataccatgaatgttaa

SEQ ID NO: 7180125 - DNA, 22 bp, Homo sapiens
ttgctgatctgaaacgttactg

SEQ ID NO: 7180126 - DNA, 22 bp, Homo sapiens
ttgctgatggagggaatgctca

SEQ ID NO: 7180127 - DNA, 22 bp, Homo sapiens
ttgctgatgcccttgtccaggc

SEQ ID NO: 7180128 - DNA, 22 bp, Homo sapiens
ttgctgatggagggaatgctca

SEQ ID NO: 7180129 - DNA, 22 bp, Homo sapiens
ttgctgatggtattatgctagt

SEQ ID NO: 7180130 - DNA, 22 bp, Homo sapiens
ttgctgattctgtatttaaggt

SEQ ID NO: 7180131 - DNA, 22 bp, Homo sapiens
ttgctgatttagccatacacat

SEQ ID NO: 7180132 - DNA, 22 bp, Homo sapiens
ttgctgatttccccttgagtgt

SEQ ID NO: 7180133 - DNA, 22 bp, Homo sapiens
ttgctgatttccccttgagtgt

SEQ ID NO: 7180134 - DNA, 22 bp, Homo sapiens
ttgctgatttgtttctattcca

SEQ ID NO: 7180135 - DNA, 21 bp, Homo sapiens
ttgctgccctccctttcctca

SEQ ID NO: 7180136 - DNA, 23 bp, Homo sapiens
ttgctgcctgagccttcctctgg

SEQ ID NO: 7180137 - DNA, 22 bp, Homo sapiens
ttgctgctcccaagaggcagct

SEQ ID NO: 7180138 - DNA, 22 bp, Homo sapiens
ctcaggctcatatcccatcagc

SEQ ID NO: 7180139 - DNA, 22 bp, Homo sapiens
ctcaggctcatatcccatcagc

SEQ ID NO: 7180140 - DNA, 22 bp, Homo sapiens
ttgctgtagttcaatatgtggt

SEQ ID NO: 7180141 - DNA, 22 bp, Homo sapiens
ttgctgggtgctattatgaaca

SEQ ID NO: 7180142 - DNA, 22 bp, Homo sapiens
ttgctggtaaagtctttatcgg

SEQ ID NO: 7180143 - DNA, 22 bp, Homo sapiens
ttgctgtaagtatctttctacc

SEQ ID NO: 7180144 - DNA, 22 bp, Homo sapiens
ttgctgtaccaaagattcctga

SEQ ID NO: 7180145 - DNA, 22 bp, Homo sapiens
ttgctggcaatttagagatttc

SEQ ID NO: 7180146 - DNA, 20 bp, Homo sapiens
ttgctgggacctttttcaac

SEQ ID NO: 7180147 - DNA, 22 bp, Homo sapiens
ttgctgggcatgtcttaattct

SEQ ID NO: 7180148 - DNA, 22 bp, Homo sapiens
ttgctgggctcttcaacacaca

SEQ ID NO: 7180149 - DNA, 22 bp, Homo sapiens
ttgctggggtgtgaaatctgat

SEQ ID NO: 7180150 - DNA, 22 bp, Homo sapiens
ttgctgggtcagaagccaggag

SEQ ID NO: 7180151 - DNA, 22 bp, Homo sapiens
ttgctgggtcagaagccaggag

SEQ ID NO: 7180152 - DNA, 22 bp, Homo sapiens
ttgctggaggtgttccagatct

SEQ ID NO: 7180153 - DNA, 22 bp, Homo sapiens
ttgctggcaatttagagatttc

SEQ ID NO: 7180154 - DNA, 22 bp, Homo sapiens
ttgctggatggcgtccaccagg

SEQ ID NO: 7180155 - DNA, 19 bp, Homo sapiens
ttgctggcatttgatctct

SEQ ID NO: 7180156 - DNA, 22 bp, Homo sapiens
ttgctggcttgaagatagagga

SEQ ID NO: 7180157 - DNA, 18 bp, Homo sapiens
ctcaggcctttccctgtg

SEQ ID NO: 7180158 - DNA, 18 bp, Homo sapiens
ctcaggcctttccctgtg

SEQ ID NO: 7180159 - DNA, 22 bp, Homo sapiens
ctcaggccttgaagtcttttct

SEQ ID NO: 7180160 - DNA, 22 bp, Homo sapiens
ctcaggcctgagtggcagtccc

SEQ ID NO: 7180161 - DNA, 20 bp, Homo sapiens
ttgcacagagaaggaggcag

SEQ ID NO: 7180162 - DNA, 20 bp, Homo sapiens
ttgcacagaggtttcaagtg

SEQ ID NO: 7180163 - DNA, 18 bp, Homo sapiens
ctcaggcctttccctgtg

SEQ ID NO: 7180164 - DNA, 23 bp, Homo sapiens
ttgcacagtgtatacacatattt

SEQ ID NO: 7180165 - DNA, 23 bp, Homo sapiens
ttgcacagtttcggaaactgagg

SEQ ID NO: 7180166 - DNA, 22 bp, Homo sapiens
ttgcacagtttgaagatgactc

SEQ ID NO: 7180167 - DNA, 22 bp, Homo sapiens
ttgcacatgatagatgatttct

SEQ ID NO: 7180168 - DNA, 22 bp, Homo sapiens
ttgcacatgctatttatgtttt

SEQ ID NO: 7180169 - DNA, 22 bp, Homo sapiens
ttgcacagcaacgtgaatgtac

SEQ ID NO: 7180170 - DNA, 22 bp, Homo sapiens
ttgcacagtagcgcgtgattgt

SEQ ID NO: 7180171 - DNA, 22 bp, Homo sapiens
ttgcacagtggtttagagcctg

SEQ ID NO: 7180172 - DNA, 22 bp, Homo sapiens
ttgcacagatgagggtgatgct

SEQ ID NO: 7180173 - DNA, 22 bp, Homo sapiens
ttgcacagatgcacatggttgc

SEQ ID NO: 7180174 - DNA, 22 bp, Homo sapiens
ttgcactccagcccgagcaaca

SEQ ID NO: 7180175 - DNA, 21 bp, Homo sapiens
ttgcaccatgataaattcaga

SEQ ID NO: 7180176 - DNA, 22 bp, Homo sapiens
ttgcaccatttcacttccatta

SEQ ID NO: 7180177 - DNA, 22 bp, Homo sapiens
ttgcacctcatttcatttgggc

SEQ ID NO: 7180178 - DNA, 22 bp, Homo sapiens
ttgcacctgtctctgtgttggg

SEQ ID NO: 7180179 - DNA, 22 bp, Homo sapiens
ttgcacagtttgaagatgactc

SEQ ID NO: 7180180 - DNA, 22 bp, Homo sapiens
ttgcacatgttggttcttgaaa

SEQ ID NO: 7180181 - DNA, 23 bp, Homo sapiens
ttgcacattggagctggtcttct

SEQ ID NO: 7180182 - DNA, 22 bp, Homo sapiens
ttgcaccaaatgagttaaaatt

SEQ ID NO: 7180183 - DNA, 22 bp, Homo sapiens
ttgcaccaaatgagttaaaatt

SEQ ID NO: 7180184 - DNA, 21 bp, Homo sapiens
ttgcaccatgataaattcaga

SEQ ID NO: 7180185 - DNA, 22 bp, Homo sapiens
ttgcactccagtctgggaacaa

SEQ ID NO: 7180186 - DNA, 22 bp, Homo sapiens
ttgcactttatagaaacttttg

SEQ ID NO: 7180187 - DNA, 22 bp, Homo sapiens
ttgcctagagttgcacatctgg

SEQ ID NO: 7180188 - DNA, 22 bp, Homo sapiens
ttgctgagcagtgtttaattgt

SEQ ID NO: 7180189 - DNA, 22 bp, Homo sapiens
ttgccgccgtctgctcgccccg

SEQ ID NO: 7180190 - DNA, 22 bp, Homo sapiens
ctcagccatgcaacatgctggg

SEQ ID NO: 7180191 - DNA, 22 bp, Homo sapiens
ctcagccagtgatctttccttt

SEQ ID NO: 7180192 - DNA, 22 bp, Homo sapiens
ctcagccatgcaacatgctggg

SEQ ID NO: 7180193 - DNA, 22 bp, Homo sapiens
ctcagccaggtgggggtcggga

SEQ ID NO: 7180194 - DNA, 22 bp, Homo sapiens
ctcagccagtgatctttccttt

SEQ ID NO: 7180195 - DNA, 22 bp, Homo sapiens
ctcagccatgcaacatgctggg

SEQ ID NO: 7180196 - DNA, 22 bp, Homo sapiens
ctcagccatgcaacatgctggg

SEQ ID NO: 7180197 - DNA, 22 bp, Homo sapiens
ctcagcatcatggtatctgggg

SEQ ID NO: 7180198 - DNA, 22 bp, Homo sapiens
ctcagcattcaatgtccagtcc

SEQ ID NO: 7180199 - DNA, 22 bp, Homo sapiens
ctcagccagacatgacccagtc

SEQ ID NO: 7180200 - DNA, 22 bp, Homo sapiens
ctcagccaggagagtgttcaca

SEQ ID NO: 7180201 - DNA, 22 bp, Homo sapiens
ctcagccccaattctccccatt

SEQ ID NO: 7180202 - DNA, 22 bp, Homo sapiens
ctcagcccagcccaggaccagg

SEQ ID NO: 7180203 - DNA, 22 bp, Homo sapiens
ctcagccatggggtggatcagc

SEQ ID NO: 7180204 - DNA, 22 bp, Homo sapiens
ctcagccatggggtggatcagc

SEQ ID NO: 7180205 - DNA, 22 bp, Homo sapiens
ctcagccatgtcatgcctacct

SEQ ID NO: 7180206 - DNA, 22 bp, Homo sapiens
ctcagcccagcccaggaccagg

SEQ ID NO: 7180207 - DNA, 22 bp, Homo sapiens
ctcaggccattcttccagctgc

SEQ ID NO: 7180208 - DNA, 22 bp, Homo sapiens
ctcaggccattcttccagctgc

SEQ ID NO: 7180209 - DNA, 22 bp, Homo sapiens
ctcaggcccacagcagacccac

SEQ ID NO: 7180210 - DNA, 22 bp, Homo sapiens
ctcaggcccacagcagacccac

SEQ ID NO: 7180211 - DNA, 22 bp, Homo sapiens
ctcaggcccacagcagacccac

SEQ ID NO: 7180212 - DNA, 22 bp, Homo sapiens
ctcaggcctgagtggcagtccc

SEQ ID NO: 7180213 - DNA, 22 bp, Homo sapiens
ctcaggcctgagtggcagtccc

SEQ ID NO: 7180214 - DNA, 22 bp, Homo sapiens
ctcaggagttggaggctacagt

SEQ ID NO: 7180215 - DNA, 22 bp, Homo sapiens
ctcaggagtagttcagcagctg

SEQ ID NO: 7180216 - DNA, 22 bp, Homo sapiens
ctcaggccaataagctccagcc

SEQ ID NO: 7180217 - DNA, 22 bp, Homo sapiens
ctcaggccaggtttctcccaca

SEQ ID NO: 7180218 - DNA, 22 bp, Homo sapiens
ctcaggccaggtttctcccaca

SEQ ID NO: 7180219 - DNA, 22 bp, Homo sapiens
ctcaggccattcctaccaaggg

SEQ ID NO: 7180220 - DNA, 22 bp, Homo sapiens
ctcaggccattcctaccaaggg

SEQ ID NO: 7180221 - DNA, 22 bp, Homo sapiens
ctcaggccattcttccagctgc

SEQ ID NO: 7180222 - DNA, 22 bp, Homo sapiens
ctcaggccattcttccagctgc

SEQ ID NO: 7180223 - DNA, 22 bp, Homo sapiens
ttgcaaaagccgaggcactcca

SEQ ID NO: 7180224 - DNA, 22 bp, Homo sapiens
ttgcaaaagcaattgcagtttt

SEQ ID NO: 7180225 - DNA, 22 bp, Homo sapiens
ttgcaaaaccatcctaagtaaa

SEQ ID NO: 7180226 - DNA, 22 bp, Homo sapiens
ttgcaaaaccatcctaagtaaa

SEQ ID NO: 7180227 - DNA, 23 bp, Homo sapiens
ttgcaaaatgagtcttgagtgaa

SEQ ID NO: 7180228 - DNA, 23 bp, Homo sapiens
ttgcaaaatgcaattgagttaga

SEQ ID NO: 7180229 - DNA, 22 bp, Homo sapiens
ttgcaaagaattttacattcta

SEQ ID NO: 7180230 - DNA, 22 bp, Homo sapiens
ctcagcagtgacaagagagtat

SEQ ID NO: 7180231 - DNA, 22 bp, Homo sapiens
ctcagcagtgacaagagagtat

SEQ ID NO: 7180232 - DNA, 22 bp, Homo sapiens
ctcagaaacggagctgccattt

SEQ ID NO: 7180233 - DNA, 22 bp, Homo sapiens
ctcagaaagcaatctggtgagg

SEQ ID NO: 7180234 - DNA, 22 bp, Homo sapiens
ttgatattttgcacgcttggta

SEQ ID NO: 7180235 - DNA, 22 bp, Homo sapiens
ttgatattttgcacgcttggta

SEQ ID NO: 7180236 - DNA, 22 bp, Homo sapiens
ttgatcaaatcagctactgagg

SEQ ID NO: 7180237 - DNA, 22 bp, Homo sapiens
ttgatcaaatcagctactgagg

SEQ ID NO: 7180238 - DNA, 22 bp, Homo sapiens
ttgatcaagtgggaaatagtaa

SEQ ID NO: 7180239 - DNA, 22 bp, Homo sapiens
ttgatttttttctactatgcgc

SEQ ID NO: 7180240 - DNA, 22 bp, Homo sapiens
ttgatttttttctactatgcgc

SEQ ID NO: 7180241 - DNA, 22 bp, Homo sapiens
ttgcaaaaactgcaattacttt

SEQ ID NO: 7180242 - DNA, 22 bp, Homo sapiens
ttgcaaaaaccacaattacttt

SEQ ID NO: 7180243 - DNA, 19 bp, Homo sapiens
cccagaggaatgcctggaa

SEQ ID NO: 7180244 - DNA, 19 bp, Homo sapiens
cccagaggaatgcctggaa

SEQ ID NO: 7180245 - DNA, 19 bp, Homo sapiens
cccagaggaatgcctggaa

SEQ ID NO: 7180246 - DNA, 23 bp, Homo sapiens
cccagaggagcagggcgtgagat

SEQ ID NO: 7180247 - DNA, 23 bp, Homo sapiens
cccagaggagcagggcgtgagat

SEQ ID NO: 7180248 - DNA, 23 bp, Homo sapiens
cccagaggagcagggcgtgagat

SEQ ID NO: 7180249 - DNA, 23 bp, Homo sapiens
cccagaggagcagggcgtgagat

SEQ ID NO: 7180250 - DNA, 18 bp, Homo sapiens
cccagaggaatgcctgga

SEQ ID NO: 7180251 - DNA, 22 bp, Homo sapiens
cccagagctgggtgggcagcgg

SEQ ID NO: 7180252 - DNA, 18 bp, Homo sapiens
cccagaggaatgcctgga

SEQ ID NO: 7180253 - DNA, 18 bp, Homo sapiens
cccagaggaatgcctgga

SEQ ID NO: 7180254 - DNA, 18 bp, Homo sapiens
cccagaggaatgcctgga

SEQ ID NO: 7180255 - DNA, 22 bp, Homo sapiens
cccagagctgattgttggagcc

SEQ ID NO: 7180256 - DNA, 22 bp, Homo sapiens
cccagagctgattgttggagcc

SEQ ID NO: 7180257 - DNA, 22 bp, Homo sapiens
cccagagctgggtgggcagcgg

SEQ ID NO: 7180258 - DNA, 22 bp, Homo sapiens
cccagagatgtcctgagtgata

SEQ ID NO: 7180259 - DNA, 21 bp, Homo sapiens
cccagagcctagggagggcac

SEQ ID NO: 7180260 - DNA, 22 bp, Homo sapiens
cccagagcctcattctgttggg

SEQ ID NO: 7180261 - DNA, 22 bp, Homo sapiens
tgcagagagttagggcccgtat

SEQ ID NO: 7180262 - DNA, 22 bp, Homo sapiens
tgcagagagccctgccttcctc

SEQ ID NO: 7180263 - DNA, 22 bp, Homo sapiens
tgcagagagccagctctctcgg

SEQ ID NO: 7180264 - DNA, 16 bp, Homo sapiens
tgcagagagcatggtg

SEQ ID NO: 7180265 - DNA, 16 bp, Homo sapiens
tgcagagagcatggtg

SEQ ID NO: 7180266 - DNA, 22 bp, Homo sapiens
cccagagctcagtgtgcaaggt

SEQ ID NO: 7180267 - DNA, 22 bp, Homo sapiens
cccagagctcagtgtgcaaggt

SEQ ID NO: 7180268 - DNA, 22 bp, Homo sapiens
cccagagctcagtgtgcaaggt

SEQ ID NO: 7180269 - DNA, 22 bp, Homo sapiens
cccagagctccggtcctgccca

SEQ ID NO: 7180270 - DNA, 22 bp, Homo sapiens
cccagagctccggtcctgccca

SEQ ID NO: 7180271 - DNA, 22 bp, Homo sapiens
cccagagctccggtcctgccca

SEQ ID NO: 7180272 - DNA, 22 bp, Homo sapiens
cccagagctccggtcctgccca

SEQ ID NO: 7180273 - DNA, 22 bp, Homo sapiens
cccagagctccggtcctgccca

SEQ ID NO: 7180274 - DNA, 22 bp, Homo sapiens
cccagagctgagggggcacgtt

SEQ ID NO: 7180275 - DNA, 22 bp, Homo sapiens
cccagagctgagggggcacgtt

SEQ ID NO: 7180276 - DNA, 22 bp, Homo sapiens
cccagagctgagtctgatatat

SEQ ID NO: 7180277 - DNA, 22 bp, Homo sapiens
tgcagagagatcctcagggttt

SEQ ID NO: 7180278 - DNA, 22 bp, Homo sapiens
tgcagagagatatggcaagagg

SEQ ID NO: 7180279 - DNA, 22 bp, Homo sapiens
tgcagagagatatggcaagagg

SEQ ID NO: 7180280 - DNA, 22 bp, Homo sapiens
tgcagagagatatggcaagagg

SEQ ID NO: 7180281 - DNA, 19 bp, Homo sapiens
tgcagagagaggcaaagaa

SEQ ID NO: 7180282 - DNA, 19 bp, Homo sapiens
tgcagagagaggcaaagaa

SEQ ID NO: 7180283 - DNA, 22 bp, Homo sapiens
tgcagagagacccctgggccag

SEQ ID NO: 7180284 - DNA, 22 bp, Homo sapiens
tgcagagaccactgtgccttcc

SEQ ID NO: 7180285 - DNA, 22 bp, Homo sapiens
tgcagagaagaggacagttcta

SEQ ID NO: 7180286 - DNA, 22 bp, Homo sapiens
tgcagagaagaggacagttcta

SEQ ID NO: 7180287 - DNA, 22 bp, Homo sapiens
tgcagagaagaggacagttcta

SEQ ID NO: 7180288 - DNA, 22 bp, Homo sapiens
tgcagagaaagtgtagacaggc

SEQ ID NO: 7180289 - DNA, 22 bp, Homo sapiens
tgcagagaaagtgtagacaggc

SEQ ID NO: 7180290 - DNA, 22 bp, Homo sapiens
tgcagagaaagtgtagacaggc

SEQ ID NO: 7180291 - DNA, 22 bp, Homo sapiens
tgcagagaaaccagtggaggac

SEQ ID NO: 7180292 - DNA, 22 bp, Homo sapiens
tgcactgggaaagaaggaggga

SEQ ID NO: 7180293 - DNA, 22 bp, Homo sapiens
tgcactgggaaagaaggaggga

SEQ ID NO: 7180294 - DNA, 22 bp, Homo sapiens
tgcactggggtcccagcgcacg

SEQ ID NO: 7180295 - DNA, 22 bp, Homo sapiens
tgcactgatcctgaccagtgaa

SEQ ID NO: 7180296 - DNA, 22 bp, Homo sapiens
tgcactccaggctgggtgacag

SEQ ID NO: 7180297 - DNA, 18 bp, Homo sapiens
tgcactgtgctgagtggc

SEQ ID NO: 7180298 - DNA, 22 bp, Homo sapiens
tgcactggtggtgagtgaggga

SEQ ID NO: 7180299 - DNA, 22 bp, Homo sapiens
tgcactggtggtgagtgaggga

SEQ ID NO: 7180300 - DNA, 22 bp, Homo sapiens
tgcactttatttcctctcacac

SEQ ID NO: 7180301 - DNA, 19 bp, Homo sapiens
tgcacttgagatgtttgta

SEQ ID NO: 7180302 - DNA, 19 bp, Homo sapiens
tgcacttgagatgtttgta

SEQ ID NO: 7180303 - DNA, 22 bp, Homo sapiens
tgcacttgtgttttcagaatct

SEQ ID NO: 7180304 - DNA, 22 bp, Homo sapiens
tgcacttgtgttttcagaatct

SEQ ID NO: 7180305 - DNA, 22 bp, Homo sapiens
tgcactttaaaaaatggtgatg

SEQ ID NO: 7180306 - DNA, 22 bp, Homo sapiens
tgcacagatctggtggcaagga

SEQ ID NO: 7180307 - DNA, 22 bp, Homo sapiens
cccaagggtgcccagcagagga

SEQ ID NO: 7180308 - DNA, 22 bp, Homo sapiens
cccaaggggtgttgatggagga

SEQ ID NO: 7180309 - DNA, 22 bp, Homo sapiens
cccaaggggtgttgatggagga

SEQ ID NO: 7180310 - DNA, 22 bp, Homo sapiens
cccaagggtgcccagcagagga

SEQ ID NO: 7180311 - DNA, 22 bp, Homo sapiens
cccaagggatgcttgagtagtt

SEQ ID NO: 7180312 - DNA, 22 bp, Homo sapiens
cccaagggatgcttgagtagtt

SEQ ID NO: 7180313 - DNA, 22 bp, Homo sapiens
cccaagggatgcttgagtagtt

SEQ ID NO: 7180314 - DNA, 22 bp, Homo sapiens
cccaaggggagattttcttgag

SEQ ID NO: 7180315 - DNA, 22 bp, Homo sapiens
cccaaggggagattttcttgag

SEQ ID NO: 7180316 - DNA, 22 bp, Homo sapiens
cccaaggggtgttgatggagga

SEQ ID NO: 7180317 - DNA, 22 bp, Homo sapiens
tgcactatttcgccatggttgt

SEQ ID NO: 7180318 - DNA, 22 bp, Homo sapiens
tgcactattgtgttcactatta

SEQ ID NO: 7180319 - DNA, 22 bp, Homo sapiens
tgcactatttcgccatggttgt

SEQ ID NO: 7180320 - DNA, 22 bp, Homo sapiens
tgcactattttcaggctttgtg

SEQ ID NO: 7180321 - DNA, 22 bp, Homo sapiens
tgcactagccacatttcaaatg

SEQ ID NO: 7180322 - DNA, 22 bp, Homo sapiens
tgcacagatgctaggaggtgaa

SEQ ID NO: 7180323 - DNA, 22 bp, Homo sapiens
tgcacagatgctaggaggtgaa

SEQ ID NO: 7180324 - DNA, 22 bp, Homo sapiens
tgcacagatgggcttgttcata

SEQ ID NO: 7180325 - DNA, 22 bp, Homo sapiens
tgcacagatgggcttgttcata

SEQ ID NO: 7180326 - DNA, 21 bp, Homo sapiens
tgcacagcaaaagttgagtaa

SEQ ID NO: 7180327 - DNA, 21 bp, Homo sapiens
tgcacagcaaaagttgagtaa

SEQ ID NO: 7180328 - DNA, 22 bp, Homo sapiens
tgcactccaggctgggtgacag

SEQ ID NO: 7180329 - DNA, 22 bp, Homo sapiens
tgcactccaggctgggtgacag

SEQ ID NO: 7180330 - DNA, 22 bp, Homo sapiens
tgcactccaggctgggtgacag

SEQ ID NO: 7180331 - DNA, 22 bp, Homo sapiens
cccaaggcctctccttggcttg

SEQ ID NO: 7180332 - DNA, 22 bp, Homo sapiens
cccaaggccttcaagccagctc

SEQ ID NO: 7180333 - DNA, 22 bp, Homo sapiens
cccaaggacacgggcagggaca

SEQ ID NO: 7180334 - DNA, 16 bp, Homo sapiens
cccaaggagctccagg

SEQ ID NO: 7180335 - DNA, 22 bp, Homo sapiens
cccaaggcatggcatggtggca

SEQ ID NO: 7180336 - DNA, 22 bp, Homo sapiens
cccaaggcagggattttctgct

SEQ ID NO: 7180337 - DNA, 19 bp, Homo sapiens
cccaaggccctgggcaggc

SEQ ID NO: 7180338 - DNA, 19 bp, Homo sapiens
cccaaggccctgggcaggc

SEQ ID NO: 7180339 - DNA, 22 bp, Homo sapiens
cccaaggccttcaagccagctc

SEQ ID NO: 7180340 - DNA, 22 bp, Homo sapiens
cccaaggctgcagtgagcatga

SEQ ID NO: 7180341 - DNA, 22 bp, Homo sapiens
cccaaggctgcagtgagcatga

SEQ ID NO: 7180342 - DNA, 22 bp, Homo sapiens
cccaaggctgcagtgagcatga

SEQ ID NO: 7180343 - DNA, 22 bp, Homo sapiens
cccaaggctgcagtgagcatga

SEQ ID NO: 7180344 - DNA, 21 bp, Homo sapiens
cccaagggaggcaggataagg

SEQ ID NO: 7180345 - DNA, 21 bp, Homo sapiens
cccaagggaggcaggataagg

SEQ ID NO: 7180346 - DNA, 22 bp, Homo sapiens
cccaagggagtgcctggtcaac

SEQ ID NO: 7180347 - DNA, 23 bp, Homo sapiens
cccaagcctgtgccctctgactc

SEQ ID NO: 7180348 - DNA, 22 bp, Homo sapiens
cccaagcctttcaaaactcaga

SEQ ID NO: 7180349 - DNA, 22 bp, Homo sapiens
cccaaggaataggatcccagga

SEQ ID NO: 7180350 - DNA, 22 bp, Homo sapiens
cccaaggacacgggcagggaca

SEQ ID NO: 7180351 - DNA, 22 bp, Homo sapiens
cccaaggacacgggcagggaca

SEQ ID NO: 7180352 - DNA, 21 bp, Homo sapiens
tgcaatccagcctgggcgaca

SEQ ID NO: 7180353 - DNA, 22 bp, Homo sapiens
cccaagccagaccctgaccctg

SEQ ID NO: 7180354 - DNA, 22 bp, Homo sapiens
cccaagccagaccctgaccctg

SEQ ID NO: 7180355 - DNA, 22 bp, Homo sapiens
cccaagccagaccctgaccctg

SEQ ID NO: 7180356 - DNA, 23 bp, Homo sapiens
cccaagcctgtgccctctgactc

SEQ ID NO: 7180357 - DNA, 23 bp, Homo sapiens
cccaagcctgtgccctctgactc

SEQ ID NO: 7180358 - DNA, 23 bp, Homo sapiens
cccaagcctgtgccctctgactc

SEQ ID NO: 7180359 - DNA, 23 bp, Homo sapiens
cccaagcctgtgccctctgactc

SEQ ID NO: 7180360 - DNA, 22 bp, Homo sapiens
tgatacagagcaagcatctttt

SEQ ID NO: 7180361 - DNA, 22 bp, Homo sapiens
tgatacacagatttacatcaat

SEQ ID NO: 7180362 - DNA, 22 bp, Homo sapiens
tgatacagagaaagcatctttt

SEQ ID NO: 7180363 - DNA, 22 bp, Homo sapiens
tgataatgttcgagaatgaaga

SEQ ID NO: 7180364 - DNA, 22 bp, Homo sapiens
tgataaatccatgtaaatggta

SEQ ID NO: 7180365 - DNA, 22 bp, Homo sapiens
tgataactctcagtttctcatg

SEQ ID NO: 7180366 - DNA, 22 bp, Homo sapiens
tgataatattttgaatcataag

SEQ ID NO: 7180367 - DNA, 22 bp, Homo sapiens
tgcaataacccagtatctgtga

SEQ ID NO: 7180368 - DNA, 22 bp, Homo sapiens
tgcaataaagtgctataaatcc

SEQ ID NO: 7180369 - DNA, 22 bp, Homo sapiens
tgcaataacccagtatctgtga

SEQ ID NO: 7180370 - DNA, 22 bp, Homo sapiens
tgcaataaagtgctataaatcc

SEQ ID NO: 7180371 - DNA, 19 bp, Homo sapiens
tgcaagtgtcttggacaag

SEQ ID NO: 7180372 - DNA, 22 bp, Homo sapiens
tgcaataaagtgctataaatcc

SEQ ID NO: 7180373 - DNA, 22 bp, Homo sapiens
tgcaaatattgggacagtctag

SEQ ID NO: 7180374 - DNA, 22 bp, Homo sapiens
tgcaataaggagtaatagtaaa

SEQ ID NO: 7180375 - DNA, 22 bp, Homo sapiens
tgcaataactactttaatgttg

SEQ ID NO: 7180376 - DNA, 22 bp, Homo sapiens
tgcaataaggagtaatagtaaa

SEQ ID NO: 7180377 - DNA, 22 bp, Homo sapiens
tgcaataacccagtatctgtga

SEQ ID NO: 7180378 - DNA, 22 bp, Homo sapiens
tgcaataaggagtaatagtaaa

SEQ ID NO: 7180379 - DNA, 22 bp, Homo sapiens
tgcaataagttgtgttatcact

SEQ ID NO: 7180380 - DNA, 22 bp, Homo sapiens
tgcaatatcagattcaacacat

SEQ ID NO: 7180381 - DNA, 22 bp, Homo sapiens
tgcaatatgttgcattgtatgg

SEQ ID NO: 7180382 - DNA, 22 bp, Homo sapiens
tgcaatatgttgcattgtatgg

SEQ ID NO: 7180383 - DNA, 20 bp, Homo sapiens
tgcaatattcagttggttat

SEQ ID NO: 7180384 - DNA, 22 bp, Homo sapiens
tgcaatatgttgcattgtatgg

SEQ ID NO: 7180385 - DNA, 22 bp, Homo sapiens
tgcaatatgttgcattgtatgg

SEQ ID NO: 7180386 - DNA, 22 bp, Homo sapiens
tgcaatattttatatccaacaa

SEQ ID NO: 7180387 - DNA, 23 bp, Homo sapiens
tgcaggactactcgagcactgct

SEQ ID NO: 7180388 - DNA, 23 bp, Homo sapiens
tgcaggactcaagaaagaaaggc

SEQ ID NO: 7180389 - DNA, 22 bp, Homo sapiens
tgcaggactgaaggagggctgg

SEQ ID NO: 7180390 - DNA, 22 bp, Homo sapiens
tgcaggacttcaggactctgag

SEQ ID NO: 7180391 - DNA, 23 bp, Homo sapiens
tgcaggactactcgagcactgct

SEQ ID NO: 7180392 - DNA, 22 bp, Homo sapiens
tgcaggaccttgatcctggact

SEQ ID NO: 7180393 - DNA, 22 bp, Homo sapiens
tgcaggacagtttggaagagag

SEQ ID NO: 7180394 - DNA, 22 bp, Homo sapiens
tgcaggaattttttgcagaaag

SEQ ID NO: 7180395 - DNA, 20 bp, Homo sapiens
tgcaggacagagcctgtgtg

SEQ ID NO: 7180396 - DNA, 22 bp, Homo sapiens
tgcaggaatagctacagagctg

SEQ ID NO: 7180397 - DNA, 22 bp, Homo sapiens
tgcaggaatagctacagagctg

SEQ ID NO: 7180398 - DNA, 22 bp, Homo sapiens
tgcaggaatagctacagagctg

SEQ ID NO: 7180399 - DNA, 22 bp, Homo sapiens
tgcaggaatagctacagagctg

SEQ ID NO: 7180400 - DNA, 22 bp, Homo sapiens
tgcaggaatagctacagagctg

SEQ ID NO: 7180401 - DNA, 22 bp, Homo sapiens
tgcaggaagtttcctgaacttt

SEQ ID NO: 7180402 - DNA, 22 bp, Homo sapiens
tgcagctgctcattctctcagt

SEQ ID NO: 7180403 - DNA, 22 bp, Homo sapiens
tgcagctgcaggagggtgggag

SEQ ID NO: 7180404 - DNA, 22 bp, Homo sapiens
tgcagctgcaggagggtgggag

SEQ ID NO: 7180405 - DNA, 22 bp, Homo sapiens
tgcagctgcctagggctggctt

SEQ ID NO: 7180406 - DNA, 23 bp, Homo sapiens
tgcagctgcctctggcgggccgg

SEQ ID NO: 7180407 - DNA, 22 bp, Homo sapiens
cccagaggctgagttgggagca

SEQ ID NO: 7180408 - DNA, 22 bp, Homo sapiens
cccagagggaagggaatgaggt

SEQ ID NO: 7180409 - DNA, 22 bp, Homo sapiens
cccagaggaggcaaagctctgt

SEQ ID NO: 7180410 - DNA, 22 bp, Homo sapiens
cccagaggctgagttgggagca

SEQ ID NO: 7180411 - DNA, 22 bp, Homo sapiens
cccagaggctgagttgggagca

SEQ ID NO: 7180412 - DNA, 22 bp, Homo sapiens
cccagaggaggcaaagctctgt

SEQ ID NO: 7180413 - DNA, 22 bp, Homo sapiens
cccagaggaggcaaagctctgt

SEQ ID NO: 7180414 - DNA, 22 bp, Homo sapiens
cccagaggaggcaaagctctgt

SEQ ID NO: 7180415 - DNA, 22 bp, Homo sapiens
cccagaggaggatctcggcccg

SEQ ID NO: 7180416 - DNA, 22 bp, Homo sapiens
cccagaggaggatctcggcccg

SEQ ID NO: 7180417 - DNA, 22 bp, Homo sapiens
cccagaggaggatctcggcccg

SEQ ID NO: 7180418 - DNA, 22 bp, Homo sapiens
cccagagggaagggaatgaggt

SEQ ID NO: 7180419 - DNA, 22 bp, Homo sapiens
cccagagggctgaggatatgaa

SEQ ID NO: 7180420 - DNA, 22 bp, Homo sapiens
cccagagggaagggaatgaggt

SEQ ID NO: 7180421 - DNA, 22 bp, Homo sapiens
cccagaggggtcgtctgagggg

SEQ ID NO: 7180422 - DNA, 22 bp, Homo sapiens
cccagaggggtcgtctgagggg

SEQ ID NO: 7180423 - DNA, 20 bp, Homo sapiens
tgcagctgcaggagggtggg

SEQ ID NO: 7180424 - DNA, 20 bp, Homo sapiens
tgcagctgcaggagggtggg

SEQ ID NO: 7180425 - DNA, 22 bp, Homo sapiens
tgcagctgcaggagggtgggag

SEQ ID NO: 7180426 - DNA, 22 bp, Homo sapiens
tgcagctgattaaagggcagac

SEQ ID NO: 7180427 - DNA, 22 bp, Homo sapiens
tgcagctgcaagtccaggtcag

SEQ ID NO: 7180428 - DNA, 22 bp, Homo sapiens
tgcagctgcaagtccaggtcag

SEQ ID NO: 7180429 - DNA, 22 bp, Homo sapiens
tgcagctgcaagtccaggtcag

SEQ ID NO: 7180430 - DNA, 22 bp, Homo sapiens
cccagaggggtcgtctgagggg

SEQ ID NO: 7180431 - DNA, 22 bp, Homo sapiens
cccagagggtggaggttgcagt

SEQ ID NO: 7180432 - DNA, 22 bp, Homo sapiens
cccagagggtggaggttgcagt

SEQ ID NO: 7180433 - DNA, 22 bp, Homo sapiens
tgcagccacatgacctgggtct

SEQ ID NO: 7180434 - DNA, 22 bp, Homo sapiens
tgcagccaccacctctgctgaa

SEQ ID NO: 7180435 - DNA, 19 bp, Homo sapiens
tgcagccacgtgagagact

SEQ ID NO: 7180436 - DNA, 22 bp, Homo sapiens
tgcagctgattaaagggcagac

SEQ ID NO: 7180437 - DNA, 22 bp, Homo sapiens
tgcagctgattaaagggcagac

SEQ ID NO: 7180438 - DNA, 22 bp, Homo sapiens
tgcagggccttgttgatgtgct

SEQ ID NO: 7180439 - DNA, 22 bp, Homo sapiens
tgcagggccttgttgatgtgct

SEQ ID NO: 7180440 - DNA, 22 bp, Homo sapiens
tgcagggccttgttgatgtgct

SEQ ID NO: 7180441 - DNA, 22 bp, Homo sapiens
tgcagggccttgttgatgtgct

SEQ ID NO: 7180442 - DNA, 22 bp, Homo sapiens
tgcagggccttgttgatgtgct

SEQ ID NO: 7180443 - DNA, 22 bp, Homo sapiens
tgcagggccttgttgatgtgct

SEQ ID NO: 7180444 - DNA, 22 bp, Homo sapiens
tgcagggctaagtcagagcctg

SEQ ID NO: 7180445 - DNA, 22 bp, Homo sapiens
tgcagggctaagtcagagcctg

SEQ ID NO: 7180446 - DNA, 22 bp, Homo sapiens
tgcagggctaagtcagagcctg

SEQ ID NO: 7180447 - DNA, 22 bp, Homo sapiens
tgcagggccttgttgatgtgct

SEQ ID NO: 7180448 - DNA, 22 bp, Homo sapiens
tgcagggccttgggtctttctt

SEQ ID NO: 7180449 - DNA, 22 bp, Homo sapiens
tgcagggccttgggtctttctt

SEQ ID NO: 7180450 - DNA, 22 bp, Homo sapiens
tgcagggccttgggtctttctt

SEQ ID NO: 7180451 - DNA, 22 bp, Homo sapiens
tgcagggccttgggatgtgtcc

SEQ ID NO: 7180452 - DNA, 22 bp, Homo sapiens
tgcagggccttgggatgtgtcc

SEQ ID NO: 7180453 - DNA, 22 bp, Homo sapiens
tgcagggccttgggatgtgtcc

SEQ ID NO: 7180454 - DNA, 22 bp, Homo sapiens
tgcagggccttgggatgtgtcc

SEQ ID NO: 7180455 - DNA, 22 bp, Homo sapiens
tgcagggccttgggatgtgtcc

SEQ ID NO: 7180456 - DNA, 22 bp, Homo sapiens
tgcagggccttctagaccatgg

SEQ ID NO: 7180457 - DNA, 20 bp, Homo sapiens
tgcagggcctaaaaagggaa

SEQ ID NO: 7180458 - DNA, 22 bp, Homo sapiens
tgcagggccttctagaccatgg

SEQ ID NO: 7180459 - DNA, 22 bp, Homo sapiens
tgcagggatcctagctgaagag

SEQ ID NO: 7180460 - DNA, 22 bp, Homo sapiens
tgcagggatcctagctgaagag

SEQ ID NO: 7180461 - DNA, 22 bp, Homo sapiens
tgcagggccgctggaggtcatg

SEQ ID NO: 7180462 - DNA, 20 bp, Homo sapiens
tgcagggcctaaaaagggaa

SEQ ID NO: 7180463 - DNA, 20 bp, Homo sapiens
tgcagggcctaaaaagggaa

SEQ ID NO: 7180464 - DNA, 22 bp, Homo sapiens
cccagcagggtctctgtgtcta

SEQ ID NO: 7180465 - DNA, 22 bp, Homo sapiens
cccagcagggtctctgtgtcta

SEQ ID NO: 7180466 - DNA, 22 bp, Homo sapiens
cccagcagggtctctgtgtcta

SEQ ID NO: 7180467 - DNA, 22 bp, Homo sapiens
cccagcagggtctctgtgtcta

SEQ ID NO: 7180468 - DNA, 22 bp, Homo sapiens
cccagcaggtcggtgctgcctg

SEQ ID NO: 7180469 - DNA, 22 bp, Homo sapiens
cccagcaggtcggtgctgcctg

SEQ ID NO: 7180470 - DNA, 22 bp, Homo sapiens
tgcagggatcctagctgaagag

SEQ ID NO: 7180471 - DNA, 22 bp, Homo sapiens
cccagcaggaggaggttgcagt

SEQ ID NO: 7180472 - DNA, 22 bp, Homo sapiens
cccagcaggaggaggttgcagt

SEQ ID NO: 7180473 - DNA, 22 bp, Homo sapiens
cccagcaggaggaggttgcagt

SEQ ID NO: 7180474 - DNA, 22 bp, Homo sapiens
cccagcaggcatgttgggagga

SEQ ID NO: 7180475 - DNA, 22 bp, Homo sapiens
cccagcaggcatgttgggagga

SEQ ID NO: 7180476 - DNA, 22 bp, Homo sapiens
cccagcaggcatgttgggagga

SEQ ID NO: 7180477 - DNA, 22 bp, Homo sapiens
cccagcaggcatgttgggagga

SEQ ID NO: 7180478 - DNA, 22 bp, Homo sapiens
cccagcagggtctctgtgtcta

SEQ ID NO: 7180479 - DNA, 22 bp, Homo sapiens
cccagcagggtctctgtgtcta

SEQ ID NO: 7180480 - DNA, 22 bp, Homo sapiens
cccagcagcctggatgttcttt

SEQ ID NO: 7180481 - DNA, 22 bp, Homo sapiens
cccagcagccttgtcccttctc

SEQ ID NO: 7180482 - DNA, 22 bp, Homo sapiens
cccagcagcttgcacagtgctg

SEQ ID NO: 7180483 - DNA, 22 bp, Homo sapiens
cccagcagcttgcacagtgctg

SEQ ID NO: 7180484 - DNA, 22 bp, Homo sapiens
cccagcagcttgcacagtgctg

SEQ ID NO: 7180485 - DNA, 22 bp, Homo sapiens
cccagcagcttgcacagtgctg

SEQ ID NO: 7180486 - DNA, 22 bp, Homo sapiens
tgcaggcccagtgtagaggctc

SEQ ID NO: 7180487 - DNA, 22 bp, Homo sapiens
tgcaggcccagtgtagaggctc

SEQ ID NO: 7180488 - DNA, 22 bp, Homo sapiens
tgcaggccggccctaggcctca

SEQ ID NO: 7180489 - DNA, 22 bp, Homo sapiens
tgcaggcctatggtggggcccc

SEQ ID NO: 7180490 - DNA, 22 bp, Homo sapiens
tgcaggcctcacacctggcacc

SEQ ID NO: 7180491 - DNA, 22 bp, Homo sapiens
tgcaggcagggccagcgtgagg

SEQ ID NO: 7180492 - DNA, 22 bp, Homo sapiens
tgcaggcaggggatgagcagcc

SEQ ID NO: 7180493 - DNA, 22 bp, Homo sapiens
tgcaggcaggggatgagcagcc

SEQ ID NO: 7180494 - DNA, 22 bp, Homo sapiens
tgcaggcaggggatgagcagcc

SEQ ID NO: 7180495 - DNA, 21 bp, Homo sapiens
tgcaggcaggcagagatgctg

SEQ ID NO: 7180496 - DNA, 21 bp, Homo sapiens
tgcaggcaggcagagatgctg

SEQ ID NO: 7180497 - DNA, 22 bp, Homo sapiens
tgcaggcagggccagcgtgagg

SEQ ID NO: 7180498 - DNA, 21 bp, Homo sapiens
tgcaggcaggcagagatgctg

SEQ ID NO: 7180499 - DNA, 21 bp, Homo sapiens
tgcaggcaggcagagatgctg

SEQ ID NO: 7180500 - DNA, 21 bp, Homo sapiens
tgcaggcaggcagagatgctg

SEQ ID NO: 7180501 - DNA, 22 bp, Homo sapiens
tgcaggcaggggatgagcagcc

SEQ ID NO: 7180502 - DNA, 22 bp, Homo sapiens
tgcaggcaggggatgagcagcc

SEQ ID NO: 7180503 - DNA, 22 bp, Homo sapiens
tgcaggcagtaggccagctcca

SEQ ID NO: 7180504 - DNA, 22 bp, Homo sapiens
tgcaggcagtaggccagctcca

SEQ ID NO: 7180505 - DNA, 22 bp, Homo sapiens
tgcaggcaggggatgagcagcc

SEQ ID NO: 7180506 - DNA, 22 bp, Homo sapiens
tgcaggcaggggatgagcagcc

SEQ ID NO: 7180507 - DNA, 22 bp, Homo sapiens
tgcaggcaggggatgagcagcc

SEQ ID NO: 7180508 - DNA, 22 bp, Homo sapiens
tgcaggcataaccgatgttgat

SEQ ID NO: 7180509 - DNA, 22 bp, Homo sapiens
tgcaggcagtaggccagctcca

SEQ ID NO: 7180510 - DNA, 22 bp, Homo sapiens
tgcaggcataaccgatgttgat

SEQ ID NO: 7180511 - DNA, 22 bp, Homo sapiens
tgcaggcattggtgagagaagc

SEQ ID NO: 7180512 - DNA, 22 bp, Homo sapiens
tgcaggcattggtgagagaagc

SEQ ID NO: 7180513 - DNA, 22 bp, Homo sapiens
tgcaggcattggtgagagaagc

SEQ ID NO: 7180514 - DNA, 22 bp, Homo sapiens
tgcaggcattggtgagagaagc

SEQ ID NO: 7180515 - DNA, 22 bp, Homo sapiens
tgcaggcattggtgagagaagc

SEQ ID NO: 7180516 - DNA, 22 bp, Homo sapiens
ccagtgcccagtctccctggtc

SEQ ID NO: 7180517 - DNA, 22 bp, Homo sapiens
ccagtgcccagtctccctggtc

SEQ ID NO: 7180518 - DNA, 22 bp, Homo sapiens
ccagtgcccagctgcccaggca

SEQ ID NO: 7180519 - DNA, 22 bp, Homo sapiens
ccagtgcccagctgcccaggca

SEQ ID NO: 7180520 - DNA, 22 bp, Homo sapiens
ccagtgcccagctgcccaggca

SEQ ID NO: 7180521 - DNA, 22 bp, Homo sapiens
ccagtgcattgccgtgtctagg

SEQ ID NO: 7180522 - DNA, 18 bp, Homo sapiens
ccagtgccaagagtggca

SEQ ID NO: 7180523 - DNA, 22 bp, Homo sapiens
ccagtgcattgccgtgtctagg

SEQ ID NO: 7180524 - DNA, 22 bp, Homo sapiens
ccagtgcagtccccctgaactg

SEQ ID NO: 7180525 - DNA, 22 bp, Homo sapiens
ccagtgcagtccccctgaactg

SEQ ID NO: 7180526 - DNA, 22 bp, Homo sapiens
ccagtgcataatcaatacagcc

SEQ ID NO: 7180527 - DNA, 22 bp, Homo sapiens
ccagtgcctatccttctcctgt

SEQ ID NO: 7180528 - DNA, 22 bp, Homo sapiens
ccagtgcctatccttctcctgt

SEQ ID NO: 7180529 - DNA, 22 bp, Homo sapiens
ccagtgcccagtctccctggtc

SEQ ID NO: 7180530 - DNA, 22 bp, Homo sapiens
ccagtgcccagtctccctggtc

SEQ ID NO: 7180531 - DNA, 19 bp, Homo sapiens
ccagtgccggcgctgggga

SEQ ID NO: 7180532 - DNA, 22 bp, Homo sapiens
ccagtgcctgtgggcatggtgc

SEQ ID NO: 7180533 - DNA, 22 bp, Homo sapiens
ccagtgcctatctcctctggga

SEQ ID NO: 7180534 - DNA, 17 bp, Homo sapiens
ccagtgcctgtggcaac

SEQ ID NO: 7180535 - DNA, 22 bp, Homo sapiens
ccagtgcttccaggaatacggt

SEQ ID NO: 7180536 - DNA, 22 bp, Homo sapiens
ccagtgcttccaggaatacggt

SEQ ID NO: 7180537 - DNA, 21 bp, Homo sapiens
ccagtgctacagctgcctgac

SEQ ID NO: 7180538 - DNA, 22 bp, Homo sapiens
ccagtgctcttaaaggtcataa

SEQ ID NO: 7180539 - DNA, 22 bp, Homo sapiens
ccagtgctgaatgaggaggtct

SEQ ID NO: 7180540 - DNA, 22 bp, Homo sapiens
ccagtggacttctccctgtggt

SEQ ID NO: 7180541 - DNA, 22 bp, Homo sapiens
ccagtggaattaaaaataagtg

SEQ ID NO: 7180542 - DNA, 22 bp, Homo sapiens
ccagtggacaatttctgaggaa

SEQ ID NO: 7180543 - DNA, 22 bp, Homo sapiens
ccagtggaattaaaaataagtg

SEQ ID NO: 7180544 - DNA, 22 bp, Homo sapiens
ccagtggaaatgtggtcaggat

SEQ ID NO: 7180545 - DNA, 22 bp, Homo sapiens
tgaggcagtgctgggaagcctg

SEQ ID NO: 7180546 - DNA, 22 bp, Homo sapiens
ccagtggccatgcacgagcagc

SEQ ID NO: 7180547 - DNA, 22 bp, Homo sapiens
ccagtggccatgcacgagcagc

SEQ ID NO: 7180548 - DNA, 22 bp, Homo sapiens
ccagtggagtttttatacccag

SEQ ID NO: 7180549 - DNA, 22 bp, Homo sapiens
tgaggcagtgctgggaagcctg

SEQ ID NO: 7180550 - DNA, 22 bp, Homo sapiens
tgaggcagtgctgggaagcctg

SEQ ID NO: 7180551 - DNA, 22 bp, Homo sapiens
tgagcccaggaggcagaggttg

SEQ ID NO: 7180552 - DNA, 22 bp, Homo sapiens
tgagcccagcgtcccgttctgt

SEQ ID NO: 7180553 - DNA, 23 bp, Homo sapiens
tgagcccaggaggtcaaggctgc

SEQ ID NO: 7180554 - DNA, 22 bp, Homo sapiens
tgagcccaggagtatgaggctg

SEQ ID NO: 7180555 - DNA, 22 bp, Homo sapiens
tgagcccagagcccttgtaggg

SEQ ID NO: 7180556 - DNA, 22 bp, Homo sapiens
tgagcccagagatctgagctat

SEQ ID NO: 7180557 - DNA, 22 bp, Homo sapiens
tgagcccagagatctgagctat

SEQ ID NO: 7180558 - DNA, 22 bp, Homo sapiens
tgagcccagagatctgagctat

SEQ ID NO: 7180559 - DNA, 22 bp, Homo sapiens
tgagcccaggagttggagaccg

SEQ ID NO: 7180560 - DNA, 22 bp, Homo sapiens
tgagcccaggagttggagaccg

SEQ ID NO: 7180561 - DNA, 22 bp, Homo sapiens
tgagcccaggagttggagaccg

SEQ ID NO: 7180562 - DNA, 22 bp, Homo sapiens
ccagtctgaggcctggtgaggg

SEQ ID NO: 7180563 - DNA, 22 bp, Homo sapiens
ccagtctgaggcctggtgaggg

SEQ ID NO: 7180564 - DNA, 22 bp, Homo sapiens
ccagtctgcagcccctggggac

SEQ ID NO: 7180565 - DNA, 22 bp, Homo sapiens
ccagtctgcagcccctggggac

SEQ ID NO: 7180566 - DNA, 22 bp, Homo sapiens
ccagtgcaggtgagcaccaggt

SEQ ID NO: 7180567 - DNA, 22 bp, Homo sapiens
ccagtcccagctctgccatgct

SEQ ID NO: 7180568 - DNA, 22 bp, Homo sapiens
ccagtcccagctctgccatgct

SEQ ID NO: 7180569 - DNA, 22 bp, Homo sapiens
ccagtcccaggcagaaatccag

SEQ ID NO: 7180570 - DNA, 22 bp, Homo sapiens
ccagtcccagctctgccatgct

SEQ ID NO: 7180571 - DNA, 22 bp, Homo sapiens
ccagtcccagctctgccatgct

SEQ ID NO: 7180572 - DNA, 22 bp, Homo sapiens
ccagtcccagctctgccatgct

SEQ ID NO: 7180573 - DNA, 19 bp, Homo sapiens
ccagtcccatacaggagat

SEQ ID NO: 7180574 - DNA, 19 bp, Homo sapiens
ccagtcccatacaggagat

SEQ ID NO: 7180575 - DNA, 19 bp, Homo sapiens
ccagtcccatacaggagat

SEQ ID NO: 7180576 - DNA, 19 bp, Homo sapiens
ccagtcccatacaggagat

SEQ ID NO: 7180577 - DNA, 19 bp, Homo sapiens
ccagtcccatacaggagat

SEQ ID NO: 7180578 - DNA, 19 bp, Homo sapiens
ccagtcccatacaggagat

SEQ ID NO: 7180579 - DNA, 19 bp, Homo sapiens
ccagtcccatacaggagat

SEQ ID NO: 7180580 - DNA, 22 bp, Homo sapiens
tgagccagttcttcagatccat

SEQ ID NO: 7180581 - DNA, 22 bp, Homo sapiens
tgagccagttcttcagatccat

SEQ ID NO: 7180582 - DNA, 22 bp, Homo sapiens
tgagccagtggaagatggcagt

SEQ ID NO: 7180583 - DNA, 22 bp, Homo sapiens
tgagccagtgtggtaaagctga

SEQ ID NO: 7180584 - DNA, 22 bp, Homo sapiens
tgagccagtgtggtaaagctga

SEQ ID NO: 7180585 - DNA, 22 bp, Homo sapiens
tgagccagtgtggtaaagctga

SEQ ID NO: 7180586 - DNA, 22 bp, Homo sapiens
tgagccagtggaagatggcagt

SEQ ID NO: 7180587 - DNA, 22 bp, Homo sapiens
tgagccagtggaagatggcagt

SEQ ID NO: 7180588 - DNA, 22 bp, Homo sapiens
tgagccagtggaagatggcagt

SEQ ID NO: 7180589 - DNA, 22 bp, Homo sapiens
tgagccatgggactccaaggga

SEQ ID NO: 7180590 - DNA, 22 bp, Homo sapiens
tgagccatgggactccaaggga

SEQ ID NO: 7180591 - DNA, 17 bp, Homo sapiens
ccaggtgggaggtgggg

SEQ ID NO: 7180592 - DNA, 17 bp, Homo sapiens
ccaggtgggaggtgggg

SEQ ID NO: 7180593 - DNA, 17 bp, Homo sapiens
ccaggtgggaggtgggg

SEQ ID NO: 7180594 - DNA, 17 bp, Homo sapiens
ccaggtgggaggtgggg

SEQ ID NO: 7180595 - DNA, 17 bp, Homo sapiens
ccaggtgggaggtgggg

SEQ ID NO: 7180596 - DNA, 22 bp, Homo sapiens
ccaggtgtgtcaccattgccca

SEQ ID NO: 7180597 - DNA, 22 bp, Homo sapiens
ccaggtgtgtcaccattgccca

SEQ ID NO: 7180598 - DNA, 22 bp, Homo sapiens
ccaggtgtgtcaccattgccca

SEQ ID NO: 7180599 - DNA, 22 bp, Homo sapiens
ccaggtgggaggaaagcagaga

SEQ ID NO: 7180600 - DNA, 22 bp, Homo sapiens
ccaggtggcttctgcccgatgt

SEQ ID NO: 7180601 - DNA, 22 bp, Homo sapiens
ccaggtggcttctgcccgatgt

SEQ ID NO: 7180602 - DNA, 22 bp, Homo sapiens
ccaggtgggaggaaagcagaga

SEQ ID NO: 7180603 - DNA, 22 bp, Homo sapiens
ccaggtggccctgccctactct

SEQ ID NO: 7180604 - DNA, 22 bp, Homo sapiens
ccaggtggccctgccctactct

SEQ ID NO: 7180605 - DNA, 22 bp, Homo sapiens
ccaggtggataaggtttctgga

SEQ ID NO: 7180606 - DNA, 22 bp, Homo sapiens
ccaggtggataaggtttctgga

SEQ ID NO: 7180607 - DNA, 22 bp, Homo sapiens
ccaggtggccctgccctactct

SEQ ID NO: 7180608 - DNA, 22 bp, Homo sapiens
ccaggtggaggtgtgaggtcct

SEQ ID NO: 7180609 - DNA, 22 bp, Homo sapiens
ccaggtggataaggtttctgga

SEQ ID NO: 7180610 - DNA, 22 bp, Homo sapiens
ccaggtggaggtgtgaggtcct

SEQ ID NO: 7180611 - DNA, 22 bp, Homo sapiens
ccaggtggaggtgtgaggtcct

SEQ ID NO: 7180612 - DNA, 22 bp, Homo sapiens
ccaggtggaggtgtgaggtcct

SEQ ID NO: 7180613 - DNA, 22 bp, Homo sapiens
ccaggtggaggtgtgaggtcct

SEQ ID NO: 7180614 - DNA, 22 bp, Homo sapiens
ccaggtggacttgatttgaata

SEQ ID NO: 7180615 - DNA, 22 bp, Homo sapiens
ccaggtgtgtcaccattgccca

SEQ ID NO: 7180616 - DNA, 22 bp, Homo sapiens
ccaggtgtgtcaccattgccca

SEQ ID NO: 7180617 - DNA, 22 bp, Homo sapiens
ccaggtgtgtctggccccgaag

SEQ ID NO: 7180618 - DNA, 22 bp, Homo sapiens
ccagtcagccaagctgcagcgg

SEQ ID NO: 7180619 - DNA, 22 bp, Homo sapiens
ccagtcagggcaggagcctggt

SEQ ID NO: 7180620 - DNA, 22 bp, Homo sapiens
ccagtcagggcaggagcctggt

SEQ ID NO: 7180621 - DNA, 22 bp, Homo sapiens
ccagtcagggcaggagcctggt

SEQ ID NO: 7180622 - DNA, 22 bp, Homo sapiens
ccagtcagtcagttgctggcat

SEQ ID NO: 7180623 - DNA, 20 bp, Homo sapiens
ccagtccaaattccttatga

SEQ ID NO: 7180624 - DNA, 20 bp, Homo sapiens
ccagtccacctgagacatgt

SEQ ID NO: 7180625 - DNA, 22 bp, Homo sapiens
ccagtccaggccatggattttg

SEQ ID NO: 7180626 - DNA, 22 bp, Homo sapiens
ccagtccaggccatggattttg

SEQ ID NO: 7180627 - DNA, 22 bp, Homo sapiens
ccagtccagtgccatgcatggc

SEQ ID NO: 7180628 - DNA, 22 bp, Homo sapiens
ccagtccagtgccatgcatggc

SEQ ID NO: 7180629 - DNA, 22 bp, Homo sapiens
ccagtccatatttatactgccg

SEQ ID NO: 7180630 - DNA, 22 bp, Homo sapiens
ccagtccatatttatactgccg

SEQ ID NO: 7180631 - DNA, 22 bp, Homo sapiens
tgagcagtaacagctcacaggg

SEQ ID NO: 7180632 - DNA, 22 bp, Homo sapiens
tgagcagtaggtctgaatagtg

SEQ ID NO: 7180633 - DNA, 22 bp, Homo sapiens
tgagcaggtgagtctagggcag

SEQ ID NO: 7180634 - DNA, 21 bp, Homo sapiens
tgagcaggtgcagggaagtgg

SEQ ID NO: 7180635 - DNA, 21 bp, Homo sapiens
tgagcaggtgcagggaagtgg

SEQ ID NO: 7180636 - DNA, 21 bp, Homo sapiens
tgagcaggtgcagggaagtgg

SEQ ID NO: 7180637 - DNA, 21 bp, Homo sapiens
tgagcaggtgcagggaagtgg

SEQ ID NO: 7180638 - DNA, 21 bp, Homo sapiens
tgagcaggtgcagggaagtgg

SEQ ID NO: 7180639 - DNA, 21 bp, Homo sapiens
tgagcaggtgctgcttttatg

SEQ ID NO: 7180640 - DNA, 22 bp, Homo sapiens
tgagcaggtgagtctagggcag

SEQ ID NO: 7180641 - DNA, 22 bp, Homo sapiens
tgagcaggtgagtctagggcag

SEQ ID NO: 7180642 - DNA, 22 bp, Homo sapiens
tgagcaggtgagtctagggcag

SEQ ID NO: 7180643 - DNA, 18 bp, Homo sapiens
tgagcaggggctgacctt

SEQ ID NO: 7180644 - DNA, 18 bp, Homo sapiens
tgagcaggggctgacctt

SEQ ID NO: 7180645 - DNA, 22 bp, Homo sapiens
tgagcaggtcaagactccagct

SEQ ID NO: 7180646 - DNA, 22 bp, Homo sapiens
tgagcaggtcaagactccagct

SEQ ID NO: 7180647 - DNA, 22 bp, Homo sapiens
tgagcaggtcaagactccagct

SEQ ID NO: 7180648 - DNA, 22 bp, Homo sapiens
tgagcaggggagagcgaatgtg

SEQ ID NO: 7180649 - DNA, 22 bp, Homo sapiens
tgagcaggggagagcgaatgtg

SEQ ID NO: 7180650 - DNA, 18 bp, Homo sapiens
tgagcaggggctgacctt

SEQ ID NO: 7180651 - DNA, 18 bp, Homo sapiens
tgagcaggggctgacctt

SEQ ID NO: 7180652 - DNA, 22 bp, Homo sapiens
tgagcagagacttcaagggcag

SEQ ID NO: 7180653 - DNA, 22 bp, Homo sapiens
tgagcagggagctgggctgagc

SEQ ID NO: 7180654 - DNA, 22 bp, Homo sapiens
tgagcagagacgggggcctcca

SEQ ID NO: 7180655 - DNA, 22 bp, Homo sapiens
ccagggctgctgtgggactcca

SEQ ID NO: 7180656 - DNA, 22 bp, Homo sapiens
ccagggctgctgtgggactcca

SEQ ID NO: 7180657 - DNA, 22 bp, Homo sapiens
ccagggctgctgtgggactcca

SEQ ID NO: 7180658 - DNA, 22 bp, Homo sapiens
ccagggctgctgtgggactcca

SEQ ID NO: 7180659 - DNA, 22 bp, Homo sapiens
ccagggctgcctggccgtgtgt

SEQ ID NO: 7180660 - DNA, 22 bp, Homo sapiens
ccagggctgctcattggctggt

SEQ ID NO: 7180661 - DNA, 22 bp, Homo sapiens
ccagggctgctcattggctggt

SEQ ID NO: 7180662 - DNA, 22 bp, Homo sapiens
ccagggctgctgggggagttga

SEQ ID NO: 7180663 - DNA, 22 bp, Homo sapiens
ccagggctgctgggggagttga

SEQ ID NO: 7180664 - DNA, 22 bp, Homo sapiens
ccagggctgctgggggagttga

SEQ ID NO: 7180665 - DNA, 22 bp, Homo sapiens
tgagttttggaagacaacacaa

SEQ ID NO: 7180666 - DNA, 22 bp, Homo sapiens
tgataaacagctgatgaagacc

SEQ ID NO: 7180667 - DNA, 22 bp, Homo sapiens
tgataaacattttaggaactaa

SEQ ID NO: 7180668 - DNA, 22 bp, Homo sapiens
tgagttgctatctagatccaga

SEQ ID NO: 7180669 - DNA, 22 bp, Homo sapiens
tgagtttaatgatatttatatg

SEQ ID NO: 7180670 - DNA, 22 bp, Homo sapiens
tgagttctttccgttaggtatg

SEQ ID NO: 7180671 - DNA, 22 bp, Homo sapiens
tgagttctttgcaaataacaag

SEQ ID NO: 7180672 - DNA, 22 bp, Homo sapiens
tgagtctcggtttcccctccaa

SEQ ID NO: 7180673 - DNA, 22 bp, Homo sapiens
tgagtctcccaagtagttggaa

SEQ ID NO: 7180674 - DNA, 21 bp, Homo sapiens
tgagtctctcagcttcaggta

SEQ ID NO: 7180675 - DNA, 22 bp, Homo sapiens
tgagtctgctcctggtagcaga

SEQ ID NO: 7180676 - DNA, 22 bp, Homo sapiens
tgagtcctgctgagcagagagg

SEQ ID NO: 7180677 - DNA, 23 bp, Homo sapiens
tgagtctactcaccacaactggg

SEQ ID NO: 7180678 - DNA, 22 bp, Homo sapiens
tgagtcctgtctttgtcactta

SEQ ID NO: 7180679 - DNA, 22 bp, Homo sapiens
tgagtcctgtctttgtcactta

SEQ ID NO: 7180680 - DNA, 22 bp, Homo sapiens
ccatcctgaatggtctcagcca

SEQ ID NO: 7180681 - DNA, 22 bp, Homo sapiens
ccatcccttctctggccagcag

SEQ ID NO: 7180682 - DNA, 22 bp, Homo sapiens
ccatccctcctccaccagctag

SEQ ID NO: 7180683 - DNA, 22 bp, Homo sapiens
ccatccaggctgtgggtgagct

SEQ ID NO: 7180684 - DNA, 22 bp, Homo sapiens
ccatccaggctgtgggtgagct

SEQ ID NO: 7180685 - DNA, 22 bp, Homo sapiens
tgaggtcctgcatgttgaggtc

SEQ ID NO: 7180686 - DNA, 19 bp, Homo sapiens
tgaggtctacatgggcatc

SEQ ID NO: 7180687 - DNA, 20 bp, Homo sapiens
tgagtcagctgcatgggtgg

SEQ ID NO: 7180688 - DNA, 22 bp, Homo sapiens
tgagtcagtctgccctggcttc

SEQ ID NO: 7180689 - DNA, 22 bp, Homo sapiens
tgaggtcccaggggtagtgtgc

SEQ ID NO: 7180690 - DNA, 22 bp, Homo sapiens
tgaggtcatggctgatatttcc

SEQ ID NO: 7180691 - DNA, 22 bp, Homo sapiens
ccatcctgcaggacctccatat

SEQ ID NO: 7180692 - DNA, 22 bp, Homo sapiens
ccatcctgcaggacctccatat

SEQ ID NO: 7180693 - DNA, 22 bp, Homo sapiens
ccatcctgaatggtctcagcca

SEQ ID NO: 7180694 - DNA, 22 bp, Homo sapiens
tgagtcatgtaataatgctgct

SEQ ID NO: 7180695 - DNA, 22 bp, Homo sapiens
tgagtccaaattctaccacctc

SEQ ID NO: 7180696 - DNA, 22 bp, Homo sapiens
tgagtccaacttccatttgacc

SEQ ID NO: 7180697 - DNA, 22 bp, Homo sapiens
tgagtccaagagccagtgggaa

SEQ ID NO: 7180698 - DNA, 22 bp, Homo sapiens
tgagtccaccttagtatatggg

SEQ ID NO: 7180699 - DNA, 22 bp, Homo sapiens
tgagtccaccttagtatatggg

SEQ ID NO: 7180700 - DNA, 22 bp, Homo sapiens
tgaggctgagatatcagggagg

SEQ ID NO: 7180701 - DNA, 22 bp, Homo sapiens
tgaggctgagatatcagggagg

SEQ ID NO: 7180702 - DNA, 22 bp, Homo sapiens
tgaggctgagatatcagggagg

SEQ ID NO: 7180703 - DNA, 22 bp, Homo sapiens
tgaggctgacaaaagatgaggt

SEQ ID NO: 7180704 - DNA, 22 bp, Homo sapiens
tgaggctgacaaaagatgaggt

SEQ ID NO: 7180705 - DNA, 22 bp, Homo sapiens
tgaggctgacaaaagatgaggt

SEQ ID NO: 7180706 - DNA, 22 bp, Homo sapiens
tgaggctgacaaaagatgaggt

SEQ ID NO: 7180707 - DNA, 22 bp, Homo sapiens
tgaggctgacaaaagatgaggt

SEQ ID NO: 7180708 - DNA, 22 bp, Homo sapiens
tgaggctgacaaaagatgaggt

SEQ ID NO: 7180709 - DNA, 22 bp, Homo sapiens
tgaggctgacaaaagatgaggt

SEQ ID NO: 7180710 - DNA, 22 bp, Homo sapiens
tgaggctgacaaaagatgaggt

SEQ ID NO: 7180711 - DNA, 18 bp, Homo sapiens
tgaggctgaatatggggc

SEQ ID NO: 7180712 - DNA, 18 bp, Homo sapiens
tgaggctgaatatggggc

SEQ ID NO: 7180713 - DNA, 18 bp, Homo sapiens
tgaggctgaatatggggc

SEQ ID NO: 7180714 - DNA, 18 bp, Homo sapiens
tgaggctgaatatggggc

SEQ ID NO: 7180715 - DNA, 22 bp, Homo sapiens
tgaggctgaaactggcgataga

SEQ ID NO: 7180716 - DNA, 22 bp, Homo sapiens
tgaggctgaaactggcgataga

SEQ ID NO: 7180717 - DNA, 22 bp, Homo sapiens
tgaggctgaaactggcgataga

SEQ ID NO: 7180718 - DNA, 22 bp, Homo sapiens
tgaggctgaaactggcgataga

SEQ ID NO: 7180719 - DNA, 22 bp, Homo sapiens
tgaggctgaaactggcgataga

SEQ ID NO: 7180720 - DNA, 22 bp, Homo sapiens
tgaggccccgaagctgaggttt

SEQ ID NO: 7180721 - DNA, 18 bp, Homo sapiens
tgaggcccatctctctga

SEQ ID NO: 7180722 - DNA, 22 bp, Homo sapiens
tgaggcccagccgccctgagag

SEQ ID NO: 7180723 - DNA, 22 bp, Homo sapiens
tgaggcccagccgccctgagag

SEQ ID NO: 7180724 - DNA, 22 bp, Homo sapiens
tgaggcccagccgccctgagag

SEQ ID NO: 7180725 - DNA, 22 bp, Homo sapiens
tgaggccatgcccgtgccggcc

SEQ ID NO: 7180726 - DNA, 22 bp, Homo sapiens
tgaggccagtgacatatattaa

SEQ ID NO: 7180727 - DNA, 22 bp, Homo sapiens
tgaggccagtctcatcacaggc

SEQ ID NO: 7180728 - DNA, 22 bp, Homo sapiens
tgaggccagtctcatcacaggc

SEQ ID NO: 7180729 - DNA, 22 bp, Homo sapiens
tgaggcagtgtgagataataaa

SEQ ID NO: 7180730 - DNA, 22 bp, Homo sapiens
tgaggcagtgtgagataataaa

SEQ ID NO: 7180731 - DNA, 22 bp, Homo sapiens
tgaggcagtgtgagataataaa

SEQ ID NO: 7180732 - DNA, 22 bp, Homo sapiens
tgaggccaggcaaaggcgatct

SEQ ID NO: 7180733 - DNA, 22 bp, Homo sapiens
tgaggccaggcaaaggcgatct

SEQ ID NO: 7180734 - DNA, 22 bp, Homo sapiens
tgaggccagggattccatcatt

SEQ ID NO: 7180735 - DNA, 22 bp, Homo sapiens
tgaggccatgcccgtgccggcc

SEQ ID NO: 7180736 - DNA, 22 bp, Homo sapiens
tgaggccatggaactagcttgg

SEQ ID NO: 7180737 - DNA, 22 bp, Homo sapiens
tgaggccatggaactagcttgg

SEQ ID NO: 7180738 - DNA, 17 bp, Homo sapiens
tgaggccatggcaccat

SEQ ID NO: 7180739 - DNA, 17 bp, Homo sapiens
tgaggccatggcaccat

SEQ ID NO: 7180740 - DNA, 17 bp, Homo sapiens
tgaggccatggcaccat

SEQ ID NO: 7180741 - DNA, 22 bp, Homo sapiens
tgaggccatggtcttcccagtc

SEQ ID NO: 7180742 - DNA, 20 bp, Homo sapiens
tgaggcccagcagagtcggg

SEQ ID NO: 7180743 - DNA, 22 bp, Homo sapiens
ccagttaaggaaacagcacgaa

SEQ ID NO: 7180744 - DNA, 22 bp, Homo sapiens
ccatagaactctgaggccagag

SEQ ID NO: 7180745 - DNA, 22 bp, Homo sapiens
ccatagtgaattgtctcagacg

SEQ ID NO: 7180746 - DNA, 22 bp, Homo sapiens
ccatagtgaattgtctcagacg

SEQ ID NO: 7180747 - DNA, 18 bp, Homo sapiens
tgaggctgagggtagagg

SEQ ID NO: 7180748 - DNA, 22 bp, Homo sapiens
tgaggctgagatatcagggagg

SEQ ID NO: 7180749 - DNA, 18 bp, Homo sapiens
tgaggctgagggtagagg

SEQ ID NO: 7180750 - DNA, 22 bp, Homo sapiens
tgaggctgagatatcagggagg

SEQ ID NO: 7180751 - DNA, 18 bp, Homo sapiens
tgaggctgagggtagagg

SEQ ID NO: 7180752 - DNA, 18 bp, Homo sapiens
tgaggctgagggtagagg

SEQ ID NO: 7180753 - DNA, 23 bp, Homo sapiens
tgaggctgattgatttttgctca

SEQ ID NO: 7180754 - DNA, 18 bp, Homo sapiens
tgaggctgagggtagagg

SEQ ID NO: 7180755 - DNA, 22 bp, Homo sapiens
ccatcatttgatacagctgtct

SEQ ID NO: 7180756 - DNA, 22 bp, Homo sapiens
ccatccacagtcttgattattt

SEQ ID NO: 7180757 - DNA, 21 bp, Homo sapiens
ccatccactgagtggttccct

SEQ ID NO: 7180758 - DNA, 22 bp, Homo sapiens
ccatccagaaacttccatcccc

SEQ ID NO: 7180759 - DNA, 22 bp, Homo sapiens
ccatccagaaacttccatcccc

SEQ ID NO: 7180760 - DNA, 23 bp, Homo sapiens
ccatcaggcctccgtgtccagcc

SEQ ID NO: 7180761 - DNA, 23 bp, Homo sapiens
ccatcaggcctccgtgtccagcc

SEQ ID NO: 7180762 - DNA, 22 bp, Homo sapiens
ccatcagtgaaggagacagatt

SEQ ID NO: 7180763 - DNA, 22 bp, Homo sapiens
ccatcagtgaaggagacagatt

SEQ ID NO: 7180764 - DNA, 22 bp, Homo sapiens
ccatatcagaagattgtcaccc

SEQ ID NO: 7180765 - DNA, 22 bp, Homo sapiens
ccatatatgattgcctctttca

SEQ ID NO: 7180766 - DNA, 22 bp, Homo sapiens
ccatatatgattgcctctttca

SEQ ID NO: 7180767 - DNA, 22 bp, Homo sapiens
ccatcacagtccccatcgtgat

SEQ ID NO: 7180768 - DNA, 18 bp, Homo sapiens
ccatcaccctaactagtg

SEQ ID NO: 7180769 - DNA, 22 bp, Homo sapiens
ccatcaatgactaataaaatag

SEQ ID NO: 7180770 - DNA, 22 bp, Homo sapiens
ccatcacagtccccatcgtgat

SEQ ID NO: 7180771 - DNA, 22 bp, Homo sapiens
ccatcactcatctagatattta

SEQ ID NO: 7180772 - DNA, 22 bp, Homo sapiens
ccatcagcatgggagcatgggc

SEQ ID NO: 7180773 - DNA, 22 bp, Homo sapiens
ccatcagcatgggagcatgggc

SEQ ID NO: 7180774 - DNA, 22 bp, Homo sapiens
ccaggaggcttcgtccgtggag

SEQ ID NO: 7180775 - DNA, 22 bp, Homo sapiens
ccaggaggcttcgtccgtggag

SEQ ID NO: 7180776 - DNA, 22 bp, Homo sapiens
ccaggaggctcttgtccctggt

SEQ ID NO: 7180777 - DNA, 16 bp, Homo sapiens
ccaggaggctgacacc

SEQ ID NO: 7180778 - DNA, 22 bp, Homo sapiens
ccaggcacactgccctgccctt

SEQ ID NO: 7180779 - DNA, 22 bp, Homo sapiens
ccaggcacactgccctgccctt

SEQ ID NO: 7180780 - DNA, 22 bp, Homo sapiens
ccaggcacttgtttgccaggca

SEQ ID NO: 7180781 - DNA, 22 bp, Homo sapiens
ccaggcacttgtttgccaggca

SEQ ID NO: 7180782 - DNA, 22 bp, Homo sapiens
ccaggcagaatgaaacccctgt

SEQ ID NO: 7180783 - DNA, 22 bp, Homo sapiens
ccaggcacactgccctgccctt

SEQ ID NO: 7180784 - DNA, 22 bp, Homo sapiens
ccaggcacaggtgggcctcaga

SEQ ID NO: 7180785 - DNA, 22 bp, Homo sapiens
ccaggcacaggtgggcctcaga

SEQ ID NO: 7180786 - DNA, 22 bp, Homo sapiens
ccaggcacttgtttgccaggca

SEQ ID NO: 7180787 - DNA, 22 bp, Homo sapiens
ccaggcagaatgaaacccctgt

SEQ ID NO: 7180788 - DNA, 21 bp, Homo sapiens
ccaggcagagctgtgagttct

SEQ ID NO: 7180789 - DNA, 21 bp, Homo sapiens
ccaggcagagctgtgagttct

SEQ ID NO: 7180790 - DNA, 22 bp, Homo sapiens
ccaggaggctcttgtccctggt

SEQ ID NO: 7180791 - DNA, 22 bp, Homo sapiens
ccaggaggctcttgtccctggt

SEQ ID NO: 7180792 - DNA, 22 bp, Homo sapiens
ccaggaggctcttgtccctggt

SEQ ID NO: 7180793 - DNA, 22 bp, Homo sapiens
ccaggaggctctgcccatccca

SEQ ID NO: 7180794 - DNA, 22 bp, Homo sapiens
ccaggaggctctgcccatccca

SEQ ID NO: 7180795 - DNA, 22 bp, Homo sapiens
ccaggaggctctgactggaccc

SEQ ID NO: 7180796 - DNA, 22 bp, Homo sapiens
ccaggaggctctgactggaccc

SEQ ID NO: 7180797 - DNA, 22 bp, Homo sapiens
ccaggaggctctgactggaccc

SEQ ID NO: 7180798 - DNA, 22 bp, Homo sapiens
ccaggaggcggaggttgcagtg

SEQ ID NO: 7180799 - DNA, 22 bp, Homo sapiens
ccaggaggcggaggttgcagtg

SEQ ID NO: 7180800 - DNA, 22 bp, Homo sapiens
ccaggaggcggaggttgcagcg

SEQ ID NO: 7180801 - DNA, 22 bp, Homo sapiens
ccaggaggcggaggttgcagtg

SEQ ID NO: 7180802 - DNA, 22 bp, Homo sapiens
ccaggaggcggaggttgcagtg

SEQ ID NO: 7180803 - DNA, 22 bp, Homo sapiens
ccaggaggcggaggttgcagtg

SEQ ID NO: 7180804 - DNA, 22 bp, Homo sapiens
ccaggaggcggaggttgcagtg

SEQ ID NO: 7180805 - DNA, 22 bp, Homo sapiens
ccaggaggctctgactggaccc

SEQ ID NO: 7180806 - DNA, 22 bp, Homo sapiens
tcttaatgctagccaatagaga

SEQ ID NO: 7180807 - DNA, 22 bp, Homo sapiens
ccaggcagcaaattttctgaat

SEQ ID NO: 7180808 - DNA, 22 bp, Homo sapiens
tcttaattctgtgtcttcacta

SEQ ID NO: 7180809 - DNA, 22 bp, Homo sapiens
tcttacaagaaataagccaatg

SEQ ID NO: 7180810 - DNA, 22 bp, Homo sapiens
tcttacaagaaggaaaagggag

SEQ ID NO: 7180811 - DNA, 20 bp, Homo sapiens
tcttacaatcgttacatcca

SEQ ID NO: 7180812 - DNA, 20 bp, Homo sapiens
tcttacaatcgttacatcca

SEQ ID NO: 7180813 - DNA, 22 bp, Homo sapiens
tcttacagccactctgtgaagc

SEQ ID NO: 7180814 - DNA, 22 bp, Homo sapiens
tcttacatatacgtcatttagt

SEQ ID NO: 7180815 - DNA, 22 bp, Homo sapiens
ccaggcagatgggccggcttca

SEQ ID NO: 7180816 - DNA, 22 bp, Homo sapiens
ccaggcagagtgctccagaaag

SEQ ID NO: 7180817 - DNA, 22 bp, Homo sapiens
ccaggcagagtgctccagaaag

SEQ ID NO: 7180818 - DNA, 22 bp, Homo sapiens
ccaggcagagggaatagcaagt

SEQ ID NO: 7180819 - DNA, 22 bp, Homo sapiens
ccaggcagagggaatagcaagt

SEQ ID NO: 7180820 - DNA, 22 bp, Homo sapiens
ccaggcagagggaatagcaagt

SEQ ID NO: 7180821 - DNA, 22 bp, Homo sapiens
ccaggcagagggatccccatcc

SEQ ID NO: 7180822 - DNA, 22 bp, Homo sapiens
ccaggcagagggatccccatcc

SEQ ID NO: 7180823 - DNA, 22 bp, Homo sapiens
ccaggcagagggatccccatcc

SEQ ID NO: 7180824 - DNA, 22 bp, Homo sapiens
tcttctggatgagagcggaggc

SEQ ID NO: 7180825 - DNA, 22 bp, Homo sapiens
tcttctgatgccagtaaccatg

SEQ ID NO: 7180826 - DNA, 22 bp, Homo sapiens
tcttctgatgccagtaaccatg

SEQ ID NO: 7180827 - DNA, 22 bp, Homo sapiens
tcttctgaaggtaggaagcatt

SEQ ID NO: 7180828 - DNA, 19 bp, Homo sapiens
tcttctgacttcaagaaac

SEQ ID NO: 7180829 - DNA, 17 bp, Homo sapiens
tcttctcttccagtctt

SEQ ID NO: 7180830 - DNA, 17 bp, Homo sapiens
tcttctcttccagtctt

SEQ ID NO: 7180831 - DNA, 17 bp, Homo sapiens
tcttctcttccagtctt

SEQ ID NO: 7180832 - DNA, 17 bp, Homo sapiens
tcttctcttccagtctt

SEQ ID NO: 7180833 - DNA, 22 bp, Homo sapiens
tcttctctgtggcctggtggtg

SEQ ID NO: 7180834 - DNA, 22 bp, Homo sapiens
tcttctctgtggcctggtggtg

SEQ ID NO: 7180835 - DNA, 22 bp, Homo sapiens
tcttctctgtggcctggtggtg

SEQ ID NO: 7180836 - DNA, 17 bp, Homo sapiens
tcttctcttccagtctt

SEQ ID NO: 7180837 - DNA, 17 bp, Homo sapiens
tcttctcttccagtctt

SEQ ID NO: 7180838 - DNA, 22 bp, Homo sapiens
tcttcctatggggctgcaggaa

SEQ ID NO: 7180839 - DNA, 22 bp, Homo sapiens
tcttagaaattccccagtggct

SEQ ID NO: 7180840 - DNA, 22 bp, Homo sapiens
tcttctctcctgcttggcagaa

SEQ ID NO: 7180841 - DNA, 22 bp, Homo sapiens
tcttctctcctgcttggcagaa

SEQ ID NO: 7180842 - DNA, 22 bp, Homo sapiens
tcttctctcctgcttggcagaa

SEQ ID NO: 7180843 - DNA, 22 bp, Homo sapiens
tcttctctgtggcctggtggtg

SEQ ID NO: 7180844 - DNA, 22 bp, Homo sapiens
tcttctctcatgtaggagggaa

SEQ ID NO: 7180845 - DNA, 22 bp, Homo sapiens
tcttctctcatgtaggagggaa

SEQ ID NO: 7180846 - DNA, 22 bp, Homo sapiens
tcttctctcatgtaggagggaa

SEQ ID NO: 7180847 - DNA, 22 bp, Homo sapiens
tcttctctcctgcttggcagaa

SEQ ID NO: 7180848 - DNA, 22 bp, Homo sapiens
tcttcctcaatgtaacaacccc

SEQ ID NO: 7180849 - DNA, 22 bp, Homo sapiens
ccaggcctcccttttccagcca

SEQ ID NO: 7180850 - DNA, 22 bp, Homo sapiens
ccaggcccccgagcagaagaca

SEQ ID NO: 7180851 - DNA, 22 bp, Homo sapiens
ccaggcccccgagcagaagaca

SEQ ID NO: 7180852 - DNA, 22 bp, Homo sapiens
ccaggcccgttcccttctccag

SEQ ID NO: 7180853 - DNA, 22 bp, Homo sapiens
ccaggcccgttcccttctccag

SEQ ID NO: 7180854 - DNA, 22 bp, Homo sapiens
ccaggcccccgagcagaagaca

SEQ ID NO: 7180855 - DNA, 22 bp, Homo sapiens
ccaggcaggcgatggtgcagtg

SEQ ID NO: 7180856 - DNA, 22 bp, Homo sapiens
ccaggcaggcgatggtgcagtg

SEQ ID NO: 7180857 - DNA, 22 bp, Homo sapiens
ccaggcctcccttttccagcca

SEQ ID NO: 7180858 - DNA, 22 bp, Homo sapiens
ccaggcctcccttttccagcca

SEQ ID NO: 7180859 - DNA, 19 bp, Homo sapiens
ccaggcctcctgggaggtc

SEQ ID NO: 7180860 - DNA, 19 bp, Homo sapiens
ccaggcctcctgggaggtc

SEQ ID NO: 7180861 - DNA, 19 bp, Homo sapiens
ccaggcctcctgggaggtc

SEQ ID NO: 7180862 - DNA, 22 bp, Homo sapiens
ccaggcctcctgtgagtggacc

SEQ ID NO: 7180863 - DNA, 22 bp, Homo sapiens
ccaggcctcctgtgagtggacc

SEQ ID NO: 7180864 - DNA, 22 bp, Homo sapiens
ccaggcctcctgtgagtggacc

SEQ ID NO: 7180865 - DNA, 22 bp, Homo sapiens
ccaggcaggcgatggtgcagtg

SEQ ID NO: 7180866 - DNA, 22 bp, Homo sapiens
ccaggcaggcgatggtgcagtg

SEQ ID NO: 7180867 - DNA, 22 bp, Homo sapiens
ccaggcaggcgatggtgcagtg

SEQ ID NO: 7180868 - DNA, 22 bp, Homo sapiens
ccaggcaggcgatggtgcagtg

SEQ ID NO: 7180869 - DNA, 22 bp, Homo sapiens
ccaggcaggcgatggtgcagtg

SEQ ID NO: 7180870 - DNA, 22 bp, Homo sapiens
ccaggcaggcagcgttctcagg

SEQ ID NO: 7180871 - DNA, 22 bp, Homo sapiens
ccaggcaggcgatggtgcagtg

SEQ ID NO: 7180872 - DNA, 22 bp, Homo sapiens
ccaggcagccaagtgtgtgtgt

SEQ ID NO: 7180873 - DNA, 22 bp, Homo sapiens
ccaggcagccaagtgtgtgtgt

SEQ ID NO: 7180874 - DNA, 22 bp, Homo sapiens
ccaggcagccaagtgtgtgtgt

SEQ ID NO: 7180875 - DNA, 22 bp, Homo sapiens
ccaggcagcctgctccattctg

SEQ ID NO: 7180876 - DNA, 22 bp, Homo sapiens
ccaggcagcctgctccattctg

SEQ ID NO: 7180877 - DNA, 22 bp, Homo sapiens
ccaggcagctctgatttatgtc

SEQ ID NO: 7180878 - DNA, 22 bp, Homo sapiens
ccaggcaggcagcgttctcagg

SEQ ID NO: 7180879 - DNA, 22 bp, Homo sapiens
tctgggctctgtcagcacctct

SEQ ID NO: 7180880 - DNA, 22 bp, Homo sapiens
tctgggctctgggaattaggga

SEQ ID NO: 7180881 - DNA, 22 bp, Homo sapiens
tctgggctctgcgaagcccttc

SEQ ID NO: 7180882 - DNA, 22 bp, Homo sapiens
tctgggccttggagtggggaga

SEQ ID NO: 7180883 - DNA, 22 bp, Homo sapiens
tctgggccttggagtggggaga

SEQ ID NO: 7180884 - DNA, 22 bp, Homo sapiens
tctgggctatatggtctctgct

SEQ ID NO: 7180885 - DNA, 22 bp, Homo sapiens
tctgggctatatggtctctgct

SEQ ID NO: 7180886 - DNA, 22 bp, Homo sapiens
tctgggctcacgagtctggaca

SEQ ID NO: 7180887 - DNA, 22 bp, Homo sapiens
tctgggccttggagtggggaga

SEQ ID NO: 7180888 - DNA, 22 bp, Homo sapiens
tctgggccttggagtggggaga

SEQ ID NO: 7180889 - DNA, 22 bp, Homo sapiens
tctgggcctgtctcagagctgg

SEQ ID NO: 7180890 - DNA, 22 bp, Homo sapiens
tctgggcctgatggctaaagcc

SEQ ID NO: 7180891 - DNA, 22 bp, Homo sapiens
tctgggcctgatggctaaagcc

SEQ ID NO: 7180892 - DNA, 22 bp, Homo sapiens
tctgggcctgtctcagagctgg

SEQ ID NO: 7180893 - DNA, 22 bp, Homo sapiens
tctgggcctgtctcagagctgg

SEQ ID NO: 7180894 - DNA, 22 bp, Homo sapiens
tctgggcctgtctcagagctgg

SEQ ID NO: 7180895 - DNA, 22 bp, Homo sapiens
tctgggcctcacctgctgctca

SEQ ID NO: 7180896 - DNA, 22 bp, Homo sapiens
tctgggcctcacctgctgctca

SEQ ID NO: 7180897 - DNA, 22 bp, Homo sapiens
tctgggcctcacctgctgctca

SEQ ID NO: 7180898 - DNA, 22 bp, Homo sapiens
tctgggcctcagtttcttcatc

SEQ ID NO: 7180899 - DNA, 22 bp, Homo sapiens
tctgggcctcagtttcttcatc

SEQ ID NO: 7180900 - DNA, 22 bp, Homo sapiens
tctgggcctcagtttcttcatc

SEQ ID NO: 7180901 - DNA, 22 bp, Homo sapiens
tctgggcctgatggctaaagcc

SEQ ID NO: 7180902 - DNA, 22 bp, Homo sapiens
tctgggagggagcctcagaatc

SEQ ID NO: 7180903 - DNA, 22 bp, Homo sapiens
tctgggaggctgggtcccgtcc

SEQ ID NO: 7180904 - DNA, 22 bp, Homo sapiens
ccagcactctattgaatattct

SEQ ID NO: 7180905 - DNA, 22 bp, Homo sapiens
ccagcactctgtcccagcttcc

SEQ ID NO: 7180906 - DNA, 22 bp, Homo sapiens
ccagcactctgtcccagcttcc

SEQ ID NO: 7180907 - DNA, 22 bp, Homo sapiens
ccagcactctgtcccagcttcc

SEQ ID NO: 7180908 - DNA, 22 bp, Homo sapiens
ccagcactctgtcccagcttcc

SEQ ID NO: 7180909 - DNA, 22 bp, Homo sapiens
ccagcaccttgatcttggagtt

SEQ ID NO: 7180910 - DNA, 22 bp, Homo sapiens
ccagcactcctgtctcaagtct

SEQ ID NO: 7180911 - DNA, 22 bp, Homo sapiens
ccagcactcctgtctcaagtct

SEQ ID NO: 7180912 - DNA, 22 bp, Homo sapiens
ccagcactcctgtctcaagtct

SEQ ID NO: 7180913 - DNA, 22 bp, Homo sapiens
ccagcactcgctgattttagga

SEQ ID NO: 7180914 - DNA, 22 bp, Homo sapiens
ccagcactctattgaatattct

SEQ ID NO: 7180915 - DNA, 22 bp, Homo sapiens
ccagcactctattgaatattct

SEQ ID NO: 7180916 - DNA, 22 bp, Homo sapiens
tctgggcctcacctgctgctca

SEQ ID NO: 7180917 - DNA, 22 bp, Homo sapiens
tctgggcctcacctgctgctca

SEQ ID NO: 7180918 - DNA, 22 bp, Homo sapiens
tctgggcctatagaagtctacc

SEQ ID NO: 7180919 - DNA, 22 bp, Homo sapiens
tctgggcctcacctgctgctca

SEQ ID NO: 7180920 - DNA, 22 bp, Homo sapiens
tctgggccggagccgacggcag

SEQ ID NO: 7180921 - DNA, 22 bp, Homo sapiens
tctgggccggagccgacggcag

SEQ ID NO: 7180922 - DNA, 22 bp, Homo sapiens
tctgggcctatagaagtctacc

SEQ ID NO: 7180923 - DNA, 22 bp, Homo sapiens
tctgggccctgagatgttcttc

SEQ ID NO: 7180924 - DNA, 22 bp, Homo sapiens
tctgggccctgagatgttcttc

SEQ ID NO: 7180925 - DNA, 22 bp, Homo sapiens
tctgggccgctgcgttccatga

SEQ ID NO: 7180926 - DNA, 22 bp, Homo sapiens
tctgggccgctgcgttccatga

SEQ ID NO: 7180927 - DNA, 22 bp, Homo sapiens
tctgggccgctgcgttccatga

SEQ ID NO: 7180928 - DNA, 22 bp, Homo sapiens
tctgggccgctgcgttccatga

SEQ ID NO: 7180929 - DNA, 22 bp, Homo sapiens
tctgggccggagccgacggcag

SEQ ID NO: 7180930 - DNA, 22 bp, Homo sapiens
tctggggagggagccacaggtc

SEQ ID NO: 7180931 - DNA, 22 bp, Homo sapiens
tctggggacggggcccagcaat

SEQ ID NO: 7180932 - DNA, 22 bp, Homo sapiens
tctggggagggagccacaggtc

SEQ ID NO: 7180933 - DNA, 22 bp, Homo sapiens
tctggggagcagccctggtgag

SEQ ID NO: 7180934 - DNA, 22 bp, Homo sapiens
tctggggagggagccacaggtc

SEQ ID NO: 7180935 - DNA, 22 bp, Homo sapiens
tctggggagcagccctggtgag

SEQ ID NO: 7180936 - DNA, 22 bp, Homo sapiens
tctggggaccatggcatctaaa

SEQ ID NO: 7180937 - DNA, 22 bp, Homo sapiens
tctggggaccatggcatctaaa

SEQ ID NO: 7180938 - DNA, 22 bp, Homo sapiens
tctggggaccatggcatctaaa

SEQ ID NO: 7180939 - DNA, 22 bp, Homo sapiens
tctggggaccatggcatctaaa

SEQ ID NO: 7180940 - DNA, 22 bp, Homo sapiens
tctggggacggggcccagcaat

SEQ ID NO: 7180941 - DNA, 22 bp, Homo sapiens
tctggggacggggcccagcaat

SEQ ID NO: 7180942 - DNA, 22 bp, Homo sapiens
tctggggacggggcccagcaat

SEQ ID NO: 7180943 - DNA, 22 bp, Homo sapiens
tctggggacggggcccagcaat

SEQ ID NO: 7180944 - DNA, 22 bp, Homo sapiens
tctgggcttttgcactggccat

SEQ ID NO: 7180945 - DNA, 21 bp, Homo sapiens
tctggggaagacatctaggat

SEQ ID NO: 7180946 - DNA, 21 bp, Homo sapiens
tctggggaagacatctaggat

SEQ ID NO: 7180947 - DNA, 22 bp, Homo sapiens
tctggggaatgttcatttctga

SEQ ID NO: 7180948 - DNA, 22 bp, Homo sapiens
tctgggcttttgcactggccat

SEQ ID NO: 7180949 - DNA, 22 bp, Homo sapiens
tctggggagtcaaagagacctg

SEQ ID NO: 7180950 - DNA, 22 bp, Homo sapiens
tctggggagtgcctaagtggaa

SEQ ID NO: 7180951 - DNA, 22 bp, Homo sapiens
tctggggagtgcctaagtggaa

SEQ ID NO: 7180952 - DNA, 22 bp, Homo sapiens
tctggggagtgcctaagtggaa

SEQ ID NO: 7180953 - DNA, 22 bp, Homo sapiens
tctggggagtcaaagagacctg

SEQ ID NO: 7180954 - DNA, 22 bp, Homo sapiens
tctggggagtcaaagagacctg

SEQ ID NO: 7180955 - DNA, 22 bp, Homo sapiens
tctggggataagacccaggtat

SEQ ID NO: 7180956 - DNA, 22 bp, Homo sapiens
tctggggagtgcctaagtggaa

SEQ ID NO: 7180957 - DNA, 22 bp, Homo sapiens
tctggggagtgcctaagtggaa

SEQ ID NO: 7180958 - DNA, 22 bp, Homo sapiens
tctggggatgaggacctagatg

SEQ ID NO: 7180959 - DNA, 17 bp, Homo sapiens
ccaggagagatgcttgt

SEQ ID NO: 7180960 - DNA, 17 bp, Homo sapiens
ccaggagagatgcttgt

SEQ ID NO: 7180961 - DNA, 22 bp, Homo sapiens
tctggggatgaggacctagatg

SEQ ID NO: 7180962 - DNA, 22 bp, Homo sapiens
ccaggagcaacttgaaggcaag

SEQ ID NO: 7180963 - DNA, 22 bp, Homo sapiens
ccaggagcaacttgaaggcaag

SEQ ID NO: 7180964 - DNA, 22 bp, Homo sapiens
ccaggagcaccaggcctgtgcc

SEQ ID NO: 7180965 - DNA, 22 bp, Homo sapiens
ccaggagcaccaggcctgtgcc

SEQ ID NO: 7180966 - DNA, 22 bp, Homo sapiens
ccaggagagcaaaggtcactct

SEQ ID NO: 7180967 - DNA, 22 bp, Homo sapiens
ccaggagagcaaaggtcactct

SEQ ID NO: 7180968 - DNA, 22 bp, Homo sapiens
ccaggagcattaagagaacata

SEQ ID NO: 7180969 - DNA, 22 bp, Homo sapiens
ccaggagcattaagagaacata

SEQ ID NO: 7180970 - DNA, 22 bp, Homo sapiens
ccaggagcattaagagaacata

SEQ ID NO: 7180971 - DNA, 22 bp, Homo sapiens
ccaggagccactcaggcccaca

SEQ ID NO: 7180972 - DNA, 22 bp, Homo sapiens
ccaggagccactcaggcccaca

SEQ ID NO: 7180973 - DNA, 22 bp, Homo sapiens
ccaggagccactcaggcccaca

SEQ ID NO: 7180974 - DNA, 22 bp, Homo sapiens
ccaggagccctgccacaatggt

SEQ ID NO: 7180975 - DNA, 22 bp, Homo sapiens
ccaggagcagggctggctgcac

SEQ ID NO: 7180976 - DNA, 22 bp, Homo sapiens
ccaggagcagggctggctgcac

SEQ ID NO: 7180977 - DNA, 22 bp, Homo sapiens
ccaggagcagggctggctgcac

SEQ ID NO: 7180978 - DNA, 22 bp, Homo sapiens
ccaggagcagggctggctgcac

SEQ ID NO: 7180979 - DNA, 19 bp, Homo sapiens
ccaggagcagtggtgagct

SEQ ID NO: 7180980 - DNA, 19 bp, Homo sapiens
ccaggagcagtggtgagct

SEQ ID NO: 7180981 - DNA, 19 bp, Homo sapiens
ccaggagcagtggtgagct

SEQ ID NO: 7180982 - DNA, 19 bp, Homo sapiens
ccaggagcagtggtgagct

SEQ ID NO: 7180983 - DNA, 22 bp, Homo sapiens
ccaggagcaggagctggacaga

SEQ ID NO: 7180984 - DNA, 22 bp, Homo sapiens
ccaggagcaggagctggacaga

SEQ ID NO: 7180985 - DNA, 22 bp, Homo sapiens
ccaggagcaggagctggacaga

SEQ ID NO: 7180986 - DNA, 22 bp, Homo sapiens
ccaggagcaggagctggacaga

SEQ ID NO: 7180987 - DNA, 22 bp, Homo sapiens
ccaggagcaggagctgcagctg

SEQ ID NO: 7180988 - DNA, 22 bp, Homo sapiens
ccaggagcaccaggcctgtgcc

SEQ ID NO: 7180989 - DNA, 22 bp, Homo sapiens
ccaggagcaccaggcctgtgcc

SEQ ID NO: 7180990 - DNA, 22 bp, Homo sapiens
ccaggagcagagtaggtgttca

SEQ ID NO: 7180991 - DNA, 22 bp, Homo sapiens
ccaggagcagatatggacataa

SEQ ID NO: 7180992 - DNA, 22 bp, Homo sapiens
ccaggagcagatatggacataa

SEQ ID NO: 7180993 - DNA, 22 bp, Homo sapiens
tctgttattttcttgtgtggaa

SEQ ID NO: 7180994 - DNA, 23 bp, Homo sapiens
tctgtggctccttcaggctgctg

SEQ ID NO: 7180995 - DNA, 22 bp, Homo sapiens
ccaggagccctgccacaatggt

SEQ ID NO: 7180996 - DNA, 22 bp, Homo sapiens
ccaggagccctgccacaatggt

SEQ ID NO: 7180997 - DNA, 22 bp, Homo sapiens
ccaggagcctgggccaggctgg

SEQ ID NO: 7180998 - DNA, 22 bp, Homo sapiens
ccaggagcctgggccaggctgg

SEQ ID NO: 7180999 - DNA, 23 bp, Homo sapiens
tctgttcaaggctttctccttga

SEQ ID NO: 7181000 - DNA, 22 bp, Homo sapiens
tctgttcagacactttacatgt

SEQ ID NO: 7181001 - DNA, 22 bp, Homo sapiens
tctgttcagttgattagacaga

SEQ ID NO: 7181002 - DNA, 22 bp, Homo sapiens
tctgttccatgttttgttccat

SEQ ID NO: 7181003 - DNA, 22 bp, Homo sapiens
tctgttcatttgcctcggctct

SEQ ID NO: 7181004 - DNA, 22 bp, Homo sapiens
tctgttcatgttgggcttttcc

SEQ ID NO: 7181005 - DNA, 22 bp, Homo sapiens
tctgttctaagcattctatgtg

SEQ ID NO: 7181006 - DNA, 22 bp, Homo sapiens
tctgttcttcctacattcacat

SEQ ID NO: 7181007 - DNA, 22 bp, Homo sapiens
ccaggaggcggaggttgcagcg

SEQ ID NO: 7181008 - DNA, 22 bp, Homo sapiens
ccaggaggcggaggttgcagcg

SEQ ID NO: 7181009 - DNA, 22 bp, Homo sapiens
tctgttctattggtctatgtgt

SEQ ID NO: 7181010 - DNA, 22 bp, Homo sapiens
tctgttcttcctacattcacat

SEQ ID NO: 7181011 - DNA, 22 bp, Homo sapiens
ccagggcatcacatccagtgtt

SEQ ID NO: 7181012 - DNA, 22 bp, Homo sapiens
ccagggcatcacatccagtgtt

SEQ ID NO: 7181013 - DNA, 22 bp, Homo sapiens
ccagggcatcacatccagtgtt

SEQ ID NO: 7181014 - DNA, 22 bp, Homo sapiens
ccagggcatcacatccagtgtt

SEQ ID NO: 7181015 - DNA, 22 bp, Homo sapiens
ccagggcatcacatccagtgtt

SEQ ID NO: 7181016 - DNA, 22 bp, Homo sapiens
ccagggcatcctcacatcgcag

SEQ ID NO: 7181017 - DNA, 22 bp, Homo sapiens
ccagggcagtgggagaaggtgc

SEQ ID NO: 7181018 - DNA, 22 bp, Homo sapiens
ccagggcagtgggagaaggtgc

SEQ ID NO: 7181019 - DNA, 22 bp, Homo sapiens
ccagggcatcctcacatcgcag

SEQ ID NO: 7181020 - DNA, 22 bp, Homo sapiens
ccagggcatcctcacatcgcag

SEQ ID NO: 7181021 - DNA, 22 bp, Homo sapiens
ccagggcatgggaagaactgaa

SEQ ID NO: 7181022 - DNA, 22 bp, Homo sapiens
ccagggcatgggaagaactgaa

SEQ ID NO: 7181023 - DNA, 22 bp, Homo sapiens
ccagggcatgggaagaactgaa

SEQ ID NO: 7181024 - DNA, 22 bp, Homo sapiens
tgaaggtgtttatacctcagat

SEQ ID NO: 7181025 - DNA, 23 bp, Homo sapiens
tgaagtgaaatttcacaagggac

SEQ ID NO: 7181026 - DNA, 22 bp, Homo sapiens
tgaagtctttctgatcatttac

SEQ ID NO: 7181027 - DNA, 23 bp, Homo sapiens
tgaagtgaaatttcacaagggac

SEQ ID NO: 7181028 - DNA, 22 bp, Homo sapiens
tgaagtgaagaagcatgaatag

SEQ ID NO: 7181029 - DNA, 22 bp, Homo sapiens
tgaagtctattctatgccaggt

SEQ ID NO: 7181030 - DNA, 22 bp, Homo sapiens
tgaagtctattctatgccaggt

SEQ ID NO: 7181031 - DNA, 22 bp, Homo sapiens
tgaagtctctgttttctcattt

SEQ ID NO: 7181032 - DNA, 22 bp, Homo sapiens
tgaagtctttcagggctagaat

SEQ ID NO: 7181033 - DNA, 22 bp, Homo sapiens
tgaagtgacctggggcagtgta

SEQ ID NO: 7181034 - DNA, 22 bp, Homo sapiens
tgaagtgacctggggcagtgta

SEQ ID NO: 7181035 - DNA, 22 bp, Homo sapiens
tgaagtgacctggggcagtgta

SEQ ID NO: 7181036 - DNA, 22 bp, Homo sapiens
tgaagtgagtagtgtctagggg

SEQ ID NO: 7181037 - DNA, 22 bp, Homo sapiens
tgaagtgattagaaccacttga

SEQ ID NO: 7181038 - DNA, 22 bp, Homo sapiens
tgaagtaactgtccaggatcca

SEQ ID NO: 7181039 - DNA, 22 bp, Homo sapiens
tgaagtacccgtttttattgca

SEQ ID NO: 7181040 - DNA, 22 bp, Homo sapiens
tgaagtatacaggctctgctaa

SEQ ID NO: 7181041 - DNA, 22 bp, Homo sapiens
tgaagtatctatggatataaga

SEQ ID NO: 7181042 - DNA, 22 bp, Homo sapiens
tgaagtccctgacatttagaaa

SEQ ID NO: 7181043 - DNA, 22 bp, Homo sapiens
ccagggcctacagcttaagtcc

SEQ ID NO: 7181044 - DNA, 22 bp, Homo sapiens
ccagggcctcgtgttctgagtg

SEQ ID NO: 7181045 - DNA, 23 bp, Homo sapiens
ccagggcccctacaccactgtcc

SEQ ID NO: 7181046 - DNA, 23 bp, Homo sapiens
ccagggcccctacaccactgtcc

SEQ ID NO: 7181047 - DNA, 22 bp, Homo sapiens
tgaagttagaactatgaggata

SEQ ID NO: 7181048 - DNA, 17 bp, Homo sapiens
tgaagttaggctgcaga

SEQ ID NO: 7181049 - DNA, 22 bp, Homo sapiens
ccagggctccattgctcatcct

SEQ ID NO: 7181050 - DNA, 22 bp, Homo sapiens
ccagggctccccagaagtaccc

SEQ ID NO: 7181051 - DNA, 22 bp, Homo sapiens
ccagggctcgggtgcttagtca

SEQ ID NO: 7181052 - DNA, 22 bp, Homo sapiens
ccagggctcgggtgcttagtca

SEQ ID NO: 7181053 - DNA, 22 bp, Homo sapiens
ccagggctctatgagggtggag

SEQ ID NO: 7181054 - DNA, 22 bp, Homo sapiens
ccagggctctgcttctgccatg

SEQ ID NO: 7181055 - DNA, 22 bp, Homo sapiens
ccagggctctgcttctgccatg

SEQ ID NO: 7181056 - DNA, 22 bp, Homo sapiens
ccagggctctgcttctgccatg

SEQ ID NO: 7181057 - DNA, 22 bp, Homo sapiens
ccagggctctgcttctgccatg

SEQ ID NO: 7181058 - DNA, 22 bp, Homo sapiens
ccagggctctatgagggtggag

SEQ ID NO: 7181059 - DNA, 22 bp, Homo sapiens
ccagggctctatgagggtggag

SEQ ID NO: 7181060 - DNA, 22 bp, Homo sapiens
ccagggctgagactgtattggg

SEQ ID NO: 7181061 - DNA, 22 bp, Homo sapiens
ccagggctgccgcatccctggt

SEQ ID NO: 7181062 - DNA, 22 bp, Homo sapiens
ccagggctgccgcatccctggt

SEQ ID NO: 7181063 - DNA, 22 bp, Homo sapiens
ccagggctgccgcatccctggt

SEQ ID NO: 7181064 - DNA, 22 bp, Homo sapiens
ccagggctgagctgtgaccatg

SEQ ID NO: 7181065 - DNA, 22 bp, Homo sapiens
ccagggctgagctgtgaccatg

SEQ ID NO: 7181066 - DNA, 22 bp, Homo sapiens
ccagggctgagctgtgaccatg

SEQ ID NO: 7181067 - DNA, 22 bp, Homo sapiens
ccagggcagggaccacgtgtct

SEQ ID NO: 7181068 - DNA, 22 bp, Homo sapiens
ccagggcagggaccacgtgtct

SEQ ID NO: 7181069 - DNA, 22 bp, Homo sapiens
ccagggcaggagaaagactcac

SEQ ID NO: 7181070 - DNA, 22 bp, Homo sapiens
ccagggcagggaccacgtgtct

SEQ ID NO: 7181071 - DNA, 22 bp, Homo sapiens
ccagggcaggggctggagttca

SEQ ID NO: 7181072 - DNA, 22 bp, Homo sapiens
ccagggcaggggctggagttca

SEQ ID NO: 7181073 - DNA, 22 bp, Homo sapiens
ccagggcaggggctggagttca

SEQ ID NO: 7181074 - DNA, 22 bp, Homo sapiens
ccagggcagtgggagaaggtgc

SEQ ID NO: 7181075 - DNA, 22 bp, Homo sapiens
ccagggcagtgggagaaggtgc

SEQ ID NO: 7181076 - DNA, 22 bp, Homo sapiens
ccagggcacgttgggacagtac

SEQ ID NO: 7181077 - DNA, 22 bp, Homo sapiens
ccagggcacgttgggacagtac

SEQ ID NO: 7181078 - DNA, 22 bp, Homo sapiens
ccagggcacgttgggacagtac

SEQ ID NO: 7181079 - DNA, 22 bp, Homo sapiens
ccagggcacgttgggacagtac

SEQ ID NO: 7181080 - DNA, 22 bp, Homo sapiens
ccagggcacgttgggacagtac

SEQ ID NO: 7181081 - DNA, 22 bp, Homo sapiens
ccagggcaattatttggagggt

SEQ ID NO: 7181082 - DNA, 22 bp, Homo sapiens
ccagggcacgttgggacagtac

SEQ ID NO: 7181083 - DNA, 22 bp, Homo sapiens
ccagggcacgttgggacagtac

SEQ ID NO: 7181084 - DNA, 22 bp, Homo sapiens
ccagggcaacgctgtctcagag

SEQ ID NO: 7181085 - DNA, 22 bp, Homo sapiens
ccagggcaacgctgtctcagag

SEQ ID NO: 7181086 - DNA, 22 bp, Homo sapiens
ccagggcaacgctgtctcagag

SEQ ID NO: 7181087 - DNA, 22 bp, Homo sapiens
ccagggcaacgctgtctcagag

SEQ ID NO: 7181088 - DNA, 22 bp, Homo sapiens
ccagggcaacgctgtctcagag

SEQ ID NO: 7181089 - DNA, 22 bp, Homo sapiens
ccagggcaaatgagatcatagc

SEQ ID NO: 7181090 - DNA, 22 bp, Homo sapiens
ccagggatgtggcagcaccata

SEQ ID NO: 7181091 - DNA, 22 bp, Homo sapiens
ccagggcaaatgagatcatagc

SEQ ID NO: 7181092 - DNA, 22 bp, Homo sapiens
ccagggcaaatgagatcatagc

SEQ ID NO: 7181093 - DNA, 22 bp, Homo sapiens
ccagggcaacgctgtctcagag

SEQ ID NO: 7181094 - DNA, 22 bp, Homo sapiens
ccagggcaataggaacactttt

SEQ ID NO: 7181095 - DNA, 22 bp, Homo sapiens
ccagggcaataggaacactttt

SEQ ID NO: 7181096 - DNA, 22 bp, Homo sapiens
ccagggcaataggaacactttt

SEQ ID NO: 7181097 - DNA, 22 bp, Homo sapiens
ccagggcaattatttggagggt

SEQ ID NO: 7181098 - DNA, 22 bp, Homo sapiens
ccagggcaattatttggagggt

SEQ ID NO: 7181099 - DNA, 22 bp, Homo sapiens
ccagggcaattatttggagggt

SEQ ID NO: 7181100 - DNA, 22 bp, Homo sapiens
ccagggcaattatttggagggt

SEQ ID NO: 7181101 - DNA, 22 bp, Homo sapiens
ccagggagggtcctgtggcttc

SEQ ID NO: 7181102 - DNA, 22 bp, Homo sapiens
ccagggagggtcctgtggcttc

SEQ ID NO: 7181103 - DNA, 23 bp, Homo sapiens
ccagggaggttgattggttaccc

SEQ ID NO: 7181104 - DNA, 18 bp, Homo sapiens
ccagggatgcatggtccc

SEQ ID NO: 7181105 - DNA, 23 bp, Homo sapiens
ccagggagtgctactatcaagcc

SEQ ID NO: 7181106 - DNA, 23 bp, Homo sapiens
ccagggagtgctactatcaagcc

SEQ ID NO: 7181107 - DNA, 23 bp, Homo sapiens
ccagggagtgctactatcaagcc

SEQ ID NO: 7181108 - DNA, 22 bp, Homo sapiens
ccagggagtttccaatctgaga

SEQ ID NO: 7181109 - DNA, 22 bp, Homo sapiens
tgaaatgatatctgataacaaa

SEQ ID NO: 7181110 - DNA, 22 bp, Homo sapiens
tgaaatgagcatttattcttta

SEQ ID NO: 7181111 - DNA, 22 bp, Homo sapiens
tgaaatgatatctgataacaaa

SEQ ID NO: 7181112 - DNA, 22 bp, Homo sapiens
tgaaatgatatctgataacaaa

SEQ ID NO: 7181113 - DNA, 22 bp, Homo sapiens
tgaaatgagcatttattcttta

SEQ ID NO: 7181114 - DNA, 22 bp, Homo sapiens
tgaaatgagatagataatcagg

SEQ ID NO: 7181115 - DNA, 22 bp, Homo sapiens
tgaaatgagatagataatcagg

SEQ ID NO: 7181116 - DNA, 22 bp, Homo sapiens
tgaaatgagatagataatcagg

SEQ ID NO: 7181117 - DNA, 22 bp, Homo sapiens
tgaaatgagatagataatcagg

SEQ ID NO: 7181118 - DNA, 22 bp, Homo sapiens
tgaaatgagatagataatcagg

SEQ ID NO: 7181119 - DNA, 22 bp, Homo sapiens
tgaaatgagataatttaagtgc

SEQ ID NO: 7181120 - DNA, 22 bp, Homo sapiens
tgaaatgatcagtttggttact

SEQ ID NO: 7181121 - DNA, 22 bp, Homo sapiens
ccagggaaggactctctttccc

SEQ ID NO: 7181122 - DNA, 23 bp, Homo sapiens
ccagggaaggccatcttcaactg

SEQ ID NO: 7181123 - DNA, 22 bp, Homo sapiens
ccagggaagctggtcacgcagg

SEQ ID NO: 7181124 - DNA, 22 bp, Homo sapiens
ccagggaagctggtcacgcagg

SEQ ID NO: 7181125 - DNA, 22 bp, Homo sapiens
tgaaatgagagcacagaataaa

SEQ ID NO: 7181126 - DNA, 22 bp, Homo sapiens
tgaaatgagagcacagaataaa

SEQ ID NO: 7181127 - DNA, 21 bp, Homo sapiens
tgaaatgagaatgctgagcac

SEQ ID NO: 7181128 - DNA, 22 bp, Homo sapiens
tgaaatgacagtcttaagctct

SEQ ID NO: 7181129 - DNA, 22 bp, Homo sapiens
tgaaatgacagtcttaagctct

SEQ ID NO: 7181130 - DNA, 22 bp, Homo sapiens
tgaaatgacagtcttaagctct

SEQ ID NO: 7181131 - DNA, 22 bp, Homo sapiens
tgaaatgacaaaggtttttctt

SEQ ID NO: 7181132 - DNA, 22 bp, Homo sapiens
ccaggcttcccccatcctagga

SEQ ID NO: 7181133 - DNA, 22 bp, Homo sapiens
ccaggcttcaggagtggtttcc

SEQ ID NO: 7181134 - DNA, 22 bp, Homo sapiens
ccaggcttccctgagaggctgc

SEQ ID NO: 7181135 - DNA, 22 bp, Homo sapiens
ccaggcttccctgagaggctgc

SEQ ID NO: 7181136 - DNA, 22 bp, Homo sapiens
ccaggcttcctaatgtgtgcag

SEQ ID NO: 7181137 - DNA, 22 bp, Homo sapiens
ccaggcttcctaatgtgtgcag

SEQ ID NO: 7181138 - DNA, 22 bp, Homo sapiens
ccaggctgttttcaaacttggg

SEQ ID NO: 7181139 - DNA, 22 bp, Homo sapiens
ccaggctgttttcaaacttggg

SEQ ID NO: 7181140 - DNA, 22 bp, Homo sapiens
ccaggctgttttcaaacttggg

SEQ ID NO: 7181141 - DNA, 22 bp, Homo sapiens
ccaggctgtggtttagatagag

SEQ ID NO: 7181142 - DNA, 22 bp, Homo sapiens
ccaggctgtggtttagatagag

SEQ ID NO: 7181143 - DNA, 22 bp, Homo sapiens
ccaggctgtgcttttcataaat

SEQ ID NO: 7181144 - DNA, 22 bp, Homo sapiens
ccaggctgtgcttttcataaat

SEQ ID NO: 7181145 - DNA, 22 bp, Homo sapiens
ccaggctgtaagagtgatgttg

SEQ ID NO: 7181146 - DNA, 22 bp, Homo sapiens
ccaggctgtaagagtgatgttg

SEQ ID NO: 7181147 - DNA, 22 bp, Homo sapiens
ccaggctgtaagagtgatgttg

SEQ ID NO: 7181148 - DNA, 21 bp, Homo sapiens
ccaggctgggagggcagttcc

SEQ ID NO: 7181149 - DNA, 23 bp, Homo sapiens
tgaaacagatgccaatgatcaag

SEQ ID NO: 7181150 - DNA, 21 bp, Homo sapiens
ccaggctgggagggcagttcc

SEQ ID NO: 7181151 - DNA, 21 bp, Homo sapiens
ccaggctgggagggcagttcc

SEQ ID NO: 7181152 - DNA, 21 bp, Homo sapiens
ccaggctgggagggcagttcc

SEQ ID NO: 7181153 - DNA, 22 bp, Homo sapiens
tgaaacactgcgataaaatcct

SEQ ID NO: 7181154 - DNA, 22 bp, Homo sapiens
tgaaacagaagatgttcatgtg

SEQ ID NO: 7181155 - DNA, 22 bp, Homo sapiens
tgaaacagaagatgttcatgtg

SEQ ID NO: 7181156 - DNA, 22 bp, Homo sapiens
tgaaacaatgtgaagttgctga

SEQ ID NO: 7181157 - DNA, 22 bp, Homo sapiens
tgaaacaattagaatgtaatga

SEQ ID NO: 7181158 - DNA, 22 bp, Homo sapiens
tgaaacaattagaatgtaatga

SEQ ID NO: 7181159 - DNA, 22 bp, Homo sapiens
tgaaacaattagaatgtaatga

SEQ ID NO: 7181160 - DNA, 22 bp, Homo sapiens
tgaaacacaagcctggttagtg

SEQ ID NO: 7181161 - DNA, 17 bp, Homo sapiens
tgaaacaccaagactgt

SEQ ID NO: 7181162 - DNA, 22 bp, Homo sapiens
tcttttgtgccaagtaatgaat

SEQ ID NO: 7181163 - DNA, 22 bp, Homo sapiens
tcttttgtgattctttagttac

SEQ ID NO: 7181164 - DNA, 22 bp, Homo sapiens
tgaaacaaatttggaaaatcta

SEQ ID NO: 7181165 - DNA, 22 bp, Homo sapiens
tgaaacaaatttggaaaatcta

SEQ ID NO: 7181166 - DNA, 22 bp, Homo sapiens
tgaaacaaatttggaaaatcta

SEQ ID NO: 7181167 - DNA, 18 bp, Homo sapiens
tgaaacaagaatggtgca

SEQ ID NO: 7181168 - DNA, 22 bp, Homo sapiens
tgaaacaagatccacagacttg

SEQ ID NO: 7181169 - DNA, 22 bp, Homo sapiens
tgaaacaagggccatgggaaac

SEQ ID NO: 7181170 - DNA, 22 bp, Homo sapiens
tgaaacaagtttaagggatcta

SEQ ID NO: 7181171 - DNA, 21 bp, Homo sapiens
tgaaacaatcagacagagtct

SEQ ID NO: 7181172 - DNA, 22 bp, Homo sapiens
ccaggcctctggctgcttagtc

SEQ ID NO: 7181173 - DNA, 19 bp, Homo sapiens
ccaggcctctggggcctgt

SEQ ID NO: 7181174 - DNA, 19 bp, Homo sapiens
ccaggcctctggggcctgt

SEQ ID NO: 7181175 - DNA, 23 bp, Homo sapiens
ccaggcctctcagagggtgtgcc

SEQ ID NO: 7181176 - DNA, 22 bp, Homo sapiens
ccaggcctctggctgcttagtc

SEQ ID NO: 7181177 - DNA, 22 bp, Homo sapiens
ccaggcctctggctgcttagtc

SEQ ID NO: 7181178 - DNA, 22 bp, Homo sapiens
ccaggcctgattgggaatcttg

SEQ ID NO: 7181179 - DNA, 22 bp, Homo sapiens
ccaggcctgattgggaatcttg

SEQ ID NO: 7181180 - DNA, 22 bp, Homo sapiens
ccaggcctgcatctgctgcgca

SEQ ID NO: 7181181 - DNA, 22 bp, Homo sapiens
ccaggcctgcatctgctgcgca

SEQ ID NO: 7181182 - DNA, 22 bp, Homo sapiens
tcttgcaggcatgaaaggactc

SEQ ID NO: 7181183 - DNA, 22 bp, Homo sapiens
tcttgcaggcatgaaaggactc

SEQ ID NO: 7181184 - DNA, 22 bp, Homo sapiens
tcttgcaggcaaactacctcta

SEQ ID NO: 7181185 - DNA, 19 bp, Homo sapiens
tcttgcagccccagcaggc

SEQ ID NO: 7181186 - DNA, 19 bp, Homo sapiens
tcttgcagccccagcaggc

SEQ ID NO: 7181187 - DNA, 20 bp, Homo sapiens
tcttgcagctcctgtaccat

SEQ ID NO: 7181188 - DNA, 22 bp, Homo sapiens
tcttgcagaggcactgtgtcag

SEQ ID NO: 7181189 - DNA, 22 bp, Homo sapiens
tcttgcagagggcccttctgct

SEQ ID NO: 7181190 - DNA, 22 bp, Homo sapiens
tcttgcagagtggttcccctct

SEQ ID NO: 7181191 - DNA, 22 bp, Homo sapiens
tcttgcacttcatgaatatgtt

SEQ ID NO: 7181192 - DNA, 22 bp, Homo sapiens
tcttgcacttcatgaatatgtt

SEQ ID NO: 7181193 - DNA, 22 bp, Homo sapiens
tcttgcaccacacaaaaatttg

SEQ ID NO: 7181194 - DNA, 22 bp, Homo sapiens
tcttgcagaaaatagtatagat

SEQ ID NO: 7181195 - DNA, 22 bp, Homo sapiens
tcttgcacttcatgaatatgtt

SEQ ID NO: 7181196 - DNA, 22 bp, Homo sapiens
tcttgcagacagcttccagcct

SEQ ID NO: 7181197 - DNA, 22 bp, Homo sapiens
tcttttctgccagctgagccct

SEQ ID NO: 7181198 - DNA, 22 bp, Homo sapiens
tcttttctggactctgcatgga

SEQ ID NO: 7181199 - DNA, 22 bp, Homo sapiens
tcttttctggactctgcatgga

SEQ ID NO: 7181200 - DNA, 22 bp, Homo sapiens
tcttttctggactctgcatgga

SEQ ID NO: 7181201 - DNA, 22 bp, Homo sapiens
tcttttctgtaactcagtgtct

SEQ ID NO: 7181202 - DNA, 22 bp, Homo sapiens
tcttttctgtaactcagtgtct

SEQ ID NO: 7181203 - DNA, 22 bp, Homo sapiens
tcttttctggactctgcatgga

SEQ ID NO: 7181204 - DNA, 22 bp, Homo sapiens
tcttttctgtaactcagtgtct

SEQ ID NO: 7181205 - DNA, 22 bp, Homo sapiens
tcttttcttcttaatggttaat

SEQ ID NO: 7181206 - DNA, 22 bp, Homo sapiens
tcttttcttcttaatggttaat

SEQ ID NO: 7181207 - DNA, 22 bp, Homo sapiens
tcttttcttcttaatggttaat

SEQ ID NO: 7181208 - DNA, 22 bp, Homo sapiens
tcttgcattgctcattgtgcca

SEQ ID NO: 7181209 - DNA, 22 bp, Homo sapiens
tcttgcatttaaggagctcata

SEQ ID NO: 7181210 - DNA, 22 bp, Homo sapiens
tcttgcatttcagagttcagag

SEQ ID NO: 7181211 - DNA, 22 bp, Homo sapiens
tctttggtttctgtctctgtaa

SEQ ID NO: 7181212 - DNA, 22 bp, Homo sapiens
tctttggtttctgtctctgtaa

SEQ ID NO: 7181213 - DNA, 22 bp, Homo sapiens
tcttgcaggcggctcagcaacc

SEQ ID NO: 7181214 - DNA, 22 bp, Homo sapiens
tcttgcatacactatatgtaca

SEQ ID NO: 7181215 - DNA, 22 bp, Homo sapiens
tcttgcataggtcttttatcag

SEQ ID NO: 7181216 - DNA, 22 bp, Homo sapiens
tcttgcatgatattctgtattt

SEQ ID NO: 7181217 - DNA, 22 bp, Homo sapiens
tcttgcattccattctcgtgcc

SEQ ID NO: 7181218 - DNA, 21 bp, Homo sapiens
tcttttgtaactatttcagcc

SEQ ID NO: 7181219 - DNA, 22 bp, Homo sapiens
tcttttgtactcagtattgaca

SEQ ID NO: 7181220 - DNA, 22 bp, Homo sapiens
tcttttgtagctaacacattca

SEQ ID NO: 7181221 - DNA, 22 bp, Homo sapiens
tcttttgtcatcccttgtacat

SEQ ID NO: 7181222 - DNA, 22 bp, Homo sapiens
tcttttgtgaggacaaggtacg

SEQ ID NO: 7181223 - DNA, 22 bp, Homo sapiens
tcttttgtgaggacaaggtacg

SEQ ID NO: 7181224 - DNA, 22 bp, Homo sapiens
tcttttcttgcattattgcact

SEQ ID NO: 7181225 - DNA, 22 bp, Homo sapiens
tcttttcttgcattattgcact

SEQ ID NO: 7181226 - DNA, 22 bp, Homo sapiens
tcttttgagggccagaggaaga

SEQ ID NO: 7181227 - DNA, 22 bp, Homo sapiens
tcttttcttgcattattgcact

SEQ ID NO: 7181228 - DNA, 22 bp, Homo sapiens
cctgcaggttgcagaggcggaa

SEQ ID NO: 7181229 - DNA, 22 bp, Homo sapiens
cctgcaggttgcagaggcggaa

SEQ ID NO: 7181230 - DNA, 22 bp, Homo sapiens
cctgcaggttgcagaggcggaa

SEQ ID NO: 7181231 - DNA, 22 bp, Homo sapiens
cctgcaggtccccggatgcgca

SEQ ID NO: 7181232 - DNA, 22 bp, Homo sapiens
cctgcaggttgcagaggcggaa

SEQ ID NO: 7181233 - DNA, 22 bp, Homo sapiens
cctgcaggtttcccccggacgg

SEQ ID NO: 7181234 - DNA, 22 bp, Homo sapiens
cctgcaggtttcccccggacgg

SEQ ID NO: 7181235 - DNA, 22 bp, Homo sapiens
cctgcagtctacccaatgtgtg

SEQ ID NO: 7181236 - DNA, 17 bp, Homo sapiens
cctgcagtgcctgtcgg

SEQ ID NO: 7181237 - DNA, 22 bp, Homo sapiens
tgggtcagtttgggggccagcc

SEQ ID NO: 7181238 - DNA, 22 bp, Homo sapiens
tgggtccacaaacatcagatat

SEQ ID NO: 7181239 - DNA, 22 bp, Homo sapiens
cctgccagaaaagagggagttc

SEQ ID NO: 7181240 - DNA, 22 bp, Homo sapiens
cctgccagacgcaccagggggc

SEQ ID NO: 7181241 - DNA, 22 bp, Homo sapiens
cctgccacttcttgctatggag

SEQ ID NO: 7181242 - DNA, 22 bp, Homo sapiens
cctgccactgtaggtgacagtt

SEQ ID NO: 7181243 - DNA, 22 bp, Homo sapiens
cctgccagaaaagagggagttc

SEQ ID NO: 7181244 - DNA, 17 bp, Homo sapiens
cctgcagtgcctgtcgg

SEQ ID NO: 7181245 - DNA, 22 bp, Homo sapiens
cctgcatccgaaagtgatcata

SEQ ID NO: 7181246 - DNA, 22 bp, Homo sapiens
cctgcatgtggtcagcactcct

SEQ ID NO: 7181247 - DNA, 22 bp, Homo sapiens
cctgcattaaatcctgttctgc

SEQ ID NO: 7181248 - DNA, 22 bp, Homo sapiens
cctgcattgctcttctgttcct

SEQ ID NO: 7181249 - DNA, 22 bp, Homo sapiens
cctgccactgtaggtgacagtt

SEQ ID NO: 7181250 - DNA, 22 bp, Homo sapiens
cctgccactgtaggtgacagtt

SEQ ID NO: 7181251 - DNA, 22 bp, Homo sapiens
cctgccactgtaggtgacagtt

SEQ ID NO: 7181252 - DNA, 19 bp, Homo sapiens
cctgcagggatgagaggtt

SEQ ID NO: 7181253 - DNA, 22 bp, Homo sapiens
cctgcagggaatcgaggcagaa

SEQ ID NO: 7181254 - DNA, 22 bp, Homo sapiens
cctgcagggaatcgaggcagaa

SEQ ID NO: 7181255 - DNA, 19 bp, Homo sapiens
cctgcagggatgagaggtt

SEQ ID NO: 7181256 - DNA, 19 bp, Homo sapiens
cctgcagggatgagaggtt

SEQ ID NO: 7181257 - DNA, 19 bp, Homo sapiens
cctgcagggatgagaggtt

SEQ ID NO: 7181258 - DNA, 22 bp, Homo sapiens
cctgcaggggagagacttctag

SEQ ID NO: 7181259 - DNA, 22 bp, Homo sapiens
cctgcaggggagagacttctag

SEQ ID NO: 7181260 - DNA, 22 bp, Homo sapiens
cctgcaggggagagacttctag

SEQ ID NO: 7181261 - DNA, 22 bp, Homo sapiens
cctgcagggtgctgccacagat

SEQ ID NO: 7181262 - DNA, 22 bp, Homo sapiens
cctgcagggtgctgccacagat

SEQ ID NO: 7181263 - DNA, 22 bp, Homo sapiens
cctgcaggtaaggctaactgcc

SEQ ID NO: 7181264 - DNA, 22 bp, Homo sapiens
cctgcaggtaaggctaactgcc

SEQ ID NO: 7181265 - DNA, 22 bp, Homo sapiens
cctgcaggtccccggatgcgca

SEQ ID NO: 7181266 - DNA, 22 bp, Homo sapiens
cctgcagggtgctgccacagat

SEQ ID NO: 7181267 - DNA, 22 bp, Homo sapiens
cctgcagggtgctgccacagat

SEQ ID NO: 7181268 - DNA, 22 bp, Homo sapiens
cctgcagggtgctgccacagat

SEQ ID NO: 7181269 - DNA, 22 bp, Homo sapiens
cctgcagggtgctgccacagat

SEQ ID NO: 7181270 - DNA, 22 bp, Homo sapiens
cctgcagggtgctgccacagat

SEQ ID NO: 7181271 - DNA, 22 bp, Homo sapiens
cctgcagggtgctgccacagat

SEQ ID NO: 7181272 - DNA, 22 bp, Homo sapiens
cctgcagggtgctgccacagat

SEQ ID NO: 7181273 - DNA, 22 bp, Homo sapiens
tgggtggcggcctggttctgag

SEQ ID NO: 7181274 - DNA, 22 bp, Homo sapiens
tgggtggcggcctggttctgag

SEQ ID NO: 7181275 - DNA, 18 bp, Homo sapiens
tgggtggctagggagttt

SEQ ID NO: 7181276 - DNA, 18 bp, Homo sapiens
tgggtggctagggagttt

SEQ ID NO: 7181277 - DNA, 22 bp, Homo sapiens
tgggtggcacttctggggtcca

SEQ ID NO: 7181278 - DNA, 22 bp, Homo sapiens
tgggtggcagcttcagcatgtt

SEQ ID NO: 7181279 - DNA, 22 bp, Homo sapiens
tgggtggcagcttcagcatgtt

SEQ ID NO: 7181280 - DNA, 22 bp, Homo sapiens
tgggtggcagcttcagcatgtt

SEQ ID NO: 7181281 - DNA, 22 bp, Homo sapiens
tgggtggcagcttcagcatgtt

SEQ ID NO: 7181282 - DNA, 22 bp, Homo sapiens
tgggtggaataaatcagttctg

SEQ ID NO: 7181283 - DNA, 22 bp, Homo sapiens
tgggtggaataaatcagttctg

SEQ ID NO: 7181284 - DNA, 22 bp, Homo sapiens
tgggtggaataaatcagttctg

SEQ ID NO: 7181285 - DNA, 22 bp, Homo sapiens
tgggtggagaagtggacctgct

SEQ ID NO: 7181286 - DNA, 22 bp, Homo sapiens
tgggtggagaagtggacctgct

SEQ ID NO: 7181287 - DNA, 22 bp, Homo sapiens
tgggtggagctccacaacctgt

SEQ ID NO: 7181288 - DNA, 22 bp, Homo sapiens
tgggtggattaggatagggtat

SEQ ID NO: 7181289 - DNA, 22 bp, Homo sapiens
tgggtggagaagtggacctgct

SEQ ID NO: 7181290 - DNA, 22 bp, Homo sapiens
tgggtggagctccacaacctgt

SEQ ID NO: 7181291 - DNA, 22 bp, Homo sapiens
tgggtggagctccacaacctgt

SEQ ID NO: 7181292 - DNA, 22 bp, Homo sapiens
tgggtggattaggatagggtat

SEQ ID NO: 7181293 - DNA, 22 bp, Homo sapiens
tgggtggcaaaggcccattgtc

SEQ ID NO: 7181294 - DNA, 22 bp, Homo sapiens
tgggtggcaaaggcccattgtc

SEQ ID NO: 7181295 - DNA, 22 bp, Homo sapiens
tgggtggcaaaggcccattgtc

SEQ ID NO: 7181296 - DNA, 22 bp, Homo sapiens
tgggtggcacttctggggtcca

SEQ ID NO: 7181297 - DNA, 22 bp, Homo sapiens
tgggtggcacttctggggtcca

SEQ ID NO: 7181298 - DNA, 22 bp, Homo sapiens
tggtaatttgagtggacttagt

SEQ ID NO: 7181299 - DNA, 22 bp, Homo sapiens
tggtacacatgtccaaggtcag

SEQ ID NO: 7181300 - DNA, 22 bp, Homo sapiens
tgggtgggagcaccctgtctgg

SEQ ID NO: 7181301 - DNA, 22 bp, Homo sapiens
tgggtgggagcaccctgtctgg

SEQ ID NO: 7181302 - DNA, 22 bp, Homo sapiens
tgggtgggagcaccctgtctgg

SEQ ID NO: 7181303 - DNA, 23 bp, Homo sapiens
tggtaatagggagcagaaggtag

SEQ ID NO: 7181304 - DNA, 22 bp, Homo sapiens
tgggtgggagcgccctgtctgg

SEQ ID NO: 7181305 - DNA, 22 bp, Homo sapiens
tgggtgggagcaccctgtctgg

SEQ ID NO: 7181306 - DNA, 22 bp, Homo sapiens
tgggtgggagcaccctgtctgg

SEQ ID NO: 7181307 - DNA, 22 bp, Homo sapiens
tgggtgggagcaccctgtctgg

SEQ ID NO: 7181308 - DNA, 22 bp, Homo sapiens
tgggtgggagcaccctgtctgg

SEQ ID NO: 7181309 - DNA, 22 bp, Homo sapiens
cctgcctgcagaaagtatctcc

SEQ ID NO: 7181310 - DNA, 22 bp, Homo sapiens
tggtgggacatctgaggagagg

SEQ ID NO: 7181311 - DNA, 22 bp, Homo sapiens
cctgcctgcagaaagtatctcc

SEQ ID NO: 7181312 - DNA, 22 bp, Homo sapiens
cctgcctgcagaaagtatctcc

SEQ ID NO: 7181313 - DNA, 22 bp, Homo sapiens
tggttacagaacatgaatgttg

SEQ ID NO: 7181314 - DNA, 22 bp, Homo sapiens
tggttacataagaatagcactg

SEQ ID NO: 7181315 - DNA, 22 bp, Homo sapiens
cctgcctgcaaaatgggacaag

SEQ ID NO: 7181316 - DNA, 22 bp, Homo sapiens
cctgcctgcaccttctctgggg

SEQ ID NO: 7181317 - DNA, 22 bp, Homo sapiens
cctgcctgcaccttctctgggg

SEQ ID NO: 7181318 - DNA, 22 bp, Homo sapiens
cctgcctgcagaaagtatctcc

SEQ ID NO: 7181319 - DNA, 22 bp, Homo sapiens
cctgcctgacagagaaggttca

SEQ ID NO: 7181320 - DNA, 23 bp, Homo sapiens
cctgcctccccatcagttataca

SEQ ID NO: 7181321 - DNA, 22 bp, Homo sapiens
cctgcctcccagaggtcctcta

SEQ ID NO: 7181322 - DNA, 23 bp, Homo sapiens
cctgcctccccatcagttataca

SEQ ID NO: 7181323 - DNA, 23 bp, Homo sapiens
cctgcctccccatcagttataca

SEQ ID NO: 7181324 - DNA, 22 bp, Homo sapiens
cctgcctcccagaggtcctcta

SEQ ID NO: 7181325 - DNA, 22 bp, Homo sapiens
cctgcctcatcaacttgtcgtg

SEQ ID NO: 7181326 - DNA, 22 bp, Homo sapiens
cctgcctcatcaacttgtcgtg

SEQ ID NO: 7181327 - DNA, 22 bp, Homo sapiens
cctgcctcccagaggtcctcta

SEQ ID NO: 7181328 - DNA, 22 bp, Homo sapiens
tggtaccatttcccaggagtgt

SEQ ID NO: 7181329 - DNA, 21 bp, Homo sapiens
tggtacaccttgcctgtcaga

SEQ ID NO: 7181330 - DNA, 22 bp, Homo sapiens
tggtacacatgtccaaggtcag

SEQ ID NO: 7181331 - DNA, 22 bp, Homo sapiens
tggtacacatgtccaaggtcag

SEQ ID NO: 7181332 - DNA, 21 bp, Homo sapiens
tggtacagaggaggtgaagtg

SEQ ID NO: 7181333 - DNA, 17 bp, Homo sapiens
tggtacaggctgaggga

SEQ ID NO: 7181334 - DNA, 22 bp, Homo sapiens
cctgccctgtcactggctaggg

SEQ ID NO: 7181335 - DNA, 22 bp, Homo sapiens
cctgccctgtcactggctaggg

SEQ ID NO: 7181336 - DNA, 22 bp, Homo sapiens
tggtaggagatatggtctccga

SEQ ID NO: 7181337 - DNA, 22 bp, Homo sapiens
cctgcccagagcccctttcact

SEQ ID NO: 7181338 - DNA, 22 bp, Homo sapiens
cctgcccagagcccctttcact

SEQ ID NO: 7181339 - DNA, 22 bp, Homo sapiens
cctgcccagcttcacctcaggc

SEQ ID NO: 7181340 - DNA, 22 bp, Homo sapiens
tggtagcaacatctcagtggct

SEQ ID NO: 7181341 - DNA, 22 bp, Homo sapiens
tggtaggaatgattacgacttt

SEQ ID NO: 7181342 - DNA, 22 bp, Homo sapiens
cctgcccttctttccccagcat

SEQ ID NO: 7181343 - DNA, 22 bp, Homo sapiens
cctgcccttctttccccagcat

SEQ ID NO: 7181344 - DNA, 22 bp, Homo sapiens
cctgcccttctttccccagcat

SEQ ID NO: 7181345 - DNA, 22 bp, Homo sapiens
cctgcccttctttccccagcat

SEQ ID NO: 7181346 - DNA, 22 bp, Homo sapiens
cctgcctactgagttttatatt

SEQ ID NO: 7181347 - DNA, 22 bp, Homo sapiens
cctgcccttctttccccagcat

SEQ ID NO: 7181348 - DNA, 22 bp, Homo sapiens
cctgccctgtgtttggggacta

SEQ ID NO: 7181349 - DNA, 22 bp, Homo sapiens
cctgcctcaggactctgcatat

SEQ ID NO: 7181350 - DNA, 22 bp, Homo sapiens
cctgcctcaggactctgcatat

SEQ ID NO: 7181351 - DNA, 22 bp, Homo sapiens
cctgcctatgagacgttttgcc

SEQ ID NO: 7181352 - DNA, 22 bp, Homo sapiens
cctgcctcaggactctgcatat

SEQ ID NO: 7181353 - DNA, 22 bp, Homo sapiens
cctgcctcatcaacttgtcgtg

SEQ ID NO: 7181354 - DNA, 22 bp, Homo sapiens
cctgcctcaggactctgcatat

SEQ ID NO: 7181355 - DNA, 22 bp, Homo sapiens
cctgcagggaatcgaggcagaa

SEQ ID NO: 7181356 - DNA, 22 bp, Homo sapiens
cctgcagggaatcgaggcagaa

SEQ ID NO: 7181357 - DNA, 22 bp, Homo sapiens
cctgcagggaatcgaggcagaa

SEQ ID NO: 7181358 - DNA, 22 bp, Homo sapiens
cctgcagggaatcgaggcagaa

SEQ ID NO: 7181359 - DNA, 22 bp, Homo sapiens
cctgcagggaatcgaggcagaa

SEQ ID NO: 7181360 - DNA, 22 bp, Homo sapiens
cctgcagggaatcgaggcagaa

SEQ ID NO: 7181361 - DNA, 22 bp, Homo sapiens
cctgcaggctgcaggccagttc

SEQ ID NO: 7181362 - DNA, 22 bp, Homo sapiens
cctgcaggctgcaggccagttc

SEQ ID NO: 7181363 - DNA, 22 bp, Homo sapiens
cctgcaggctgcaggccagttc

SEQ ID NO: 7181364 - DNA, 23 bp, Homo sapiens
cctgcagctgctggggctccacc

SEQ ID NO: 7181365 - DNA, 22 bp, Homo sapiens
cctgcagctgtaggagaaggcg

SEQ ID NO: 7181366 - DNA, 22 bp, Homo sapiens
cctgcagctgtaggagaaggcg

SEQ ID NO: 7181367 - DNA, 23 bp, Homo sapiens
cctgcagctgctggggctccacc

SEQ ID NO: 7181368 - DNA, 22 bp, Homo sapiens
cctgcaggctgcaggccagttc

SEQ ID NO: 7181369 - DNA, 22 bp, Homo sapiens
cctgcaggctgcaggccagttc

SEQ ID NO: 7181370 - DNA, 22 bp, Homo sapiens
cctgcaggctgcaggccagttc

SEQ ID NO: 7181371 - DNA, 22 bp, Homo sapiens
cctgcagctttgcctcctgaac

SEQ ID NO: 7181372 - DNA, 22 bp, Homo sapiens
tggggagagattgaggagtttt

SEQ ID NO: 7181373 - DNA, 22 bp, Homo sapiens
tggggagagattgaggagtttt

SEQ ID NO: 7181374 - DNA, 22 bp, Homo sapiens
tggggagagattgaggagtttt

SEQ ID NO: 7181375 - DNA, 22 bp, Homo sapiens
tggggagagaccggaatgtttc

SEQ ID NO: 7181376 - DNA, 22 bp, Homo sapiens
tggggagagaccggaatgtttc

SEQ ID NO: 7181377 - DNA, 22 bp, Homo sapiens
tggggagagaccggaatgtttc

SEQ ID NO: 7181378 - DNA, 22 bp, Homo sapiens
tggggagagattgaggagtttt

SEQ ID NO: 7181379 - DNA, 22 bp, Homo sapiens
tggggagagattgaggagtttt

SEQ ID NO: 7181380 - DNA, 22 bp, Homo sapiens
tggggagagattgaggagtttt

SEQ ID NO: 7181381 - DNA, 22 bp, Homo sapiens
tggggagaggtatcattgagat

SEQ ID NO: 7181382 - DNA, 22 bp, Homo sapiens
tggggagaggtatcattgagat

SEQ ID NO: 7181383 - DNA, 22 bp, Homo sapiens
tggggagagattgaggagtttt

SEQ ID NO: 7181384 - DNA, 22 bp, Homo sapiens
tggggagaggaatttgaatgat

SEQ ID NO: 7181385 - DNA, 22 bp, Homo sapiens
tggggagaggtatcattgagat

SEQ ID NO: 7181386 - DNA, 22 bp, Homo sapiens
tggggagcacggtagggaaatg

SEQ ID NO: 7181387 - DNA, 22 bp, Homo sapiens
tggggagcacggtagggaaatg

SEQ ID NO: 7181388 - DNA, 22 bp, Homo sapiens
tggggagcacggtagggaaatg

SEQ ID NO: 7181389 - DNA, 22 bp, Homo sapiens
tggggagcacggtagggaaatg

SEQ ID NO: 7181390 - DNA, 22 bp, Homo sapiens
cctgcagacacttgtccagcaa

SEQ ID NO: 7181391 - DNA, 22 bp, Homo sapiens
tggggagcccactcacctcccc

SEQ ID NO: 7181392 - DNA, 22 bp, Homo sapiens
cctgcagaccacactcagtcct

SEQ ID NO: 7181393 - DNA, 23 bp, Homo sapiens
tggggagagttaccctggaagcg

SEQ ID NO: 7181394 - DNA, 23 bp, Homo sapiens
tggggagagttaccctggaagcg

SEQ ID NO: 7181395 - DNA, 22 bp, Homo sapiens
tggggagagttacaaggaatct

SEQ ID NO: 7181396 - DNA, 22 bp, Homo sapiens
tggggagagttacaaggaatct

SEQ ID NO: 7181397 - DNA, 22 bp, Homo sapiens
tggggagagttacaaggaatct

SEQ ID NO: 7181398 - DNA, 22 bp, Homo sapiens
tggggagagttacaaggaatct

SEQ ID NO: 7181399 - DNA, 23 bp, Homo sapiens
tggggagagttaccctggaagcg

SEQ ID NO: 7181400 - DNA, 23 bp, Homo sapiens
tggggagagttaccctggaagcg

SEQ ID NO: 7181401 - DNA, 22 bp, Homo sapiens
cctgagtgccatgagagcaccc

SEQ ID NO: 7181402 - DNA, 22 bp, Homo sapiens
cctgaggtcatggtccagtgtt

SEQ ID NO: 7181403 - DNA, 17 bp, Homo sapiens
cctgagtgggagaggaa

SEQ ID NO: 7181404 - DNA, 22 bp, Homo sapiens
cctgagtggccaggcagctgtg

SEQ ID NO: 7181405 - DNA, 22 bp, Homo sapiens
cctgagtgcttccagagtcatg

SEQ ID NO: 7181406 - DNA, 22 bp, Homo sapiens
tggggagagaccggaatgtttc

SEQ ID NO: 7181407 - DNA, 22 bp, Homo sapiens
tggggagactggccgagatcct

SEQ ID NO: 7181408 - DNA, 22 bp, Homo sapiens
tggggagactggccgagatcct

SEQ ID NO: 7181409 - DNA, 22 bp, Homo sapiens
tggggagaagcaatagactcta

SEQ ID NO: 7181410 - DNA, 22 bp, Homo sapiens
tggggagaagcaatagactcta

SEQ ID NO: 7181411 - DNA, 22 bp, Homo sapiens
tggggagactggccgagatcct

SEQ ID NO: 7181412 - DNA, 22 bp, Homo sapiens
tggggagactggccgagatcct

SEQ ID NO: 7181413 - DNA, 19 bp, Homo sapiens
cctgatggagctggtgcaa

SEQ ID NO: 7181414 - DNA, 22 bp, Homo sapiens
tggggacttgccttgttgctca

SEQ ID NO: 7181415 - DNA, 19 bp, Homo sapiens
cctgatggagctggtgcaa

SEQ ID NO: 7181416 - DNA, 22 bp, Homo sapiens
cctgatggagccctgctgcatg

SEQ ID NO: 7181417 - DNA, 22 bp, Homo sapiens
cctgataatattgacctacaga

SEQ ID NO: 7181418 - DNA, 22 bp, Homo sapiens
cctgataatgtaattgttaaat

SEQ ID NO: 7181419 - DNA, 22 bp, Homo sapiens
cctgataaaccctggaatttgt

SEQ ID NO: 7181420 - DNA, 22 bp, Homo sapiens
cctgataacacagatacaagat

SEQ ID NO: 7181421 - DNA, 22 bp, Homo sapiens
tgggctccggcggcctcaggct

SEQ ID NO: 7181422 - DNA, 22 bp, Homo sapiens
tgggctccggcggcctcaggct

SEQ ID NO: 7181423 - DNA, 22 bp, Homo sapiens
tgggctccagcacctgtgctct

SEQ ID NO: 7181424 - DNA, 22 bp, Homo sapiens
tgggctccggcggcctcaggct

SEQ ID NO: 7181425 - DNA, 22 bp, Homo sapiens
tgggctccggcggcctcaggct

SEQ ID NO: 7181426 - DNA, 22 bp, Homo sapiens
tgggctccggcggcctcaggct

SEQ ID NO: 7181427 - DNA, 22 bp, Homo sapiens
tgggctccggcggcctcaggct

SEQ ID NO: 7181428 - DNA, 22 bp, Homo sapiens
tgggctccgttgcctggggcag

SEQ ID NO: 7181429 - DNA, 22 bp, Homo sapiens
tgggctccgttgcctggggcag

SEQ ID NO: 7181430 - DNA, 22 bp, Homo sapiens
tgggctccgttgcctggggcag

SEQ ID NO: 7181431 - DNA, 22 bp, Homo sapiens
tgggctcctcgtcactcgctgt

SEQ ID NO: 7181432 - DNA, 19 bp, Homo sapiens
tgggctcattcaggtggtt

SEQ ID NO: 7181433 - DNA, 19 bp, Homo sapiens
tgggctcattcaggtggtt

SEQ ID NO: 7181434 - DNA, 22 bp, Homo sapiens
tgggctcatgtttctttgagga

SEQ ID NO: 7181435 - DNA, 22 bp, Homo sapiens
tgggctcatgtttatacatatc

SEQ ID NO: 7181436 - DNA, 22 bp, Homo sapiens
tgggctcatgtttctttgagga

SEQ ID NO: 7181437 - DNA, 22 bp, Homo sapiens
tgggctccagcacctgtgctct

SEQ ID NO: 7181438 - DNA, 22 bp, Homo sapiens
tgggctccagcacctgtgctct

SEQ ID NO: 7181439 - DNA, 22 bp, Homo sapiens
tgggctccagcacctgtgctct

SEQ ID NO: 7181440 - DNA, 22 bp, Homo sapiens
tgggctcatggcccagcactgg

SEQ ID NO: 7181441 - DNA, 22 bp, Homo sapiens
tgggctcatggcccagcactgg

SEQ ID NO: 7181442 - DNA, 22 bp, Homo sapiens
tgggctcatggcccagcactgg

SEQ ID NO: 7181443 - DNA, 22 bp, Homo sapiens
tgggctcatggcccagcactgg

SEQ ID NO: 7181444 - DNA, 22 bp, Homo sapiens
tgggctcatgctggagatgaga

SEQ ID NO: 7181445 - DNA, 22 bp, Homo sapiens
tgggctcagtgggagaaagggc

SEQ ID NO: 7181446 - DNA, 23 bp, Homo sapiens
tgggcctggcctcccagtccagc

SEQ ID NO: 7181447 - DNA, 23 bp, Homo sapiens
tgggcctggcctcccagtccagc

SEQ ID NO: 7181448 - DNA, 22 bp, Homo sapiens
tgggcctgggagggcagacgct

SEQ ID NO: 7181449 - DNA, 22 bp, Homo sapiens
tgggcctgggagggcagacgct

SEQ ID NO: 7181450 - DNA, 22 bp, Homo sapiens
tgggcctgggagggcagacgct

SEQ ID NO: 7181451 - DNA, 22 bp, Homo sapiens
tgggcctgggagggcagacgct

SEQ ID NO: 7181452 - DNA, 22 bp, Homo sapiens
tgggcctggccctgtggaggag

SEQ ID NO: 7181453 - DNA, 22 bp, Homo sapiens
tgggcctggccctgtggaggag

SEQ ID NO: 7181454 - DNA, 22 bp, Homo sapiens
tgggcctggccctgtggaggag

SEQ ID NO: 7181455 - DNA, 23 bp, Homo sapiens
tgggcctggcctcccagtccagc

SEQ ID NO: 7181456 - DNA, 23 bp, Homo sapiens
tgggcctggcctcccagtccagc

SEQ ID NO: 7181457 - DNA, 22 bp, Homo sapiens
tgggcctggagtttgtccagag

SEQ ID NO: 7181458 - DNA, 22 bp, Homo sapiens
tgggcctggccctgtggaggag

SEQ ID NO: 7181459 - DNA, 22 bp, Homo sapiens
tgggcctggccctgtggaggag

SEQ ID NO: 7181460 - DNA, 22 bp, Homo sapiens
tgggcctggccctgtggaggag

SEQ ID NO: 7181461 - DNA, 22 bp, Homo sapiens
tgggcctggccctgtggaggag

SEQ ID NO: 7181462 - DNA, 22 bp, Homo sapiens
tgggcctggccctgtggaggag

SEQ ID NO: 7181463 - DNA, 22 bp, Homo sapiens
tgggcaggatgcgttgattctt

SEQ ID NO: 7181464 - DNA, 22 bp, Homo sapiens
tgggcaggataatatctcatgt

SEQ ID NO: 7181465 - DNA, 22 bp, Homo sapiens
tgggcaggagagaagctaaaga

SEQ ID NO: 7181466 - DNA, 22 bp, Homo sapiens
tgggcaggagagaagctaaaga

SEQ ID NO: 7181467 - DNA, 22 bp, Homo sapiens
tgggcaggataatatctcatgt

SEQ ID NO: 7181468 - DNA, 22 bp, Homo sapiens
tgggcaggagagaagctaaaga

SEQ ID NO: 7181469 - DNA, 22 bp, Homo sapiens
tgggcaggagagaagctaaaga

SEQ ID NO: 7181470 - DNA, 22 bp, Homo sapiens
tgggcaggatgcgttgattctt

SEQ ID NO: 7181471 - DNA, 22 bp, Homo sapiens
tgggcaggcaagtgaatacctt

SEQ ID NO: 7181472 - DNA, 22 bp, Homo sapiens
tgggcaggcaagtgaatacctt

SEQ ID NO: 7181473 - DNA, 22 bp, Homo sapiens
tgggcaggatgcgttgattctt

SEQ ID NO: 7181474 - DNA, 22 bp, Homo sapiens
tgggcaggataatatctcatgt

SEQ ID NO: 7181475 - DNA, 22 bp, Homo sapiens
tgggcaggcaagtgaatacctt

SEQ ID NO: 7181476 - DNA, 22 bp, Homo sapiens
tgggcaggcaagtgaatacctt

SEQ ID NO: 7181477 - DNA, 22 bp, Homo sapiens
tgggcaggcaagtgaatacctt

SEQ ID NO: 7181478 - DNA, 22 bp, Homo sapiens
tgggcctggacaaggccactag

SEQ ID NO: 7181479 - DNA, 22 bp, Homo sapiens
tgggcaggcaagtgaatacctt

SEQ ID NO: 7181480 - DNA, 22 bp, Homo sapiens
tgggcaggcaagtgaatacctt

SEQ ID NO: 7181481 - DNA, 23 bp, Homo sapiens
tgggccggattgtgaaggacgtg

SEQ ID NO: 7181482 - DNA, 22 bp, Homo sapiens
tgggccgggcactgtactgggc

SEQ ID NO: 7181483 - DNA, 22 bp, Homo sapiens
tgggccgggcactgtactgggc

SEQ ID NO: 7181484 - DNA, 22 bp, Homo sapiens
tgggccgtggagcactctgaga

SEQ ID NO: 7181485 - DNA, 22 bp, Homo sapiens
tgggcctggagtttgtccagag

SEQ ID NO: 7181486 - DNA, 22 bp, Homo sapiens
tgggcctggagccctggagagt

SEQ ID NO: 7181487 - DNA, 22 bp, Homo sapiens
tgggcctggagtttgtccagag

SEQ ID NO: 7181488 - DNA, 22 bp, Homo sapiens
tgggcctggagccctggagagt

SEQ ID NO: 7181489 - DNA, 22 bp, Homo sapiens
tgggcctggagccctggagagt

SEQ ID NO: 7181490 - DNA, 22 bp, Homo sapiens
tgggcctggagccctggagagt

SEQ ID NO: 7181491 - DNA, 22 bp, Homo sapiens
tgggcctggagccctggagagt

SEQ ID NO: 7181492 - DNA, 22 bp, Homo sapiens
tgggcctggagccctggagagt

SEQ ID NO: 7181493 - DNA, 22 bp, Homo sapiens
tggcagtgtcttatcaggagtg

SEQ ID NO: 7181494 - DNA, 22 bp, Homo sapiens
tggcagtgtataggtggctcct

SEQ ID NO: 7181495 - DNA, 22 bp, Homo sapiens
tggcagtgtcttatcaggagtg

SEQ ID NO: 7181496 - DNA, 22 bp, Homo sapiens
tggcagtgtcttatcaggagtg

SEQ ID NO: 7181497 - DNA, 22 bp, Homo sapiens
tggcagtgtcttgctggggcag

SEQ ID NO: 7181498 - DNA, 22 bp, Homo sapiens
tggcagtgtcttgctggggcag

SEQ ID NO: 7181499 - DNA, 19 bp, Homo sapiens
tggcagtgtggggtatgaa

SEQ ID NO: 7181500 - DNA, 22 bp, Homo sapiens
tggcagtgtgggaggaaggtac

SEQ ID NO: 7181501 - DNA, 22 bp, Homo sapiens
tggcagtgtgggaggaaggtac

SEQ ID NO: 7181502 - DNA, 22 bp, Homo sapiens
tggcagtgtgggaggaaggtac

SEQ ID NO: 7181503 - DNA, 22 bp, Homo sapiens
tggcagtgtgggaggaaggtac

SEQ ID NO: 7181504 - DNA, 22 bp, Homo sapiens
tggcatttgctcccttgtgttc

SEQ ID NO: 7181505 - DNA, 22 bp, Homo sapiens
tggcatttgctcccttgtgttc

SEQ ID NO: 7181506 - DNA, 19 bp, Homo sapiens
tggcatttggaggcaacct

SEQ ID NO: 7181507 - DNA, 19 bp, Homo sapiens
tggcatttggaggcaacct

SEQ ID NO: 7181508 - DNA, 22 bp, Homo sapiens
tggcagtgggaagctggaagtc

SEQ ID NO: 7181509 - DNA, 22 bp, Homo sapiens
tggcagtgggaagctggaagtc

SEQ ID NO: 7181510 - DNA, 22 bp, Homo sapiens
tggcagtgggaagctggaagtc

SEQ ID NO: 7181511 - DNA, 22 bp, Homo sapiens
tggcagtgggaagctggaagtc

SEQ ID NO: 7181512 - DNA, 19 bp, Homo sapiens
tggcaggtagtgagcagtc

SEQ ID NO: 7181513 - DNA, 19 bp, Homo sapiens
tggcaggtagtgagcagtc

SEQ ID NO: 7181514 - DNA, 19 bp, Homo sapiens
tggcaggtagtgagcagtc

SEQ ID NO: 7181515 - DNA, 22 bp, Homo sapiens
tggcagtggctttgctggtgga

SEQ ID NO: 7181516 - DNA, 22 bp, Homo sapiens
tggcagtgggaagctggaagtc

SEQ ID NO: 7181517 - DNA, 22 bp, Homo sapiens
tggcagtgggaagctggaagtc

SEQ ID NO: 7181518 - DNA, 22 bp, Homo sapiens
tggcagtgggaagctggaagtc

SEQ ID NO: 7181519 - DNA, 22 bp, Homo sapiens
tggcagtggtaccggctctcag

SEQ ID NO: 7181520 - DNA, 22 bp, Homo sapiens
tggcagtggtaccggctctcag

SEQ ID NO: 7181521 - DNA, 22 bp, Homo sapiens
tggcagtggtgtctgcacaggc

SEQ ID NO: 7181522 - DNA, 22 bp, Homo sapiens
cctccagggcccctctcactgg

SEQ ID NO: 7181523 - DNA, 22 bp, Homo sapiens
cctccagggcccctctcactgg

SEQ ID NO: 7181524 - DNA, 22 bp, Homo sapiens
cctccagggcagacggggagca

SEQ ID NO: 7181525 - DNA, 22 bp, Homo sapiens
cctccagggcccctctcactgg

SEQ ID NO: 7181526 - DNA, 21 bp, Homo sapiens
cctccaggtgattccgtgctc

SEQ ID NO: 7181527 - DNA, 21 bp, Homo sapiens
cctccaggtgattccgtgctc

SEQ ID NO: 7181528 - DNA, 21 bp, Homo sapiens
cctccaggtgattccgtgctc

SEQ ID NO: 7181529 - DNA, 20 bp, Homo sapiens
tggccaagtatccaactgga

SEQ ID NO: 7181530 - DNA, 20 bp, Homo sapiens
tggccaagtatccaactgga

SEQ ID NO: 7181531 - DNA, 21 bp, Homo sapiens
tggccaaggaatagaagctct

SEQ ID NO: 7181532 - DNA, 22 bp, Homo sapiens
tggccaatcactgacaaaatgc

SEQ ID NO: 7181533 - DNA, 22 bp, Homo sapiens
tggccaatcactgacaaaatgc

SEQ ID NO: 7181534 - DNA, 22 bp, Homo sapiens
tggccacaaagagaacgaggtc

SEQ ID NO: 7181535 - DNA, 22 bp, Homo sapiens
tggccacaaagagaacgaggtc

SEQ ID NO: 7181536 - DNA, 22 bp, Homo sapiens
cctccagcgcgatccactccgg

SEQ ID NO: 7181537 - DNA, 22 bp, Homo sapiens
tggccaattgaattttaattat

SEQ ID NO: 7181538 - DNA, 22 bp, Homo sapiens
cctccagctgcctcagtctctt

SEQ ID NO: 7181539 - DNA, 22 bp, Homo sapiens
cctccagctgcctcagtctctt

SEQ ID NO: 7181540 - DNA, 22 bp, Homo sapiens
cctccagctgcctcagtctctt

SEQ ID NO: 7181541 - DNA, 22 bp, Homo sapiens
cctccaggctggttatcagctg

SEQ ID NO: 7181542 - DNA, 22 bp, Homo sapiens
cctccaggctggttatcagctg

SEQ ID NO: 7181543 - DNA, 22 bp, Homo sapiens
cctccagggcagacggggagca

SEQ ID NO: 7181544 - DNA, 21 bp, Homo sapiens
tggcatttgtacagggacttt

SEQ ID NO: 7181545 - DNA, 22 bp, Homo sapiens
tggcatttgtagccacttgcct

SEQ ID NO: 7181546 - DNA, 23 bp, Homo sapiens
tggcattttagttagcttcagtg

SEQ ID NO: 7181547 - DNA, 22 bp, Homo sapiens
tggcattttgttcagtatatgg

SEQ ID NO: 7181548 - DNA, 21 bp, Homo sapiens
tggccaaactggagcatttga

SEQ ID NO: 7181549 - DNA, 21 bp, Homo sapiens
tggccaaaaccatattattaa

SEQ ID NO: 7181550 - DNA, 21 bp, Homo sapiens
tggccaaactggagcatttga

SEQ ID NO: 7181551 - DNA, 22 bp, Homo sapiens
tggccaagaatgatatgtgaag

SEQ ID NO: 7181552 - DNA, 22 bp, Homo sapiens
tggccaagatgcgacctctcag

SEQ ID NO: 7181553 - DNA, 22 bp, Homo sapiens
tggccaagccactgctgggtct

SEQ ID NO: 7181554 - DNA, 22 bp, Homo sapiens
tggccaagccactgctgggtct

SEQ ID NO: 7181555 - DNA, 22 bp, Homo sapiens
tggccaagccactgctgggtct

SEQ ID NO: 7181556 - DNA, 22 bp, Homo sapiens
tggccaagccactgctgggtct

SEQ ID NO: 7181557 - DNA, 22 bp, Homo sapiens
cctccatctccagcttctgcct

SEQ ID NO: 7181558 - DNA, 22 bp, Homo sapiens
cctccagtcacctggatgagaa

SEQ ID NO: 7181559 - DNA, 22 bp, Homo sapiens
cctccagtactccagtccagcg

SEQ ID NO: 7181560 - DNA, 22 bp, Homo sapiens
cctccagtactccagtccagcg

SEQ ID NO: 7181561 - DNA, 22 bp, Homo sapiens
cctccagtactccagtccagcg

SEQ ID NO: 7181562 - DNA, 22 bp, Homo sapiens
cctccaggtgttacatatgact

SEQ ID NO: 7181563 - DNA, 22 bp, Homo sapiens
cctccaggtgttacatatgact

SEQ ID NO: 7181564 - DNA, 22 bp, Homo sapiens
cctcccacatcctagctctgct

SEQ ID NO: 7181565 - DNA, 22 bp, Homo sapiens
cctcccacatcctagctctgct

SEQ ID NO: 7181566 - DNA, 22 bp, Homo sapiens
cctcccacatcctagctctgct

SEQ ID NO: 7181567 - DNA, 17 bp, Homo sapiens
cctcccacaccgccctg

SEQ ID NO: 7181568 - DNA, 22 bp, Homo sapiens
cctccatgtaaaggtcccctca

SEQ ID NO: 7181569 - DNA, 17 bp, Homo sapiens
cctcccacaccgccctg

SEQ ID NO: 7181570 - DNA, 23 bp, Homo sapiens
cctccatggtaagaagcttagag

SEQ ID NO: 7181571 - DNA, 23 bp, Homo sapiens
cctcccacctatttcactttctt

SEQ ID NO: 7181572 - DNA, 19 bp, Homo sapiens
cctcccacggattccttcc

SEQ ID NO: 7181573 - DNA, 23 bp, Homo sapiens
cctcccacctatttcactttctt

SEQ ID NO: 7181574 - DNA, 22 bp, Homo sapiens
cctcccacttcttgctgaggtc

SEQ ID NO: 7181575 - DNA, 22 bp, Homo sapiens
cctcccacttcttgctgaggtc

SEQ ID NO: 7181576 - DNA, 22 bp, Homo sapiens
cctcccacttcttgctgaggtc

SEQ ID NO: 7181577 - DNA, 22 bp, Homo sapiens
cctcccaccgtatctcagtggc

SEQ ID NO: 7181578 - DNA, 22 bp, Homo sapiens
cctcccaccgtatctcagtggc

SEQ ID NO: 7181579 - DNA, 22 bp, Homo sapiens
cctcccaccgtatctcagtggc

SEQ ID NO: 7181580 - DNA, 22 bp, Homo sapiens
cctcccaccgtatctcagtggc

SEQ ID NO: 7181581 - DNA, 22 bp, Homo sapiens
cctcccaccatttagagagagc

SEQ ID NO: 7181582 - DNA, 22 bp, Homo sapiens
cctcccacattgaggacatgct

SEQ ID NO: 7181583 - DNA, 22 bp, Homo sapiens
cctcctctggtgctgccaaccc

SEQ ID NO: 7181584 - DNA, 22 bp, Homo sapiens
cctcctctggtgctgccaaccc

SEQ ID NO: 7181585 - DNA, 22 bp, Homo sapiens
cctcctctggtgctgccaaccc

SEQ ID NO: 7181586 - DNA, 22 bp, Homo sapiens
cctcctctgtgcagctgtgggt

SEQ ID NO: 7181587 - DNA, 22 bp, Homo sapiens
cctcctctgtgcagctgtgggt

SEQ ID NO: 7181588 - DNA, 22 bp, Homo sapiens
cctcctctgtgcagctgtgggt

SEQ ID NO: 7181589 - DNA, 22 bp, Homo sapiens
cctcctggccctgggcctggaa

SEQ ID NO: 7181590 - DNA, 22 bp, Homo sapiens
cctcctggcctgtgcagagccc

SEQ ID NO: 7181591 - DNA, 22 bp, Homo sapiens
cctcctggcctgtgcagagccc

SEQ ID NO: 7181592 - DNA, 22 bp, Homo sapiens
cctcctggcctgtgcagagccc

SEQ ID NO: 7181593 - DNA, 22 bp, Homo sapiens
cctcctggcctgtgcagagccc

SEQ ID NO: 7181594 - DNA, 22 bp, Homo sapiens
cctcctggcctgtgcagagccc

SEQ ID NO: 7181595 - DNA, 22 bp, Homo sapiens
cctcctgggactcattagcacc

SEQ ID NO: 7181596 - DNA, 22 bp, Homo sapiens
cctcctgggactcattagcacc

SEQ ID NO: 7181597 - DNA, 22 bp, Homo sapiens
cctcctgggacaggctggcaca

SEQ ID NO: 7181598 - DNA, 22 bp, Homo sapiens
cctcctgggacaggctggcaca

SEQ ID NO: 7181599 - DNA, 22 bp, Homo sapiens
cctcctgggacaggctggcaca

SEQ ID NO: 7181600 - DNA, 22 bp, Homo sapiens
cctcctggcttttcccattgaa

SEQ ID NO: 7181601 - DNA, 22 bp, Homo sapiens
cctcctgggccttgctctgtga

SEQ ID NO: 7181602 - DNA, 22 bp, Homo sapiens
cctcctgggccttgctctgtga

SEQ ID NO: 7181603 - DNA, 22 bp, Homo sapiens
cctcctgggccttgctctgtga

SEQ ID NO: 7181604 - DNA, 22 bp, Homo sapiens
cctcctgggccttgctctgtga

SEQ ID NO: 7181605 - DNA, 22 bp, Homo sapiens
cctcctgggctcctgtctgcac

SEQ ID NO: 7181606 - DNA, 22 bp, Homo sapiens
cctcctgggctcctgtctgcac

SEQ ID NO: 7181607 - DNA, 22 bp, Homo sapiens
cctcctgggctcctgtctgcac

SEQ ID NO: 7181608 - DNA, 22 bp, Homo sapiens
cctcctggggtgaaggatggga

SEQ ID NO: 7181609 - DNA, 23 bp, Homo sapiens
cctcctgggcacaggcctgatgg

SEQ ID NO: 7181610 - DNA, 23 bp, Homo sapiens
cctcctgggcacaggcctgatgg

SEQ ID NO: 7181611 - DNA, 22 bp, Homo sapiens
cctcctgggactcattagcacc

SEQ ID NO: 7181612 - DNA, 22 bp, Homo sapiens
cctcctgggagagcacggaggg

SEQ ID NO: 7181613 - DNA, 22 bp, Homo sapiens
cctcctgggagagcacggaggg

SEQ ID NO: 7181614 - DNA, 22 bp, Homo sapiens
cctctccagttttaacgtgacc

SEQ ID NO: 7181615 - DNA, 22 bp, Homo sapiens
cctctccagttttaacgtgacc

SEQ ID NO: 7181616 - DNA, 22 bp, Homo sapiens
cctctcccacgtggcagaggct

SEQ ID NO: 7181617 - DNA, 22 bp, Homo sapiens
cctctcccacgtggcagaggct

SEQ ID NO: 7181618 - DNA, 22 bp, Homo sapiens
cctctcccacgtggcagaggct

SEQ ID NO: 7181619 - DNA, 22 bp, Homo sapiens
cctctcccacgtggcagaggct

SEQ ID NO: 7181620 - DNA, 22 bp, Homo sapiens
cctctcccaggcgcggcggcag

SEQ ID NO: 7181621 - DNA, 22 bp, Homo sapiens
cctctcccagggagagcctgag

SEQ ID NO: 7181622 - DNA, 22 bp, Homo sapiens
cctctcccagggagagcctgag

SEQ ID NO: 7181623 - DNA, 22 bp, Homo sapiens
cctctccagcggcctcagggcc

SEQ ID NO: 7181624 - DNA, 22 bp, Homo sapiens
cctctccagcggcctcagggcc

SEQ ID NO: 7181625 - DNA, 22 bp, Homo sapiens
cctctccagcggcctcagggcc

SEQ ID NO: 7181626 - DNA, 22 bp, Homo sapiens
cctctccagcggcctcagggcc

SEQ ID NO: 7181627 - DNA, 22 bp, Homo sapiens
cctctccagcggcctcagggcc

SEQ ID NO: 7181628 - DNA, 22 bp, Homo sapiens
cctctccagttttaacgtgacc

SEQ ID NO: 7181629 - DNA, 22 bp, Homo sapiens
cctctccagttttaacgtgacc

SEQ ID NO: 7181630 - DNA, 22 bp, Homo sapiens
tggctttacagtttgcaaacta

SEQ ID NO: 7181631 - DNA, 22 bp, Homo sapiens
tggctttactgtcattcttatg

SEQ ID NO: 7181632 - DNA, 19 bp, Homo sapiens
cctctcccatgcttacctc

SEQ ID NO: 7181633 - DNA, 19 bp, Homo sapiens
cctctcccatgcttacctc

SEQ ID NO: 7181634 - DNA, 22 bp, Homo sapiens
cctctcccctcccaaggcggga

SEQ ID NO: 7181635 - DNA, 22 bp, Homo sapiens
cctctcccctcccaaggcggga

SEQ ID NO: 7181636 - DNA, 22 bp, Homo sapiens
cctctcccagggagagcctgag

SEQ ID NO: 7181637 - DNA, 22 bp, Homo sapiens
cctctcccagggagagcctgag

SEQ ID NO: 7181638 - DNA, 22 bp, Homo sapiens
cctctcccagggagagcctgag

SEQ ID NO: 7181639 - DNA, 19 bp, Homo sapiens
cctctcccatgcttacctc

SEQ ID NO: 7181640 - DNA, 22 bp, Homo sapiens
cctctcccgggtgccgctgggc

SEQ ID NO: 7181641 - DNA, 22 bp, Homo sapiens
cctctcccgggtgccgctgggc

SEQ ID NO: 7181642 - DNA, 22 bp, Homo sapiens
tgggaaggcagtcactgtccta

SEQ ID NO: 7181643 - DNA, 22 bp, Homo sapiens
tgggaaggcgtggaagtagaag

SEQ ID NO: 7181644 - DNA, 22 bp, Homo sapiens
tgggaaggcgtggaagtagaag

SEQ ID NO: 7181645 - DNA, 22 bp, Homo sapiens
tgggaaggcgtggaagtagaag

SEQ ID NO: 7181646 - DNA, 22 bp, Homo sapiens
tgggacacctcagatagtgtct

SEQ ID NO: 7181647 - DNA, 22 bp, Homo sapiens
tgggacacctcagatagtgtct

SEQ ID NO: 7181648 - DNA, 19 bp, Homo sapiens
tgggacacgatctgcctgt

SEQ ID NO: 7181649 - DNA, 19 bp, Homo sapiens
tgggacacgatctgcctgt

SEQ ID NO: 7181650 - DNA, 22 bp, Homo sapiens
tgggacacggaggccccagcac

SEQ ID NO: 7181651 - DNA, 22 bp, Homo sapiens
tgggacagagtgagctttggcc

SEQ ID NO: 7181652 - DNA, 22 bp, Homo sapiens
tgggacagagtgagctttggcc

SEQ ID NO: 7181653 - DNA, 22 bp, Homo sapiens
tggcttgtcatgtatctgaggc

SEQ ID NO: 7181654 - DNA, 22 bp, Homo sapiens
tggcttgggtgtctcagctctt

SEQ ID NO: 7181655 - DNA, 22 bp, Homo sapiens
tggcttggtgagcagagtgtag

SEQ ID NO: 7181656 - DNA, 22 bp, Homo sapiens
tggcttgcttccccattctcat

SEQ ID NO: 7181657 - DNA, 22 bp, Homo sapiens
tggcttgcttcttctgctgtcg

SEQ ID NO: 7181658 - DNA, 19 bp, Homo sapiens
tggcttggctgcagatgct

SEQ ID NO: 7181659 - DNA, 22 bp, Homo sapiens
tggcttctttgtagaaattgaa

SEQ ID NO: 7181660 - DNA, 22 bp, Homo sapiens
tggcttctttccactgtcctgt

SEQ ID NO: 7181661 - DNA, 22 bp, Homo sapiens
tggcttctttccactgtcctgt

SEQ ID NO: 7181662 - DNA, 22 bp, Homo sapiens
tggcttctttccactgtcctgt

SEQ ID NO: 7181663 - DNA, 22 bp, Homo sapiens
tggcttcccctaccttccaatt

SEQ ID NO: 7181664 - DNA, 17 bp, Homo sapiens
tggcttccctgggccac

SEQ ID NO: 7181665 - DNA, 22 bp, Homo sapiens
cctcctggtccagcatctcttt

SEQ ID NO: 7181666 - DNA, 22 bp, Homo sapiens
cctcctgggttcaagcgattct

SEQ ID NO: 7181667 - DNA, 22 bp, Homo sapiens
cctcctggtaattagcgaaagg

SEQ ID NO: 7181668 - DNA, 22 bp, Homo sapiens
cctcctggtaattagcgaaagg

SEQ ID NO: 7181669 - DNA, 20 bp, Homo sapiens
cctcctggtcaggtgtgcag

SEQ ID NO: 7181670 - DNA, 20 bp, Homo sapiens
cctcctggtcaggtgtgcag

SEQ ID NO: 7181671 - DNA, 20 bp, Homo sapiens
cctcctggtcaggtgtgcag

SEQ ID NO: 7181672 - DNA, 22 bp, Homo sapiens
tgggagagataggcttctggac

SEQ ID NO: 7181673 - DNA, 22 bp, Homo sapiens
tgggagagataggcttctggac

SEQ ID NO: 7181674 - DNA, 22 bp, Homo sapiens
tgggagagagaattcccagtgg

SEQ ID NO: 7181675 - DNA, 22 bp, Homo sapiens
tgggagagataggcttctggac

SEQ ID NO: 7181676 - DNA, 22 bp, Homo sapiens
tgggagagataggcttctggac

SEQ ID NO: 7181677 - DNA, 22 bp, Homo sapiens
tgggagagcactgcagccccgg

SEQ ID NO: 7181678 - DNA, 22 bp, Homo sapiens
tgggagagaattctggtgactg

SEQ ID NO: 7181679 - DNA, 22 bp, Homo sapiens
tgggagagaattctggtgactg

SEQ ID NO: 7181680 - DNA, 22 bp, Homo sapiens
tgggagagaattctggtgactg

SEQ ID NO: 7181681 - DNA, 22 bp, Homo sapiens
tgggagagaattctggtgactg

SEQ ID NO: 7181682 - DNA, 22 bp, Homo sapiens
tgggagagagaattcccagtgg

SEQ ID NO: 7181683 - DNA, 22 bp, Homo sapiens
tgggagagagaattcccagtgg

SEQ ID NO: 7181684 - DNA, 22 bp, Homo sapiens
tgggacagggaatctgatcccc

SEQ ID NO: 7181685 - DNA, 22 bp, Homo sapiens
tgggacagggaatctgatcccc

SEQ ID NO: 7181686 - DNA, 22 bp, Homo sapiens
tgggacagggaatctgatcccc

SEQ ID NO: 7181687 - DNA, 22 bp, Homo sapiens
tgggacagggaatctgatcccc

SEQ ID NO: 7181688 - DNA, 22 bp, Homo sapiens
tgggagagaataatcaataggt

SEQ ID NO: 7181689 - DNA, 22 bp, Homo sapiens
tgggagagaataatcaataggt

SEQ ID NO: 7181690 - DNA, 22 bp, Homo sapiens
tgggagagaataatcaataggt

SEQ ID NO: 7181691 - DNA, 22 bp, Homo sapiens
tgggagagaataatcaataggt

SEQ ID NO: 7181692 - DNA, 22 bp, Homo sapiens
tgggagagaattctggtgactg

SEQ ID NO: 7181693 - DNA, 22 bp, Homo sapiens
tgggagagaattctggtgactg

SEQ ID NO: 7181694 - DNA, 22 bp, Homo sapiens
tgggagagaattctggtgactg

SEQ ID NO: 7181695 - DNA, 22 bp, Homo sapiens
tgggagagaattctggtgactg

SEQ ID NO: 7181696 - DNA, 22 bp, Homo sapiens
tgggacaggaggcctctggaga

SEQ ID NO: 7181697 - DNA, 22 bp, Homo sapiens
tgggacaggaggcctctggaga

SEQ ID NO: 7181698 - DNA, 22 bp, Homo sapiens
tgggacaggaggcctctggaga

SEQ ID NO: 7181699 - DNA, 22 bp, Homo sapiens
tgggacaggaggcctctggaga

SEQ ID NO: 7181700 - DNA, 22 bp, Homo sapiens
tgggacaggaggcctctggaga

SEQ ID NO: 7181701 - DNA, 22 bp, Homo sapiens
tgggacaggaggcctctggaga

SEQ ID NO: 7181702 - DNA, 22 bp, Homo sapiens
tgggacaggaggcctctggaga

SEQ ID NO: 7181703 - DNA, 22 bp, Homo sapiens
tgggacaggaggcctctggaga

SEQ ID NO: 7181704 - DNA, 22 bp, Homo sapiens
tgggacaggatgaccagaaggt

SEQ ID NO: 7181705 - DNA, 22 bp, Homo sapiens
tgggacaggatgaccagaaggt

SEQ ID NO: 7181706 - DNA, 22 bp, Homo sapiens
tgggacaggatgaccagaaggt

SEQ ID NO: 7181707 - DNA, 22 bp, Homo sapiens
tgggacaggatgaccagaaggt

SEQ ID NO: 7181708 - DNA, 22 bp, Homo sapiens
tgggacaggatgaccagaaggt

SEQ ID NO: 7181709 - DNA, 22 bp, Homo sapiens
tgggacaggatgaccagaaggt

SEQ ID NO: 7181710 - DNA, 22 bp, Homo sapiens
tgggacagagtgagctttggcc

SEQ ID NO: 7181711 - DNA, 22 bp, Homo sapiens
tgggacagagtgagctttggcc

SEQ ID NO: 7181712 - DNA, 22 bp, Homo sapiens
tgggacagagtgagctttggcc

SEQ ID NO: 7181713 - DNA, 22 bp, Homo sapiens
tgggacagagtgagctttggcc

SEQ ID NO: 7181714 - DNA, 22 bp, Homo sapiens
tgggacagagtgagctttggcc

SEQ ID NO: 7181715 - DNA, 22 bp, Homo sapiens
tgggacagattataagtctgca

SEQ ID NO: 7181716 - DNA, 22 bp, Homo sapiens
tgggacagattataagtctgca

SEQ ID NO: 7181717 - DNA, 22 bp, Homo sapiens
tgggacagattataagtctgca

SEQ ID NO: 7181718 - DNA, 22 bp, Homo sapiens
tgggacagattataagtctgca

SEQ ID NO: 7181719 - DNA, 22 bp, Homo sapiens
tgggacaggaggcctctggaga

SEQ ID NO: 7181720 - DNA, 22 bp, Homo sapiens
tgggacaggaggcctctggaga

SEQ ID NO: 7181721 - DNA, 22 bp, Homo sapiens
tgggacaggaggcctctggaga

SEQ ID NO: 7181722 - DNA, 22 bp, Homo sapiens
tgggcagaaggaagagccacct

SEQ ID NO: 7181723 - DNA, 22 bp, Homo sapiens
tgggcagaatgtgggatccaga

SEQ ID NO: 7181724 - DNA, 22 bp, Homo sapiens
tgggcagaatgtgggatccaga

SEQ ID NO: 7181725 - DNA, 22 bp, Homo sapiens
tgggcagaatgtgggatccaga

SEQ ID NO: 7181726 - DNA, 22 bp, Homo sapiens
tgggcagaatgtgggatccaga

SEQ ID NO: 7181727 - DNA, 22 bp, Homo sapiens
tgggcagaatgtgggatccaga

SEQ ID NO: 7181728 - DNA, 22 bp, Homo sapiens
tgggcagaaatcagtatcagat

SEQ ID NO: 7181729 - DNA, 22 bp, Homo sapiens
tgggcagaaggaagagccacct

SEQ ID NO: 7181730 - DNA, 22 bp, Homo sapiens
tgggcagaaggaagagccacct

SEQ ID NO: 7181731 - DNA, 22 bp, Homo sapiens
tgggcacttatcgaaattgagg

SEQ ID NO: 7181732 - DNA, 22 bp, Homo sapiens
tgggcagaaatcagtatcagat

SEQ ID NO: 7181733 - DNA, 22 bp, Homo sapiens
tgggcagaaatcagtatcagat

SEQ ID NO: 7181734 - DNA, 22 bp, Homo sapiens
tgggcagaattgtggtagttaa

SEQ ID NO: 7181735 - DNA, 22 bp, Homo sapiens
tgggcagacattgagtttgttc

SEQ ID NO: 7181736 - DNA, 22 bp, Homo sapiens
tgggcagacgctgttggaaggc

SEQ ID NO: 7181737 - DNA, 22 bp, Homo sapiens
tgggcagacgctgttggaaggc

SEQ ID NO: 7181738 - DNA, 22 bp, Homo sapiens
tgggcagacgggagcttgcctt

SEQ ID NO: 7181739 - DNA, 22 bp, Homo sapiens
tgggcagactaaggtcaaagct

SEQ ID NO: 7181740 - DNA, 22 bp, Homo sapiens
tgggcagactaaggtcaaagct

SEQ ID NO: 7181741 - DNA, 22 bp, Homo sapiens
tgggcactgtgtgtggtaaaat

SEQ ID NO: 7181742 - DNA, 22 bp, Homo sapiens
tgggcactgtgtgtggtaaaat

SEQ ID NO: 7181743 - DNA, 22 bp, Homo sapiens
tgggcactgtagctggtgctgg

SEQ ID NO: 7181744 - DNA, 22 bp, Homo sapiens
tgggcactgtagctggtgctgg

SEQ ID NO: 7181745 - DNA, 22 bp, Homo sapiens
tgggcactggggctccagaggt

SEQ ID NO: 7181746 - DNA, 22 bp, Homo sapiens
tgggcactggaagcctgctgtg

SEQ ID NO: 7181747 - DNA, 22 bp, Homo sapiens
tgggcactgactgttagtgatg

SEQ ID NO: 7181748 - DNA, 21 bp, Homo sapiens
tgggcactgagggtgctgctc

SEQ ID NO: 7181749 - DNA, 22 bp, Homo sapiens
tgggcactgaagctttgagcag

SEQ ID NO: 7181750 - DNA, 22 bp, Homo sapiens
tgggcactcttctgtgcaaaca

SEQ ID NO: 7181751 - DNA, 22 bp, Homo sapiens
tgggagagcactgcagccccgg

SEQ ID NO: 7181752 - DNA, 22 bp, Homo sapiens
tgggagagcactgcagccccgg

SEQ ID NO: 7181753 - DNA, 22 bp, Homo sapiens
tgggagagcactgcagccccgg

SEQ ID NO: 7181754 - DNA, 22 bp, Homo sapiens
tgggagagcactgcagccccgg

SEQ ID NO: 7181755 - DNA, 22 bp, Homo sapiens
tgggagagcagagaaccctctt

SEQ ID NO: 7181756 - DNA, 22 bp, Homo sapiens
tgggagagcagagaaccctctt

SEQ ID NO: 7181757 - DNA, 22 bp, Homo sapiens
tgggagagcagagaaccctctt

SEQ ID NO: 7181758 - DNA, 21 bp, Homo sapiens
tgggagagcgttgctgtcctc

SEQ ID NO: 7181759 - DNA, 21 bp, Homo sapiens
tgggagagcgttgctgtcctc

SEQ ID NO: 7181760 - DNA, 21 bp, Homo sapiens
tgggagagcgttgctgtcctc

SEQ ID NO: 7181761 - DNA, 22 bp, Homo sapiens
tgggataaggtatgtgaagtac

SEQ ID NO: 7181762 - DNA, 22 bp, Homo sapiens
tgggataataaatagaggcaga

SEQ ID NO: 7181763 - DNA, 21 bp, Homo sapiens
tgggatagaaatatggctgct

SEQ ID NO: 7181764 - DNA, 21 bp, Homo sapiens
tgggatagaaatatggctgct

SEQ ID NO: 7181765 - DNA, 22 bp, Homo sapiens
tgggatagaaatttagaacaag

SEQ ID NO: 7181766 - DNA, 23 bp, Homo sapiens
tgggatagaatttcatggctgct

SEQ ID NO: 7181767 - DNA, 23 bp, Homo sapiens
tgggatagaatttcatggctgct

SEQ ID NO: 7181768 - DNA, 22 bp, Homo sapiens
tgctaggaatacacagagcaat

SEQ ID NO: 7181769 - DNA, 22 bp, Homo sapiens
tgctaggagaggcagcacagcg

SEQ ID NO: 7181770 - DNA, 22 bp, Homo sapiens
tgctaggagaggcagcacagcg

SEQ ID NO: 7181771 - DNA, 22 bp, Homo sapiens
tgctagaattaggttaaacaaa

SEQ ID NO: 7181772 - DNA, 22 bp, Homo sapiens
tgctagaagatagctagaagat

SEQ ID NO: 7181773 - DNA, 22 bp, Homo sapiens
tgctagaatacctacctggagg

SEQ ID NO: 7181774 - DNA, 22 bp, Homo sapiens
tgctactcctttgctcgaaatc

SEQ ID NO: 7181775 - DNA, 23 bp, Homo sapiens
tgctactcaaagtgtggtcccag

SEQ ID NO: 7181776 - DNA, 22 bp, Homo sapiens
tgctactcaattcacctgccac

SEQ ID NO: 7181777 - DNA, 19 bp, Homo sapiens
tgctagaaattctgtgact

SEQ ID NO: 7181778 - DNA, 22 bp, Homo sapiens
tgctcagggacaatggagaggg

SEQ ID NO: 7181779 - DNA, 22 bp, Homo sapiens
tgctcagggacaatggagaggg

SEQ ID NO: 7181780 - DNA, 22 bp, Homo sapiens
tgctcaggccctgggccatcct

SEQ ID NO: 7181781 - DNA, 22 bp, Homo sapiens
tgctcaggccctgggccatcct

SEQ ID NO: 7181782 - DNA, 19 bp, Homo sapiens
tgctcaggccaaggagccc

SEQ ID NO: 7181783 - DNA, 19 bp, Homo sapiens
tgctcaggccaaggagccc

SEQ ID NO: 7181784 - DNA, 22 bp, Homo sapiens
tgctcaggaggaggctgtgagg

SEQ ID NO: 7181785 - DNA, 22 bp, Homo sapiens
tgctcaggaggaggctgtgagg

SEQ ID NO: 7181786 - DNA, 22 bp, Homo sapiens
tgctcaggaggaggctgtgagg

SEQ ID NO: 7181787 - DNA, 22 bp, Homo sapiens
tgctagtgtgtgagatgttcaa

SEQ ID NO: 7181788 - DNA, 22 bp, Homo sapiens
tgctcaggaaataatgtctgtg

SEQ ID NO: 7181789 - DNA, 22 bp, Homo sapiens
tgctcaggaaataatgtctgtg

SEQ ID NO: 7181790 - DNA, 22 bp, Homo sapiens
tgcaggtgccatcgctgctcat

SEQ ID NO: 7181791 - DNA, 22 bp, Homo sapiens
tgcaggtgccatcgctgctcat

SEQ ID NO: 7181792 - DNA, 22 bp, Homo sapiens
tgcaggtgcctcttgagcttgt

SEQ ID NO: 7181793 - DNA, 22 bp, Homo sapiens
tgcagggctaagtcagagcctg

SEQ ID NO: 7181794 - DNA, 22 bp, Homo sapiens
tgcagggctacaggactacaac

SEQ ID NO: 7181795 - DNA, 22 bp, Homo sapiens
tgcagggctacaggactacaac

SEQ ID NO: 7181796 - DNA, 22 bp, Homo sapiens
tgcaggtgcctcttgagcttgt

SEQ ID NO: 7181797 - DNA, 22 bp, Homo sapiens
tgcaggtgcgttttcaagcctc

SEQ ID NO: 7181798 - DNA, 22 bp, Homo sapiens
tgcaggtgctccgggggtgccc

SEQ ID NO: 7181799 - DNA, 22 bp, Homo sapiens
tgcaggtgctacaagaactcac

SEQ ID NO: 7181800 - DNA, 22 bp, Homo sapiens
tgcaggtgctccgggggtgccc

SEQ ID NO: 7181801 - DNA, 22 bp, Homo sapiens
tgcaggtgctgatacctactcc

SEQ ID NO: 7181802 - DNA, 22 bp, Homo sapiens
tgcaggtgctgtgtcaagagag

SEQ ID NO: 7181803 - DNA, 22 bp, Homo sapiens
tgctaagctgaggaagatgaga

SEQ ID NO: 7181804 - DNA, 22 bp, Homo sapiens
tgctaaggactgggaggcaggg

SEQ ID NO: 7181805 - DNA, 19 bp, Homo sapiens
tgctaagtcctttagaggc

SEQ ID NO: 7181806 - DNA, 22 bp, Homo sapiens
tgctaatgtcctgaccgttctg

SEQ ID NO: 7181807 - DNA, 22 bp, Homo sapiens
tgctaatgtttcatttttagat

SEQ ID NO: 7181808 - DNA, 22 bp, Homo sapiens
tgctacagagcgggggctcagt

SEQ ID NO: 7181809 - DNA, 22 bp, Homo sapiens
tgctacagagccaggaagagtg

SEQ ID NO: 7181810 - DNA, 22 bp, Homo sapiens
tgctacaaattcgtaatcaatt

SEQ ID NO: 7181811 - DNA, 22 bp, Homo sapiens
tgctacaaattcgtaatcaatt

SEQ ID NO: 7181812 - DNA, 22 bp, Homo sapiens
tgctacaaattcgtaatcaatt

SEQ ID NO: 7181813 - DNA, 22 bp, Homo sapiens
tgctacataccacgatgcagta

SEQ ID NO: 7181814 - DNA, 22 bp, Homo sapiens
tgctacataccacgatgcagta

SEQ ID NO: 7181815 - DNA, 22 bp, Homo sapiens
tgctacataggatagctcaaat

SEQ ID NO: 7181816 - DNA, 22 bp, Homo sapiens
tgctacataggatagctcaaat

SEQ ID NO: 7181817 - DNA, 22 bp, Homo sapiens
tgctacataggatagctcaaat

SEQ ID NO: 7181818 - DNA, 22 bp, Homo sapiens
tgctacatgcactgtgatctag

SEQ ID NO: 7181819 - DNA, 22 bp, Homo sapiens
tgctacattatatggcaaagga

SEQ ID NO: 7181820 - DNA, 22 bp, Homo sapiens
tgctacattatatggcaaagga

SEQ ID NO: 7181821 - DNA, 21 bp, Homo sapiens
tgctacattgctggttatgtt

SEQ ID NO: 7181822 - DNA, 22 bp, Homo sapiens
cccagtgccaggcacaggcagc

SEQ ID NO: 7181823 - DNA, 18 bp, Homo sapiens
cccagtgctcactgcctc

SEQ ID NO: 7181824 - DNA, 22 bp, Homo sapiens
cccagtgctatgcctattacat

SEQ ID NO: 7181825 - DNA, 22 bp, Homo sapiens
cccagtggagataggagtgtgg

SEQ ID NO: 7181826 - DNA, 22 bp, Homo sapiens
cccagtggaaggagtagaagac

SEQ ID NO: 7181827 - DNA, 18 bp, Homo sapiens
cccagtgctcactgcctc

SEQ ID NO: 7181828 - DNA, 22 bp, Homo sapiens
cccagtggagataggagtgtgg

SEQ ID NO: 7181829 - DNA, 22 bp, Homo sapiens
cccagtggcaaagcagcttaga

SEQ ID NO: 7181830 - DNA, 22 bp, Homo sapiens
cccagtggcccagcatgtggtg

SEQ ID NO: 7181831 - DNA, 22 bp, Homo sapiens
cccagtggcccagcatgtggtg

SEQ ID NO: 7181832 - DNA, 22 bp, Homo sapiens
cccagtggcccagcatgtggtg

SEQ ID NO: 7181833 - DNA, 22 bp, Homo sapiens
cccagtggctgtccccatgggc

SEQ ID NO: 7181834 - DNA, 22 bp, Homo sapiens
tgctctgaactgaacttagggt

SEQ ID NO: 7181835 - DNA, 22 bp, Homo sapiens
tgctctgaaggggaagggatgg

SEQ ID NO: 7181836 - DNA, 22 bp, Homo sapiens
tgctctgaaggggaagggatgg

SEQ ID NO: 7181837 - DNA, 22 bp, Homo sapiens
tgctctgaggcacatgccatcg

SEQ ID NO: 7181838 - DNA, 22 bp, Homo sapiens
tgctctgcaagcaggagcaaga

SEQ ID NO: 7181839 - DNA, 22 bp, Homo sapiens
tgctctgcacatccctcacaaa

SEQ ID NO: 7181840 - DNA, 22 bp, Homo sapiens
cccagtgccaggcacaggcagc

SEQ ID NO: 7181841 - DNA, 22 bp, Homo sapiens
cccagtgccaggcacaggcagc

SEQ ID NO: 7181842 - DNA, 19 bp, Homo sapiens
cccagtccttgtcctgggc

SEQ ID NO: 7181843 - DNA, 19 bp, Homo sapiens
cccagtctaggtcctagga

SEQ ID NO: 7181844 - DNA, 22 bp, Homo sapiens
cccagtccagaccatgacctca

SEQ ID NO: 7181845 - DNA, 22 bp, Homo sapiens
cccagtcctaaagcagacgcca

SEQ ID NO: 7181846 - DNA, 22 bp, Homo sapiens
cccagtcctaaagcagacgcca

SEQ ID NO: 7181847 - DNA, 19 bp, Homo sapiens
cccagtccttgtcctgggc

SEQ ID NO: 7181848 - DNA, 19 bp, Homo sapiens
cccagtccttgtcctgggc

SEQ ID NO: 7181849 - DNA, 22 bp, Homo sapiens
tgctcagggagcttcctggtgg

SEQ ID NO: 7181850 - DNA, 22 bp, Homo sapiens
tgctcaggtcgttctgcccctt

SEQ ID NO: 7181851 - DNA, 22 bp, Homo sapiens
tgctcaggtgccttggctgctg

SEQ ID NO: 7181852 - DNA, 22 bp, Homo sapiens
tgctcaggtgccttggctgctg

SEQ ID NO: 7181853 - DNA, 22 bp, Homo sapiens
tgctcaggtgccttggctgctg

SEQ ID NO: 7181854 - DNA, 22 bp, Homo sapiens
cccaggtctcctgcttcccagg

SEQ ID NO: 7181855 - DNA, 22 bp, Homo sapiens
cccaggtctgtgccagctctga

SEQ ID NO: 7181856 - DNA, 22 bp, Homo sapiens
cccaggtctgtgccagctctga

SEQ ID NO: 7181857 - DNA, 22 bp, Homo sapiens
cccagtccaaaagtaggttcta

SEQ ID NO: 7181858 - DNA, 22 bp, Homo sapiens
cccagtccaaaagtaggttcta

SEQ ID NO: 7181859 - DNA, 22 bp, Homo sapiens
cccagtccagaccatgacctca

SEQ ID NO: 7181860 - DNA, 22 bp, Homo sapiens
tgctctggacgctgagtggttt

SEQ ID NO: 7181861 - DNA, 22 bp, Homo sapiens
tgctctggaccatgactatgtg

SEQ ID NO: 7181862 - DNA, 22 bp, Homo sapiens
tgctctggaatagtcctaggca

SEQ ID NO: 7181863 - DNA, 22 bp, Homo sapiens
tgctctggaatagtcctaggca

SEQ ID NO: 7181864 - DNA, 20 bp, Homo sapiens
tgctctggaaatggtctgag

SEQ ID NO: 7181865 - DNA, 20 bp, Homo sapiens
tgctctggaaatggtctgag

SEQ ID NO: 7181866 - DNA, 20 bp, Homo sapiens
tgctctggaaatggtctgag

SEQ ID NO: 7181867 - DNA, 20 bp, Homo sapiens
tgctctggaaatggtctgag

SEQ ID NO: 7181868 - DNA, 22 bp, Homo sapiens
tgctctgcacatccctcacaaa

SEQ ID NO: 7181869 - DNA, 22 bp, Homo sapiens
tgctctgcacatccctcacaaa

SEQ ID NO: 7181870 - DNA, 22 bp, Homo sapiens
tgctctgcacatccctcacaaa

SEQ ID NO: 7181871 - DNA, 19 bp, Homo sapiens
tgctctggagccagctctc

SEQ ID NO: 7181872 - DNA, 22 bp, Homo sapiens
tgctctggagggtgaagctttt

SEQ ID NO: 7181873 - DNA, 22 bp, Homo sapiens
tgctctggacgctgagtggttt

SEQ ID NO: 7181874 - DNA, 19 bp, Homo sapiens
tgctctggagccagctctc

SEQ ID NO: 7181875 - DNA, 19 bp, Homo sapiens
tgctctggagccagctctc

SEQ ID NO: 7181876 - DNA, 22 bp, Homo sapiens
tgctgcaggcaatagaaaacct

SEQ ID NO: 7181877 - DNA, 22 bp, Homo sapiens
tgctgcaggcaatagaaaacct

SEQ ID NO: 7181878 - DNA, 22 bp, Homo sapiens
tgctctggagggtgaagctttt

SEQ ID NO: 7181879 - DNA, 22 bp, Homo sapiens
tgctgcctggtttcttcttgct

SEQ ID NO: 7181880 - DNA, 22 bp, Homo sapiens
tgctgcctgctacgagggaaga

SEQ ID NO: 7181881 - DNA, 22 bp, Homo sapiens
tgctgcctgtgccaggagggtc

SEQ ID NO: 7181882 - DNA, 22 bp, Homo sapiens
tgctgcctgtgccaggagggtc

SEQ ID NO: 7181883 - DNA, 22 bp, Homo sapiens
tgctgcctgttgtggggccacg

SEQ ID NO: 7181884 - DNA, 22 bp, Homo sapiens
tgctgcctgttgtggggccacg

SEQ ID NO: 7181885 - DNA, 22 bp, Homo sapiens
tgctgccttagcagccaggcaa

SEQ ID NO: 7181886 - DNA, 22 bp, Homo sapiens
tgctgccttctaggcgtgccct

SEQ ID NO: 7181887 - DNA, 22 bp, Homo sapiens
tgctgccttctaggcgtgccct

SEQ ID NO: 7181888 - DNA, 22 bp, Homo sapiens
tgctgccttctaggcgtgccct

SEQ ID NO: 7181889 - DNA, 22 bp, Homo sapiens
tgctgccttgacctcctgggct

SEQ ID NO: 7181890 - DNA, 22 bp, Homo sapiens
tgctgccttgacctcctgggct

SEQ ID NO: 7181891 - DNA, 22 bp, Homo sapiens
tgctgcctttactgggatttaa

SEQ ID NO: 7181892 - DNA, 22 bp, Homo sapiens
tgctgcctttctgaatggtgga

SEQ ID NO: 7181893 - DNA, 22 bp, Homo sapiens
tgctgggggctttctggatacc

SEQ ID NO: 7181894 - DNA, 22 bp, Homo sapiens
tgctgggggctttctggatacc

SEQ ID NO: 7181895 - DNA, 22 bp, Homo sapiens
tgctgggggtagctctgcgtag

SEQ ID NO: 7181896 - DNA, 22 bp, Homo sapiens
tgctgggggtagctctgcgtag

SEQ ID NO: 7181897 - DNA, 22 bp, Homo sapiens
tgctggggctctgaccactcca

SEQ ID NO: 7181898 - DNA, 22 bp, Homo sapiens
tgctgggggctttctggatacc

SEQ ID NO: 7181899 - DNA, 22 bp, Homo sapiens
tgctgggggctttctggatacc

SEQ ID NO: 7181900 - DNA, 22 bp, Homo sapiens
tgctgggggctttctggatacc

SEQ ID NO: 7181901 - DNA, 22 bp, Homo sapiens
tgctgggggctttctggatacc

SEQ ID NO: 7181902 - DNA, 22 bp, Homo sapiens
tgctgggggtgtctcaccaggc

SEQ ID NO: 7181903 - DNA, 22 bp, Homo sapiens
tgctgggggtgtctcaccaggc

SEQ ID NO: 7181904 - DNA, 22 bp, Homo sapiens
tgctgggggttcagatgagtaa

SEQ ID NO: 7181905 - DNA, 22 bp, Homo sapiens
tgctgggggttcagatgagtaa

SEQ ID NO: 7181906 - DNA, 22 bp, Homo sapiens
tgctgggggttcagatgagtaa

SEQ ID NO: 7181907 - DNA, 22 bp, Homo sapiens
tgctgggggtagctctgcgtag

SEQ ID NO: 7181908 - DNA, 22 bp, Homo sapiens
tgctgggggtgtctcaccaggc

SEQ ID NO: 7181909 - DNA, 22 bp, Homo sapiens
tgctgggggtgtctcaccaggc

SEQ ID NO: 7181910 - DNA, 22 bp, Homo sapiens
tgctgggggtgtctcaccaggc

SEQ ID NO: 7181911 - DNA, 23 bp, Homo sapiens
tgctggggtagtttgtggcacag

SEQ ID NO: 7181912 - DNA, 18 bp, Homo sapiens
tgctggggtagaatccac

SEQ ID NO: 7181913 - DNA, 18 bp, Homo sapiens
tgctggggtagaatccac

SEQ ID NO: 7181914 - DNA, 18 bp, Homo sapiens
tgctggggtagaatccac

SEQ ID NO: 7181915 - DNA, 18 bp, Homo sapiens
tgctggggtagaatccac

SEQ ID NO: 7181916 - DNA, 23 bp, Homo sapiens
tgctggggtagtttgtggcacag

SEQ ID NO: 7181917 - DNA, 22 bp, Homo sapiens
tgctgggggttcagatgagtaa

SEQ ID NO: 7181918 - DNA, 22 bp, Homo sapiens
tgctgggggttcagatgagtaa

SEQ ID NO: 7181919 - DNA, 18 bp, Homo sapiens
tgctggggtagaatccac

SEQ ID NO: 7181920 - DNA, 22 bp, Homo sapiens
tgctgggggttcagatgagtaa

SEQ ID NO: 7181921 - DNA, 22 bp, Homo sapiens
tgctgggggttcagatgagtaa

SEQ ID NO: 7181922 - DNA, 18 bp, Homo sapiens
tgctggggtagaatccac

SEQ ID NO: 7181923 - DNA, 22 bp, Homo sapiens
ccccagctgcatacttgccaag

SEQ ID NO: 7181924 - DNA, 22 bp, Homo sapiens
ccccaggaagcctcagatttgc

SEQ ID NO: 7181925 - DNA, 22 bp, Homo sapiens
ccccaggacacatggaccaagt

SEQ ID NO: 7181926 - DNA, 22 bp, Homo sapiens
ccccaggacacatggaccaagt

SEQ ID NO: 7181927 - DNA, 22 bp, Homo sapiens
ccccagctcagtgcagggacat

SEQ ID NO: 7181928 - DNA, 22 bp, Homo sapiens
ccccagctgagatttgaggaga

SEQ ID NO: 7181929 - DNA, 22 bp, Homo sapiens
ccccagctgcatacttgccaag

SEQ ID NO: 7181930 - DNA, 22 bp, Homo sapiens
cccagtggtgctggcatctgtg

SEQ ID NO: 7181931 - DNA, 22 bp, Homo sapiens
cccagtggtgctggcatctgtg

SEQ ID NO: 7181932 - DNA, 22 bp, Homo sapiens
cccagtggtttgcagaaccaag

SEQ ID NO: 7181933 - DNA, 22 bp, Homo sapiens
cccagtggtgctggcatctgtg

SEQ ID NO: 7181934 - DNA, 22 bp, Homo sapiens
cccagtgggtcactgcatctca

SEQ ID NO: 7181935 - DNA, 22 bp, Homo sapiens
tgctgcctttgggacctggcct

SEQ ID NO: 7181936 - DNA, 22 bp, Homo sapiens
tgctgcctttgtggggtcactg

SEQ ID NO: 7181937 - DNA, 22 bp, Homo sapiens
tgctgcctttgtggggtcactg

SEQ ID NO: 7181938 - DNA, 22 bp, Homo sapiens
tgctgctcacacacagtgaatg

SEQ ID NO: 7181939 - DNA, 22 bp, Homo sapiens
tgctgctccccagcacacagca

SEQ ID NO: 7181940 - DNA, 22 bp, Homo sapiens
cccagtggcttttgcccaggtt

SEQ ID NO: 7181941 - DNA, 22 bp, Homo sapiens
cccagttgttgccggctctgga

SEQ ID NO: 7181942 - DNA, 22 bp, Homo sapiens
cccagttgttgccggctctgga

SEQ ID NO: 7181943 - DNA, 22 bp, Homo sapiens
cccagttgttgccggctctgga

SEQ ID NO: 7181944 - DNA, 22 bp, Homo sapiens
cccagttgttgccggctctgga

SEQ ID NO: 7181945 - DNA, 22 bp, Homo sapiens
tgctgggcacacagtaggtgct

SEQ ID NO: 7181946 - DNA, 22 bp, Homo sapiens
tgctgggcaccagtgcctgcag

SEQ ID NO: 7181947 - DNA, 22 bp, Homo sapiens
tgctgggcaccagtgcctgcag

SEQ ID NO: 7181948 - DNA, 22 bp, Homo sapiens
tgctgggcaccagtgcctgcag

SEQ ID NO: 7181949 - DNA, 22 bp, Homo sapiens
tgctgggcaccagtgcctgcag

SEQ ID NO: 7181950 - DNA, 22 bp, Homo sapiens
tgctgggcactgtctaggtact

SEQ ID NO: 7181951 - DNA, 22 bp, Homo sapiens
tgctgggcactgtctaggtact

SEQ ID NO: 7181952 - DNA, 22 bp, Homo sapiens
tgctggggctctgaccactcca

SEQ ID NO: 7181953 - DNA, 22 bp, Homo sapiens
cccagtgtctcttgtgcctttc

SEQ ID NO: 7181954 - DNA, 22 bp, Homo sapiens
cccagtgtctgggcctgcaggg

SEQ ID NO: 7181955 - DNA, 22 bp, Homo sapiens
ccctccctctgctgggtgtaga

SEQ ID NO: 7181956 - DNA, 22 bp, Homo sapiens
ccctccctatgtagatgatgtt

SEQ ID NO: 7181957 - DNA, 22 bp, Homo sapiens
ccctccctatgtagatgatgtt

SEQ ID NO: 7181958 - DNA, 22 bp, Homo sapiens
ccctccccacaaagcttcacac

SEQ ID NO: 7181959 - DNA, 22 bp, Homo sapiens
ccctccccagggtcatattgaa

SEQ ID NO: 7181960 - DNA, 22 bp, Homo sapiens
ccctccccagggtcatattgaa

SEQ ID NO: 7181961 - DNA, 22 bp, Homo sapiens
ccctccccagggtcatattgaa

SEQ ID NO: 7181962 - DNA, 22 bp, Homo sapiens
ccctccccagggtcatattgaa

SEQ ID NO: 7181963 - DNA, 22 bp, Homo sapiens
ccctccagtgtcccagtgggga

SEQ ID NO: 7181964 - DNA, 22 bp, Homo sapiens
ccctccagtgtcccagtgggga

SEQ ID NO: 7181965 - DNA, 22 bp, Homo sapiens
ccctccccacaaagcttcacac

SEQ ID NO: 7181966 - DNA, 22 bp, Homo sapiens
ccctccccacaaagcttcacac

SEQ ID NO: 7181967 - DNA, 22 bp, Homo sapiens
ccctccccacaaagcttcacac

SEQ ID NO: 7181968 - DNA, 22 bp, Homo sapiens
tgcttgtcaggataagctctgg

SEQ ID NO: 7181969 - DNA, 20 bp, Homo sapiens
tgcttgtcatgcactcaggc

SEQ ID NO: 7181970 - DNA, 22 bp, Homo sapiens
tgcttgtccgaggtgagtactt

SEQ ID NO: 7181971 - DNA, 22 bp, Homo sapiens
tgcttgggaatgtggagtcaga

SEQ ID NO: 7181972 - DNA, 22 bp, Homo sapiens
tgcttgggaatgtggagtcaga

SEQ ID NO: 7181973 - DNA, 22 bp, Homo sapiens
tgcttgggcggccagcatggcg

SEQ ID NO: 7181974 - DNA, 22 bp, Homo sapiens
tgcttgtattcatatcacagct

SEQ ID NO: 7181975 - DNA, 22 bp, Homo sapiens
tgcttgtcacatacaggagcat

SEQ ID NO: 7181976 - DNA, 22 bp, Homo sapiens
tgcttgtcaccctgcctgagtg

SEQ ID NO: 7181977 - DNA, 22 bp, Homo sapiens
tgcttggctaaaaatggcaaga

SEQ ID NO: 7181978 - DNA, 18 bp, Homo sapiens
tgcttggagcatttacca

SEQ ID NO: 7181979 - DNA, 22 bp, Homo sapiens
tgcttggctagcttggcagctc

SEQ ID NO: 7181980 - DNA, 22 bp, Homo sapiens
tgcttgctgggccaatggcaat

SEQ ID NO: 7181981 - DNA, 22 bp, Homo sapiens
tgcttcctatccacacaatgcc

SEQ ID NO: 7181982 - DNA, 19 bp, Homo sapiens
tgcttcctcaccatctccc

SEQ ID NO: 7181983 - DNA, 22 bp, Homo sapiens
tgcttccgctaaaaattaatcc

SEQ ID NO: 7181984 - DNA, 22 bp, Homo sapiens
tgcttcctgctaaggctgcctg

SEQ ID NO: 7181985 - DNA, 19 bp, Homo sapiens
tgcttcctcaccatctccc

SEQ ID NO: 7181986 - DNA, 22 bp, Homo sapiens
tgcttcctgctaaggctgcctg

SEQ ID NO: 7181987 - DNA, 20 bp, Homo sapiens
tgcttcctggccactgcggg

SEQ ID NO: 7181988 - DNA, 22 bp, Homo sapiens
tgcttccttgagctctccaatc

SEQ ID NO: 7181989 - DNA, 22 bp, Homo sapiens
tgcttccttcccgttcttctcc

SEQ ID NO: 7181990 - DNA, 22 bp, Homo sapiens
tgcttccttgatcattcccaaa

SEQ ID NO: 7181991 - DNA, 22 bp, Homo sapiens
ccccaggagaaatcttaaacta

SEQ ID NO: 7181992 - DNA, 22 bp, Homo sapiens
ccccaggagaaatcttaaacta

SEQ ID NO: 7181993 - DNA, 22 bp, Homo sapiens
ccccaggagatttgggagcaca

SEQ ID NO: 7181994 - DNA, 22 bp, Homo sapiens
ccccaggacgtggccctcatag

SEQ ID NO: 7181995 - DNA, 22 bp, Homo sapiens
ccccaggacgtggccctcatag

SEQ ID NO: 7181996 - DNA, 16 bp, Homo sapiens
ccccaggacttggcac

SEQ ID NO: 7181997 - DNA, 22 bp, Homo sapiens
tgcttccctgctctgcacacct

SEQ ID NO: 7181998 - DNA, 22 bp, Homo sapiens
tgcttccctgctctgcacacct

SEQ ID NO: 7181999 - DNA, 22 bp, Homo sapiens
tgctgtttgagcttattttcag

SEQ ID NO: 7182000 - DNA, 22 bp, Homo sapiens
tgctgtttcattttcctcatcc

SEQ ID NO: 7182001 - DNA, 22 bp, Homo sapiens
tgctgtttgccaagatcacttt

SEQ ID NO: 7182002 - DNA, 22 bp, Homo sapiens
tgcttaaaaacagtatggtagt

SEQ ID NO: 7182003 - DNA, 22 bp, Homo sapiens
tgctgttatcacattttgtaaa

SEQ ID NO: 7182004 - DNA, 22 bp, Homo sapiens
ccccaggagatttgggagcaca

SEQ ID NO: 7182005 - DNA, 22 bp, Homo sapiens
ccccaggagcttgttttagaga

SEQ ID NO: 7182006 - DNA, 22 bp, Homo sapiens
ccccaggcagggcctaacagag

SEQ ID NO: 7182007 - DNA, 22 bp, Homo sapiens
ccccaggcagggcctaacagag

SEQ ID NO: 7182008 - DNA, 22 bp, Homo sapiens
tggcacagtgctggatggtgct

SEQ ID NO: 7182009 - DNA, 22 bp, Homo sapiens
tggcacagtgctggatggtgct

SEQ ID NO: 7182010 - DNA, 22 bp, Homo sapiens
tggcacagtgctggatggtgct

SEQ ID NO: 7182011 - DNA, 22 bp, Homo sapiens
tggcacttgatatttgatttgc

SEQ ID NO: 7182012 - DNA, 22 bp, Homo sapiens
tggcacttggctgagaggttct

SEQ ID NO: 7182013 - DNA, 22 bp, Homo sapiens
ccctggagtgtgacgaggcatt

SEQ ID NO: 7182014 - DNA, 22 bp, Homo sapiens
ccctggagtgtgacgaggcatt

SEQ ID NO: 7182015 - DNA, 22 bp, Homo sapiens
tggcagaagtacacaagcatgc

SEQ ID NO: 7182016 - DNA, 22 bp, Homo sapiens
tggcagaatgaagactggggcc

SEQ ID NO: 7182017 - DNA, 22 bp, Homo sapiens
tggcacttggtaaatatgtgtt

SEQ ID NO: 7182018 - DNA, 22 bp, Homo sapiens
tggcagagaacacacatgattc

SEQ ID NO: 7182019 - DNA, 22 bp, Homo sapiens
tggcagactttagggtctacat

SEQ ID NO: 7182020 - DNA, 19 bp, Homo sapiens
tggcagacacaccttcttc

SEQ ID NO: 7182021 - DNA, 21 bp, Homo sapiens
tggcagacaggaggagctcac

SEQ ID NO: 7182022 - DNA, 22 bp, Homo sapiens
tggcagaattttaaagacagat

SEQ ID NO: 7182023 - DNA, 22 bp, Homo sapiens
tggcagaattttaaagacagat

SEQ ID NO: 7182024 - DNA, 22 bp, Homo sapiens
tggcagagaacacacatgattc

SEQ ID NO: 7182025 - DNA, 22 bp, Homo sapiens
tggcagagaacacacatgattc

SEQ ID NO: 7182026 - DNA, 22 bp, Homo sapiens
ccctggctgcgtgatggatgaa

SEQ ID NO: 7182027 - DNA, 22 bp, Homo sapiens
ccctggctgctaccaggtagct

SEQ ID NO: 7182028 - DNA, 22 bp, Homo sapiens
ccctggctgctaccaggtagct

SEQ ID NO: 7182029 - DNA, 22 bp, Homo sapiens
ccctggctgcttgtagtctggc

SEQ ID NO: 7182030 - DNA, 22 bp, Homo sapiens
ccctggctgcttgtagtctggc

SEQ ID NO: 7182031 - DNA, 22 bp, Homo sapiens
ccctggctgcttgtagtctggc

SEQ ID NO: 7182032 - DNA, 22 bp, Homo sapiens
ccctggaggttgaggctgcagt

SEQ ID NO: 7182033 - DNA, 22 bp, Homo sapiens
ccctggaggtggaggttgcagg

SEQ ID NO: 7182034 - DNA, 22 bp, Homo sapiens
ccctggaggtggaggttgcagg

SEQ ID NO: 7182035 - DNA, 22 bp, Homo sapiens
ccctggaggttgaggctgcagt

SEQ ID NO: 7182036 - DNA, 22 bp, Homo sapiens
ccctggaggttgaggctgcagt

SEQ ID NO: 7182037 - DNA, 22 bp, Homo sapiens
ccctggaggttgaggctgcagt

SEQ ID NO: 7182038 - DNA, 22 bp, Homo sapiens
ccctggaggtggaggttgcagg

SEQ ID NO: 7182039 - DNA, 22 bp, Homo sapiens
ccctggaggtcagaggcctggg

SEQ ID NO: 7182040 - DNA, 22 bp, Homo sapiens
ccctggaggtcagaggcctggg

SEQ ID NO: 7182041 - DNA, 22 bp, Homo sapiens
ccctggagggcagacagatgcc

SEQ ID NO: 7182042 - DNA, 22 bp, Homo sapiens
ccctggagggcagacagatgcc

SEQ ID NO: 7182043 - DNA, 22 bp, Homo sapiens
ccctggagggcagacagatgcc

SEQ ID NO: 7182044 - DNA, 22 bp, Homo sapiens
ccctggagggcagacagatgcc

SEQ ID NO: 7182045 - DNA, 22 bp, Homo sapiens
ccctggagggcagacagatgcc

SEQ ID NO: 7182046 - DNA, 22 bp, Homo sapiens
ccctggaggtcagaggcctggg

SEQ ID NO: 7182047 - DNA, 22 bp, Homo sapiens
ccctggaggtcagaggcctggg

SEQ ID NO: 7182048 - DNA, 23 bp, Homo sapiens
ccctggagtaaattcttggaagg

SEQ ID NO: 7182049 - DNA, 23 bp, Homo sapiens
ccctggagtaaattcttggaagg

SEQ ID NO: 7182050 - DNA, 23 bp, Homo sapiens
ccctggagtaaattcttggaagg

SEQ ID NO: 7182051 - DNA, 23 bp, Homo sapiens
ccctggagtaaattcttggaagg

SEQ ID NO: 7182052 - DNA, 22 bp, Homo sapiens
ccctggagtagcactgggtcgc

SEQ ID NO: 7182053 - DNA, 22 bp, Homo sapiens
ccctggagtagcactgggtcgc

SEQ ID NO: 7182054 - DNA, 22 bp, Homo sapiens
ccctggagtagcactgggtcgc

SEQ ID NO: 7182055 - DNA, 22 bp, Homo sapiens
ccctggagtagcactgggtcgc

SEQ ID NO: 7182056 - DNA, 22 bp, Homo sapiens
ccctggagtagcactgggtcgc

SEQ ID NO: 7182057 - DNA, 22 bp, Homo sapiens
ccctggagtagcactgggtcgc

SEQ ID NO: 7182058 - DNA, 22 bp, Homo sapiens
ccctggagtagcactgggtcgc

SEQ ID NO: 7182059 - DNA, 22 bp, Homo sapiens
ccctggagtcaggttggcctgg

SEQ ID NO: 7182060 - DNA, 22 bp, Homo sapiens
ccctggagtcaggttggcctgg

SEQ ID NO: 7182061 - DNA, 22 bp, Homo sapiens
ccctggagtccggagctcacct

SEQ ID NO: 7182062 - DNA, 22 bp, Homo sapiens
ccctggagtccggagctcacct

SEQ ID NO: 7182063 - DNA, 22 bp, Homo sapiens
ccctggagtccggagctcacct

SEQ ID NO: 7182064 - DNA, 22 bp, Homo sapiens
ccctggagtccggagctcacct

SEQ ID NO: 7182065 - DNA, 22 bp, Homo sapiens
ccctggagtcctggcagttgat

SEQ ID NO: 7182066 - DNA, 22 bp, Homo sapiens
ccctggagtcctggcagttgat

SEQ ID NO: 7182067 - DNA, 22 bp, Homo sapiens
ccctggagtcctggcagttgat

SEQ ID NO: 7182068 - DNA, 22 bp, Homo sapiens
ccctggagtcctggcagttgat

SEQ ID NO: 7182069 - DNA, 22 bp, Homo sapiens
ccctggagtgccggaatcaaga

SEQ ID NO: 7182070 - DNA, 22 bp, Homo sapiens
ccctggagtgccggaatcaaga

SEQ ID NO: 7182071 - DNA, 22 bp, Homo sapiens
ccctggagtgccggaatcaaga

SEQ ID NO: 7182072 - DNA, 22 bp, Homo sapiens
ccctggagtgccggaatcaaga

SEQ ID NO: 7182073 - DNA, 22 bp, Homo sapiens
ccctggagtgccggaatcaaga

SEQ ID NO: 7182074 - DNA, 22 bp, Homo sapiens
ccctggagtgtgacgaggcatt

SEQ ID NO: 7182075 - DNA, 22 bp, Homo sapiens
ccctggagtgtgacgaggcatt

SEQ ID NO: 7182076 - DNA, 22 bp, Homo sapiens
tggcaggtagtcagaggcgaca

SEQ ID NO: 7182077 - DNA, 22 bp, Homo sapiens
ccctttagcccctgcagagact

SEQ ID NO: 7182078 - DNA, 22 bp, Homo sapiens
ccctttaagtcctggaacaaag

SEQ ID NO: 7182079 - DNA, 22 bp, Homo sapiens
ccctttaattccaacacaggaa

SEQ ID NO: 7182080 - DNA, 23 bp, Homo sapiens
ccctttaagatttgaatagtcag

SEQ ID NO: 7182081 - DNA, 20 bp, Homo sapiens
ccctttaagctttagtatgc

SEQ ID NO: 7182082 - DNA, 22 bp, Homo sapiens
ccctttaaggtctgattttcag

SEQ ID NO: 7182083 - DNA, 22 bp, Homo sapiens
ccctttaagtagaatatattat

SEQ ID NO: 7182084 - DNA, 22 bp, Homo sapiens
cccttggaaggtagctggcagt

SEQ ID NO: 7182085 - DNA, 22 bp, Homo sapiens
cccttggaaggtagctggcagt

SEQ ID NO: 7182086 - DNA, 22 bp, Homo sapiens
cccttggggtggaggttgcagt

SEQ ID NO: 7182087 - DNA, 22 bp, Homo sapiens
cccttgcatcccatgtgtggcc

SEQ ID NO: 7182088 - DNA, 21 bp, Homo sapiens
cccttgcctgcactcctcggc

SEQ ID NO: 7182089 - DNA, 22 bp, Homo sapiens
cccttgctgccacagctgccca

SEQ ID NO: 7182090 - DNA, 22 bp, Homo sapiens
cccttgctgccacagctgccca

SEQ ID NO: 7182091 - DNA, 22 bp, Homo sapiens
tggcagggagccaccggtcatg

SEQ ID NO: 7182092 - DNA, 22 bp, Homo sapiens
tggcagggagccaccggtcatg

SEQ ID NO: 7182093 - DNA, 22 bp, Homo sapiens
tggcagggagccaccggtcatg

SEQ ID NO: 7182094 - DNA, 22 bp, Homo sapiens
tggcagggagccaccggtcatg

SEQ ID NO: 7182095 - DNA, 22 bp, Homo sapiens
cccttgaagactagaatgagga

SEQ ID NO: 7182096 - DNA, 22 bp, Homo sapiens
tggcagggagccaccggtcatg

SEQ ID NO: 7182097 - DNA, 22 bp, Homo sapiens
cccttgaggtagactgaacacc

SEQ ID NO: 7182098 - DNA, 19 bp, Homo sapiens
tggcagggagagtttgaag

SEQ ID NO: 7182099 - DNA, 19 bp, Homo sapiens
tggcagggagagtttgaag

SEQ ID NO: 7182100 - DNA, 19 bp, Homo sapiens
tggcagggagagtttgaag

SEQ ID NO: 7182101 - DNA, 19 bp, Homo sapiens
tggcagggagagtttgaag

SEQ ID NO: 7182102 - DNA, 19 bp, Homo sapiens
tggcagggagagtttgaag

SEQ ID NO: 7182103 - DNA, 22 bp, Homo sapiens
tggcagggaatacagatgttta

SEQ ID NO: 7182104 - DNA, 22 bp, Homo sapiens
tggcagggaatacagatgttta

SEQ ID NO: 7182105 - DNA, 22 bp, Homo sapiens
tggcagggaatacagatgttta

SEQ ID NO: 7182106 - DNA, 22 bp, Homo sapiens
tggcagggaatacagatgttta

SEQ ID NO: 7182107 - DNA, 22 bp, Homo sapiens
tggcagggaatacagatgttta

SEQ ID NO: 7182108 - DNA, 22 bp, Homo sapiens
tggcaggctgagttggcctggt

SEQ ID NO: 7182109 - DNA, 22 bp, Homo sapiens
tggcaggctgagttggcctggt

SEQ ID NO: 7182110 - DNA, 22 bp, Homo sapiens
tggcaggctgagttggcctggt

SEQ ID NO: 7182111 - DNA, 22 bp, Homo sapiens
tggcaggcggaggttgcagtga

SEQ ID NO: 7182112 - DNA, 22 bp, Homo sapiens
tggcaggcgggagccatagagg

SEQ ID NO: 7182113 - DNA, 22 bp, Homo sapiens
tggcaggctctgagtagcacct

SEQ ID NO: 7182114 - DNA, 22 bp, Homo sapiens
tggcaggctctgagtagcacct

SEQ ID NO: 7182115 - DNA, 22 bp, Homo sapiens
tggcaggctgagttggcctggt

SEQ ID NO: 7182116 - DNA, 22 bp, Homo sapiens
tggcaggctgagttggcctggt

SEQ ID NO: 7182117 - DNA, 19 bp, Homo sapiens
tggcaggcccaggatggac

SEQ ID NO: 7182118 - DNA, 19 bp, Homo sapiens
tggcaggcccaggatggac

SEQ ID NO: 7182119 - DNA, 19 bp, Homo sapiens
tggcaggcccaggatggac

SEQ ID NO: 7182120 - DNA, 19 bp, Homo sapiens
tggcaggcccaggatggac

SEQ ID NO: 7182121 - DNA, 19 bp, Homo sapiens
tggcaggcccaggatggac

SEQ ID NO: 7182122 - DNA, 19 bp, Homo sapiens
tggcaggcccaggatggac

SEQ ID NO: 7182123 - DNA, 22 bp, Homo sapiens
tggcaggaaaaacattggagat

SEQ ID NO: 7182124 - DNA, 22 bp, Homo sapiens
tggcaggaaaaacattggagat

SEQ ID NO: 7182125 - DNA, 22 bp, Homo sapiens
ccctgggagtccactgatgtca

SEQ ID NO: 7182126 - DNA, 22 bp, Homo sapiens
ccctgggagaagttgagggctg

SEQ ID NO: 7182127 - DNA, 22 bp, Homo sapiens
ccctgggagctgcctggctgac

SEQ ID NO: 7182128 - DNA, 22 bp, Homo sapiens
ccctgggaggcttccaggcaga

SEQ ID NO: 7182129 - DNA, 22 bp, Homo sapiens
ccctgggacccgctgcagaggc

SEQ ID NO: 7182130 - DNA, 22 bp, Homo sapiens
ccctgggagaagttgagggctg

SEQ ID NO: 7182131 - DNA, 22 bp, Homo sapiens
ccctggctgcttgtagtctggc

SEQ ID NO: 7182132 - DNA, 22 bp, Homo sapiens
ccctggctggaaattaagtagt

SEQ ID NO: 7182133 - DNA, 22 bp, Homo sapiens
ccctggctggaaattaagtagt

SEQ ID NO: 7182134 - DNA, 22 bp, Homo sapiens
ccctggctggctctgcccggac

SEQ ID NO: 7182135 - DNA, 22 bp, Homo sapiens
ccctggcttaaaaacctcatat

SEQ ID NO: 7182136 - DNA, 22 bp, Homo sapiens
ccctggcttaaaaacctcatat

SEQ ID NO: 7182137 - DNA, 22 bp, Homo sapiens
ccctggcttggcactctccact

SEQ ID NO: 7182138 - DNA, 22 bp, Homo sapiens
ccctggcttggcactctccact

SEQ ID NO: 7182139 - DNA, 22 bp, Homo sapiens
ccctgggaagtattccagctat

SEQ ID NO: 7182140 - DNA, 22 bp, Homo sapiens
ccctgggaagtattccagctat

SEQ ID NO: 7182141 - DNA, 22 bp, Homo sapiens
ccctgggaagtattccagctat

SEQ ID NO: 7182142 - DNA, 22 bp, Homo sapiens
ccctgggacccgctgcagaggc

SEQ ID NO: 7182143 - DNA, 22 bp, Homo sapiens
ccctgggacccgctgcagaggc

SEQ ID NO: 7182144 - DNA, 22 bp, Homo sapiens
ccctccctttgcagcagtgcat

SEQ ID NO: 7182145 - DNA, 22 bp, Homo sapiens
ccctccctttgcagcagtgcat

SEQ ID NO: 7182146 - DNA, 22 bp, Homo sapiens
ccctccctgtgtgcctcatttg

SEQ ID NO: 7182147 - DNA, 22 bp, Homo sapiens
ccctcccttccaagttgaggac

SEQ ID NO: 7182148 - DNA, 22 bp, Homo sapiens
ccctcccttccaagttgaggac

SEQ ID NO: 7182149 - DNA, 22 bp, Homo sapiens
ccctcccttccaagttgaggac

SEQ ID NO: 7182150 - DNA, 22 bp, Homo sapiens
ccctccctgtgtgcctcatttg

SEQ ID NO: 7182151 - DNA, 22 bp, Homo sapiens
ccctccctgtgtgcctcatttg

SEQ ID NO: 7182152 - DNA, 22 bp, Homo sapiens
ccctccctgtgtgcctcatttg

SEQ ID NO: 7182153 - DNA, 22 bp, Homo sapiens
ccctccctgaagaagttactct

SEQ ID NO: 7182154 - DNA, 22 bp, Homo sapiens
ccctccctgaagaagttactct

SEQ ID NO: 7182155 - DNA, 22 bp, Homo sapiens
ccctccctgaagaagttactct

SEQ ID NO: 7182156 - DNA, 22 bp, Homo sapiens
ccctcctcaactctggcttcca

SEQ ID NO: 7182157 - DNA, 22 bp, Homo sapiens
ccctccctttgcagcagtgcat

SEQ ID NO: 7182158 - DNA, 22 bp, Homo sapiens
ccctccctttgtctttatgaac

SEQ ID NO: 7182159 - DNA, 22 bp, Homo sapiens
ccctccctttgtctttatgaac

SEQ ID NO: 7182160 - DNA, 22 bp, Homo sapiens
ccctccctttgtctttatgaac

SEQ ID NO: 7182161 - DNA, 22 bp, Homo sapiens
ccctcctcaactctggcttcca

SEQ ID NO: 7182162 - DNA, 22 bp, Homo sapiens
ccctcctcaactctggcttcca

SEQ ID NO: 7182163 - DNA, 22 bp, Homo sapiens
ccctcctcaactctggcttcca

SEQ ID NO: 7182164 - DNA, 23 bp, Homo sapiens
tggaaacattctgaatgtccatc

SEQ ID NO: 7182165 - DNA, 23 bp, Homo sapiens
tggaaacattctgaatgtccatc

SEQ ID NO: 7182166 - DNA, 22 bp, Homo sapiens
tggaaactgtggtatttcttta

SEQ ID NO: 7182167 - DNA, 23 bp, Homo sapiens
tggaaacttaagggggagatgtc

SEQ ID NO: 7182168 - DNA, 19 bp, Homo sapiens
tggaaactcctgatattag

SEQ ID NO: 7182169 - DNA, 22 bp, Homo sapiens
tggaaactctacctctctaaga

SEQ ID NO: 7182170 - DNA, 22 bp, Homo sapiens
tggaaactgggagttaaatgta

SEQ ID NO: 7182171 - DNA, 22 bp, Homo sapiens
tggaaactaggatggaagaaat

SEQ ID NO: 7182172 - DNA, 22 bp, Homo sapiens
tggaaactataaaagcaccttc

SEQ ID NO: 7182173 - DNA, 22 bp, Homo sapiens
tggaaactagagagtttgtatt

SEQ ID NO: 7182174 - DNA, 22 bp, Homo sapiens
tggaaacctactgatacaggag

SEQ ID NO: 7182175 - DNA, 22 bp, Homo sapiens
tggaaacctgtcattggatcca

SEQ ID NO: 7182176 - DNA, 22 bp, Homo sapiens
tggaaactaacaacagagcaga

SEQ ID NO: 7182177 - DNA, 22 bp, Homo sapiens
tggagatgaacatggtgatgtt

SEQ ID NO: 7182178 - DNA, 22 bp, Homo sapiens
tggagatgaacatggtgatgtt

SEQ ID NO: 7182179 - DNA, 22 bp, Homo sapiens
tggagatgaatatgtgtacctg

SEQ ID NO: 7182180 - DNA, 22 bp, Homo sapiens
tggagatgaatatgtgtacctg

SEQ ID NO: 7182181 - DNA, 22 bp, Homo sapiens
tggagatgaggacatggacgtc

SEQ ID NO: 7182182 - DNA, 22 bp, Homo sapiens
tggagatgaggacatggacgtc

SEQ ID NO: 7182183 - DNA, 22 bp, Homo sapiens
tggagatgaggacatggacgtc

SEQ ID NO: 7182184 - DNA, 22 bp, Homo sapiens
tggagagaaaaaagacagttct

SEQ ID NO: 7182185 - DNA, 22 bp, Homo sapiens
tggagagtttagcctactggaa

SEQ ID NO: 7182186 - DNA, 22 bp, Homo sapiens
tggagatgaacatggtgatgtt

SEQ ID NO: 7182187 - DNA, 22 bp, Homo sapiens
tggagactctgcatctgtgaca

SEQ ID NO: 7182188 - DNA, 22 bp, Homo sapiens
tggagactctgcatctgtgaca

SEQ ID NO: 7182189 - DNA, 22 bp, Homo sapiens
tggagacatttctcattaaaaa

SEQ ID NO: 7182190 - DNA, 22 bp, Homo sapiens
tggagacctctacccatctcct

SEQ ID NO: 7182191 - DNA, 22 bp, Homo sapiens
tggagactcagaaggggaagca

SEQ ID NO: 7182192 - DNA, 22 bp, Homo sapiens
tggagactgactgcctgtattt

SEQ ID NO: 7182193 - DNA, 22 bp, Homo sapiens
tggagactgactgcctgtattt

SEQ ID NO: 7182194 - DNA, 19 bp, Homo sapiens
tggagactgagagtgagca

SEQ ID NO: 7182195 - DNA, 19 bp, Homo sapiens
tggagactgagagtgagca

SEQ ID NO: 7182196 - DNA, 22 bp, Homo sapiens
tggagactgataaaggctattg

SEQ ID NO: 7182197 - DNA, 22 bp, Homo sapiens
tggagactgataaaggctattg

SEQ ID NO: 7182198 - DNA, 22 bp, Homo sapiens
tggagactgtgctaagggagtt

SEQ ID NO: 7182199 - DNA, 22 bp, Homo sapiens
tggagacacaggaccagactgc

SEQ ID NO: 7182200 - DNA, 22 bp, Homo sapiens
tggagaattctatgttgagggg

SEQ ID NO: 7182201 - DNA, 22 bp, Homo sapiens
tggagaattctatgttgagggg

SEQ ID NO: 7182202 - DNA, 23 bp, Homo sapiens
tggagaattcttccttccactgt

SEQ ID NO: 7182203 - DNA, 22 bp, Homo sapiens
tggagaattctatgttgagggg

SEQ ID NO: 7182204 - DNA, 23 bp, Homo sapiens
tggagaattcagtctttgttttg

SEQ ID NO: 7182205 - DNA, 22 bp, Homo sapiens
tggagaattctatgttgagggg

SEQ ID NO: 7182206 - DNA, 22 bp, Homo sapiens
tggagaattctatgttgagggg

SEQ ID NO: 7182207 - DNA, 22 bp, Homo sapiens
tggagaatgatattccatcatt

SEQ ID NO: 7182208 - DNA, 23 bp, Homo sapiens
tggagaatgtgtttacttcgtgt

SEQ ID NO: 7182209 - DNA, 22 bp, Homo sapiens
tggaaagaattcctatggttca

SEQ ID NO: 7182210 - DNA, 22 bp, Homo sapiens
tggacatgtccggccagacaat

SEQ ID NO: 7182211 - DNA, 22 bp, Homo sapiens
tggacatgtcttctccaagaaa

SEQ ID NO: 7182212 - DNA, 21 bp, Homo sapiens
tggacattatggagagagtag

SEQ ID NO: 7182213 - DNA, 22 bp, Homo sapiens
tggaggacaggactggacagcc

SEQ ID NO: 7182214 - DNA, 22 bp, Homo sapiens
tggaggacaggactggacagcc

SEQ ID NO: 7182215 - DNA, 21 bp, Homo sapiens
tggaggaataaagcacagaag

SEQ ID NO: 7182216 - DNA, 22 bp, Homo sapiens
tggaggaagtggctggccagaa

SEQ ID NO: 7182217 - DNA, 22 bp, Homo sapiens
tggaggaagttgctggaagtca

SEQ ID NO: 7182218 - DNA, 22 bp, Homo sapiens
tggaggaagtggctggccagaa

SEQ ID NO: 7182219 - DNA, 22 bp, Homo sapiens
tggaggaagtggacagttgtgt

SEQ ID NO: 7182220 - DNA, 23 bp, Homo sapiens
tggaggaaacacatcagaagacc

SEQ ID NO: 7182221 - DNA, 23 bp, Homo sapiens
tggaggaaacacatcagaagacc

SEQ ID NO: 7182222 - DNA, 22 bp, Homo sapiens
tggagatgggttaatggagaga

SEQ ID NO: 7182223 - DNA, 22 bp, Homo sapiens
tggagatgggaaaaaggaggta

SEQ ID NO: 7182224 - DNA, 22 bp, Homo sapiens
tggagatgggttaatggagaga

SEQ ID NO: 7182225 - DNA, 22 bp, Homo sapiens
tggagatggcctcaggccctca

SEQ ID NO: 7182226 - DNA, 22 bp, Homo sapiens
tggagatggcctcaggccctca

SEQ ID NO: 7182227 - DNA, 22 bp, Homo sapiens
tggagatgggaaaaaggaggta

SEQ ID NO: 7182228 - DNA, 22 bp, Homo sapiens
tggagatgggaaaaaggaggta

SEQ ID NO: 7182229 - DNA, 22 bp, Homo sapiens
tggagatgcctggagattaggg

SEQ ID NO: 7182230 - DNA, 22 bp, Homo sapiens
tggagatggcctcaggccctca

SEQ ID NO: 7182231 - DNA, 22 bp, Homo sapiens
tggagatggcctcaggccctca

SEQ ID NO: 7182232 - DNA, 22 bp, Homo sapiens
tggagatgcacgagcaggtgga

SEQ ID NO: 7182233 - DNA, 22 bp, Homo sapiens
tggagatgaggacatggacgtc

SEQ ID NO: 7182234 - DNA, 22 bp, Homo sapiens
tggagatgcacgagcaggtgga

SEQ ID NO: 7182235 - DNA, 22 bp, Homo sapiens
tggagatgcacgagcaggtgga

SEQ ID NO: 7182236 - DNA, 23 bp, Homo sapiens
tggagatgccccactccctgtct

SEQ ID NO: 7182237 - DNA, 22 bp, Homo sapiens
tggagatgggttaatggagaga

SEQ ID NO: 7182238 - DNA, 22 bp, Homo sapiens
tggagatgggttaatggagaga

SEQ ID NO: 7182239 - DNA, 22 bp, Homo sapiens
tggagatgtaaagcaaggctta

SEQ ID NO: 7182240 - DNA, 22 bp, Homo sapiens
tggagatgtaaagcaaggctta

SEQ ID NO: 7182241 - DNA, 22 bp, Homo sapiens
tggagatgtaaagcaaggctta

SEQ ID NO: 7182242 - DNA, 18 bp, Homo sapiens
tggagctgagggcaatgc

SEQ ID NO: 7182243 - DNA, 22 bp, Homo sapiens
tggagctgaggggaatgctgag

SEQ ID NO: 7182244 - DNA, 22 bp, Homo sapiens
tggagctgaggggaatgctgag

SEQ ID NO: 7182245 - DNA, 22 bp, Homo sapiens
tggagctgaggggaatgctgag

SEQ ID NO: 7182246 - DNA, 22 bp, Homo sapiens
tggaggaaaattactggggtct

SEQ ID NO: 7182247 - DNA, 23 bp, Homo sapiens
tggaggaaacacatcagaagacc

SEQ ID NO: 7182248 - DNA, 23 bp, Homo sapiens
tggaggaaacacatcagaagacc

SEQ ID NO: 7182249 - DNA, 23 bp, Homo sapiens
tggaggaaacacatcagaagacc

SEQ ID NO: 7182250 - DNA, 22 bp, Homo sapiens
tggaggcatgacagtgtctgga

SEQ ID NO: 7182251 - DNA, 22 bp, Homo sapiens
tggaggcatgacagtgtctgga

SEQ ID NO: 7182252 - DNA, 16 bp, Homo sapiens
tggaggcatctggccc

SEQ ID NO: 7182253 - DNA, 22 bp, Homo sapiens
tggaggcatcagagtgcttggc

SEQ ID NO: 7182254 - DNA, 22 bp, Homo sapiens
tggaggcatcagagtgcttggc

SEQ ID NO: 7182255 - DNA, 22 bp, Homo sapiens
tggaggcatcagagtgcttggc

SEQ ID NO: 7182256 - DNA, 22 bp, Homo sapiens
tggaggcatcagagtgcttggc

SEQ ID NO: 7182257 - DNA, 22 bp, Homo sapiens
tggaggcatcagagtgcttggc

SEQ ID NO: 7182258 - DNA, 22 bp, Homo sapiens
tggaggcataggcctgggccct

SEQ ID NO: 7182259 - DNA, 22 bp, Homo sapiens
tggaggcataggcctgggccct

SEQ ID NO: 7182260 - DNA, 22 bp, Homo sapiens
tggaggcatcagagtgcttggc

SEQ ID NO: 7182261 - DNA, 22 bp, Homo sapiens
tggaggcataggcctgggccct

SEQ ID NO: 7182262 - DNA, 22 bp, Homo sapiens
tggaggcataggcctgggccct

SEQ ID NO: 7182263 - DNA, 22 bp, Homo sapiens
tggaggcataggcctgggccct

SEQ ID NO: 7182264 - DNA, 22 bp, Homo sapiens
tggaggcagtttaagtctgaga

SEQ ID NO: 7182265 - DNA, 22 bp, Homo sapiens
tggaggcagtttaagtctgaga

SEQ ID NO: 7182266 - DNA, 22 bp, Homo sapiens
tggaggagaactccctggctac

SEQ ID NO: 7182267 - DNA, 22 bp, Homo sapiens
tggaggagaactccctggctac

SEQ ID NO: 7182268 - DNA, 22 bp, Homo sapiens
tggaggacgtgtccaccatgaa

SEQ ID NO: 7182269 - DNA, 22 bp, Homo sapiens
tggaggcagtcacctgaagtca

SEQ ID NO: 7182270 - DNA, 22 bp, Homo sapiens
tggaggcatgacagtgtctgga

SEQ ID NO: 7182271 - DNA, 22 bp, Homo sapiens
tggaggcattgtgactgctgaa

SEQ ID NO: 7182272 - DNA, 22 bp, Homo sapiens
tggaggcattgtgactgctgaa

SEQ ID NO: 7182273 - DNA, 22 bp, Homo sapiens
tggaggcattgtgactgctgaa

SEQ ID NO: 7182274 - DNA, 22 bp, Homo sapiens
tggaggcatttctttttggtcg

SEQ ID NO: 7182275 - DNA, 22 bp, Homo sapiens
tggaggcatttgatgttcataa

SEQ ID NO: 7182276 - DNA, 22 bp, Homo sapiens
tggaggcatttgatgttcataa

SEQ ID NO: 7182277 - DNA, 22 bp, Homo sapiens
tggaggcatttgatgttcataa

SEQ ID NO: 7182278 - DNA, 22 bp, Homo sapiens
tggaggcattttaggttgtcac

SEQ ID NO: 7182279 - DNA, 22 bp, Homo sapiens
tggaggcattttaggttgtcac

SEQ ID NO: 7182280 - DNA, 22 bp, Homo sapiens
tggaggccaaggcaggcggatc

SEQ ID NO: 7182281 - DNA, 22 bp, Homo sapiens
tggaggccacatgaacgctgcg

SEQ ID NO: 7182282 - DNA, 22 bp, Homo sapiens
ccctggaggaccccaatgtggc

SEQ ID NO: 7182283 - DNA, 22 bp, Homo sapiens
ccctggaggaccccaatgtggc

SEQ ID NO: 7182284 - DNA, 22 bp, Homo sapiens
ccctggaggaccccaatgtggc

SEQ ID NO: 7182285 - DNA, 22 bp, Homo sapiens
ccctggaggaccccaatgtggc

SEQ ID NO: 7182286 - DNA, 22 bp, Homo sapiens
ccctggaggaccccaatgtggc

SEQ ID NO: 7182287 - DNA, 22 bp, Homo sapiens
ccctggagggatttctcaatca

SEQ ID NO: 7182288 - DNA, 22 bp, Homo sapiens
ccctggagggatttctcaatca

SEQ ID NO: 7182289 - DNA, 22 bp, Homo sapiens
ccctggagggatttctcaatca

SEQ ID NO: 7182290 - DNA, 22 bp, Homo sapiens
tatgcaaatgactggtatgttt

SEQ ID NO: 7182291 - DNA, 22 bp, Homo sapiens
tatgcaacagcattattacaat

SEQ ID NO: 7182292 - DNA, 22 bp, Homo sapiens
tatgcaattctcttaatattct

SEQ ID NO: 7182293 - DNA, 22 bp, Homo sapiens
tatgcacaacatgcaggtttgt

SEQ ID NO: 7182294 - DNA, 22 bp, Homo sapiens
tatgcacacatcgcagcaggaa

SEQ ID NO: 7182295 - DNA, 22 bp, Homo sapiens
tatgcaaatgactggtatgttt

SEQ ID NO: 7182296 - DNA, 22 bp, Homo sapiens
tatgcaaatcattagatttcct

SEQ ID NO: 7182297 - DNA, 22 bp, Homo sapiens
tatgcaaatcattagatttcct

SEQ ID NO: 7182298 - DNA, 22 bp, Homo sapiens
tatgcaaatcattagatttcct

SEQ ID NO: 7182299 - DNA, 22 bp, Homo sapiens
tatgcaaatcattagatttcct

SEQ ID NO: 7182300 - DNA, 22 bp, Homo sapiens
tatgcaaagtcctaagaaagaa

SEQ ID NO: 7182301 - DNA, 22 bp, Homo sapiens
tatgcaaagccacccagggacg

SEQ ID NO: 7182302 - DNA, 22 bp, Homo sapiens
tatgcaaagccacccagggacg

SEQ ID NO: 7182303 - DNA, 22 bp, Homo sapiens
tatgcaaagtcctaagaaagaa

SEQ ID NO: 7182304 - DNA, 22 bp, Homo sapiens
tatgcaaagtcctaagaaagaa

SEQ ID NO: 7182305 - DNA, 22 bp, Homo sapiens
tatgcaaactaagttgtttcct

SEQ ID NO: 7182306 - DNA, 22 bp, Homo sapiens
tatgcaaactaagttgtttcct

SEQ ID NO: 7182307 - DNA, 22 bp, Homo sapiens
tatgcaaacagttcaggtgaca

SEQ ID NO: 7182308 - DNA, 22 bp, Homo sapiens
tatgcaaacagttcaggtgaca

SEQ ID NO: 7182309 - DNA, 22 bp, Homo sapiens
tatgcaaacagttcaggtgaca

SEQ ID NO: 7182310 - DNA, 22 bp, Homo sapiens
tatgatttgtagacatttgatt

SEQ ID NO: 7182311 - DNA, 22 bp, Homo sapiens
tatgatttgtagacatttgatt

SEQ ID NO: 7182312 - DNA, 22 bp, Homo sapiens
tatgcaaacagttcaggtgaca

SEQ ID NO: 7182313 - DNA, 22 bp, Homo sapiens
tatgattaatattcttaaaatt

SEQ ID NO: 7182314 - DNA, 22 bp, Homo sapiens
tatgatttgtagacatttgatt

SEQ ID NO: 7182315 - DNA, 22 bp, Homo sapiens
tatgaagatatatctgatctct

SEQ ID NO: 7182316 - DNA, 22 bp, Homo sapiens
tatgaagactcatttattgggt

SEQ ID NO: 7182317 - DNA, 20 bp, Homo sapiens
tatgaagactcaagtagggc

SEQ ID NO: 7182318 - DNA, 22 bp, Homo sapiens
tatgaagacaatgatagcatga

SEQ ID NO: 7182319 - DNA, 22 bp, Homo sapiens
tatgaagacaatgatagcatga

SEQ ID NO: 7182320 - DNA, 22 bp, Homo sapiens
tatgaagaagttctgtgaaatg

SEQ ID NO: 7182321 - DNA, 22 bp, Homo sapiens
tatgaagaagacaaatgacact

SEQ ID NO: 7182322 - DNA, 22 bp, Homo sapiens
tatgaagaagacaaatgacact

SEQ ID NO: 7182323 - DNA, 22 bp, Homo sapiens
tatgaagaagttctgtgaaatg

SEQ ID NO: 7182324 - DNA, 19 bp, Homo sapiens
tatgaagaatgtggcaaag

SEQ ID NO: 7182325 - DNA, 19 bp, Homo sapiens
tatgaagaatgtggcaaag

SEQ ID NO: 7182326 - DNA, 22 bp, Homo sapiens
tatgatatgcactttatcagaa

SEQ ID NO: 7182327 - DNA, 22 bp, Homo sapiens
tatgatattctaaattgacacc

SEQ ID NO: 7182328 - DNA, 22 bp, Homo sapiens
tatgatattctaaattgacacc

SEQ ID NO: 7182329 - DNA, 22 bp, Homo sapiens
tatgatatgcactttatcagaa

SEQ ID NO: 7182330 - DNA, 22 bp, Homo sapiens
tatgaagatatatctgatctct

SEQ ID NO: 7182331 - DNA, 22 bp, Homo sapiens
tatgaagatatatctgatctct

SEQ ID NO: 7182332 - DNA, 22 bp, Homo sapiens
tatgaagatatatctgatctct

SEQ ID NO: 7182333 - DNA, 20 bp, Homo sapiens
tatgaagatatgtgaacagc

SEQ ID NO: 7182334 - DNA, 22 bp, Homo sapiens
tatgatattctaaattgacacc

SEQ ID NO: 7182335 - DNA, 22 bp, Homo sapiens
tatgatattctaaattgacacc

SEQ ID NO: 7182336 - DNA, 22 bp, Homo sapiens
tatgatgactctagataaagtc

SEQ ID NO: 7182337 - DNA, 22 bp, Homo sapiens
tatgatgactctagataaagtc

SEQ ID NO: 7182338 - DNA, 22 bp, Homo sapiens
tatgatgggaggaatggaattt

SEQ ID NO: 7182339 - DNA, 22 bp, Homo sapiens
tatattcattttaaagccatct

SEQ ID NO: 7182340 - DNA, 22 bp, Homo sapiens
tatattctattgtacctctcct

SEQ ID NO: 7182341 - DNA, 22 bp, Homo sapiens
tatattctattgtacctctcct

SEQ ID NO: 7182342 - DNA, 22 bp, Homo sapiens
tatattctgattccatctgtgt

SEQ ID NO: 7182343 - DNA, 22 bp, Homo sapiens
tatattctgattccatctgtgt

SEQ ID NO: 7182344 - DNA, 22 bp, Homo sapiens
tatattccagttcatctcttga

SEQ ID NO: 7182345 - DNA, 22 bp, Homo sapiens
tatattcttaccagtgtatgta

SEQ ID NO: 7182346 - DNA, 18 bp, Homo sapiens
tatattctgtgccctggt

SEQ ID NO: 7182347 - DNA, 18 bp, Homo sapiens
tatattctgtgccctggt

SEQ ID NO: 7182348 - DNA, 22 bp, Homo sapiens
tatattgtaggtgctatttgaa

SEQ ID NO: 7182349 - DNA, 22 bp, Homo sapiens
tatattgtagctgatgacaaat

SEQ ID NO: 7182350 - DNA, 22 bp, Homo sapiens
tatattgtagctgatgacaaat

SEQ ID NO: 7182351 - DNA, 22 bp, Homo sapiens
tatattctttcaccttcttcct

SEQ ID NO: 7182352 - DNA, 22 bp, Homo sapiens
tatattctttcaccttcttcct

SEQ ID NO: 7182353 - DNA, 22 bp, Homo sapiens
tatattcttaccagtgtatgta

SEQ ID NO: 7182354 - DNA, 22 bp, Homo sapiens
tatattgactttaaagaagcaa

SEQ ID NO: 7182355 - DNA, 22 bp, Homo sapiens
tatctgtagtctcatggttcct

SEQ ID NO: 7182356 - DNA, 22 bp, Homo sapiens
tatctgtatccccatctagcta

SEQ ID NO: 7182357 - DNA, 22 bp, Homo sapiens
tatctgtatccccatctagcta

SEQ ID NO: 7182358 - DNA, 17 bp, Homo sapiens
tatctgtatgatggata

SEQ ID NO: 7182359 - DNA, 22 bp, Homo sapiens
tatctgtattctgacagtcact

SEQ ID NO: 7182360 - DNA, 23 bp, Homo sapiens
tatctgtatttgttcactgctgt

SEQ ID NO: 7182361 - DNA, 21 bp, Homo sapiens
tatgaacatgaccaatagtcc

SEQ ID NO: 7182362 - DNA, 21 bp, Homo sapiens
tatgaacatgaccaatagtcc

SEQ ID NO: 7182363 - DNA, 21 bp, Homo sapiens
tatgaacatgaccaatagtcc

SEQ ID NO: 7182364 - DNA, 22 bp, Homo sapiens
tatgaacatgctgtggttataa

SEQ ID NO: 7182365 - DNA, 22 bp, Homo sapiens
tatgaacatgttcattgactta

SEQ ID NO: 7182366 - DNA, 22 bp, Homo sapiens
tatgaacattatttttgtctag

SEQ ID NO: 7182367 - DNA, 22 bp, Homo sapiens
tatgaacattttggtatatatg

SEQ ID NO: 7182368 - DNA, 22 bp, Homo sapiens
tatgaacattttggtatatatg

SEQ ID NO: 7182369 - DNA, 22 bp, Homo sapiens
tatgaactagctgatttagttt

SEQ ID NO: 7182370 - DNA, 22 bp, Homo sapiens
tatgaactgtactgtactaagc

SEQ ID NO: 7182371 - DNA, 22 bp, Homo sapiens
tatgaactgtaaccctcaccgc

SEQ ID NO: 7182372 - DNA, 22 bp, Homo sapiens
tatgaactgtgagtgtgatggg

SEQ ID NO: 7182373 - DNA, 22 bp, Homo sapiens
tatgaactttaagctctgtgtc

SEQ ID NO: 7182374 - DNA, 22 bp, Homo sapiens
tatgaacttttgatgtgacatg

SEQ ID NO: 7182375 - DNA, 22 bp, Homo sapiens
tatgaagaaacctatcctctag

SEQ ID NO: 7182376 - DNA, 22 bp, Homo sapiens
tatgaagaaatctttgaaaatc

SEQ ID NO: 7182377 - DNA, 22 bp, Homo sapiens
tatgaagaagacaaatgacact

SEQ ID NO: 7182378 - DNA, 22 bp, Homo sapiens
cagtacatttcatatgattcta

SEQ ID NO: 7182379 - DNA, 22 bp, Homo sapiens
cagtacatttcatatgattcta

SEQ ID NO: 7182380 - DNA, 22 bp, Homo sapiens
cagtacagtaaagcaagctgaa

SEQ ID NO: 7182381 - DNA, 22 bp, Homo sapiens
cagtacataatgcgcaaaaccg

SEQ ID NO: 7182382 - DNA, 22 bp, Homo sapiens
cagtacatttcatatgattcta

SEQ ID NO: 7182383 - DNA, 22 bp, Homo sapiens
cagtaccagtcaccacattgat

SEQ ID NO: 7182384 - DNA, 22 bp, Homo sapiens
cagtacttaacttataggagag

SEQ ID NO: 7182385 - DNA, 23 bp, Homo sapiens
cagtacttagtgtagcgttaatt

SEQ ID NO: 7182386 - DNA, 22 bp, Homo sapiens
cagtacttagttctcatggttt

SEQ ID NO: 7182387 - DNA, 22 bp, Homo sapiens
cagtacttatttctatttaggg

SEQ ID NO: 7182388 - DNA, 22 bp, Homo sapiens
cagtacttatttctatttaggg

SEQ ID NO: 7182389 - DNA, 22 bp, Homo sapiens
cagtacttcttggaaactggat

SEQ ID NO: 7182390 - DNA, 22 bp, Homo sapiens
cagtacttgggaatgctgggga

SEQ ID NO: 7182391 - DNA, 22 bp, Homo sapiens
cagtacttggggggttctaagt

SEQ ID NO: 7182392 - DNA, 22 bp, Homo sapiens
cagtaaaagatggaaatagaat

SEQ ID NO: 7182393 - DNA, 22 bp, Homo sapiens
cagtaattccaagtgcttatac

SEQ ID NO: 7182394 - DNA, 22 bp, Homo sapiens
cagtacaagaggccacctgccc

SEQ ID NO: 7182395 - DNA, 22 bp, Homo sapiens
cagtacacaagctttcatgtat

SEQ ID NO: 7182396 - DNA, 22 bp, Homo sapiens
cagtacagaatctattcctgca

SEQ ID NO: 7182397 - DNA, 22 bp, Homo sapiens
cagtaaaagatggaaatagaat

SEQ ID NO: 7182398 - DNA, 22 bp, Homo sapiens
cagtaaaagatggaaatagaat

SEQ ID NO: 7182399 - DNA, 22 bp, Homo sapiens
tatgtacatgttaaagggcaaa

SEQ ID NO: 7182400 - DNA, 22 bp, Homo sapiens
tatgtacatggagagcaattga

SEQ ID NO: 7182401 - DNA, 22 bp, Homo sapiens
tatgtacatggagagcaattga

SEQ ID NO: 7182402 - DNA, 22 bp, Homo sapiens
tatgtacatggagagcaattga

SEQ ID NO: 7182403 - DNA, 22 bp, Homo sapiens
tatgtacatggagagcaattga

SEQ ID NO: 7182404 - DNA, 22 bp, Homo sapiens
tatgtacatcttgagcaatgaa

SEQ ID NO: 7182405 - DNA, 22 bp, Homo sapiens
tatgtacatcttgagcaatgaa

SEQ ID NO: 7182406 - DNA, 22 bp, Homo sapiens
tatgtacatcttgagcaatgaa

SEQ ID NO: 7182407 - DNA, 22 bp, Homo sapiens
tatgtacatgatttcatttgct

SEQ ID NO: 7182408 - DNA, 22 bp, Homo sapiens
tatgtacatgatttcatttgct

SEQ ID NO: 7182409 - DNA, 22 bp, Homo sapiens
tatgtacatgatttcatttgct

SEQ ID NO: 7182410 - DNA, 22 bp, Homo sapiens
caggtggcttattagggtcagt

SEQ ID NO: 7182411 - DNA, 22 bp, Homo sapiens
tatgcacacatgtatgcatgtg

SEQ ID NO: 7182412 - DNA, 22 bp, Homo sapiens
caggtggcttattagggtcagt

SEQ ID NO: 7182413 - DNA, 22 bp, Homo sapiens
caggtggcttattagggtcagt

SEQ ID NO: 7182414 - DNA, 22 bp, Homo sapiens
caggtgggcgtggcgagaaggc

SEQ ID NO: 7182415 - DNA, 22 bp, Homo sapiens
caggtgggcgtggcgagaaggc

SEQ ID NO: 7182416 - DNA, 22 bp, Homo sapiens
caggtgggccggggtttgttct

SEQ ID NO: 7182417 - DNA, 22 bp, Homo sapiens
caggtgggctgcctctccagct

SEQ ID NO: 7182418 - DNA, 22 bp, Homo sapiens
caggtgggctgcctctccagct

SEQ ID NO: 7182419 - DNA, 22 bp, Homo sapiens
caggtgggcttgggagaacact

SEQ ID NO: 7182420 - DNA, 22 bp, Homo sapiens
caggtgggcttgggagaacact

SEQ ID NO: 7182421 - DNA, 22 bp, Homo sapiens
caggtgggcttgggagaacact

SEQ ID NO: 7182422 - DNA, 22 bp, Homo sapiens
caggtgggcttgggagaacact

SEQ ID NO: 7182423 - DNA, 22 bp, Homo sapiens
caggtgggcttgggagaacact

SEQ ID NO: 7182424 - DNA, 22 bp, Homo sapiens
caggtggggagagtgtggagca

SEQ ID NO: 7182425 - DNA, 22 bp, Homo sapiens
caggtggggagagtgtggagca

SEQ ID NO: 7182426 - DNA, 22 bp, Homo sapiens
caggtggggagagtgtggagca

SEQ ID NO: 7182427 - DNA, 22 bp, Homo sapiens
caggtggggagagtgtggagca

SEQ ID NO: 7182428 - DNA, 22 bp, Homo sapiens
caggtggggagagtgtggagca

SEQ ID NO: 7182429 - DNA, 22 bp, Homo sapiens
caggtggggagagtgtggagca

SEQ ID NO: 7182430 - DNA, 22 bp, Homo sapiens
caggtggggcagctgtgggagc

SEQ ID NO: 7182431 - DNA, 22 bp, Homo sapiens
caggtggggcgccctcaggcag

SEQ ID NO: 7182432 - DNA, 22 bp, Homo sapiens
caggtggggcgccctcaggcag

SEQ ID NO: 7182433 - DNA, 22 bp, Homo sapiens
caggtggggcgccctcaggcag

SEQ ID NO: 7182434 - DNA, 22 bp, Homo sapiens
caggtggggcagctgtgggagc

SEQ ID NO: 7182435 - DNA, 22 bp, Homo sapiens
caggtggggcagctgtgggagc

SEQ ID NO: 7182436 - DNA, 22 bp, Homo sapiens
caggtggggcagctgtgggagc

SEQ ID NO: 7182437 - DNA, 22 bp, Homo sapiens
caggtggggcagctgtgggagc

SEQ ID NO: 7182438 - DNA, 22 bp, Homo sapiens
caggtggggcagctgtgggagc

SEQ ID NO: 7182439 - DNA, 22 bp, Homo sapiens
caggtggggcagctgtgggagc

SEQ ID NO: 7182440 - DNA, 22 bp, Homo sapiens
caggtggggagagtgtggagca

SEQ ID NO: 7182441 - DNA, 22 bp, Homo sapiens
caggtggggagagtgtggagca

SEQ ID NO: 7182442 - DNA, 22 bp, Homo sapiens
caggtggggagagtgtggagca

SEQ ID NO: 7182443 - DNA, 22 bp, Homo sapiens
tatgtacatcgttgaattcaaa

SEQ ID NO: 7182444 - DNA, 22 bp, Homo sapiens
caggtggggcgccctcaggcag

SEQ ID NO: 7182445 - DNA, 22 bp, Homo sapiens
caggtggggggcttccgagcct

SEQ ID NO: 7182446 - DNA, 22 bp, Homo sapiens
caggtggggggcttccgagcct

SEQ ID NO: 7182447 - DNA, 22 bp, Homo sapiens
caggtggggcgccctcaggcag

SEQ ID NO: 7182448 - DNA, 22 bp, Homo sapiens
caggtggggcgccctcaggcag

SEQ ID NO: 7182449 - DNA, 22 bp, Homo sapiens
caggtggggcgccctcaggcag

SEQ ID NO: 7182450 - DNA, 22 bp, Homo sapiens
tatattcaatgattagtatcag

SEQ ID NO: 7182451 - DNA, 22 bp, Homo sapiens
tatattcatattgttgtctctc

SEQ ID NO: 7182452 - DNA, 22 bp, Homo sapiens
tatattcatattgttgtctctc

SEQ ID NO: 7182453 - DNA, 22 bp, Homo sapiens
tatattcaatgattagtatcag

SEQ ID NO: 7182454 - DNA, 22 bp, Homo sapiens
tatatatatgcacacacaccta

SEQ ID NO: 7182455 - DNA, 22 bp, Homo sapiens
tatatatatgcacacacaccta

SEQ ID NO: 7182456 - DNA, 22 bp, Homo sapiens
tatatagaaaagcagatgttgg

SEQ ID NO: 7182457 - DNA, 22 bp, Homo sapiens
tatatagaaaagcagatgttgg

SEQ ID NO: 7182458 - DNA, 18 bp, Homo sapiens
tatatagagaaacccatt

SEQ ID NO: 7182459 - DNA, 18 bp, Homo sapiens
tatatagagaaacccatt

SEQ ID NO: 7182460 - DNA, 22 bp, Homo sapiens
tatatatatgcacacacaccta

SEQ ID NO: 7182461 - DNA, 22 bp, Homo sapiens
tatatatatgcacacacaccta

SEQ ID NO: 7182462 - DNA, 22 bp, Homo sapiens
tatatagaaaagcagatgttgg

SEQ ID NO: 7182463 - DNA, 22 bp, Homo sapiens
tatatacttttgtaagttggct

SEQ ID NO: 7182464 - DNA, 22 bp, Homo sapiens
tatatactttcttcctgggtag

SEQ ID NO: 7182465 - DNA, 22 bp, Homo sapiens
tatatactttcttcctgggtag

SEQ ID NO: 7182466 - DNA, 22 bp, Homo sapiens
tatatacaaggtaggtttaggt

SEQ ID NO: 7182467 - DNA, 22 bp, Homo sapiens
tatatactatgcgattcctgcc

SEQ ID NO: 7182468 - DNA, 22 bp, Homo sapiens
tatatactatgcgattcctgcc

SEQ ID NO: 7182469 - DNA, 22 bp, Homo sapiens
tagttttagtcccattttacag

SEQ ID NO: 7182470 - DNA, 22 bp, Homo sapiens
tagttttagtcccattttacag

SEQ ID NO: 7182471 - DNA, 22 bp, Homo sapiens
tagttttagtcccattttacag

SEQ ID NO: 7182472 - DNA, 22 bp, Homo sapiens
tatacatcagtatgtttagata

SEQ ID NO: 7182473 - DNA, 22 bp, Homo sapiens
tatataactactattttgctca

SEQ ID NO: 7182474 - DNA, 22 bp, Homo sapiens
tatataatttgtaaaagcacct

SEQ ID NO: 7182475 - DNA, 22 bp, Homo sapiens
tatataattttctgccatatcc

SEQ ID NO: 7182476 - DNA, 22 bp, Homo sapiens
tatataatttgtaaaagcacct

SEQ ID NO: 7182477 - DNA, 21 bp, Homo sapiens
tatacatgtgtgcatacgtgt

SEQ ID NO: 7182478 - DNA, 22 bp, Homo sapiens
tatataatttgtaaaagcacct

SEQ ID NO: 7182479 - DNA, 22 bp, Homo sapiens
tatataatttgtaaaagcacct

SEQ ID NO: 7182480 - DNA, 22 bp, Homo sapiens
tatataatttgtaaaagcacct

SEQ ID NO: 7182481 - DNA, 22 bp, Homo sapiens
tatatacaaggtaggtttaggt

SEQ ID NO: 7182482 - DNA, 22 bp, Homo sapiens
tatataattttctgccatatcc

SEQ ID NO: 7182483 - DNA, 22 bp, Homo sapiens
tagtttgagaattgaaatagaa

SEQ ID NO: 7182484 - DNA, 22 bp, Homo sapiens
tagttttacatcagccattgtt

SEQ ID NO: 7182485 - DNA, 22 bp, Homo sapiens
tagttttacttgcgatgataat

SEQ ID NO: 7182486 - DNA, 22 bp, Homo sapiens
tagttttacttgcgatgataat

SEQ ID NO: 7182487 - DNA, 22 bp, Homo sapiens
tagttttacttgcgatgataat

SEQ ID NO: 7182488 - DNA, 22 bp, Homo sapiens
tagttttagcagcaatgggatg

SEQ ID NO: 7182489 - DNA, 22 bp, Homo sapiens
tagtttcttcacctgtaaaatg

SEQ ID NO: 7182490 - DNA, 22 bp, Homo sapiens
tagtgttctaagaacatccatg

SEQ ID NO: 7182491 - DNA, 22 bp, Homo sapiens
tagtgtttagtacatatgcata

SEQ ID NO: 7182492 - DNA, 22 bp, Homo sapiens
tagtgtttagtacatatgcata

SEQ ID NO: 7182493 - DNA, 22 bp, Homo sapiens
tagtgtggtatcttctatggaa

SEQ ID NO: 7182494 - DNA, 22 bp, Homo sapiens
tagtgtgtatggtaatgatgaa

SEQ ID NO: 7182495 - DNA, 22 bp, Homo sapiens
tagtgtgtccctggggagtgtt

SEQ ID NO: 7182496 - DNA, 22 bp, Homo sapiens
tagtgtgtccctggggagtgtt

SEQ ID NO: 7182497 - DNA, 22 bp, Homo sapiens
tagtgtgtccctggggagtgtt

SEQ ID NO: 7182498 - DNA, 22 bp, Homo sapiens
tagtgtgtccctggggagtgtt

SEQ ID NO: 7182499 - DNA, 22 bp, Homo sapiens
tagtgttcagctttatttccag

SEQ ID NO: 7182500 - DNA, 22 bp, Homo sapiens
tagtgtctgacatttaagagca

SEQ ID NO: 7182501 - DNA, 22 bp, Homo sapiens
tagtgtctgatccgtagttaca

SEQ ID NO: 7182502 - DNA, 22 bp, Homo sapiens
tagtgtctgtccatcagtaact

SEQ ID NO: 7182503 - DNA, 22 bp, Homo sapiens
tagtgtctgttgcttttgttca

SEQ ID NO: 7182504 - DNA, 21 bp, Homo sapiens
tagtgtcttaagagccttgca

SEQ ID NO: 7182505 - DNA, 22 bp, Homo sapiens
tagtgtcttcaggagatatgag

SEQ ID NO: 7182506 - DNA, 22 bp, Homo sapiens
tagtgtcttcaggagatatgag

SEQ ID NO: 7182507 - DNA, 22 bp, Homo sapiens
tagtgtcttccaggacatggta

SEQ ID NO: 7182508 - DNA, 21 bp, Homo sapiens
tagtgtcttaagagccttgca

SEQ ID NO: 7182509 - DNA, 22 bp, Homo sapiens
tagtgtggccccaagaggatct

SEQ ID NO: 7182510 - DNA, 22 bp, Homo sapiens
tagtgtggtatcttctatggaa

SEQ ID NO: 7182511 - DNA, 22 bp, Homo sapiens
cagggctgagtcatatagcctt

SEQ ID NO: 7182512 - DNA, 22 bp, Homo sapiens
cagggctgagtcatatagcctt

SEQ ID NO: 7182513 - DNA, 22 bp, Homo sapiens
cagggctgagtcatatagcctt

SEQ ID NO: 7182514 - DNA, 22 bp, Homo sapiens
cagggctgagaatttagagaca

SEQ ID NO: 7182515 - DNA, 22 bp, Homo sapiens
cagggctgaggacacaagtaaa

SEQ ID NO: 7182516 - DNA, 22 bp, Homo sapiens
tagtaatcagaggtaaacttta

SEQ ID NO: 7182517 - DNA, 19 bp, Homo sapiens
tagtacaaaagcagccata

SEQ ID NO: 7182518 - DNA, 22 bp, Homo sapiens
tagtacaactcacttgatttta

SEQ ID NO: 7182519 - DNA, 19 bp, Homo sapiens
tagtacacactctaattcc

SEQ ID NO: 7182520 - DNA, 19 bp, Homo sapiens
tagtacacactctaattcc

SEQ ID NO: 7182521 - DNA, 22 bp, Homo sapiens
tagtacactaccatcaggtttt

SEQ ID NO: 7182522 - DNA, 22 bp, Homo sapiens
tagtacactaccatcaggtttt

SEQ ID NO: 7182523 - DNA, 22 bp, Homo sapiens
tagtacactctgtaagtttaaa

SEQ ID NO: 7182524 - DNA, 22 bp, Homo sapiens
tagtacactctgtaagtttaaa

SEQ ID NO: 7182525 - DNA, 22 bp, Homo sapiens
tagtacagtactgggctctagt

SEQ ID NO: 7182526 - DNA, 22 bp, Homo sapiens
cagggctggatttcatttctag

SEQ ID NO: 7182527 - DNA, 22 bp, Homo sapiens
cagggctggatcctccagactc

SEQ ID NO: 7182528 - DNA, 22 bp, Homo sapiens
tagtgattctgtgagcctttac

SEQ ID NO: 7182529 - DNA, 22 bp, Homo sapiens
tagtgcaaaggccctgagatgg

SEQ ID NO: 7182530 - DNA, 22 bp, Homo sapiens
tagtgtctagtgagtttgatgc

SEQ ID NO: 7182531 - DNA, 22 bp, Homo sapiens
tagtgtctattgaccggaaaga

SEQ ID NO: 7182532 - DNA, 22 bp, Homo sapiens
tagtgtctcggggcccaggatt

SEQ ID NO: 7182533 - DNA, 22 bp, Homo sapiens
tagtgtctcttcctgtttgaaa

SEQ ID NO: 7182534 - DNA, 22 bp, Homo sapiens
tagtgtctgaatgcacctgttt

SEQ ID NO: 7182535 - DNA, 22 bp, Homo sapiens
cagggctggatcctccagactc

SEQ ID NO: 7182536 - DNA, 22 bp, Homo sapiens
cagggctggatcctccagactc

SEQ ID NO: 7182537 - DNA, 22 bp, Homo sapiens
cagggctggatcctccagactc

SEQ ID NO: 7182538 - DNA, 22 bp, Homo sapiens
cagggctgctggccgtgccctc

SEQ ID NO: 7182539 - DNA, 22 bp, Homo sapiens
cagggctgctggccgtgccctc

SEQ ID NO: 7182540 - DNA, 22 bp, Homo sapiens
cagggctgctggccgtgccctc

SEQ ID NO: 7182541 - DNA, 22 bp, Homo sapiens
tagtaaatctcagaaaaagatc

SEQ ID NO: 7182542 - DNA, 17 bp, Homo sapiens
tagtaaatgagtagagc

SEQ ID NO: 7182543 - DNA, 22 bp, Homo sapiens
tagtaaatctcagaaaaagatc

SEQ ID NO: 7182544 - DNA, 22 bp, Homo sapiens
taggtatacagagatttctggg

SEQ ID NO: 7182545 - DNA, 17 bp, Homo sapiens
tagtaaatgagtagagc

SEQ ID NO: 7182546 - DNA, 22 bp, Homo sapiens
tagtaaatgtgaaatgtgggga

SEQ ID NO: 7182547 - DNA, 22 bp, Homo sapiens
tagtaaattaaaatattgactt

SEQ ID NO: 7182548 - DNA, 22 bp, Homo sapiens
tagtaaattaaaatattgactt

SEQ ID NO: 7182549 - DNA, 22 bp, Homo sapiens
tagtaacaacaactagcatttt

SEQ ID NO: 7182550 - DNA, 22 bp, Homo sapiens
tagtaacacattgaacgatcgc

SEQ ID NO: 7182551 - DNA, 22 bp, Homo sapiens
tagtaacagatttatacagtct

SEQ ID NO: 7182552 - DNA, 22 bp, Homo sapiens
tagtaacagcagcttccctgtg

SEQ ID NO: 7182553 - DNA, 22 bp, Homo sapiens
tagtaacccacacaacagtaga

SEQ ID NO: 7182554 - DNA, 22 bp, Homo sapiens
tagtaacccacacaacagtaga

SEQ ID NO: 7182555 - DNA, 22 bp, Homo sapiens
tagtaacccacacaacagtaga

SEQ ID NO: 7182556 - DNA, 22 bp, Homo sapiens
tagtaagcctctccagagacag

SEQ ID NO: 7182557 - DNA, 22 bp, Homo sapiens
tagtaataagttgtgctttgat

SEQ ID NO: 7182558 - DNA, 21 bp, Homo sapiens
cagggccaatcctgacctcta

SEQ ID NO: 7182559 - DNA, 22 bp, Homo sapiens
cagggccaccctctgctgggtg

SEQ ID NO: 7182560 - DNA, 22 bp, Homo sapiens
cagggccaagctgcagcatctg

SEQ ID NO: 7182561 - DNA, 22 bp, Homo sapiens
cagggccaagctgcagcatctg

SEQ ID NO: 7182562 - DNA, 21 bp, Homo sapiens
cagggccaatcctgacctcta

SEQ ID NO: 7182563 - DNA, 21 bp, Homo sapiens
cagggccaatcctgacctcta

SEQ ID NO: 7182564 - DNA, 22 bp, Homo sapiens
cagggccaccctctgctgggtg

SEQ ID NO: 7182565 - DNA, 22 bp, Homo sapiens
cagggccaccctctgctgggtg

SEQ ID NO: 7182566 - DNA, 22 bp, Homo sapiens
cagggccaccctctgctgggtg

SEQ ID NO: 7182567 - DNA, 20 bp, Homo sapiens
cagggccacgctccaaggca

SEQ ID NO: 7182568 - DNA, 22 bp, Homo sapiens
taggtagttacacagcaatgta

SEQ ID NO: 7182569 - DNA, 22 bp, Homo sapiens
taggtagttacacagcaatgta

SEQ ID NO: 7182570 - DNA, 20 bp, Homo sapiens
cagggccacgctccaaggca

SEQ ID NO: 7182571 - DNA, 21 bp, Homo sapiens
tcaaagcacatatttgcacat

SEQ ID NO: 7182572 - DNA, 22 bp, Homo sapiens
tcaaagcactggggaaagcctg

SEQ ID NO: 7182573 - DNA, 22 bp, Homo sapiens
tattcctaatttgcagggcatg

SEQ ID NO: 7182574 - DNA, 22 bp, Homo sapiens
tattcctaatacttgttttggg

SEQ ID NO: 7182575 - DNA, 22 bp, Homo sapiens
tattccctgatgtacactggca

SEQ ID NO: 7182576 - DNA, 22 bp, Homo sapiens
tattcctcccagtaagtacaac

SEQ ID NO: 7182577 - DNA, 22 bp, Homo sapiens
tcaaaacctaggctctctgctt

SEQ ID NO: 7182578 - DNA, 22 bp, Homo sapiens
tcaaaactcattttggaagtaa

SEQ ID NO: 7182579 - DNA, 22 bp, Homo sapiens
tcaaaagaaacaccatgttcct

SEQ ID NO: 7182580 - DNA, 22 bp, Homo sapiens
tcaaaggaatttgattttgatg

SEQ ID NO: 7182581 - DNA, 22 bp, Homo sapiens
tcaaaggagacacaaggagaaa

SEQ ID NO: 7182582 - DNA, 22 bp, Homo sapiens
tcaaagcatcagtcaatttagg

SEQ ID NO: 7182583 - DNA, 22 bp, Homo sapiens
tcaaagcatcagtcaatttagg

SEQ ID NO: 7182584 - DNA, 22 bp, Homo sapiens
tcaaaggcaccaaggtcactgc

SEQ ID NO: 7182585 - DNA, 22 bp, Homo sapiens
tcaaaggcaccaaggtcactgc

SEQ ID NO: 7182586 - DNA, 22 bp, Homo sapiens
tcaaaggcattgccaataagta

SEQ ID NO: 7182587 - DNA, 22 bp, Homo sapiens
tcaaaggcattgccaataagta

SEQ ID NO: 7182588 - DNA, 19 bp, Homo sapiens
tcaaaggcaaggaggaact

SEQ ID NO: 7182589 - DNA, 20 bp, Homo sapiens
tcaaaggcaaaggtgggtgt

SEQ ID NO: 7182590 - DNA, 22 bp, Homo sapiens
tcaaaggcccattgtcccgttg

SEQ ID NO: 7182591 - DNA, 22 bp, Homo sapiens
tcaaaggcggtccaggaataaa

SEQ ID NO: 7182592 - DNA, 22 bp, Homo sapiens
tcaaaggcggtccaggaataaa

SEQ ID NO: 7182593 - DNA, 20 bp, Homo sapiens
tcaaaggcaaaggtgggtgt

SEQ ID NO: 7182594 - DNA, 22 bp, Homo sapiens
tattccaattggttgtaaagaa

SEQ ID NO: 7182595 - DNA, 22 bp, Homo sapiens
tattccagataccttgtgtaag

SEQ ID NO: 7182596 - DNA, 22 bp, Homo sapiens
tattccagatgaaatcattcag

SEQ ID NO: 7182597 - DNA, 22 bp, Homo sapiens
tattccaagtgcctagaagagt

SEQ ID NO: 7182598 - DNA, 20 bp, Homo sapiens
tattccaagggtagagaaaa

SEQ ID NO: 7182599 - DNA, 20 bp, Homo sapiens
tattccaagggtagagaaaa

SEQ ID NO: 7182600 - DNA, 22 bp, Homo sapiens
tattccaggtttcttgttgtat

SEQ ID NO: 7182601 - DNA, 22 bp, Homo sapiens
tattccagtatgtctggtgtcc

SEQ ID NO: 7182602 - DNA, 22 bp, Homo sapiens
tattccagtgtgatctttgtag

SEQ ID NO: 7182603 - DNA, 22 bp, Homo sapiens
tattccatgccagagtttattg

SEQ ID NO: 7182604 - DNA, 22 bp, Homo sapiens
tattcccaccctaagtagtagg

SEQ ID NO: 7182605 - DNA, 22 bp, Homo sapiens
tattcccactcctcagcaattt

SEQ ID NO: 7182606 - DNA, 22 bp, Homo sapiens
tattcccagcacatggccattt

SEQ ID NO: 7182607 - DNA, 22 bp, Homo sapiens
tattcccattccacttatcaag

SEQ ID NO: 7182608 - DNA, 22 bp, Homo sapiens
tattccaactgtcatagtcata

SEQ ID NO: 7182609 - DNA, 22 bp, Homo sapiens
cagtagcagggattattttagg

SEQ ID NO: 7182610 - DNA, 22 bp, Homo sapiens
cagtagcacctatgattttgta

SEQ ID NO: 7182611 - DNA, 22 bp, Homo sapiens
cagtagcactagatatgtgtgg

SEQ ID NO: 7182612 - DNA, 22 bp, Homo sapiens
cagtagcactctgtcagtgaag

SEQ ID NO: 7182613 - DNA, 22 bp, Homo sapiens
cagtagcaggatttgggattat

SEQ ID NO: 7182614 - DNA, 22 bp, Homo sapiens
cagtagcaggcaggtgcttttg

SEQ ID NO: 7182615 - DNA, 22 bp, Homo sapiens
cagtacttggtcaaggaagcag

SEQ ID NO: 7182616 - DNA, 22 bp, Homo sapiens
cagtacttgtcctcaggtgtta

SEQ ID NO: 7182617 - DNA, 22 bp, Homo sapiens
cagtactttgaagatattttag

SEQ ID NO: 7182618 - DNA, 22 bp, Homo sapiens
cagtactttgaagatattttag

SEQ ID NO: 7182619 - DNA, 22 bp, Homo sapiens
cagtactttgcatcattccact

SEQ ID NO: 7182620 - DNA, 22 bp, Homo sapiens
cagtacttttcaaccagtatga

SEQ ID NO: 7182621 - DNA, 22 bp, Homo sapiens
cagtacttttctggctttctac

SEQ ID NO: 7182622 - DNA, 22 bp, Homo sapiens
cagtagaagcttgtttttcaga

SEQ ID NO: 7182623 - DNA, 22 bp, Homo sapiens
cagtagacacattaatatggaa

SEQ ID NO: 7182624 - DNA, 22 bp, Homo sapiens
cagtagacacatttgtttttcc

SEQ ID NO: 7182625 - DNA, 22 bp, Homo sapiens
cagtagacagctgatgatgggc

SEQ ID NO: 7182626 - DNA, 22 bp, Homo sapiens
cagtagacagctgatgatgggc

SEQ ID NO: 7182627 - DNA, 22 bp, Homo sapiens
cagtagatttggtaaactagga

SEQ ID NO: 7182628 - DNA, 20 bp, Homo sapiens
cagtagcaataattagaagc

SEQ ID NO: 7182629 - DNA, 20 bp, Homo sapiens
cagtagcaataattagaagc

SEQ ID NO: 7182630 - DNA, 22 bp, Homo sapiens
cagtgaaatagtggacatcaaa

SEQ ID NO: 7182631 - DNA, 22 bp, Homo sapiens
cagtcttttgtatattagcaga

SEQ ID NO: 7182632 - DNA, 22 bp, Homo sapiens
cagtcttttgtatattagcaga

SEQ ID NO: 7182633 - DNA, 22 bp, Homo sapiens
cagtctttgttcccattactga

SEQ ID NO: 7182634 - DNA, 22 bp, Homo sapiens
cagtcttatcctgaaaacaaca

SEQ ID NO: 7182635 - DNA, 22 bp, Homo sapiens
cagtctttgatgcatcctagcc

SEQ ID NO: 7182636 - DNA, 22 bp, Homo sapiens
cagtctttgatgcatcctagcc

SEQ ID NO: 7182637 - DNA, 22 bp, Homo sapiens
cagtgaaatagtggacatcaaa

SEQ ID NO: 7182638 - DNA, 22 bp, Homo sapiens
cagtgaacttgagtacttcatt

SEQ ID NO: 7182639 - DNA, 17 bp, Homo sapiens
tcaaatgtacagaacta

SEQ ID NO: 7182640 - DNA, 22 bp, Homo sapiens
tcaaattagtggaataataatg

SEQ ID NO: 7182641 - DNA, 19 bp, Homo sapiens
tcaaattcctaagttctgg

SEQ ID NO: 7182642 - DNA, 22 bp, Homo sapiens
tcaaattctattctatactcag

SEQ ID NO: 7182643 - DNA, 22 bp, Homo sapiens
tcaaattctattctatactcag

SEQ ID NO: 7182644 - DNA, 22 bp, Homo sapiens
tcaaattttaacatgcattaga

SEQ ID NO: 7182645 - DNA, 22 bp, Homo sapiens
cagtccctagtggagctcacag

SEQ ID NO: 7182646 - DNA, 22 bp, Homo sapiens
cagtcccatgagcccagaacat

SEQ ID NO: 7182647 - DNA, 22 bp, Homo sapiens
cagtcccatctcccaggtggct

SEQ ID NO: 7182648 - DNA, 22 bp, Homo sapiens
cagtcccatgagcccagaacat

SEQ ID NO: 7182649 - DNA, 22 bp, Homo sapiens
cagtcccagtttgagactctgg

SEQ ID NO: 7182650 - DNA, 22 bp, Homo sapiens
cagtcccagtttgagactctgg

SEQ ID NO: 7182651 - DNA, 22 bp, Homo sapiens
cagtcccatctcccaggtggct

SEQ ID NO: 7182652 - DNA, 22 bp, Homo sapiens
cagtcccatctcccaggtggct

SEQ ID NO: 7182653 - DNA, 22 bp, Homo sapiens
cagtcccagtttgagactctgg

SEQ ID NO: 7182654 - DNA, 22 bp, Homo sapiens
cagtcccagggttggttcagct

SEQ ID NO: 7182655 - DNA, 15 bp, Homo sapiens
cagtcccagggaccc

SEQ ID NO: 7182656 - DNA, 15 bp, Homo sapiens
cagtcccagggaccc

SEQ ID NO: 7182657 - DNA, 22 bp, Homo sapiens
cagtcccagggttggttcagct

SEQ ID NO: 7182658 - DNA, 22 bp, Homo sapiens
cagtcccagctgctcagaaggc

SEQ ID NO: 7182659 - DNA, 22 bp, Homo sapiens
cagtcccagctgctcagaaggc

SEQ ID NO: 7182660 - DNA, 22 bp, Homo sapiens
cagtcccagctgctcagaaggc

SEQ ID NO: 7182661 - DNA, 22 bp, Homo sapiens
cagtcccagctgctcagaaggc

SEQ ID NO: 7182662 - DNA, 22 bp, Homo sapiens
cagtcccagacccagaaggtgg

SEQ ID NO: 7182663 - DNA, 23 bp, Homo sapiens
cagtctgcagcccacttgggcag

SEQ ID NO: 7182664 - DNA, 22 bp, Homo sapiens
cagtctggaggtcagctggctt

SEQ ID NO: 7182665 - DNA, 22 bp, Homo sapiens
cagtctggatctgtgctgctgt

SEQ ID NO: 7182666 - DNA, 22 bp, Homo sapiens
cagtctctcagctttcagctgt

SEQ ID NO: 7182667 - DNA, 22 bp, Homo sapiens
cagtcctcagtgagtgatcctg

SEQ ID NO: 7182668 - DNA, 22 bp, Homo sapiens
cagtcctctcactcaggccttt

SEQ ID NO: 7182669 - DNA, 22 bp, Homo sapiens
cagtctctaaatcaatctgaat

SEQ ID NO: 7182670 - DNA, 23 bp, Homo sapiens
cagtctctccccggacagcaaaa

SEQ ID NO: 7182671 - DNA, 22 bp, Homo sapiens
cagtctctctccttgcaggcgt

SEQ ID NO: 7182672 - DNA, 22 bp, Homo sapiens
cagtctctctccttgcaggcgt

SEQ ID NO: 7182673 - DNA, 22 bp, Homo sapiens
cagtctctcagctttcagctgt

SEQ ID NO: 7182674 - DNA, 22 bp, Homo sapiens
cagtctggcacagcacactgaa

SEQ ID NO: 7182675 - DNA, 22 bp, Homo sapiens
cagtctgggactgagctccacc

SEQ ID NO: 7182676 - DNA, 22 bp, Homo sapiens
cagtctgggactgagctccacc

SEQ ID NO: 7182677 - DNA, 22 bp, Homo sapiens
cagtctgtaatgggttttaaaa

SEQ ID NO: 7182678 - DNA, 22 bp, Homo sapiens
cagtctgtttctgagaaacaga

SEQ ID NO: 7182679 - DNA, 22 bp, Homo sapiens
cagtcttaggagaaactacaga

SEQ ID NO: 7182680 - DNA, 16 bp, Homo sapiens
tcacacatttgttggt

SEQ ID NO: 7182681 - DNA, 16 bp, Homo sapiens
tcacacatttgttggt

SEQ ID NO: 7182682 - DNA, 22 bp, Homo sapiens
tcacaccaggagcagtgccaga

SEQ ID NO: 7182683 - DNA, 22 bp, Homo sapiens
tcacacattctaggtatgttga

SEQ ID NO: 7182684 - DNA, 22 bp, Homo sapiens
tcacacatttctcaagtgtagg

SEQ ID NO: 7182685 - DNA, 22 bp, Homo sapiens
tcacacatttctcaagtgtagg

SEQ ID NO: 7182686 - DNA, 22 bp, Homo sapiens
cagtgcagtttcccagatgctg

SEQ ID NO: 7182687 - DNA, 22 bp, Homo sapiens
cagtgcagtttcccagatgctg

SEQ ID NO: 7182688 - DNA, 22 bp, Homo sapiens
cagtgcagtttcccagatgctg

SEQ ID NO: 7182689 - DNA, 22 bp, Homo sapiens
cagtgcagtttcccagatgctg

SEQ ID NO: 7182690 - DNA, 22 bp, Homo sapiens
cagtgcataatctaaatggggg

SEQ ID NO: 7182691 - DNA, 15 bp, Homo sapiens
cagtgcatacagtga

SEQ ID NO: 7182692 - DNA, 22 bp, Homo sapiens
cagtgcataccctttccctcat

SEQ ID NO: 7182693 - DNA, 22 bp, Homo sapiens
cagtgcatagagagctcctgac

SEQ ID NO: 7182694 - DNA, 22 bp, Homo sapiens
cagtgcatagatcctgaggcct

SEQ ID NO: 7182695 - DNA, 22 bp, Homo sapiens
cagtgcatatgattctgcagtt

SEQ ID NO: 7182696 - DNA, 22 bp, Homo sapiens
tcacacatgtaagggctttgga

SEQ ID NO: 7182697 - DNA, 22 bp, Homo sapiens
cagtgcagttggtggcaggggt

SEQ ID NO: 7182698 - DNA, 22 bp, Homo sapiens
cagtgcagttggtggcaggggt

SEQ ID NO: 7182699 - DNA, 22 bp, Homo sapiens
cagtgcagttggtggcaggggt

SEQ ID NO: 7182700 - DNA, 22 bp, Homo sapiens
cagtgcagttggtggcaggggt

SEQ ID NO: 7182701 - DNA, 22 bp, Homo sapiens
cagtgcagttggtggcaggggt

SEQ ID NO: 7182702 - DNA, 22 bp, Homo sapiens
cagtgcagtcaaggaagaacca

SEQ ID NO: 7182703 - DNA, 22 bp, Homo sapiens
cagtgcaggtttagggctgggg

SEQ ID NO: 7182704 - DNA, 22 bp, Homo sapiens
cagtgcaggtttagggctgggg

SEQ ID NO: 7182705 - DNA, 22 bp, Homo sapiens
cagtgcagtcaaggaagaacca

SEQ ID NO: 7182706 - DNA, 22 bp, Homo sapiens
cagtgcagtcaaggaagaacca

SEQ ID NO: 7182707 - DNA, 22 bp, Homo sapiens
cagtgcaggtttagggctgggg

SEQ ID NO: 7182708 - DNA, 22 bp, Homo sapiens
cagtgcaggtttagggctgggg

SEQ ID NO: 7182709 - DNA, 22 bp, Homo sapiens
cagtgcaggtttagggctgggg

SEQ ID NO: 7182710 - DNA, 22 bp, Homo sapiens
cagtgcaggtttagggctgggg

SEQ ID NO: 7182711 - DNA, 22 bp, Homo sapiens
cagtgcaggtggcagaggacag

SEQ ID NO: 7182712 - DNA, 22 bp, Homo sapiens
cagtgcaggtggcagaggacag

SEQ ID NO: 7182713 - DNA, 22 bp, Homo sapiens
cagtgcaggtggcagaggacag

SEQ ID NO: 7182714 - DNA, 22 bp, Homo sapiens
tcaacaaatacttaaagcagag

SEQ ID NO: 7182715 - DNA, 22 bp, Homo sapiens
cagtgcagaggtgcaagcatgt

SEQ ID NO: 7182716 - DNA, 22 bp, Homo sapiens
cagtgcagaggtgcaagcatgt

SEQ ID NO: 7182717 - DNA, 22 bp, Homo sapiens
cagtgcagaggtgcaagcatgt

SEQ ID NO: 7182718 - DNA, 22 bp, Homo sapiens
cagtgcaggtggcagaggacag

SEQ ID NO: 7182719 - DNA, 17 bp, Homo sapiens
cagtgcagataagtgag

SEQ ID NO: 7182720 - DNA, 17 bp, Homo sapiens
cagtgcagataagtgag

SEQ ID NO: 7182721 - DNA, 22 bp, Homo sapiens
cagtgcaggtggcagaggacag

SEQ ID NO: 7182722 - DNA, 22 bp, Homo sapiens
cagtgcaggtggcagaggacag

SEQ ID NO: 7182723 - DNA, 19 bp, Homo sapiens
cagtggagattggaggagg

SEQ ID NO: 7182724 - DNA, 19 bp, Homo sapiens
cagtggagattggaggagg

SEQ ID NO: 7182725 - DNA, 22 bp, Homo sapiens
cagtggagaggcatgcttggca

SEQ ID NO: 7182726 - DNA, 19 bp, Homo sapiens
cagtggagattggaggagg

SEQ ID NO: 7182727 - DNA, 19 bp, Homo sapiens
cagtggagattggaggagg

SEQ ID NO: 7182728 - DNA, 22 bp, Homo sapiens
tcacactgtgaagagacaagca

SEQ ID NO: 7182729 - DNA, 22 bp, Homo sapiens
tcacactgtgaagagacaagca

SEQ ID NO: 7182730 - DNA, 22 bp, Homo sapiens
tcacacttagagcgaattgttt

SEQ ID NO: 7182731 - DNA, 22 bp, Homo sapiens
tcacactctgcgggtgaccttt

SEQ ID NO: 7182732 - DNA, 22 bp, Homo sapiens
tcacaccaggagcagtgccaga

SEQ ID NO: 7182733 - DNA, 22 bp, Homo sapiens
tcacacgtccttgctactcctc

SEQ ID NO: 7182734 - DNA, 22 bp, Homo sapiens
tcacacgtgaggttctatcctg

SEQ ID NO: 7182735 - DNA, 22 bp, Homo sapiens
cagtggagtgggactggtctga

SEQ ID NO: 7182736 - DNA, 22 bp, Homo sapiens
cagtggaggccttgggaccttt

SEQ ID NO: 7182737 - DNA, 19 bp, Homo sapiens
cagtggagattggaggagg

SEQ ID NO: 7182738 - DNA, 22 bp, Homo sapiens
cagtggaggccttgggaccttt

SEQ ID NO: 7182739 - DNA, 22 bp, Homo sapiens
cagtggaggccttgggaccttt

SEQ ID NO: 7182740 - DNA, 22 bp, Homo sapiens
cagtggaggctcaagtgtgctt

SEQ ID NO: 7182741 - DNA, 22 bp, Homo sapiens
cagtggaggctcaagtgtgctt

SEQ ID NO: 7182742 - DNA, 22 bp, Homo sapiens
cagtggaggctcaagtgtgctt

SEQ ID NO: 7182743 - DNA, 22 bp, Homo sapiens
cagtggaggccttgggaccttt

SEQ ID NO: 7182744 - DNA, 22 bp, Homo sapiens
cagtggattagccagagctgga

SEQ ID NO: 7182745 - DNA, 22 bp, Homo sapiens
cagtggcaagtccggtattgaa

SEQ ID NO: 7182746 - DNA, 22 bp, Homo sapiens
cagtggcaagtccggtattgaa

SEQ ID NO: 7182747 - DNA, 22 bp, Homo sapiens
cagtggcaatgggacagagcac

SEQ ID NO: 7182748 - DNA, 22 bp, Homo sapiens
cagtggcaatgggacagagcac

SEQ ID NO: 7182749 - DNA, 22 bp, Homo sapiens
cagtggcaatgggacagagcac

SEQ ID NO: 7182750 - DNA, 22 bp, Homo sapiens
tcacatgcttgaggaaagaaaa

SEQ ID NO: 7182751 - DNA, 22 bp, Homo sapiens
tcacatgtactgtctgtgacat

SEQ ID NO: 7182752 - DNA, 22 bp, Homo sapiens
tcacatgtcagaataagtgcat

SEQ ID NO: 7182753 - DNA, 22 bp, Homo sapiens
tcacatgtcagaataagtgcat

SEQ ID NO: 7182754 - DNA, 22 bp, Homo sapiens
tcacatgtcagtcttaaacaga

SEQ ID NO: 7182755 - DNA, 22 bp, Homo sapiens
tcacatgtgtacagtcctccca

SEQ ID NO: 7182756 - DNA, 22 bp, Homo sapiens
tcacatgtgtggcagtgcaagt

SEQ ID NO: 7182757 - DNA, 22 bp, Homo sapiens
tcacatgtcacaaaacactgcc

SEQ ID NO: 7182758 - DNA, 22 bp, Homo sapiens
tcacatgtcaagaagataattt

SEQ ID NO: 7182759 - DNA, 22 bp, Homo sapiens
tcacatgtatatgcagcacagc

SEQ ID NO: 7182760 - DNA, 22 bp, Homo sapiens
tcacatgtcaaaaactacataa

SEQ ID NO: 7182761 - DNA, 22 bp, Homo sapiens
tcacatgtgttttctcaccaac

SEQ ID NO: 7182762 - DNA, 22 bp, Homo sapiens
tcacatgtgtggcagtgcaagt

SEQ ID NO: 7182763 - DNA, 22 bp, Homo sapiens
tcacatgttaggtcgggcaagg

SEQ ID NO: 7182764 - DNA, 18 bp, Homo sapiens
tcacattataatgtaaca

SEQ ID NO: 7182765 - DNA, 22 bp, Homo sapiens
tcacattctcagcatctataca

SEQ ID NO: 7182766 - DNA, 22 bp, Homo sapiens
tcacattctcagcatctataca

SEQ ID NO: 7182767 - DNA, 22 bp, Homo sapiens
tcacattcatggtgctaataaa

SEQ ID NO: 7182768 - DNA, 22 bp, Homo sapiens
tcacattctagaatgttatcgt

SEQ ID NO: 7182769 - DNA, 19 bp, Homo sapiens
tcacattcagccttgctga

SEQ ID NO: 7182770 - DNA, 19 bp, Homo sapiens
tcacattcagccttgctga

SEQ ID NO: 7182771 - DNA, 22 bp, Homo sapiens
tcacattcttccctgacttctt

SEQ ID NO: 7182772 - DNA, 22 bp, Homo sapiens
tcacattcttccctgacttctt

SEQ ID NO: 7182773 - DNA, 19 bp, Homo sapiens
tcactctccctgtctgtcc

SEQ ID NO: 7182774 - DNA, 19 bp, Homo sapiens
tcactctccctgtctgtcc

SEQ ID NO: 7182775 - DNA, 22 bp, Homo sapiens
tcactctctaagcatgacagac

SEQ ID NO: 7182776 - DNA, 22 bp, Homo sapiens
tcactctctaagcatgacagac

SEQ ID NO: 7182777 - DNA, 22 bp, Homo sapiens
tcactctctaagcatgacagac

SEQ ID NO: 7182778 - DNA, 22 bp, Homo sapiens
tcactctgaatggtactgagga

SEQ ID NO: 7182779 - DNA, 22 bp, Homo sapiens
tcactctgaatggtactgagga

SEQ ID NO: 7182780 - DNA, 22 bp, Homo sapiens
tcactgcaacctccacctcctg

SEQ ID NO: 7182781 - DNA, 22 bp, Homo sapiens
cagtggcacccacgggctgggc

SEQ ID NO: 7182782 - DNA, 22 bp, Homo sapiens
cagtggcaatgggacagagcac

SEQ ID NO: 7182783 - DNA, 22 bp, Homo sapiens
cagtggcaatgggacagagcac

SEQ ID NO: 7182784 - DNA, 22 bp, Homo sapiens
cagtggcacgatctcagctcac

SEQ ID NO: 7182785 - DNA, 21 bp, Homo sapiens
tcactgcaatgctaggagaaa

SEQ ID NO: 7182786 - DNA, 21 bp, Homo sapiens
tcactgcaatgctaggagaaa

SEQ ID NO: 7182787 - DNA, 22 bp, Homo sapiens
tcactgcactccagcctgggca

SEQ ID NO: 7182788 - DNA, 22 bp, Homo sapiens
tcactgcactccagcctgggtg

SEQ ID NO: 7182789 - DNA, 22 bp, Homo sapiens
tcactgcactccagcctggtga

SEQ ID NO: 7182790 - DNA, 22 bp, Homo sapiens
tcactgcaggtttttcaggagg

SEQ ID NO: 7182791 - DNA, 22 bp, Homo sapiens
cagtggcagagaacagagacct

SEQ ID NO: 7182792 - DNA, 22 bp, Homo sapiens
cagtggcagagaacagagacct

SEQ ID NO: 7182793 - DNA, 22 bp, Homo sapiens
cagtggcagagaacagagacct

SEQ ID NO: 7182794 - DNA, 22 bp, Homo sapiens
cagtggcagagaacagagacct

SEQ ID NO: 7182795 - DNA, 22 bp, Homo sapiens
cagtggcagatcaccaactgga

SEQ ID NO: 7182796 - DNA, 17 bp, Homo sapiens
cagtggcagatcttctc

SEQ ID NO: 7182797 - DNA, 22 bp, Homo sapiens
cagtggcaggatttcagctcag

SEQ ID NO: 7182798 - DNA, 22 bp, Homo sapiens
cagtggttgcttgcatggctcc

SEQ ID NO: 7182799 - DNA, 22 bp, Homo sapiens
cagtggttggtagatacttgag

SEQ ID NO: 7182800 - DNA, 22 bp, Homo sapiens
cagtggttgtcagcaacaatat

SEQ ID NO: 7182801 - DNA, 22 bp, Homo sapiens
cagtggtttaggtcaaggggag

SEQ ID NO: 7182802 - DNA, 22 bp, Homo sapiens
cagtggcaggggaagcaggtgt

SEQ ID NO: 7182803 - DNA, 22 bp, Homo sapiens
cagtgggtgaaagatggctaag

SEQ ID NO: 7182804 - DNA, 22 bp, Homo sapiens
cagtgggtgagaggaaaagctt

SEQ ID NO: 7182805 - DNA, 22 bp, Homo sapiens
cagtgggtgatgagtcctgggg

SEQ ID NO: 7182806 - DNA, 22 bp, Homo sapiens
cagtgggtgatgagtcctgggg

SEQ ID NO: 7182807 - DNA, 22 bp, Homo sapiens
tagcatggtctggaattctcag

SEQ ID NO: 7182808 - DNA, 22 bp, Homo sapiens
tagcatggtctgacatcctttg

SEQ ID NO: 7182809 - DNA, 22 bp, Homo sapiens
tagcatggtctgacatcctttg

SEQ ID NO: 7182810 - DNA, 22 bp, Homo sapiens
tagcatctttttctgtcttcta

SEQ ID NO: 7182811 - DNA, 22 bp, Homo sapiens
tagcatggctgtggtttcttct

SEQ ID NO: 7182812 - DNA, 22 bp, Homo sapiens
tagcatggggagcagaaagtca

SEQ ID NO: 7182813 - DNA, 22 bp, Homo sapiens
tagcatgggtcgcgtctctgga

SEQ ID NO: 7182814 - DNA, 20 bp, Homo sapiens
tagcatgggtgagggtagag

SEQ ID NO: 7182815 - DNA, 22 bp, Homo sapiens
tagcatgtcagtcgccacacgt

SEQ ID NO: 7182816 - DNA, 22 bp, Homo sapiens
tagcattaaaggtaagacatta

SEQ ID NO: 7182817 - DNA, 22 bp, Homo sapiens
tagcattaaaggtaagacatta

SEQ ID NO: 7182818 - DNA, 22 bp, Homo sapiens
tagcattagagatagaaatagt

SEQ ID NO: 7182819 - DNA, 22 bp, Homo sapiens
tagcattagagatagaaatagt

SEQ ID NO: 7182820 - DNA, 22 bp, Homo sapiens
cagggcaggacagatacattac

SEQ ID NO: 7182821 - DNA, 22 bp, Homo sapiens
tagcatcatgatcagaactgtt

SEQ ID NO: 7182822 - DNA, 20 bp, Homo sapiens
tagcatccattcctaccttc

SEQ ID NO: 7182823 - DNA, 20 bp, Homo sapiens
tagcatcctttcctaccttc

SEQ ID NO: 7182824 - DNA, 22 bp, Homo sapiens
tagcatctaacatcttaggact

SEQ ID NO: 7182825 - DNA, 22 bp, Homo sapiens
tagcatctcaacctcctgaaag

SEQ ID NO: 7182826 - DNA, 22 bp, Homo sapiens
tagcatctccttagggtaagga

SEQ ID NO: 7182827 - DNA, 21 bp, Homo sapiens
tagcatctctactgtcataga

SEQ ID NO: 7182828 - DNA, 22 bp, Homo sapiens
tagcatctgaactgttgaaaag

SEQ ID NO: 7182829 - DNA, 22 bp, Homo sapiens
tagcatctgaactgttgaaaag

SEQ ID NO: 7182830 - DNA, 22 bp, Homo sapiens
tagcatctgcatttgtaactag

SEQ ID NO: 7182831 - DNA, 22 bp, Homo sapiens
tagcatctgcgttgggttggac

SEQ ID NO: 7182832 - DNA, 22 bp, Homo sapiens
tagcatctggagaaacaagtcc

SEQ ID NO: 7182833 - DNA, 22 bp, Homo sapiens
tagcatctgtactgacataatc

SEQ ID NO: 7182834 - DNA, 22 bp, Homo sapiens
tagcatctgttctttcattaaa

SEQ ID NO: 7182835 - DNA, 22 bp, Homo sapiens
tagcatctgttctttcattaaa

SEQ ID NO: 7182836 - DNA, 22 bp, Homo sapiens
tagcatctgtttctctttgtga

SEQ ID NO: 7182837 - DNA, 22 bp, Homo sapiens
tagcatcttgatttcagaccag

SEQ ID NO: 7182838 - DNA, 22 bp, Homo sapiens
tagcataatttgtagaaaatca

SEQ ID NO: 7182839 - DNA, 22 bp, Homo sapiens
tagcataatttgtagaaaatca

SEQ ID NO: 7182840 - DNA, 22 bp, Homo sapiens
tagcatagtttggaaatgcagg

SEQ ID NO: 7182841 - DNA, 22 bp, Homo sapiens
tagcatcagccacaccttgtac

SEQ ID NO: 7182842 - DNA, 22 bp, Homo sapiens
tagcataacaggtaagagtgag

SEQ ID NO: 7182843 - DNA, 22 bp, Homo sapiens
tagcagtgtaaagtggctagaa

SEQ ID NO: 7182844 - DNA, 22 bp, Homo sapiens
tagcagtgtaaagtggctagaa

SEQ ID NO: 7182845 - DNA, 22 bp, Homo sapiens
tagcagtgtctaggtaggccat

SEQ ID NO: 7182846 - DNA, 22 bp, Homo sapiens
tagcagtgttgccgttggctgc

SEQ ID NO: 7182847 - DNA, 22 bp, Homo sapiens
tagcagcacatggtggttttat

SEQ ID NO: 7182848 - DNA, 22 bp, Homo sapiens
tagcagcacatggtggttttat

SEQ ID NO: 7182849 - DNA, 22 bp, Homo sapiens
tagcagcacctacacgtcagag

SEQ ID NO: 7182850 - DNA, 22 bp, Homo sapiens
tagcagcacctttctaatctga

SEQ ID NO: 7182851 - DNA, 22 bp, Homo sapiens
tagcagcactatttgttgtagt

SEQ ID NO: 7182852 - DNA, 20 bp, Homo sapiens
tagcagcagaaagaacttag

SEQ ID NO: 7182853 - DNA, 18 bp, Homo sapiens
tagcagcactggccgctt

SEQ ID NO: 7182854 - DNA, 20 bp, Homo sapiens
tagcagcagaaagaacttag

SEQ ID NO: 7182855 - DNA, 22 bp, Homo sapiens
tagcagcaggggaaacagctgt

SEQ ID NO: 7182856 - DNA, 22 bp, Homo sapiens
tagcagcaggggaaacagctgt

SEQ ID NO: 7182857 - DNA, 22 bp, Homo sapiens
cagggcagtttgtgcctatgag

SEQ ID NO: 7182858 - DNA, 22 bp, Homo sapiens
cagggcagtttgtgcctatgag

SEQ ID NO: 7182859 - DNA, 22 bp, Homo sapiens
cagggcagtttgtgcctatgag

SEQ ID NO: 7182860 - DNA, 22 bp, Homo sapiens
cagggcagtttgtgcctatgag

SEQ ID NO: 7182861 - DNA, 22 bp, Homo sapiens
cagggcagtttgtgcctatgag

SEQ ID NO: 7182862 - DNA, 22 bp, Homo sapiens
cagggcagtgaagaacacacgt

SEQ ID NO: 7182863 - DNA, 22 bp, Homo sapiens
cagggcagtgaagaacacacgt

SEQ ID NO: 7182864 - DNA, 22 bp, Homo sapiens
cagggcaggacagatacattac

SEQ ID NO: 7182865 - DNA, 22 bp, Homo sapiens
cagggcagtaccgccctctggc

SEQ ID NO: 7182866 - DNA, 22 bp, Homo sapiens
cagggcagtaccgccctctggc

SEQ ID NO: 7182867 - DNA, 22 bp, Homo sapiens
cagggcagtgaagaacacacgt

SEQ ID NO: 7182868 - DNA, 22 bp, Homo sapiens
cagggcatgaggtgtgcttctc

SEQ ID NO: 7182869 - DNA, 22 bp, Homo sapiens
cagggcatccgtgctccatgct

SEQ ID NO: 7182870 - DNA, 22 bp, Homo sapiens
cagggcatccgtgctccatgct

SEQ ID NO: 7182871 - DNA, 22 bp, Homo sapiens
cagggcatctggagtcgggcgg

SEQ ID NO: 7182872 - DNA, 22 bp, Homo sapiens
cagggcataagatgaggctgta

SEQ ID NO: 7182873 - DNA, 22 bp, Homo sapiens
cagggcatccgtgctccatgct

SEQ ID NO: 7182874 - DNA, 22 bp, Homo sapiens
cagggcatccgtgctccatgct

SEQ ID NO: 7182875 - DNA, 22 bp, Homo sapiens
cagggcatccgtgctccatgct

SEQ ID NO: 7182876 - DNA, 22 bp, Homo sapiens
cagggccaagctgcagcatctg

SEQ ID NO: 7182877 - DNA, 22 bp, Homo sapiens
cagggccaagctgcagcatctg

SEQ ID NO: 7182878 - DNA, 22 bp, Homo sapiens
cagggcattacttcaggtcctt

SEQ ID NO: 7182879 - DNA, 22 bp, Homo sapiens
cagggcagttttacttctctct

SEQ ID NO: 7182880 - DNA, 22 bp, Homo sapiens
cagggcagttttacttctctct

SEQ ID NO: 7182881 - DNA, 22 bp, Homo sapiens
cagggcagttttacttctctct

SEQ ID NO: 7182882 - DNA, 22 bp, Homo sapiens
cagggcagttttacttctctct

SEQ ID NO: 7182883 - DNA, 22 bp, Homo sapiens
cagggcataagatgaggctgta

SEQ ID NO: 7182884 - DNA, 22 bp, Homo sapiens
cagggcataagatgaggctgta

SEQ ID NO: 7182885 - DNA, 22 bp, Homo sapiens
cagggagctttcccaggaccct

SEQ ID NO: 7182886 - DNA, 22 bp, Homo sapiens
cagggagcggagtcccatgcct

SEQ ID NO: 7182887 - DNA, 23 bp, Homo sapiens
cagggaggagatactgtgtatct

SEQ ID NO: 7182888 - DNA, 23 bp, Homo sapiens
cagggaggagatactgtgtatct

SEQ ID NO: 7182889 - DNA, 22 bp, Homo sapiens
cagggaggatgggctgttttgc

SEQ ID NO: 7182890 - DNA, 22 bp, Homo sapiens
cagggaggatgggctgttttgc

SEQ ID NO: 7182891 - DNA, 22 bp, Homo sapiens
cagggaggatgggctgttttgc

SEQ ID NO: 7182892 - DNA, 22 bp, Homo sapiens
cagggaggctgtcttatgcctg

SEQ ID NO: 7182893 - DNA, 22 bp, Homo sapiens
cagggaggctgtcttatgcctg

SEQ ID NO: 7182894 - DNA, 22 bp, Homo sapiens
cagggaggctgtcttatgcctg

SEQ ID NO: 7182895 - DNA, 22 bp, Homo sapiens
cagggagtcaacaaacagatca

SEQ ID NO: 7182896 - DNA, 22 bp, Homo sapiens
cagggagggaggaaaatttgct

SEQ ID NO: 7182897 - DNA, 22 bp, Homo sapiens
cagggagggaggaaaatttgct

SEQ ID NO: 7182898 - DNA, 22 bp, Homo sapiens
cagggagggacaattgtcacct

SEQ ID NO: 7182899 - DNA, 22 bp, Homo sapiens
cagggagggaggaaaatttgct

SEQ ID NO: 7182900 - DNA, 22 bp, Homo sapiens
cagggagggaggaaaatttgct

SEQ ID NO: 7182901 - DNA, 22 bp, Homo sapiens
cagggaggctgtcttatgcctg

SEQ ID NO: 7182902 - DNA, 22 bp, Homo sapiens
cagggagggacaattgtcacct

SEQ ID NO: 7182903 - DNA, 22 bp, Homo sapiens
cagggatgaccagagggatgtg

SEQ ID NO: 7182904 - DNA, 22 bp, Homo sapiens
cagggatgagaaagctctctaa

SEQ ID NO: 7182905 - DNA, 22 bp, Homo sapiens
cagggatgagaaagctctctaa

SEQ ID NO: 7182906 - DNA, 22 bp, Homo sapiens
cagggatgaccagagggatgtg

SEQ ID NO: 7182907 - DNA, 22 bp, Homo sapiens
cagggatgaccagagggatgtg

SEQ ID NO: 7182908 - DNA, 22 bp, Homo sapiens
cagggagtcaacaaacagatca

SEQ ID NO: 7182909 - DNA, 22 bp, Homo sapiens
cagggagtgtacaccatgtgta

SEQ ID NO: 7182910 - DNA, 22 bp, Homo sapiens
cagggagtttttgttcctctag

SEQ ID NO: 7182911 - DNA, 22 bp, Homo sapiens
cagggagtcaacaaacagatca

SEQ ID NO: 7182912 - DNA, 22 bp, Homo sapiens
cagggatgctgcttaggcagtt

SEQ ID NO: 7182913 - DNA, 22 bp, Homo sapiens
cagggatgctgcttaggcagtt

SEQ ID NO: 7182914 - DNA, 22 bp, Homo sapiens
cagggatggcctggcgggccac

SEQ ID NO: 7182915 - DNA, 22 bp, Homo sapiens
cagggatgagcagatggagcaa

SEQ ID NO: 7182916 - DNA, 22 bp, Homo sapiens
cagggatgagcagatggagcaa

SEQ ID NO: 7182917 - DNA, 22 bp, Homo sapiens
cagggatgagagatggcacaga

SEQ ID NO: 7182918 - DNA, 22 bp, Homo sapiens
cagggatgagagatggcacaga

SEQ ID NO: 7182919 - DNA, 22 bp, Homo sapiens
cagggatgagagatggcacaga

SEQ ID NO: 7182920 - DNA, 22 bp, Homo sapiens
cagggatgagagatggcacaga

SEQ ID NO: 7182921 - DNA, 22 bp, Homo sapiens
tagcagagtttggtacctgggg

SEQ ID NO: 7182922 - DNA, 22 bp, Homo sapiens
tagcagcaaagcaggatctgct

SEQ ID NO: 7182923 - DNA, 22 bp, Homo sapiens
tagcagcaaagcaggatctgct

SEQ ID NO: 7182924 - DNA, 22 bp, Homo sapiens
cagggatggcctggcgggccac

SEQ ID NO: 7182925 - DNA, 22 bp, Homo sapiens
tagcaatgtgttgacttggtca

SEQ ID NO: 7182926 - DNA, 22 bp, Homo sapiens
tagcacaaagagtctttcagag

SEQ ID NO: 7182927 - DNA, 22 bp, Homo sapiens
tagcagcaattcaggtgtgatg

SEQ ID NO: 7182928 - DNA, 22 bp, Homo sapiens
tagcagcaagaatgggatgtgt

SEQ ID NO: 7182929 - DNA, 22 bp, Homo sapiens
tagcagcaattacacagtccgt

SEQ ID NO: 7182930 - DNA, 22 bp, Homo sapiens
tagcagcaattacacagtccgt

SEQ ID NO: 7182931 - DNA, 22 bp, Homo sapiens
tagcagcaatttcagaagtttg

SEQ ID NO: 7182932 - DNA, 22 bp, Homo sapiens
tagcagcaatttcagaagtttg

SEQ ID NO: 7182933 - DNA, 22 bp, Homo sapiens
tagcagcacaaatggactatga

SEQ ID NO: 7182934 - DNA, 22 bp, Homo sapiens
tagcagcacagaaagcctggag

SEQ ID NO: 7182935 - DNA, 22 bp, Homo sapiens
caggctgcagcagcagtggccc

SEQ ID NO: 7182936 - DNA, 22 bp, Homo sapiens
caggctgcagcagcagtggccc

SEQ ID NO: 7182937 - DNA, 22 bp, Homo sapiens
caggctgcagcagcagtggccc

SEQ ID NO: 7182938 - DNA, 22 bp, Homo sapiens
caggctgcagcagcagtggccc

SEQ ID NO: 7182939 - DNA, 22 bp, Homo sapiens
caggctgcagcagcagtggccc

SEQ ID NO: 7182940 - DNA, 22 bp, Homo sapiens
caggctgcagcagcagtggccc

SEQ ID NO: 7182941 - DNA, 22 bp, Homo sapiens
tacccagcttcaagtcaggact

SEQ ID NO: 7182942 - DNA, 22 bp, Homo sapiens
tacccaggagaaacagcagggc

SEQ ID NO: 7182943 - DNA, 22 bp, Homo sapiens
tacccaggaggaaactgaggct

SEQ ID NO: 7182944 - DNA, 22 bp, Homo sapiens
tacccaggaggaaactgaggct

SEQ ID NO: 7182945 - DNA, 19 bp, Homo sapiens
taccctcagggcctcattt

SEQ ID NO: 7182946 - DNA, 22 bp, Homo sapiens
taccccttctaatcatcctgtc

SEQ ID NO: 7182947 - DNA, 22 bp, Homo sapiens
taccctgctagctagcatctct

SEQ ID NO: 7182948 - DNA, 22 bp, Homo sapiens
tacctacagatgtaaatgaaac

SEQ ID NO: 7182949 - DNA, 22 bp, Homo sapiens
tacctagacatgaacacagatg

SEQ ID NO: 7182950 - DNA, 22 bp, Homo sapiens
caggctgcagcagcagtggccc

SEQ ID NO: 7182951 - DNA, 22 bp, Homo sapiens
caggctgcagcagcagtggccc

SEQ ID NO: 7182952 - DNA, 22 bp, Homo sapiens
caggctgcagcagcagtggccc

SEQ ID NO: 7182953 - DNA, 22 bp, Homo sapiens
caggctgcagcagcagtggccc

SEQ ID NO: 7182954 - DNA, 22 bp, Homo sapiens
caggctgcagaggcctttcatg

SEQ ID NO: 7182955 - DNA, 22 bp, Homo sapiens
caggctgcagaggcctttcatg

SEQ ID NO: 7182956 - DNA, 22 bp, Homo sapiens
caggctgcaagaaaggcattca

SEQ ID NO: 7182957 - DNA, 22 bp, Homo sapiens
caggctgcaagaaaggcattca

SEQ ID NO: 7182958 - DNA, 22 bp, Homo sapiens
caggctgcaagaaaggcattca

SEQ ID NO: 7182959 - DNA, 22 bp, Homo sapiens
caggctgcaagaaaggcattca

SEQ ID NO: 7182960 - DNA, 22 bp, Homo sapiens
caggctgattaggcctcgtcca

SEQ ID NO: 7182961 - DNA, 22 bp, Homo sapiens
caggctgatcagggctgggatg

SEQ ID NO: 7182962 - DNA, 22 bp, Homo sapiens
caggctgatcagggctgggatg

SEQ ID NO: 7182963 - DNA, 22 bp, Homo sapiens
caggctgagggttaggccttag

SEQ ID NO: 7182964 - DNA, 22 bp, Homo sapiens
tagaaagagctttgcttccttt

SEQ ID NO: 7182965 - DNA, 22 bp, Homo sapiens
tagaaagatctgtaggcaagag

SEQ ID NO: 7182966 - DNA, 19 bp, Homo sapiens
tagaaagatgatgggtggg

SEQ ID NO: 7182967 - DNA, 22 bp, Homo sapiens
tagaaagactgtccagatttca

SEQ ID NO: 7182968 - DNA, 22 bp, Homo sapiens
tagaaagactgtccagatttca

SEQ ID NO: 7182969 - DNA, 22 bp, Homo sapiens
tagaaagacatgggccagcagc

SEQ ID NO: 7182970 - DNA, 22 bp, Homo sapiens
tagaaagacatgggccagcagc

SEQ ID NO: 7182971 - DNA, 22 bp, Homo sapiens
tagaaagacatgggccagcagc

SEQ ID NO: 7182972 - DNA, 22 bp, Homo sapiens
tagaaagagcatagtattataa

SEQ ID NO: 7182973 - DNA, 22 bp, Homo sapiens
tagaaagagcatagtattataa

SEQ ID NO: 7182974 - DNA, 22 bp, Homo sapiens
tagaaagagcatagtattataa

SEQ ID NO: 7182975 - DNA, 22 bp, Homo sapiens
tagaaagacaatgggaagtgct

SEQ ID NO: 7182976 - DNA, 22 bp, Homo sapiens
tagaaagacaatgggaagtgct

SEQ ID NO: 7182977 - DNA, 22 bp, Homo sapiens
tagaaagacagaggttttgtct

SEQ ID NO: 7182978 - DNA, 22 bp, Homo sapiens
tagaaagacagaggttttgtct

SEQ ID NO: 7182979 - DNA, 22 bp, Homo sapiens
tagaaacaagtttctctttggg

SEQ ID NO: 7182980 - DNA, 22 bp, Homo sapiens
tagaaacaagggagaggattct

SEQ ID NO: 7182981 - DNA, 22 bp, Homo sapiens
tagaaacaagggagaggattct

SEQ ID NO: 7182982 - DNA, 22 bp, Homo sapiens
tacctctcggggtctgtttgtg

SEQ ID NO: 7182983 - DNA, 22 bp, Homo sapiens
tacctctcggggtctgtttgtg

SEQ ID NO: 7182984 - DNA, 22 bp, Homo sapiens
tacctctctaaacccagggaca

SEQ ID NO: 7182985 - DNA, 22 bp, Homo sapiens
tagaaacaagggagaggattct

SEQ ID NO: 7182986 - DNA, 22 bp, Homo sapiens
tacctagaccagttacaatgca

SEQ ID NO: 7182987 - DNA, 22 bp, Homo sapiens
tacctagaccagttacaatgca

SEQ ID NO: 7182988 - DNA, 22 bp, Homo sapiens
tacctataggtacaattacaag

SEQ ID NO: 7182989 - DNA, 22 bp, Homo sapiens
tacctcaagttccaggaaagcg

SEQ ID NO: 7182990 - DNA, 22 bp, Homo sapiens
tacctcaagttccaggaaagcg

SEQ ID NO: 7182991 - DNA, 22 bp, Homo sapiens
tacctcaagttccaggaaagcg

SEQ ID NO: 7182992 - DNA, 22 bp, Homo sapiens
cagggagaagtctggtcagtcc

SEQ ID NO: 7182993 - DNA, 22 bp, Homo sapiens
cagggagaagtctggtcagtcc

SEQ ID NO: 7182994 - DNA, 22 bp, Homo sapiens
cagggagaaatctccaggaggt

SEQ ID NO: 7182995 - DNA, 22 bp, Homo sapiens
cagggagaaatctccaggaggt

SEQ ID NO: 7182996 - DNA, 22 bp, Homo sapiens
tagaacagtataggctaaacat

SEQ ID NO: 7182997 - DNA, 22 bp, Homo sapiens
tagaacataagtcattcatttg

SEQ ID NO: 7182998 - DNA, 22 bp, Homo sapiens
cagggacagccttggggtggcg

SEQ ID NO: 7182999 - DNA, 22 bp, Homo sapiens
cagggacagccttggggtggcg

SEQ ID NO: 7183000 - DNA, 22 bp, Homo sapiens
cagggacagccttggggtggcg

SEQ ID NO: 7183001 - DNA, 22 bp, Homo sapiens
tagaacacagaaatgtgtggcc

SEQ ID NO: 7183002 - DNA, 22 bp, Homo sapiens
tagaacacttgaccactgctcc

SEQ ID NO: 7183003 - DNA, 22 bp, Homo sapiens
tagaacacagaaatgtgtggcc

SEQ ID NO: 7183004 - DNA, 22 bp, Homo sapiens
tagaacagaaggcaccttctct

SEQ ID NO: 7183005 - DNA, 22 bp, Homo sapiens
tagaacagagggttgcccagat

SEQ ID NO: 7183006 - DNA, 22 bp, Homo sapiens
tagaacagagttccagtgatca

SEQ ID NO: 7183007 - DNA, 22 bp, Homo sapiens
tagaacagcatttggctattaa

SEQ ID NO: 7183008 - DNA, 22 bp, Homo sapiens
tagaacagcatttggctattaa

SEQ ID NO: 7183009 - DNA, 22 bp, Homo sapiens
tagaacagcatttggctattaa

SEQ ID NO: 7183010 - DNA, 22 bp, Homo sapiens
tagaacaggaataagggaaata

SEQ ID NO: 7183011 - DNA, 22 bp, Homo sapiens
tagaacaggaataagggaaata

SEQ ID NO: 7183012 - DNA, 22 bp, Homo sapiens
tagaacaggctgtcagagcggg

SEQ ID NO: 7183013 - DNA, 22 bp, Homo sapiens
tagaaatgttggtattaacatt

SEQ ID NO: 7183014 - DNA, 22 bp, Homo sapiens
tagaaatgttagatgtattgag

SEQ ID NO: 7183015 - DNA, 22 bp, Homo sapiens
tagaaatgttagatgtattgag

SEQ ID NO: 7183016 - DNA, 22 bp, Homo sapiens
tagaaatgttagatgtattgag

SEQ ID NO: 7183017 - DNA, 22 bp, Homo sapiens
tagaaatgttagatgtattgag

SEQ ID NO: 7183018 - DNA, 22 bp, Homo sapiens
tagaaatgttggtattaacatt

SEQ ID NO: 7183019 - DNA, 22 bp, Homo sapiens
tagaaatgttggtattaacatt

SEQ ID NO: 7183020 - DNA, 22 bp, Homo sapiens
tagaaatgttggtattaacatt

SEQ ID NO: 7183021 - DNA, 22 bp, Homo sapiens
tagaaagcagtatctccatttt

SEQ ID NO: 7183022 - DNA, 22 bp, Homo sapiens
tagaaatgtcgtctccacattt

SEQ ID NO: 7183023 - DNA, 22 bp, Homo sapiens
tagaaatgtcgtctccacattt

SEQ ID NO: 7183024 - DNA, 22 bp, Homo sapiens
tagaaatgtcgtctccacattt

SEQ ID NO: 7183025 - DNA, 22 bp, Homo sapiens
tagaaatgtgataatagcttaa

SEQ ID NO: 7183026 - DNA, 22 bp, Homo sapiens
tagaaatgtgataatagcttaa

SEQ ID NO: 7183027 - DNA, 22 bp, Homo sapiens
tagaaatgtgataatagcttaa

SEQ ID NO: 7183028 - DNA, 22 bp, Homo sapiens
tagaaatgtgataatagcttaa

SEQ ID NO: 7183029 - DNA, 22 bp, Homo sapiens
cagggagaagtctggtcagtcc

SEQ ID NO: 7183030 - DNA, 22 bp, Homo sapiens
cagggagaagtctggtcagtcc

SEQ ID NO: 7183031 - DNA, 22 bp, Homo sapiens
cagggagaggcatcatagggaa

SEQ ID NO: 7183032 - DNA, 22 bp, Homo sapiens
cagggagaggcatcatagggaa

SEQ ID NO: 7183033 - DNA, 22 bp, Homo sapiens
cagggagaagtctggtcagtcc

SEQ ID NO: 7183034 - DNA, 22 bp, Homo sapiens
cagggagaggcctctgttgccc

SEQ ID NO: 7183035 - DNA, 22 bp, Homo sapiens
cagggagaggcatcatagggaa

SEQ ID NO: 7183036 - DNA, 22 bp, Homo sapiens
cagggagaggcatcatagggaa

SEQ ID NO: 7183037 - DNA, 22 bp, Homo sapiens
cagggagaggcatcatagggaa

SEQ ID NO: 7183038 - DNA, 22 bp, Homo sapiens
cagggagaggcatcatagggaa

SEQ ID NO: 7183039 - DNA, 22 bp, Homo sapiens
cagggagaggcctctgttgccc

SEQ ID NO: 7183040 - DNA, 22 bp, Homo sapiens
cagggagaggctggtggagtaa

SEQ ID NO: 7183041 - DNA, 22 bp, Homo sapiens
cagggagaggcctctgttgccc

SEQ ID NO: 7183042 - DNA, 22 bp, Homo sapiens
cagggagaggcctctgttgccc

SEQ ID NO: 7183043 - DNA, 22 bp, Homo sapiens
cagggagaggcctctgttgccc

SEQ ID NO: 7183044 - DNA, 22 bp, Homo sapiens
cagggagaggctggtggagtaa

SEQ ID NO: 7183045 - DNA, 22 bp, Homo sapiens
cagggagaggctggtggagtaa

SEQ ID NO: 7183046 - DNA, 22 bp, Homo sapiens
cagggagatcttggctcctggt

SEQ ID NO: 7183047 - DNA, 22 bp, Homo sapiens
cagggagaggctggtggagtaa

SEQ ID NO: 7183048 - DNA, 22 bp, Homo sapiens
cagggagatcttggctcctggt

SEQ ID NO: 7183049 - DNA, 22 bp, Homo sapiens
cagggagatcttggctcctggt

SEQ ID NO: 7183050 - DNA, 22 bp, Homo sapiens
cagggagaggctggtggagtaa

SEQ ID NO: 7183051 - DNA, 22 bp, Homo sapiens
tagacatttctggttattgaca

SEQ ID NO: 7183052 - DNA, 22 bp, Homo sapiens
tagacatttggagttttatgac

SEQ ID NO: 7183053 - DNA, 22 bp, Homo sapiens
tagacatttgtcaagaatgact

SEQ ID NO: 7183054 - DNA, 22 bp, Homo sapiens
tagacatttgtcaagaatgact

SEQ ID NO: 7183055 - DNA, 22 bp, Homo sapiens
tagacattatgtattaagttct

SEQ ID NO: 7183056 - DNA, 22 bp, Homo sapiens
tagacattggccattcctgtgg

SEQ ID NO: 7183057 - DNA, 22 bp, Homo sapiens
tagacatttctggttattgaca

SEQ ID NO: 7183058 - DNA, 22 bp, Homo sapiens
tagacatttctggttattgaca

SEQ ID NO: 7183059 - DNA, 22 bp, Homo sapiens
tagacattaggtaggttcatgg

SEQ ID NO: 7183060 - DNA, 22 bp, Homo sapiens
tagacattatgtattaagttct

SEQ ID NO: 7183061 - DNA, 22 bp, Homo sapiens
tagacataggaagtggaagctt

SEQ ID NO: 7183062 - DNA, 22 bp, Homo sapiens
tagacaggagtcaggctagaat

SEQ ID NO: 7183063 - DNA, 22 bp, Homo sapiens
tagacagggtggcttagaaaca

SEQ ID NO: 7183064 - DNA, 22 bp, Homo sapiens
tagacagtgagctatgagtggt

SEQ ID NO: 7183065 - DNA, 23 bp, Homo sapiens
tagacataagctctgtcaccttc

SEQ ID NO: 7183066 - DNA, 22 bp, Homo sapiens
tagacatacagtgcagtacata

SEQ ID NO: 7183067 - DNA, 22 bp, Homo sapiens
gtggagcaatcagagggtcagt

SEQ ID NO: 7183068 - DNA, 21 bp, Homo sapiens
gtggagagtgattttgatgca

SEQ ID NO: 7183069 - DNA, 20 bp, Homo sapiens
gtggagaggctggcgggact

SEQ ID NO: 7183070 - DNA, 20 bp, Homo sapiens
gtggagaggctggcgggact

SEQ ID NO: 7183071 - DNA, 20 bp, Homo sapiens
gtggagaggctggcgggact

SEQ ID NO: 7183072 - DNA, 22 bp, Homo sapiens
gtggagaggagcagctacctca

SEQ ID NO: 7183073 - DNA, 22 bp, Homo sapiens
gtggagcaatcagagggtcagt

SEQ ID NO: 7183074 - DNA, 22 bp, Homo sapiens
gtggagcaatcagagggtcagt

SEQ ID NO: 7183075 - DNA, 22 bp, Homo sapiens
gtggagcaatcagagggtcagt

SEQ ID NO: 7183076 - DNA, 22 bp, Homo sapiens
gtggagcacggaggaggcccct

SEQ ID NO: 7183077 - DNA, 22 bp, Homo sapiens
gtggagcacggaggaggcccct

SEQ ID NO: 7183078 - DNA, 22 bp, Homo sapiens
gtggagcaggactagctgagaa

SEQ ID NO: 7183079 - DNA, 22 bp, Homo sapiens
gtggagcaggactagctgagaa

SEQ ID NO: 7183080 - DNA, 22 bp, Homo sapiens
gtggagcaggactagctgagaa

SEQ ID NO: 7183081 - DNA, 22 bp, Homo sapiens
gtggagcaggactagctgagaa

SEQ ID NO: 7183082 - DNA, 22 bp, Homo sapiens
gtggagcataacacactagcct

SEQ ID NO: 7183083 - DNA, 22 bp, Homo sapiens
gtggagcataacacactagcct

SEQ ID NO: 7183084 - DNA, 22 bp, Homo sapiens
gtggagcatgtgaggactgagt

SEQ ID NO: 7183085 - DNA, 22 bp, Homo sapiens
gtggagcatgtgaggactgagt

SEQ ID NO: 7183086 - DNA, 23 bp, Homo sapiens
gtggagccacatcacaggctcct

SEQ ID NO: 7183087 - DNA, 22 bp, Homo sapiens
gtggagccaggatctccgcaca

SEQ ID NO: 7183088 - DNA, 22 bp, Homo sapiens
cagctctgccacttcctagcta

SEQ ID NO: 7183089 - DNA, 22 bp, Homo sapiens
cagctctgccacttcctagcta

SEQ ID NO: 7183090 - DNA, 22 bp, Homo sapiens
cagctctgccacttcctagcta

SEQ ID NO: 7183091 - DNA, 22 bp, Homo sapiens
cagctctgccacttcctagcta

SEQ ID NO: 7183092 - DNA, 22 bp, Homo sapiens
cagctctgccatcatctgcctt

SEQ ID NO: 7183093 - DNA, 17 bp, Homo sapiens
cagctctgcatcttcct

SEQ ID NO: 7183094 - DNA, 17 bp, Homo sapiens
cagctctgcatcttcct

SEQ ID NO: 7183095 - DNA, 17 bp, Homo sapiens
cagctctgcatcttcct

SEQ ID NO: 7183096 - DNA, 17 bp, Homo sapiens
cagctctgcatcttcct

SEQ ID NO: 7183097 - DNA, 17 bp, Homo sapiens
cagctctgcatcttcct

SEQ ID NO: 7183098 - DNA, 17 bp, Homo sapiens
cagctctgcatcttcct

SEQ ID NO: 7183099 - DNA, 22 bp, Homo sapiens
cagctctgccacttcctagcta

SEQ ID NO: 7183100 - DNA, 22 bp, Homo sapiens
cagctctgccacttcctagcta

SEQ ID NO: 7183101 - DNA, 22 bp, Homo sapiens
cagctctgccacttcctagcta

SEQ ID NO: 7183102 - DNA, 22 bp, Homo sapiens
cagctctgccatcatctgcctt

SEQ ID NO: 7183103 - DNA, 22 bp, Homo sapiens
cagctctgccatcatctgcctt

SEQ ID NO: 7183104 - DNA, 22 bp, Homo sapiens
cagctctgccatcatctgcctt

SEQ ID NO: 7183105 - DNA, 22 bp, Homo sapiens
cagctctgcctctggggctgag

SEQ ID NO: 7183106 - DNA, 22 bp, Homo sapiens
cagctctgcctctggggctgag

SEQ ID NO: 7183107 - DNA, 22 bp, Homo sapiens
cagctctgcctctggggctgag

SEQ ID NO: 7183108 - DNA, 22 bp, Homo sapiens
cagctctgcctctggggctgag

SEQ ID NO: 7183109 - DNA, 22 bp, Homo sapiens
cagctctgcctctggggctgag

SEQ ID NO: 7183110 - DNA, 22 bp, Homo sapiens
cagctctgcctctggggctgag

SEQ ID NO: 7183111 - DNA, 22 bp, Homo sapiens
cagctctgcctctggggctgag

SEQ ID NO: 7183112 - DNA, 22 bp, Homo sapiens
cagctctgctgggaggatgcag

SEQ ID NO: 7183113 - DNA, 22 bp, Homo sapiens
cagctctgctgggaggatgcag

SEQ ID NO: 7183114 - DNA, 22 bp, Homo sapiens
cagctctgctgggaggatgcag

SEQ ID NO: 7183115 - DNA, 22 bp, Homo sapiens
cagctctgctgggaggatgcag

SEQ ID NO: 7183116 - DNA, 22 bp, Homo sapiens
gtggagaggaacccagctctgt

SEQ ID NO: 7183117 - DNA, 22 bp, Homo sapiens
cagctctgctgggaggatgcag

SEQ ID NO: 7183118 - DNA, 22 bp, Homo sapiens
tacacagatatgtgatcaatca

SEQ ID NO: 7183119 - DNA, 22 bp, Homo sapiens
tacacagaggctgatgtcttag

SEQ ID NO: 7183120 - DNA, 22 bp, Homo sapiens
tacacagaggctgatgtcttag

SEQ ID NO: 7183121 - DNA, 22 bp, Homo sapiens
tacacagaggctgatgtcttag

SEQ ID NO: 7183122 - DNA, 22 bp, Homo sapiens
tacacagactcttcaattcaga

SEQ ID NO: 7183123 - DNA, 22 bp, Homo sapiens
tacacagactcttcaattcaga

SEQ ID NO: 7183124 - DNA, 22 bp, Homo sapiens
tacaatatgtgaactttggtgt

SEQ ID NO: 7183125 - DNA, 22 bp, Homo sapiens
tacaatagggcttttgtttatg

SEQ ID NO: 7183126 - DNA, 22 bp, Homo sapiens
tacaatagggcttttgtttatg

SEQ ID NO: 7183127 - DNA, 22 bp, Homo sapiens
tacacagatttcagtatcatca

SEQ ID NO: 7183128 - DNA, 22 bp, Homo sapiens
tacacagcctgtaatgatgact

SEQ ID NO: 7183129 - DNA, 22 bp, Homo sapiens
tacacagcctgtaatgatgact

SEQ ID NO: 7183130 - DNA, 22 bp, Homo sapiens
tacacagggaaaggtctcagag

SEQ ID NO: 7183131 - DNA, 22 bp, Homo sapiens
tacacagggaaaggtctcagag

SEQ ID NO: 7183132 - DNA, 22 bp, Homo sapiens
tacacagggagagattggaaac

SEQ ID NO: 7183133 - DNA, 22 bp, Homo sapiens
tacacagggtatggcttgagga

SEQ ID NO: 7183134 - DNA, 22 bp, Homo sapiens
caggccaaaattcaggcattct

SEQ ID NO: 7183135 - DNA, 22 bp, Homo sapiens
caggccaaagatcccattgaca

SEQ ID NO: 7183136 - DNA, 22 bp, Homo sapiens
caggccaaagatcccattgaca

SEQ ID NO: 7183137 - DNA, 22 bp, Homo sapiens
caggccaaagatcccattgaca

SEQ ID NO: 7183138 - DNA, 22 bp, Homo sapiens
caggccaaagatcccattgaca

SEQ ID NO: 7183139 - DNA, 22 bp, Homo sapiens
caggccaactgcatggtgacca

SEQ ID NO: 7183140 - DNA, 22 bp, Homo sapiens
caggccaactgcatggtgacca

SEQ ID NO: 7183141 - DNA, 22 bp, Homo sapiens
caggccaactgcatggtgacca

SEQ ID NO: 7183142 - DNA, 22 bp, Homo sapiens
caggccaactgcatggtgacca

SEQ ID NO: 7183143 - DNA, 22 bp, Homo sapiens
caggccaagcctccccagctcc

SEQ ID NO: 7183144 - DNA, 22 bp, Homo sapiens
caggccaagcctccccagctcc

SEQ ID NO: 7183145 - DNA, 22 bp, Homo sapiens
caggccaagcctccccagctcc

SEQ ID NO: 7183146 - DNA, 22 bp, Homo sapiens
caggccaagtcccaagtgcggg

SEQ ID NO: 7183147 - DNA, 22 bp, Homo sapiens
caggccaagtcccaagtgcggg

SEQ ID NO: 7183148 - DNA, 22 bp, Homo sapiens
caggccaataaatgtgatggcc

SEQ ID NO: 7183149 - DNA, 22 bp, Homo sapiens
caggccaataaatgtgatggcc

SEQ ID NO: 7183150 - DNA, 22 bp, Homo sapiens
tacagaccagtagttctcagcg

SEQ ID NO: 7183151 - DNA, 22 bp, Homo sapiens
tacagactgttcaagtgataat

SEQ ID NO: 7183152 - DNA, 22 bp, Homo sapiens
tacagactgttcaagtgataat

SEQ ID NO: 7183153 - DNA, 22 bp, Homo sapiens
tacagagaactcatagaaagaa

SEQ ID NO: 7183154 - DNA, 22 bp, Homo sapiens
tacagacatttactccactcct

SEQ ID NO: 7183155 - DNA, 22 bp, Homo sapiens
tacagacatttactccactcct

SEQ ID NO: 7183156 - DNA, 22 bp, Homo sapiens
tacagagaactcatagaaagaa

SEQ ID NO: 7183157 - DNA, 22 bp, Homo sapiens
tacagagaactcatagaaagaa

SEQ ID NO: 7183158 - DNA, 22 bp, Homo sapiens
tacagagaataataggacaggt

SEQ ID NO: 7183159 - DNA, 22 bp, Homo sapiens
tacagagaataataggacaggt

SEQ ID NO: 7183160 - DNA, 22 bp, Homo sapiens
tacagagaataataggacaggt

SEQ ID NO: 7183161 - DNA, 22 bp, Homo sapiens
tacagagaataataggacaggt

SEQ ID NO: 7183162 - DNA, 22 bp, Homo sapiens
tacactttatggatcctacttt

SEQ ID NO: 7183163 - DNA, 22 bp, Homo sapiens
tacactttgtgatgccgggagc

SEQ ID NO: 7183164 - DNA, 22 bp, Homo sapiens
tacacttttcaatgtagtctgt

SEQ ID NO: 7183165 - DNA, 22 bp, Homo sapiens
tacagacattcaattttgaccc

SEQ ID NO: 7183166 - DNA, 22 bp, Homo sapiens
tacactgtttgaactgtggtcg

SEQ ID NO: 7183167 - DNA, 22 bp, Homo sapiens
tacactgtttttggaaagaaga

SEQ ID NO: 7183168 - DNA, 19 bp, Homo sapiens
tacacttgtaatgagcaga

SEQ ID NO: 7183169 - DNA, 19 bp, Homo sapiens
tacacttgtaatgagcaga

SEQ ID NO: 7183170 - DNA, 22 bp, Homo sapiens
tacacttgttcaaacagcaaaa

SEQ ID NO: 7183171 - DNA, 22 bp, Homo sapiens
tacactgtgtaaaatgcacttt

SEQ ID NO: 7183172 - DNA, 22 bp, Homo sapiens
tacactgtgtaaaatgcacttt

SEQ ID NO: 7183173 - DNA, 22 bp, Homo sapiens
tacactgtgtaaaatgcacttt

SEQ ID NO: 7183174 - DNA, 22 bp, Homo sapiens
tacactgtgaggtttccaaggg

SEQ ID NO: 7183175 - DNA, 22 bp, Homo sapiens
tacactgtggtaaactcaaagt

SEQ ID NO: 7183176 - DNA, 22 bp, Homo sapiens
tacactgtgacaatcatgacag

SEQ ID NO: 7183177 - DNA, 22 bp, Homo sapiens
tacactgtgacaatcatgacag

SEQ ID NO: 7183178 - DNA, 22 bp, Homo sapiens
tacactgtcagatttcgattgc

SEQ ID NO: 7183179 - DNA, 22 bp, Homo sapiens
tacactgtcttagaaaggggca

SEQ ID NO: 7183180 - DNA, 22 bp, Homo sapiens
caggccctgccttggcatgtgt

SEQ ID NO: 7183181 - DNA, 22 bp, Homo sapiens
caggccctgccttggcatgtgt

SEQ ID NO: 7183182 - DNA, 22 bp, Homo sapiens
caggccctgctgctgagacctt

SEQ ID NO: 7183183 - DNA, 22 bp, Homo sapiens
tacactggacaggagtaggaag

SEQ ID NO: 7183184 - DNA, 22 bp, Homo sapiens
tacactggacaggagtaggaag

SEQ ID NO: 7183185 - DNA, 22 bp, Homo sapiens
tacactggagcccttggggtct

SEQ ID NO: 7183186 - DNA, 22 bp, Homo sapiens
tacactggattagctgtcctac

SEQ ID NO: 7183187 - DNA, 22 bp, Homo sapiens
tacactggccaaatgcctttgg

SEQ ID NO: 7183188 - DNA, 22 bp, Homo sapiens
tacactggccccagggcggggc

SEQ ID NO: 7183189 - DNA, 22 bp, Homo sapiens
tacactggccccagggcggggc

SEQ ID NO: 7183190 - DNA, 22 bp, Homo sapiens
tacactggctgttttgcagaaa

SEQ ID NO: 7183191 - DNA, 22 bp, Homo sapiens
tacactggggctctgggagtga

SEQ ID NO: 7183192 - DNA, 22 bp, Homo sapiens
tacactgtacgctctgcttcaa

SEQ ID NO: 7183193 - DNA, 22 bp, Homo sapiens
tacactgtacgctctgcttcaa

SEQ ID NO: 7183194 - DNA, 22 bp, Homo sapiens
tacactgtaggtggcaggcagc

SEQ ID NO: 7183195 - DNA, 22 bp, Homo sapiens
caggccaccagatacatgcccc

SEQ ID NO: 7183196 - DNA, 22 bp, Homo sapiens
caggccacagctaaagaggatt

SEQ ID NO: 7183197 - DNA, 22 bp, Homo sapiens
caggccacagctaaagaggatt

SEQ ID NO: 7183198 - DNA, 22 bp, Homo sapiens
caggccaccagatacatgcccc

SEQ ID NO: 7183199 - DNA, 22 bp, Homo sapiens
caggccacacggcggctccctg

SEQ ID NO: 7183200 - DNA, 22 bp, Homo sapiens
caggccaatatcacatgctatg

SEQ ID NO: 7183201 - DNA, 22 bp, Homo sapiens
caggccaatatcacatgctatg

SEQ ID NO: 7183202 - DNA, 22 bp, Homo sapiens
caggccaatatcacatgctatg

SEQ ID NO: 7183203 - DNA, 22 bp, Homo sapiens
caggccaatatcacatgctatg

SEQ ID NO: 7183204 - DNA, 22 bp, Homo sapiens
caggccaatttcttgtcattta

SEQ ID NO: 7183205 - DNA, 22 bp, Homo sapiens
caggccacaagttgggttcaag

SEQ ID NO: 7183206 - DNA, 22 bp, Homo sapiens
caggccacaagttgggttcaag

SEQ ID NO: 7183207 - DNA, 22 bp, Homo sapiens
caggccacacggcggctccctg

SEQ ID NO: 7183208 - DNA, 22 bp, Homo sapiens
caggccacacggcggctccctg

SEQ ID NO: 7183209 - DNA, 22 bp, Homo sapiens
caggccaccagatacatgcccc

SEQ ID NO: 7183210 - DNA, 22 bp, Homo sapiens
caggccacgccccggcgtgtga

SEQ ID NO: 7183211 - DNA, 22 bp, Homo sapiens
caggccacgccccggcgtgtga

SEQ ID NO: 7183212 - DNA, 22 bp, Homo sapiens
caggccagagcgcgtggttggg

SEQ ID NO: 7183213 - DNA, 22 bp, Homo sapiens
caggcccaggggtctggcccac

SEQ ID NO: 7183214 - DNA, 22 bp, Homo sapiens
caggcccaggggtctggcccac

SEQ ID NO: 7183215 - DNA, 22 bp, Homo sapiens
caggcccagggagggagaccaa

SEQ ID NO: 7183216 - DNA, 22 bp, Homo sapiens
caggcccaggggtctggcccac

SEQ ID NO: 7183217 - DNA, 22 bp, Homo sapiens
caggcccaggggtctggcccac

SEQ ID NO: 7183218 - DNA, 22 bp, Homo sapiens
caggcccaggggtctggcccac

SEQ ID NO: 7183219 - DNA, 22 bp, Homo sapiens
caggcccaggggtctggcccac

SEQ ID NO: 7183220 - DNA, 22 bp, Homo sapiens
caggcccaggggtctggcccac

SEQ ID NO: 7183221 - DNA, 22 bp, Homo sapiens
caggccccattcctcttgggac

SEQ ID NO: 7183222 - DNA, 22 bp, Homo sapiens
caggccctcaggcaagggctct

SEQ ID NO: 7183223 - DNA, 22 bp, Homo sapiens
caggccctcaggcaagggctct

SEQ ID NO: 7183224 - DNA, 22 bp, Homo sapiens
caggccctgcactaggccctgg

SEQ ID NO: 7183225 - DNA, 22 bp, Homo sapiens
caggccctgcactaggccctgg

SEQ ID NO: 7183226 - DNA, 22 bp, Homo sapiens
caggccctgccttgagggacct

SEQ ID NO: 7183227 - DNA, 22 bp, Homo sapiens
caggccctgccttgagggacct

SEQ ID NO: 7183228 - DNA, 22 bp, Homo sapiens
caggccctgcactaggccctgg

SEQ ID NO: 7183229 - DNA, 22 bp, Homo sapiens
caggccctgcacagtggtcctg

SEQ ID NO: 7183230 - DNA, 22 bp, Homo sapiens
caggccctgcacagtggtcctg

SEQ ID NO: 7183231 - DNA, 22 bp, Homo sapiens
caggccctcgtggtgagctggg

SEQ ID NO: 7183232 - DNA, 22 bp, Homo sapiens
caggccctcgtggtgagctggg

SEQ ID NO: 7183233 - DNA, 22 bp, Homo sapiens
caggccctcctgtgatctgcct

SEQ ID NO: 7183234 - DNA, 22 bp, Homo sapiens
caggccctcctgtgatctgcct

SEQ ID NO: 7183235 - DNA, 22 bp, Homo sapiens
caggccctcctgtgatctgcct

SEQ ID NO: 7183236 - DNA, 22 bp, Homo sapiens
caggccctcctgtgatctgcct

SEQ ID NO: 7183237 - DNA, 22 bp, Homo sapiens
caggccctcctgtgatctgcct

SEQ ID NO: 7183238 - DNA, 22 bp, Homo sapiens
caggccctcgcccgcagcgacc

SEQ ID NO: 7183239 - DNA, 22 bp, Homo sapiens
caggccctcgcccgcagcgacc

SEQ ID NO: 7183240 - DNA, 22 bp, Homo sapiens
caggccctcgcccgcagcgacc

SEQ ID NO: 7183241 - DNA, 22 bp, Homo sapiens
caggccctcgtggtgagctggg

SEQ ID NO: 7183242 - DNA, 22 bp, Homo sapiens
tacagcatatacagaatgaaca

SEQ ID NO: 7183243 - DNA, 22 bp, Homo sapiens
tacagcatgatcacaatggaaa

SEQ ID NO: 7183244 - DNA, 22 bp, Homo sapiens
tacagagagtacagcatccaca

SEQ ID NO: 7183245 - DNA, 22 bp, Homo sapiens
tacagcagggcgctgtgatgaa

SEQ ID NO: 7183246 - DNA, 22 bp, Homo sapiens
tacagcagggcgctgtgatgaa

SEQ ID NO: 7183247 - DNA, 22 bp, Homo sapiens
tacagagagctccggacattca

SEQ ID NO: 7183248 - DNA, 22 bp, Homo sapiens
tacagagagctccggacattca

SEQ ID NO: 7183249 - DNA, 20 bp, Homo sapiens
tacagagagctagctctctg

SEQ ID NO: 7183250 - DNA, 20 bp, Homo sapiens
tacagagagctagctctctg

SEQ ID NO: 7183251 - DNA, 22 bp, Homo sapiens
tacagagagctccggacattca

SEQ ID NO: 7183252 - DNA, 22 bp, Homo sapiens
tacagagaggtgacccttgggc

SEQ ID NO: 7183253 - DNA, 22 bp, Homo sapiens
tacagagagtacagcatccaca

SEQ ID NO: 7183254 - DNA, 22 bp, Homo sapiens
tacagagacccacaagagactg

SEQ ID NO: 7183255 - DNA, 22 bp, Homo sapiens
tacagagacccacaagagactg

SEQ ID NO: 7183256 - DNA, 22 bp, Homo sapiens
tacagagactttatggcacaaa

SEQ ID NO: 7183257 - DNA, 22 bp, Homo sapiens
tacagagactttatggcacaaa

SEQ ID NO: 7183258 - DNA, 22 bp, Homo sapiens
tacagagagaggggttaccagg

SEQ ID NO: 7183259 - DNA, 22 bp, Homo sapiens
tacagagagaggggttaccagg

SEQ ID NO: 7183260 - DNA, 22 bp, Homo sapiens
tacagagagataagtgtaaaag

SEQ ID NO: 7183261 - DNA, 22 bp, Homo sapiens
tacagagagataagtgtaaaag

SEQ ID NO: 7183262 - DNA, 20 bp, Homo sapiens
tacagagagctagctctctg

SEQ ID NO: 7183263 - DNA, 22 bp, Homo sapiens
tacagcatgtccttagcaaggc

SEQ ID NO: 7183264 - DNA, 22 bp, Homo sapiens
tacagccacaggtgactctcat

SEQ ID NO: 7183265 - DNA, 22 bp, Homo sapiens
tacagccacggtctatggaggc

SEQ ID NO: 7183266 - DNA, 22 bp, Homo sapiens
tacagcctcacatttacttaca

SEQ ID NO: 7183267 - DNA, 22 bp, Homo sapiens
tacagcctcgaactcctgcatt

SEQ ID NO: 7183268 - DNA, 22 bp, Homo sapiens
tacagcctcttccctggagtgg

SEQ ID NO: 7183269 - DNA, 22 bp, Homo sapiens
tacagcctgatttggagccact

SEQ ID NO: 7183270 - DNA, 22 bp, Homo sapiens
tacagcctcgaactcctgcatt

SEQ ID NO: 7183271 - DNA, 22 bp, Homo sapiens
tacagcctggcactaccctggg

SEQ ID NO: 7183272 - DNA, 22 bp, Homo sapiens
tacagcctgttacctatatttg

SEQ ID NO: 7183273 - DNA, 22 bp, Homo sapiens
tacagcgaaaatttagcttgat

SEQ ID NO: 7183274 - DNA, 22 bp, Homo sapiens
tacagcgatcagtgtcattagc

SEQ ID NO: 7183275 - DNA, 22 bp, Homo sapiens
tacagctaggcaaaaatgacat

SEQ ID NO: 7183276 - DNA, 22 bp, Homo sapiens
tacagctcccggggagcttcgt

SEQ ID NO: 7183277 - DNA, 23 bp, Homo sapiens
tacagctgcagaatcaggctaag

SEQ ID NO: 7183278 - DNA, 22 bp, Homo sapiens
tacagctgagtttaggtacagg

SEQ ID NO: 7183279 - DNA, 22 bp, Homo sapiens
caggcctggagtgcaatggcac

SEQ ID NO: 7183280 - DNA, 22 bp, Homo sapiens
caggcctggagtgcaatggcac

SEQ ID NO: 7183281 - DNA, 22 bp, Homo sapiens
caggcctggagtgcaatggcac

SEQ ID NO: 7183282 - DNA, 22 bp, Homo sapiens
caggcctggagtgcaatggcac

SEQ ID NO: 7183283 - DNA, 22 bp, Homo sapiens
caggcctgtctgcacatgaggc

SEQ ID NO: 7183284 - DNA, 22 bp, Homo sapiens
caggcctgtctgcacatgaggc

SEQ ID NO: 7183285 - DNA, 22 bp, Homo sapiens
caggcctgtgacaccgtgtctg

SEQ ID NO: 7183286 - DNA, 22 bp, Homo sapiens
caggcctgtgacaccgtgtctg

SEQ ID NO: 7183287 - DNA, 22 bp, Homo sapiens
caggcctgtgacaccgtgtctg

SEQ ID NO: 7183288 - DNA, 22 bp, Homo sapiens
caggcctgtgagttgaggcccc

SEQ ID NO: 7183289 - DNA, 22 bp, Homo sapiens
caggcctgtgagttgaggcccc

SEQ ID NO: 7183290 - DNA, 22 bp, Homo sapiens
caggcctgtgagttgaggcccc

SEQ ID NO: 7183291 - DNA, 22 bp, Homo sapiens
caggcctgtgagttgaggcccc

SEQ ID NO: 7183292 - DNA, 22 bp, Homo sapiens
caggcctgtgagttgaggcccc

SEQ ID NO: 7183293 - DNA, 22 bp, Homo sapiens
caggccttgaaggcctgcggga

SEQ ID NO: 7183294 - DNA, 17 bp, Homo sapiens
caggccttgagccttta

SEQ ID NO: 7183295 - DNA, 22 bp, Homo sapiens
caggccttgcgtcccatggcct

SEQ ID NO: 7183296 - DNA, 22 bp, Homo sapiens
caggccttgggagagggtagat

SEQ ID NO: 7183297 - DNA, 22 bp, Homo sapiens
caggctctaggttagtaggaga

SEQ ID NO: 7183298 - DNA, 22 bp, Homo sapiens
caggctctaggttagtaggaga

SEQ ID NO: 7183299 - DNA, 21 bp, Homo sapiens
caggctctgctagaggagcct

SEQ ID NO: 7183300 - DNA, 22 bp, Homo sapiens
caggctctaggttagtaggaga

SEQ ID NO: 7183301 - DNA, 22 bp, Homo sapiens
caggctcggaagtgctggcttt

SEQ ID NO: 7183302 - DNA, 22 bp, Homo sapiens
caggctcggtccagtggcaccc

SEQ ID NO: 7183303 - DNA, 22 bp, Homo sapiens
caggctccttcccagggatggt

SEQ ID NO: 7183304 - DNA, 22 bp, Homo sapiens
caggctccttcccagggatggt

SEQ ID NO: 7183305 - DNA, 22 bp, Homo sapiens
caggctcggaagtgctggcttt

SEQ ID NO: 7183306 - DNA, 22 bp, Homo sapiens
caggctccttcccagggatggt

SEQ ID NO: 7183307 - DNA, 22 bp, Homo sapiens
caggctccttcccagggatggt

SEQ ID NO: 7183308 - DNA, 22 bp, Homo sapiens
caggctccttcccagggatggt

SEQ ID NO: 7183309 - DNA, 20 bp, Homo sapiens
caggctccgcaggactaggg

SEQ ID NO: 7183310 - DNA, 20 bp, Homo sapiens
caggctccgcaggactaggg

SEQ ID NO: 7183311 - DNA, 20 bp, Homo sapiens
caggctccgcaggactaggg

SEQ ID NO: 7183312 - DNA, 20 bp, Homo sapiens
caggctccgcaggactaggg

SEQ ID NO: 7183313 - DNA, 22 bp, Homo sapiens
caggctcctcactcatgctccc

SEQ ID NO: 7183314 - DNA, 22 bp, Homo sapiens
caggctcctcactcatgctccc

SEQ ID NO: 7183315 - DNA, 22 bp, Homo sapiens
caggctcctcactcatgctccc

SEQ ID NO: 7183316 - DNA, 22 bp, Homo sapiens
caggctcctcactcatgctccc

SEQ ID NO: 7183317 - DNA, 17 bp, Homo sapiens
caggctccttccagatt

SEQ ID NO: 7183318 - DNA, 17 bp, Homo sapiens
caggctccttccagatt

SEQ ID NO: 7183319 - DNA, 22 bp, Homo sapiens
caggctccttcccagggatggt

SEQ ID NO: 7183320 - DNA, 22 bp, Homo sapiens
caggctcccgctccactgggca

SEQ ID NO: 7183321 - DNA, 22 bp, Homo sapiens
caggctcccgctccactgggca

SEQ ID NO: 7183322 - DNA, 23 bp, Homo sapiens
caggctcccggaccaggatccgc

SEQ ID NO: 7183323 - DNA, 23 bp, Homo sapiens
caggctcccggaccaggatccgc

SEQ ID NO: 7183324 - DNA, 23 bp, Homo sapiens
caggctcccggaccaggatccgc

SEQ ID NO: 7183325 - DNA, 22 bp, Homo sapiens
caggctccctaagtcagcagcc

SEQ ID NO: 7183326 - DNA, 22 bp, Homo sapiens
caggctccctaagtcagcagcc

SEQ ID NO: 7183327 - DNA, 22 bp, Homo sapiens
caggctccctaagtcagcagcc

SEQ ID NO: 7183328 - DNA, 22 bp, Homo sapiens
caggctccctgcaggccagtga

SEQ ID NO: 7183329 - DNA, 22 bp, Homo sapiens
caggctccctgcaggccagtga

SEQ ID NO: 7183330 - DNA, 22 bp, Homo sapiens
caggctccctgcaggccagtga

SEQ ID NO: 7183331 - DNA, 22 bp, Homo sapiens
caggctccctgccagggccggc

SEQ ID NO: 7183332 - DNA, 22 bp, Homo sapiens
caggctccctgccagggccggc

SEQ ID NO: 7183333 - DNA, 22 bp, Homo sapiens
caggctccctgccagggccggc

SEQ ID NO: 7183334 - DNA, 22 bp, Homo sapiens
caggctccctgggcagtggcag

SEQ ID NO: 7183335 - DNA, 22 bp, Homo sapiens
caggctccctgggcagtggcag

SEQ ID NO: 7183336 - DNA, 22 bp, Homo sapiens
caggctccctgggcagtggcag

SEQ ID NO: 7183337 - DNA, 22 bp, Homo sapiens
caggctccctgggcagtggcag

SEQ ID NO: 7183338 - DNA, 22 bp, Homo sapiens
caggctccctgggcagtggcag

SEQ ID NO: 7183339 - DNA, 22 bp, Homo sapiens
caggctccctgggcagtggcag

SEQ ID NO: 7183340 - DNA, 20 bp, Homo sapiens
caggctccgcaggactaggg

SEQ ID NO: 7183341 - DNA, 20 bp, Homo sapiens
caggctccgcaggactaggg

SEQ ID NO: 7183342 - DNA, 22 bp, Homo sapiens
tacagttcctctcgtggaggtg

SEQ ID NO: 7183343 - DNA, 22 bp, Homo sapiens
tacagttccaggatcatagggt

SEQ ID NO: 7183344 - DNA, 22 bp, Homo sapiens
tacagtttaacactttggagaa

SEQ ID NO: 7183345 - DNA, 22 bp, Homo sapiens
tacagtttaacactttggagaa

SEQ ID NO: 7183346 - DNA, 22 bp, Homo sapiens
tacagttcacagtatcataaat

SEQ ID NO: 7183347 - DNA, 22 bp, Homo sapiens
tacagtttacatgagaggaagc

SEQ ID NO: 7183348 - DNA, 22 bp, Homo sapiens
tacagtttacatgagaggaagc

SEQ ID NO: 7183349 - DNA, 22 bp, Homo sapiens
tacagtttagaaccatagatgg

SEQ ID NO: 7183350 - DNA, 22 bp, Homo sapiens
tacagtttagaaccatagatgg

SEQ ID NO: 7183351 - DNA, 22 bp, Homo sapiens
tacagtttcccagcagatgcaa

SEQ ID NO: 7183352 - DNA, 22 bp, Homo sapiens
tacagtttcccagcagatgcaa

SEQ ID NO: 7183353 - DNA, 22 bp, Homo sapiens
tacagtttcccagcagatgcaa

SEQ ID NO: 7183354 - DNA, 22 bp, Homo sapiens
tacagtttagaaccatagatgg

SEQ ID NO: 7183355 - DNA, 22 bp, Homo sapiens
tacagtttccaagggcttgaag

SEQ ID NO: 7183356 - DNA, 22 bp, Homo sapiens
tacagtttctgtccttgtggag

SEQ ID NO: 7183357 - DNA, 22 bp, Homo sapiens
tacagtttctcattatgctctc

SEQ ID NO: 7183358 - DNA, 22 bp, Homo sapiens
tacagtttctcattatgctctc

SEQ ID NO: 7183359 - DNA, 22 bp, Homo sapiens
tacagtttctcattatgctctc

SEQ ID NO: 7183360 - DNA, 22 bp, Homo sapiens
tacagtttctcattatgctctc

SEQ ID NO: 7183361 - DNA, 22 bp, Homo sapiens
tacagtttgtatggtcaggaat

SEQ ID NO: 7183362 - DNA, 22 bp, Homo sapiens
tacagtttgtatggtcaggaat

SEQ ID NO: 7183363 - DNA, 22 bp, Homo sapiens
caggctcaatggccacttgggc

SEQ ID NO: 7183364 - DNA, 22 bp, Homo sapiens
caggctcactgtaaggtcagct

SEQ ID NO: 7183365 - DNA, 22 bp, Homo sapiens
caggctccactgtaggcagctc

SEQ ID NO: 7183366 - DNA, 22 bp, Homo sapiens
caggctccactgtaggcagctc

SEQ ID NO: 7183367 - DNA, 22 bp, Homo sapiens
caggctccagcttcctgctcag

SEQ ID NO: 7183368 - DNA, 22 bp, Homo sapiens
caggctccagcttcctgctcag

SEQ ID NO: 7183369 - DNA, 22 bp, Homo sapiens
caggctccagcttcctgctcag

SEQ ID NO: 7183370 - DNA, 22 bp, Homo sapiens
caggctccagcttcctgctcag

SEQ ID NO: 7183371 - DNA, 22 bp, Homo sapiens
caggctcccacaagctcccagc

SEQ ID NO: 7183372 - DNA, 22 bp, Homo sapiens
caggctcccaccctcctgcagc

SEQ ID NO: 7183373 - DNA, 22 bp, Homo sapiens
caggctcccaccctcctgcagc

SEQ ID NO: 7183374 - DNA, 22 bp, Homo sapiens
caggctcccaccctcctgcagc

SEQ ID NO: 7183375 - DNA, 22 bp, Homo sapiens
caggctcccgaaatcacccatg

SEQ ID NO: 7183376 - DNA, 22 bp, Homo sapiens
caggctcccgaaatcacccatg

SEQ ID NO: 7183377 - DNA, 22 bp, Homo sapiens
caggctcccgctccactgggca

SEQ ID NO: 7183378 - DNA, 22 bp, Homo sapiens
caggctcccgctccactgggca

SEQ ID NO: 7183379 - DNA, 22 bp, Homo sapiens
caggctcccgctccactgggca

SEQ ID NO: 7183380 - DNA, 22 bp, Homo sapiens
ccaagaggttgaggctgcagtg

SEQ ID NO: 7183381 - DNA, 22 bp, Homo sapiens
ccaagaggggcagagggctgca

SEQ ID NO: 7183382 - DNA, 22 bp, Homo sapiens
ccaagaggggcagagggctgca

SEQ ID NO: 7183383 - DNA, 22 bp, Homo sapiens
ccaagaggttgaggctgcagtg

SEQ ID NO: 7183384 - DNA, 22 bp, Homo sapiens
ccaagaggttgaggctgcagtg

SEQ ID NO: 7183385 - DNA, 22 bp, Homo sapiens
tcctgcccagagctctccactc

SEQ ID NO: 7183386 - DNA, 22 bp, Homo sapiens
tcctgcccagagctctccactc

SEQ ID NO: 7183387 - DNA, 21 bp, Homo sapiens
tcctgccttagtccagagcag

SEQ ID NO: 7183388 - DNA, 21 bp, Homo sapiens
tcctgccttagtccagagcag

SEQ ID NO: 7183389 - DNA, 22 bp, Homo sapiens
tcctgcccagagctctccactc

SEQ ID NO: 7183390 - DNA, 21 bp, Homo sapiens
tcctgccttagtccagagcag

SEQ ID NO: 7183391 - DNA, 23 bp, Homo sapiens
tcctgctgaaagctccagctggc

SEQ ID NO: 7183392 - DNA, 22 bp, Homo sapiens
tcctgctagagaataacagcac

SEQ ID NO: 7183393 - DNA, 22 bp, Homo sapiens
tcctggagccacggagctttca

SEQ ID NO: 7183394 - DNA, 22 bp, Homo sapiens
tcctggagccacggagctttca

SEQ ID NO: 7183395 - DNA, 22 bp, Homo sapiens
tcctggagccaggacccttccc

SEQ ID NO: 7183396 - DNA, 22 bp, Homo sapiens
tcctggagccaggacccttccc

SEQ ID NO: 7183397 - DNA, 22 bp, Homo sapiens
tcctggagccaggacccttccc

SEQ ID NO: 7183398 - DNA, 22 bp, Homo sapiens
tcctggagccaggacccttccc

SEQ ID NO: 7183399 - DNA, 22 bp, Homo sapiens
tcctggagccatgattcccctc

SEQ ID NO: 7183400 - DNA, 22 bp, Homo sapiens
tcctggagccatgattcccctc

SEQ ID NO: 7183401 - DNA, 22 bp, Homo sapiens
tcctgccttgcctgggacatca

SEQ ID NO: 7183402 - DNA, 22 bp, Homo sapiens
tcctgccttgcctgggacatca

SEQ ID NO: 7183403 - DNA, 22 bp, Homo sapiens
tcctgccttcatactgctgtat

SEQ ID NO: 7183404 - DNA, 22 bp, Homo sapiens
tcctgccttcatactgctgtat

SEQ ID NO: 7183405 - DNA, 22 bp, Homo sapiens
tcctgccttcatactgctgtat

SEQ ID NO: 7183406 - DNA, 22 bp, Homo sapiens
tcctgccttcatactgctgtat

SEQ ID NO: 7183407 - DNA, 22 bp, Homo sapiens
ccaagaggcagaatgcagagaa

SEQ ID NO: 7183408 - DNA, 22 bp, Homo sapiens
ccaagaggcagaatgcagagaa

SEQ ID NO: 7183409 - DNA, 22 bp, Homo sapiens
ccaagaggcagaatgcagagaa

SEQ ID NO: 7183410 - DNA, 23 bp, Homo sapiens
ccaagactgttaggagtggggag

SEQ ID NO: 7183411 - DNA, 21 bp, Homo sapiens
ccaagagcaatgctaaggaga

SEQ ID NO: 7183412 - DNA, 21 bp, Homo sapiens
ccaagagcaatgctaaggaga

SEQ ID NO: 7183413 - DNA, 20 bp, Homo sapiens
ccaagagcatgcatgaggaa

SEQ ID NO: 7183414 - DNA, 20 bp, Homo sapiens
ccaagagcatgcatgaggaa

SEQ ID NO: 7183415 - DNA, 22 bp, Homo sapiens
ccaacaccatctgagctccagc

SEQ ID NO: 7183416 - DNA, 22 bp, Homo sapiens
ccaacaccatctgagctccagc

SEQ ID NO: 7183417 - DNA, 22 bp, Homo sapiens
ccaacaggtgttctgtttttca

SEQ ID NO: 7183418 - DNA, 22 bp, Homo sapiens
ccaacctgaggcaggctgcagc

SEQ ID NO: 7183419 - DNA, 22 bp, Homo sapiens
ccaagaatgataggtgtgagca

SEQ ID NO: 7183420 - DNA, 23 bp, Homo sapiens
ccaagactgttaggagtggggag

SEQ ID NO: 7183421 - DNA, 22 bp, Homo sapiens
tcctgaggtgctcagccaggaa

SEQ ID NO: 7183422 - DNA, 22 bp, Homo sapiens
tcctgaggtgctcagccaggaa

SEQ ID NO: 7183423 - DNA, 22 bp, Homo sapiens
tcctgaggtctgaaaaaggagc

SEQ ID NO: 7183424 - DNA, 22 bp, Homo sapiens
tcctgaggtctgaaaaaggagc

SEQ ID NO: 7183425 - DNA, 22 bp, Homo sapiens
tcctgaggtatatgctttgcag

SEQ ID NO: 7183426 - DNA, 22 bp, Homo sapiens
tcctgagggctgcagtcatagg

SEQ ID NO: 7183427 - DNA, 22 bp, Homo sapiens
tcctgagggctgcagtcatagg

SEQ ID NO: 7183428 - DNA, 23 bp, Homo sapiens
tcctgagggtttcccagccttgg

SEQ ID NO: 7183429 - DNA, 23 bp, Homo sapiens
tcctgagggtttcccagccttgg

SEQ ID NO: 7183430 - DNA, 22 bp, Homo sapiens
ccaaattaaatcatacagacag

SEQ ID NO: 7183431 - DNA, 22 bp, Homo sapiens
ccaaattctgtgttcaaactca

SEQ ID NO: 7183432 - DNA, 22 bp, Homo sapiens
ccaacacagatgtgttagtgtt

SEQ ID NO: 7183433 - DNA, 22 bp, Homo sapiens
ccaacacagatgtgttagtgtt

SEQ ID NO: 7183434 - DNA, 22 bp, Homo sapiens
tcctgaggtggattgagcagag

SEQ ID NO: 7183435 - DNA, 22 bp, Homo sapiens
tcctgaggtggattgagcagag

SEQ ID NO: 7183436 - DNA, 22 bp, Homo sapiens
tcctggctaacacggtgacacc

SEQ ID NO: 7183437 - DNA, 22 bp, Homo sapiens
tcctggctaacacggtgacacc

SEQ ID NO: 7183438 - DNA, 22 bp, Homo sapiens
tcctggctaacacggtgacacc

SEQ ID NO: 7183439 - DNA, 22 bp, Homo sapiens
tcctggccttgcgtcttgggag

SEQ ID NO: 7183440 - DNA, 22 bp, Homo sapiens
tcctggccttgctcctgatgcc

SEQ ID NO: 7183441 - DNA, 22 bp, Homo sapiens
tcctggctaatgctgctgatgg

SEQ ID NO: 7183442 - DNA, 22 bp, Homo sapiens
tcctggctaatgctgctgatgg

SEQ ID NO: 7183443 - DNA, 22 bp, Homo sapiens
tcctggctagttttgctgaaat

SEQ ID NO: 7183444 - DNA, 22 bp, Homo sapiens
tcctggctcaggcccctggtgc

SEQ ID NO: 7183445 - DNA, 22 bp, Homo sapiens
tcctggctcaggcccctggtgc

SEQ ID NO: 7183446 - DNA, 22 bp, Homo sapiens
tcctggctcaggcccctggtgc

SEQ ID NO: 7183447 - DNA, 22 bp, Homo sapiens
tcctggctccactgagcaggcc

SEQ ID NO: 7183448 - DNA, 22 bp, Homo sapiens
tcctggctccactgagcaggcc

SEQ ID NO: 7183449 - DNA, 22 bp, Homo sapiens
ccaccaggacagccctgagggg

SEQ ID NO: 7183450 - DNA, 22 bp, Homo sapiens
ccacaggggtctctgtagctga

SEQ ID NO: 7183451 - DNA, 22 bp, Homo sapiens
ccacaggggtctctgtagctga

SEQ ID NO: 7183452 - DNA, 22 bp, Homo sapiens
ccacaggggtctctgtagctga

SEQ ID NO: 7183453 - DNA, 22 bp, Homo sapiens
ccacagggctctaggcgcttcc

SEQ ID NO: 7183454 - DNA, 22 bp, Homo sapiens
ccacagggctctaggcgcttcc

SEQ ID NO: 7183455 - DNA, 21 bp, Homo sapiens
ccacaggggctcccctgtcag

SEQ ID NO: 7183456 - DNA, 22 bp, Homo sapiens
tcctggccttagcgaggcggtc

SEQ ID NO: 7183457 - DNA, 22 bp, Homo sapiens
tcctggccttatccccaaactg

SEQ ID NO: 7183458 - DNA, 20 bp, Homo sapiens
tcctggccttctcgggcagt

SEQ ID NO: 7183459 - DNA, 22 bp, Homo sapiens
tcctggaggaataagttttcca

SEQ ID NO: 7183460 - DNA, 22 bp, Homo sapiens
tcctggaggaataagttttcca

SEQ ID NO: 7183461 - DNA, 22 bp, Homo sapiens
tcctggaggacagaggcatctc

SEQ ID NO: 7183462 - DNA, 22 bp, Homo sapiens
tcctggaggacagaggcatctc

SEQ ID NO: 7183463 - DNA, 22 bp, Homo sapiens
tcctggagcttccttcatggta

SEQ ID NO: 7183464 - DNA, 22 bp, Homo sapiens
tcctggaggacagaggcatctc

SEQ ID NO: 7183465 - DNA, 22 bp, Homo sapiens
tcctggaggacagaggcatctc

SEQ ID NO: 7183466 - DNA, 22 bp, Homo sapiens
ccacagctgacaatggatagac

SEQ ID NO: 7183467 - DNA, 22 bp, Homo sapiens
ccacagctgaccgcaggtgagc

SEQ ID NO: 7183468 - DNA, 22 bp, Homo sapiens
ccacagctgaccgcaggtgagc

SEQ ID NO: 7183469 - DNA, 22 bp, Homo sapiens
ccacagctgaccgcaggtgagc

SEQ ID NO: 7183470 - DNA, 22 bp, Homo sapiens
tcctggagcctcattcaaacac

SEQ ID NO: 7183471 - DNA, 22 bp, Homo sapiens
tcctggagcctcattcaaacac

SEQ ID NO: 7183472 - DNA, 22 bp, Homo sapiens
tcctggagcctcattcaaacac

SEQ ID NO: 7183473 - DNA, 22 bp, Homo sapiens
tcctggagctgactccgtttga

SEQ ID NO: 7183474 - DNA, 22 bp, Homo sapiens
tcctggagctgactccgtttga

SEQ ID NO: 7183475 - DNA, 22 bp, Homo sapiens
tcctggagctgactccgtttga

SEQ ID NO: 7183476 - DNA, 20 bp, Homo sapiens
tcctggagctgcttgaattc

SEQ ID NO: 7183477 - DNA, 20 bp, Homo sapiens
tcctggagctgcttgaattc

SEQ ID NO: 7183478 - DNA, 20 bp, Homo sapiens
tcctggagctgcttgaattc

SEQ ID NO: 7183479 - DNA, 20 bp, Homo sapiens
tcctggagctgcttgaattc

SEQ ID NO: 7183480 - DNA, 20 bp, Homo sapiens
tcctggagctgcttgaattc

SEQ ID NO: 7183481 - DNA, 22 bp, Homo sapiens
tcctggagctggtgtctttccc

SEQ ID NO: 7183482 - DNA, 22 bp, Homo sapiens
tcctggagctggtgtctttccc

SEQ ID NO: 7183483 - DNA, 22 bp, Homo sapiens
tcctggagcttcagtttccttt

SEQ ID NO: 7183484 - DNA, 22 bp, Homo sapiens
tcctggagcttcagtttccttt

SEQ ID NO: 7183485 - DNA, 22 bp, Homo sapiens
tcctggagcttccttcatggta

SEQ ID NO: 7183486 - DNA, 22 bp, Homo sapiens
ccacaggctgctgcaggtcccg

SEQ ID NO: 7183487 - DNA, 22 bp, Homo sapiens
ccacaggctgctgcaggtcccg

SEQ ID NO: 7183488 - DNA, 22 bp, Homo sapiens
ccacaggctgctgcaggtcccg

SEQ ID NO: 7183489 - DNA, 22 bp, Homo sapiens
ccacaggctgctgcaggtcccg

SEQ ID NO: 7183490 - DNA, 22 bp, Homo sapiens
ccacagggactgttaaaaccct

SEQ ID NO: 7183491 - DNA, 22 bp, Homo sapiens
ccacagggataggaatggggct

SEQ ID NO: 7183492 - DNA, 22 bp, Homo sapiens
ccacaggctgctgcaggtcccg

SEQ ID NO: 7183493 - DNA, 22 bp, Homo sapiens
ccacagggaacatgacagcctt

SEQ ID NO: 7183494 - DNA, 22 bp, Homo sapiens
ccacagggataggaatggggct

SEQ ID NO: 7183495 - DNA, 22 bp, Homo sapiens
ccacagggcacagacaggaagc

SEQ ID NO: 7183496 - DNA, 22 bp, Homo sapiens
ccacagggcacagacaggaagc

SEQ ID NO: 7183497 - DNA, 22 bp, Homo sapiens
ccacagggcacagacaggaagc

SEQ ID NO: 7183498 - DNA, 22 bp, Homo sapiens
ccacagggcacagacaggaagc

SEQ ID NO: 7183499 - DNA, 22 bp, Homo sapiens
ccacagggcctttcctgctggc

SEQ ID NO: 7183500 - DNA, 22 bp, Homo sapiens
ccacagggcctttcctgctggc

SEQ ID NO: 7183501 - DNA, 22 bp, Homo sapiens
ccacagggcctttcctgctggc

SEQ ID NO: 7183502 - DNA, 22 bp, Homo sapiens
tcctgagaaggcacagcttgca

SEQ ID NO: 7183503 - DNA, 22 bp, Homo sapiens
tcctgagaaggcacagcttgca

SEQ ID NO: 7183504 - DNA, 22 bp, Homo sapiens
ccaaaaagctcagagatatgtt

SEQ ID NO: 7183505 - DNA, 22 bp, Homo sapiens
ccaaaaattagatacacatata

SEQ ID NO: 7183506 - DNA, 22 bp, Homo sapiens
ccaaaaattagatacacatata

SEQ ID NO: 7183507 - DNA, 22 bp, Homo sapiens
tcctgagggcgattcagcaggt

SEQ ID NO: 7183508 - DNA, 22 bp, Homo sapiens
tcctgagggcgattcagcaggt

SEQ ID NO: 7183509 - DNA, 22 bp, Homo sapiens
tcctgagggcgattcagcaggt

SEQ ID NO: 7183510 - DNA, 22 bp, Homo sapiens
tcctgagggcattttggtgact

SEQ ID NO: 7183511 - DNA, 22 bp, Homo sapiens
tcctgagggcattttggtgact

SEQ ID NO: 7183512 - DNA, 22 bp, Homo sapiens
tcctgagggctcggggctcatg

SEQ ID NO: 7183513 - DNA, 22 bp, Homo sapiens
tcctgagggctcggggctcatg

SEQ ID NO: 7183514 - DNA, 22 bp, Homo sapiens
tcctgagggctcggggctcatg

SEQ ID NO: 7183515 - DNA, 19 bp, Homo sapiens
cattttctcattgtgcccc

SEQ ID NO: 7183516 - DNA, 22 bp, Homo sapiens
cattttgtgctagacactatgg

SEQ ID NO: 7183517 - DNA, 19 bp, Homo sapiens
cattttcccatcatccttt

SEQ ID NO: 7183518 - DNA, 22 bp, Homo sapiens
cattttccacaggcctatttcc

SEQ ID NO: 7183519 - DNA, 19 bp, Homo sapiens
cattttcccatcatccttt

SEQ ID NO: 7183520 - DNA, 22 bp, Homo sapiens
cattttccacaggcctatttcc

SEQ ID NO: 7183521 - DNA, 22 bp, Homo sapiens
cattttcatgagtttctgttca

SEQ ID NO: 7183522 - DNA, 22 bp, Homo sapiens
cattttcatgagtttctgttca

SEQ ID NO: 7183523 - DNA, 22 bp, Homo sapiens
cattttaaatgatttaagccaa

SEQ ID NO: 7183524 - DNA, 22 bp, Homo sapiens
cattttaagatgacctggtttc

SEQ ID NO: 7183525 - DNA, 22 bp, Homo sapiens
cattttaagatgacctggtttc

SEQ ID NO: 7183526 - DNA, 19 bp, Homo sapiens
cattttaagcatccccagt

SEQ ID NO: 7183527 - DNA, 19 bp, Homo sapiens
cattttaagcatccccagt

SEQ ID NO: 7183528 - DNA, 19 bp, Homo sapiens
cattttaagcatccccagt

SEQ ID NO: 7183529 - DNA, 22 bp, Homo sapiens
catttctagggatcataaagta

SEQ ID NO: 7183530 - DNA, 22 bp, Homo sapiens
catttctatggcaatgggaaaa

SEQ ID NO: 7183531 - DNA, 21 bp, Homo sapiens
catttctattgatgagaaaag

SEQ ID NO: 7183532 - DNA, 21 bp, Homo sapiens
catttctattgatgagaaaag

SEQ ID NO: 7183533 - DNA, 21 bp, Homo sapiens
catttctattgatgagaaaag

SEQ ID NO: 7183534 - DNA, 22 bp, Homo sapiens
catttgtcatcactgagctgcc

SEQ ID NO: 7183535 - DNA, 22 bp, Homo sapiens
catttgtctctaggaagtgagg

SEQ ID NO: 7183536 - DNA, 22 bp, Homo sapiens
catttgtgcttttataaaatag

SEQ ID NO: 7183537 - DNA, 22 bp, Homo sapiens
cattttcagcacccatctgaaa

SEQ ID NO: 7183538 - DNA, 22 bp, Homo sapiens
cattttcagcacccatctgaaa

SEQ ID NO: 7183539 - DNA, 22 bp, Homo sapiens
cattttatgtttatggagtgct

SEQ ID NO: 7183540 - DNA, 22 bp, Homo sapiens
cattttcagcacccatctgaaa

SEQ ID NO: 7183541 - DNA, 22 bp, Homo sapiens
cattttcagcacccatctgaaa

SEQ ID NO: 7183542 - DNA, 22 bp, Homo sapiens
cattttcagcacccatctgaaa

SEQ ID NO: 7183543 - DNA, 22 bp, Homo sapiens
cattttatgtttatggagtgct

SEQ ID NO: 7183544 - DNA, 22 bp, Homo sapiens
cattttatgtttatggagtgct

SEQ ID NO: 7183545 - DNA, 22 bp, Homo sapiens
cattttactgactcttgaatta

SEQ ID NO: 7183546 - DNA, 22 bp, Homo sapiens
cattttactgactcttgaatta

SEQ ID NO: 7183547 - DNA, 22 bp, Homo sapiens
cattttacgacatagggcaggc

SEQ ID NO: 7183548 - DNA, 22 bp, Homo sapiens
cattttacctagaagctgaaag

SEQ ID NO: 7183549 - DNA, 22 bp, Homo sapiens
cattttacctagaagctgaaag

SEQ ID NO: 7183550 - DNA, 22 bp, Homo sapiens
cattttatcctctgggaagcta

SEQ ID NO: 7183551 - DNA, 22 bp, Homo sapiens
cattttatcctctgggaagcta

SEQ ID NO: 7183552 - DNA, 22 bp, Homo sapiens
cattttatgtttatggagtgct

SEQ ID NO: 7183553 - DNA, 22 bp, Homo sapiens
cattttatgtttatggagtgct

SEQ ID NO: 7183554 - DNA, 22 bp, Homo sapiens
cattttatcctctgggaagcta

SEQ ID NO: 7183555 - DNA, 22 bp, Homo sapiens
cattttatcctctgggaagcta

SEQ ID NO: 7183556 - DNA, 22 bp, Homo sapiens
cattttactgactcttgaatta

SEQ ID NO: 7183557 - DNA, 20 bp, Homo sapiens
catttcattgtgtcttcact

SEQ ID NO: 7183558 - DNA, 21 bp, Homo sapiens
catttcatgattatagaaatg

SEQ ID NO: 7183559 - DNA, 21 bp, Homo sapiens
catttcatgattatagaaatg

SEQ ID NO: 7183560 - DNA, 21 bp, Homo sapiens
catttcatgattatagaaatg

SEQ ID NO: 7183561 - DNA, 22 bp, Homo sapiens
catttcattcctttgaaagtgg

SEQ ID NO: 7183562 - DNA, 22 bp, Homo sapiens
catttcattcctttgaaagtgg

SEQ ID NO: 7183563 - DNA, 21 bp, Homo sapiens
catttcatgattatagaaatg

SEQ ID NO: 7183564 - DNA, 21 bp, Homo sapiens
catttcagtaaggaagcctgt

SEQ ID NO: 7183565 - DNA, 21 bp, Homo sapiens
catttcagtaaggaagcctgt

SEQ ID NO: 7183566 - DNA, 22 bp, Homo sapiens
catttcatagttgtcacaataa

SEQ ID NO: 7183567 - DNA, 22 bp, Homo sapiens
catttcatagttgtcacaataa

SEQ ID NO: 7183568 - DNA, 22 bp, Homo sapiens
catttccttcctgctgctcctc

SEQ ID NO: 7183569 - DNA, 22 bp, Homo sapiens
catttcctgtctggaggtcaaa

SEQ ID NO: 7183570 - DNA, 22 bp, Homo sapiens
catttccttcctgctgctcctc

SEQ ID NO: 7183571 - DNA, 22 bp, Homo sapiens
catttcggtagcttgaacttta

SEQ ID NO: 7183572 - DNA, 22 bp, Homo sapiens
catttctaagaagatctgggta

SEQ ID NO: 7183573 - DNA, 22 bp, Homo sapiens
catttccacttctgaaaactgg

SEQ ID NO: 7183574 - DNA, 22 bp, Homo sapiens
catttccacttctgaaaactgg

SEQ ID NO: 7183575 - DNA, 22 bp, Homo sapiens
catttccacttctgaaaactgg

SEQ ID NO: 7183576 - DNA, 22 bp, Homo sapiens
catttccccctcatgttgcagc

SEQ ID NO: 7183577 - DNA, 22 bp, Homo sapiens
catttctaagaaggctgcacat

SEQ ID NO: 7183578 - DNA, 22 bp, Homo sapiens
catttctaagaaggctgcacat

SEQ ID NO: 7183579 - DNA, 21 bp, Homo sapiens
catttctaagcctggctatag

SEQ ID NO: 7183580 - DNA, 22 bp, Homo sapiens
catttctacagcttcttcagaa

SEQ ID NO: 7183581 - DNA, 22 bp, Homo sapiens
catttctaccaaatgtgactgg

SEQ ID NO: 7183582 - DNA, 22 bp, Homo sapiens
catttctaccaaatgtgactgg

SEQ ID NO: 7183583 - DNA, 22 bp, Homo sapiens
catttcacgcacactcattact

SEQ ID NO: 7183584 - DNA, 22 bp, Homo sapiens
tccatattaactaaaactagaa

SEQ ID NO: 7183585 - DNA, 22 bp, Homo sapiens
catttattggcatgtagtaggt

SEQ ID NO: 7183586 - DNA, 22 bp, Homo sapiens
tccatacatatccaaagagaag

SEQ ID NO: 7183587 - DNA, 22 bp, Homo sapiens
tccatactcagaaagtattgca

SEQ ID NO: 7183588 - DNA, 22 bp, Homo sapiens
tccatagtagaaaatgggacag

SEQ ID NO: 7183589 - DNA, 22 bp, Homo sapiens
tccatagtgaatgggtaatgca

SEQ ID NO: 7183590 - DNA, 22 bp, Homo sapiens
tccatataatgggattccttat

SEQ ID NO: 7183591 - DNA, 22 bp, Homo sapiens
tccatatacaacttaatcttta

SEQ ID NO: 7183592 - DNA, 18 bp, Homo sapiens
tccaggtcccaggggaag

SEQ ID NO: 7183593 - DNA, 18 bp, Homo sapiens
tccaggtcccaggggaag

SEQ ID NO: 7183594 - DNA, 22 bp, Homo sapiens
tccagtttgggtgtgagctgcg

SEQ ID NO: 7183595 - DNA, 22 bp, Homo sapiens
tccataaaccagaaaatcaaga

SEQ ID NO: 7183596 - DNA, 22 bp, Homo sapiens
tccataaaccagaaaatcaaga

SEQ ID NO: 7183597 - DNA, 22 bp, Homo sapiens
tccataaaccagaaaatcaaga

SEQ ID NO: 7183598 - DNA, 22 bp, Homo sapiens
tccataaaccatgcttccaggt

SEQ ID NO: 7183599 - DNA, 22 bp, Homo sapiens
tccataaattttatgaacatat

SEQ ID NO: 7183600 - DNA, 21 bp, Homo sapiens
tccataagagaccatctccta

SEQ ID NO: 7183601 - DNA, 22 bp, Homo sapiens
tccatacacattgaattttagt

SEQ ID NO: 7183602 - DNA, 22 bp, Homo sapiens
tccatacacattgaattttagt

SEQ ID NO: 7183603 - DNA, 22 bp, Homo sapiens
tccatacagaatgcagtaaggg

SEQ ID NO: 7183604 - DNA, 22 bp, Homo sapiens
tccatacagtgactcaggaatc

SEQ ID NO: 7183605 - DNA, 22 bp, Homo sapiens
tccatacataaaatgtttaatg

SEQ ID NO: 7183606 - DNA, 22 bp, Homo sapiens
ccagagggagccaccagggtgt

SEQ ID NO: 7183607 - DNA, 22 bp, Homo sapiens
ccagagggagccaccagggtgt

SEQ ID NO: 7183608 - DNA, 22 bp, Homo sapiens
ccagagggacgttaccagttca

SEQ ID NO: 7183609 - DNA, 22 bp, Homo sapiens
ccagagggagccaccagggtgt

SEQ ID NO: 7183610 - DNA, 22 bp, Homo sapiens
ccagagggagccaccagggtgt

SEQ ID NO: 7183611 - DNA, 22 bp, Homo sapiens
ccagagggcaaaatgaagctta

SEQ ID NO: 7183612 - DNA, 22 bp, Homo sapiens
ccagagggcaaaatgaagctta

SEQ ID NO: 7183613 - DNA, 22 bp, Homo sapiens
ccagagggaactgggcctcatt

SEQ ID NO: 7183614 - DNA, 22 bp, Homo sapiens
ccagagggaactgggcctcatt

SEQ ID NO: 7183615 - DNA, 22 bp, Homo sapiens
ccagagggaactgggcctcatt

SEQ ID NO: 7183616 - DNA, 22 bp, Homo sapiens
ccagagggaactgggcctcatt

SEQ ID NO: 7183617 - DNA, 22 bp, Homo sapiens
ccagagggaagaggaagcgctg

SEQ ID NO: 7183618 - DNA, 22 bp, Homo sapiens
ccagagggaagaggaagcgctg

SEQ ID NO: 7183619 - DNA, 22 bp, Homo sapiens
ccagagggaagaggaagcgctg

SEQ ID NO: 7183620 - DNA, 22 bp, Homo sapiens
ccagaggctggggaaggataca

SEQ ID NO: 7183621 - DNA, 22 bp, Homo sapiens
ccagaggctggggaaggataca

SEQ ID NO: 7183622 - DNA, 22 bp, Homo sapiens
ccagaggctggcagccagctga

SEQ ID NO: 7183623 - DNA, 22 bp, Homo sapiens
ccagaggctggggaaggataca

SEQ ID NO: 7183624 - DNA, 22 bp, Homo sapiens
ccagaggctgggttcacctcag

SEQ ID NO: 7183625 - DNA, 22 bp, Homo sapiens
ccagaggctgggttcacctcag

SEQ ID NO: 7183626 - DNA, 22 bp, Homo sapiens
ccagaggctggcaagggctcct

SEQ ID NO: 7183627 - DNA, 22 bp, Homo sapiens
ccagaggctggcagccagctga

SEQ ID NO: 7183628 - DNA, 22 bp, Homo sapiens
ccagaggctggcagccagctga

SEQ ID NO: 7183629 - DNA, 22 bp, Homo sapiens
ccagagcctgctgagccccatt

SEQ ID NO: 7183630 - DNA, 22 bp, Homo sapiens
ccagagcctgctgagccccatt

SEQ ID NO: 7183631 - DNA, 22 bp, Homo sapiens
ccagaggatcagtactggctgg

SEQ ID NO: 7183632 - DNA, 22 bp, Homo sapiens
ccagagcctcttatgaagatcg

SEQ ID NO: 7183633 - DNA, 21 bp, Homo sapiens
ccagagcctgagaggattatg

SEQ ID NO: 7183634 - DNA, 22 bp, Homo sapiens
ccagagcctcgcccggagcctc

SEQ ID NO: 7183635 - DNA, 22 bp, Homo sapiens
ccagagcctcaacacaggtcct

SEQ ID NO: 7183636 - DNA, 22 bp, Homo sapiens
ccagagcctcgcccggagcctc

SEQ ID NO: 7183637 - DNA, 22 bp, Homo sapiens
ccagagcctcgcccggagcctc

SEQ ID NO: 7183638 - DNA, 22 bp, Homo sapiens
ccagagcctcgcccggagcctc

SEQ ID NO: 7183639 - DNA, 22 bp, Homo sapiens
ccagagcctcgcccggagcctc

SEQ ID NO: 7183640 - DNA, 22 bp, Homo sapiens
ccagagcctcttatgaagatcg

SEQ ID NO: 7183641 - DNA, 22 bp, Homo sapiens
ccagagcctcaacacaggtcct

SEQ ID NO: 7183642 - DNA, 22 bp, Homo sapiens
ccagagcctcaacacaggtcct

SEQ ID NO: 7183643 - DNA, 22 bp, Homo sapiens
ccagagcctcaacacaggtcct

SEQ ID NO: 7183644 - DNA, 22 bp, Homo sapiens
ccagagcctcaacacaggtcct

SEQ ID NO: 7183645 - DNA, 22 bp, Homo sapiens
ccagagcctaagatctgatcct

SEQ ID NO: 7183646 - DNA, 22 bp, Homo sapiens
ccagagcctaagatctgatcct

SEQ ID NO: 7183647 - DNA, 22 bp, Homo sapiens
ccagagccggctccctcagctt

SEQ ID NO: 7183648 - DNA, 22 bp, Homo sapiens
ccagagccggctccctcagctt

SEQ ID NO: 7183649 - DNA, 22 bp, Homo sapiens
ccagagccggctccctcagctt

SEQ ID NO: 7183650 - DNA, 22 bp, Homo sapiens
ccagagccggctccctcagctt

SEQ ID NO: 7183651 - DNA, 22 bp, Homo sapiens
ccagagcccgggacctggactt

SEQ ID NO: 7183652 - DNA, 22 bp, Homo sapiens
ccagagcccgggacctggactt

SEQ ID NO: 7183653 - DNA, 22 bp, Homo sapiens
ccagagcccgggacctggactt

SEQ ID NO: 7183654 - DNA, 22 bp, Homo sapiens
ccagagcccgggacctggactt

SEQ ID NO: 7183655 - DNA, 22 bp, Homo sapiens
ccagagcccagggtcatgcagg

SEQ ID NO: 7183656 - DNA, 22 bp, Homo sapiens
ccagagcccagggtcatgcagg

SEQ ID NO: 7183657 - DNA, 22 bp, Homo sapiens
ccagagcccctgagcttccctg

SEQ ID NO: 7183658 - DNA, 22 bp, Homo sapiens
ccagagcccctgagcttccctg

SEQ ID NO: 7183659 - DNA, 22 bp, Homo sapiens
ccagagcccagggtcatgcagg

SEQ ID NO: 7183660 - DNA, 22 bp, Homo sapiens
ccagagcccctgagcttccctg

SEQ ID NO: 7183661 - DNA, 22 bp, Homo sapiens
ccagagcccctgagcttccctg

SEQ ID NO: 7183662 - DNA, 22 bp, Homo sapiens
ccagagcccctgagcttccctg

SEQ ID NO: 7183663 - DNA, 19 bp, Homo sapiens
ccagagcccgccagatggg

SEQ ID NO: 7183664 - DNA, 19 bp, Homo sapiens
ccagagcccgccagatggg

SEQ ID NO: 7183665 - DNA, 19 bp, Homo sapiens
ccagagcccgccagatggg

SEQ ID NO: 7183666 - DNA, 19 bp, Homo sapiens
ccagagcccgccagatggg

SEQ ID NO: 7183667 - DNA, 19 bp, Homo sapiens
ccagagcccgccagatggg

SEQ ID NO: 7183668 - DNA, 19 bp, Homo sapiens
ccagagcccgccagatggg

SEQ ID NO: 7183669 - DNA, 22 bp, Homo sapiens
ccagagcccgggacctggactt

SEQ ID NO: 7183670 - DNA, 22 bp, Homo sapiens
ccagagcagggcagcagggctc

SEQ ID NO: 7183671 - DNA, 20 bp, Homo sapiens
ccagagcagccactgaagtt

SEQ ID NO: 7183672 - DNA, 22 bp, Homo sapiens
ccagagagggcgccacctggag

SEQ ID NO: 7183673 - DNA, 22 bp, Homo sapiens
ccagagcagggcagcagggctc

SEQ ID NO: 7183674 - DNA, 22 bp, Homo sapiens
ccagagcagggcagcagggctc

SEQ ID NO: 7183675 - DNA, 22 bp, Homo sapiens
ccagagcagggcagcagggctc

SEQ ID NO: 7183676 - DNA, 22 bp, Homo sapiens
ccagagcagggcagcagggctc

SEQ ID NO: 7183677 - DNA, 22 bp, Homo sapiens
ccagagcatgaagggcaatgac

SEQ ID NO: 7183678 - DNA, 22 bp, Homo sapiens
ccagagcatgaagggcaatgac

SEQ ID NO: 7183679 - DNA, 22 bp, Homo sapiens
ccagagccagagaggtgcctgc

SEQ ID NO: 7183680 - DNA, 22 bp, Homo sapiens
ccagagcatgaagggcaatgac

SEQ ID NO: 7183681 - DNA, 22 bp, Homo sapiens
ccagagccagagaggtgcctgc

SEQ ID NO: 7183682 - DNA, 22 bp, Homo sapiens
ccagagccagagaggtgcctgc

SEQ ID NO: 7183683 - DNA, 22 bp, Homo sapiens
ccagagccagagaggtgcctgc

SEQ ID NO: 7183684 - DNA, 22 bp, Homo sapiens
ccagagcccagcacacggtgct

SEQ ID NO: 7183685 - DNA, 22 bp, Homo sapiens
ccagagcccagcacacggtgct

SEQ ID NO: 7183686 - DNA, 22 bp, Homo sapiens
ccagagcccagcacacggtgct

SEQ ID NO: 7183687 - DNA, 22 bp, Homo sapiens
ccagagcccagggtcatgcagg

SEQ ID NO: 7183688 - DNA, 22 bp, Homo sapiens
ccagagcccagggtcatgcagg

SEQ ID NO: 7183689 - DNA, 22 bp, Homo sapiens
ccagagggccctggtctcagct

SEQ ID NO: 7183690 - DNA, 22 bp, Homo sapiens
ccagagggccctggtctcagct

SEQ ID NO: 7183691 - DNA, 22 bp, Homo sapiens
ccagagggccctggtctcagct

SEQ ID NO: 7183692 - DNA, 22 bp, Homo sapiens
ccagagggccctggtctcagct

SEQ ID NO: 7183693 - DNA, 22 bp, Homo sapiens
ccagagggcctttggagttatc

SEQ ID NO: 7183694 - DNA, 22 bp, Homo sapiens
ccagagggcctttggagttatc

SEQ ID NO: 7183695 - DNA, 22 bp, Homo sapiens
ccagagggcctttggagttatc

SEQ ID NO: 7183696 - DNA, 22 bp, Homo sapiens
ccagagggcttggtttgggcca

SEQ ID NO: 7183697 - DNA, 22 bp, Homo sapiens
ccagagggcttggtttgggcca

SEQ ID NO: 7183698 - DNA, 22 bp, Homo sapiens
ccagaggggcacaaaagtagaa

SEQ ID NO: 7183699 - DNA, 22 bp, Homo sapiens
ccagaggggcacaaaagtagaa

SEQ ID NO: 7183700 - DNA, 22 bp, Homo sapiens
ccagaggggcacaaaagtagaa

SEQ ID NO: 7183701 - DNA, 22 bp, Homo sapiens
ccagaggggcacaaaagtagaa

SEQ ID NO: 7183702 - DNA, 22 bp, Homo sapiens
ccagaggggctgagcaggtcac

SEQ ID NO: 7183703 - DNA, 22 bp, Homo sapiens
ccagaggggctgagcaggtcac

SEQ ID NO: 7183704 - DNA, 22 bp, Homo sapiens
ccagaggggctgagcaggtcac

SEQ ID NO: 7183705 - DNA, 22 bp, Homo sapiens
ccagaggggtgggcctggttta

SEQ ID NO: 7183706 - DNA, 22 bp, Homo sapiens
ccagaggggtgggcctggttta

SEQ ID NO: 7183707 - DNA, 22 bp, Homo sapiens
ccagaggggctgagcaggtcac

SEQ ID NO: 7183708 - DNA, 22 bp, Homo sapiens
ccagaggggctgagcaggtcac

SEQ ID NO: 7183709 - DNA, 22 bp, Homo sapiens
ccagaggggctgagcaggtcac

SEQ ID NO: 7183710 - DNA, 22 bp, Homo sapiens
ccagaggggctgagcaggtcac

SEQ ID NO: 7183711 - DNA, 22 bp, Homo sapiens
ccagaggggtgggcctggttta

SEQ ID NO: 7183712 - DNA, 22 bp, Homo sapiens
ccagaggggtgggcctggttta

SEQ ID NO: 7183713 - DNA, 20 bp, Homo sapiens
ccagagggtagggccgcccc

SEQ ID NO: 7183714 - DNA, 20 bp, Homo sapiens
ccagagggtagggccgcccc

SEQ ID NO: 7183715 - DNA, 20 bp, Homo sapiens
ccagagggtagggccgcccc

SEQ ID NO: 7183716 - DNA, 20 bp, Homo sapiens
ccagagggtagggccgcccc

SEQ ID NO: 7183717 - DNA, 18 bp, Homo sapiens
ccagagggtgcgtcagct

SEQ ID NO: 7183718 - DNA, 18 bp, Homo sapiens
ccagagggtgcgtcagct

SEQ ID NO: 7183719 - DNA, 22 bp, Homo sapiens
ccagaggtcctgctcactggtg

SEQ ID NO: 7183720 - DNA, 22 bp, Homo sapiens
ccagaggtcccctgccaggagg

SEQ ID NO: 7183721 - DNA, 22 bp, Homo sapiens
ccagaggtcccctgccaggagg

SEQ ID NO: 7183722 - DNA, 18 bp, Homo sapiens
ccagagggtgcgtcagct

SEQ ID NO: 7183723 - DNA, 18 bp, Homo sapiens
ccagagggtgcgtcagct

SEQ ID NO: 7183724 - DNA, 18 bp, Homo sapiens
ccagagggtgcgtcagct

SEQ ID NO: 7183725 - DNA, 22 bp, Homo sapiens
ccagaggtctcctgcacgggat

SEQ ID NO: 7183726 - DNA, 22 bp, Homo sapiens
ccagaggtctctctatactggg

SEQ ID NO: 7183727 - DNA, 22 bp, Homo sapiens
tctctgggataaactgggccag

SEQ ID NO: 7183728 - DNA, 22 bp, Homo sapiens
ccagaggtgaacaggaggctgt

SEQ ID NO: 7183729 - DNA, 22 bp, Homo sapiens
ccagcaaggtccagcataggga

SEQ ID NO: 7183730 - DNA, 23 bp, Homo sapiens
ccagatttgccacgagagaggct

SEQ ID NO: 7183731 - DNA, 22 bp, Homo sapiens
ccagatttgtaggggctcttac

SEQ ID NO: 7183732 - DNA, 22 bp, Homo sapiens
ccagcaaggtccagcataggga

SEQ ID NO: 7183733 - DNA, 22 bp, Homo sapiens
ccagcacacagtgggtgcccag

SEQ ID NO: 7183734 - DNA, 22 bp, Homo sapiens
ccagcacacagtgggtgcccag

SEQ ID NO: 7183735 - DNA, 20 bp, Homo sapiens
ccagcaccctctcagctgaa

SEQ ID NO: 7183736 - DNA, 22 bp, Homo sapiens
ccagatgtccctctcaggtttg

SEQ ID NO: 7183737 - DNA, 22 bp, Homo sapiens
ccagatgtccctctcaggtttg

SEQ ID NO: 7183738 - DNA, 22 bp, Homo sapiens
ccagatgtccctctcaggtttg

SEQ ID NO: 7183739 - DNA, 22 bp, Homo sapiens
ccagatgtccctctcaggtttg

SEQ ID NO: 7183740 - DNA, 22 bp, Homo sapiens
ccagattcatagaaactcatag

SEQ ID NO: 7183741 - DNA, 22 bp, Homo sapiens
ccagatttgagcgtcttaaacc

SEQ ID NO: 7183742 - DNA, 22 bp, Homo sapiens
ccagatttgagcgtcttaaacc

SEQ ID NO: 7183743 - DNA, 22 bp, Homo sapiens
ccagatgtccctctcaggtttg

SEQ ID NO: 7183744 - DNA, 22 bp, Homo sapiens
tctctgtcacacaatctacaca

SEQ ID NO: 7183745 - DNA, 22 bp, Homo sapiens
tctctgtattctgatattcact

SEQ ID NO: 7183746 - DNA, 22 bp, Homo sapiens
tctctgtatcccagaaccaaaa

SEQ ID NO: 7183747 - DNA, 22 bp, Homo sapiens
tctctgtatcagcacctgctgg

SEQ ID NO: 7183748 - DNA, 22 bp, Homo sapiens
tctctgtagttgggcagctgct

SEQ ID NO: 7183749 - DNA, 22 bp, Homo sapiens
tctctgtagggctgcttgagta

SEQ ID NO: 7183750 - DNA, 22 bp, Homo sapiens
tctctgtagggctgcttgagta

SEQ ID NO: 7183751 - DNA, 22 bp, Homo sapiens
tctctgtagggctgcttgagta

SEQ ID NO: 7183752 - DNA, 22 bp, Homo sapiens
tctctgtagagacagcactgtg

SEQ ID NO: 7183753 - DNA, 20 bp, Homo sapiens
tctctgtaaatcttctttta

SEQ ID NO: 7183754 - DNA, 22 bp, Homo sapiens
tctctgtaaaatgtggatgata

SEQ ID NO: 7183755 - DNA, 22 bp, Homo sapiens
tctctgtaaaatgtggatgata

SEQ ID NO: 7183756 - DNA, 22 bp, Homo sapiens
tctctgggatcaggtggcccag

SEQ ID NO: 7183757 - DNA, 22 bp, Homo sapiens
tctctgggatcaggtggcccag

SEQ ID NO: 7183758 - DNA, 21 bp, Homo sapiens
tctctggttggagttgtgcca

SEQ ID NO: 7183759 - DNA, 22 bp, Homo sapiens
tctctgtaaaatgtggatgata

SEQ ID NO: 7183760 - DNA, 22 bp, Homo sapiens
tctctgtagacctgaccagcac

SEQ ID NO: 7183761 - DNA, 22 bp, Homo sapiens
tctctgtagagacagcactgtg

SEQ ID NO: 7183762 - DNA, 23 bp, Homo sapiens
tctctgtacagatgaggacacac

SEQ ID NO: 7183763 - DNA, 23 bp, Homo sapiens
tctctgtacagatgaggacacac

SEQ ID NO: 7183764 - DNA, 22 bp, Homo sapiens
tctctgtaaggaagaattagat

SEQ ID NO: 7183765 - DNA, 18 bp, Homo sapiens
tctagaaacttctctcct

SEQ ID NO: 7183766 - DNA, 18 bp, Homo sapiens
tctagaaacccagactct

SEQ ID NO: 7183767 - DNA, 18 bp, Homo sapiens
tctagaaacccagactct

SEQ ID NO: 7183768 - DNA, 22 bp, Homo sapiens
tctagaaagtactagagctggt

SEQ ID NO: 7183769 - DNA, 22 bp, Homo sapiens
tctagaaagtttgtactgattt

SEQ ID NO: 7183770 - DNA, 22 bp, Homo sapiens
tctagaaattttgccttgtatt

SEQ ID NO: 7183771 - DNA, 22 bp, Homo sapiens
tctagaactccagttaggcaat

SEQ ID NO: 7183772 - DNA, 22 bp, Homo sapiens
tctagaacttctctaaaatgaa

SEQ ID NO: 7183773 - DNA, 22 bp, Homo sapiens
tctagaagtatattgtagggtg

SEQ ID NO: 7183774 - DNA, 22 bp, Homo sapiens
tctagaatactgtgacatgcca

SEQ ID NO: 7183775 - DNA, 22 bp, Homo sapiens
tctagaatagattctgctgatc

SEQ ID NO: 7183776 - DNA, 22 bp, Homo sapiens
tctagaatagattctgctgatc

SEQ ID NO: 7183777 - DNA, 22 bp, Homo sapiens
tcctgtgttacccttgcagtga

SEQ ID NO: 7183778 - DNA, 22 bp, Homo sapiens
tcctgtgttctaggtatggtct

SEQ ID NO: 7183779 - DNA, 22 bp, Homo sapiens
tcctgtgttgatagagatggtt

SEQ ID NO: 7183780 - DNA, 22 bp, Homo sapiens
tcctgtttcaacccttacactg

SEQ ID NO: 7183781 - DNA, 23 bp, Homo sapiens
tctaatgcaattagaaattaggg

SEQ ID NO: 7183782 - DNA, 22 bp, Homo sapiens
tctaatgcagttctgggtattt

SEQ ID NO: 7183783 - DNA, 22 bp, Homo sapiens
tctaatgctctgagaacagtgc

SEQ ID NO: 7183784 - DNA, 22 bp, Homo sapiens
tctaatgcttcctctcatccca

SEQ ID NO: 7183785 - DNA, 22 bp, Homo sapiens
tcctgtggtctggaaggaatgg

SEQ ID NO: 7183786 - DNA, 22 bp, Homo sapiens
tcctgtggtcattcttctgccc

SEQ ID NO: 7183787 - DNA, 22 bp, Homo sapiens
tcctgtgtctcagcgtgaagca

SEQ ID NO: 7183788 - DNA, 22 bp, Homo sapiens
tcctgtgtgggcaggatgagaa

SEQ ID NO: 7183789 - DNA, 22 bp, Homo sapiens
tcctgtgtgggcaggatgagaa

SEQ ID NO: 7183790 - DNA, 22 bp, Homo sapiens
tcctgtgttaaagggggtgcta

SEQ ID NO: 7183791 - DNA, 22 bp, Homo sapiens
ccaccctgagccgcaagagcag

SEQ ID NO: 7183792 - DNA, 22 bp, Homo sapiens
ccaccctgaggaatggtccggc

SEQ ID NO: 7183793 - DNA, 22 bp, Homo sapiens
ccaccctgccttgggccagtga

SEQ ID NO: 7183794 - DNA, 18 bp, Homo sapiens
ccacccagggggagagga

SEQ ID NO: 7183795 - DNA, 18 bp, Homo sapiens
ccacccagggggagagga

SEQ ID NO: 7183796 - DNA, 18 bp, Homo sapiens
ccacccatctctgccttt

SEQ ID NO: 7183797 - DNA, 18 bp, Homo sapiens
ccacccatctctgccttt

SEQ ID NO: 7183798 - DNA, 22 bp, Homo sapiens
ccaccccaaatgaagacctctc

SEQ ID NO: 7183799 - DNA, 22 bp, Homo sapiens
ccaccccaaatgaagacctctc

SEQ ID NO: 7183800 - DNA, 22 bp, Homo sapiens
ccacccctgggtgcagggagcg

SEQ ID NO: 7183801 - DNA, 22 bp, Homo sapiens
ccacccctgggtgcagggagcg

SEQ ID NO: 7183802 - DNA, 22 bp, Homo sapiens
ccacccctgggtgcagggagcg

SEQ ID NO: 7183803 - DNA, 22 bp, Homo sapiens
ccacccctgggtgcagggagcg

SEQ ID NO: 7183804 - DNA, 22 bp, Homo sapiens
ccacccctgggtgcagggagcg

SEQ ID NO: 7183805 - DNA, 19 bp, Homo sapiens
ccacccctttgctgggccc

SEQ ID NO: 7183806 - DNA, 19 bp, Homo sapiens
ccacccctttgctgggccc

SEQ ID NO: 7183807 - DNA, 22 bp, Homo sapiens
ccaccctgagccgcaagagcag

SEQ ID NO: 7183808 - DNA, 22 bp, Homo sapiens
ccagagaggccttggcaagaca

SEQ ID NO: 7183809 - DNA, 22 bp, Homo sapiens
ccagagaggccttggcaagaca

SEQ ID NO: 7183810 - DNA, 22 bp, Homo sapiens
tctcagtgtgttttctctcaga

SEQ ID NO: 7183811 - DNA, 22 bp, Homo sapiens
tctcagtgtttaaaaagatttc

SEQ ID NO: 7183812 - DNA, 22 bp, Homo sapiens
tctcagtgggttaaaagagaag

SEQ ID NO: 7183813 - DNA, 22 bp, Homo sapiens
tctcagtggtgttttgagtcca

SEQ ID NO: 7183814 - DNA, 22 bp, Homo sapiens
tctcagtgtgttgagaggtctg

SEQ ID NO: 7183815 - DNA, 22 bp, Homo sapiens
tctcaggactcctctggccata

SEQ ID NO: 7183816 - DNA, 22 bp, Homo sapiens
tctcaggactttgggaagctca

SEQ ID NO: 7183817 - DNA, 22 bp, Homo sapiens
tctcaggagccacagcgggagt

SEQ ID NO: 7183818 - DNA, 23 bp, Homo sapiens
tctcaggcaaaccaggacaagtt

SEQ ID NO: 7183819 - DNA, 23 bp, Homo sapiens
tctcaggcaaaccaggacaagtt

SEQ ID NO: 7183820 - DNA, 23 bp, Homo sapiens
tctcaggcaaaccaggacaagtt

SEQ ID NO: 7183821 - DNA, 23 bp, Homo sapiens
tctcaggcaaaccaggacaagtt

SEQ ID NO: 7183822 - DNA, 17 bp, Homo sapiens
tctcaggcacgtgtggc

SEQ ID NO: 7183823 - DNA, 17 bp, Homo sapiens
tctcaggcacgtgtggc

SEQ ID NO: 7183824 - DNA, 22 bp, Homo sapiens
tctcaggcactgggtgccaact

SEQ ID NO: 7183825 - DNA, 22 bp, Homo sapiens
tctcaggcatctgtgtggcaca

SEQ ID NO: 7183826 - DNA, 22 bp, Homo sapiens
tctcaggcatctgtgtggcaca

SEQ ID NO: 7183827 - DNA, 22 bp, Homo sapiens
tctcaggcatggtttgttcatc

SEQ ID NO: 7183828 - DNA, 22 bp, Homo sapiens
tctcaggcattcccacatagaa

SEQ ID NO: 7183829 - DNA, 22 bp, Homo sapiens
tctcaggcattcccacatagaa

SEQ ID NO: 7183830 - DNA, 22 bp, Homo sapiens
tctcaggcccactgtgttgaaa

SEQ ID NO: 7183831 - DNA, 20 bp, Homo sapiens
tctcaggccccagttttctt

SEQ ID NO: 7183832 - DNA, 22 bp, Homo sapiens
tctcagtggatctcagaatttt

SEQ ID NO: 7183833 - DNA, 22 bp, Homo sapiens
tctcaggaatagagtggcagca

SEQ ID NO: 7183834 - DNA, 23 bp, Homo sapiens
tctcaggacacacatgtctatca

SEQ ID NO: 7183835 - DNA, 22 bp, Homo sapiens
tctcagcttgagtggatgagct

SEQ ID NO: 7183836 - DNA, 22 bp, Homo sapiens
tctcagagacctgaactccctg

SEQ ID NO: 7183837 - DNA, 22 bp, Homo sapiens
tctcagctgcctgccctgctcc

SEQ ID NO: 7183838 - DNA, 23 bp, Homo sapiens
tctatacatactgcagcctctgg

SEQ ID NO: 7183839 - DNA, 22 bp, Homo sapiens
tctatacacacaaagaatgctt

SEQ ID NO: 7183840 - DNA, 22 bp, Homo sapiens
tctatacatgtgcacacacatc

SEQ ID NO: 7183841 - DNA, 22 bp, Homo sapiens
tctatacatgtgcacacacatc

SEQ ID NO: 7183842 - DNA, 22 bp, Homo sapiens
tctatacaagtttcactttgac

SEQ ID NO: 7183843 - DNA, 22 bp, Homo sapiens
tctataatcctatttcaactgc

SEQ ID NO: 7183844 - DNA, 22 bp, Homo sapiens
tctataaattatgcagtctcag

SEQ ID NO: 7183845 - DNA, 21 bp, Homo sapiens
tctataactatagtgacagat

SEQ ID NO: 7183846 - DNA, 21 bp, Homo sapiens
tctataactatagtgacagat

SEQ ID NO: 7183847 - DNA, 21 bp, Homo sapiens
tctataactatagtgacagat

SEQ ID NO: 7183848 - DNA, 21 bp, Homo sapiens
tctataatatgcaggtcatca

SEQ ID NO: 7183849 - DNA, 22 bp, Homo sapiens
tctataaatgcagatatgtgtg

SEQ ID NO: 7183850 - DNA, 22 bp, Homo sapiens
tctagaattcccttttgacaat

SEQ ID NO: 7183851 - DNA, 22 bp, Homo sapiens
tctagaatttgcgtaggttaga

SEQ ID NO: 7183852 - DNA, 22 bp, Homo sapiens
tctataaatgcagatatgtgtg

SEQ ID NO: 7183853 - DNA, 21 bp, Homo sapiens
tctagaatcctgtataagact

SEQ ID NO: 7183854 - DNA, 22 bp, Homo sapiens
tctagaatctaaactatagttt

SEQ ID NO: 7183855 - DNA, 22 bp, Homo sapiens
tctagaatggctgggcacagct

SEQ ID NO: 7183856 - DNA, 22 bp, Homo sapiens
tctagaatggctgggcacagct

SEQ ID NO: 7183857 - DNA, 22 bp, Homo sapiens
catgctaagtcataaaagagta

SEQ ID NO: 7183858 - DNA, 22 bp, Homo sapiens
catgccaggactctggaggctt

SEQ ID NO: 7183859 - DNA, 22 bp, Homo sapiens
catgccaacaacaagcaatgag

SEQ ID NO: 7183860 - DNA, 22 bp, Homo sapiens
catgccaacaacaagcaatgag

SEQ ID NO: 7183861 - DNA, 22 bp, Homo sapiens
catgccaagcatgttcagaagt

SEQ ID NO: 7183862 - DNA, 22 bp, Homo sapiens
catgccacgccgctgcaaggac

SEQ ID NO: 7183863 - DNA, 22 bp, Homo sapiens
catgccacgctgctgcaaggac

SEQ ID NO: 7183864 - DNA, 22 bp, Homo sapiens
tcatcagggatattggcctgaa

SEQ ID NO: 7183865 - DNA, 22 bp, Homo sapiens
tcatcagtccttttcattatga

SEQ ID NO: 7183866 - DNA, 22 bp, Homo sapiens
tcatcagggatattggcctgaa

SEQ ID NO: 7183867 - DNA, 22 bp, Homo sapiens
tcatcagggatattggcctgaa

SEQ ID NO: 7183868 - DNA, 22 bp, Homo sapiens
catgctcacaaaagatggcaaa

SEQ ID NO: 7183869 - DNA, 22 bp, Homo sapiens
catgctaattaattccacctgc

SEQ ID NO: 7183870 - DNA, 22 bp, Homo sapiens
catgctaattcccaggccccaa

SEQ ID NO: 7183871 - DNA, 22 bp, Homo sapiens
catgctactgaacaagtccatg

SEQ ID NO: 7183872 - DNA, 22 bp, Homo sapiens
catgctactgaacaagtccatg

SEQ ID NO: 7183873 - DNA, 22 bp, Homo sapiens
catgctacttgctatgcaaaaa

SEQ ID NO: 7183874 - DNA, 22 bp, Homo sapiens
catgctacttgctatgcaaaaa

SEQ ID NO: 7183875 - DNA, 22 bp, Homo sapiens
catgctctagattctctctaat

SEQ ID NO: 7183876 - DNA, 22 bp, Homo sapiens
catgctccatatggatattctt

SEQ ID NO: 7183877 - DNA, 22 bp, Homo sapiens
catgctctagattctctctaat

SEQ ID NO: 7183878 - DNA, 22 bp, Homo sapiens
catgctctccattggacacaga

SEQ ID NO: 7183879 - DNA, 22 bp, Homo sapiens
catgctctctggcaacttgtgt

SEQ ID NO: 7183880 - DNA, 22 bp, Homo sapiens
catgctctctggcaacttgtgt

SEQ ID NO: 7183881 - DNA, 22 bp, Homo sapiens
catgctgtgtgttttagctcca

SEQ ID NO: 7183882 - DNA, 22 bp, Homo sapiens
catgctgtgttacttggcatct

SEQ ID NO: 7183883 - DNA, 22 bp, Homo sapiens
catgctgtgctattcgtgctgt

SEQ ID NO: 7183884 - DNA, 22 bp, Homo sapiens
catgctgtggtaaatcactgaa

SEQ ID NO: 7183885 - DNA, 22 bp, Homo sapiens
catgctggtcagccagtggatg

SEQ ID NO: 7183886 - DNA, 22 bp, Homo sapiens
catgctggtcagccagtggatg

SEQ ID NO: 7183887 - DNA, 22 bp, Homo sapiens
catgctgtactctgtgtcagaa

SEQ ID NO: 7183888 - DNA, 22 bp, Homo sapiens
catgctgtcctgaaaagatatt

SEQ ID NO: 7183889 - DNA, 22 bp, Homo sapiens
catgctgatgaacttctacttg

SEQ ID NO: 7183890 - DNA, 22 bp, Homo sapiens
catgctgggccttgggtgcact

SEQ ID NO: 7183891 - DNA, 22 bp, Homo sapiens
catgctgggtaaaggtggtgaa

SEQ ID NO: 7183892 - DNA, 22 bp, Homo sapiens
catgctgagcacattctgtatt

SEQ ID NO: 7183893 - DNA, 22 bp, Homo sapiens
catgctgagcacattctgtatt

SEQ ID NO: 7183894 - DNA, 22 bp, Homo sapiens
catgctgagcacattctgtatt

SEQ ID NO: 7183895 - DNA, 22 bp, Homo sapiens
catgctgagcacattctgtatt

SEQ ID NO: 7183896 - DNA, 22 bp, Homo sapiens
catgctctccattggacacaga

SEQ ID NO: 7183897 - DNA, 22 bp, Homo sapiens
catgctctctggcaacttgtgt

SEQ ID NO: 7183898 - DNA, 22 bp, Homo sapiens
catgctctgcagcagacctgtg

SEQ ID NO: 7183899 - DNA, 19 bp, Homo sapiens
catgctgacctgctgtggt

SEQ ID NO: 7183900 - DNA, 22 bp, Homo sapiens
tccaagatgtcggtcctgtcca

SEQ ID NO: 7183901 - DNA, 22 bp, Homo sapiens
tccaagatctacagcagtttag

SEQ ID NO: 7183902 - DNA, 22 bp, Homo sapiens
tccaagagttcaaggctacagt

SEQ ID NO: 7183903 - DNA, 22 bp, Homo sapiens
tccaagagtatagtttattggc

SEQ ID NO: 7183904 - DNA, 22 bp, Homo sapiens
tccaagaatcagtctcttttgg

SEQ ID NO: 7183905 - DNA, 22 bp, Homo sapiens
tccaagacaagcacattcctgc

SEQ ID NO: 7183906 - DNA, 22 bp, Homo sapiens
tccaagaatacagatttgtgaa

SEQ ID NO: 7183907 - DNA, 22 bp, Homo sapiens
tccaagaatcactgacacagct

SEQ ID NO: 7183908 - DNA, 22 bp, Homo sapiens
tccaagacaagcacattcctgc

SEQ ID NO: 7183909 - DNA, 22 bp, Homo sapiens
tccaagaggagacactgggatg

SEQ ID NO: 7183910 - DNA, 23 bp, Homo sapiens
tccaagaagtagggcctggactt

SEQ ID NO: 7183911 - DNA, 22 bp, Homo sapiens
tccaagaagtcatctaaactgt

SEQ ID NO: 7183912 - DNA, 22 bp, Homo sapiens
tccaagaagtcatctaaactgt

SEQ ID NO: 7183913 - DNA, 16 bp, Homo sapiens
tccaagaagtgcccct

SEQ ID NO: 7183914 - DNA, 22 bp, Homo sapiens
tccaagaagtttatgttgtttc

SEQ ID NO: 7183915 - DNA, 22 bp, Homo sapiens
tccaagaagtttatgttgtttc

SEQ ID NO: 7183916 - DNA, 22 bp, Homo sapiens
tccaagaatacagatttgtgaa

SEQ ID NO: 7183917 - DNA, 22 bp, Homo sapiens
tccaagcatgtggtcaggagcc

SEQ ID NO: 7183918 - DNA, 22 bp, Homo sapiens
tccaagcactgttaattaaact

SEQ ID NO: 7183919 - DNA, 18 bp, Homo sapiens
tccagagagggagaagtg

SEQ ID NO: 7183920 - DNA, 18 bp, Homo sapiens
tccagagagggagaagtg

SEQ ID NO: 7183921 - DNA, 18 bp, Homo sapiens
tccagagagggagaagtg

SEQ ID NO: 7183922 - DNA, 18 bp, Homo sapiens
tccagaggtgttggagcc

SEQ ID NO: 7183923 - DNA, 18 bp, Homo sapiens
tccagaggtgttggagcc

SEQ ID NO: 7183924 - DNA, 18 bp, Homo sapiens
tccagaggtgttggagcc

SEQ ID NO: 7183925 - DNA, 22 bp, Homo sapiens
tccagatagagtcctgttagta

SEQ ID NO: 7183926 - DNA, 22 bp, Homo sapiens
catgtaaagcacttcataacag

SEQ ID NO: 7183927 - DNA, 22 bp, Homo sapiens
catgtaaagcatccttctaggg

SEQ ID NO: 7183928 - DNA, 22 bp, Homo sapiens
catgtaaagaatttcacacaag

SEQ ID NO: 7183929 - DNA, 22 bp, Homo sapiens
catgtaaagaatttcacacaag

SEQ ID NO: 7183930 - DNA, 22 bp, Homo sapiens
catgtaaagcatccttctaggg

SEQ ID NO: 7183931 - DNA, 22 bp, Homo sapiens
catgtaaatccttctttaggcc

SEQ ID NO: 7183932 - DNA, 22 bp, Homo sapiens
catgtacaaaaggcaaatgcct

SEQ ID NO: 7183933 - DNA, 22 bp, Homo sapiens
catgtaaaccattgtgagcatc

SEQ ID NO: 7183934 - DNA, 22 bp, Homo sapiens
catgtaaaacactcagaacagt

SEQ ID NO: 7183935 - DNA, 22 bp, Homo sapiens
catgtaaaacactcagaacagt

SEQ ID NO: 7183936 - DNA, 22 bp, Homo sapiens
catgtaaaaagaagaatctgga

SEQ ID NO: 7183937 - DNA, 22 bp, Homo sapiens
catgtaaaaagaagaatctgga

SEQ ID NO: 7183938 - DNA, 22 bp, Homo sapiens
catgtaaaaaattaggtcatct

SEQ ID NO: 7183939 - DNA, 22 bp, Homo sapiens
catgtaaaaaattaggtcatct

SEQ ID NO: 7183940 - DNA, 22 bp, Homo sapiens
catgtaaaaaattaggtcatct

SEQ ID NO: 7183941 - DNA, 20 bp, Homo sapiens
catggtggaggagcagggcc

SEQ ID NO: 7183942 - DNA, 19 bp, Homo sapiens
catggtgaaaccccgtctc

SEQ ID NO: 7183943 - DNA, 22 bp, Homo sapiens
catggtgggtgtagtttccgcc

SEQ ID NO: 7183944 - DNA, 22 bp, Homo sapiens
catgggctcttctggactgcac

SEQ ID NO: 7183945 - DNA, 23 bp, Homo sapiens
catggaaaactgaaagctgacct

SEQ ID NO: 7183946 - DNA, 23 bp, Homo sapiens
catggaaaactgaaagctgacct

SEQ ID NO: 7183947 - DNA, 23 bp, Homo sapiens
catggaaaactgaaagctgacct

SEQ ID NO: 7183948 - DNA, 22 bp, Homo sapiens
catggaaagcactcagcccagt

SEQ ID NO: 7183949 - DNA, 22 bp, Homo sapiens
catggaacaaggaagatgtttg

SEQ ID NO: 7183950 - DNA, 22 bp, Homo sapiens
catggaactgtataaaggcact

SEQ ID NO: 7183951 - DNA, 21 bp, Homo sapiens
tccagcacagatgacctcccc

SEQ ID NO: 7183952 - DNA, 22 bp, Homo sapiens
tccagcacagaatttcctagct

SEQ ID NO: 7183953 - DNA, 22 bp, Homo sapiens
tccagcacagaatttcctagct

SEQ ID NO: 7183954 - DNA, 22 bp, Homo sapiens
tccagatggatttaagacctaa

SEQ ID NO: 7183955 - DNA, 21 bp, Homo sapiens
tccagcacagatgacctcccc

SEQ ID NO: 7183956 - DNA, 22 bp, Homo sapiens
tccagcaccaccacagggaaga

SEQ ID NO: 7183957 - DNA, 22 bp, Homo sapiens
tccagcaccaccacagggaaga

SEQ ID NO: 7183958 - DNA, 22 bp, Homo sapiens
tccagcacccaatgtggctaag

SEQ ID NO: 7183959 - DNA, 22 bp, Homo sapiens
tccagcacccaatgtggctaag

SEQ ID NO: 7183960 - DNA, 22 bp, Homo sapiens
tccagcacccaatgtggctaag

SEQ ID NO: 7183961 - DNA, 22 bp, Homo sapiens
tccagcacccaatgtggctaag

SEQ ID NO: 7183962 - DNA, 20 bp, Homo sapiens
tccagcaccctcacagagaa

SEQ ID NO: 7183963 - DNA, 20 bp, Homo sapiens
tccagcaccctcacagagaa

SEQ ID NO: 7183964 - DNA, 20 bp, Homo sapiens
tccagcaccctcacagagaa

SEQ ID NO: 7183965 - DNA, 22 bp, Homo sapiens
tccagcacctggaggcgtcccc

SEQ ID NO: 7183966 - DNA, 22 bp, Homo sapiens
tccagcacctggaggcgtcccc

SEQ ID NO: 7183967 - DNA, 22 bp, Homo sapiens
tccagcactcgcccagggcttg

SEQ ID NO: 7183968 - DNA, 22 bp, Homo sapiens
tccagcactcgcccagggcttg

SEQ ID NO: 7183969 - DNA, 22 bp, Homo sapiens
tccagcagaaaagaggtaggga

SEQ ID NO: 7183970 - DNA, 22 bp, Homo sapiens
tccagcagaaaagaggtaggga

SEQ ID NO: 7183971 - DNA, 22 bp, Homo sapiens
tccagcagaaaagaggtaggga

SEQ ID NO: 7183972 - DNA, 22 bp, Homo sapiens
tccagcagaaccagagacctgg

SEQ ID NO: 7183973 - DNA, 22 bp, Homo sapiens
tccagcagaaccagagacctgg

SEQ ID NO: 7183974 - DNA, 22 bp, Homo sapiens
catgctgttgaatatgacattg

SEQ ID NO: 7183975 - DNA, 22 bp, Homo sapiens
catgctttgggtcagaaatgcc

SEQ ID NO: 7183976 - DNA, 22 bp, Homo sapiens
catgcttttttctagtataaat

SEQ ID NO: 7183977 - DNA, 23 bp, Homo sapiens
catggaaaactgaaagctgacct

SEQ ID NO: 7183978 - DNA, 22 bp, Homo sapiens
catgctttctgtccaaatgtta

SEQ ID NO: 7183979 - DNA, 22 bp, Homo sapiens
catgctttctgtccaaatgtta

SEQ ID NO: 7183980 - DNA, 22 bp, Homo sapiens
catgctttgggtcagaaatgcc

SEQ ID NO: 7183981 - DNA, 22 bp, Homo sapiens
catgcttttcaatctatcttaa

SEQ ID NO: 7183982 - DNA, 22 bp, Homo sapiens
catgcttttcaatctatcttaa

SEQ ID NO: 7183983 - DNA, 22 bp, Homo sapiens
catgctttaccaaagcagtgat

SEQ ID NO: 7183984 - DNA, 22 bp, Homo sapiens
catgcttcctccaaactaccct

SEQ ID NO: 7183985 - DNA, 22 bp, Homo sapiens
catgcttcctccaaactaccct

SEQ ID NO: 7183986 - DNA, 22 bp, Homo sapiens
catgcttaattggagcattcat

SEQ ID NO: 7183987 - DNA, 22 bp, Homo sapiens
catgcttacttgtctcagcaga

SEQ ID NO: 7183988 - DNA, 22 bp, Homo sapiens
catgcttatatggaaaggaaga

SEQ ID NO: 7183989 - DNA, 22 bp, Homo sapiens
catgcttatgatttgctaagcc

SEQ ID NO: 7183990 - DNA, 22 bp, Homo sapiens
tccaggctgtgcgcaccgtgtg

SEQ ID NO: 7183991 - DNA, 22 bp, Homo sapiens
tccaggcttcacgtctgccctc

SEQ ID NO: 7183992 - DNA, 22 bp, Homo sapiens
tccaggcttcacgtctgccctc

SEQ ID NO: 7183993 - DNA, 22 bp, Homo sapiens
tccaggctgtgcgcaccgtgtg

SEQ ID NO: 7183994 - DNA, 22 bp, Homo sapiens
tccaggctgtgcgcaccgtgtg

SEQ ID NO: 7183995 - DNA, 22 bp, Homo sapiens
tccaggctgtgcatgagtttag

SEQ ID NO: 7183996 - DNA, 22 bp, Homo sapiens
tccaggctgtgcgcaccgtgtg

SEQ ID NO: 7183997 - DNA, 22 bp, Homo sapiens
tccaggctgtgcgcaccgtgtg

SEQ ID NO: 7183998 - DNA, 22 bp, Homo sapiens
tccaggcttcacgtctgccctc

SEQ ID NO: 7183999 - DNA, 22 bp, Homo sapiens
tccaggcttcacgtctgccctc

SEQ ID NO: 7184000 - DNA, 22 bp, Homo sapiens
tccaggcttgagaccaggctct

SEQ ID NO: 7184001 - DNA, 22 bp, Homo sapiens
catgtacagtttttctgtcctg

SEQ ID NO: 7184002 - DNA, 22 bp, Homo sapiens
catgtacagtttttctgtcctg

SEQ ID NO: 7184003 - DNA, 22 bp, Homo sapiens
catgtacatgcatgggcactgt

SEQ ID NO: 7184004 - DNA, 22 bp, Homo sapiens
catgtacatgcctactatcaat

SEQ ID NO: 7184005 - DNA, 22 bp, Homo sapiens
catgtacatgcctactatcaat

SEQ ID NO: 7184006 - DNA, 20 bp, Homo sapiens
tccaggctcctccacttagt

SEQ ID NO: 7184007 - DNA, 20 bp, Homo sapiens
tccaggctcctccacttagt

SEQ ID NO: 7184008 - DNA, 22 bp, Homo sapiens
tccaggctcctgactttttggg

SEQ ID NO: 7184009 - DNA, 22 bp, Homo sapiens
tccaggctgggctgaagggtgc

SEQ ID NO: 7184010 - DNA, 23 bp, Homo sapiens
catgtacagagtttgataaagtg

SEQ ID NO: 7184011 - DNA, 23 bp, Homo sapiens
catgtacagagtttgataaagtg

SEQ ID NO: 7184012 - DNA, 22 bp, Homo sapiens
catgtacagccagggttgagaa

SEQ ID NO: 7184013 - DNA, 22 bp, Homo sapiens
catgtacactcatgtaactata

SEQ ID NO: 7184014 - DNA, 22 bp, Homo sapiens
catgtacactcatgtaactata

SEQ ID NO: 7184015 - DNA, 22 bp, Homo sapiens
catgtacactcatgtaactata

SEQ ID NO: 7184016 - DNA, 22 bp, Homo sapiens
catgtacactcatgtaactata

SEQ ID NO: 7184017 - DNA, 22 bp, Homo sapiens
catgtacactcatgtaactata

SEQ ID NO: 7184018 - DNA, 22 bp, Homo sapiens
catgtacactcatgtaactata

SEQ ID NO: 7184019 - DNA, 23 bp, Homo sapiens
catgtacagagtttgataaagtg

SEQ ID NO: 7184020 - DNA, 23 bp, Homo sapiens
catgtacagagtttgataaagtg

SEQ ID NO: 7184021 - DNA, 23 bp, Homo sapiens
catgtacacacagctgtacagtg

SEQ ID NO: 7184022 - DNA, 23 bp, Homo sapiens
catgtacacacagctgtacagtg

SEQ ID NO: 7184023 - DNA, 23 bp, Homo sapiens
catgtacacacagctgtacagtg

SEQ ID NO: 7184024 - DNA, 23 bp, Homo sapiens
catgtacacacagctgtacagtg

SEQ ID NO: 7184025 - DNA, 22 bp, Homo sapiens
catgtacaaggatgctcagagt

SEQ ID NO: 7184026 - DNA, 22 bp, Homo sapiens
catgtacacacaaagggacaat

SEQ ID NO: 7184027 - DNA, 22 bp, Homo sapiens
catgtacacacaaagggacaat

SEQ ID NO: 7184028 - DNA, 23 bp, Homo sapiens
catgtacacacagctgtacagtg

SEQ ID NO: 7184029 - DNA, 22 bp, Homo sapiens
tccaggctttggggcaggagcg

SEQ ID NO: 7184030 - DNA, 22 bp, Homo sapiens
tccaggctttggggcaggagcg

SEQ ID NO: 7184031 - DNA, 22 bp, Homo sapiens
tccaggctttggggcaggagcg

SEQ ID NO: 7184032 - DNA, 22 bp, Homo sapiens
tccaggctttggggcaggagcg

SEQ ID NO: 7184033 - DNA, 22 bp, Homo sapiens
tccaggcttgagaccaggctct

SEQ ID NO: 7184034 - DNA, 22 bp, Homo sapiens
tccaggcttgagaccaggctct

SEQ ID NO: 7184035 - DNA, 22 bp, Homo sapiens
tccaggctttggggcaggagcg

SEQ ID NO: 7184036 - DNA, 22 bp, Homo sapiens
tccaggctttggggcaggagcg

SEQ ID NO: 7184037 - DNA, 22 bp, Homo sapiens
catgtgctgtagcagagaggaa

SEQ ID NO: 7184038 - DNA, 23 bp, Homo sapiens
catgtgcctgctgtgtggaagcc

SEQ ID NO: 7184039 - DNA, 22 bp, Homo sapiens
catgtgctgtagcagagaggaa

SEQ ID NO: 7184040 - DNA, 22 bp, Homo sapiens
tccaggctttttcatgctgtct

SEQ ID NO: 7184041 - DNA, 22 bp, Homo sapiens
tccaggctttttcatgctgtct

SEQ ID NO: 7184042 - DNA, 22 bp, Homo sapiens
catgtggctttggcatgtgccc

SEQ ID NO: 7184043 - DNA, 22 bp, Homo sapiens
catgtggctttggcatgtgccc

SEQ ID NO: 7184044 - DNA, 22 bp, Homo sapiens
catgtggctttggcatgtgccc

SEQ ID NO: 7184045 - DNA, 22 bp, Homo sapiens
catgtgggaagaggccagctgg

SEQ ID NO: 7184046 - DNA, 22 bp, Homo sapiens
catgtgggaagaggccagctgg

SEQ ID NO: 7184047 - DNA, 22 bp, Homo sapiens
catgtgggacaatctcaggtat

SEQ ID NO: 7184048 - DNA, 22 bp, Homo sapiens
catgtgggacaatctcaggtat

SEQ ID NO: 7184049 - DNA, 22 bp, Homo sapiens
catgtgggttattgggttctag

SEQ ID NO: 7184050 - DNA, 22 bp, Homo sapiens
catgtgtcaaatgatgtagctg

SEQ ID NO: 7184051 - DNA, 19 bp, Homo sapiens
catgtgtcaatactgtacc

SEQ ID NO: 7184052 - DNA, 22 bp, Homo sapiens
catgtgtcacagccttttattg

SEQ ID NO: 7184053 - DNA, 22 bp, Homo sapiens
catgtgtcacagccttttattg

SEQ ID NO: 7184054 - DNA, 20 bp, Homo sapiens
catgtgtcagttctcaccca

SEQ ID NO: 7184055 - DNA, 22 bp, Homo sapiens
catgttttgtgtacagaatatt

SEQ ID NO: 7184056 - DNA, 22 bp, Homo sapiens
catgttttgtgtacagaatatt

SEQ ID NO: 7184057 - DNA, 22 bp, Homo sapiens
catgttttgtgtacagaatatt

SEQ ID NO: 7184058 - DNA, 22 bp, Homo sapiens
catgttttgtgtacagaatatt

SEQ ID NO: 7184059 - DNA, 22 bp, Homo sapiens
tccaggtcccagactgggcagc

SEQ ID NO: 7184060 - DNA, 22 bp, Homo sapiens
tccaggtcccagactgggcagc

SEQ ID NO: 7184061 - DNA, 22 bp, Homo sapiens
tccaggtcatcttggagagctg

SEQ ID NO: 7184062 - DNA, 22 bp, Homo sapiens
tccaggtcatcttggagagctg

SEQ ID NO: 7184063 - DNA, 22 bp, Homo sapiens
tccaggtcccagactgggcagc

SEQ ID NO: 7184064 - DNA, 17 bp, Homo sapiens
tccagggtttatgaaat

SEQ ID NO: 7184065 - DNA, 20 bp, Homo sapiens
tccaggtaacatctctctgg

SEQ ID NO: 7184066 - DNA, 22 bp, Homo sapiens
tccagggtcagaagtcacatac

SEQ ID NO: 7184067 - DNA, 21 bp, Homo sapiens
tccagggtcagaagttcagtg

SEQ ID NO: 7184068 - DNA, 21 bp, Homo sapiens
tccagggtcagaagttcagtg

SEQ ID NO: 7184069 - DNA, 19 bp, Homo sapiens
tccagggtcattaacaatg

SEQ ID NO: 7184070 - DNA, 22 bp, Homo sapiens
tccagggttgtgggcttcagca

SEQ ID NO: 7184071 - DNA, 22 bp, Homo sapiens
tccagggttgtgggcttcagca

SEQ ID NO: 7184072 - DNA, 22 bp, Homo sapiens
tccagggttgtgggcttcagca

SEQ ID NO: 7184073 - DNA, 22 bp, Homo sapiens
tccagggtcagaagtcacatac

SEQ ID NO: 7184074 - DNA, 22 bp, Homo sapiens
tccagggcatgctcagactcag

SEQ ID NO: 7184075 - DNA, 22 bp, Homo sapiens
tccagggcatgctcagactcag

SEQ ID NO: 7184076 - DNA, 23 bp, Homo sapiens
tccagggcagtggctgggtctgc

SEQ ID NO: 7184077 - DNA, 22 bp, Homo sapiens
tccagggcatgctcagactcag

SEQ ID NO: 7184078 - DNA, 22 bp, Homo sapiens
tccagggcatgctcagactcag

SEQ ID NO: 7184079 - DNA, 22 bp, Homo sapiens
tccagggcatggggagagagtg

SEQ ID NO: 7184080 - DNA, 22 bp, Homo sapiens
tccagggccaagtcatggaacc

SEQ ID NO: 7184081 - DNA, 23 bp, Homo sapiens
tccagggcagtggctgggtctgc

SEQ ID NO: 7184082 - DNA, 22 bp, Homo sapiens
tccagggcagtgactacagcgg

SEQ ID NO: 7184083 - DNA, 22 bp, Homo sapiens
tccagggcagtgactacagcgg

SEQ ID NO: 7184084 - DNA, 22 bp, Homo sapiens
tccagggcagtgactacagcgg

SEQ ID NO: 7184085 - DNA, 22 bp, Homo sapiens
cattacagaatatgtaatgatc

SEQ ID NO: 7184086 - DNA, 22 bp, Homo sapiens
cattacaaccccaaattacaaa

SEQ ID NO: 7184087 - DNA, 22 bp, Homo sapiens
cattacaaagttataaacagtt

SEQ ID NO: 7184088 - DNA, 22 bp, Homo sapiens
cattacaaagttataaacagtt

SEQ ID NO: 7184089 - DNA, 22 bp, Homo sapiens
cattacaaagttataaacagtt

SEQ ID NO: 7184090 - DNA, 22 bp, Homo sapiens
cattacaaccccaaattacaaa

SEQ ID NO: 7184091 - DNA, 22 bp, Homo sapiens
cattacaaccccaaattacaaa

SEQ ID NO: 7184092 - DNA, 22 bp, Homo sapiens
cattaatttaatattcaaagaa

SEQ ID NO: 7184093 - DNA, 22 bp, Homo sapiens
cattaatttaatattcaaagaa

SEQ ID NO: 7184094 - DNA, 22 bp, Homo sapiens
cattacaaacatgttaagattt

SEQ ID NO: 7184095 - DNA, 22 bp, Homo sapiens
cattacaaacatgttaagattt

SEQ ID NO: 7184096 - DNA, 22 bp, Homo sapiens
cattaagtctgttaactggaga

SEQ ID NO: 7184097 - DNA, 22 bp, Homo sapiens
cattaataaacatttcagaaga

SEQ ID NO: 7184098 - DNA, 22 bp, Homo sapiens
cattaatattgttcttctttag

SEQ ID NO: 7184099 - DNA, 22 bp, Homo sapiens
tcaggcagaattatcaaaagat

SEQ ID NO: 7184100 - DNA, 22 bp, Homo sapiens
tcaggcagaattatcaaaagat

SEQ ID NO: 7184101 - DNA, 22 bp, Homo sapiens
tcaggcagaaaaatcactaatt

SEQ ID NO: 7184102 - DNA, 21 bp, Homo sapiens
tcaggaggctcagactcctgc

SEQ ID NO: 7184103 - DNA, 21 bp, Homo sapiens
tcaggaggctcagactcctgc

SEQ ID NO: 7184104 - DNA, 22 bp, Homo sapiens
tcaggagggagtgtggatagag

SEQ ID NO: 7184105 - DNA, 22 bp, Homo sapiens
tcaggcagaaaaatcactaatt

SEQ ID NO: 7184106 - DNA, 22 bp, Homo sapiens
tcaggaggcggtgctgcctttg

SEQ ID NO: 7184107 - DNA, 22 bp, Homo sapiens
tcaggaggcgtctcgctggggc

SEQ ID NO: 7184108 - DNA, 22 bp, Homo sapiens
tcaggaggcgtctcgctggggc

SEQ ID NO: 7184109 - DNA, 22 bp, Homo sapiens
tcaggaggcgtgctggggtaca

SEQ ID NO: 7184110 - DNA, 22 bp, Homo sapiens
tcaggaggctcaagacctggca

SEQ ID NO: 7184111 - DNA, 22 bp, Homo sapiens
tcaggaggctcaagacctggca

SEQ ID NO: 7184112 - DNA, 22 bp, Homo sapiens
tcaggaggctcaagacctggca

SEQ ID NO: 7184113 - DNA, 22 bp, Homo sapiens
tcaggaggcggaggttgcagtg

SEQ ID NO: 7184114 - DNA, 22 bp, Homo sapiens
tcaggaggcggaggttgcagtg

SEQ ID NO: 7184115 - DNA, 22 bp, Homo sapiens
tcaggaggcggaggttgcagtg

SEQ ID NO: 7184116 - DNA, 22 bp, Homo sapiens
tcaggaggccgtgtgctcagtg

SEQ ID NO: 7184117 - DNA, 22 bp, Homo sapiens
tcaggaggccgtgtgctcagtg

SEQ ID NO: 7184118 - DNA, 22 bp, Homo sapiens
tcaggaggcctgagtagctcta

SEQ ID NO: 7184119 - DNA, 22 bp, Homo sapiens
tcaggaggcctgagtagctcta

SEQ ID NO: 7184120 - DNA, 22 bp, Homo sapiens
tcaggaggccaccaggacctgt

SEQ ID NO: 7184121 - DNA, 22 bp, Homo sapiens
tcaggaggccggcaggatttga

SEQ ID NO: 7184122 - DNA, 22 bp, Homo sapiens
tcaggaggccggcaggatttga

SEQ ID NO: 7184123 - DNA, 22 bp, Homo sapiens
tcaggaggccgtgtgctcagtg

SEQ ID NO: 7184124 - DNA, 22 bp, Homo sapiens
tcaggaatgaggataaacattg

SEQ ID NO: 7184125 - DNA, 22 bp, Homo sapiens
tcaggaatgaggataaacattg

SEQ ID NO: 7184126 - DNA, 22 bp, Homo sapiens
tcaggaatgaggataaacattg

SEQ ID NO: 7184127 - DNA, 22 bp, Homo sapiens
tcaggaggccaccaggacctgt

SEQ ID NO: 7184128 - DNA, 22 bp, Homo sapiens
tcaggaggccaccaggacctgt

SEQ ID NO: 7184129 - DNA, 22 bp, Homo sapiens
tcaggaggccaccaggacctgt

SEQ ID NO: 7184130 - DNA, 22 bp, Homo sapiens
tcacttcacacccactatcatg

SEQ ID NO: 7184131 - DNA, 22 bp, Homo sapiens
tcacttattgctcatctcatgc

SEQ ID NO: 7184132 - DNA, 22 bp, Homo sapiens
tcacttattttctaaccaaagg

SEQ ID NO: 7184133 - DNA, 22 bp, Homo sapiens
tcacttcccagacggggtggca

SEQ ID NO: 7184134 - DNA, 22 bp, Homo sapiens
tcacttcccagacggggtggca

SEQ ID NO: 7184135 - DNA, 22 bp, Homo sapiens
tcacttattgctcatctcatgc

SEQ ID NO: 7184136 - DNA, 22 bp, Homo sapiens
tcacttattgctcatctcatgc

SEQ ID NO: 7184137 - DNA, 22 bp, Homo sapiens
tcacttattaactcataccatt

SEQ ID NO: 7184138 - DNA, 20 bp, Homo sapiens
tcacttattctcaacttgtg

SEQ ID NO: 7184139 - DNA, 22 bp, Homo sapiens
tcacttatatttcaggagatat

SEQ ID NO: 7184140 - DNA, 22 bp, Homo sapiens
tcacttatgccagctctggaag

SEQ ID NO: 7184141 - DNA, 22 bp, Homo sapiens
tcacttatgtgtaggcagctta

SEQ ID NO: 7184142 - DNA, 22 bp, Homo sapiens
tcacttatgtgtgattgatgcc

SEQ ID NO: 7184143 - DNA, 22 bp, Homo sapiens
tcacttatgtgtgattgatgcc

SEQ ID NO: 7184144 - DNA, 21 bp, Homo sapiens
tcacttataatgtatttgctg

SEQ ID NO: 7184145 - DNA, 21 bp, Homo sapiens
tcacttataatgtatttgctg

SEQ ID NO: 7184146 - DNA, 22 bp, Homo sapiens
tcacttataaaatgcaagatct

SEQ ID NO: 7184147 - DNA, 22 bp, Homo sapiens
tcacttataaaatgcaagatct

SEQ ID NO: 7184148 - DNA, 22 bp, Homo sapiens
tcacttagatggggatcatcac

SEQ ID NO: 7184149 - DNA, 22 bp, Homo sapiens
tcacttaggtgcaaagggaact

SEQ ID NO: 7184150 - DNA, 22 bp, Homo sapiens
tcactgtttcctgtactggaca

SEQ ID NO: 7184151 - DNA, 22 bp, Homo sapiens
tcactgtttcctgtactggaca

SEQ ID NO: 7184152 - DNA, 22 bp, Homo sapiens
tcactgtttgcagtgaagagaa

SEQ ID NO: 7184153 - DNA, 22 bp, Homo sapiens
tcactgttttgcctgcacttcc

SEQ ID NO: 7184154 - DNA, 22 bp, Homo sapiens
tcacttagatggggatcatcac

SEQ ID NO: 7184155 - DNA, 22 bp, Homo sapiens
tcacttagatggggatcatcac

SEQ ID NO: 7184156 - DNA, 22 bp, Homo sapiens
tcacttagatggggatcatcac

SEQ ID NO: 7184157 - DNA, 22 bp, Homo sapiens
cagtgtctcaaaacaagttgct

SEQ ID NO: 7184158 - DNA, 22 bp, Homo sapiens
cagtgtctcaaaacaagttgct

SEQ ID NO: 7184159 - DNA, 22 bp, Homo sapiens
cagtgtctacagtggctggagg

SEQ ID NO: 7184160 - DNA, 22 bp, Homo sapiens
cagtgtcctcagccagcagcta

SEQ ID NO: 7184161 - DNA, 22 bp, Homo sapiens
cagtgtctacagtggctggagg

SEQ ID NO: 7184162 - DNA, 22 bp, Homo sapiens
cagtggtttccaaacttgttcc

SEQ ID NO: 7184163 - DNA, 22 bp, Homo sapiens
cagtggtttctgaacagtgtgc

SEQ ID NO: 7184164 - DNA, 22 bp, Homo sapiens
cagtggtttctgaacagtgtgc

SEQ ID NO: 7184165 - DNA, 22 bp, Homo sapiens
cagtggttttatatctaagctt

SEQ ID NO: 7184166 - DNA, 22 bp, Homo sapiens
cagtggttttatatctaagctt

SEQ ID NO: 7184167 - DNA, 22 bp, Homo sapiens
cagtggttttgagattcagggt

SEQ ID NO: 7184168 - DNA, 22 bp, Homo sapiens
cagtgtaagaattcaaagccta

SEQ ID NO: 7184169 - DNA, 22 bp, Homo sapiens
cagtggttttgagattcagggt

SEQ ID NO: 7184170 - DNA, 22 bp, Homo sapiens
cagtgtaagctctagactagaa

SEQ ID NO: 7184171 - DNA, 22 bp, Homo sapiens
cagtgtataaactttaacatag

SEQ ID NO: 7184172 - DNA, 22 bp, Homo sapiens
tcaggctgcctatcagactgtg

SEQ ID NO: 7184173 - DNA, 18 bp, Homo sapiens
tcaggctgccctgtgtct

SEQ ID NO: 7184174 - DNA, 18 bp, Homo sapiens
tcaggctgccctgtgtct

SEQ ID NO: 7184175 - DNA, 22 bp, Homo sapiens
tcaggctgcctatcagactgtg

SEQ ID NO: 7184176 - DNA, 22 bp, Homo sapiens
tcaggctgcctatcagactgtg

SEQ ID NO: 7184177 - DNA, 21 bp, Homo sapiens
catcacattactcaaagtcct

SEQ ID NO: 7184178 - DNA, 22 bp, Homo sapiens
catcacattagtctcaagagaa

SEQ ID NO: 7184179 - DNA, 22 bp, Homo sapiens
catcacattagtctcaagagaa

SEQ ID NO: 7184180 - DNA, 22 bp, Homo sapiens
tcaggctgcccgttcagggctc

SEQ ID NO: 7184181 - DNA, 22 bp, Homo sapiens
tcaggctgcccgttcagggctc

SEQ ID NO: 7184182 - DNA, 22 bp, Homo sapiens
tcaggctgcatctgtaagggtg

SEQ ID NO: 7184183 - DNA, 22 bp, Homo sapiens
tcaggctgcatctgtaagggtg

SEQ ID NO: 7184184 - DNA, 22 bp, Homo sapiens
tcaggctgcatctgtaagggtg

SEQ ID NO: 7184185 - DNA, 22 bp, Homo sapiens
tcaggctgcagctgtcagcagc

SEQ ID NO: 7184186 - DNA, 22 bp, Homo sapiens
tcaggctgcagctgtcagcagc

SEQ ID NO: 7184187 - DNA, 22 bp, Homo sapiens
tcaggctgcagctgtcagcagc

SEQ ID NO: 7184188 - DNA, 22 bp, Homo sapiens
tcaggctgcagctgtcagcagc

SEQ ID NO: 7184189 - DNA, 22 bp, Homo sapiens
tcaggctgcagtggcaaaagac

SEQ ID NO: 7184190 - DNA, 22 bp, Homo sapiens
tcaggctgatttcttttgaggg

SEQ ID NO: 7184191 - DNA, 22 bp, Homo sapiens
catcaattggccaaggagcagt

SEQ ID NO: 7184192 - DNA, 22 bp, Homo sapiens
catcacaaaatgattattccct

SEQ ID NO: 7184193 - DNA, 20 bp, Homo sapiens
catcaacaccttgtcagcct

SEQ ID NO: 7184194 - DNA, 22 bp, Homo sapiens
catcaagagtcttactatcagt

SEQ ID NO: 7184195 - DNA, 21 bp, Homo sapiens
catcaactcttgtgctcacac

SEQ ID NO: 7184196 - DNA, 22 bp, Homo sapiens
catcaagatggaagagcaaata

SEQ ID NO: 7184197 - DNA, 22 bp, Homo sapiens
catcaatagggtttgaaagcaa

SEQ ID NO: 7184198 - DNA, 22 bp, Homo sapiens
catcaatgtgcagagatgaacg

SEQ ID NO: 7184199 - DNA, 22 bp, Homo sapiens
catcaatgtgcagagatgaacg

SEQ ID NO: 7184200 - DNA, 22 bp, Homo sapiens
catatgtatttctcataattag

SEQ ID NO: 7184201 - DNA, 22 bp, Homo sapiens
tcaggcagagtggaagctgcaa

SEQ ID NO: 7184202 - DNA, 22 bp, Homo sapiens
tcaggcagagggagaagccaag

SEQ ID NO: 7184203 - DNA, 22 bp, Homo sapiens
tcaggcagagggagaagccaag

SEQ ID NO: 7184204 - DNA, 22 bp, Homo sapiens
tcaggcagagggagaagccaag

SEQ ID NO: 7184205 - DNA, 22 bp, Homo sapiens
tcaggcagagggagaagccaag

SEQ ID NO: 7184206 - DNA, 22 bp, Homo sapiens
tcaggcagaggatggggagcgt

SEQ ID NO: 7184207 - DNA, 22 bp, Homo sapiens
tcaggcagagggagaagccaag

SEQ ID NO: 7184208 - DNA, 22 bp, Homo sapiens
tcaggcagagggagaagccaag

SEQ ID NO: 7184209 - DNA, 22 bp, Homo sapiens
tcaggcagaggatggggagcgt

SEQ ID NO: 7184210 - DNA, 22 bp, Homo sapiens
tcaggcagaggatggggagcgt

SEQ ID NO: 7184211 - DNA, 22 bp, Homo sapiens
tcaggcagagctgtggagctct

SEQ ID NO: 7184212 - DNA, 22 bp, Homo sapiens
tcaggcagagctgtggagctct

SEQ ID NO: 7184213 - DNA, 22 bp, Homo sapiens
tcaggcagaattatcaaaagat

SEQ ID NO: 7184214 - DNA, 22 bp, Homo sapiens
tcaggcagaccaccgtgggcag

SEQ ID NO: 7184215 - DNA, 22 bp, Homo sapiens
tcaggcagaccaccgtgggcag

SEQ ID NO: 7184216 - DNA, 22 bp, Homo sapiens
tcaggcagaccaccgtgggcag

SEQ ID NO: 7184217 - DNA, 22 bp, Homo sapiens
catcaaatggcaagtgaaagct

SEQ ID NO: 7184218 - DNA, 22 bp, Homo sapiens
catcaaatggcaagtgaaagct

SEQ ID NO: 7184219 - DNA, 22 bp, Homo sapiens
catcaaattatgtgtcaaagca

SEQ ID NO: 7184220 - DNA, 22 bp, Homo sapiens
catcaaatctgacttttcttcc

SEQ ID NO: 7184221 - DNA, 22 bp, Homo sapiens
catcaaataggaatatttggca

SEQ ID NO: 7184222 - DNA, 22 bp, Homo sapiens
catcaaatctgacttttcttcc

SEQ ID NO: 7184223 - DNA, 22 bp, Homo sapiens
catcaaataaagaaattccttg

SEQ ID NO: 7184224 - DNA, 22 bp, Homo sapiens
catcaaaattagacattgttga

SEQ ID NO: 7184225 - DNA, 22 bp, Homo sapiens
catcaaaattagacattgttga

SEQ ID NO: 7184226 - DNA, 22 bp, Homo sapiens
catcaaagttgatatccaatta

SEQ ID NO: 7184227 - DNA, 21 bp, Homo sapiens
catattaaatcggtgccttta

SEQ ID NO: 7184228 - DNA, 22 bp, Homo sapiens
catcaaaattagacattgttga

SEQ ID NO: 7184229 - DNA, 22 bp, Homo sapiens
catcaaaattagacattgttga

SEQ ID NO: 7184230 - DNA, 22 bp, Homo sapiens
catcaaaattagacattgttga

SEQ ID NO: 7184231 - DNA, 22 bp, Homo sapiens
catcatcaaaagtgacagagaa

SEQ ID NO: 7184232 - DNA, 22 bp, Homo sapiens
catcatcaaaacaaatggagtc

SEQ ID NO: 7184233 - DNA, 22 bp, Homo sapiens
catcatcaaaagtgacagagaa

SEQ ID NO: 7184234 - DNA, 22 bp, Homo sapiens
catcatatatttctacaagtgc

SEQ ID NO: 7184235 - DNA, 22 bp, Homo sapiens
catcatatatttctacaagtgc

SEQ ID NO: 7184236 - DNA, 22 bp, Homo sapiens
catcatatggaatttaaagtca

SEQ ID NO: 7184237 - DNA, 22 bp, Homo sapiens
catcatatggaatttaaagtca

SEQ ID NO: 7184238 - DNA, 22 bp, Homo sapiens
catcataaaattgagataactg

SEQ ID NO: 7184239 - DNA, 22 bp, Homo sapiens
catcataaaattgagataactg

SEQ ID NO: 7184240 - DNA, 22 bp, Homo sapiens
catcataataacccagacacag

SEQ ID NO: 7184241 - DNA, 22 bp, Homo sapiens
catcataataacccagacacag

SEQ ID NO: 7184242 - DNA, 22 bp, Homo sapiens
catcatatatttctacaagtgc

SEQ ID NO: 7184243 - DNA, 22 bp, Homo sapiens
tcagtgtcttgacctgggtgtg

SEQ ID NO: 7184244 - DNA, 22 bp, Homo sapiens
tcagtgtgaattcaggagccta

SEQ ID NO: 7184245 - DNA, 22 bp, Homo sapiens
tcagtgtgactgatggctttat

SEQ ID NO: 7184246 - DNA, 22 bp, Homo sapiens
tcagtgtgattaggctatctga

SEQ ID NO: 7184247 - DNA, 22 bp, Homo sapiens
tcagtgtgattaggctatctga

SEQ ID NO: 7184248 - DNA, 22 bp, Homo sapiens
tcagtgtgcacatggtagcagt

SEQ ID NO: 7184249 - DNA, 22 bp, Homo sapiens
tcagtgtgcacatggtagcagt

SEQ ID NO: 7184250 - DNA, 22 bp, Homo sapiens
tcagtgtggaaaatcctttggc

SEQ ID NO: 7184251 - DNA, 20 bp, Homo sapiens
tcagtgtggcggggacctca

SEQ ID NO: 7184252 - DNA, 22 bp, Homo sapiens
tcagtgtgggtaagcatgctgt

SEQ ID NO: 7184253 - DNA, 22 bp, Homo sapiens
tcagtgtgtacactgagcattt

SEQ ID NO: 7184254 - DNA, 22 bp, Homo sapiens
catcaggagaccaggtcctgct

SEQ ID NO: 7184255 - DNA, 22 bp, Homo sapiens
catcaggaggagatgaagaaaa

SEQ ID NO: 7184256 - DNA, 22 bp, Homo sapiens
catcaggataagttccaggtgg

SEQ ID NO: 7184257 - DNA, 22 bp, Homo sapiens
catcagtcagtcaacgcagttt

SEQ ID NO: 7184258 - DNA, 22 bp, Homo sapiens
catcagtcagtctcttcagtat

SEQ ID NO: 7184259 - DNA, 22 bp, Homo sapiens
catcagctttggcgctgagcat

SEQ ID NO: 7184260 - DNA, 22 bp, Homo sapiens
catcagctttggcgctgagcat

SEQ ID NO: 7184261 - DNA, 22 bp, Homo sapiens
catcagcttttctatgtggtga

SEQ ID NO: 7184262 - DNA, 22 bp, Homo sapiens
catcaggaaaggacgtctagcc

SEQ ID NO: 7184263 - DNA, 22 bp, Homo sapiens
catcaggaataaatgaggctgt

SEQ ID NO: 7184264 - DNA, 22 bp, Homo sapiens
catcaggacagcttcttttcac

SEQ ID NO: 7184265 - DNA, 20 bp, Homo sapiens
catcaggaccctcagttttt

SEQ ID NO: 7184266 - DNA, 22 bp, Homo sapiens
catcagagtggtggcctggtgt

SEQ ID NO: 7184267 - DNA, 22 bp, Homo sapiens
catcagcactatgattaaagta

SEQ ID NO: 7184268 - DNA, 22 bp, Homo sapiens
catcagcagtcacatgatgctg

SEQ ID NO: 7184269 - DNA, 22 bp, Homo sapiens
catcagctaaacttagtgaaat

SEQ ID NO: 7184270 - DNA, 22 bp, Homo sapiens
catcagctgagggtgagcagaa

SEQ ID NO: 7184271 - DNA, 22 bp, Homo sapiens
catcagctgagggtgagcagaa

SEQ ID NO: 7184272 - DNA, 22 bp, Homo sapiens
catcagctgagggtgagcagaa

SEQ ID NO: 7184273 - DNA, 20 bp, Homo sapiens
catcagtgcctgacaggtcc

SEQ ID NO: 7184274 - DNA, 22 bp, Homo sapiens
catcagtgcccttggggatgcc

SEQ ID NO: 7184275 - DNA, 20 bp, Homo sapiens
catcagtgcctgacaggtcc

SEQ ID NO: 7184276 - DNA, 22 bp, Homo sapiens
catcagtgagccccttgatgag

SEQ ID NO: 7184277 - DNA, 22 bp, Homo sapiens
catcagtcccacggagcagccc

SEQ ID NO: 7184278 - DNA, 22 bp, Homo sapiens
catcagtctagattctagtacc

SEQ ID NO: 7184279 - DNA, 22 bp, Homo sapiens
catcagtctgaaagccagggag

SEQ ID NO: 7184280 - DNA, 22 bp, Homo sapiens
catcagtctgtgaagagggcta

SEQ ID NO: 7184281 - DNA, 22 bp, Homo sapiens
catcagtgaaagtgaatgttct

SEQ ID NO: 7184282 - DNA, 22 bp, Homo sapiens
catcagtgtctctctggtactt

SEQ ID NO: 7184283 - DNA, 22 bp, Homo sapiens
catcagtgtggcagttcactgt

SEQ ID NO: 7184284 - DNA, 22 bp, Homo sapiens
catcagtggtaactgaatggtt

SEQ ID NO: 7184285 - DNA, 22 bp, Homo sapiens
catcagtgtctctctggtactt

SEQ ID NO: 7184286 - DNA, 22 bp, Homo sapiens
catcagtgtgttgccttgctca

SEQ ID NO: 7184287 - DNA, 22 bp, Homo sapiens
catcagtgttcactattccttc

SEQ ID NO: 7184288 - DNA, 22 bp, Homo sapiens
catcagtgttcactattccttc

SEQ ID NO: 7184289 - DNA, 20 bp, Homo sapiens
tcatcagataggttagtaca

SEQ ID NO: 7184290 - DNA, 22 bp, Homo sapiens
tcatcagctcatctgctcctag

SEQ ID NO: 7184291 - DNA, 22 bp, Homo sapiens
tcatcactgtatcattgataga

SEQ ID NO: 7184292 - DNA, 19 bp, Homo sapiens
tcatcacttcagaggaaaa

SEQ ID NO: 7184293 - DNA, 22 bp, Homo sapiens
tcatcagactgactgtggttct

SEQ ID NO: 7184294 - DNA, 22 bp, Homo sapiens
tcatcacatgtgtagtcatccc

SEQ ID NO: 7184295 - DNA, 22 bp, Homo sapiens
tcatcacatgtgtagtcatccc

SEQ ID NO: 7184296 - DNA, 22 bp, Homo sapiens
tcatcacatgtgtagtcatccc

SEQ ID NO: 7184297 - DNA, 22 bp, Homo sapiens
tcatcacatgtgtagtcatccc

SEQ ID NO: 7184298 - DNA, 22 bp, Homo sapiens
tcatcacatgtgtagtcatccc

SEQ ID NO: 7184299 - DNA, 22 bp, Homo sapiens
tcatcactcattggacaacaga

SEQ ID NO: 7184300 - DNA, 22 bp, Homo sapiens
tcatcactcattggacaacaga

SEQ ID NO: 7184301 - DNA, 22 bp, Homo sapiens
tcatcaaagtcaaagaatgact

SEQ ID NO: 7184302 - DNA, 22 bp, Homo sapiens
tcatacataacttgtacagtga

SEQ ID NO: 7184303 - DNA, 22 bp, Homo sapiens
tcatcaaagtcaaagaatgact

SEQ ID NO: 7184304 - DNA, 22 bp, Homo sapiens
tcatcaaagtcaaagaatgact

SEQ ID NO: 7184305 - DNA, 22 bp, Homo sapiens
tcatacataaataagagtttag

SEQ ID NO: 7184306 - DNA, 22 bp, Homo sapiens
tcatacataaataagagtttag

SEQ ID NO: 7184307 - DNA, 22 bp, Homo sapiens
tcatacataaataagagtttag

SEQ ID NO: 7184308 - DNA, 22 bp, Homo sapiens
tcatacataaataagagtttag

SEQ ID NO: 7184309 - DNA, 22 bp, Homo sapiens
tcatcacaattttatgaccctc

SEQ ID NO: 7184310 - DNA, 22 bp, Homo sapiens
tcatcacatatgtcatgatttg

SEQ ID NO: 7184311 - DNA, 22 bp, Homo sapiens
tcatcacatatgtcatgatttg

SEQ ID NO: 7184312 - DNA, 22 bp, Homo sapiens
tcatcacatatgtcatgatttg

SEQ ID NO: 7184313 - DNA, 22 bp, Homo sapiens
tcataattgtatacatttatgg

SEQ ID NO: 7184314 - DNA, 22 bp, Homo sapiens
tcataattgtatacatttatgg

SEQ ID NO: 7184315 - DNA, 22 bp, Homo sapiens
tcataattgtatacatttatgg

SEQ ID NO: 7184316 - DNA, 22 bp, Homo sapiens
tcatacaactaagagtttcaga

SEQ ID NO: 7184317 - DNA, 22 bp, Homo sapiens
tcataagtggtttatatgcttg

SEQ ID NO: 7184318 - DNA, 22 bp, Homo sapiens
tcataatacaaagagttctgca

SEQ ID NO: 7184319 - DNA, 22 bp, Homo sapiens
tcataatgacaaacatactcag

SEQ ID NO: 7184320 - DNA, 22 bp, Homo sapiens
tcataatgaccccagagtccgc

SEQ ID NO: 7184321 - DNA, 22 bp, Homo sapiens
tcataatgtagttcatggctgg

SEQ ID NO: 7184322 - DNA, 22 bp, Homo sapiens
tcatacaaggagggtgttcaaa

SEQ ID NO: 7184323 - DNA, 20 bp, Homo sapiens
tcatacacatgagcatgcag

SEQ ID NO: 7184324 - DNA, 22 bp, Homo sapiens
tcatacacattcttattacttt

SEQ ID NO: 7184325 - DNA, 22 bp, Homo sapiens
tcatacaggctcaagctatacg

SEQ ID NO: 7184326 - DNA, 22 bp, Homo sapiens
catcctgtgatgtctttggctg

SEQ ID NO: 7184327 - DNA, 22 bp, Homo sapiens
catccttcaaaggctacaatta

SEQ ID NO: 7184328 - DNA, 22 bp, Homo sapiens
catcctgacccatgggagggga

SEQ ID NO: 7184329 - DNA, 22 bp, Homo sapiens
catcctgactgggtaaagctta

SEQ ID NO: 7184330 - DNA, 22 bp, Homo sapiens
catcctgactgtaactaagaga

SEQ ID NO: 7184331 - DNA, 22 bp, Homo sapiens
catcctgactgtaactaagaga

SEQ ID NO: 7184332 - DNA, 22 bp, Homo sapiens
catcctgagaaaataaaggaga

SEQ ID NO: 7184333 - DNA, 22 bp, Homo sapiens
catcctgacaagaaagccagaa

SEQ ID NO: 7184334 - DNA, 22 bp, Homo sapiens
catccctgtctgccactctgaa

SEQ ID NO: 7184335 - DNA, 19 bp, Homo sapiens
tcagtgtgtgggaggtggt

SEQ ID NO: 7184336 - DNA, 22 bp, Homo sapiens
tcagtttcctggttgtgatatt

SEQ ID NO: 7184337 - DNA, 22 bp, Homo sapiens
tcataacaacctggaaggccag

SEQ ID NO: 7184338 - DNA, 22 bp, Homo sapiens
tcataacagctaagtccctttc

SEQ ID NO: 7184339 - DNA, 22 bp, Homo sapiens
tcataacaggctgagaggattt

SEQ ID NO: 7184340 - DNA, 22 bp, Homo sapiens
tcataacaggctgagaggattt

SEQ ID NO: 7184341 - DNA, 19 bp, Homo sapiens
tcataaggagagaggaaat

SEQ ID NO: 7184342 - DNA, 22 bp, Homo sapiens
catctaatacctcatttaatct

SEQ ID NO: 7184343 - DNA, 18 bp, Homo sapiens
catctacaaatgccagaa

SEQ ID NO: 7184344 - DNA, 22 bp, Homo sapiens
catctacaggagaatgtcactg

SEQ ID NO: 7184345 - DNA, 22 bp, Homo sapiens
catctacatgcttgccactgct

SEQ ID NO: 7184346 - DNA, 22 bp, Homo sapiens
catctagaaaaaagacctgttg

SEQ ID NO: 7184347 - DNA, 23 bp, Homo sapiens
catctagcatccagtgagtagtg

SEQ ID NO: 7184348 - DNA, 23 bp, Homo sapiens
catctagcatccagtgagtagtg

SEQ ID NO: 7184349 - DNA, 23 bp, Homo sapiens
catctagcatccagtgagtagtg

SEQ ID NO: 7184350 - DNA, 22 bp, Homo sapiens
ttcatagaaagtgcttagattg

SEQ ID NO: 7184351 - DNA, 22 bp, Homo sapiens
ttcatactgtttaagttctgtt

SEQ ID NO: 7184352 - DNA, 22 bp, Homo sapiens
ttcatagaaagtgcttagattg

SEQ ID NO: 7184353 - DNA, 22 bp, Homo sapiens
ttcatactcactccaataactg

SEQ ID NO: 7184354 - DNA, 22 bp, Homo sapiens
ttcatactcactccaataactg

SEQ ID NO: 7184355 - DNA, 22 bp, Homo sapiens
ttcatactgtgtttccaagttt

SEQ ID NO: 7184356 - DNA, 22 bp, Homo sapiens
ttcatacacgaaaatgcatgca

SEQ ID NO: 7184357 - DNA, 22 bp, Homo sapiens
ttcagacatgcaggctgaggct

SEQ ID NO: 7184358 - DNA, 22 bp, Homo sapiens
ttcatacatttttactaacagc

SEQ ID NO: 7184359 - DNA, 22 bp, Homo sapiens
ttcagaatctatgtgccagctc

SEQ ID NO: 7184360 - DNA, 22 bp, Homo sapiens
ttcagaatgacttatgtaaggc

SEQ ID NO: 7184361 - DNA, 22 bp, Homo sapiens
ttcagaatgattacattctggt

SEQ ID NO: 7184362 - DNA, 22 bp, Homo sapiens
ttcagacaataagagtcatctc

SEQ ID NO: 7184363 - DNA, 22 bp, Homo sapiens
ttcagacacagcgctgggaaat

SEQ ID NO: 7184364 - DNA, 22 bp, Homo sapiens
ttcagacaggcagctgggctgg

SEQ ID NO: 7184365 - DNA, 22 bp, Homo sapiens
ttcagacagtaagaaagaggtt

SEQ ID NO: 7184366 - DNA, 22 bp, Homo sapiens
ttcagacagttttcagattcat

SEQ ID NO: 7184367 - DNA, 22 bp, Homo sapiens
ttcagacagttttcagattcat

SEQ ID NO: 7184368 - DNA, 22 bp, Homo sapiens
ttcatattcaaatactctgctt

SEQ ID NO: 7184369 - DNA, 22 bp, Homo sapiens
ttcatattcaaatactctgctt

SEQ ID NO: 7184370 - DNA, 22 bp, Homo sapiens
ttcatattatgatttgaaatgc

SEQ ID NO: 7184371 - DNA, 22 bp, Homo sapiens
ttcatattatgatttgaaatgc

SEQ ID NO: 7184372 - DNA, 22 bp, Homo sapiens
ttcatatatatgcactacgtac

SEQ ID NO: 7184373 - DNA, 22 bp, Homo sapiens
ttcatcaatgtgtttaataatg

SEQ ID NO: 7184374 - DNA, 22 bp, Homo sapiens
ttcatcaatgtgtttaataatg

SEQ ID NO: 7184375 - DNA, 22 bp, Homo sapiens
ttcatcaccttggtagcactcc

SEQ ID NO: 7184376 - DNA, 21 bp, Homo sapiens
ttcatcagccagaaatcaagc

SEQ ID NO: 7184377 - DNA, 22 bp, Homo sapiens
ttcatatttgaaacagaagtta

SEQ ID NO: 7184378 - DNA, 22 bp, Homo sapiens
ttcatatttgaaacagaagtta

SEQ ID NO: 7184379 - DNA, 22 bp, Homo sapiens
ttcatattttctgcttgctcac

SEQ ID NO: 7184380 - DNA, 22 bp, Homo sapiens
ttcatattttctgcttgctcac

SEQ ID NO: 7184381 - DNA, 22 bp, Homo sapiens
ttcatattcaaatactctgctt

SEQ ID NO: 7184382 - DNA, 22 bp, Homo sapiens
ttcatattgcttccgtggagtg

SEQ ID NO: 7184383 - DNA, 22 bp, Homo sapiens
ttcatatttctttaaggacttt

SEQ ID NO: 7184384 - DNA, 22 bp, Homo sapiens
ttcatagtgacatgcattctgg

SEQ ID NO: 7184385 - DNA, 22 bp, Homo sapiens
ttcatagtgattgttcagatag

SEQ ID NO: 7184386 - DNA, 22 bp, Homo sapiens
ttcatagtgcttaatttgataa

SEQ ID NO: 7184387 - DNA, 22 bp, Homo sapiens
ttcatagtgcttaatttgataa

SEQ ID NO: 7184388 - DNA, 22 bp, Homo sapiens
ttcatagtgtttccttccagtg

SEQ ID NO: 7184389 - DNA, 22 bp, Homo sapiens
ttcatagtgtttccttccagtg

SEQ ID NO: 7184390 - DNA, 22 bp, Homo sapiens
ttcatagtgtttccttccagtg

SEQ ID NO: 7184391 - DNA, 22 bp, Homo sapiens
ttcatataaatggaatcagaat

SEQ ID NO: 7184392 - DNA, 22 bp, Homo sapiens
ttcatataaatggaatcagaat

SEQ ID NO: 7184393 - DNA, 22 bp, Homo sapiens
ttcatataaatggaatcagaat

SEQ ID NO: 7184394 - DNA, 21 bp, Homo sapiens
ttcagaagttgagggcaggtt

SEQ ID NO: 7184395 - DNA, 22 bp, Homo sapiens
ttcagaagtagctaagcagtca

SEQ ID NO: 7184396 - DNA, 22 bp, Homo sapiens
ttcagaagtgctttcacactct

SEQ ID NO: 7184397 - DNA, 22 bp, Homo sapiens
ttcagaagttttcaaaactaag

SEQ ID NO: 7184398 - DNA, 22 bp, Homo sapiens
ttcagaagttttcaaaactaag

SEQ ID NO: 7184399 - DNA, 22 bp, Homo sapiens
ttcagaactgtctgtccttttc

SEQ ID NO: 7184400 - DNA, 17 bp, Homo sapiens
ttcagaagcattttggc

SEQ ID NO: 7184401 - DNA, 22 bp, Homo sapiens
ttcagaaggatgacaccagttg

SEQ ID NO: 7184402 - DNA, 22 bp, Homo sapiens
ttcagaaggattttaacacatg

SEQ ID NO: 7184403 - DNA, 22 bp, Homo sapiens
ttcagaaggtgcagcctgggcc

SEQ ID NO: 7184404 - DNA, 22 bp, Homo sapiens
ttcagaaatccctcttctaccc

SEQ ID NO: 7184405 - DNA, 22 bp, Homo sapiens
ttcactgttatgaagctctggg

SEQ ID NO: 7184406 - DNA, 22 bp, Homo sapiens
ttcactgttatgaagctctggg

SEQ ID NO: 7184407 - DNA, 22 bp, Homo sapiens
ttcactgttgagttcctgatat

SEQ ID NO: 7184408 - DNA, 22 bp, Homo sapiens
ttcactgttggctttgcttgtc

SEQ ID NO: 7184409 - DNA, 22 bp, Homo sapiens
ttcactgtgaactcatattcag

SEQ ID NO: 7184410 - DNA, 22 bp, Homo sapiens
ttcactgtgaactcatattcag

SEQ ID NO: 7184411 - DNA, 22 bp, Homo sapiens
ttcactgtgaactcatattcag

SEQ ID NO: 7184412 - DNA, 22 bp, Homo sapiens
ttcactgtgatggtgcagaggc

SEQ ID NO: 7184413 - DNA, 22 bp, Homo sapiens
ttcactgtgatggtgcagaggc

SEQ ID NO: 7184414 - DNA, 22 bp, Homo sapiens
ttcactgtgatgtttaagagaa

SEQ ID NO: 7184415 - DNA, 22 bp, Homo sapiens
ttcagaacaaccatggttagat

SEQ ID NO: 7184416 - DNA, 22 bp, Homo sapiens
ttcagaacaatatgaacagaac

SEQ ID NO: 7184417 - DNA, 22 bp, Homo sapiens
ttcagaaatcgagtttcatgtc

SEQ ID NO: 7184418 - DNA, 22 bp, Homo sapiens
ttcagaaatccctcttctaccc

SEQ ID NO: 7184419 - DNA, 22 bp, Homo sapiens
ttcagaaatccctcttctaccc

SEQ ID NO: 7184420 - DNA, 22 bp, Homo sapiens
ttcagaaatcgagtttcatgtc

SEQ ID NO: 7184421 - DNA, 22 bp, Homo sapiens
ttcagaaatgaatattggtatt

SEQ ID NO: 7184422 - DNA, 17 bp, Homo sapiens
ttcaatgattaatgcat

SEQ ID NO: 7184423 - DNA, 22 bp, Homo sapiens
ttcaatcatttttacatagtcc

SEQ ID NO: 7184424 - DNA, 22 bp, Homo sapiens
ttcaatatgatattagctgtgg

SEQ ID NO: 7184425 - DNA, 22 bp, Homo sapiens
ttcaatcaccatcaggacatta

SEQ ID NO: 7184426 - DNA, 22 bp, Homo sapiens
ttcaatcattagaatctcaggc

SEQ ID NO: 7184427 - DNA, 22 bp, Homo sapiens
ttcaatcattagaatctcaggc

SEQ ID NO: 7184428 - DNA, 22 bp, Homo sapiens
ttcaatcattccaacactttaa

SEQ ID NO: 7184429 - DNA, 22 bp, Homo sapiens
ttcaatcattccaacactttaa

SEQ ID NO: 7184430 - DNA, 22 bp, Homo sapiens
ttcaatcattccaacactttaa

SEQ ID NO: 7184431 - DNA, 22 bp, Homo sapiens
ttcaatatctctaagaatgagg

SEQ ID NO: 7184432 - DNA, 22 bp, Homo sapiens
ttcaatatctctaagaatgagg

SEQ ID NO: 7184433 - DNA, 20 bp, Homo sapiens
ttcaatatgaccctggggag

SEQ ID NO: 7184434 - DNA, 22 bp, Homo sapiens
ttcaatatgatattagctgtgg

SEQ ID NO: 7184435 - DNA, 22 bp, Homo sapiens
ttcaatatctctaagaatgagg

SEQ ID NO: 7184436 - DNA, 22 bp, Homo sapiens
ttcaatatctctaagaatgagg

SEQ ID NO: 7184437 - DNA, 22 bp, Homo sapiens
ttcaagtcctttggaaggcctg

SEQ ID NO: 7184438 - DNA, 22 bp, Homo sapiens
ttcaatatcattgtttagtctc

SEQ ID NO: 7184439 - DNA, 22 bp, Homo sapiens
ttcaatatctctaagaatgagg

SEQ ID NO: 7184440 - DNA, 22 bp, Homo sapiens
ttcaagtcagagcaagccaagt

SEQ ID NO: 7184441 - DNA, 22 bp, Homo sapiens
ttcaagtcaatttttgaatgac

SEQ ID NO: 7184442 - DNA, 22 bp, Homo sapiens
ttcaagtaaatcactttttgtc

SEQ ID NO: 7184443 - DNA, 22 bp, Homo sapiens
ttcaagtacattgtgttttcct

SEQ ID NO: 7184444 - DNA, 22 bp, Homo sapiens
ttcaagtagtcacacatgatat

SEQ ID NO: 7184445 - DNA, 22 bp, Homo sapiens
ttccaagagcctttcttctaga

SEQ ID NO: 7184446 - DNA, 22 bp, Homo sapiens
ttccaagagcctttcttctaga

SEQ ID NO: 7184447 - DNA, 22 bp, Homo sapiens
ttccaagagctgctggggtaag

SEQ ID NO: 7184448 - DNA, 22 bp, Homo sapiens
ttccaagagctttaattgttga

SEQ ID NO: 7184449 - DNA, 22 bp, Homo sapiens
ttccaaggagtgaacttcaaat

SEQ ID NO: 7184450 - DNA, 22 bp, Homo sapiens
ttccaaggagaacactctgtag

SEQ ID NO: 7184451 - DNA, 22 bp, Homo sapiens
ttccaagagtcagctgatccca

SEQ ID NO: 7184452 - DNA, 22 bp, Homo sapiens
ttccaaggcaacagcctaggct

SEQ ID NO: 7184453 - DNA, 22 bp, Homo sapiens
ttccaaggcaacagcctaggct

SEQ ID NO: 7184454 - DNA, 22 bp, Homo sapiens
ttccaaggcaacagcctaggct

SEQ ID NO: 7184455 - DNA, 22 bp, Homo sapiens
ttccaaggcatgttctcaagta

SEQ ID NO: 7184456 - DNA, 22 bp, Homo sapiens
ttccaaggcagttttctctctg

SEQ ID NO: 7184457 - DNA, 22 bp, Homo sapiens
ttccaaggcccagcagagagga

SEQ ID NO: 7184458 - DNA, 22 bp, Homo sapiens
ttccaaggcccagcagagagga

SEQ ID NO: 7184459 - DNA, 22 bp, Homo sapiens
ttccaaggccagacagggcagt

SEQ ID NO: 7184460 - DNA, 22 bp, Homo sapiens
ttccaagaaacaagtgatgcag

SEQ ID NO: 7184461 - DNA, 22 bp, Homo sapiens
ttccaagacacctttagtcact

SEQ ID NO: 7184462 - DNA, 22 bp, Homo sapiens
ttccaactttgaaaatgttatg

SEQ ID NO: 7184463 - DNA, 22 bp, Homo sapiens
ttccaactttgtcatatattat

SEQ ID NO: 7184464 - DNA, 22 bp, Homo sapiens
ttccaacttcccatccctgctg

SEQ ID NO: 7184465 - DNA, 22 bp, Homo sapiens
ttccaactttaaaattcattct

SEQ ID NO: 7184466 - DNA, 22 bp, Homo sapiens
ttcatcaggcatcatgctcaag

SEQ ID NO: 7184467 - DNA, 22 bp, Homo sapiens
ttcatttttaccgcgtgtcaaa

SEQ ID NO: 7184468 - DNA, 22 bp, Homo sapiens
ttccaaaacaatattctgtgaa

SEQ ID NO: 7184469 - DNA, 22 bp, Homo sapiens
ttccaaaacagtatggcatgtg

SEQ ID NO: 7184470 - DNA, 19 bp, Homo sapiens
ttccaaaatcaggatttga

SEQ ID NO: 7184471 - DNA, 19 bp, Homo sapiens
ttccaaaatcaggatttga

SEQ ID NO: 7184472 - DNA, 19 bp, Homo sapiens
ttccaaaatcaggatttga

SEQ ID NO: 7184473 - DNA, 19 bp, Homo sapiens
ttccaaaatcaggatttga

SEQ ID NO: 7184474 - DNA, 22 bp, Homo sapiens
ttccaatgacatttgttttaaa

SEQ ID NO: 7184475 - DNA, 22 bp, Homo sapiens
ttccaatagtgtgaccttatag

SEQ ID NO: 7184476 - DNA, 22 bp, Homo sapiens
ttccaatatttacaatgcatta

SEQ ID NO: 7184477 - DNA, 22 bp, Homo sapiens
ttccataaaggtgatagtatac

SEQ ID NO: 7184478 - DNA, 21 bp, Homo sapiens
ttccagttttaattaaattgt

SEQ ID NO: 7184479 - DNA, 21 bp, Homo sapiens
ttccagttttaattaaattgt

SEQ ID NO: 7184480 - DNA, 22 bp, Homo sapiens
ttccaattgtgagattttttaa

SEQ ID NO: 7184481 - DNA, 22 bp, Homo sapiens
ttccaattgcagatcagataca

SEQ ID NO: 7184482 - DNA, 22 bp, Homo sapiens
ttccaattgtgagattttttaa

SEQ ID NO: 7184483 - DNA, 22 bp, Homo sapiens
ttccatacgactgaggtctcgg

SEQ ID NO: 7184484 - DNA, 22 bp, Homo sapiens
ttccatatgaaaaagctgttgc

SEQ ID NO: 7184485 - DNA, 22 bp, Homo sapiens
ttccatatgaaaaagctgttgc

SEQ ID NO: 7184486 - DNA, 22 bp, Homo sapiens
ttccatatgaaaaagctgttgc

SEQ ID NO: 7184487 - DNA, 22 bp, Homo sapiens
ttccatatgtatatagctgtta

SEQ ID NO: 7184488 - DNA, 22 bp, Homo sapiens
ttccatatgtatatagctgtta

SEQ ID NO: 7184489 - DNA, 22 bp, Homo sapiens
ttccatatgtatatagctgtta

SEQ ID NO: 7184490 - DNA, 22 bp, Homo sapiens
ttccatattagactatgtgggg

SEQ ID NO: 7184491 - DNA, 22 bp, Homo sapiens
ttccataatcaccttattcttt

SEQ ID NO: 7184492 - DNA, 22 bp, Homo sapiens
ttccaaggctgtcctcactttg

SEQ ID NO: 7184493 - DNA, 23 bp, Homo sapiens
ttccaaggggatgtctccaagtg

SEQ ID NO: 7184494 - DNA, 22 bp, Homo sapiens
ttccaagttaggcgagctggtg

SEQ ID NO: 7184495 - DNA, 22 bp, Homo sapiens
ttccaagttaggcgagctggtg

SEQ ID NO: 7184496 - DNA, 22 bp, Homo sapiens
ttccccaggctggagtgcagtg

SEQ ID NO: 7184497 - DNA, 22 bp, Homo sapiens
ttccccaggctggagtgcagtg

SEQ ID NO: 7184498 - DNA, 22 bp, Homo sapiens
ttccccaggcggctttttcagc

SEQ ID NO: 7184499 - DNA, 22 bp, Homo sapiens
ttcccatttgtggtagtgaatt

SEQ ID NO: 7184500 - DNA, 21 bp, Homo sapiens
ttcccatcttttctgagtctg

SEQ ID NO: 7184501 - DNA, 22 bp, Homo sapiens
ttcccagtattaccttcaggaa

SEQ ID NO: 7184502 - DNA, 22 bp, Homo sapiens
ttcccagtattaccttcaggaa

SEQ ID NO: 7184503 - DNA, 22 bp, Homo sapiens
ttcccagtcaaacgaaggactt

SEQ ID NO: 7184504 - DNA, 22 bp, Homo sapiens
ttcccagtcccaagaaaagcca

SEQ ID NO: 7184505 - DNA, 22 bp, Homo sapiens
ttcccagtcccaagaaaagcca

SEQ ID NO: 7184506 - DNA, 22 bp, Homo sapiens
ttcccagtgaggaagcaatgca

SEQ ID NO: 7184507 - DNA, 22 bp, Homo sapiens
ttcccagtgattaaggcagtgg

SEQ ID NO: 7184508 - DNA, 22 bp, Homo sapiens
ttcccagtgattgaacatccct

SEQ ID NO: 7184509 - DNA, 22 bp, Homo sapiens
ttcccagttagtcatttttaca

SEQ ID NO: 7184510 - DNA, 22 bp, Homo sapiens
ttcccatagtgaccgatgctga

SEQ ID NO: 7184511 - DNA, 19 bp, Homo sapiens
ttcccaggaaaggggtgca

SEQ ID NO: 7184512 - DNA, 22 bp, Homo sapiens
ttcccagaggcaaagtctggat

SEQ ID NO: 7184513 - DNA, 22 bp, Homo sapiens
ttcccagattggagggcagggg

SEQ ID NO: 7184514 - DNA, 22 bp, Homo sapiens
ttcccagattggagggcagggg

SEQ ID NO: 7184515 - DNA, 22 bp, Homo sapiens
ttcccagattggagggcagggg

SEQ ID NO: 7184516 - DNA, 21 bp, Homo sapiens
ttcccagcacctagcacaggt

SEQ ID NO: 7184517 - DNA, 21 bp, Homo sapiens
ttcccagcacctagcacaggt

SEQ ID NO: 7184518 - DNA, 22 bp, Homo sapiens
ttcccaggaagcctctccaagc

SEQ ID NO: 7184519 - DNA, 22 bp, Homo sapiens
ttcccaggactctgggtgtctt

SEQ ID NO: 7184520 - DNA, 22 bp, Homo sapiens
ttcccaggctgtgctaccagag

SEQ ID NO: 7184521 - DNA, 22 bp, Homo sapiens
ttcccaggctgtgctaccagag

SEQ ID NO: 7184522 - DNA, 22 bp, Homo sapiens
ttcccaggtaattctgaggcag

SEQ ID NO: 7184523 - DNA, 22 bp, Homo sapiens
ttcccccacctggggtacagga

SEQ ID NO: 7184524 - DNA, 19 bp, Homo sapiens
ttcccctccccagggatag

SEQ ID NO: 7184525 - DNA, 22 bp, Homo sapiens
ttcccctctcagatctggccta

SEQ ID NO: 7184526 - DNA, 22 bp, Homo sapiens
ttccccaggtgattctcatggc

SEQ ID NO: 7184527 - DNA, 22 bp, Homo sapiens
ttccccaggtgattctcatggc

SEQ ID NO: 7184528 - DNA, 22 bp, Homo sapiens
ttccccagtaacatacatgtga

SEQ ID NO: 7184529 - DNA, 22 bp, Homo sapiens
ttccccagtagtgacaatcaaa

SEQ ID NO: 7184530 - DNA, 22 bp, Homo sapiens
ttccccagtaacatacatgtga

SEQ ID NO: 7184531 - DNA, 22 bp, Homo sapiens
ttccccaggggctcctgccttt

SEQ ID NO: 7184532 - DNA, 22 bp, Homo sapiens
ttccccaggtgattctcatggc

SEQ ID NO: 7184533 - DNA, 22 bp, Homo sapiens
ttccccaggtgattctcatggc

SEQ ID NO: 7184534 - DNA, 22 bp, Homo sapiens
ttccccagggaagctcctgcgc

SEQ ID NO: 7184535 - DNA, 22 bp, Homo sapiens
ttccccagggaagctcctgcgc

SEQ ID NO: 7184536 - DNA, 22 bp, Homo sapiens
ttccccaggctggagtgcagtg

SEQ ID NO: 7184537 - DNA, 17 bp, Homo sapiens
ttcccctgaccaagcct

SEQ ID NO: 7184538 - DNA, 22 bp, Homo sapiens
ttccccttgcactatcaccctg

SEQ ID NO: 7184539 - DNA, 22 bp, Homo sapiens
ttccccttgcactatcaccctg

SEQ ID NO: 7184540 - DNA, 22 bp, Homo sapiens
ttccccttgataatgcagtaag

SEQ ID NO: 7184541 - DNA, 22 bp, Homo sapiens
ttcccagaggagatttgcttat

SEQ ID NO: 7184542 - DNA, 22 bp, Homo sapiens
ttcccagaggagatttgcttat

SEQ ID NO: 7184543 - DNA, 22 bp, Homo sapiens
ttcccagaggcaaagtctggat

SEQ ID NO: 7184544 - DNA, 19 bp, Homo sapiens
ttcccagagccatgagtga

SEQ ID NO: 7184545 - DNA, 19 bp, Homo sapiens
ttcccagagccatgagtga

SEQ ID NO: 7184546 - DNA, 19 bp, Homo sapiens
ttcccagagccatgagtga

SEQ ID NO: 7184547 - DNA, 19 bp, Homo sapiens
ttcccagagccatgagtga

SEQ ID NO: 7184548 - DNA, 22 bp, Homo sapiens
ttcccagagataagacgtctta

SEQ ID NO: 7184549 - DNA, 22 bp, Homo sapiens
ttcccagagataagacgtctta

SEQ ID NO: 7184550 - DNA, 22 bp, Homo sapiens
ttcccagagaaggatgaaaaag

SEQ ID NO: 7184551 - DNA, 22 bp, Homo sapiens
ttcccagagaaggatgaaaaag

SEQ ID NO: 7184552 - DNA, 22 bp, Homo sapiens
ttcccagagaaggatgaaaaag

SEQ ID NO: 7184553 - DNA, 22 bp, Homo sapiens
ttcccagactccacactgaggc

SEQ ID NO: 7184554 - DNA, 22 bp, Homo sapiens
ttcccagactccacactgaggc

SEQ ID NO: 7184555 - DNA, 22 bp, Homo sapiens
ttcccagactccacactgaggc

SEQ ID NO: 7184556 - DNA, 22 bp, Homo sapiens
ttcccagactccacactgaggc

SEQ ID NO: 7184557 - DNA, 22 bp, Homo sapiens
ttcccagactccacactgaggc

SEQ ID NO: 7184558 - DNA, 22 bp, Homo sapiens
ttcccagacctgtaggatcaga

SEQ ID NO: 7184559 - DNA, 22 bp, Homo sapiens
ttcccagacctgtaggatcaga

SEQ ID NO: 7184560 - DNA, 22 bp, Homo sapiens
ttcccagacctgtaggatcaga

SEQ ID NO: 7184561 - DNA, 22 bp, Homo sapiens
ttcccagaatgaatggatggag

SEQ ID NO: 7184562 - DNA, 22 bp, Homo sapiens
ttcccagaatgaatggatggag

SEQ ID NO: 7184563 - DNA, 22 bp, Homo sapiens
ttcccagaattgttgggaactg

SEQ ID NO: 7184564 - DNA, 22 bp, Homo sapiens
ttcccagaattgttgggaactg

SEQ ID NO: 7184565 - DNA, 22 bp, Homo sapiens
ttcccagaattgttgggaactg

SEQ ID NO: 7184566 - DNA, 22 bp, Homo sapiens
ttcccagaattgttgggaactg

SEQ ID NO: 7184567 - DNA, 22 bp, Homo sapiens
ttccatgtgagtacactgtgat

SEQ ID NO: 7184568 - DNA, 21 bp, Homo sapiens
ttccattatctctcagccatc

SEQ ID NO: 7184569 - DNA, 22 bp, Homo sapiens
ttccattgagtacctggagaca

SEQ ID NO: 7184570 - DNA, 22 bp, Homo sapiens
ttccattggtaaaatgagagtg

SEQ ID NO: 7184571 - DNA, 22 bp, Homo sapiens
ttccatttattcttgtccagat

SEQ ID NO: 7184572 - DNA, 22 bp, Homo sapiens
ttccatattgtactctttggag

SEQ ID NO: 7184573 - DNA, 22 bp, Homo sapiens
ttccatattcccaattttgcca

SEQ ID NO: 7184574 - DNA, 22 bp, Homo sapiens
ttccatcacatcactgaagaca

SEQ ID NO: 7184575 - DNA, 22 bp, Homo sapiens
ttccatcctaataaaagaagtt

SEQ ID NO: 7184576 - DNA, 19 bp, Homo sapiens
ttccatctatcttcttact

SEQ ID NO: 7184577 - DNA, 22 bp, Homo sapiens
ttccatctgagagctgtgaaga

SEQ ID NO: 7184578 - DNA, 22 bp, Homo sapiens
ttccatctgagagctgtgaaga

SEQ ID NO: 7184579 - DNA, 22 bp, Homo sapiens
ttccatctgctaggtaaatgaa

SEQ ID NO: 7184580 - DNA, 22 bp, Homo sapiens
ttccatctttcagctttgttgg

SEQ ID NO: 7184581 - DNA, 22 bp, Homo sapiens
ttccatctttcagctttgttgg

SEQ ID NO: 7184582 - DNA, 22 bp, Homo sapiens
ttccatgcctctatttagaatt

SEQ ID NO: 7184583 - DNA, 22 bp, Homo sapiens
tcctctccagcaaactggctat

SEQ ID NO: 7184584 - DNA, 22 bp, Homo sapiens
tcctctccagcaaactggctat

SEQ ID NO: 7184585 - DNA, 22 bp, Homo sapiens
tcctctccagcaaactggctat

SEQ ID NO: 7184586 - DNA, 22 bp, Homo sapiens
tcctctccagcaaactggctat

SEQ ID NO: 7184587 - DNA, 22 bp, Homo sapiens
tcctctccagcaaactggctat

SEQ ID NO: 7184588 - DNA, 21 bp, Homo sapiens
tcctctactgagccatgcaga

SEQ ID NO: 7184589 - DNA, 22 bp, Homo sapiens
tcctctcagtgtggttgtggga

SEQ ID NO: 7184590 - DNA, 22 bp, Homo sapiens
tcctctccagcaaactggctat

SEQ ID NO: 7184591 - DNA, 22 bp, Homo sapiens
tcctctgctcagcattcctcac

SEQ ID NO: 7184592 - DNA, 22 bp, Homo sapiens
tcctctgctcagcattcctcac

SEQ ID NO: 7184593 - DNA, 22 bp, Homo sapiens
tcctctccaggtgagccgaaat

SEQ ID NO: 7184594 - DNA, 22 bp, Homo sapiens
tcctctgccccagatgaaattt

SEQ ID NO: 7184595 - DNA, 22 bp, Homo sapiens
tcctctgccccagatgaaattt

SEQ ID NO: 7184596 - DNA, 22 bp, Homo sapiens
tcctctgctccaggctggactt

SEQ ID NO: 7184597 - DNA, 22 bp, Homo sapiens
tcctctgctccaggctggactt

SEQ ID NO: 7184598 - DNA, 22 bp, Homo sapiens
tcctctgctccaggctggactt

SEQ ID NO: 7184599 - DNA, 22 bp, Homo sapiens
tcctctgctccatctttactgt

SEQ ID NO: 7184600 - DNA, 22 bp, Homo sapiens
tcctctgctccatctttactgt

SEQ ID NO: 7184601 - DNA, 21 bp, Homo sapiens
tcctctactgagccatgcaga

SEQ ID NO: 7184602 - DNA, 22 bp, Homo sapiens
tcctcctttccccgctggagcc

SEQ ID NO: 7184603 - DNA, 22 bp, Homo sapiens
tcctcctgtttctcaggcctgg

SEQ ID NO: 7184604 - DNA, 19 bp, Homo sapiens
tcctccttacttcctcttg

SEQ ID NO: 7184605 - DNA, 21 bp, Homo sapiens
tcctccttcaagtcctggcct

SEQ ID NO: 7184606 - DNA, 22 bp, Homo sapiens
tcctcctgtttctcaggcctgg

SEQ ID NO: 7184607 - DNA, 22 bp, Homo sapiens
tcctcctgtttctcaggcctgg

SEQ ID NO: 7184608 - DNA, 20 bp, Homo sapiens
tcctccttgcagagcccaga

SEQ ID NO: 7184609 - DNA, 20 bp, Homo sapiens
tcctccttgcagagcccaga

SEQ ID NO: 7184610 - DNA, 22 bp, Homo sapiens
tcctcctgtttctcaggcctgg

SEQ ID NO: 7184611 - DNA, 22 bp, Homo sapiens
tcctcctgtttctcaggcctgg

SEQ ID NO: 7184612 - DNA, 22 bp, Homo sapiens
tcctcctgtctaccagttcctg

SEQ ID NO: 7184613 - DNA, 22 bp, Homo sapiens
tcctcctgtttctcaggcctgg

SEQ ID NO: 7184614 - DNA, 22 bp, Homo sapiens
tcctcctgtctaccagttcctg

SEQ ID NO: 7184615 - DNA, 22 bp, Homo sapiens
tcctcctgtctaccagttcctg

SEQ ID NO: 7184616 - DNA, 21 bp, Homo sapiens
tcctcctgtagagggtcctgg

SEQ ID NO: 7184617 - DNA, 21 bp, Homo sapiens
tcctcctgtagagggtcctgg

SEQ ID NO: 7184618 - DNA, 21 bp, Homo sapiens
tcctcctggccaggcggcccc

SEQ ID NO: 7184619 - DNA, 21 bp, Homo sapiens
tcctcctggccaggcggcccc

SEQ ID NO: 7184620 - DNA, 21 bp, Homo sapiens
tcctcctgtagagggtcctgg

SEQ ID NO: 7184621 - DNA, 22 bp, Homo sapiens
ttagtgtattttcaaatgtaga

SEQ ID NO: 7184622 - DNA, 22 bp, Homo sapiens
ttagtgtattttcaaatgtaga

SEQ ID NO: 7184623 - DNA, 23 bp, Homo sapiens
ttagtgtaaggcaggcacagttg

SEQ ID NO: 7184624 - DNA, 22 bp, Homo sapiens
ttagtgtacttagtgctctaag

SEQ ID NO: 7184625 - DNA, 17 bp, Homo sapiens
ttagtgtatctgttttg

SEQ ID NO: 7184626 - DNA, 22 bp, Homo sapiens
ttagtggtactcagggagggaa

SEQ ID NO: 7184627 - DNA, 22 bp, Homo sapiens
ttagtggggatgtatgggaggc

SEQ ID NO: 7184628 - DNA, 22 bp, Homo sapiens
ttagtggtgttggtgaggactg

SEQ ID NO: 7184629 - DNA, 22 bp, Homo sapiens
ttagtggtgttggtgaggactg

SEQ ID NO: 7184630 - DNA, 22 bp, Homo sapiens
ttagtgtctggctatatttaaa

SEQ ID NO: 7184631 - DNA, 22 bp, Homo sapiens
ttagtgtgcatggatctgtgga

SEQ ID NO: 7184632 - DNA, 22 bp, Homo sapiens
ttagtgtgtccagttctgaaaa

SEQ ID NO: 7184633 - DNA, 22 bp, Homo sapiens
ttagtgttagggcctgttacct

SEQ ID NO: 7184634 - DNA, 22 bp, Homo sapiens
ttagtgtttaaaggtttcagag

SEQ ID NO: 7184635 - DNA, 22 bp, Homo sapiens
ttagttaaaattctgctgacat

SEQ ID NO: 7184636 - DNA, 22 bp, Homo sapiens
ttagttaattgactatgttgca

SEQ ID NO: 7184637 - DNA, 22 bp, Homo sapiens
tcctctggatataagcctcacc

SEQ ID NO: 7184638 - DNA, 22 bp, Homo sapiens
tcctctggaacctcacccttgc

SEQ ID NO: 7184639 - DNA, 22 bp, Homo sapiens
tcctctggaacctcacccttgc

SEQ ID NO: 7184640 - DNA, 21 bp, Homo sapiens
tcctctgctctcataccacaa

SEQ ID NO: 7184641 - DNA, 21 bp, Homo sapiens
tcctctgctctcataccacaa

SEQ ID NO: 7184642 - DNA, 22 bp, Homo sapiens
tcctctgctggaagggcaagag

SEQ ID NO: 7184643 - DNA, 22 bp, Homo sapiens
tcctctgctgttctggttcttt

SEQ ID NO: 7184644 - DNA, 22 bp, Homo sapiens
tcctctggcccagctgcctctg

SEQ ID NO: 7184645 - DNA, 22 bp, Homo sapiens
tcctctggcccagctgcctctg

SEQ ID NO: 7184646 - DNA, 22 bp, Homo sapiens
tcctctggcccagctgcctctg

SEQ ID NO: 7184647 - DNA, 22 bp, Homo sapiens
tcctctggcccagctgcctctg

SEQ ID NO: 7184648 - DNA, 22 bp, Homo sapiens
tcctctggctctttccctagga

SEQ ID NO: 7184649 - DNA, 22 bp, Homo sapiens
ttatacacgtttatggagctac

SEQ ID NO: 7184650 - DNA, 22 bp, Homo sapiens
ttatacactgcagaaccagcat

SEQ ID NO: 7184651 - DNA, 22 bp, Homo sapiens
ttatacaccatcactgccttgg

SEQ ID NO: 7184652 - DNA, 22 bp, Homo sapiens
ttatacacgtttatggagctac

SEQ ID NO: 7184653 - DNA, 22 bp, Homo sapiens
ttatacaccatcactgccttgg

SEQ ID NO: 7184654 - DNA, 22 bp, Homo sapiens
ttatacactgcagaaccagcat

SEQ ID NO: 7184655 - DNA, 22 bp, Homo sapiens
ttataattctggcataggctgt

SEQ ID NO: 7184656 - DNA, 22 bp, Homo sapiens
ttataattctggcataggctgt

SEQ ID NO: 7184657 - DNA, 22 bp, Homo sapiens
ttataattctggcataggctgt

SEQ ID NO: 7184658 - DNA, 22 bp, Homo sapiens
ttataattctggcataggctgt

SEQ ID NO: 7184659 - DNA, 22 bp, Homo sapiens
ttataattgcttattagaccca

SEQ ID NO: 7184660 - DNA, 22 bp, Homo sapiens
ttatacacaattcttttactac

SEQ ID NO: 7184661 - DNA, 22 bp, Homo sapiens
ttatacacaattcttttactac

SEQ ID NO: 7184662 - DNA, 22 bp, Homo sapiens
ttatacaggagattccttactt

SEQ ID NO: 7184663 - DNA, 22 bp, Homo sapiens
ttatacagtttatacttagaat

SEQ ID NO: 7184664 - DNA, 22 bp, Homo sapiens
ttatgcaacaggtgagcagaca

SEQ ID NO: 7184665 - DNA, 23 bp, Homo sapiens
ttatgcaagcttcctggtctcag

SEQ ID NO: 7184666 - DNA, 22 bp, Homo sapiens
ttatgcaaggacttattacagt

SEQ ID NO: 7184667 - DNA, 22 bp, Homo sapiens
ttagttagagccctatgttagg

SEQ ID NO: 7184668 - DNA, 22 bp, Homo sapiens
ttagttatagtgaagaaatact

SEQ ID NO: 7184669 - DNA, 22 bp, Homo sapiens
ttagttatagtgaagaaatact

SEQ ID NO: 7184670 - DNA, 22 bp, Homo sapiens
ttagttcactgctatatcatca

SEQ ID NO: 7184671 - DNA, 20 bp, Homo sapiens
ttagttgagtagctcctgaa

SEQ ID NO: 7184672 - DNA, 22 bp, Homo sapiens
ttagttgatagccaaaatttat

SEQ ID NO: 7184673 - DNA, 22 bp, Homo sapiens
ttagttgatcattcaacatggg

SEQ ID NO: 7184674 - DNA, 22 bp, Homo sapiens
ttagttgatgttctggaggtag

SEQ ID NO: 7184675 - DNA, 21 bp, Homo sapiens
ttagttctaccacttgcattc

SEQ ID NO: 7184676 - DNA, 21 bp, Homo sapiens
ttagttctaccacttgcattc

SEQ ID NO: 7184677 - DNA, 22 bp, Homo sapiens
ttataactttggatatgacaag

SEQ ID NO: 7184678 - DNA, 22 bp, Homo sapiens
ttagtttataattcatttctgt

SEQ ID NO: 7184679 - DNA, 22 bp, Homo sapiens
ttagtttataattcatttctgt

SEQ ID NO: 7184680 - DNA, 22 bp, Homo sapiens
ttagtttataattcatttctgt

SEQ ID NO: 7184681 - DNA, 22 bp, Homo sapiens
ttagttgcaatctattgacgtt

SEQ ID NO: 7184682 - DNA, 22 bp, Homo sapiens
ttagttgcatgccagacttggc

SEQ ID NO: 7184683 - DNA, 22 bp, Homo sapiens
ttagttgccagtgaggaggatt

SEQ ID NO: 7184684 - DNA, 22 bp, Homo sapiens
ttagttgcctcagtgggcactt

SEQ ID NO: 7184685 - DNA, 22 bp, Homo sapiens
ttagttgctcactacaaggtta

SEQ ID NO: 7184686 - DNA, 22 bp, Homo sapiens
ttagttgctggcagaccctagg

SEQ ID NO: 7184687 - DNA, 22 bp, Homo sapiens
ttagttgtaaaatggaatttgt

SEQ ID NO: 7184688 - DNA, 22 bp, Homo sapiens
ttataattctggcataggctgt

SEQ ID NO: 7184689 - DNA, 22 bp, Homo sapiens
ttataagagtatatagtgtact

SEQ ID NO: 7184690 - DNA, 22 bp, Homo sapiens
ttatgcatgagataaaaattgg

SEQ ID NO: 7184691 - DNA, 18 bp, Homo sapiens
ttatgcagatcagttcac

SEQ ID NO: 7184692 - DNA, 22 bp, Homo sapiens
ttatgcagcaaagtgcttgaaa

SEQ ID NO: 7184693 - DNA, 22 bp, Homo sapiens
ttatgcagtcgacatctgatca

SEQ ID NO: 7184694 - DNA, 22 bp, Homo sapiens
ttatgctaaatgaatcaagtca

SEQ ID NO: 7184695 - DNA, 17 bp, Homo sapiens
ttatgcctgtgaggttg

SEQ ID NO: 7184696 - DNA, 22 bp, Homo sapiens
ttatggaaatgaaattttattg

SEQ ID NO: 7184697 - DNA, 22 bp, Homo sapiens
ttatggaaaatacaattataag

SEQ ID NO: 7184698 - DNA, 22 bp, Homo sapiens
ttatggaagtgcaaattgtgtg

SEQ ID NO: 7184699 - DNA, 22 bp, Homo sapiens
ttatggaataacctttctgaaa

SEQ ID NO: 7184700 - DNA, 22 bp, Homo sapiens
ttatggaaaactccagagagta

SEQ ID NO: 7184701 - DNA, 22 bp, Homo sapiens
ttatgttatgaatggatgatct

SEQ ID NO: 7184702 - DNA, 22 bp, Homo sapiens
ttatgtcttaagtatgctaatt

SEQ ID NO: 7184703 - DNA, 22 bp, Homo sapiens
ttatggagactttcagaagcgg

SEQ ID NO: 7184704 - DNA, 22 bp, Homo sapiens
ttatggagcagacagctggtca

SEQ ID NO: 7184705 - DNA, 23 bp, Homo sapiens
ttatggagtgccagacatttggc

SEQ ID NO: 7184706 - DNA, 22 bp, Homo sapiens
ttatggagtgcttacctgccag

SEQ ID NO: 7184707 - DNA, 22 bp, Homo sapiens
ttatggaatttgcaaaaggtta

SEQ ID NO: 7184708 - DNA, 22 bp, Homo sapiens
ttatggaatggagaaagtctgc

SEQ ID NO: 7184709 - DNA, 22 bp, Homo sapiens
ttatggaatggagaaagtctgc

SEQ ID NO: 7184710 - DNA, 22 bp, Homo sapiens
ttatggaatacttatgctgcag

SEQ ID NO: 7184711 - DNA, 22 bp, Homo sapiens
ttatggaataacctttctgaaa

SEQ ID NO: 7184712 - DNA, 22 bp, Homo sapiens
ttattgttagtgagactgtaga

SEQ ID NO: 7184713 - DNA, 22 bp, Homo sapiens
ttattgttagtgagactgtaga

SEQ ID NO: 7184714 - DNA, 22 bp, Homo sapiens
ttatgttttatggctatatcat

SEQ ID NO: 7184715 - DNA, 22 bp, Homo sapiens
ttattgtttaaagccatgtaaa

SEQ ID NO: 7184716 - DNA, 22 bp, Homo sapiens
ttattgtttgggtataatttga

SEQ ID NO: 7184717 - DNA, 22 bp, Homo sapiens
ttattgtttgggtataatttga

SEQ ID NO: 7184718 - DNA, 22 bp, Homo sapiens
ttattgtttgggtataatttga

SEQ ID NO: 7184719 - DNA, 22 bp, Homo sapiens
ttattgtttgggtataatttga

SEQ ID NO: 7184720 - DNA, 22 bp, Homo sapiens
ttatgttttatggctatatcat

SEQ ID NO: 7184721 - DNA, 22 bp, Homo sapiens
ttatgtttgagtatatgactca

SEQ ID NO: 7184722 - DNA, 22 bp, Homo sapiens
ttatgttttatggctatatcat

SEQ ID NO: 7184723 - DNA, 22 bp, Homo sapiens
ttatgttttatggctatatcat

SEQ ID NO: 7184724 - DNA, 22 bp, Homo sapiens
ttatgtttgagtatatgactca

SEQ ID NO: 7184725 - DNA, 22 bp, Homo sapiens
ttatgttatgctatttcagata

SEQ ID NO: 7184726 - DNA, 22 bp, Homo sapiens
ttatgttgggaaaagtcagatt

SEQ ID NO: 7184727 - DNA, 22 bp, Homo sapiens
ttattgtttgggtataatttga

SEQ ID NO: 7184728 - DNA, 22 bp, Homo sapiens
ttatttaaaagtggtaagattc

SEQ ID NO: 7184729 - DNA, 22 bp, Homo sapiens
ttatttaaaagtggtaagattc

SEQ ID NO: 7184730 - DNA, 22 bp, Homo sapiens
ttattgtttgggtataatttga

SEQ ID NO: 7184731 - DNA, 22 bp, Homo sapiens
ttattgtttgggtataatttga

SEQ ID NO: 7184732 - DNA, 22 bp, Homo sapiens
ttattgtttgggtataatttga

SEQ ID NO: 7184733 - DNA, 22 bp, Homo sapiens
ttatttaaaagtggtaagattc

SEQ ID NO: 7184734 - DNA, 22 bp, Homo sapiens
ttatttaaaagtggtaagattc

SEQ ID NO: 7184735 - DNA, 22 bp, Homo sapiens
ttatttaaaagtggtaagattc

SEQ ID NO: 7184736 - DNA, 22 bp, Homo sapiens
ttatttaaaagtggtaagattc

SEQ ID NO: 7184737 - DNA, 22 bp, Homo sapiens
ttatttaaaagtggtaagattc

SEQ ID NO: 7184738 - DNA, 22 bp, Homo sapiens
ttatttaaaagtggtaagattc

SEQ ID NO: 7184739 - DNA, 22 bp, Homo sapiens
ttatttaaaatgtaggttggga

SEQ ID NO: 7184740 - DNA, 22 bp, Homo sapiens
ttatttaaaatgtaggttggga

SEQ ID NO: 7184741 - DNA, 22 bp, Homo sapiens
ttatttaatgtgatctgaagag

SEQ ID NO: 7184742 - DNA, 22 bp, Homo sapiens
ttatttaatgtgatctgaagag

SEQ ID NO: 7184743 - DNA, 22 bp, Homo sapiens
ttatttaatgtgatctgaagag

SEQ ID NO: 7184744 - DNA, 22 bp, Homo sapiens
ttatttaaaatgtaggttggga

SEQ ID NO: 7184745 - DNA, 22 bp, Homo sapiens
ttatttaatgtgatctgaagag

SEQ ID NO: 7184746 - DNA, 22 bp, Homo sapiens
ttatttaatgtgatctgaagag

SEQ ID NO: 7184747 - DNA, 22 bp, Homo sapiens
ttatttacaactcttctcttcc

SEQ ID NO: 7184748 - DNA, 22 bp, Homo sapiens
ttatttacaactcttctcttcc

SEQ ID NO: 7184749 - DNA, 22 bp, Homo sapiens
ttatttaattttctcactcaga

SEQ ID NO: 7184750 - DNA, 22 bp, Homo sapiens
ttatttaatgtgatctgaagag

SEQ ID NO: 7184751 - DNA, 22 bp, Homo sapiens
ttatttaatgtgatctgaagag

SEQ ID NO: 7184752 - DNA, 22 bp, Homo sapiens
ttatttaatgtgatctgaagag

SEQ ID NO: 7184753 - DNA, 22 bp, Homo sapiens
ttatttaattttctcactcaga

SEQ ID NO: 7184754 - DNA, 22 bp, Homo sapiens
ttatttaattttctcactcaga

SEQ ID NO: 7184755 - DNA, 22 bp, Homo sapiens
ttatttaattttctcactcaga

SEQ ID NO: 7184756 - DNA, 22 bp, Homo sapiens
ttatttaattttctcactcaga

SEQ ID NO: 7184757 - DNA, 22 bp, Homo sapiens
ttatttacaactcttctcttcc

SEQ ID NO: 7184758 - DNA, 22 bp, Homo sapiens
ttatttacaactcttctcttcc

SEQ ID NO: 7184759 - DNA, 22 bp, Homo sapiens
ttatttactggatggccttggg

SEQ ID NO: 7184760 - DNA, 22 bp, Homo sapiens
ttatttactggatggccttggg

SEQ ID NO: 7184761 - DNA, 22 bp, Homo sapiens
ttatttactggatggccttggg

SEQ ID NO: 7184762 - DNA, 22 bp, Homo sapiens
ttatttacaactcttctcttcc

SEQ ID NO: 7184763 - DNA, 22 bp, Homo sapiens
ttatttacaactcttctcttcc

SEQ ID NO: 7184764 - DNA, 22 bp, Homo sapiens
ttatttaggaggaaactgaggt

SEQ ID NO: 7184765 - DNA, 22 bp, Homo sapiens
ttatttagtctagatgaatttt

SEQ ID NO: 7184766 - DNA, 22 bp, Homo sapiens
ttatttagtctagatgaatttt

SEQ ID NO: 7184767 - DNA, 22 bp, Homo sapiens
ttatttagtctagatgaatttt

SEQ ID NO: 7184768 - DNA, 22 bp, Homo sapiens
ttatttgtggcatatgagacga

SEQ ID NO: 7184769 - DNA, 22 bp, Homo sapiens
ttatttatggcactgttggtgg

SEQ ID NO: 7184770 - DNA, 22 bp, Homo sapiens
ttatttatggcactgttggtgg

SEQ ID NO: 7184771 - DNA, 22 bp, Homo sapiens
ttatttatggcactgttggtgg

SEQ ID NO: 7184772 - DNA, 22 bp, Homo sapiens
ttatttatggcactgttggtgg

SEQ ID NO: 7184773 - DNA, 22 bp, Homo sapiens
ttatttatatctctgcagttta

SEQ ID NO: 7184774 - DNA, 22 bp, Homo sapiens
ttatttatatctctgcagttta

SEQ ID NO: 7184775 - DNA, 22 bp, Homo sapiens
ttatttagtctagatgaatttt

SEQ ID NO: 7184776 - DNA, 22 bp, Homo sapiens
ttatttatatctctgcagttta

SEQ ID NO: 7184777 - DNA, 22 bp, Homo sapiens
ttatttatatctctgcagttta

SEQ ID NO: 7184778 - DNA, 22 bp, Homo sapiens
ttatttatatctctgcagttta

SEQ ID NO: 7184779 - DNA, 22 bp, Homo sapiens
ttatttgtggcatatgagacga

SEQ ID NO: 7184780 - DNA, 22 bp, Homo sapiens
ttatttgtggcatatgagacga

SEQ ID NO: 7184781 - DNA, 22 bp, Homo sapiens
ttatttgtggcatatgagacga

SEQ ID NO: 7184782 - DNA, 22 bp, Homo sapiens
ttatttgtggcatatgagacga

SEQ ID NO: 7184783 - DNA, 22 bp, Homo sapiens
ttattttaccttcctctgagct

SEQ ID NO: 7184784 - DNA, 22 bp, Homo sapiens
ttattttaccttcctctgagct

SEQ ID NO: 7184785 - DNA, 22 bp, Homo sapiens
ttatttgttttctgagaagtat

SEQ ID NO: 7184786 - DNA, 18 bp, Homo sapiens
ttatttgttacagcacat

SEQ ID NO: 7184787 - DNA, 18 bp, Homo sapiens
ttatttgttacagcacat

SEQ ID NO: 7184788 - DNA, 20 bp, Homo sapiens
ttatttgtttactttggtcc

SEQ ID NO: 7184789 - DNA, 20 bp, Homo sapiens
ttatttgtttactttggtcc

SEQ ID NO: 7184790 - DNA, 20 bp, Homo sapiens
ttatttgtttactttggtcc

SEQ ID NO: 7184791 - DNA, 22 bp, Homo sapiens
ttattttaccttcctctgagct

SEQ ID NO: 7184792 - DNA, 22 bp, Homo sapiens
ttattttaccttcctctgagct

SEQ ID NO: 7184793 - DNA, 22 bp, Homo sapiens
ttattttaccttcctctgagct

SEQ ID NO: 7184794 - DNA, 22 bp, Homo sapiens
ttattttctcctcagaaagtgg

SEQ ID NO: 7184795 - DNA, 22 bp, Homo sapiens
ttattttctcctcagaaagtgg

SEQ ID NO: 7184796 - DNA, 22 bp, Homo sapiens
ttattttcagctaggaaagcca

SEQ ID NO: 7184797 - DNA, 22 bp, Homo sapiens
ttattttctcctcagaaagtgg

SEQ ID NO: 7184798 - DNA, 22 bp, Homo sapiens
ttattttctcctcagaaagtgg

SEQ ID NO: 7184799 - DNA, 22 bp, Homo sapiens
ttattttctcctcagaaagtgg

SEQ ID NO: 7184800 - DNA, 22 bp, Homo sapiens
ttattttgagagaatgtgtgct

SEQ ID NO: 7184801 - DNA, 22 bp, Homo sapiens
ttattttgagagaatgtgtgct

SEQ ID NO: 7184802 - DNA, 22 bp, Homo sapiens
ttattttgagagaatgtgtgct

SEQ ID NO: 7184803 - DNA, 22 bp, Homo sapiens
ttattttgagagaatgtgtgct

SEQ ID NO: 7184804 - DNA, 22 bp, Homo sapiens
ttattttgccacaggtgacctt

SEQ ID NO: 7184805 - DNA, 22 bp, Homo sapiens
ttattttgccacaggtgacctt

SEQ ID NO: 7184806 - DNA, 22 bp, Homo sapiens
ttattttggtaaatgtttgcct

SEQ ID NO: 7184807 - DNA, 22 bp, Homo sapiens
ttattttggtaaatgtttgcct

SEQ ID NO: 7184808 - DNA, 22 bp, Homo sapiens
ttattttgtagctctgatcttt

SEQ ID NO: 7184809 - DNA, 22 bp, Homo sapiens
ttattttgtagctctgatcttt

SEQ ID NO: 7184810 - DNA, 22 bp, Homo sapiens
ttattttgtagctctgatcttt

SEQ ID NO: 7184811 - DNA, 22 bp, Homo sapiens
ttattttggtaaatgtttgcct

SEQ ID NO: 7184812 - DNA, 22 bp, Homo sapiens
ttattttggtaaatgtttgcct

SEQ ID NO: 7184813 - DNA, 22 bp, Homo sapiens
ttattttgtagctctgatcttt

SEQ ID NO: 7184814 - DNA, 23 bp, Homo sapiens
ttcaaaactggaaaatcagatgc

SEQ ID NO: 7184815 - DNA, 23 bp, Homo sapiens
ttcaaaactggaaaatcagatgc

SEQ ID NO: 7184816 - DNA, 22 bp, Homo sapiens
ttcaaaagactcagatgtagcg

SEQ ID NO: 7184817 - DNA, 22 bp, Homo sapiens
ttcaaaagactcagatgtagcg

SEQ ID NO: 7184818 - DNA, 21 bp, Homo sapiens
ttcaaaatggtgtgtttgtct

SEQ ID NO: 7184819 - DNA, 22 bp, Homo sapiens
ttcaaaagcggtccaggaagat

SEQ ID NO: 7184820 - DNA, 22 bp, Homo sapiens
ttcaaaagcggtccaggaagat

SEQ ID NO: 7184821 - DNA, 22 bp, Homo sapiens
ttcaaaagtaatcagtattaga

SEQ ID NO: 7184822 - DNA, 22 bp, Homo sapiens
ttcaaaagtaatcagtattaga

SEQ ID NO: 7184823 - DNA, 22 bp, Homo sapiens
ttcaaaagtaatcagtattaga

SEQ ID NO: 7184824 - DNA, 22 bp, Homo sapiens
ttcaagcagagatatttcaaga

SEQ ID NO: 7184825 - DNA, 22 bp, Homo sapiens
ttcaagatgtcttcacaatagt

SEQ ID NO: 7184826 - DNA, 22 bp, Homo sapiens
ttcaaggaaaccagcatttggt

SEQ ID NO: 7184827 - DNA, 22 bp, Homo sapiens
ttcaaggagattggagtctact

SEQ ID NO: 7184828 - DNA, 22 bp, Homo sapiens
ttcaagggaaaacacagtgaat

SEQ ID NO: 7184829 - DNA, 23 bp, Homo sapiens
ttcaagggttatttgttagcact

SEQ ID NO: 7184830 - DNA, 22 bp, Homo sapiens
ttcaagatccagcacaacagtg

SEQ ID NO: 7184831 - DNA, 22 bp, Homo sapiens
ttcaagatcgagtttaaagtga

SEQ ID NO: 7184832 - DNA, 22 bp, Homo sapiens
ttcaagatcgagtttaaagtga

SEQ ID NO: 7184833 - DNA, 22 bp, Homo sapiens
ttcaagatctgggttttcagct

SEQ ID NO: 7184834 - DNA, 22 bp, Homo sapiens
ttcaagatcttccaaaggatac

SEQ ID NO: 7184835 - DNA, 22 bp, Homo sapiens
ttcaagatgacccagtcacacg

SEQ ID NO: 7184836 - DNA, 22 bp, Homo sapiens
ttcaagatgacccagtcacacg

SEQ ID NO: 7184837 - DNA, 22 bp, Homo sapiens
ttcaagatgacccagtcacacg

SEQ ID NO: 7184838 - DNA, 22 bp, Homo sapiens
ttcaagatgcacagtggcattc

SEQ ID NO: 7184839 - DNA, 22 bp, Homo sapiens
ttcaagatgccagggacgcggc

SEQ ID NO: 7184840 - DNA, 22 bp, Homo sapiens
ttcaagatggcaccagtgagtg

SEQ ID NO: 7184841 - DNA, 22 bp, Homo sapiens
ttcaagatggccccagtgagcc

SEQ ID NO: 7184842 - DNA, 22 bp, Homo sapiens
ttcaagatggctgcaaatactt

SEQ ID NO: 7184843 - DNA, 22 bp, Homo sapiens
ttcaagatggctgcaaatactt

SEQ ID NO: 7184844 - DNA, 22 bp, Homo sapiens
ttcaagatggctgcaaatactt

SEQ ID NO: 7184845 - DNA, 22 bp, Homo sapiens
ttcaagatgtcttcacaatagt

SEQ ID NO: 7184846 - DNA, 22 bp, Homo sapiens
ttcaaacaaaactctttcctat

SEQ ID NO: 7184847 - DNA, 22 bp, Homo sapiens
ttcaaacacagacagcagcatg

SEQ ID NO: 7184848 - DNA, 22 bp, Homo sapiens
ttcaaacaactcatttatgcaa

SEQ ID NO: 7184849 - DNA, 22 bp, Homo sapiens
ttcaaacaactcatttatgcaa

SEQ ID NO: 7184850 - DNA, 22 bp, Homo sapiens
ttcaaacacagacagcagcatg

SEQ ID NO: 7184851 - DNA, 22 bp, Homo sapiens
ttcaaacaaaactgttcccata

SEQ ID NO: 7184852 - DNA, 22 bp, Homo sapiens
ttcaaacaactcatttatgcaa

SEQ ID NO: 7184853 - DNA, 22 bp, Homo sapiens
ttcaagaatcttcctgaccact

SEQ ID NO: 7184854 - DNA, 22 bp, Homo sapiens
ttcaagaggcttaattctggat

SEQ ID NO: 7184855 - DNA, 22 bp, Homo sapiens
ttcaagataataggaatgaaaa

SEQ ID NO: 7184856 - DNA, 23 bp, Homo sapiens
ttcaagatacggtttccaggctg

SEQ ID NO: 7184857 - DNA, 17 bp, Homo sapiens
ttcaagatattgaaatg

SEQ ID NO: 7184858 - DNA, 21 bp, Homo sapiens
ttcaagatatttaaaaggtgg

SEQ ID NO: 7184859 - DNA, 22 bp, Homo sapiens
ttcaagatccagcacaacagtg

SEQ ID NO: 7184860 - DNA, 22 bp, Homo sapiens
ttcaagatccagcacaacagtg

SEQ ID NO: 7184861 - DNA, 22 bp, Homo sapiens
ttccctgatcacgtgtcaggag

SEQ ID NO: 7184862 - DNA, 22 bp, Homo sapiens
ttccctgatggccccaaggata

SEQ ID NO: 7184863 - DNA, 22 bp, Homo sapiens
ttccttgttgaaaatgtctgca

SEQ ID NO: 7184864 - DNA, 22 bp, Homo sapiens
ttccttgtttcaagccatccac

SEQ ID NO: 7184865 - DNA, 22 bp, Homo sapiens
ttccttgtttgtagctctggga

SEQ ID NO: 7184866 - DNA, 22 bp, Homo sapiens
ttccctctttcactgtgatttt

SEQ ID NO: 7184867 - DNA, 22 bp, Homo sapiens
ttccctctttcactgtgatttt

SEQ ID NO: 7184868 - DNA, 22 bp, Homo sapiens
ttccctctttcactgtgatttt

SEQ ID NO: 7184869 - DNA, 22 bp, Homo sapiens
ttccctcttttccaacagttgt

SEQ ID NO: 7184870 - DNA, 22 bp, Homo sapiens
ttccctcttttccaacagttgt

SEQ ID NO: 7184871 - DNA, 22 bp, Homo sapiens
ttccctgaagacctcatgtgac

SEQ ID NO: 7184872 - DNA, 22 bp, Homo sapiens
ttccctgaagacctcatgtgac

SEQ ID NO: 7184873 - DNA, 22 bp, Homo sapiens
ttccctcttttccaacagttgt

SEQ ID NO: 7184874 - DNA, 22 bp, Homo sapiens
ttccctcttttccaacagttgt

SEQ ID NO: 7184875 - DNA, 22 bp, Homo sapiens
ttcctttagtgtcatatacttt

SEQ ID NO: 7184876 - DNA, 22 bp, Homo sapiens
ttcctttagtgtcatatacttt

SEQ ID NO: 7184877 - DNA, 22 bp, Homo sapiens
ttcctttagggaaatcgtctca

SEQ ID NO: 7184878 - DNA, 22 bp, Homo sapiens
ttcctttagtgtcatatacttt

SEQ ID NO: 7184879 - DNA, 20 bp, Homo sapiens
ttcgctgggagtggccaggc

SEQ ID NO: 7184880 - DNA, 20 bp, Homo sapiens
ttcgctgggagtggccaggc

SEQ ID NO: 7184881 - DNA, 20 bp, Homo sapiens
ttcgctgggagtggccaggc

SEQ ID NO: 7184882 - DNA, 20 bp, Homo sapiens
ttcgctgggagtggccaggc

SEQ ID NO: 7184883 - DNA, 22 bp, Homo sapiens
ttccctctctccagggctgcct

SEQ ID NO: 7184884 - DNA, 22 bp, Homo sapiens
ttccctctctccagggctgcct

SEQ ID NO: 7184885 - DNA, 22 bp, Homo sapiens
ttccctctctccagggctgcct

SEQ ID NO: 7184886 - DNA, 22 bp, Homo sapiens
ttccctctgcgcattgaatttc

SEQ ID NO: 7184887 - DNA, 22 bp, Homo sapiens
ttccctctctccagggctgcct

SEQ ID NO: 7184888 - DNA, 22 bp, Homo sapiens
ttccctctgcgcattgaatttc

SEQ ID NO: 7184889 - DNA, 22 bp, Homo sapiens
ttccctctccaggagccctgag

SEQ ID NO: 7184890 - DNA, 22 bp, Homo sapiens
ttccctctcctactcaggaaag

SEQ ID NO: 7184891 - DNA, 22 bp, Homo sapiens
ttccctctcctactcaggaaag

SEQ ID NO: 7184892 - DNA, 22 bp, Homo sapiens
ttccctctcctactcaggaaag

SEQ ID NO: 7184893 - DNA, 22 bp, Homo sapiens
ttccctctcctactcaggaaag

SEQ ID NO: 7184894 - DNA, 22 bp, Homo sapiens
ttccctctctagctttccccaa

SEQ ID NO: 7184895 - DNA, 22 bp, Homo sapiens
ttccctctctagctttccccaa

SEQ ID NO: 7184896 - DNA, 22 bp, Homo sapiens
ttccctctctagctttccccaa

SEQ ID NO: 7184897 - DNA, 22 bp, Homo sapiens
ttccctctcacttaaagcttgg

SEQ ID NO: 7184898 - DNA, 22 bp, Homo sapiens
ttccctctccaggagccctgag

SEQ ID NO: 7184899 - DNA, 22 bp, Homo sapiens
ttccctctccaggagccctgag

SEQ ID NO: 7184900 - DNA, 22 bp, Homo sapiens
ttccctcctatgcccactgaaa

SEQ ID NO: 7184901 - DNA, 22 bp, Homo sapiens
ttccctcctatgcccactgaaa

SEQ ID NO: 7184902 - DNA, 22 bp, Homo sapiens
ttccctctcacttaaagcttgg

SEQ ID NO: 7184903 - DNA, 22 bp, Homo sapiens
ttccctctcacttaaagcttgg

SEQ ID NO: 7184904 - DNA, 22 bp, Homo sapiens
ttccctccgaacctcagtgctg

SEQ ID NO: 7184905 - DNA, 22 bp, Homo sapiens
ttccctccctggctgccatttc

SEQ ID NO: 7184906 - DNA, 22 bp, Homo sapiens
ttccctcccccagcctggcagg

SEQ ID NO: 7184907 - DNA, 22 bp, Homo sapiens
ttctaaattttggaagatgcag

SEQ ID NO: 7184908 - DNA, 22 bp, Homo sapiens
ttctaaattttggaagatgcag

SEQ ID NO: 7184909 - DNA, 18 bp, Homo sapiens
ttctaaattctgttttta

SEQ ID NO: 7184910 - DNA, 18 bp, Homo sapiens
ttctaaattctgttttta

SEQ ID NO: 7184911 - DNA, 18 bp, Homo sapiens
ttctaaattctgttttta

SEQ ID NO: 7184912 - DNA, 22 bp, Homo sapiens
ttctaaatgtaaatagtatgat

SEQ ID NO: 7184913 - DNA, 22 bp, Homo sapiens
ttctaaagtgcaatctgacaga

SEQ ID NO: 7184914 - DNA, 22 bp, Homo sapiens
ttctaaagtgcaatctgacaga

SEQ ID NO: 7184915 - DNA, 22 bp, Homo sapiens
ttctaaatggggatcctttctg

SEQ ID NO: 7184916 - DNA, 22 bp, Homo sapiens
ttctaactctacactagctttg

SEQ ID NO: 7184917 - DNA, 22 bp, Homo sapiens
ttctaaaaccaattctgcttct

SEQ ID NO: 7184918 - DNA, 22 bp, Homo sapiens
ttctaaaaccaattctgcttct

SEQ ID NO: 7184919 - DNA, 22 bp, Homo sapiens
ttctaaaataagtttatctggt

SEQ ID NO: 7184920 - DNA, 22 bp, Homo sapiens
ttcgggcatgtgtgctgtgaaa

SEQ ID NO: 7184921 - DNA, 22 bp, Homo sapiens
ttcgggctcgcccagatcagtg

SEQ ID NO: 7184922 - DNA, 22 bp, Homo sapiens
ttcgtgtggagatgtttctgca

SEQ ID NO: 7184923 - DNA, 22 bp, Homo sapiens
ttcgtcaagggctgttggacta

SEQ ID NO: 7184924 - DNA, 22 bp, Homo sapiens
ttcgttcatagtagaaatggct

SEQ ID NO: 7184925 - DNA, 22 bp, Homo sapiens
ttctaaaataagtttatctggt

SEQ ID NO: 7184926 - DNA, 22 bp, Homo sapiens
ttctaaaataagtttatctggt

SEQ ID NO: 7184927 - DNA, 22 bp, Homo sapiens
ttctaaaataagtttatctggt

SEQ ID NO: 7184928 - DNA, 22 bp, Homo sapiens
ttctaaacactacgggatttgg

SEQ ID NO: 7184929 - DNA, 22 bp, Homo sapiens
ttctaaacggcttcacaggaat

SEQ ID NO: 7184930 - DNA, 21 bp, Homo sapiens
ttctaaactaggggaagcgtc

SEQ ID NO: 7184931 - DNA, 22 bp, Homo sapiens
ttctaaactgaagtattttaaa

SEQ ID NO: 7184932 - DNA, 20 bp, Homo sapiens
ttctaaactgttaggcttgc

SEQ ID NO: 7184933 - DNA, 22 bp, Homo sapiens
ttctaaacttcaattctaaatt

SEQ ID NO: 7184934 - DNA, 21 bp, Homo sapiens
ttctccaggcaaccatttcag

SEQ ID NO: 7184935 - DNA, 19 bp, Homo sapiens
ttctccagcctgacctgag

SEQ ID NO: 7184936 - DNA, 19 bp, Homo sapiens
ttctccagcctgacctgag

SEQ ID NO: 7184937 - DNA, 22 bp, Homo sapiens
ttctcagatatttgtatggaac

SEQ ID NO: 7184938 - DNA, 22 bp, Homo sapiens
ttctcagaattgactgggagca

SEQ ID NO: 7184939 - DNA, 22 bp, Homo sapiens
ttctcacattcagaacttttat

SEQ ID NO: 7184940 - DNA, 22 bp, Homo sapiens
ttctcacagtacctaacatgta

SEQ ID NO: 7184941 - DNA, 22 bp, Homo sapiens
ttctcacagtacctaacatgta

SEQ ID NO: 7184942 - DNA, 22 bp, Homo sapiens
ttctcacaattcttgtatttgc

SEQ ID NO: 7184943 - DNA, 22 bp, Homo sapiens
ttctcacactttccactgaggt

SEQ ID NO: 7184944 - DNA, 22 bp, Homo sapiens
ttctcacactttccactgaggt

SEQ ID NO: 7184945 - DNA, 22 bp, Homo sapiens
ttctcacactttccactgaggt

SEQ ID NO: 7184946 - DNA, 22 bp, Homo sapiens
ttctcacaaatccatccaggag

SEQ ID NO: 7184947 - DNA, 22 bp, Homo sapiens
ttctcacaggaagtaggacttt

SEQ ID NO: 7184948 - DNA, 22 bp, Homo sapiens
ttctcacaggaagtaggacttt

SEQ ID NO: 7184949 - DNA, 22 bp, Homo sapiens
ttctcacaggatttcttttagt

SEQ ID NO: 7184950 - DNA, 22 bp, Homo sapiens
ttctcacaggatttcttttagt

SEQ ID NO: 7184951 - DNA, 22 bp, Homo sapiens
ttctcacaggctggaatgatga

SEQ ID NO: 7184952 - DNA, 22 bp, Homo sapiens
ttctcacaggctggaatgatga

SEQ ID NO: 7184953 - DNA, 22 bp, Homo sapiens
ttctcaaggacaaaatgacatg

SEQ ID NO: 7184954 - DNA, 22 bp, Homo sapiens
ttctcaactctcaagagaagct

SEQ ID NO: 7184955 - DNA, 22 bp, Homo sapiens
ttctcaaagaaagctgtcatta

SEQ ID NO: 7184956 - DNA, 22 bp, Homo sapiens
ttctcaaagggtggtttgcaaa

SEQ ID NO: 7184957 - DNA, 22 bp, Homo sapiens
ttctcaaagggtggtttgcaaa

SEQ ID NO: 7184958 - DNA, 22 bp, Homo sapiens
ttctcaaagtgtgctccctgga

SEQ ID NO: 7184959 - DNA, 19 bp, Homo sapiens
ttctatgattaacatgaga

SEQ ID NO: 7184960 - DNA, 22 bp, Homo sapiens
ttctatgaaggtaagatgtacg

SEQ ID NO: 7184961 - DNA, 22 bp, Homo sapiens
ttctcaaagaaagctgtcatta

SEQ ID NO: 7184962 - DNA, 22 bp, Homo sapiens
ttctcaaagaaagctgtcatta

SEQ ID NO: 7184963 - DNA, 22 bp, Homo sapiens
ttctcaaagaaagctgtcatta

SEQ ID NO: 7184964 - DNA, 22 bp, Homo sapiens
ttctatgaaggtaagatgtacg

SEQ ID NO: 7184965 - DNA, 19 bp, Homo sapiens
ttctatgattaacatgaga

SEQ ID NO: 7184966 - DNA, 22 bp, Homo sapiens
ttctatctcatatgtgttctag

SEQ ID NO: 7184967 - DNA, 22 bp, Homo sapiens
ttctatgaaggtaagatgtacg

SEQ ID NO: 7184968 - DNA, 22 bp, Homo sapiens
ttctatattgttaaaggttata

SEQ ID NO: 7184969 - DNA, 22 bp, Homo sapiens
ttctatatttatgggcatcacc

SEQ ID NO: 7184970 - DNA, 22 bp, Homo sapiens
ttctatcatacttgaatacatt

SEQ ID NO: 7184971 - DNA, 22 bp, Homo sapiens
ttctatattggaagtgagaaat

SEQ ID NO: 7184972 - DNA, 22 bp, Homo sapiens
ttctcccatctcagtcttacat

SEQ ID NO: 7184973 - DNA, 22 bp, Homo sapiens
ttctccctgccaaagctgcctc

SEQ ID NO: 7184974 - DNA, 22 bp, Homo sapiens
ttctcccactccgtgcttcagt

SEQ ID NO: 7184975 - DNA, 22 bp, Homo sapiens
ttctcccactccgtgcttcagt

SEQ ID NO: 7184976 - DNA, 21 bp, Homo sapiens
ttctccagggggagctctctc

SEQ ID NO: 7184977 - DNA, 22 bp, Homo sapiens
ttctcctctgttggccttccct

SEQ ID NO: 7184978 - DNA, 18 bp, Homo sapiens
ttctctggtggatgttat

SEQ ID NO: 7184979 - DNA, 22 bp, Homo sapiens
ttctcctctgttaccttgcaaa

SEQ ID NO: 7184980 - DNA, 22 bp, Homo sapiens
ttctcctctgttaccttgcaaa

SEQ ID NO: 7184981 - DNA, 22 bp, Homo sapiens
ttctcctctgttaccttgcaaa

SEQ ID NO: 7184982 - DNA, 21 bp, Homo sapiens
ttctcctccaagttgctcctg

SEQ ID NO: 7184983 - DNA, 21 bp, Homo sapiens
ttctcctccaagttgctcctg

SEQ ID NO: 7184984 - DNA, 17 bp, Homo sapiens
ttctcctctgtgtcctt

SEQ ID NO: 7184985 - DNA, 22 bp, Homo sapiens
ttctccgctaagttctctgcag

SEQ ID NO: 7184986 - DNA, 22 bp, Homo sapiens
ttctccgctaagttctctgcag

SEQ ID NO: 7184987 - DNA, 22 bp, Homo sapiens
ttctccctgccaaagctgcctc

SEQ ID NO: 7184988 - DNA, 22 bp, Homo sapiens
ttctccctgccaaagctgcctc

SEQ ID NO: 7184989 - DNA, 22 bp, Homo sapiens
ttctccctgtcctatcaagact

SEQ ID NO: 7184990 - DNA, 22 bp, Homo sapiens
ttctccctgtcctatcaagact

SEQ ID NO: 7184991 - DNA, 22 bp, Homo sapiens
ttctccctgtcctatcaagact

SEQ ID NO: 7184992 - DNA, 22 bp, Homo sapiens
ttctcctacttaaggccttcca

SEQ ID NO: 7184993 - DNA, 22 bp, Homo sapiens
ttctcttcatctcagtaaatgt

SEQ ID NO: 7184994 - DNA, 22 bp, Homo sapiens
ttctcttattctggatatgcag

SEQ ID NO: 7184995 - DNA, 22 bp, Homo sapiens
ttctcttatctggcattattgg

SEQ ID NO: 7184996 - DNA, 22 bp, Homo sapiens
ttctcttattctggatatgcag

SEQ ID NO: 7184997 - DNA, 22 bp, Homo sapiens
ttctctgttttcccctcgatgt

SEQ ID NO: 7184998 - DNA, 22 bp, Homo sapiens
ttctctgttttcccctcgatgt

SEQ ID NO: 7184999 - DNA, 22 bp, Homo sapiens
ttctcttacattttctcagcct

SEQ ID NO: 7185000 - DNA, 22 bp, Homo sapiens
ttctcttacattttctcagcct

SEQ ID NO: 7185001 - DNA, 22 bp, Homo sapiens
ttctcttagcactttgtgttac

SEQ ID NO: 7185002 - DNA, 22 bp, Homo sapiens
ttctcttagctgtaaagtcaat

SEQ ID NO: 7185003 - DNA, 22 bp, Homo sapiens
ttctcttagctgtaaagtcaat

SEQ ID NO: 7185004 - DNA, 22 bp, Homo sapiens
ttctcttagctgtaaagtcaat

SEQ ID NO: 7185005 - DNA, 22 bp, Homo sapiens
ttctctgtagttgcctggtgga

SEQ ID NO: 7185006 - DNA, 22 bp, Homo sapiens
ttctctggtttgctgtttctga

SEQ ID NO: 7185007 - DNA, 22 bp, Homo sapiens
ttctctgtgagggtgctggatt

SEQ ID NO: 7185008 - DNA, 22 bp, Homo sapiens
ttctctgtgagggtgctggatt

SEQ ID NO: 7185009 - DNA, 19 bp, Homo sapiens
ttctctgtgctagactctg

SEQ ID NO: 7185010 - DNA, 19 bp, Homo sapiens
ttctctgtgctagactctg

SEQ ID NO: 7185011 - DNA, 22 bp, Homo sapiens
ttctcttccagccgggcttgca

SEQ ID NO: 7185012 - DNA, 22 bp, Homo sapiens
ttctcttcccactttctgtatt

SEQ ID NO: 7185013 - DNA, 22 bp, Homo sapiens
ttctcttcccactttctgtatt

SEQ ID NO: 7185014 - DNA, 22 bp, Homo sapiens
ttctcttcccactttctgtatt

SEQ ID NO: 7185015 - DNA, 22 bp, Homo sapiens
ttctcttcatctcagtaaatgt

SEQ ID NO: 7185016 - DNA, 22 bp, Homo sapiens
ttctcttcatctcagtaaatgt

SEQ ID NO: 7185017 - DNA, 22 bp, Homo sapiens
ttctcttcccactttctgtatt

SEQ ID NO: 7185018 - DNA, 17 bp, Homo sapiens
ttctcttcctggatagt

SEQ ID NO: 7185019 - DNA, 17 bp, Homo sapiens
ttctcttcctggatagt

SEQ ID NO: 7185020 - DNA, 23 bp, Homo sapiens
ttctctttagatttacattactc

SEQ ID NO: 7185021 - DNA, 23 bp, Homo sapiens
ttctctttagatttacattactc

SEQ ID NO: 7185022 - DNA, 23 bp, Homo sapiens
ttctctttagatttacattactc

SEQ ID NO: 7185023 - DNA, 22 bp, Homo sapiens
ttctgatgcatgggtctctgtt

SEQ ID NO: 7185024 - DNA, 22 bp, Homo sapiens
ttctgatggtggaatgcttcag

SEQ ID NO: 7185025 - DNA, 22 bp, Homo sapiens
ttctgatgatggcggctggagc

SEQ ID NO: 7185026 - DNA, 22 bp, Homo sapiens
ttctgatatagtgattgattta

SEQ ID NO: 7185027 - DNA, 22 bp, Homo sapiens
ttctgattgctgatgaggccca

SEQ ID NO: 7185028 - DNA, 22 bp, Homo sapiens
ttctgattgctgatgaggccca

SEQ ID NO: 7185029 - DNA, 22 bp, Homo sapiens
ttctgataccttgcaggatcct

SEQ ID NO: 7185030 - DNA, 22 bp, Homo sapiens
ttctgatacagtcccaacacaa

SEQ ID NO: 7185031 - DNA, 22 bp, Homo sapiens
ttctgataataccacatcgcag

SEQ ID NO: 7185032 - DNA, 22 bp, Homo sapiens
ttctgataacaaacaccaattt

SEQ ID NO: 7185033 - DNA, 22 bp, Homo sapiens
ttctgataacaaacaccaattt

SEQ ID NO: 7185034 - DNA, 22 bp, Homo sapiens
ttctgaggctttcccgtcccct

SEQ ID NO: 7185035 - DNA, 22 bp, Homo sapiens
ttctgaggctttcccgtcccct

SEQ ID NO: 7185036 - DNA, 22 bp, Homo sapiens
ttctgagggaggttctctggga

SEQ ID NO: 7185037 - DNA, 22 bp, Homo sapiens
ttctgagggctaatgtactgta

SEQ ID NO: 7185038 - DNA, 22 bp, Homo sapiens
ttctgaggtccatgcagtactg

SEQ ID NO: 7185039 - DNA, 22 bp, Homo sapiens
ttctgaggccattaccaataaa

SEQ ID NO: 7185040 - DNA, 22 bp, Homo sapiens
ttctgaggcatagaggatgaga

SEQ ID NO: 7185041 - DNA, 22 bp, Homo sapiens
ttctgaggcatagaggatgaga

SEQ ID NO: 7185042 - DNA, 22 bp, Homo sapiens
ttctgaggaggagcaaaaactc

SEQ ID NO: 7185043 - DNA, 22 bp, Homo sapiens
ttctgaggcactggctctccca

SEQ ID NO: 7185044 - DNA, 20 bp, Homo sapiens
ttctctttgggtccagagaa

SEQ ID NO: 7185045 - DNA, 22 bp, Homo sapiens
ttctcttttagaggctccatga

SEQ ID NO: 7185046 - DNA, 22 bp, Homo sapiens
ttctcttttagaggctccatga

SEQ ID NO: 7185047 - DNA, 22 bp, Homo sapiens
ttctctttgacattattcaggt

SEQ ID NO: 7185048 - DNA, 22 bp, Homo sapiens
ttctctttgacattattcaggt

SEQ ID NO: 7185049 - DNA, 22 bp, Homo sapiens
ttctctttatgtatttagtggg

SEQ ID NO: 7185050 - DNA, 22 bp, Homo sapiens
ttctctttctacagtgtgattg

SEQ ID NO: 7185051 - DNA, 22 bp, Homo sapiens
ttctgccaaaggctttgttttg

SEQ ID NO: 7185052 - DNA, 22 bp, Homo sapiens
ttctgccacgagcagtttcttc

SEQ ID NO: 7185053 - DNA, 23 bp, Homo sapiens
ttctgccactgaaaatgcctcag

SEQ ID NO: 7185054 - DNA, 22 bp, Homo sapiens
ttctgccagctcagagctctag

SEQ ID NO: 7185055 - DNA, 22 bp, Homo sapiens
ttctgccagggaattctgctta

SEQ ID NO: 7185056 - DNA, 22 bp, Homo sapiens
ttctgccagggaattctgctta

SEQ ID NO: 7185057 - DNA, 22 bp, Homo sapiens
ttctgcattgacttttatttcc

SEQ ID NO: 7185058 - DNA, 22 bp, Homo sapiens
ttctgcattggagtctattctt

SEQ ID NO: 7185059 - DNA, 22 bp, Homo sapiens
ttctgcatttaaaatattacta

SEQ ID NO: 7185060 - DNA, 22 bp, Homo sapiens
ttctgcaccgttacagcaagag

SEQ ID NO: 7185061 - DNA, 22 bp, Homo sapiens
ttctgcacaaattttaggttat

SEQ ID NO: 7185062 - DNA, 22 bp, Homo sapiens
ttctgcacccatagctgatgat

SEQ ID NO: 7185063 - DNA, 22 bp, Homo sapiens
ttctggaggacaactgttttca

SEQ ID NO: 7185064 - DNA, 22 bp, Homo sapiens
ttctggaggagaaagggtgggc

SEQ ID NO: 7185065 - DNA, 22 bp, Homo sapiens
ttctggaggagaaagggtgggc

SEQ ID NO: 7185066 - DNA, 22 bp, Homo sapiens
ttctggaggccagctgccacct

SEQ ID NO: 7185067 - DNA, 22 bp, Homo sapiens
ttctggaggccagctgccacct

SEQ ID NO: 7185068 - DNA, 22 bp, Homo sapiens
ttctggaggccccttccttctc

SEQ ID NO: 7185069 - DNA, 22 bp, Homo sapiens
ttctggaggcgggcgacctcgc

SEQ ID NO: 7185070 - DNA, 20 bp, Homo sapiens
ttctggaggctacaagtctg

SEQ ID NO: 7185071 - DNA, 20 bp, Homo sapiens
ttctggaggctacaagtctg

SEQ ID NO: 7185072 - DNA, 20 bp, Homo sapiens
ttctgcctagggttagcctg

SEQ ID NO: 7185073 - DNA, 22 bp, Homo sapiens
ttctgcctgatgtagtcatacc

SEQ ID NO: 7185074 - DNA, 22 bp, Homo sapiens
ttctgcctgatgtagtcatacc

SEQ ID NO: 7185075 - DNA, 22 bp, Homo sapiens
ttctggagcttggcttgtatgt

SEQ ID NO: 7185076 - DNA, 20 bp, Homo sapiens
ttctgcctagggttagcctg

SEQ ID NO: 7185077 - DNA, 20 bp, Homo sapiens
ttctgcctagggttagcctg

SEQ ID NO: 7185078 - DNA, 20 bp, Homo sapiens
ttctgcctagggttagcctg

SEQ ID NO: 7185079 - DNA, 19 bp, Homo sapiens
ttctgccctctcttctagc

SEQ ID NO: 7185080 - DNA, 22 bp, Homo sapiens
ttctgccagtgatcaataattg

SEQ ID NO: 7185081 - DNA, 22 bp, Homo sapiens
ttctttctctactagcagagct

SEQ ID NO: 7185082 - DNA, 22 bp, Homo sapiens
ttctttctctactagcagagct

SEQ ID NO: 7185083 - DNA, 22 bp, Homo sapiens
ttctttctctactagcagagct

SEQ ID NO: 7185084 - DNA, 22 bp, Homo sapiens
ttctttcttctcaggctgggta

SEQ ID NO: 7185085 - DNA, 22 bp, Homo sapiens
ttctttcttctcaggctgggta

SEQ ID NO: 7185086 - DNA, 22 bp, Homo sapiens
ttctttctcagtgggcagatac

SEQ ID NO: 7185087 - DNA, 22 bp, Homo sapiens
ttctttctcactctttaggaag

SEQ ID NO: 7185088 - DNA, 22 bp, Homo sapiens
ttctttctcactctttaggaag

SEQ ID NO: 7185089 - DNA, 22 bp, Homo sapiens
ttcttcttgaaactttaggttg

SEQ ID NO: 7185090 - DNA, 22 bp, Homo sapiens
ttcttcttcaagtgctgcattc

SEQ ID NO: 7185091 - DNA, 22 bp, Homo sapiens
ttcttcttcatttctgacgatg

SEQ ID NO: 7185092 - DNA, 22 bp, Homo sapiens
ttcttcttcatttctgacgatg

SEQ ID NO: 7185093 - DNA, 22 bp, Homo sapiens
ttcttctgttgaaagggtagag

SEQ ID NO: 7185094 - DNA, 22 bp, Homo sapiens
ttcttctgttggcagagcatac

SEQ ID NO: 7185095 - DNA, 22 bp, Homo sapiens
ttcttctgtgaggtgtgtgcct

SEQ ID NO: 7185096 - DNA, 22 bp, Homo sapiens
ttcttctgcctcccacctgata

SEQ ID NO: 7185097 - DNA, 22 bp, Homo sapiens
ttcttctgaaacataatcaata

SEQ ID NO: 7185098 - DNA, 22 bp, Homo sapiens
ttcttctgaaacataatcaata

SEQ ID NO: 7185099 - DNA, 22 bp, Homo sapiens
ttcttctctcatagattaaggt

SEQ ID NO: 7185100 - DNA, 20 bp, Homo sapiens
ttcttctctagttatcttca

SEQ ID NO: 7185101 - DNA, 20 bp, Homo sapiens
ttcttctctagttatcttca

SEQ ID NO: 7185102 - DNA, 20 bp, Homo sapiens
ttcttctctagttatcttca

SEQ ID NO: 7185103 - DNA, 20 bp, Homo sapiens
ttcttctctagttatcttca

SEQ ID NO: 7185104 - DNA, 22 bp, Homo sapiens
ttctttgagttagtacagtcca

SEQ ID NO: 7185105 - DNA, 22 bp, Homo sapiens
ttctttgaccaaacagttttcc

SEQ ID NO: 7185106 - DNA, 22 bp, Homo sapiens
ttctttctttgtagtcctgaac

SEQ ID NO: 7185107 - DNA, 22 bp, Homo sapiens
ttctttcttggggaacacactc

SEQ ID NO: 7185108 - DNA, 22 bp, Homo sapiens
ttctttcttggggaacacactc

SEQ ID NO: 7185109 - DNA, 19 bp, Homo sapiens
ttctttgagttcttctgag

SEQ ID NO: 7185110 - DNA, 22 bp, Homo sapiens
ttctttgcccatgtttcctaag

SEQ ID NO: 7185111 - DNA, 22 bp, Homo sapiens
ttctttgggcaattgctggccc

SEQ ID NO: 7185112 - DNA, 22 bp, Homo sapiens
ttctttgggctcagagagggag

SEQ ID NO: 7185113 - DNA, 22 bp, Homo sapiens
ttctttggggaatattctggtt

SEQ ID NO: 7185114 - DNA, 22 bp, Homo sapiens
ttcttctcggctgtcagatagt

SEQ ID NO: 7185115 - DNA, 22 bp, Homo sapiens
ttcttctcagggtcccacatgg

SEQ ID NO: 7185116 - DNA, 22 bp, Homo sapiens
ttcttctcagggtcccacatgg

SEQ ID NO: 7185117 - DNA, 22 bp, Homo sapiens
ttcttctcagggtcccacatgg

SEQ ID NO: 7185118 - DNA, 23 bp, Homo sapiens
ttcttctcaattagttgattcag

SEQ ID NO: 7185119 - DNA, 22 bp, Homo sapiens
ttcttcctctgtaaaaggtgac

SEQ ID NO: 7185120 - DNA, 22 bp, Homo sapiens
ttcttccttggtttcctggata

SEQ ID NO: 7185121 - DNA, 22 bp, Homo sapiens
ttcttccttggtttcctggata

SEQ ID NO: 7185122 - DNA, 22 bp, Homo sapiens
ttcttctaaatgtgcttattaa

SEQ ID NO: 7185123 - DNA, 22 bp, Homo sapiens
ttcttctacctctgagacttgt

SEQ ID NO: 7185124 - DNA, 22 bp, Homo sapiens
ttcttctagagttcagaagcca

SEQ ID NO: 7185125 - DNA, 23 bp, Homo sapiens
ttcttctcaattagttgattcag

SEQ ID NO: 7185126 - DNA, 23 bp, Homo sapiens
ttcttctcaattagttgattcag

SEQ ID NO: 7185127 - DNA, 22 bp, Homo sapiens
ttcttcctcagcagggctgcct

SEQ ID NO: 7185128 - DNA, 22 bp, Homo sapiens
ttcttcagatcctacaagtctg

SEQ ID NO: 7185129 - DNA, 22 bp, Homo sapiens
ttcttcagagagtagaagcaag

SEQ ID NO: 7185130 - DNA, 22 bp, Homo sapiens
ttctgggcacacaggccctggt

SEQ ID NO: 7185131 - DNA, 22 bp, Homo sapiens
ttctgggaggctggctgtcata

SEQ ID NO: 7185132 - DNA, 20 bp, Homo sapiens
ttctgggatgcctgcatctt

SEQ ID NO: 7185133 - DNA, 22 bp, Homo sapiens
ttctgggatgtgaatggtttaa

SEQ ID NO: 7185134 - DNA, 22 bp, Homo sapiens
ttctgggaggcctttgtgtctg

SEQ ID NO: 7185135 - DNA, 22 bp, Homo sapiens
ttctgggaggatgggaaatcat

SEQ ID NO: 7185136 - DNA, 22 bp, Homo sapiens
ttctgggacattgcaggtattc

SEQ ID NO: 7185137 - DNA, 22 bp, Homo sapiens
ttctgggagaatctaaatggtt

SEQ ID NO: 7185138 - DNA, 22 bp, Homo sapiens
ttctgggagagaaagggccttg

SEQ ID NO: 7185139 - DNA, 22 bp, Homo sapiens
ttctgggagagaaagggccttg

SEQ ID NO: 7185140 - DNA, 21 bp, Homo sapiens
ttctgggaaatgagctggggc

SEQ ID NO: 7185141 - DNA, 22 bp, Homo sapiens
ttctgggaacaaagtggagtgg

SEQ ID NO: 7185142 - DNA, 22 bp, Homo sapiens
ttctggctttggagaggatagc

SEQ ID NO: 7185143 - DNA, 22 bp, Homo sapiens
ttctggagttgtgacctcaggg

SEQ ID NO: 7185144 - DNA, 22 bp, Homo sapiens
ttctggagttcaggtccctaaa

SEQ ID NO: 7185145 - DNA, 22 bp, Homo sapiens
ttctggagttgtgacctcaggg

SEQ ID NO: 7185146 - DNA, 22 bp, Homo sapiens
ttctggagtttgaagatcaggt

SEQ ID NO: 7185147 - DNA, 22 bp, Homo sapiens
ttctggagtttgaagatcaggt

SEQ ID NO: 7185148 - DNA, 22 bp, Homo sapiens
ttctggataggggtatggagct

SEQ ID NO: 7185149 - DNA, 22 bp, Homo sapiens
ttctggatataacattcagtcc

SEQ ID NO: 7185150 - DNA, 22 bp, Homo sapiens
ttctggatatggattttggtga

SEQ ID NO: 7185151 - DNA, 22 bp, Homo sapiens
ttctggatatgggagagggagc

SEQ ID NO: 7185152 - DNA, 22 bp, Homo sapiens
ttctggatatgggagagggagc

SEQ ID NO: 7185153 - DNA, 22 bp, Homo sapiens
ttctggatctgagggggaagat

SEQ ID NO: 7185154 - DNA, 22 bp, Homo sapiens
ttctggatgatccatttacaga

SEQ ID NO: 7185155 - DNA, 22 bp, Homo sapiens
ttctggagtcattggggctgat

SEQ ID NO: 7185156 - DNA, 22 bp, Homo sapiens
ttctggagtattcctggcacct

SEQ ID NO: 7185157 - DNA, 22 bp, Homo sapiens
ttctggagtattcctggcacct

SEQ ID NO: 7185158 - DNA, 22 bp, Homo sapiens
ttctggagtattcctggcagcc

SEQ ID NO: 7185159 - DNA, 22 bp, Homo sapiens
ttctggagtcccacagccaggg

SEQ ID NO: 7185160 - DNA, 22 bp, Homo sapiens
ttctggagtcttcaattttaga

SEQ ID NO: 7185161 - DNA, 22 bp, Homo sapiens
ttctggagtgataaaacaccac

SEQ ID NO: 7185162 - DNA, 22 bp, Homo sapiens
ttctggagtgtattgggtctgc

SEQ ID NO: 7185163 - DNA, 22 bp, Homo sapiens
ttctggagtgtggaccgctgtt

SEQ ID NO: 7185164 - DNA, 22 bp, Homo sapiens
ttctggaggctccagggaagaa

SEQ ID NO: 7185165 - DNA, 22 bp, Homo sapiens
ttctggaggctctaagggacaa

SEQ ID NO: 7185166 - DNA, 22 bp, Homo sapiens
ttctggagggcatgctgctgcc

SEQ ID NO: 7185167 - DNA, 22 bp, Homo sapiens
ttctggagggcatgctgctgcc

SEQ ID NO: 7185168 - DNA, 22 bp, Homo sapiens
ttctggagggcctgatcacaca

SEQ ID NO: 7185169 - DNA, 22 bp, Homo sapiens
ttctggaggtgtgaccattagc

SEQ ID NO: 7185170 - DNA, 19 bp, Homo sapiens
ttctggaggttaccctgag

SEQ ID NO: 7185171 - DNA, 22 bp, Homo sapiens
ttctggaggttattaggagtct

SEQ ID NO: 7185172 - DNA, 22 bp, Homo sapiens
ttgaaacagtagctcatagacc

SEQ ID NO: 7185173 - DNA, 22 bp, Homo sapiens
ttgaaacagtagctcatagacc

SEQ ID NO: 7185174 - DNA, 22 bp, Homo sapiens
ttgaaaatggtaagcatgatat

SEQ ID NO: 7185175 - DNA, 20 bp, Homo sapiens
ttgaaaatgcattgtgcagt

SEQ ID NO: 7185176 - DNA, 20 bp, Homo sapiens
ttgaaaatgcattgtgcagt

SEQ ID NO: 7185177 - DNA, 20 bp, Homo sapiens
ttgaaaatgcattgtgcagt

SEQ ID NO: 7185178 - DNA, 19 bp, Homo sapiens
ttgaaaatatggatctgag

SEQ ID NO: 7185179 - DNA, 19 bp, Homo sapiens
ttgaaaatatggatctgag

SEQ ID NO: 7185180 - DNA, 22 bp, Homo sapiens
ttgaaaatatcacaggagcagc

SEQ ID NO: 7185181 - DNA, 22 bp, Homo sapiens
ttgaaaatatcacaggagcagc

SEQ ID NO: 7185182 - DNA, 22 bp, Homo sapiens
ttgaaaatatcacaggagcagc

SEQ ID NO: 7185183 - DNA, 17 bp, Homo sapiens
ttgaaaagtaagctccc

SEQ ID NO: 7185184 - DNA, 23 bp, Homo sapiens
ttgaaaaatatagtcccattgtc

SEQ ID NO: 7185185 - DNA, 22 bp, Homo sapiens
ttgaaaaaattggtagaggatg

SEQ ID NO: 7185186 - DNA, 22 bp, Homo sapiens
ttctttttggatagctgatgaa

SEQ ID NO: 7185187 - DNA, 22 bp, Homo sapiens
ttgaaaaaattggtagaggatg

SEQ ID NO: 7185188 - DNA, 22 bp, Homo sapiens
ttctttttatcttcccataaga

SEQ ID NO: 7185189 - DNA, 22 bp, Homo sapiens
ttctttttatcttcccataaga

SEQ ID NO: 7185190 - DNA, 22 bp, Homo sapiens
ttctttttggatagctgatgaa

SEQ ID NO: 7185191 - DNA, 22 bp, Homo sapiens
ttctttttggatagctgatgaa

SEQ ID NO: 7185192 - DNA, 22 bp, Homo sapiens
ttctttttatcttcccataaga

SEQ ID NO: 7185193 - DNA, 22 bp, Homo sapiens
ttctttttggatagctgatgaa

SEQ ID NO: 7185194 - DNA, 23 bp, Homo sapiens
ttgacagtaggtggttttcattg

SEQ ID NO: 7185195 - DNA, 22 bp, Homo sapiens
ttgacagtatagctttacctat

SEQ ID NO: 7185196 - DNA, 22 bp, Homo sapiens
ttgaaaggaatacagaggccta

SEQ ID NO: 7185197 - DNA, 23 bp, Homo sapiens
ttgaaagattgctaagtaaaaat

SEQ ID NO: 7185198 - DNA, 23 bp, Homo sapiens
ttgaaagattgctaagtaaaaat

SEQ ID NO: 7185199 - DNA, 23 bp, Homo sapiens
ttgaaagattgctaagtaaaaat

SEQ ID NO: 7185200 - DNA, 19 bp, Homo sapiens
ttgaaagattagctttcta

SEQ ID NO: 7185201 - DNA, 19 bp, Homo sapiens
ttgaaagattagctttcta

SEQ ID NO: 7185202 - DNA, 22 bp, Homo sapiens
ttgaaagatatgttaatctttc

SEQ ID NO: 7185203 - DNA, 22 bp, Homo sapiens
ttgaaagatatgttaatctttc

SEQ ID NO: 7185204 - DNA, 22 bp, Homo sapiens
ttgaaagatatgttaatctttc

SEQ ID NO: 7185205 - DNA, 21 bp, Homo sapiens
ttgaccaagggtgcgtgctcc

SEQ ID NO: 7185206 - DNA, 22 bp, Homo sapiens
ttgaccactgaatggttctgaa

SEQ ID NO: 7185207 - DNA, 21 bp, Homo sapiens
ttgaccaagggtgcgtgctcc

SEQ ID NO: 7185208 - DNA, 22 bp, Homo sapiens
ttgaccactgaatggttctgaa

SEQ ID NO: 7185209 - DNA, 22 bp, Homo sapiens
ttgacattttgtcatattgaca

SEQ ID NO: 7185210 - DNA, 22 bp, Homo sapiens
ttgagaaacctggcagtagaga

SEQ ID NO: 7185211 - DNA, 22 bp, Homo sapiens
ttgagaaactaacggcttgagc

SEQ ID NO: 7185212 - DNA, 22 bp, Homo sapiens
ttgagaaactaacggcttgagc

SEQ ID NO: 7185213 - DNA, 22 bp, Homo sapiens
ttgagaaactctgggttagaat

SEQ ID NO: 7185214 - DNA, 22 bp, Homo sapiens
ttgagaaactctgggttagaat

SEQ ID NO: 7185215 - DNA, 22 bp, Homo sapiens
ttgagaaacctggcagtagaga

SEQ ID NO: 7185216 - DNA, 22 bp, Homo sapiens
ttgaaagaaggtggtagagaat

SEQ ID NO: 7185217 - DNA, 22 bp, Homo sapiens
ttgaaagacattatttatatat

SEQ ID NO: 7185218 - DNA, 22 bp, Homo sapiens
ttgaaagacattatttatatat

SEQ ID NO: 7185219 - DNA, 22 bp, Homo sapiens
ttgaaagatagtgaagccagcc

SEQ ID NO: 7185220 - DNA, 22 bp, Homo sapiens
ttgaaagaacaattctgtgatg

SEQ ID NO: 7185221 - DNA, 22 bp, Homo sapiens
ttgaaagaacaattctgtgatg

SEQ ID NO: 7185222 - DNA, 22 bp, Homo sapiens
ttgaaagaacaattctgtgatg

SEQ ID NO: 7185223 - DNA, 22 bp, Homo sapiens
ttgaaagaactcttcagagata

SEQ ID NO: 7185224 - DNA, 22 bp, Homo sapiens
ttgaaagaagaagctgcgatgt

SEQ ID NO: 7185225 - DNA, 22 bp, Homo sapiens
ttgaaagaaggtggtagagaat

SEQ ID NO: 7185226 - DNA, 22 bp, Homo sapiens
ttgaaactcatcttagtgatgt

SEQ ID NO: 7185227 - DNA, 22 bp, Homo sapiens
ttgaaactcccttttgtctagt

SEQ ID NO: 7185228 - DNA, 22 bp, Homo sapiens
ttgaaactgcttattgaatttg

SEQ ID NO: 7185229 - DNA, 22 bp, Homo sapiens
ttgaaactgggaagcagggggt

SEQ ID NO: 7185230 - DNA, 22 bp, Homo sapiens
ttgaaactgtcagcttttacgc

SEQ ID NO: 7185231 - DNA, 22 bp, Homo sapiens
ttgaaactttagtaaactaagg

SEQ ID NO: 7185232 - DNA, 21 bp, Homo sapiens
ttgaggggtattgcttttctc

SEQ ID NO: 7185233 - DNA, 22 bp, Homo sapiens
ttgagggtctggatctgctgct

SEQ ID NO: 7185234 - DNA, 19 bp, Homo sapiens
ttgaggggccaggggagat

SEQ ID NO: 7185235 - DNA, 22 bp, Homo sapiens
ttgagggatttacagaggtggg

SEQ ID NO: 7185236 - DNA, 19 bp, Homo sapiens
ttgaggggccaggggagat

SEQ ID NO: 7185237 - DNA, 22 bp, Homo sapiens
ttgagggagcctgggagccatg

SEQ ID NO: 7185238 - DNA, 18 bp, Homo sapiens
ttgagggaggggcagagt

SEQ ID NO: 7185239 - DNA, 18 bp, Homo sapiens
ttgagggaggggcagagt

SEQ ID NO: 7185240 - DNA, 22 bp, Homo sapiens
ttgagggatttacagaggtggg

SEQ ID NO: 7185241 - DNA, 22 bp, Homo sapiens
ttgaggtaataaacagccattc

SEQ ID NO: 7185242 - DNA, 22 bp, Homo sapiens
ttgaggtagttctattgtgagt

SEQ ID NO: 7185243 - DNA, 22 bp, Homo sapiens
ttgaggtatattcacatatatc

SEQ ID NO: 7185244 - DNA, 22 bp, Homo sapiens
ttgaggctgcacagtacaggct

SEQ ID NO: 7185245 - DNA, 22 bp, Homo sapiens
ttgaggccccatggatgagaac

SEQ ID NO: 7185246 - DNA, 22 bp, Homo sapiens
ttgaggccccatggatgagaac

SEQ ID NO: 7185247 - DNA, 22 bp, Homo sapiens
ttgaggcccggcaggccgagcg

SEQ ID NO: 7185248 - DNA, 22 bp, Homo sapiens
ttgaggcctgctggaaggtgtt

SEQ ID NO: 7185249 - DNA, 22 bp, Homo sapiens
ttgaggctgcacagtacaggct

SEQ ID NO: 7185250 - DNA, 22 bp, Homo sapiens
ttgagagtgccaagcatcctcc

SEQ ID NO: 7185251 - DNA, 22 bp, Homo sapiens
ttgagagtgccaagcatcctcc

SEQ ID NO: 7185252 - DNA, 22 bp, Homo sapiens
ttgagagtggcttgttgactgc

SEQ ID NO: 7185253 - DNA, 22 bp, Homo sapiens
ttgagagttaccagcagaggaa

SEQ ID NO: 7185254 - DNA, 22 bp, Homo sapiens
ttgagagttctgaatgagtaac

SEQ ID NO: 7185255 - DNA, 22 bp, Homo sapiens
ttgagagtttgggggcaatatg

SEQ ID NO: 7185256 - DNA, 22 bp, Homo sapiens
ttgagagttttcaatagattgg

SEQ ID NO: 7185257 - DNA, 22 bp, Homo sapiens
ttgagatacattgggaaatgcc

SEQ ID NO: 7185258 - DNA, 22 bp, Homo sapiens
ttgagatagatctcatcttccc

SEQ ID NO: 7185259 - DNA, 22 bp, Homo sapiens
ttgagagtagagatggcagggc

SEQ ID NO: 7185260 - DNA, 22 bp, Homo sapiens
ttgagagtcatttaaggtgttg

SEQ ID NO: 7185261 - DNA, 22 bp, Homo sapiens
ttgagagtcgattttgaactag

SEQ ID NO: 7185262 - DNA, 22 bp, Homo sapiens
ttgagagtctatcaaatagctt

SEQ ID NO: 7185263 - DNA, 22 bp, Homo sapiens
ttgagagtctgagtttggacta

SEQ ID NO: 7185264 - DNA, 22 bp, Homo sapiens
ttgagacactttgggcatcact

SEQ ID NO: 7185265 - DNA, 22 bp, Homo sapiens
ttgagacagtatctttgttggc

SEQ ID NO: 7185266 - DNA, 22 bp, Homo sapiens
ttgagacagtggggtgttgccg

SEQ ID NO: 7185267 - DNA, 22 bp, Homo sapiens
ttgagacagtggggtgttgccg

SEQ ID NO: 7185268 - DNA, 22 bp, Homo sapiens
ttgagactcgagtctctcagac

SEQ ID NO: 7185269 - DNA, 22 bp, Homo sapiens
ttgagactcgagtctctcagac

SEQ ID NO: 7185270 - DNA, 22 bp, Homo sapiens
ttgagactgagtctcgccctgt

SEQ ID NO: 7185271 - DNA, 22 bp, Homo sapiens
ttgagactgccttgtcgtctgc

SEQ ID NO: 7185272 - DNA, 22 bp, Homo sapiens
ttgagacacagtttcactctgt

SEQ ID NO: 7185273 - DNA, 22 bp, Homo sapiens
ttgagacaccaaactttcctaa

SEQ ID NO: 7185274 - DNA, 22 bp, Homo sapiens
ttgagacaccaaactttcctaa

SEQ ID NO: 7185275 - DNA, 22 bp, Homo sapiens
ttgagaatgtgttttgctaagt

SEQ ID NO: 7185276 - DNA, 19 bp, Homo sapiens
ttgagaattatctgagtca

SEQ ID NO: 7185277 - DNA, 22 bp, Homo sapiens
ttgagacacaaggcacagtaag

SEQ ID NO: 7185278 - DNA, 22 bp, Homo sapiens
ttgagacacaaggcacagtaag

SEQ ID NO: 7185279 - DNA, 22 bp, Homo sapiens
ttgagaacaggagtgttctttt

SEQ ID NO: 7185280 - DNA, 23 bp, Homo sapiens
ttgagaacaggtgtgagaatggc

SEQ ID NO: 7185281 - DNA, 22 bp, Homo sapiens
ttgagaaccactgagttagata

SEQ ID NO: 7185282 - DNA, 22 bp, Homo sapiens
ttgagaaccactgagttagata

SEQ ID NO: 7185283 - DNA, 22 bp, Homo sapiens
ttgagaactactttattattct

SEQ ID NO: 7185284 - DNA, 22 bp, Homo sapiens
ttgagaactctgtatgtccagc

SEQ ID NO: 7185285 - DNA, 22 bp, Homo sapiens
ttgagaactctgtatgtccagc

SEQ ID NO: 7185286 - DNA, 22 bp, Homo sapiens
ttgagaataaattagcagacat

SEQ ID NO: 7185287 - DNA, 22 bp, Homo sapiens
ttgagaataaattagcagacat

SEQ ID NO: 7185288 - DNA, 22 bp, Homo sapiens
ttgagaatgatgagattcttcc

SEQ ID NO: 7185289 - DNA, 22 bp, Homo sapiens
ttgagaatgatgagattcttcc

SEQ ID NO: 7185290 - DNA, 22 bp, Homo sapiens
ttgagaaatgttttttaagctg

SEQ ID NO: 7185291 - DNA, 19 bp, Homo sapiens
ttgagaacaccaagtactg

SEQ ID NO: 7185292 - DNA, 19 bp, Homo sapiens
ttgagaacaccaagtactg

SEQ ID NO: 7185293 - DNA, 22 bp, Homo sapiens
ttgagaaatgttttttaagctg

SEQ ID NO: 7185294 - DNA, 16 bp, Homo sapiens
ttgagaaatgaagttt

SEQ ID NO: 7185295 - DNA, 19 bp, Homo sapiens
ttgagaaatgggaaaagca

SEQ ID NO: 7185296 - DNA, 22 bp, Homo sapiens
ttgagaaatacttttgtagcct

SEQ ID NO: 7185297 - DNA, 22 bp, Homo sapiens
ttgagaaatacttttgtagcct

SEQ ID NO: 7185298 - DNA, 22 bp, Homo sapiens
ttgagaaatacttttgtagcct

SEQ ID NO: 7185299 - DNA, 22 bp, Homo sapiens
ttgagaaataagcatgtctaga

SEQ ID NO: 7185300 - DNA, 18 bp, Homo sapiens
ttgagaaataagcactaa

SEQ ID NO: 7185301 - DNA, 22 bp, Homo sapiens
ttgagaaataagcatgtctaga

SEQ ID NO: 7185302 - DNA, 18 bp, Homo sapiens
ttgagaaataagcactaa

SEQ ID NO: 7185303 - DNA, 18 bp, Homo sapiens
ttgagaaataagcactaa

SEQ ID NO: 7185304 - DNA, 22 bp, Homo sapiens
ttgagaaactctgggttagaat

SEQ ID NO: 7185305 - DNA, 22 bp, Homo sapiens
ttgagaaaggggtcaatatctc

SEQ ID NO: 7185306 - DNA, 22 bp, Homo sapiens
ttgagaaaggggtcaatatctc

SEQ ID NO: 7185307 - DNA, 22 bp, Homo sapiens
ttgagaaaggtaagaacccaca

SEQ ID NO: 7185308 - DNA, 19 bp, Homo sapiens
ttgagaaagttgatttggg

SEQ ID NO: 7185309 - DNA, 19 bp, Homo sapiens
ttgagaaagttgatttggg

SEQ ID NO: 7185310 - DNA, 22 bp, Homo sapiens
ttgtattccagccaccacaggc

SEQ ID NO: 7185311 - DNA, 22 bp, Homo sapiens
ttgtattcatttggccatactg

SEQ ID NO: 7185312 - DNA, 22 bp, Homo sapiens
ttgtattcattgcttacccaat

SEQ ID NO: 7185313 - DNA, 22 bp, Homo sapiens
ttgtattagctgtaaattttct

SEQ ID NO: 7185314 - DNA, 22 bp, Homo sapiens
ttgtattagctgtaaattttct

SEQ ID NO: 7185315 - DNA, 22 bp, Homo sapiens
ttgtattagctgtaaattttct

SEQ ID NO: 7185316 - DNA, 22 bp, Homo sapiens
ttgtattaattgaaatgaatgc

SEQ ID NO: 7185317 - DNA, 22 bp, Homo sapiens
ttgtattaattgaaatgaatgc

SEQ ID NO: 7185318 - DNA, 22 bp, Homo sapiens
ttgtattaattgaaatgaatgc

SEQ ID NO: 7185319 - DNA, 22 bp, Homo sapiens
ttgtattaaaatgtgtttctgt

SEQ ID NO: 7185320 - DNA, 22 bp, Homo sapiens
ttgtattaattgaaatgaatgc

SEQ ID NO: 7185321 - DNA, 22 bp, Homo sapiens
ttgtattctgttacagcaacat

SEQ ID NO: 7185322 - DNA, 20 bp, Homo sapiens
ttgtattccttgaatcaggt

SEQ ID NO: 7185323 - DNA, 20 bp, Homo sapiens
ttgtattccttgaatcaggt

SEQ ID NO: 7185324 - DNA, 22 bp, Homo sapiens
ttgtattcctgggtcaaggaga

SEQ ID NO: 7185325 - DNA, 22 bp, Homo sapiens
ttgtattccagccaccacaggc

SEQ ID NO: 7185326 - DNA, 22 bp, Homo sapiens
ttgtattcttccttagcagtac

SEQ ID NO: 7185327 - DNA, 22 bp, Homo sapiens
ttgtattcttccttagcagtac

SEQ ID NO: 7185328 - DNA, 22 bp, Homo sapiens
ttgtattctttatgacttccct

SEQ ID NO: 7185329 - DNA, 22 bp, Homo sapiens
ttgtattggcaaagaacttgag

SEQ ID NO: 7185330 - DNA, 22 bp, Homo sapiens
ttgtatttatattgaatagctt

SEQ ID NO: 7185331 - DNA, 22 bp, Homo sapiens
ttgtatttatattgaatagctt

SEQ ID NO: 7185332 - DNA, 22 bp, Homo sapiens
ttgtatttatattgaatagctt

SEQ ID NO: 7185333 - DNA, 22 bp, Homo sapiens
ttgtatttcctataacctttct

SEQ ID NO: 7185334 - DNA, 22 bp, Homo sapiens
ttgtatttcctataacctttct

SEQ ID NO: 7185335 - DNA, 22 bp, Homo sapiens
ttgtatttcctataacctttct

SEQ ID NO: 7185336 - DNA, 22 bp, Homo sapiens
ttgtatgatcaaaagaaatgta

SEQ ID NO: 7185337 - DNA, 22 bp, Homo sapiens
ttgtatgagtatggtgtatagg

SEQ ID NO: 7185338 - DNA, 22 bp, Homo sapiens
ttgtatgtaccacaggtggtgg

SEQ ID NO: 7185339 - DNA, 22 bp, Homo sapiens
ttgtatgtctcaatatcctgtc

SEQ ID NO: 7185340 - DNA, 22 bp, Homo sapiens
ttgtatgtctcaatatcctgtc

SEQ ID NO: 7185341 - DNA, 22 bp, Homo sapiens
ttgtatcaatgccaggagaaat

SEQ ID NO: 7185342 - DNA, 22 bp, Homo sapiens
ttgtatcactccaccagctgag

SEQ ID NO: 7185343 - DNA, 20 bp, Homo sapiens
ttgtatcagtgtctcccaaa

SEQ ID NO: 7185344 - DNA, 22 bp, Homo sapiens
ttgtatcagttagctattgctg

SEQ ID NO: 7185345 - DNA, 22 bp, Homo sapiens
ttgtatcatcattatcagtctg

SEQ ID NO: 7185346 - DNA, 23 bp, Homo sapiens
ttgtatctctggaaattcttcaa

SEQ ID NO: 7185347 - DNA, 23 bp, Homo sapiens
ttgtatctctggaaattcttcaa

SEQ ID NO: 7185348 - DNA, 22 bp, Homo sapiens
ttgtatgaatgtatcctaattt

SEQ ID NO: 7185349 - DNA, 22 bp, Homo sapiens
ttgtatcagtgcctataaaatg

SEQ ID NO: 7185350 - DNA, 22 bp, Homo sapiens
ttgtatatattcttaaagatgt

SEQ ID NO: 7185351 - DNA, 22 bp, Homo sapiens
ttgtagtggccaaagaactctt

SEQ ID NO: 7185352 - DNA, 22 bp, Homo sapiens
ttgtatacaggtcttgtccatt

SEQ ID NO: 7185353 - DNA, 22 bp, Homo sapiens
ttgtatagcccagagagtgaga

SEQ ID NO: 7185354 - DNA, 22 bp, Homo sapiens
ttgtatagcccagagagtgaga

SEQ ID NO: 7185355 - DNA, 22 bp, Homo sapiens
ttgtatagcccagagagtgaga

SEQ ID NO: 7185356 - DNA, 22 bp, Homo sapiens
ttgtagaacatgcagcacaatg

SEQ ID NO: 7185357 - DNA, 22 bp, Homo sapiens
ttgtagaaaattagatgcatgg

SEQ ID NO: 7185358 - DNA, 22 bp, Homo sapiens
ttgtagaaaattagatgcatgg

SEQ ID NO: 7185359 - DNA, 22 bp, Homo sapiens
ttgtagaagcagggtgccctct

SEQ ID NO: 7185360 - DNA, 22 bp, Homo sapiens
ttgtagaatcattatttctagt

SEQ ID NO: 7185361 - DNA, 22 bp, Homo sapiens
ttgtagacatctgtatcatttt

SEQ ID NO: 7185362 - DNA, 22 bp, Homo sapiens
ttgtagatataaattttattgt

SEQ ID NO: 7185363 - DNA, 18 bp, Homo sapiens
ttgtagcaaatggcagtg

SEQ ID NO: 7185364 - DNA, 22 bp, Homo sapiens
ttgtagcaagcttgtaagttca

SEQ ID NO: 7185365 - DNA, 22 bp, Homo sapiens
ttgtagcagggatcagaataca

SEQ ID NO: 7185366 - DNA, 22 bp, Homo sapiens
ttgtagcagggatcagaataca

SEQ ID NO: 7185367 - DNA, 22 bp, Homo sapiens
ttgtagcagttctggactgcga

SEQ ID NO: 7185368 - DNA, 22 bp, Homo sapiens
ttgtagcatcaatcagtacttt

SEQ ID NO: 7185369 - DNA, 22 bp, Homo sapiens
ttgtagcatcaatcagtacttt

SEQ ID NO: 7185370 - DNA, 22 bp, Homo sapiens
ttgtagcattttaaatgagcat

SEQ ID NO: 7185371 - DNA, 22 bp, Homo sapiens
ttggggctctgaaaaagatgta

SEQ ID NO: 7185372 - DNA, 22 bp, Homo sapiens
ttggggcatgattagattatga

SEQ ID NO: 7185373 - DNA, 22 bp, Homo sapiens
ttggggcagttattctgtgccc

SEQ ID NO: 7185374 - DNA, 20 bp, Homo sapiens
ttggggcatccaccgaatgg

SEQ ID NO: 7185375 - DNA, 20 bp, Homo sapiens
ttggggcatccaccgaatgg

SEQ ID NO: 7185376 - DNA, 20 bp, Homo sapiens
ttggggcatccaccgaatgg

SEQ ID NO: 7185377 - DNA, 22 bp, Homo sapiens
ttggggcatgattagattatga

SEQ ID NO: 7185378 - DNA, 22 bp, Homo sapiens
ttggggcatgattagattatga

SEQ ID NO: 7185379 - DNA, 22 bp, Homo sapiens
ttggggggttgaggagtagata

SEQ ID NO: 7185380 - DNA, 22 bp, Homo sapiens
ttggggggttgaggagtagata

SEQ ID NO: 7185381 - DNA, 22 bp, Homo sapiens
ttggggggttgaggagtagata

SEQ ID NO: 7185382 - DNA, 22 bp, Homo sapiens
ttggggggttgaggagtagata

SEQ ID NO: 7185383 - DNA, 19 bp, Homo sapiens
ttggggtgaatgccagaca

SEQ ID NO: 7185384 - DNA, 18 bp, Homo sapiens
ttggggtgaggccaggaa

SEQ ID NO: 7185385 - DNA, 22 bp, Homo sapiens
ttgtactgatatgaagaatcaa

SEQ ID NO: 7185386 - DNA, 22 bp, Homo sapiens
ttgtgccaagaacatggaattt

SEQ ID NO: 7185387 - DNA, 22 bp, Homo sapiens
ttgtgcctggcttgtattcaca

SEQ ID NO: 7185388 - DNA, 22 bp, Homo sapiens
ttgtgctaagtgctatgaaggc

SEQ ID NO: 7185389 - DNA, 22 bp, Homo sapiens
ttgtgctagaaccagtacagaa

SEQ ID NO: 7185390 - DNA, 22 bp, Homo sapiens
ttgtgctcctatgagaatctaa

SEQ ID NO: 7185391 - DNA, 22 bp, Homo sapiens
ttgtgctcctatgagaatctaa

SEQ ID NO: 7185392 - DNA, 22 bp, Homo sapiens
ttgtgcatttctctgagtgtgt

SEQ ID NO: 7185393 - DNA, 22 bp, Homo sapiens
ttgtgcatgcatacgtatgtgt

SEQ ID NO: 7185394 - DNA, 22 bp, Homo sapiens
ttgtgcatggagaaggcagggc

SEQ ID NO: 7185395 - DNA, 22 bp, Homo sapiens
ttgtgcagagaaatctttcttg

SEQ ID NO: 7185396 - DNA, 22 bp, Homo sapiens
ttgtgcagctataaagaaatgg

SEQ ID NO: 7185397 - DNA, 22 bp, Homo sapiens
ttgtgcatattaggtacatgct

SEQ ID NO: 7185398 - DNA, 22 bp, Homo sapiens
ttgtgcatattaggtacatgct

SEQ ID NO: 7185399 - DNA, 22 bp, Homo sapiens
ttgtgcatctcatggtgggcca

SEQ ID NO: 7185400 - DNA, 22 bp, Homo sapiens
ttgtgcaagaattggaaagcaa

SEQ ID NO: 7185401 - DNA, 22 bp, Homo sapiens
ttgtgcaatttaaaatcttcct

SEQ ID NO: 7185402 - DNA, 22 bp, Homo sapiens
ttgtatttcctataacctttct

SEQ ID NO: 7185403 - DNA, 23 bp, Homo sapiens
ttgtgagaccttggaagaagtat

SEQ ID NO: 7185404 - DNA, 22 bp, Homo sapiens
ttgtgagactcgtaagagaagg

SEQ ID NO: 7185405 - DNA, 22 bp, Homo sapiens
ttgtgagagccaaacatgtaag

SEQ ID NO: 7185406 - DNA, 22 bp, Homo sapiens
ttgtgagatgtctactgaagaa

SEQ ID NO: 7185407 - DNA, 22 bp, Homo sapiens
ttgtgagcaccagaggttgttc

SEQ ID NO: 7185408 - DNA, 22 bp, Homo sapiens
ttgtgctctgtgttatttaagg

SEQ ID NO: 7185409 - DNA, 22 bp, Homo sapiens
ttgtgctgactgcgcccagctc

SEQ ID NO: 7185410 - DNA, 22 bp, Homo sapiens
ttgtgctgagcttctagctgtg

SEQ ID NO: 7185411 - DNA, 22 bp, Homo sapiens
ttgtgctgcgtaggacgtggac

SEQ ID NO: 7185412 - DNA, 22 bp, Homo sapiens
ttgtgctctgtgttatttaagg

SEQ ID NO: 7185413 - DNA, 22 bp, Homo sapiens
ttgtgctcctatgagaatctaa

SEQ ID NO: 7185414 - DNA, 22 bp, Homo sapiens
ttgtgctcctgtgagaatctag

SEQ ID NO: 7185415 - DNA, 22 bp, Homo sapiens
ttgtgctcctgtgagaatctag

SEQ ID NO: 7185416 - DNA, 22 bp, Homo sapiens
ttgtgctcctgtgagaatctag

SEQ ID NO: 7185417 - DNA, 22 bp, Homo sapiens
ttgtgctgcgtaggacgtggac

SEQ ID NO: 7185418 - DNA, 22 bp, Homo sapiens
ttgtgctgctgacttaagatat

SEQ ID NO: 7185419 - DNA, 22 bp, Homo sapiens
ttgtgctgtatcatatttgtat

SEQ ID NO: 7185420 - DNA, 22 bp, Homo sapiens
ttgtgctgctgacttaagatat

SEQ ID NO: 7185421 - DNA, 22 bp, Homo sapiens
ttgtgctgtatcatatttgtat

SEQ ID NO: 7185422 - DNA, 22 bp, Homo sapiens
ttgtgctgtgagaatgctcatt

SEQ ID NO: 7185423 - DNA, 22 bp, Homo sapiens
ttgtgcttaagcaagctttctt

SEQ ID NO: 7185424 - DNA, 22 bp, Homo sapiens
ttgtgcttgccctggaggtgcg

SEQ ID NO: 7185425 - DNA, 22 bp, Homo sapiens
ttgtgcttttctagggatgagg

SEQ ID NO: 7185426 - DNA, 22 bp, Homo sapiens
ttgtgcttttgagctgagatga

SEQ ID NO: 7185427 - DNA, 22 bp, Homo sapiens
ttgtgctttggaacagaatcct

SEQ ID NO: 7185428 - DNA, 22 bp, Homo sapiens
ttgtggaaatacagactccaag

SEQ ID NO: 7185429 - DNA, 22 bp, Homo sapiens
ttgtggaaatacagactccaag

SEQ ID NO: 7185430 - DNA, 22 bp, Homo sapiens
ttgtggaagccctatgagagac

SEQ ID NO: 7185431 - DNA, 23 bp, Homo sapiens
ttgtggaagggagatggcaacag

SEQ ID NO: 7185432 - DNA, 22 bp, Homo sapiens
ttgtggcagaccatgagtctaa

SEQ ID NO: 7185433 - DNA, 23 bp, Homo sapiens
ttgtggagtggttgttttctagg

SEQ ID NO: 7185434 - DNA, 22 bp, Homo sapiens
ttgttatttacaacaatcctat

SEQ ID NO: 7185435 - DNA, 22 bp, Homo sapiens
ttgttatttaggtctgggttag

SEQ ID NO: 7185436 - DNA, 22 bp, Homo sapiens
ttgttcagaaatttggactcct

SEQ ID NO: 7185437 - DNA, 22 bp, Homo sapiens
ttgttcagaagtttaaagaatt

SEQ ID NO: 7185438 - DNA, 22 bp, Homo sapiens
ttgttcaggaggggaatgtgag

SEQ ID NO: 7185439 - DNA, 22 bp, Homo sapiens
ttgttcagtagagagattatta

SEQ ID NO: 7185440 - DNA, 22 bp, Homo sapiens
ttgttcataaagacagttcaga

SEQ ID NO: 7185441 - DNA, 22 bp, Homo sapiens
ttgttcatcaggtgacacatac

SEQ ID NO: 7185442 - DNA, 22 bp, Homo sapiens
ttgttcttacttaagagtgaat

SEQ ID NO: 7185443 - DNA, 22 bp, Homo sapiens
ttgttctatggggtgaagtcta

SEQ ID NO: 7185444 - DNA, 22 bp, Homo sapiens
ttgttcctgccaagccaagcct

SEQ ID NO: 7185445 - DNA, 22 bp, Homo sapiens
ttgggctgaagtagagggcaga

SEQ ID NO: 7185446 - DNA, 22 bp, Homo sapiens
ttgggctgaagtagagggcaga

SEQ ID NO: 7185447 - DNA, 22 bp, Homo sapiens
ttgggctgaagtagagggcaga

SEQ ID NO: 7185448 - DNA, 22 bp, Homo sapiens
ttgggctgaggagggcgtggcc

SEQ ID NO: 7185449 - DNA, 22 bp, Homo sapiens
ttgggctgaggagggcgtggcc

SEQ ID NO: 7185450 - DNA, 22 bp, Homo sapiens
ttgggctgaagtagagggcaga

SEQ ID NO: 7185451 - DNA, 22 bp, Homo sapiens
ttgggctgaggagggcgtggcc

SEQ ID NO: 7185452 - DNA, 22 bp, Homo sapiens
ttgggctgaggagggcgtggcc

SEQ ID NO: 7185453 - DNA, 22 bp, Homo sapiens
ttgggctgatctgtggaagaag

SEQ ID NO: 7185454 - DNA, 22 bp, Homo sapiens
ttgggctgcagcaattattagt

SEQ ID NO: 7185455 - DNA, 22 bp, Homo sapiens
ttgggctggagatgatctgctg

SEQ ID NO: 7185456 - DNA, 22 bp, Homo sapiens
ttgggctggagatgatctgctg

SEQ ID NO: 7185457 - DNA, 22 bp, Homo sapiens
ttgggctggataagtctttgtt

SEQ ID NO: 7185458 - DNA, 22 bp, Homo sapiens
ttgggctggcagaggtggtctt

SEQ ID NO: 7185459 - DNA, 22 bp, Homo sapiens
ttgggctcaggagtttgagacc

SEQ ID NO: 7185460 - DNA, 22 bp, Homo sapiens
ttgggctcaggagtttgagacc

SEQ ID NO: 7185461 - DNA, 22 bp, Homo sapiens
ttgggctcaggagtttgagacc

SEQ ID NO: 7185462 - DNA, 22 bp, Homo sapiens
ttgggctgaaccctgcagctga

SEQ ID NO: 7185463 - DNA, 22 bp, Homo sapiens
ttgggctgaaccctgcagctga

SEQ ID NO: 7185464 - DNA, 23 bp, Homo sapiens
ttgggctcagtggcaggaagagt

SEQ ID NO: 7185465 - DNA, 22 bp, Homo sapiens
ttgggctcaggagtttgagacc

SEQ ID NO: 7185466 - DNA, 22 bp, Homo sapiens
ttggggcagagaggatacggca

SEQ ID NO: 7185467 - DNA, 22 bp, Homo sapiens
ttggggcagttattctgtgccc

SEQ ID NO: 7185468 - DNA, 22 bp, Homo sapiens
ttggggcacctccccagcattt

SEQ ID NO: 7185469 - DNA, 22 bp, Homo sapiens
ttggggcacctccccagcattt

SEQ ID NO: 7185470 - DNA, 22 bp, Homo sapiens
ttggggcagagaggatacggca

SEQ ID NO: 7185471 - DNA, 22 bp, Homo sapiens
ttggggagttaatgccaaagat

SEQ ID NO: 7185472 - DNA, 22 bp, Homo sapiens
ttggggagttaatgccaaagat

SEQ ID NO: 7185473 - DNA, 22 bp, Homo sapiens
ttggggagttaatgccaaagat

SEQ ID NO: 7185474 - DNA, 22 bp, Homo sapiens
ttggggcacctccccagcattt

SEQ ID NO: 7185475 - DNA, 22 bp, Homo sapiens
ttggggagaaatgaaatgaagt

SEQ ID NO: 7185476 - DNA, 22 bp, Homo sapiens
ttggggagaaatgaaatgaagt

SEQ ID NO: 7185477 - DNA, 22 bp, Homo sapiens
ttggggagaaatgaaatgaagt

SEQ ID NO: 7185478 - DNA, 22 bp, Homo sapiens
ttggggagaaatgaaatgaagt

SEQ ID NO: 7185479 - DNA, 22 bp, Homo sapiens
ttggggagaaatgaaatgaagt

SEQ ID NO: 7185480 - DNA, 22 bp, Homo sapiens
ttggggagaaatgaaatgaagt

SEQ ID NO: 7185481 - DNA, 22 bp, Homo sapiens
ttggggaggttgccacattcca

SEQ ID NO: 7185482 - DNA, 22 bp, Homo sapiens
ttggggaggttgccacattcca

SEQ ID NO: 7185483 - DNA, 22 bp, Homo sapiens
ttggggagttaatgccaaagat

SEQ ID NO: 7185484 - DNA, 22 bp, Homo sapiens
ttggggagttaatgccaaagat

SEQ ID NO: 7185485 - DNA, 22 bp, Homo sapiens
ttggggaggttgccacattcca

SEQ ID NO: 7185486 - DNA, 22 bp, Homo sapiens
ttgggcttggtcggtttgaggc

SEQ ID NO: 7185487 - DNA, 22 bp, Homo sapiens
ttgggcttgtctgggaaactgc

SEQ ID NO: 7185488 - DNA, 22 bp, Homo sapiens
ttggggaagagttgactttgga

SEQ ID NO: 7185489 - DNA, 22 bp, Homo sapiens
ttggggaagctttgaaatactt

SEQ ID NO: 7185490 - DNA, 22 bp, Homo sapiens
ttggggaaggcttccctgtacc

SEQ ID NO: 7185491 - DNA, 22 bp, Homo sapiens
ttgggctggcagaggtggtctt

SEQ ID NO: 7185492 - DNA, 22 bp, Homo sapiens
ttgggctggcagaggtggtctt

SEQ ID NO: 7185493 - DNA, 22 bp, Homo sapiens
ttgggctggcagaggtggtctt

SEQ ID NO: 7185494 - DNA, 22 bp, Homo sapiens
ttgggctggcccttgtctctgg

SEQ ID NO: 7185495 - DNA, 23 bp, Homo sapiens
ttgggctggctctcgatgcctct

SEQ ID NO: 7185496 - DNA, 23 bp, Homo sapiens
ttgggctggctctcgatgcctct

SEQ ID NO: 7185497 - DNA, 23 bp, Homo sapiens
ttgggctggctctcgatgcctct

SEQ ID NO: 7185498 - DNA, 22 bp, Homo sapiens
ttgggctgggcaagaatcaatg

SEQ ID NO: 7185499 - DNA, 22 bp, Homo sapiens
ttgggctggtctttgtttggtc

SEQ ID NO: 7185500 - DNA, 22 bp, Homo sapiens
ttgggctggtctttgtttggtc

SEQ ID NO: 7185501 - DNA, 22 bp, Homo sapiens
ttggcttcctgcacttgagttt

SEQ ID NO: 7185502 - DNA, 22 bp, Homo sapiens
ttggcttctcttaaccctaaag

SEQ ID NO: 7185503 - DNA, 22 bp, Homo sapiens
ttggcttctcttaaccctaaag

SEQ ID NO: 7185504 - DNA, 22 bp, Homo sapiens
ttggcttctcttaaccctaaag

SEQ ID NO: 7185505 - DNA, 22 bp, Homo sapiens
ttggcttccaggatctcagcag

SEQ ID NO: 7185506 - DNA, 22 bp, Homo sapiens
ttggcttcattgatctcacttt

SEQ ID NO: 7185507 - DNA, 22 bp, Homo sapiens
ttggcttccaggatctcagcag

SEQ ID NO: 7185508 - DNA, 22 bp, Homo sapiens
ttggctgttttatctcctggtg

SEQ ID NO: 7185509 - DNA, 22 bp, Homo sapiens
ttggcttcaatgtcagagacag

SEQ ID NO: 7185510 - DNA, 22 bp, Homo sapiens
ttggcttcaatgtcagagacag

SEQ ID NO: 7185511 - DNA, 22 bp, Homo sapiens
ttggcttctggcagtctggacg

SEQ ID NO: 7185512 - DNA, 22 bp, Homo sapiens
ttggcttctgttttggctctgt

SEQ ID NO: 7185513 - DNA, 22 bp, Homo sapiens
ttggcttctgttttggctctgt

SEQ ID NO: 7185514 - DNA, 22 bp, Homo sapiens
ttggcttcttataatgcaatag

SEQ ID NO: 7185515 - DNA, 22 bp, Homo sapiens
ttggcttcttgtgaaatctgag

SEQ ID NO: 7185516 - DNA, 22 bp, Homo sapiens
ttggcttctttagtcagtttgg

SEQ ID NO: 7185517 - DNA, 22 bp, Homo sapiens
ttggcttcttttctagacagaa

SEQ ID NO: 7185518 - DNA, 22 bp, Homo sapiens
ttggcttgatgactggcagtgt

SEQ ID NO: 7185519 - DNA, 22 bp, Homo sapiens
ttgggaaacagtatagctaaca

SEQ ID NO: 7185520 - DNA, 22 bp, Homo sapiens
ttgggaaagggattatgagtag

SEQ ID NO: 7185521 - DNA, 23 bp, Homo sapiens
ttgggaaatagttaagacatgag

SEQ ID NO: 7185522 - DNA, 23 bp, Homo sapiens
ttgggaaatagttaagacatgag

SEQ ID NO: 7185523 - DNA, 23 bp, Homo sapiens
ttgggaaatagttaagacatgag

SEQ ID NO: 7185524 - DNA, 22 bp, Homo sapiens
ttgggaaacagtatagctaaca

SEQ ID NO: 7185525 - DNA, 22 bp, Homo sapiens
ttgggaaagaatgagaaggtga

SEQ ID NO: 7185526 - DNA, 22 bp, Homo sapiens
ttgggaaagaatgagaaggtga

SEQ ID NO: 7185527 - DNA, 22 bp, Homo sapiens
ttgggaaagccacaaattggag

SEQ ID NO: 7185528 - DNA, 23 bp, Homo sapiens
ttgggaaatagttaagacatgag

SEQ ID NO: 7185529 - DNA, 22 bp, Homo sapiens
ttgggaaatatggattgttatt

SEQ ID NO: 7185530 - DNA, 22 bp, Homo sapiens
ttgggaaatatggattgttatt

SEQ ID NO: 7185531 - DNA, 22 bp, Homo sapiens
ttgggaaattactctgctagga

SEQ ID NO: 7185532 - DNA, 22 bp, Homo sapiens
ttgggaagaatggaggtggtta

SEQ ID NO: 7185533 - DNA, 21 bp, Homo sapiens
ttggcctgatatcttggagca

SEQ ID NO: 7185534 - DNA, 22 bp, Homo sapiens
ttggcctgctccagagaggcca

SEQ ID NO: 7185535 - DNA, 22 bp, Homo sapiens
ttggcctgctccagagaggcca

SEQ ID NO: 7185536 - DNA, 22 bp, Homo sapiens
ttggcctggcgcggtggctcac

SEQ ID NO: 7185537 - DNA, 22 bp, Homo sapiens
ttggccttaacctctctgtgcc

SEQ ID NO: 7185538 - DNA, 22 bp, Homo sapiens
ttggccttacgcatggtcggca

SEQ ID NO: 7185539 - DNA, 22 bp, Homo sapiens
ttggccttactctcctacactg

SEQ ID NO: 7185540 - DNA, 22 bp, Homo sapiens
ttggccttactctcctacactg

SEQ ID NO: 7185541 - DNA, 22 bp, Homo sapiens
ttggccttagcttcttcttaaa

SEQ ID NO: 7185542 - DNA, 22 bp, Homo sapiens
ttggccttccctacctgggcca

SEQ ID NO: 7185543 - DNA, 17 bp, Homo sapiens
ttggccttctagcctct

SEQ ID NO: 7185544 - DNA, 22 bp, Homo sapiens
ttggccttctcatttgcttatt

SEQ ID NO: 7185545 - DNA, 22 bp, Homo sapiens
ttggccttctctgacactgccc

SEQ ID NO: 7185546 - DNA, 22 bp, Homo sapiens
ttggccttctctgacactgccc

SEQ ID NO: 7185547 - DNA, 22 bp, Homo sapiens
ttggccttctcttcccggtcct

SEQ ID NO: 7185548 - DNA, 22 bp, Homo sapiens
ttggccttctggtgttcatttt

SEQ ID NO: 7185549 - DNA, 22 bp, Homo sapiens
ttggccttcttccccctgcact

SEQ ID NO: 7185550 - DNA, 22 bp, Homo sapiens
ttggccttgaacatggtttagg

SEQ ID NO: 7185551 - DNA, 22 bp, Homo sapiens
ttggccttgtacatcatattaa

SEQ ID NO: 7185552 - DNA, 22 bp, Homo sapiens
ttggccttgtcacttcattact

SEQ ID NO: 7185553 - DNA, 22 bp, Homo sapiens
ttggccttgtctggtcttctcc

SEQ ID NO: 7185554 - DNA, 22 bp, Homo sapiens
ttggccttgttaaggaggccct

SEQ ID NO: 7185555 - DNA, 19 bp, Homo sapiens
ttggccttgtttcatatct

SEQ ID NO: 7185556 - DNA, 22 bp, Homo sapiens
ttggccctagatgattaagttg

SEQ ID NO: 7185557 - DNA, 22 bp, Homo sapiens
ttggccctccacctggctgtgc

SEQ ID NO: 7185558 - DNA, 22 bp, Homo sapiens
ttggccctgaggaggcagctgc

SEQ ID NO: 7185559 - DNA, 22 bp, Homo sapiens
ttggccctgaggaggcagctgc

SEQ ID NO: 7185560 - DNA, 22 bp, Homo sapiens
ttggccctgaggttatcatcta

SEQ ID NO: 7185561 - DNA, 22 bp, Homo sapiens
ttggccctggcacacccccacg

SEQ ID NO: 7185562 - DNA, 22 bp, Homo sapiens
ttggccctggggccagcttcga

SEQ ID NO: 7185563 - DNA, 22 bp, Homo sapiens
ttggccctttatgggatgggca

SEQ ID NO: 7185564 - DNA, 22 bp, Homo sapiens
ttggccctttatgggatgggca

SEQ ID NO: 7185565 - DNA, 22 bp, Homo sapiens
ttggccgtttcactgggcagtt

SEQ ID NO: 7185566 - DNA, 22 bp, Homo sapiens
ttggcctacctgggaatgctgg

SEQ ID NO: 7185567 - DNA, 22 bp, Homo sapiens
ttggcctattccagcagctgtg

SEQ ID NO: 7185568 - DNA, 22 bp, Homo sapiens
ttggcctctcccatactgtcca

SEQ ID NO: 7185569 - DNA, 22 bp, Homo sapiens
ttggcagatgaacacaactgga

SEQ ID NO: 7185570 - DNA, 22 bp, Homo sapiens
ttggcagaggggccacctgccc

SEQ ID NO: 7185571 - DNA, 22 bp, Homo sapiens
ttggcagagggaccagcctaca

SEQ ID NO: 7185572 - DNA, 22 bp, Homo sapiens
ttggcagagccccagccttgga

SEQ ID NO: 7185573 - DNA, 22 bp, Homo sapiens
ttggcagagagtatgctgaaga

SEQ ID NO: 7185574 - DNA, 22 bp, Homo sapiens
ttggcccagggtcagcggcgct

SEQ ID NO: 7185575 - DNA, 22 bp, Homo sapiens
ttggccctagactctaagtccg

SEQ ID NO: 7185576 - DNA, 22 bp, Homo sapiens
ttggctcaaaacttagattcca

SEQ ID NO: 7185577 - DNA, 22 bp, Homo sapiens
ttggctcaaaacttagattcca

SEQ ID NO: 7185578 - DNA, 22 bp, Homo sapiens
ttggctcacaaggacggttgct

SEQ ID NO: 7185579 - DNA, 22 bp, Homo sapiens
ttggctcacaaggacggttgct

SEQ ID NO: 7185580 - DNA, 22 bp, Homo sapiens
ttggcctttaaactggactttc

SEQ ID NO: 7185581 - DNA, 22 bp, Homo sapiens
ttggcctttattctgtacttct

SEQ ID NO: 7185582 - DNA, 22 bp, Homo sapiens
ttggcctttgctgggctgttga

SEQ ID NO: 7185583 - DNA, 22 bp, Homo sapiens
ttggcctttggactctgggact

SEQ ID NO: 7185584 - DNA, 22 bp, Homo sapiens
ttggcctttgtcatcaagatca

SEQ ID NO: 7185585 - DNA, 21 bp, Homo sapiens
ttggcctttgtctcagacact

SEQ ID NO: 7185586 - DNA, 22 bp, Homo sapiens
ttggcctttgtcatcaagatca

SEQ ID NO: 7185587 - DNA, 22 bp, Homo sapiens
ttggctcacatgattatggagg

SEQ ID NO: 7185588 - DNA, 22 bp, Homo sapiens
ttggctcacatgattatggagg

SEQ ID NO: 7185589 - DNA, 22 bp, Homo sapiens
ttggctcacctggagcctgttg

SEQ ID NO: 7185590 - DNA, 22 bp, Homo sapiens
ttggctcacctggagcctgttg

SEQ ID NO: 7185591 - DNA, 22 bp, Homo sapiens
ttggctcacctgtctacccaga

SEQ ID NO: 7185592 - DNA, 22 bp, Homo sapiens
ttggctcacctgtctacccaga

SEQ ID NO: 7185593 - DNA, 22 bp, Homo sapiens
ttggctcacctgtctacccaga

SEQ ID NO: 7185594 - DNA, 20 bp, Homo sapiens
ttggctcagatttttatggg

SEQ ID NO: 7185595 - DNA, 20 bp, Homo sapiens
ttggctcagatttttatggg

SEQ ID NO: 7185596 - DNA, 22 bp, Homo sapiens
ttggctcagcatcttggtgcca

SEQ ID NO: 7185597 - DNA, 22 bp, Homo sapiens
ttggctcagcatcttggtgcca

SEQ ID NO: 7185598 - DNA, 22 bp, Homo sapiens
ttggctcagctgggactgttga

SEQ ID NO: 7185599 - DNA, 22 bp, Homo sapiens
ttggctcagctgggactgttga

SEQ ID NO: 7185600 - DNA, 22 bp, Homo sapiens
ttggctcagcatcttggtgcca

SEQ ID NO: 7185601 - DNA, 22 bp, Homo sapiens
ttggctcaggacccctgtgact

SEQ ID NO: 7185602 - DNA, 22 bp, Homo sapiens
ttggctcaggacccctgtgact

SEQ ID NO: 7185603 - DNA, 22 bp, Homo sapiens
ttggctcaggctttcattgtaa

SEQ ID NO: 7185604 - DNA, 22 bp, Homo sapiens
ttggctggtttcaagaaggcat

SEQ ID NO: 7185605 - DNA, 22 bp, Homo sapiens
ttggctggtaagccaaatgaaa

SEQ ID NO: 7185606 - DNA, 22 bp, Homo sapiens
ttggctgggcacagtgtctcat

SEQ ID NO: 7185607 - DNA, 22 bp, Homo sapiens
ttggctgggcacagtgtctcat

SEQ ID NO: 7185608 - DNA, 22 bp, Homo sapiens
ttggctggtttcaagaaggcat

SEQ ID NO: 7185609 - DNA, 22 bp, Homo sapiens
ttggctggtttcaagaaggcat

SEQ ID NO: 7185610 - DNA, 22 bp, Homo sapiens
ttggctggttttgagtatgtgc

SEQ ID NO: 7185611 - DNA, 22 bp, Homo sapiens
ttggctggttttgagtatgtgc

SEQ ID NO: 7185612 - DNA, 22 bp, Homo sapiens
ttggctgtatgtacatctgtta

SEQ ID NO: 7185613 - DNA, 22 bp, Homo sapiens
ttggctggctacctgggccgag

SEQ ID NO: 7185614 - DNA, 22 bp, Homo sapiens
ttggctctaggaaccaaagtga

SEQ ID NO: 7185615 - DNA, 22 bp, Homo sapiens
ttggctcatgctgttttgtgca

SEQ ID NO: 7185616 - DNA, 22 bp, Homo sapiens
ttggctcattaaagatgataat

SEQ ID NO: 7185617 - DNA, 22 bp, Homo sapiens
ttggctcctgttcctctgtctg

SEQ ID NO: 7185618 - DNA, 22 bp, Homo sapiens
ttggctcaggctttcattgtaa

SEQ ID NO: 7185619 - DNA, 22 bp, Homo sapiens
ttggctcagtgtgagggagatg

SEQ ID NO: 7185620 - DNA, 22 bp, Homo sapiens
ttggctcagtgtgagggagatg

SEQ ID NO: 7185621 - DNA, 20 bp, Homo sapiens
ttggctcatgcaacacctac

SEQ ID NO: 7185622 - DNA, 20 bp, Homo sapiens
ttggctcatgcaacacctac

SEQ ID NO: 7185623 - DNA, 22 bp, Homo sapiens
ttggctcatgctgttttgtgca

SEQ ID NO: 7185624 - DNA, 22 bp, Homo sapiens
ttggctcattaaagatgataat

SEQ ID NO: 7185625 - DNA, 22 bp, Homo sapiens
ttgccaagtgttttaaaatatt

SEQ ID NO: 7185626 - DNA, 22 bp, Homo sapiens
ttgccacacaagtaaagaaaca

SEQ ID NO: 7185627 - DNA, 22 bp, Homo sapiens
ttgcatttttgagcacgaagtt

SEQ ID NO: 7185628 - DNA, 22 bp, Homo sapiens
ttgcatttttgagcacgaagtt

SEQ ID NO: 7185629 - DNA, 22 bp, Homo sapiens
ttgcatttttacaagtagccag

SEQ ID NO: 7185630 - DNA, 22 bp, Homo sapiens
ttgcatttttacaagtagccag

SEQ ID NO: 7185631 - DNA, 22 bp, Homo sapiens
ttgcatttttagatgcttctgt

SEQ ID NO: 7185632 - DNA, 22 bp, Homo sapiens
ttgcatttgtttgagtagaatg

SEQ ID NO: 7185633 - DNA, 21 bp, Homo sapiens
ttgcattttaagtttactgct

SEQ ID NO: 7185634 - DNA, 22 bp, Homo sapiens
ttgcattttggttgtaaatatg

SEQ ID NO: 7185635 - DNA, 22 bp, Homo sapiens
ttgcattttggttgtaaatatg

SEQ ID NO: 7185636 - DNA, 22 bp, Homo sapiens
ttgcatttgctcatttgatatg

SEQ ID NO: 7185637 - DNA, 22 bp, Homo sapiens
ttgcatttgctcatttgatatg

SEQ ID NO: 7185638 - DNA, 22 bp, Homo sapiens
ttgcatttgctcatttgatatg

SEQ ID NO: 7185639 - DNA, 22 bp, Homo sapiens
ttgcatttggttctgcctggta

SEQ ID NO: 7185640 - DNA, 22 bp, Homo sapiens
ttgcatttgtggcatgggtgtt

SEQ ID NO: 7185641 - DNA, 22 bp, Homo sapiens
ttgcatttgtggcatgggtgtt

SEQ ID NO: 7185642 - DNA, 22 bp, Homo sapiens
ttgcatttgtggcatgggtgtt

SEQ ID NO: 7185643 - DNA, 22 bp, Homo sapiens
ttgcatttgtttgagtagaatg

SEQ ID NO: 7185644 - DNA, 22 bp, Homo sapiens
ttgcatttgtttgagtagaatg

SEQ ID NO: 7185645 - DNA, 22 bp, Homo sapiens
ttgccagggctttggtggcatc

SEQ ID NO: 7185646 - DNA, 22 bp, Homo sapiens
ttgccagtgccagcccaggcag

SEQ ID NO: 7185647 - DNA, 22 bp, Homo sapiens
ttgccagtttccctggatgtgt

SEQ ID NO: 7185648 - DNA, 22 bp, Homo sapiens
ttgccagatcttccacatggct

SEQ ID NO: 7185649 - DNA, 22 bp, Homo sapiens
ttgccaggagagccacttgcag

SEQ ID NO: 7185650 - DNA, 22 bp, Homo sapiens
ttgccaggctctggttccagcc

SEQ ID NO: 7185651 - DNA, 22 bp, Homo sapiens
ttgccagggaacagggagaggc

SEQ ID NO: 7185652 - DNA, 22 bp, Homo sapiens
ttgaggtccccagtacccactg

SEQ ID NO: 7185653 - DNA, 22 bp, Homo sapiens
ttgaggtattgatattttatga

SEQ ID NO: 7185654 - DNA, 22 bp, Homo sapiens
ttgcatttcccattgagtaatg

SEQ ID NO: 7185655 - DNA, 22 bp, Homo sapiens
ttgcatttcccattgagtaatg

SEQ ID NO: 7185656 - DNA, 22 bp, Homo sapiens
ttgcatttcactttcagtaggc

SEQ ID NO: 7185657 - DNA, 19 bp, Homo sapiens
ttgcatttcatgtttgatt

SEQ ID NO: 7185658 - DNA, 22 bp, Homo sapiens
ttgagtcatagattccacaatg

SEQ ID NO: 7185659 - DNA, 22 bp, Homo sapiens
ttgagtcagtaattccatttct

SEQ ID NO: 7185660 - DNA, 22 bp, Homo sapiens
ttgagtcagtaattccatttct

SEQ ID NO: 7185661 - DNA, 22 bp, Homo sapiens
ttgagtcagtaattccatttct

SEQ ID NO: 7185662 - DNA, 22 bp, Homo sapiens
ttgcatttcctgtactgtttga

SEQ ID NO: 7185663 - DNA, 22 bp, Homo sapiens
ttgcatttgacaaattatttaa

SEQ ID NO: 7185664 - DNA, 22 bp, Homo sapiens
ttgcatttgatcttgggttctc

SEQ ID NO: 7185665 - DNA, 22 bp, Homo sapiens
ttgcatttgagaaagttctcct

SEQ ID NO: 7185666 - DNA, 22 bp, Homo sapiens
ttgctcaggcttagagctacta

SEQ ID NO: 7185667 - DNA, 22 bp, Homo sapiens
ttgcttcagtagctctttaaag

SEQ ID NO: 7185668 - DNA, 22 bp, Homo sapiens
ttgctcagcactggagccagct

SEQ ID NO: 7185669 - DNA, 22 bp, Homo sapiens
ttgctcagcactggagccagct

SEQ ID NO: 7185670 - DNA, 18 bp, Homo sapiens
ttgctcactctccttccc

SEQ ID NO: 7185671 - DNA, 22 bp, Homo sapiens
ttgcttcagtcagtgctgccca

SEQ ID NO: 7185672 - DNA, 22 bp, Homo sapiens
ttgcttcatcagagtaaacaag

SEQ ID NO: 7185673 - DNA, 22 bp, Homo sapiens
ttgcttcatggagatggacgaa

SEQ ID NO: 7185674 - DNA, 22 bp, Homo sapiens
ttgcttcatttcctcaggcttt

SEQ ID NO: 7185675 - DNA, 22 bp, Homo sapiens
ttgcttcattttcccagtacgg

SEQ ID NO: 7185676 - DNA, 22 bp, Homo sapiens
ttgctagataatctcacacact

SEQ ID NO: 7185677 - DNA, 22 bp, Homo sapiens
ttgctaatcatatttcatcact

SEQ ID NO: 7185678 - DNA, 22 bp, Homo sapiens
ttgcggctgcagcagagaatag

SEQ ID NO: 7185679 - DNA, 22 bp, Homo sapiens
ttgcgggcctttagttcttgac

SEQ ID NO: 7185680 - DNA, 22 bp, Homo sapiens
ttgctaaaggattttgtattta

SEQ ID NO: 7185681 - DNA, 22 bp, Homo sapiens
ttgctaaatccctataatattc

SEQ ID NO: 7185682 - DNA, 22 bp, Homo sapiens
ttgctaaatccctataatattc

SEQ ID NO: 7185683 - DNA, 22 bp, Homo sapiens
ttgctaaatgtgttatatctgt

SEQ ID NO: 7185684 - DNA, 22 bp, Homo sapiens
ttgctaataaagtttttatgtg

SEQ ID NO: 7185685 - DNA, 22 bp, Homo sapiens
ttgctaatagaagatttgggaa

SEQ ID NO: 7185686 - DNA, 22 bp, Homo sapiens
ttgcctcaagattttttattga

SEQ ID NO: 7185687 - DNA, 22 bp, Homo sapiens
ttgcctcccagcatgggcagct

SEQ ID NO: 7185688 - DNA, 22 bp, Homo sapiens
ttgcctccttttaaggaaatca

SEQ ID NO: 7185689 - DNA, 22 bp, Homo sapiens
ttgcccactcatgcttttgata

SEQ ID NO: 7185690 - DNA, 22 bp, Homo sapiens
ttgcccactctgtttcccaaga

SEQ ID NO: 7185691 - DNA, 22 bp, Homo sapiens
ttgcccagagctgcctgttaca

SEQ ID NO: 7185692 - DNA, 22 bp, Homo sapiens
ttgccattaaaacatgttatct

SEQ ID NO: 7185693 - DNA, 22 bp, Homo sapiens
ttgccattatcatttatgatac

SEQ ID NO: 7185694 - DNA, 23 bp, Homo sapiens
ttgccattccaaataatttccta

SEQ ID NO: 7185695 - DNA, 22 bp, Homo sapiens
ttgccattccagggtattaggg

SEQ ID NO: 7185696 - DNA, 22 bp, Homo sapiens
ttgccattccagggtattaggg

SEQ ID NO: 7185697 - DNA, 22 bp, Homo sapiens
ttgccattgcaaagtactatga

SEQ ID NO: 7185698 - DNA, 22 bp, Homo sapiens
ttgccattgctcagtgaacaga

SEQ ID NO: 7185699 - DNA, 22 bp, Homo sapiens
ttgccattgctcagtgaacaga

SEQ ID NO: 7185700 - DNA, 22 bp, Homo sapiens
ttgccattggcaggcctcttgt

SEQ ID NO: 7185701 - DNA, 22 bp, Homo sapiens
ttgccatttagaggttaaacct

SEQ ID NO: 7185702 - DNA, 22 bp, Homo sapiens
ttgccatttaggctggctgtgg

SEQ ID NO: 7185703 - DNA, 22 bp, Homo sapiens
ttgccatttagtatgcttgtat

SEQ ID NO: 7185704 - DNA, 22 bp, Homo sapiens
ttgccatttatactgcaagtca

SEQ ID NO: 7185705 - DNA, 22 bp, Homo sapiens
ttgccatttcaagtggccactg

SEQ ID NO: 7185706 - DNA, 22 bp, Homo sapiens
ttgccatttcgtaagccgggag

SEQ ID NO: 7185707 - DNA, 22 bp, Homo sapiens
ttgccatttcgtaagccgggag

SEQ ID NO: 7185708 - DNA, 22 bp, Homo sapiens
ttgccattttgagaaggatata

SEQ ID NO: 7185709 - DNA, 22 bp, Homo sapiens
ttgcccaccatccaataaaatg

SEQ ID NO: 7185710 - DNA, 22 bp, Homo sapiens
ttgcccaccttagtcttcagac

SEQ ID NO: 7185711 - DNA, 22 bp, Homo sapiens
ttgcccaccttcttttcgtgcc

SEQ ID NO: 7185712 - DNA, 22 bp, Homo sapiens
ttgcccactcagccctgtggag

SEQ ID NO: 7185713 - DNA, 22 bp, Homo sapiens
ttgcctgtgaacgctgagtcct

SEQ ID NO: 7185714 - DNA, 22 bp, Homo sapiens
ttgcctgtgtcagcaggtggaa

SEQ ID NO: 7185715 - DNA, 22 bp, Homo sapiens
ttgcctgtgaggattctggttg

SEQ ID NO: 7185716 - DNA, 22 bp, Homo sapiens
ttgcctgggcaacatagaactc

SEQ ID NO: 7185717 - DNA, 22 bp, Homo sapiens
ttgcctgggctagtaagccaga

SEQ ID NO: 7185718 - DNA, 22 bp, Homo sapiens
ttgcctggtcctgtgggtgctg

SEQ ID NO: 7185719 - DNA, 22 bp, Homo sapiens
ttgcctggactctgctggtatt

SEQ ID NO: 7185720 - DNA, 22 bp, Homo sapiens
ttgcctggattctaccacagaa

SEQ ID NO: 7185721 - DNA, 22 bp, Homo sapiens
ttgcctggcttgtagatggggg

SEQ ID NO: 7185722 - DNA, 17 bp, Homo sapiens
ttgcctttatggtcact

SEQ ID NO: 7185723 - DNA, 22 bp, Homo sapiens
ttgcctttgacggtgcagcagt

SEQ ID NO: 7185724 - DNA, 22 bp, Homo sapiens
ttgccttgattcttctcatgtg

SEQ ID NO: 7185725 - DNA, 22 bp, Homo sapiens
ttgccttgcagaatgtctgttt

SEQ ID NO: 7185726 - DNA, 17 bp, Homo sapiens
ttgccttaagtatgtgc

SEQ ID NO: 7185727 - DNA, 22 bp, Homo sapiens
ttgccttactgcattcagtaaa

SEQ ID NO: 7185728 - DNA, 22 bp, Homo sapiens
ttgcctgtttgagagctgtgtt

SEQ ID NO: 7185729 - DNA, 22 bp, Homo sapiens
ttgccttgattcttctcatgtg

SEQ ID NO: 7185730 - DNA, 22 bp, Homo sapiens
ttggcagactgggtcctgggga

SEQ ID NO: 7185731 - DNA, 22 bp, Homo sapiens
ttggcagactgacaatctgttt

SEQ ID NO: 7185732 - DNA, 22 bp, Homo sapiens
ttggcagaattaaccactgaag

SEQ ID NO: 7185733 - DNA, 22 bp, Homo sapiens
ttggcagaatgggcagcttgag

SEQ ID NO: 7185734 - DNA, 22 bp, Homo sapiens
ttggcagaaatgtggctgggag

SEQ ID NO: 7185735 - DNA, 22 bp, Homo sapiens
ttggcactcagcaagtgttaat

SEQ ID NO: 7185736 - DNA, 22 bp, Homo sapiens
ttggcactcatcctggttgttt

SEQ ID NO: 7185737 - DNA, 22 bp, Homo sapiens
ttggcactgaccaaagaagtcc

SEQ ID NO: 7185738 - DNA, 22 bp, Homo sapiens
ttggcacaaatttctgaaataa

SEQ ID NO: 7185739 - DNA, 22 bp, Homo sapiens
ttggcacaaatttctgaaataa

SEQ ID NO: 7185740 - DNA, 22 bp, Homo sapiens
ttggcacaaatttctgaaataa

SEQ ID NO: 7185741 - DNA, 22 bp, Homo sapiens
ttggcacaagcagttgggccca

SEQ ID NO: 7185742 - DNA, 22 bp, Homo sapiens
ttggcacacagtaagccctaag

SEQ ID NO: 7185743 - DNA, 22 bp, Homo sapiens
ttggcacagaaaaactcactgt

SEQ ID NO: 7185744 - DNA, 22 bp, Homo sapiens
ttggcacagaaaaactcactgt

SEQ ID NO: 7185745 - DNA, 22 bp, Homo sapiens
ttggcacagagctgcagcctgg

SEQ ID NO: 7185746 - DNA, 22 bp, Homo sapiens
ttggcacagagctgcagcctgg

SEQ ID NO: 7185747 - DNA, 22 bp, Homo sapiens
ttggcacagagctgcagcctgg

SEQ ID NO: 7185748 - DNA, 22 bp, Homo sapiens
ttggcacagccacttctgctgc

SEQ ID NO: 7185749 - DNA, 22 bp, Homo sapiens
ttggcacagctccatggctttg

SEQ ID NO: 7185750 - DNA, 22 bp, Homo sapiens
ttggcacagctccatggctttg

SEQ ID NO: 7185751 - DNA, 22 bp, Homo sapiens
ttggcacaggggacttatgtgt

SEQ ID NO: 7185752 - DNA, 22 bp, Homo sapiens
ttggcacagtaatctctcttca

SEQ ID NO: 7185753 - DNA, 22 bp, Homo sapiens
ttggcacagtaatctctcttca

SEQ ID NO: 7185754 - DNA, 22 bp, Homo sapiens
ttggcacataatttgggaactc

SEQ ID NO: 7185755 - DNA, 22 bp, Homo sapiens
ttggatgtttgaaatcacgtac

SEQ ID NO: 7185756 - DNA, 22 bp, Homo sapiens
ttggattcagtcttgcagattc

SEQ ID NO: 7185757 - DNA, 22 bp, Homo sapiens
ttggcaaaatttaaagaagtga

SEQ ID NO: 7185758 - DNA, 22 bp, Homo sapiens
ttggcaaaatttaaagaagtga

SEQ ID NO: 7185759 - DNA, 22 bp, Homo sapiens
ttggcaactctattggcaaata

SEQ ID NO: 7185760 - DNA, 22 bp, Homo sapiens
ttggcaatatttactgaagttg

SEQ ID NO: 7185761 - DNA, 22 bp, Homo sapiens
ttggcaatcaattctgacgtct

SEQ ID NO: 7185762 - DNA, 22 bp, Homo sapiens
ttggcaatgatctcaatcttct

SEQ ID NO: 7185763 - DNA, 22 bp, Homo sapiens
ttggaggatgcaatgagggagt

SEQ ID NO: 7185764 - DNA, 22 bp, Homo sapiens
ttggaggatgcaatgagggagt

SEQ ID NO: 7185765 - DNA, 22 bp, Homo sapiens
ttggaggataaggatattgatt

SEQ ID NO: 7185766 - DNA, 22 bp, Homo sapiens
ttggaggatgcaatgagggagt

SEQ ID NO: 7185767 - DNA, 22 bp, Homo sapiens
ttggaggatgcaatgagggagt

SEQ ID NO: 7185768 - DNA, 22 bp, Homo sapiens
ttggaggatggagttagcatct

SEQ ID NO: 7185769 - DNA, 22 bp, Homo sapiens
ttggaatctgcaatttaacaaa

SEQ ID NO: 7185770 - DNA, 21 bp, Homo sapiens
ttggaatcttaggagtgtggg

SEQ ID NO: 7185771 - DNA, 22 bp, Homo sapiens
ttggaatgcacactgagcctgc

SEQ ID NO: 7185772 - DNA, 22 bp, Homo sapiens
ttggaatgttttaatataaatt

SEQ ID NO: 7185773 - DNA, 22 bp, Homo sapiens
ttggaattaaaaggagaacttc

SEQ ID NO: 7185774 - DNA, 22 bp, Homo sapiens
ttggatgtttgaaatcacgtac

SEQ ID NO: 7185775 - DNA, 22 bp, Homo sapiens
ttggaggattgctctcagccca

SEQ ID NO: 7185776 - DNA, 22 bp, Homo sapiens
ttggagggacagatggctaggc

SEQ ID NO: 7185777 - DNA, 22 bp, Homo sapiens
ttggagggacagatggctaggc

SEQ ID NO: 7185778 - DNA, 15 bp, Homo sapiens
ttggaggatgtagta

SEQ ID NO: 7185779 - DNA, 18 bp, Homo sapiens
ttggaggatgtccatgaa

SEQ ID NO: 7185780 - DNA, 22 bp, Homo sapiens
ttggaggatgtcggcatattta

SEQ ID NO: 7185781 - DNA, 22 bp, Homo sapiens
ttggaggattgctctcagccca

SEQ ID NO: 7185782 - DNA, 22 bp, Homo sapiens
ttggaggcaatgggaaggaggc

SEQ ID NO: 7185783 - DNA, 22 bp, Homo sapiens
ttggaagacattaaagagagtg

SEQ ID NO: 7185784 - DNA, 22 bp, Homo sapiens
ttggaagacattaaagagagtg

SEQ ID NO: 7185785 - DNA, 22 bp, Homo sapiens
ttggaatcaattcatgttgcaa

SEQ ID NO: 7185786 - DNA, 20 bp, Homo sapiens
ttggaatcacctggagaggt

SEQ ID NO: 7185787 - DNA, 22 bp, Homo sapiens
ttggaatcactcacataagtct

SEQ ID NO: 7185788 - DNA, 22 bp, Homo sapiens
ttggaatatatgtttcctgtta

SEQ ID NO: 7185789 - DNA, 22 bp, Homo sapiens
ttggaatcaattcatgttgcaa

SEQ ID NO: 7185790 - DNA, 22 bp, Homo sapiens
ttggaatcattcttaaaggtct

SEQ ID NO: 7185791 - DNA, 22 bp, Homo sapiens
ttggaatcctgagatgagaatt

SEQ ID NO: 7185792 - DNA, 21 bp, Homo sapiens
ttggaatctcttcatctctgc

SEQ ID NO: 7185793 - DNA, 22 bp, Homo sapiens
ttggaatcctgagatgagaatt

SEQ ID NO: 7185794 - DNA, 22 bp, Homo sapiens
ttggaatcctgcctctgctact

SEQ ID NO: 7185795 - DNA, 22 bp, Homo sapiens
ttgctttactttgccattcgtt

SEQ ID NO: 7185796 - DNA, 22 bp, Homo sapiens
ttgctttaatgagattttgcca

SEQ ID NO: 7185797 - DNA, 22 bp, Homo sapiens
ttgctttacaaaaattgatggt

SEQ ID NO: 7185798 - DNA, 22 bp, Homo sapiens
ttgctttaatgagattttgcca

SEQ ID NO: 7185799 - DNA, 22 bp, Homo sapiens
ttgctttaaggtatctggagaa

SEQ ID NO: 7185800 - DNA, 22 bp, Homo sapiens
ttgcttgcttctattttataca

SEQ ID NO: 7185801 - DNA, 22 bp, Homo sapiens
ttgctttaactagtaaatgggg

SEQ ID NO: 7185802 - DNA, 23 bp, Homo sapiens
ttgcttctgtgcaattcagtact

SEQ ID NO: 7185803 - DNA, 22 bp, Homo sapiens
ttgcttcttagatattcctctc

SEQ ID NO: 7185804 - DNA, 22 bp, Homo sapiens
ttgctttaggtatagaatccat

SEQ ID NO: 7185805 - DNA, 22 bp, Homo sapiens
ttgctttagggcaaatatttca

SEQ ID NO: 7185806 - DNA, 22 bp, Homo sapiens
ttgctttagggcaaatatttca

SEQ ID NO: 7185807 - DNA, 22 bp, Homo sapiens
ttgctttatattcaagagagga

SEQ ID NO: 7185808 - DNA, 20 bp, Homo sapiens
ttgctttatcagacatgata

SEQ ID NO: 7185809 - DNA, 22 bp, Homo sapiens
ttgctttattcacatctatatt

SEQ ID NO: 7185810 - DNA, 23 bp, Homo sapiens
ttggaacacagtaaatgcacaat

SEQ ID NO: 7185811 - DNA, 23 bp, Homo sapiens
ttggaacacagtaaatgcacaat

SEQ ID NO: 7185812 - DNA, 23 bp, Homo sapiens
ttggaacacagtaaatgcacaat

SEQ ID NO: 7185813 - DNA, 22 bp, Homo sapiens
ttggaacagaaacagacaaata

SEQ ID NO: 7185814 - DNA, 22 bp, Homo sapiens
ttggaacttaaccctgataggt

SEQ ID NO: 7185815 - DNA, 22 bp, Homo sapiens
ttggaactgatggccttcatcc

SEQ ID NO: 7185816 - DNA, 22 bp, Homo sapiens
ttggaagaaatatcaatagtgt

SEQ ID NO: 7185817 - DNA, 22 bp, Homo sapiens
ttggaactggaggaacatgcta

SEQ ID NO: 7185818 - DNA, 22 bp, Homo sapiens
ttggaactcaataattcttctt

SEQ ID NO: 7185819 - DNA, 22 bp, Homo sapiens
ttggaactcgtgttacttgtat

SEQ ID NO: 7185820 - DNA, 22 bp, Homo sapiens
ttggaagacagtgaaacagcac

SEQ ID NO: 7185821 - DNA, 20 bp, Homo sapiens
ttggaacagtggatcagcag

SEQ ID NO: 7185822 - DNA, 22 bp, Homo sapiens
ttggaacatccaggacagatat

SEQ ID NO: 7185823 - DNA, 20 bp, Homo sapiens
tttattggcctttcaggaac

SEQ ID NO: 7185824 - DNA, 22 bp, Homo sapiens
tttattggatgggtcagctcta

SEQ ID NO: 7185825 - DNA, 20 bp, Homo sapiens
tttattggcctttcaggaac

SEQ ID NO: 7185826 - DNA, 22 bp, Homo sapiens
tttattggatgggtcagctcta

SEQ ID NO: 7185827 - DNA, 22 bp, Homo sapiens
tttattggatatttacaagata

SEQ ID NO: 7185828 - DNA, 22 bp, Homo sapiens
tttattggatatttacaagata

SEQ ID NO: 7185829 - DNA, 22 bp, Homo sapiens
tttattggatatttacaagata

SEQ ID NO: 7185830 - DNA, 22 bp, Homo sapiens
tttattggatggatggatggat

SEQ ID NO: 7185831 - DNA, 22 bp, Homo sapiens
tttattggatggatggatggat

SEQ ID NO: 7185832 - DNA, 22 bp, Homo sapiens
tttattggaacacagccatgac

SEQ ID NO: 7185833 - DNA, 22 bp, Homo sapiens
tttattggaacacagccatgac

SEQ ID NO: 7185834 - DNA, 22 bp, Homo sapiens
tttattggaacacagccatgac

SEQ ID NO: 7185835 - DNA, 22 bp, Homo sapiens
tttattgctgagaaggattcca

SEQ ID NO: 7185836 - DNA, 22 bp, Homo sapiens
tttattgctgtgttagggacag

SEQ ID NO: 7185837 - DNA, 22 bp, Homo sapiens
tttattgtgttgaaactgaatt

SEQ ID NO: 7185838 - DNA, 22 bp, Homo sapiens
tttattgtgttgaaactgaatt

SEQ ID NO: 7185839 - DNA, 22 bp, Homo sapiens
tttattgtgttgaaactgaatt

SEQ ID NO: 7185840 - DNA, 22 bp, Homo sapiens
tttattgtcttcgtggtgccta

SEQ ID NO: 7185841 - DNA, 22 bp, Homo sapiens
tttattgtctatgaactgcttg

SEQ ID NO: 7185842 - DNA, 22 bp, Homo sapiens
tttattgtgttgaaactgaatt

SEQ ID NO: 7185843 - DNA, 22 bp, Homo sapiens
tttatttataagccacttgctg

SEQ ID NO: 7185844 - DNA, 22 bp, Homo sapiens
tttatttataagccacttgctg

SEQ ID NO: 7185845 - DNA, 22 bp, Homo sapiens
tttatttataagccacttgctg

SEQ ID NO: 7185846 - DNA, 22 bp, Homo sapiens
tttatttataagccacttgctg

SEQ ID NO: 7185847 - DNA, 22 bp, Homo sapiens
tttatttataagccacttgctg

SEQ ID NO: 7185848 - DNA, 22 bp, Homo sapiens
tttatttataagccacttgctg

SEQ ID NO: 7185849 - DNA, 22 bp, Homo sapiens
tttattgggcctggaggatcta

SEQ ID NO: 7185850 - DNA, 22 bp, Homo sapiens
tttattgggcctggaggatcta

SEQ ID NO: 7185851 - DNA, 22 bp, Homo sapiens
tttattgggtgcagtgcccaca

SEQ ID NO: 7185852 - DNA, 22 bp, Homo sapiens
tttattgggtgcagtgcccaca

SEQ ID NO: 7185853 - DNA, 22 bp, Homo sapiens
tttattgtcaatctattcccag

SEQ ID NO: 7185854 - DNA, 22 bp, Homo sapiens
tttattgtcaatctattcccag

SEQ ID NO: 7185855 - DNA, 22 bp, Homo sapiens
tttattgtctatgaactgcttg

SEQ ID NO: 7185856 - DNA, 22 bp, Homo sapiens
tttattgtctatgaactgcttg

SEQ ID NO: 7185857 - DNA, 22 bp, Homo sapiens
tttattgtctatgaactgcttg

SEQ ID NO: 7185858 - DNA, 22 bp, Homo sapiens
tttatgtcccttcaaatgttta

SEQ ID NO: 7185859 - DNA, 22 bp, Homo sapiens
tttatgttatgggtaggatcaa

SEQ ID NO: 7185860 - DNA, 22 bp, Homo sapiens
tttatgttcctcttgagctttc

SEQ ID NO: 7185861 - DNA, 21 bp, Homo sapiens
tttatgtacttcatagagtag

SEQ ID NO: 7185862 - DNA, 22 bp, Homo sapiens
tttatgtagttacggactatca

SEQ ID NO: 7185863 - DNA, 22 bp, Homo sapiens
tttatgtagttacggactatca

SEQ ID NO: 7185864 - DNA, 22 bp, Homo sapiens
tttattgccctgtagtacagga

SEQ ID NO: 7185865 - DNA, 22 bp, Homo sapiens
tttattgccctgtagtacagga

SEQ ID NO: 7185866 - DNA, 22 bp, Homo sapiens
tttatgtttgacaatgatctgg

SEQ ID NO: 7185867 - DNA, 22 bp, Homo sapiens
tttattgcatacacaaatgtca

SEQ ID NO: 7185868 - DNA, 22 bp, Homo sapiens
tttatgttcctcttgagctttc

SEQ ID NO: 7185869 - DNA, 22 bp, Homo sapiens
tttatgtttgacaatgatctgg

SEQ ID NO: 7185870 - DNA, 22 bp, Homo sapiens
tttatgtttgacaatgatctgg

SEQ ID NO: 7185871 - DNA, 22 bp, Homo sapiens
tttatgttgaagagactgtgtt

SEQ ID NO: 7185872 - DNA, 22 bp, Homo sapiens
tttatgtttgacaatgatctgg

SEQ ID NO: 7185873 - DNA, 22 bp, Homo sapiens
tttatgtttgacaatgatctgg

SEQ ID NO: 7185874 - DNA, 22 bp, Homo sapiens
tttatgtttgcattttcaaaga

SEQ ID NO: 7185875 - DNA, 22 bp, Homo sapiens
tttatgtttgcattttcaaaga

SEQ ID NO: 7185876 - DNA, 22 bp, Homo sapiens
tttatgagcctcaaatctgagt

SEQ ID NO: 7185877 - DNA, 22 bp, Homo sapiens
tttatgagcaatgctgagggga

SEQ ID NO: 7185878 - DNA, 22 bp, Homo sapiens
tttatgacccaagaagatacca

SEQ ID NO: 7185879 - DNA, 22 bp, Homo sapiens
tttatgacattacaatatcaag

SEQ ID NO: 7185880 - DNA, 21 bp, Homo sapiens
tttatgtacttcatagagtag

SEQ ID NO: 7185881 - DNA, 21 bp, Homo sapiens
tttatgtacttcatagagtag

SEQ ID NO: 7185882 - DNA, 21 bp, Homo sapiens
tttatgtacttcatagagtag

SEQ ID NO: 7185883 - DNA, 22 bp, Homo sapiens
tttatgacaagcattactgatt

SEQ ID NO: 7185884 - DNA, 22 bp, Homo sapiens
tttatgaactacagatataact

SEQ ID NO: 7185885 - DNA, 22 bp, Homo sapiens
tttatgaactacagatataact

SEQ ID NO: 7185886 - DNA, 22 bp, Homo sapiens
tttatgaactacagatataact

SEQ ID NO: 7185887 - DNA, 22 bp, Homo sapiens
tttatgaactacagatataact

SEQ ID NO: 7185888 - DNA, 22 bp, Homo sapiens
tttatgaactacagatataact

SEQ ID NO: 7185889 - DNA, 22 bp, Homo sapiens
tttatctttggatcttcagaaa

SEQ ID NO: 7185890 - DNA, 22 bp, Homo sapiens
tttatgaaccactctacacctt

SEQ ID NO: 7185891 - DNA, 22 bp, Homo sapiens
tttatctttggatcttcagaaa

SEQ ID NO: 7185892 - DNA, 22 bp, Homo sapiens
tttagctaagacatagattctt

SEQ ID NO: 7185893 - DNA, 22 bp, Homo sapiens
tttagcgtagctgacagctaat

SEQ ID NO: 7185894 - DNA, 22 bp, Homo sapiens
tttagcttgaaagttttggagg

SEQ ID NO: 7185895 - DNA, 22 bp, Homo sapiens
tttagcttcatttggcgtgatt

SEQ ID NO: 7185896 - DNA, 23 bp, Homo sapiens
tttagcttccctttagttagggg

SEQ ID NO: 7185897 - DNA, 22 bp, Homo sapiens
tttagcttgaaagttttggagg

SEQ ID NO: 7185898 - DNA, 22 bp, Homo sapiens
tttacagctgctggcaagcttg

SEQ ID NO: 7185899 - DNA, 22 bp, Homo sapiens
tttacagctagacatacctgag

SEQ ID NO: 7185900 - DNA, 22 bp, Homo sapiens
tttacagcttctatactatgtg

SEQ ID NO: 7185901 - DNA, 22 bp, Homo sapiens
tttacagcttctatactatgtg

SEQ ID NO: 7185902 - DNA, 22 bp, Homo sapiens
tttagcatcgaagtaaatttag

SEQ ID NO: 7185903 - DNA, 23 bp, Homo sapiens
tttagcatgaagcagctggagaa

SEQ ID NO: 7185904 - DNA, 22 bp, Homo sapiens
tttagcattactaaaatgaaaa

SEQ ID NO: 7185905 - DNA, 22 bp, Homo sapiens
tttagcattactaaaatgaaaa

SEQ ID NO: 7185906 - DNA, 22 bp, Homo sapiens
tttaggaagatctgaaggaaga

SEQ ID NO: 7185907 - DNA, 22 bp, Homo sapiens
tttaggaagagttgagtaaatt

SEQ ID NO: 7185908 - DNA, 21 bp, Homo sapiens
tttaggaagtttaaggcaggt

SEQ ID NO: 7185909 - DNA, 21 bp, Homo sapiens
tttaggaagtttaaggcaggt

SEQ ID NO: 7185910 - DNA, 22 bp, Homo sapiens
tttaggaagtttcagataggaa

SEQ ID NO: 7185911 - DNA, 22 bp, Homo sapiens
tttagcttgttggaacaattga

SEQ ID NO: 7185912 - DNA, 22 bp, Homo sapiens
tttagctttacctcatagattt

SEQ ID NO: 7185913 - DNA, 22 bp, Homo sapiens
tttagctttgaaggatatggtt

SEQ ID NO: 7185914 - DNA, 22 bp, Homo sapiens
tttaggaaatacaaggtagcct

SEQ ID NO: 7185915 - DNA, 22 bp, Homo sapiens
tttaggatattaatgttcagag

SEQ ID NO: 7185916 - DNA, 22 bp, Homo sapiens
tttaggcaaactcattgtcaga

SEQ ID NO: 7185917 - DNA, 22 bp, Homo sapiens
tttaggcaaatttcagatgtgc

SEQ ID NO: 7185918 - DNA, 22 bp, Homo sapiens
tttaggcaagaactcactgaga

SEQ ID NO: 7185919 - DNA, 22 bp, Homo sapiens
tttaggcaagggcaagattatc

SEQ ID NO: 7185920 - DNA, 22 bp, Homo sapiens
tttaggcaatagatggcagtgt

SEQ ID NO: 7185921 - DNA, 22 bp, Homo sapiens
tttaggcacaactactcagcta

SEQ ID NO: 7185922 - DNA, 22 bp, Homo sapiens
tttaggcacagagttgagggac

SEQ ID NO: 7185923 - DNA, 22 bp, Homo sapiens
tttatctttaggactttgcaga

SEQ ID NO: 7185924 - DNA, 22 bp, Homo sapiens
tttatctttaggactttgcaga

SEQ ID NO: 7185925 - DNA, 22 bp, Homo sapiens
tttatcttctgcagttctggct

SEQ ID NO: 7185926 - DNA, 22 bp, Homo sapiens
tttatctgttgtacatttatgc

SEQ ID NO: 7185927 - DNA, 22 bp, Homo sapiens
tttatctgttgtacatttatgc

SEQ ID NO: 7185928 - DNA, 22 bp, Homo sapiens
tttatctgttgtacctgcattg

SEQ ID NO: 7185929 - DNA, 22 bp, Homo sapiens
tttatcttctgcagttctggct

SEQ ID NO: 7185930 - DNA, 22 bp, Homo sapiens
tttatctttaggactttgcaga

SEQ ID NO: 7185931 - DNA, 22 bp, Homo sapiens
tttatctgtggtaaataacatt

SEQ ID NO: 7185932 - DNA, 22 bp, Homo sapiens
tttatctgtggtaaataacatt

SEQ ID NO: 7185933 - DNA, 22 bp, Homo sapiens
tttatctgttcctcttggaggc

SEQ ID NO: 7185934 - DNA, 22 bp, Homo sapiens
tttatctgttcctcttggaggc

SEQ ID NO: 7185935 - DNA, 20 bp, Homo sapiens
tttatctgtgggagtggaga

SEQ ID NO: 7185936 - DNA, 22 bp, Homo sapiens
tttatctgtgggagttgtttgg

SEQ ID NO: 7185937 - DNA, 22 bp, Homo sapiens
tttatctggactgtgatataaa

SEQ ID NO: 7185938 - DNA, 22 bp, Homo sapiens
tttatctggactgtgatataaa

SEQ ID NO: 7185939 - DNA, 22 bp, Homo sapiens
tttatctgtatatctcaagtgt

SEQ ID NO: 7185940 - DNA, 22 bp, Homo sapiens
tttagtgtggcactgatgttca

SEQ ID NO: 7185941 - DNA, 22 bp, Homo sapiens
tttagtgtggcactgatgttca

SEQ ID NO: 7185942 - DNA, 22 bp, Homo sapiens
tttagtgtttgcgtgtactcct

SEQ ID NO: 7185943 - DNA, 22 bp, Homo sapiens
tttatctgctatctgctgtgct

SEQ ID NO: 7185944 - DNA, 22 bp, Homo sapiens
tttagtgtagcattcagagtca

SEQ ID NO: 7185945 - DNA, 22 bp, Homo sapiens
tttagtgtagcctaagcagaat

SEQ ID NO: 7185946 - DNA, 22 bp, Homo sapiens
tttagtgtgacagtccccagta

SEQ ID NO: 7185947 - DNA, 22 bp, Homo sapiens
tttaggcagaacatggactttg

SEQ ID NO: 7185948 - DNA, 22 bp, Homo sapiens
tttaggcacagggagttggttt

SEQ ID NO: 7185949 - DNA, 22 bp, Homo sapiens
tttaggcagaagccctgctgat

SEQ ID NO: 7185950 - DNA, 22 bp, Homo sapiens
tttaggcagcacgggcagccct

SEQ ID NO: 7185951 - DNA, 22 bp, Homo sapiens
tttaggcagcagtgaggatgaa

SEQ ID NO: 7185952 - DNA, 22 bp, Homo sapiens
tttaggcagctacatactaact

SEQ ID NO: 7185953 - DNA, 22 bp, Homo sapiens
tttagtgcttaggaaatgggga

SEQ ID NO: 7185954 - DNA, 22 bp, Homo sapiens
tttagtgctttgctattcatgg

SEQ ID NO: 7185955 - DNA, 18 bp, Homo sapiens
tttagtggtgcatttgac

SEQ ID NO: 7185956 - DNA, 22 bp, Homo sapiens
tttagtgtaagcataaagaaca

SEQ ID NO: 7185957 - DNA, 22 bp, Homo sapiens
tttagtgtaagcataaagaaca

SEQ ID NO: 7185958 - DNA, 22 bp, Homo sapiens
tttagtgtaattctgccttttg

SEQ ID NO: 7185959 - DNA, 22 bp, Homo sapiens
tttagtgtaattctgccttttg

SEQ ID NO: 7185960 - DNA, 22 bp, Homo sapiens
tttagtgtagcattcagagtca

SEQ ID NO: 7185961 - DNA, 22 bp, Homo sapiens
tttagtgtagcattcagagtca

SEQ ID NO: 7185962 - DNA, 22 bp, Homo sapiens
tttacagaatgttgaatttggg

SEQ ID NO: 7185963 - DNA, 22 bp, Homo sapiens
tttacagaatgttgaatttggg

SEQ ID NO: 7185964 - DNA, 22 bp, Homo sapiens
tttacagaatgtcaatttctat

SEQ ID NO: 7185965 - DNA, 22 bp, Homo sapiens
tttacagaatgtcaatttctat

SEQ ID NO: 7185966 - DNA, 22 bp, Homo sapiens
tttacacttgaggaaactgagg

SEQ ID NO: 7185967 - DNA, 22 bp, Homo sapiens
tttacagaagagaaggatgctt

SEQ ID NO: 7185968 - DNA, 22 bp, Homo sapiens
tttacacttgaggaaactgagg

SEQ ID NO: 7185969 - DNA, 22 bp, Homo sapiens
tttacagagaatgtacataaag

SEQ ID NO: 7185970 - DNA, 22 bp, Homo sapiens
tttacagagaatgtacataaag

SEQ ID NO: 7185971 - DNA, 22 bp, Homo sapiens
tttacagagaatgtacataaag

SEQ ID NO: 7185972 - DNA, 22 bp, Homo sapiens
tttacagacaacttaatagggg

SEQ ID NO: 7185973 - DNA, 22 bp, Homo sapiens
tttacagacaacttaatagggg

SEQ ID NO: 7185974 - DNA, 22 bp, Homo sapiens
tttacagagaatgtacataaag

SEQ ID NO: 7185975 - DNA, 22 bp, Homo sapiens
tttacagagaatgtacataaag

SEQ ID NO: 7185976 - DNA, 22 bp, Homo sapiens
tttacagagaatgtacataaag

SEQ ID NO: 7185977 - DNA, 22 bp, Homo sapiens
tttacagagagagaactggact

SEQ ID NO: 7185978 - DNA, 22 bp, Homo sapiens
tttacagagagagaactggact

SEQ ID NO: 7185979 - DNA, 22 bp, Homo sapiens
tttacagaggtgtcctgcattg

SEQ ID NO: 7185980 - DNA, 22 bp, Homo sapiens
tttacagatctgttgatttgtt

SEQ ID NO: 7185981 - DNA, 22 bp, Homo sapiens
tttacagatctgttgatttgtt

SEQ ID NO: 7185982 - DNA, 22 bp, Homo sapiens
tttacagatctgttgatttgtt

SEQ ID NO: 7185983 - DNA, 22 bp, Homo sapiens
tttacagatgaggaaactgaga

SEQ ID NO: 7185984 - DNA, 22 bp, Homo sapiens
tttacagatgaggaaactgaga

SEQ ID NO: 7185985 - DNA, 22 bp, Homo sapiens
tttacagatgaggaaactgaga

SEQ ID NO: 7185986 - DNA, 22 bp, Homo sapiens
tttacagatgaggatactgagg

SEQ ID NO: 7185987 - DNA, 22 bp, Homo sapiens
tttacagatgaggatactgagg

SEQ ID NO: 7185988 - DNA, 22 bp, Homo sapiens
tttacagatgaggatactgagg

SEQ ID NO: 7185989 - DNA, 22 bp, Homo sapiens
tttacagatgtggaaagtgagc

SEQ ID NO: 7185990 - DNA, 22 bp, Homo sapiens
tttacagatgtggaaagtgagc

SEQ ID NO: 7185991 - DNA, 22 bp, Homo sapiens
tttacagatgtggaaagtgagc

SEQ ID NO: 7185992 - DNA, 22 bp, Homo sapiens
tttacagattctgggtattagg

SEQ ID NO: 7185993 - DNA, 22 bp, Homo sapiens
tttacagattctgggtattagg

SEQ ID NO: 7185994 - DNA, 22 bp, Homo sapiens
tttacagcaacagtgcagaggt

SEQ ID NO: 7185995 - DNA, 22 bp, Homo sapiens
tttacagcactgaagccagggg

SEQ ID NO: 7185996 - DNA, 22 bp, Homo sapiens
tttacagctagacatacctgag

SEQ ID NO: 7185997 - DNA, 22 bp, Homo sapiens
tttaagagcatttgcaatttat

SEQ ID NO: 7185998 - DNA, 22 bp, Homo sapiens
tttaagactcttgtagtacaca

SEQ ID NO: 7185999 - DNA, 22 bp, Homo sapiens
tttaagaagttatgttataaat

SEQ ID NO: 7186000 - DNA, 20 bp, Homo sapiens
tttaagaagtttctgaggaa

SEQ ID NO: 7186001 - DNA, 22 bp, Homo sapiens
tttaagagctagtatgtcattt

SEQ ID NO: 7186002 - DNA, 22 bp, Homo sapiens
tttaagagctagtatgtcattt

SEQ ID NO: 7186003 - DNA, 22 bp, Homo sapiens
tttaagagctagtatgtcattt

SEQ ID NO: 7186004 - DNA, 22 bp, Homo sapiens
tttaagagttaaactttgacct

SEQ ID NO: 7186005 - DNA, 22 bp, Homo sapiens
tttaagatcatttgtattatcc

SEQ ID NO: 7186006 - DNA, 22 bp, Homo sapiens
tttaagatcatttgtattatcc

SEQ ID NO: 7186007 - DNA, 22 bp, Homo sapiens
tttacacattattttcagtgtg

SEQ ID NO: 7186008 - DNA, 22 bp, Homo sapiens
tttacacattattttcagtgtg

SEQ ID NO: 7186009 - DNA, 22 bp, Homo sapiens
tttacacattattttcagtgtg

SEQ ID NO: 7186010 - DNA, 22 bp, Homo sapiens
tttacaagtttacagaatgatg

SEQ ID NO: 7186011 - DNA, 22 bp, Homo sapiens
tttacaagtttacagaatgatg

SEQ ID NO: 7186012 - DNA, 19 bp, Homo sapiens
tttacaagttctttgtatg

SEQ ID NO: 7186013 - DNA, 22 bp, Homo sapiens
tttacaagtcagggactgttct

SEQ ID NO: 7186014 - DNA, 19 bp, Homo sapiens
tttacaagttctttgtatg

SEQ ID NO: 7186015 - DNA, 22 bp, Homo sapiens
tttacactcctggaaatgatat

SEQ ID NO: 7186016 - DNA, 22 bp, Homo sapiens
tttacacggcattatcttcatg

SEQ ID NO: 7186017 - DNA, 22 bp, Homo sapiens
tttacacattattttcagtgtg

SEQ ID NO: 7186018 - DNA, 22 bp, Homo sapiens
tttacactgacagcacataagg

SEQ ID NO: 7186019 - DNA, 22 bp, Homo sapiens
tttacactgcttgaacaatctc

SEQ ID NO: 7186020 - DNA, 23 bp, Homo sapiens
tttaacatttgaacatgtggcca

SEQ ID NO: 7186021 - DNA, 22 bp, Homo sapiens
tttaaccagaaaggtactcatc

SEQ ID NO: 7186022 - DNA, 22 bp, Homo sapiens
tttaacctctaatttagttctc

SEQ ID NO: 7186023 - DNA, 22 bp, Homo sapiens
tttaactctgtcattctcttta

SEQ ID NO: 7186024 - DNA, 23 bp, Homo sapiens
tttaactttccaataattcattg

SEQ ID NO: 7186025 - DNA, 23 bp, Homo sapiens
tttaactttccaataattcattg

SEQ ID NO: 7186026 - DNA, 22 bp, Homo sapiens
tttaaattatagttaatgtctg

SEQ ID NO: 7186027 - DNA, 22 bp, Homo sapiens
tttaaattatagttaatgtctg

SEQ ID NO: 7186028 - DNA, 22 bp, Homo sapiens
tttaaattatagttaatgtctg

SEQ ID NO: 7186029 - DNA, 22 bp, Homo sapiens
tttaaattatagttaatgtctg

SEQ ID NO: 7186030 - DNA, 22 bp, Homo sapiens
tttaaattatagttaatgtctg

SEQ ID NO: 7186031 - DNA, 22 bp, Homo sapiens
tttaaattatagttaatgtctg

SEQ ID NO: 7186032 - DNA, 22 bp, Homo sapiens
tttaaattatagttaatgtctg

SEQ ID NO: 7186033 - DNA, 22 bp, Homo sapiens
tttaacatgttcaagaaacata

SEQ ID NO: 7186034 - DNA, 22 bp, Homo sapiens
tttaacatgtgaattttggaag

SEQ ID NO: 7186035 - DNA, 22 bp, Homo sapiens
tttaacaggtaaagtaaatgtg

SEQ ID NO: 7186036 - DNA, 22 bp, Homo sapiens
tttaacatgtgaattttggaag

SEQ ID NO: 7186037 - DNA, 22 bp, Homo sapiens
ttgttggtggaattgatgctag

SEQ ID NO: 7186038 - DNA, 22 bp, Homo sapiens
ttgttggtggaattgatgctag

SEQ ID NO: 7186039 - DNA, 22 bp, Homo sapiens
ttgttgtcattgtagaggattt

SEQ ID NO: 7186040 - DNA, 22 bp, Homo sapiens
ttgttgctcttgttgccacatg

SEQ ID NO: 7186041 - DNA, 22 bp, Homo sapiens
ttgttgctgctcaacctctata

SEQ ID NO: 7186042 - DNA, 22 bp, Homo sapiens
ttgttgctgctcaacctctata

SEQ ID NO: 7186043 - DNA, 22 bp, Homo sapiens
ttgtttaaaagaaatcatagaa

SEQ ID NO: 7186044 - DNA, 22 bp, Homo sapiens
ttgtttaaaagaaatcatagaa

SEQ ID NO: 7186045 - DNA, 22 bp, Homo sapiens
ttgtttaaaagaaatcatagaa

SEQ ID NO: 7186046 - DNA, 22 bp, Homo sapiens
ttgtttaaaagaaatcatagaa

SEQ ID NO: 7186047 - DNA, 22 bp, Homo sapiens
ttgtttaaaatgtagcaagaaa

SEQ ID NO: 7186048 - DNA, 22 bp, Homo sapiens
ttgtttaaaatgtagcaagaaa

SEQ ID NO: 7186049 - DNA, 22 bp, Homo sapiens
ttgtttaaaagaaatcatagaa

SEQ ID NO: 7186050 - DNA, 22 bp, Homo sapiens
ttgttgtttccaggatactgtg

SEQ ID NO: 7186051 - DNA, 22 bp, Homo sapiens
ttgttgtcattgtagaggattt

SEQ ID NO: 7186052 - DNA, 22 bp, Homo sapiens
ttgttcttttgcttagacagat

SEQ ID NO: 7186053 - DNA, 23 bp, Homo sapiens
ttgttcttggatcttcctgaagc

SEQ ID NO: 7186054 - DNA, 22 bp, Homo sapiens
ttgttctttatcctggaagcct

SEQ ID NO: 7186055 - DNA, 22 bp, Homo sapiens
ttgttcttgtctttgccttcac

SEQ ID NO: 7186056 - DNA, 22 bp, Homo sapiens
ttgttcttgtctttgccttcac

SEQ ID NO: 7186057 - DNA, 22 bp, Homo sapiens
ttgttgaatggataaataaatt

SEQ ID NO: 7186058 - DNA, 22 bp, Homo sapiens
ttgttcttgccaagacatgaag

SEQ ID NO: 7186059 - DNA, 22 bp, Homo sapiens
ttgttcttggagcaggcagaga

SEQ ID NO: 7186060 - DNA, 21 bp, Homo sapiens
ttgttcttccagaagcaaagt

SEQ ID NO: 7186061 - DNA, 22 bp, Homo sapiens
ttgttcttccatcatccctcag

SEQ ID NO: 7186062 - DNA, 22 bp, Homo sapiens
ttgttcttctctagagaagtgg

SEQ ID NO: 7186063 - DNA, 22 bp, Homo sapiens
ttgttcttagtatgcattgttt

SEQ ID NO: 7186064 - DNA, 21 bp, Homo sapiens
ttgttcttccagaagcaaagt

SEQ ID NO: 7186065 - DNA, 21 bp, Homo sapiens
tttatttatataggacacatg

SEQ ID NO: 7186066 - DNA, 21 bp, Homo sapiens
tttatttatataggacacatg

SEQ ID NO: 7186067 - DNA, 21 bp, Homo sapiens
tttatttatataggacacatg

SEQ ID NO: 7186068 - DNA, 21 bp, Homo sapiens
tttatttatataggacacatg

SEQ ID NO: 7186069 - DNA, 21 bp, Homo sapiens
tttatttatataggacacatg

SEQ ID NO: 7186070 - DNA, 22 bp, Homo sapiens
tttatttataagccacttgctg

SEQ ID NO: 7186071 - DNA, 22 bp, Homo sapiens
tttatttataagccacttgctg

SEQ ID NO: 7186072 - DNA, 21 bp, Homo sapiens
tttatttatataggacacatg

SEQ ID NO: 7186073 - DNA, 21 bp, Homo sapiens
tttatttatataggacacatg

SEQ ID NO: 7186074 - DNA, 21 bp, Homo sapiens
tttatttatataggacacatg

SEQ ID NO: 7186075 - DNA, 22 bp, Homo sapiens
tttatttatccttctggattgc

SEQ ID NO: 7186076 - DNA, 22 bp, Homo sapiens
tttatttatccttctggattgc

SEQ ID NO: 7186077 - DNA, 22 bp, Homo sapiens
tttatttatccttctggattgc

SEQ ID NO: 7186078 - DNA, 22 bp, Homo sapiens
tttatttatccttctggattgc

SEQ ID NO: 7186079 - DNA, 22 bp, Homo sapiens
tttatttatccttctggattgc

SEQ ID NO: 7186080 - DNA, 22 bp, Homo sapiens
tttatttatccttctggattgc

SEQ ID NO: 7186081 - DNA, 22 bp, Homo sapiens
tttatttatccttctggattgc

SEQ ID NO: 7186082 - DNA, 23 bp, Homo sapiens
tttatttatttaggctgagggat

SEQ ID NO: 7186083 - DNA, 23 bp, Homo sapiens
tttatttatttaggctgagggat

SEQ ID NO: 7186084 - DNA, 23 bp, Homo sapiens
tttatttatttaggctgagggat

SEQ ID NO: 7186085 - DNA, 23 bp, Homo sapiens
tttatttatttaggctgagggat

SEQ ID NO: 7186086 - DNA, 22 bp, Homo sapiens
tttcaagtcattctataatatc

SEQ ID NO: 7186087 - DNA, 20 bp, Homo sapiens
tttcaagtcagcaattctca

SEQ ID NO: 7186088 - DNA, 20 bp, Homo sapiens
tttcaagtcagcaattctca

SEQ ID NO: 7186089 - DNA, 22 bp, Homo sapiens
tttcaagtcagtagctaatcat

SEQ ID NO: 7186090 - DNA, 22 bp, Homo sapiens
tttcaagtcagtagctaatcat

SEQ ID NO: 7186091 - DNA, 22 bp, Homo sapiens
tttcaagtactgtaaacatgct

SEQ ID NO: 7186092 - DNA, 22 bp, Homo sapiens
tttcaagtaagatacatttcag

SEQ ID NO: 7186093 - DNA, 22 bp, Homo sapiens
tttcaagcatgtcaagttagtc

SEQ ID NO: 7186094 - DNA, 22 bp, Homo sapiens
tttcaaggccttctggttcagt

SEQ ID NO: 7186095 - DNA, 22 bp, Homo sapiens
tttcacaagacagctactgttg

SEQ ID NO: 7186096 - DNA, 22 bp, Homo sapiens
tttcacaagacagctactgttg

SEQ ID NO: 7186097 - DNA, 22 bp, Homo sapiens
tttcacaagacagctactgttg

SEQ ID NO: 7186098 - DNA, 22 bp, Homo sapiens
tttcacaactgcttatttgaga

SEQ ID NO: 7186099 - DNA, 22 bp, Homo sapiens
tttcacaagtaaagtcctaagt

SEQ ID NO: 7186100 - DNA, 22 bp, Homo sapiens
tttcacaagtttcaggattctg

SEQ ID NO: 7186101 - DNA, 22 bp, Homo sapiens
tttcacaatcaaatggtgaaat

SEQ ID NO: 7186102 - DNA, 22 bp, Homo sapiens
tttcacaacgttgtggtgagag

SEQ ID NO: 7186103 - DNA, 22 bp, Homo sapiens
tttcacaacgttgtggtgagag

SEQ ID NO: 7186104 - DNA, 22 bp, Homo sapiens
tttcacaactgcttatttgaga

SEQ ID NO: 7186105 - DNA, 22 bp, Homo sapiens
tttcacaactgcttatttgaga

SEQ ID NO: 7186106 - DNA, 18 bp, Homo sapiens
tttcacaacctccagagg

SEQ ID NO: 7186107 - DNA, 18 bp, Homo sapiens
tttcacaacctccagagg

SEQ ID NO: 7186108 - DNA, 19 bp, Homo sapiens
tttcaatggcttagagaaa

SEQ ID NO: 7186109 - DNA, 22 bp, Homo sapiens
tttcaatgacacaaaagagaaa

SEQ ID NO: 7186110 - DNA, 22 bp, Homo sapiens
tttcaagtttagtgtgttcaaa

SEQ ID NO: 7186111 - DNA, 22 bp, Homo sapiens
tttcaagttctgttctagggta

SEQ ID NO: 7186112 - DNA, 20 bp, Homo sapiens
tttcaagttgtaaggtatca

SEQ ID NO: 7186113 - DNA, 22 bp, Homo sapiens
tttcaagttaaatggggtcttt

SEQ ID NO: 7186114 - DNA, 22 bp, Homo sapiens
tttcaagtggcgagataaggaa

SEQ ID NO: 7186115 - DNA, 22 bp, Homo sapiens
tttcacatcagaggtagattag

SEQ ID NO: 7186116 - DNA, 22 bp, Homo sapiens
tttcacatcatgggatggaagc

SEQ ID NO: 7186117 - DNA, 22 bp, Homo sapiens
tttcacatatggttgttgattg

SEQ ID NO: 7186118 - DNA, 22 bp, Homo sapiens
tttcacaggattctgatgtagt

SEQ ID NO: 7186119 - DNA, 22 bp, Homo sapiens
tttcacaggtaagcaatacagg

SEQ ID NO: 7186120 - DNA, 22 bp, Homo sapiens
tttcacatatcaactctatcct

SEQ ID NO: 7186121 - DNA, 22 bp, Homo sapiens
tttcacatatggttgttgattg

SEQ ID NO: 7186122 - DNA, 22 bp, Homo sapiens
tttcacatatggttgttgattg

SEQ ID NO: 7186123 - DNA, 22 bp, Homo sapiens
tttcacaatcaaatggtgaaat

SEQ ID NO: 7186124 - DNA, 20 bp, Homo sapiens
tttcacaatgaacatgtctc

SEQ ID NO: 7186125 - DNA, 20 bp, Homo sapiens
tttcacaatgaacatgtctc

SEQ ID NO: 7186126 - DNA, 22 bp, Homo sapiens
tttcacaatcaaatggtgaaat

SEQ ID NO: 7186127 - DNA, 22 bp, Homo sapiens
tttcacaatcaaatggtgaaat

SEQ ID NO: 7186128 - DNA, 20 bp, Homo sapiens
tttcacaatgaacatgtctc

SEQ ID NO: 7186129 - DNA, 23 bp, Homo sapiens
tttcacagcttttattctgcatc

SEQ ID NO: 7186130 - DNA, 22 bp, Homo sapiens
tttcacaggaatacccggcttt

SEQ ID NO: 7186131 - DNA, 22 bp, Homo sapiens
tttcacaggagtcctttctata

SEQ ID NO: 7186132 - DNA, 22 bp, Homo sapiens
tttcacaggagtcctttctata

SEQ ID NO: 7186133 - DNA, 22 bp, Homo sapiens
tttcacaggagtcctttctata

SEQ ID NO: 7186134 - DNA, 22 bp, Homo sapiens
tttcacaggagtcctttctata

SEQ ID NO: 7186135 - DNA, 22 bp, Homo sapiens
tttcacaggatgctgttttata

SEQ ID NO: 7186136 - DNA, 22 bp, Homo sapiens
tttcacatgtgctgttgtcaat

SEQ ID NO: 7186137 - DNA, 22 bp, Homo sapiens
tttcacatgtgctgttgtcaat

SEQ ID NO: 7186138 - DNA, 22 bp, Homo sapiens
tttcacatggtactgcctgttt

SEQ ID NO: 7186139 - DNA, 22 bp, Homo sapiens
tttcacatggtactgcctgttt

SEQ ID NO: 7186140 - DNA, 22 bp, Homo sapiens
tttcacatgtatataggcatta

SEQ ID NO: 7186141 - DNA, 22 bp, Homo sapiens
tttcacatgtatataggcatta

SEQ ID NO: 7186142 - DNA, 20 bp, Homo sapiens
tttcacatctgtccctttaa

SEQ ID NO: 7186143 - DNA, 22 bp, Homo sapiens
tttcacatgcagcagggaagtg

SEQ ID NO: 7186144 - DNA, 22 bp, Homo sapiens
tttcacatggaagctctcgaga

SEQ ID NO: 7186145 - DNA, 20 bp, Homo sapiens
tttcacatctgtccctttaa

SEQ ID NO: 7186146 - DNA, 22 bp, Homo sapiens
tttcacattctctggttatcga

SEQ ID NO: 7186147 - DNA, 22 bp, Homo sapiens
tttcacattcttctgaatctac

SEQ ID NO: 7186148 - DNA, 22 bp, Homo sapiens
tttcacattggcttctatttct

SEQ ID NO: 7186149 - DNA, 23 bp, Homo sapiens
tttcacatttactgttagatggc

SEQ ID NO: 7186150 - DNA, 23 bp, Homo sapiens
tttcacattaatgtttagcagga

SEQ ID NO: 7186151 - DNA, 23 bp, Homo sapiens
tttcacattaatgtttagcagga

SEQ ID NO: 7186152 - DNA, 22 bp, Homo sapiens
tttcacatgtggaatgccaggt

SEQ ID NO: 7186153 - DNA, 23 bp, Homo sapiens
tttcacattaatgtttagcagga

SEQ ID NO: 7186154 - DNA, 22 bp, Homo sapiens
tttcacattagatatgtcattt

SEQ ID NO: 7186155 - DNA, 22 bp, Homo sapiens
tttcacattagatatgtcattt

SEQ ID NO: 7186156 - DNA, 22 bp, Homo sapiens
tttcacattagatatgtcattt

SEQ ID NO: 7186157 - DNA, 22 bp, Homo sapiens
tttcacattcagatatagactt

SEQ ID NO: 7186158 - DNA, 22 bp, Homo sapiens
tttcataaacagtagaagacta

SEQ ID NO: 7186159 - DNA, 23 bp, Homo sapiens
tttcacatttactgttagatggc

SEQ ID NO: 7186160 - DNA, 22 bp, Homo sapiens
tttcacatttaggcgtgaattg

SEQ ID NO: 7186161 - DNA, 22 bp, Homo sapiens
tttcacatttgttttaagaagt

SEQ ID NO: 7186162 - DNA, 22 bp, Homo sapiens
tttcctttgtgcaggccttggg

SEQ ID NO: 7186163 - DNA, 22 bp, Homo sapiens
tttcctttgggcacccgagctc

SEQ ID NO: 7186164 - DNA, 22 bp, Homo sapiens
tttcctttgggagcatgaattt

SEQ ID NO: 7186165 - DNA, 22 bp, Homo sapiens
tttcctttgggagcatgaattt

SEQ ID NO: 7186166 - DNA, 22 bp, Homo sapiens
tttcctttgagggtcctacact

SEQ ID NO: 7186167 - DNA, 22 bp, Homo sapiens
tttcctttgcccaatacatgtc

SEQ ID NO: 7186168 - DNA, 22 bp, Homo sapiens
tttcctttgcccaatacatgtc

SEQ ID NO: 7186169 - DNA, 22 bp, Homo sapiens
tttcctttgcccaatacatgtc

SEQ ID NO: 7186170 - DNA, 22 bp, Homo sapiens
tttcccagaggtatgaataagt

SEQ ID NO: 7186171 - DNA, 21 bp, Homo sapiens
tttcccagcagagatagctgg

SEQ ID NO: 7186172 - DNA, 22 bp, Homo sapiens
tttccttgcacattggtttcca

SEQ ID NO: 7186173 - DNA, 22 bp, Homo sapiens
tttcctttctggtttggtcata

SEQ ID NO: 7186174 - DNA, 22 bp, Homo sapiens
tttcctttgagggtcctacact

SEQ ID NO: 7186175 - DNA, 22 bp, Homo sapiens
tttcccaagtgtaaacatggca

SEQ ID NO: 7186176 - DNA, 22 bp, Homo sapiens
tttcccaagaaaaataattgga

SEQ ID NO: 7186177 - DNA, 22 bp, Homo sapiens
tttcccaagaaaaataattgga

SEQ ID NO: 7186178 - DNA, 22 bp, Homo sapiens
tttcccaacagtctctctcaaa

SEQ ID NO: 7186179 - DNA, 22 bp, Homo sapiens
tttccagtgcatggcaaatgct

SEQ ID NO: 7186180 - DNA, 22 bp, Homo sapiens
tttccagtgcatggcaaatgct

SEQ ID NO: 7186181 - DNA, 22 bp, Homo sapiens
tttccagttgtcctatcacctg

SEQ ID NO: 7186182 - DNA, 22 bp, Homo sapiens
tttccatgatcgttatagaact

SEQ ID NO: 7186183 - DNA, 21 bp, Homo sapiens
tttctaaggaggaagaaaaga

SEQ ID NO: 7186184 - DNA, 22 bp, Homo sapiens
tttctaaggtgaggtagaaaat

SEQ ID NO: 7186185 - DNA, 22 bp, Homo sapiens
tttctaagacatttgtcatctt

SEQ ID NO: 7186186 - DNA, 22 bp, Homo sapiens
tttctaagaatattgctcttaa

SEQ ID NO: 7186187 - DNA, 22 bp, Homo sapiens
tttctaacgtagacagggaggt

SEQ ID NO: 7186188 - DNA, 22 bp, Homo sapiens
tttctaacgtagacagggaggt

SEQ ID NO: 7186189 - DNA, 22 bp, Homo sapiens
tttctaacgtagacagggaggt

SEQ ID NO: 7186190 - DNA, 22 bp, Homo sapiens
tttctaacagcaaatgtttatc

SEQ ID NO: 7186191 - DNA, 22 bp, Homo sapiens
tttctaaatggtggctgcattg

SEQ ID NO: 7186192 - DNA, 22 bp, Homo sapiens
tttctaaaatagattttatggt

SEQ ID NO: 7186193 - DNA, 22 bp, Homo sapiens
tttctaaaatagattttatggt

SEQ ID NO: 7186194 - DNA, 22 bp, Homo sapiens
tttcgtcaattgtaacaaatgt

SEQ ID NO: 7186195 - DNA, 22 bp, Homo sapiens
tttcgtttgcttatataataga

SEQ ID NO: 7186196 - DNA, 22 bp, Homo sapiens
tttctaaacaaagggagtttgg

SEQ ID NO: 7186197 - DNA, 22 bp, Homo sapiens
tttctaaactggattcagcctg

SEQ ID NO: 7186198 - DNA, 22 bp, Homo sapiens
tttctaaactggattcagcctg

SEQ ID NO: 7186199 - DNA, 22 bp, Homo sapiens
tttctaaagggtagatttggcc

SEQ ID NO: 7186200 - DNA, 22 bp, Homo sapiens
tttcggccaactcttttcagtt

SEQ ID NO: 7186201 - DNA, 22 bp, Homo sapiens
tttcgagggattagctaggact

SEQ ID NO: 7186202 - DNA, 22 bp, Homo sapiens
tttccttttggctaggtgtgaa

SEQ ID NO: 7186203 - DNA, 22 bp, Homo sapiens
tttccttttaagcagtcggcct

SEQ ID NO: 7186204 - DNA, 22 bp, Homo sapiens
tttccttttataaggcttgagg

SEQ ID NO: 7186205 - DNA, 22 bp, Homo sapiens
tttcatcttatttgtctacatc

SEQ ID NO: 7186206 - DNA, 22 bp, Homo sapiens
tttcatcttatttgtctacatc

SEQ ID NO: 7186207 - DNA, 22 bp, Homo sapiens
tttcatcttatttgtctacatc

SEQ ID NO: 7186208 - DNA, 22 bp, Homo sapiens
tttcatctgtgctgccaagact

SEQ ID NO: 7186209 - DNA, 22 bp, Homo sapiens
tttcatcttatttgtctacatc

SEQ ID NO: 7186210 - DNA, 22 bp, Homo sapiens
tttcatcttatttgtctacatc

SEQ ID NO: 7186211 - DNA, 22 bp, Homo sapiens
tttcatcttccttggcataggt

SEQ ID NO: 7186212 - DNA, 22 bp, Homo sapiens
tttccaaataaggtcacactca

SEQ ID NO: 7186213 - DNA, 22 bp, Homo sapiens
tttccaaataaggtcacattct

SEQ ID NO: 7186214 - DNA, 22 bp, Homo sapiens
tttccaaataaggtcacattct

SEQ ID NO: 7186215 - DNA, 22 bp, Homo sapiens
tttccagatgctaggttgaaag

SEQ ID NO: 7186216 - DNA, 22 bp, Homo sapiens
tttccaaataaggtcacattct

SEQ ID NO: 7186217 - DNA, 22 bp, Homo sapiens
tttccagagctgagaaggcttg

SEQ ID NO: 7186218 - DNA, 23 bp, Homo sapiens
tttccaggtgaccgtcagaatta

SEQ ID NO: 7186219 - DNA, 22 bp, Homo sapiens
tttccaggccagacctttcaat

SEQ ID NO: 7186220 - DNA, 22 bp, Homo sapiens
tttccaggccagacctttcaat

SEQ ID NO: 7186221 - DNA, 22 bp, Homo sapiens
tttccagggaggaatgtggggt

SEQ ID NO: 7186222 - DNA, 22 bp, Homo sapiens
tttccagtccctggatttaacc

SEQ ID NO: 7186223 - DNA, 22 bp, Homo sapiens
tttccagtctctgcctccaagg

SEQ ID NO: 7186224 - DNA, 22 bp, Homo sapiens
tttccagtgaaattttgaatgt

SEQ ID NO: 7186225 - DNA, 22 bp, Homo sapiens
tttccagtgagcaaatgtagaa

SEQ ID NO: 7186226 - DNA, 22 bp, Homo sapiens
tttccagtgatggggtctggct

SEQ ID NO: 7186227 - DNA, 22 bp, Homo sapiens
tttcatctaacactacataggg

SEQ ID NO: 7186228 - DNA, 22 bp, Homo sapiens
tttcatctaacactacataggg

SEQ ID NO: 7186229 - DNA, 22 bp, Homo sapiens
tttcatctatttgctttgtgaa

SEQ ID NO: 7186230 - DNA, 22 bp, Homo sapiens
tttcatctctctaaaagacagt

SEQ ID NO: 7186231 - DNA, 22 bp, Homo sapiens
tttcatctctctaaaagacagt

SEQ ID NO: 7186232 - DNA, 22 bp, Homo sapiens
tttcatcatgttggcagattgg

SEQ ID NO: 7186233 - DNA, 22 bp, Homo sapiens
tttcatcatcaaaatagtgagg

SEQ ID NO: 7186234 - DNA, 22 bp, Homo sapiens
tttcatcatgttggcagattgg

SEQ ID NO: 7186235 - DNA, 22 bp, Homo sapiens
tttcatcaccccaaatctatgg

SEQ ID NO: 7186236 - DNA, 22 bp, Homo sapiens
tttcatcaccccaaatctatgg

SEQ ID NO: 7186237 - DNA, 22 bp, Homo sapiens
tttcatcaccccaaatctatgg

SEQ ID NO: 7186238 - DNA, 23 bp, Homo sapiens
tttcatcagttgatctggacagc

SEQ ID NO: 7186239 - DNA, 22 bp, Homo sapiens
tttcatcatcaaaatagtgagg

SEQ ID NO: 7186240 - DNA, 22 bp, Homo sapiens
tttcatcatcaaaatagtgagg

SEQ ID NO: 7186241 - DNA, 22 bp, Homo sapiens
tttcatagccttctaatgagtt

SEQ ID NO: 7186242 - DNA, 22 bp, Homo sapiens
tttcatagctgaaaatgttgaa

SEQ ID NO: 7186243 - DNA, 22 bp, Homo sapiens
tttcatagtcaagtgtgtatga

SEQ ID NO: 7186244 - DNA, 22 bp, Homo sapiens
tttcatatgggcattggcaata

SEQ ID NO: 7186245 - DNA, 22 bp, Homo sapiens
tttcatatgggcattggcaata

SEQ ID NO: 7186246 - DNA, 22 bp, Homo sapiens
tttcatatgggcattggcaata

SEQ ID NO: 7186247 - DNA, 23 bp, Homo sapiens
tttcatatggtgtggatgaagaa

SEQ ID NO: 7186248 - DNA, 22 bp, Homo sapiens
tttcatattattccttgagtct

SEQ ID NO: 7186249 - DNA, 22 bp, Homo sapiens
tttcatattattccttgagtct

SEQ ID NO: 7186250 - DNA, 22 bp, Homo sapiens
tttcatattattccttgagtct

SEQ ID NO: 7186251 - DNA, 22 bp, Homo sapiens
tttcataatatccagagatttt

SEQ ID NO: 7186252 - DNA, 22 bp, Homo sapiens
tttcataatagtgcagtttgtt

SEQ ID NO: 7186253 - DNA, 22 bp, Homo sapiens
tttcataatagtgcagtttgtt

SEQ ID NO: 7186254 - DNA, 22 bp, Homo sapiens
tttcataatatccagagatttt

SEQ ID NO: 7186255 - DNA, 22 bp, Homo sapiens
tttcataatctgtcaagtgggg

SEQ ID NO: 7186256 - DNA, 22 bp, Homo sapiens
tttcataatctgtcaagtgggg

SEQ ID NO: 7186257 - DNA, 22 bp, Homo sapiens
tttcataatgtcacagtcaaaa

SEQ ID NO: 7186258 - DNA, 22 bp, Homo sapiens
tttcataatactgtacatgaaa

SEQ ID NO: 7186259 - DNA, 22 bp, Homo sapiens
tttcataatactgtacatgaaa

SEQ ID NO: 7186260 - DNA, 22 bp, Homo sapiens
tttcataagggtttctagactt

SEQ ID NO: 7186261 - DNA, 22 bp, Homo sapiens
tttcataacctcaagctacagt

SEQ ID NO: 7186262 - DNA, 22 bp, Homo sapiens
tttcataacctcaagctacagt

SEQ ID NO: 7186263 - DNA, 22 bp, Homo sapiens
tttcataacctcaagctacagt

SEQ ID NO: 7186264 - DNA, 18 bp, Homo sapiens
ttttccttccaccttgaa

SEQ ID NO: 7186265 - DNA, 22 bp, Homo sapiens
ttttccttctagagcagatttc

SEQ ID NO: 7186266 - DNA, 22 bp, Homo sapiens
ttttccttctagagcagatttc

SEQ ID NO: 7186267 - DNA, 22 bp, Homo sapiens
ttttccttctagagcagatttc

SEQ ID NO: 7186268 - DNA, 19 bp, Homo sapiens
ttttccttctatatgtttc

SEQ ID NO: 7186269 - DNA, 19 bp, Homo sapiens
ttttccttctatatgtttc

SEQ ID NO: 7186270 - DNA, 22 bp, Homo sapiens
ttttggctctgtctgtatcttt

SEQ ID NO: 7186271 - DNA, 22 bp, Homo sapiens
ttttgggtatagaggtgttcat

SEQ ID NO: 7186272 - DNA, 22 bp, Homo sapiens
ttttgggtgaatttgccagtta

SEQ ID NO: 7186273 - DNA, 22 bp, Homo sapiens
ttttgggtggaagctgttatgg

SEQ ID NO: 7186274 - DNA, 22 bp, Homo sapiens
ttttgggtggaagctgttatgg

SEQ ID NO: 7186275 - DNA, 22 bp, Homo sapiens
ttttggtaaataatcaactttg

SEQ ID NO: 7186276 - DNA, 22 bp, Homo sapiens
ttttggtaatgaacttaggaag

SEQ ID NO: 7186277 - DNA, 22 bp, Homo sapiens
ttttggtgcacctagctttttc

SEQ ID NO: 7186278 - DNA, 22 bp, Homo sapiens
ttttggtgcacctagctttttc

SEQ ID NO: 7186279 - DNA, 22 bp, Homo sapiens
ttttggtgccctggttcccacc

SEQ ID NO: 7186280 - DNA, 22 bp, Homo sapiens
ttttggtggtgggcttggcagc

SEQ ID NO: 7186281 - DNA, 20 bp, Homo sapiens
ttttggtgaattccagaata

SEQ ID NO: 7186282 - DNA, 22 bp, Homo sapiens
ttttggtgaatttaagtgctgt

SEQ ID NO: 7186283 - DNA, 22 bp, Homo sapiens
ttttggtgaatttaagtgctgt

SEQ ID NO: 7186284 - DNA, 16 bp, Homo sapiens
ttttggtgaccctgga

SEQ ID NO: 7186285 - DNA, 17 bp, Homo sapiens
ttttggtgaccttggcc

SEQ ID NO: 7186286 - DNA, 18 bp, Homo sapiens
ttttggtgaggaagtgag

SEQ ID NO: 7186287 - DNA, 17 bp, Homo sapiens
ttttggtgagttgtttc

SEQ ID NO: 7186288 - DNA, 17 bp, Homo sapiens
ttttggtgagttgtttc

SEQ ID NO: 7186289 - DNA, 22 bp, Homo sapiens
ttttggtgattttactgaaggt

SEQ ID NO: 7186290 - DNA, 22 bp, Homo sapiens
ttttggtgattttactgaaggt

SEQ ID NO: 7186291 - DNA, 22 bp, Homo sapiens
ttttggtaatgcctaacttcgt

SEQ ID NO: 7186292 - DNA, 22 bp, Homo sapiens
ttttggtaattaagtagatatt

SEQ ID NO: 7186293 - DNA, 22 bp, Homo sapiens
ttttggtacatgcaatagcaat

SEQ ID NO: 7186294 - DNA, 22 bp, Homo sapiens
ttttggtacctacagctgaatt

SEQ ID NO: 7186295 - DNA, 22 bp, Homo sapiens
ttttggtagaatcaacaatgta

SEQ ID NO: 7186296 - DNA, 22 bp, Homo sapiens
ttttggtagaatcaacaatgta

SEQ ID NO: 7186297 - DNA, 22 bp, Homo sapiens
ttttggtagaatgatattggat

SEQ ID NO: 7186298 - DNA, 22 bp, Homo sapiens
ttttggtagccaacaaaatgtt

SEQ ID NO: 7186299 - DNA, 22 bp, Homo sapiens
ttttggtagcttatgtgcagtt

SEQ ID NO: 7186300 - DNA, 22 bp, Homo sapiens
ttttggtagtccagagtttagt

SEQ ID NO: 7186301 - DNA, 22 bp, Homo sapiens
ttttggtatggaatccttgctc

SEQ ID NO: 7186302 - DNA, 22 bp, Homo sapiens
ttttggtcaggttggtctcgaa

SEQ ID NO: 7186303 - DNA, 21 bp, Homo sapiens
ttttggtcctggcttaggagc

SEQ ID NO: 7186304 - DNA, 20 bp, Homo sapiens
ttttggtcttcagacaaggc

SEQ ID NO: 7186305 - DNA, 22 bp, Homo sapiens
ttttccttcacctcttgagcct

SEQ ID NO: 7186306 - DNA, 22 bp, Homo sapiens
ttttccttaacagagggagaaa

SEQ ID NO: 7186307 - DNA, 22 bp, Homo sapiens
ttttccttagcttctctgcgag

SEQ ID NO: 7186308 - DNA, 22 bp, Homo sapiens
ttttccttcatatcccttatgt

SEQ ID NO: 7186309 - DNA, 22 bp, Homo sapiens
ttttccttcatatcccttatgt

SEQ ID NO: 7186310 - DNA, 22 bp, Homo sapiens
ttttcctctgcagagcagttag

SEQ ID NO: 7186311 - DNA, 22 bp, Homo sapiens
ttttcctctgcagagcagttag

SEQ ID NO: 7186312 - DNA, 22 bp, Homo sapiens
ttttcctctgagctttgaataa

SEQ ID NO: 7186313 - DNA, 22 bp, Homo sapiens
ttttcctctgcaataaaagcag

SEQ ID NO: 7186314 - DNA, 22 bp, Homo sapiens
ttttcctcaggaatgctaagct

SEQ ID NO: 7186315 - DNA, 22 bp, Homo sapiens
ttttcctatatgcaaagaatgc

SEQ ID NO: 7186316 - DNA, 22 bp, Homo sapiens
ttttcctagtaggcctattaga

SEQ ID NO: 7186317 - DNA, 22 bp, Homo sapiens
ttttcctactgataaacagtta

SEQ ID NO: 7186318 - DNA, 22 bp, Homo sapiens
ttttcccatctacaaagcaggg

SEQ ID NO: 7186319 - DNA, 22 bp, Homo sapiens
ttttcccatctacaaagcaggg

SEQ ID NO: 7186320 - DNA, 23 bp, Homo sapiens
ttttccagaatcgactctgtaga

SEQ ID NO: 7186321 - DNA, 22 bp, Homo sapiens
ttttccagagctgtctcttgca

SEQ ID NO: 7186322 - DNA, 22 bp, Homo sapiens
ttttccagatgaattccacagt

SEQ ID NO: 7186323 - DNA, 19 bp, Homo sapiens
ttttcccaccctttagaat

SEQ ID NO: 7186324 - DNA, 22 bp, Homo sapiens
ttttgtgagatgcgtatgaatg

SEQ ID NO: 7186325 - DNA, 22 bp, Homo sapiens
ttttgtgacagaaagattaagt

SEQ ID NO: 7186326 - DNA, 22 bp, Homo sapiens
ttttgtgaatagtttatctaag

SEQ ID NO: 7186327 - DNA, 22 bp, Homo sapiens
ttttgtctaagaactttgcaaa

SEQ ID NO: 7186328 - DNA, 22 bp, Homo sapiens
ttttgtctaagaactttgcaaa

SEQ ID NO: 7186329 - DNA, 22 bp, Homo sapiens
ttttgtctaagaactttgcaaa

SEQ ID NO: 7186330 - DNA, 22 bp, Homo sapiens
ttttgtctaagaactttgcaaa

SEQ ID NO: 7186331 - DNA, 19 bp, Homo sapiens
ttttgtcttcccttagttt

SEQ ID NO: 7186332 - DNA, 22 bp, Homo sapiens
ttttgtcacctgatttgcccac

SEQ ID NO: 7186333 - DNA, 22 bp, Homo sapiens
ttttgtcacctgatttgcccac

SEQ ID NO: 7186334 - DNA, 22 bp, Homo sapiens
ttttgtcagtgagaacagagtt

SEQ ID NO: 7186335 - DNA, 22 bp, Homo sapiens
ttttgtatgagaagtgctttac

SEQ ID NO: 7186336 - DNA, 22 bp, Homo sapiens
ttttgtatcctccctttcactg

SEQ ID NO: 7186337 - DNA, 22 bp, Homo sapiens
ttttgtatagtcaaagacaaga

SEQ ID NO: 7186338 - DNA, 22 bp, Homo sapiens
ttttgtatcctccctttcactg

SEQ ID NO: 7186339 - DNA, 22 bp, Homo sapiens
ttttgtatgagaagtgctttac

SEQ ID NO: 7186340 - DNA, 22 bp, Homo sapiens
ttttgtaagaaactgccaagcc

SEQ ID NO: 7186341 - DNA, 22 bp, Homo sapiens
ttttgtaagaaactgccaagcc

SEQ ID NO: 7186342 - DNA, 22 bp, Homo sapiens
ttttgtaatttcctgacgacta

SEQ ID NO: 7186343 - DNA, 22 bp, Homo sapiens
ttttgtatagtcaaagacaaga

SEQ ID NO: 7186344 - DNA, 22 bp, Homo sapiens
ttttgtaatttcctgacgacta

SEQ ID NO: 7186345 - DNA, 22 bp, Homo sapiens
ttttgtatagtcaaagacaaga

SEQ ID NO: 7186346 - DNA, 22 bp, Homo sapiens
ttttgtgagctgagaaatgtat

SEQ ID NO: 7186347 - DNA, 19 bp, Homo sapiens
ttttgtgtagctgctggtt

SEQ ID NO: 7186348 - DNA, 22 bp, Homo sapiens
ttttgtgagcccataaatgcca

SEQ ID NO: 7186349 - DNA, 22 bp, Homo sapiens
ttttgtgtccttcacatcatgt

SEQ ID NO: 7186350 - DNA, 22 bp, Homo sapiens
ttttgtgtccttcacatcatgt

SEQ ID NO: 7186351 - DNA, 23 bp, Homo sapiens
ttttgtgtgacttaatatctctt

SEQ ID NO: 7186352 - DNA, 22 bp, Homo sapiens
ttttgtgttgccatgttaagca

SEQ ID NO: 7186353 - DNA, 22 bp, Homo sapiens
ttttgtgttgccatgttaagca

SEQ ID NO: 7186354 - DNA, 22 bp, Homo sapiens
tttttgtagtcattagaagagg

SEQ ID NO: 7186355 - DNA, 22 bp, Homo sapiens
ttttgtgttgccatgttaagca

SEQ ID NO: 7186356 - DNA, 22 bp, Homo sapiens
ttttgtgttgtaatgtcagcta

SEQ ID NO: 7186357 - DNA, 17 bp, Homo sapiens
ttttgttcatcttcaaa

SEQ ID NO: 7186358 - DNA, 17 bp, Homo sapiens
ttttgttcatcttcaaa

SEQ ID NO: 7186359 - DNA, 22 bp, Homo sapiens
ttttgttgacctctcccacctt

SEQ ID NO: 7186360 - DNA, 22 bp, Homo sapiens
ttttgttggcttaagaaataca

SEQ ID NO: 7186361 - DNA, 22 bp, Homo sapiens
tttttgttcccagagaatttgt

SEQ ID NO: 7186362 - DNA, 22 bp, Homo sapiens
tttttgttctgattatactggt

SEQ ID NO: 7186363 - DNA, 22 bp, Homo sapiens
tttttgtgtgagcagggtgtta

SEQ ID NO: 7186364 - DNA, 22 bp, Homo sapiens
tttttgttcccagagaatttgt

SEQ ID NO: 7186365 - DNA, 22 bp, Homo sapiens
tttttgttctgattatactggt

SEQ ID NO: 7186366 - DNA, 22 bp, Homo sapiens
tttttgttctgattatactggt

SEQ ID NO: 7186367 - DNA, 22 bp, Homo sapiens
tttttgttgcagagaggccact

SEQ ID NO: 7186368 - DNA, 22 bp, Homo sapiens
ttttttacagaatcattaatca

SEQ ID NO: 7186369 - DNA, 22 bp, Homo sapiens
ttttttacagaatcattaatca

SEQ ID NO: 7186370 - DNA, 22 bp, Homo sapiens
ttttttacagaatcattaatca

SEQ ID NO: 7186371 - DNA, 22 bp, Homo sapiens
tttttgtggtgtgagtggacat

SEQ ID NO: 7186372 - DNA, 22 bp, Homo sapiens
tttttgtggtgcagactaaagc

SEQ ID NO: 7186373 - DNA, 22 bp, Homo sapiens
tttttgtgtatcctgctccatg

SEQ ID NO: 7186374 - DNA, 22 bp, Homo sapiens
tttttgtgatatgacactgtat

SEQ ID NO: 7186375 - DNA, 22 bp, Homo sapiens
tttttgtggtatattgcaacaa

SEQ ID NO: 7186376 - DNA, 22 bp, Homo sapiens
tttttgtctattcactgattca

SEQ ID NO: 7186377 - DNA, 22 bp, Homo sapiens
tttttgtctattcactgattca

SEQ ID NO: 7186378 - DNA, 22 bp, Homo sapiens
tttttgtgaaatctccagacat

SEQ ID NO: 7186379 - DNA, 22 bp, Homo sapiens
ttttttatatcaactgaagtct

SEQ ID NO: 7186380 - DNA, 22 bp, Homo sapiens
ttttttatatcaactgaagtct

SEQ ID NO: 7186381 - DNA, 22 bp, Homo sapiens
ttttttatagcaatgaacccac

SEQ ID NO: 7186382 - DNA, 22 bp, Homo sapiens
ttttttagttaggtcagaatgt

SEQ ID NO: 7186383 - DNA, 22 bp, Homo sapiens
ttttttatagcaatgaacccac

SEQ ID NO: 7186384 - DNA, 22 bp, Homo sapiens
ttttttatagcaatgaacccac

SEQ ID NO: 7186385 - DNA, 22 bp, Homo sapiens
ttttttatatcaactgaagtct

SEQ ID NO: 7186386 - DNA, 22 bp, Homo sapiens
ttttttatctatggtagtacca

SEQ ID NO: 7186387 - DNA, 22 bp, Homo sapiens
ttttttatctatggtagtacca

SEQ ID NO: 7186388 - DNA, 22 bp, Homo sapiens
ttttttatatcaactgaagtct

SEQ ID NO: 7186389 - DNA, 22 bp, Homo sapiens
ttttttatatcaactgaagtct

SEQ ID NO: 7186390 - DNA, 22 bp, Homo sapiens
ttttttatatcaactgaagtct

SEQ ID NO: 7186391 - DNA, 22 bp, Homo sapiens
ttttttatctatggtagtacca

SEQ ID NO: 7186392 - DNA, 22 bp, Homo sapiens
ttttttatctatggtagtacca

SEQ ID NO: 7186393 - DNA, 22 bp, Homo sapiens
ttttttatctatggtagtacca

SEQ ID NO: 7186394 - DNA, 22 bp, Homo sapiens
ttttttccagcttctagaggcc

SEQ ID NO: 7186395 - DNA, 22 bp, Homo sapiens
ttttttccaacttaagacttca

SEQ ID NO: 7186396 - DNA, 22 bp, Homo sapiens
tttgtgctgacatttgggtcat

SEQ ID NO: 7186397 - DNA, 22 bp, Homo sapiens
tttgtggatggaaaatagcagg

SEQ ID NO: 7186398 - DNA, 22 bp, Homo sapiens
tttgtggatggaaaatagcagg

SEQ ID NO: 7186399 - DNA, 22 bp, Homo sapiens
tttgtgcaagacatgctaagag

SEQ ID NO: 7186400 - DNA, 22 bp, Homo sapiens
tttgtgcaatttatgtactata

SEQ ID NO: 7186401 - DNA, 22 bp, Homo sapiens
tttgtgcagatgtatatttgtg

SEQ ID NO: 7186402 - DNA, 20 bp, Homo sapiens
tttgtctgttaagtgtttct

SEQ ID NO: 7186403 - DNA, 22 bp, Homo sapiens
tttgtcttaaatcttgttactg

SEQ ID NO: 7186404 - DNA, 22 bp, Homo sapiens
tttgtcttaaatcttgttactg

SEQ ID NO: 7186405 - DNA, 22 bp, Homo sapiens
tttgtcttaaatcttgttactg

SEQ ID NO: 7186406 - DNA, 20 bp, Homo sapiens
tttgtctgttaagtgtttct

SEQ ID NO: 7186407 - DNA, 19 bp, Homo sapiens
tttgtctctgaataatatt

SEQ ID NO: 7186408 - DNA, 19 bp, Homo sapiens
tttgtctctgaataatatt

SEQ ID NO: 7186409 - DNA, 22 bp, Homo sapiens
tttgtccttgaatcaattcaca

SEQ ID NO: 7186410 - DNA, 18 bp, Homo sapiens
tttgtcctgtggcagctg

SEQ ID NO: 7186411 - DNA, 22 bp, Homo sapiens
tttgtctaattgcaaggcaagt

SEQ ID NO: 7186412 - DNA, 22 bp, Homo sapiens
tttgtctacaaaaagtgtacag

SEQ ID NO: 7186413 - DNA, 22 bp, Homo sapiens
tttgtcttaaatcttgttactg

SEQ ID NO: 7186414 - DNA, 22 bp, Homo sapiens
tttgtcttaaatcttgttactg

SEQ ID NO: 7186415 - DNA, 22 bp, Homo sapiens
tttgtcttatccaatctctcag

SEQ ID NO: 7186416 - DNA, 22 bp, Homo sapiens
tttgtcttatccaatctctcag

SEQ ID NO: 7186417 - DNA, 22 bp, Homo sapiens
tttgtcttatccaatctctcag

SEQ ID NO: 7186418 - DNA, 22 bp, Homo sapiens
tttgtcttccccctttaatcag

SEQ ID NO: 7186419 - DNA, 22 bp, Homo sapiens
tttgtcttatccaatctctcag

SEQ ID NO: 7186420 - DNA, 22 bp, Homo sapiens
tttgtcttatccaatctctcag

SEQ ID NO: 7186421 - DNA, 22 bp, Homo sapiens
tttgtcttccccctttaatcag

SEQ ID NO: 7186422 - DNA, 22 bp, Homo sapiens
tttgtcttccccctttaatcag

SEQ ID NO: 7186423 - DNA, 22 bp, Homo sapiens
tttgtcttccccctttaatcag

SEQ ID NO: 7186424 - DNA, 23 bp, Homo sapiens
ttttaatttggacataagaagat

SEQ ID NO: 7186425 - DNA, 22 bp, Homo sapiens
tttgtgtcgtcactgtcttctc

SEQ ID NO: 7186426 - DNA, 23 bp, Homo sapiens
ttttaatttggacataagaagat

SEQ ID NO: 7186427 - DNA, 22 bp, Homo sapiens
ttttaattttagcccttctggt

SEQ ID NO: 7186428 - DNA, 22 bp, Homo sapiens
tttgtgtaccttgtacatttgt

SEQ ID NO: 7186429 - DNA, 22 bp, Homo sapiens
tttgtgtatgcttcacctagcc

SEQ ID NO: 7186430 - DNA, 22 bp, Homo sapiens
ttttacaagctgagtcgttaaa

SEQ ID NO: 7186431 - DNA, 22 bp, Homo sapiens
ttttacaagctgagtcgttaaa

SEQ ID NO: 7186432 - DNA, 22 bp, Homo sapiens
ttttacaaatgaggagctggag

SEQ ID NO: 7186433 - DNA, 22 bp, Homo sapiens
ttttaattttgcaaatctggtg

SEQ ID NO: 7186434 - DNA, 22 bp, Homo sapiens
ttttaattttgcaaatctggtg

SEQ ID NO: 7186435 - DNA, 22 bp, Homo sapiens
ttttaattttagcccttctggt

SEQ ID NO: 7186436 - DNA, 22 bp, Homo sapiens
ttttacagttccatgcaaagcg

SEQ ID NO: 7186437 - DNA, 22 bp, Homo sapiens
ttttacagttccatgcaaagcg

SEQ ID NO: 7186438 - DNA, 22 bp, Homo sapiens
ttttacagttccatgcaaagcg

SEQ ID NO: 7186439 - DNA, 22 bp, Homo sapiens
ttttacagtcagtcaaactcag

SEQ ID NO: 7186440 - DNA, 22 bp, Homo sapiens
ttttacagtcagtcaaactcag

SEQ ID NO: 7186441 - DNA, 22 bp, Homo sapiens
ttttacagtcagtcaaactcag

SEQ ID NO: 7186442 - DNA, 22 bp, Homo sapiens
ttttacagttccatgcaaagcg

SEQ ID NO: 7186443 - DNA, 22 bp, Homo sapiens
ttttacagttccatgcaaagcg

SEQ ID NO: 7186444 - DNA, 22 bp, Homo sapiens
ttttacagttccatgcaaagcg

SEQ ID NO: 7186445 - DNA, 22 bp, Homo sapiens
ttttacagttccatgcaaagcg

SEQ ID NO: 7186446 - DNA, 22 bp, Homo sapiens
ttttacaggtcataggtatagt

SEQ ID NO: 7186447 - DNA, 22 bp, Homo sapiens
ttttacaggtcataggtatagt

SEQ ID NO: 7186448 - DNA, 22 bp, Homo sapiens
ttttacaggtgaaaaatgaaga

SEQ ID NO: 7186449 - DNA, 22 bp, Homo sapiens
ttttacaggtgaaaaatgaaga

SEQ ID NO: 7186450 - DNA, 22 bp, Homo sapiens
ttttacaggtgaaaaatgaaga

SEQ ID NO: 7186451 - DNA, 22 bp, Homo sapiens
ttttacaggtgtgagccaccat

SEQ ID NO: 7186452 - DNA, 22 bp, Homo sapiens
ttttacaggtgtgagccaccat

SEQ ID NO: 7186453 - DNA, 22 bp, Homo sapiens
ttttacaggtgtgagccaccat

SEQ ID NO: 7186454 - DNA, 22 bp, Homo sapiens
ttttacaggtcataggtatagt

SEQ ID NO: 7186455 - DNA, 22 bp, Homo sapiens
ttttacaggtcataggtatagt

SEQ ID NO: 7186456 - DNA, 22 bp, Homo sapiens
ttttacaggtcataggtatagt

SEQ ID NO: 7186457 - DNA, 21 bp, Homo sapiens
ttttacagatgaggggaaggg

SEQ ID NO: 7186458 - DNA, 21 bp, Homo sapiens
ttttacagatgaggggaaggg

SEQ ID NO: 7186459 - DNA, 21 bp, Homo sapiens
ttttacagatgaggggaaggg

SEQ ID NO: 7186460 - DNA, 22 bp, Homo sapiens
ttttacacctgttaactctaag

SEQ ID NO: 7186461 - DNA, 22 bp, Homo sapiens
ttttacacctgttaactctaag

SEQ ID NO: 7186462 - DNA, 22 bp, Homo sapiens
ttttacaagctgagtcgttaaa

SEQ ID NO: 7186463 - DNA, 22 bp, Homo sapiens
ttttacacctcagatgagcaga

SEQ ID NO: 7186464 - DNA, 22 bp, Homo sapiens
ttttacacctcagatgagcaga

SEQ ID NO: 7186465 - DNA, 22 bp, Homo sapiens
ttttacacctcagatgagcaga

SEQ ID NO: 7186466 - DNA, 22 bp, Homo sapiens
ttttacattgggaaatgcctct

SEQ ID NO: 7186467 - DNA, 22 bp, Homo sapiens
ttttacattgggaaatgcctct

SEQ ID NO: 7186468 - DNA, 22 bp, Homo sapiens
ttttaccactgggtgacatgga

SEQ ID NO: 7186469 - DNA, 22 bp, Homo sapiens
ttttacttaattcttggtcatg

SEQ ID NO: 7186470 - DNA, 22 bp, Homo sapiens
ttttacttcattcctgacttca

SEQ ID NO: 7186471 - DNA, 22 bp, Homo sapiens
ttttacttcattcctgacttca

SEQ ID NO: 7186472 - DNA, 22 bp, Homo sapiens
ttttagaaagatccctggcagg

SEQ ID NO: 7186473 - DNA, 22 bp, Homo sapiens
ttttagaaatactgatttagtg

SEQ ID NO: 7186474 - DNA, 22 bp, Homo sapiens
ttttagaaagatccctggcagg

SEQ ID NO: 7186475 - DNA, 22 bp, Homo sapiens
ttttactttggatacagtactt

SEQ ID NO: 7186476 - DNA, 22 bp, Homo sapiens
ttttagaaggaatgctatggtg

SEQ ID NO: 7186477 - DNA, 22 bp, Homo sapiens
ttttagaaggaatgctatggtg

SEQ ID NO: 7186478 - DNA, 22 bp, Homo sapiens
ttttagaaggaatgctatggtg

SEQ ID NO: 7186479 - DNA, 22 bp, Homo sapiens
ttttagaagtgcctatcctatg

SEQ ID NO: 7186480 - DNA, 22 bp, Homo sapiens
ttttagaagtgcctatcctatg

SEQ ID NO: 7186481 - DNA, 22 bp, Homo sapiens
ttttagaaatactgatttagtg

SEQ ID NO: 7186482 - DNA, 22 bp, Homo sapiens
ttttagaaatactgatttagtg

SEQ ID NO: 7186483 - DNA, 22 bp, Homo sapiens
ttttagaaatactgatttagtg

SEQ ID NO: 7186484 - DNA, 22 bp, Homo sapiens
ttttattggtaatgataaaagt

SEQ ID NO: 7186485 - DNA, 22 bp, Homo sapiens
ttttattggtaatgataaaagt

SEQ ID NO: 7186486 - DNA, 22 bp, Homo sapiens
ttttattggtaatgataaaagt

SEQ ID NO: 7186487 - DNA, 22 bp, Homo sapiens
ttttattggtaatgataaaagt

SEQ ID NO: 7186488 - DNA, 22 bp, Homo sapiens
ttttattggtaatgataaaagt

SEQ ID NO: 7186489 - DNA, 22 bp, Homo sapiens
ttttattggtaatgataaaagt

SEQ ID NO: 7186490 - DNA, 22 bp, Homo sapiens
ttttattggtaatgataaaagt

SEQ ID NO: 7186491 - DNA, 22 bp, Homo sapiens
ttttattggtaatgataaaagt

SEQ ID NO: 7186492 - DNA, 22 bp, Homo sapiens
ttttattggtaatgataaaagt

SEQ ID NO: 7186493 - DNA, 22 bp, Homo sapiens
ttttattggtaatgataaaagt

SEQ ID NO: 7186494 - DNA, 22 bp, Homo sapiens
ttttattggtaatgataaaagt

SEQ ID NO: 7186495 - DNA, 22 bp, Homo sapiens
ttttattggtaatgataaaagt

SEQ ID NO: 7186496 - DNA, 22 bp, Homo sapiens
ttttagaagtgcctatcctatg

SEQ ID NO: 7186497 - DNA, 22 bp, Homo sapiens
ttttagaagtgcctatcctatg

SEQ ID NO: 7186498 - DNA, 22 bp, Homo sapiens
ttttagaagtgcctatcctatg

SEQ ID NO: 7186499 - DNA, 22 bp, Homo sapiens
ttttattgggagtcctctactg

SEQ ID NO: 7186500 - DNA, 22 bp, Homo sapiens
ttttattgggagtcctctactg

SEQ ID NO: 7186501 - DNA, 22 bp, Homo sapiens
ttttattgggagtcctctactg

SEQ ID NO: 7186502 - DNA, 22 bp, Homo sapiens
ttttagaagtgcctatcctatg

SEQ ID NO: 7186503 - DNA, 22 bp, Homo sapiens
ttttattgggagtcctctactg

SEQ ID NO: 7186504 - DNA, 22 bp, Homo sapiens
ttttattgggagtcctctactg

SEQ ID NO: 7186505 - DNA, 22 bp, Homo sapiens
ttttattgggagtcctctactg

SEQ ID NO: 7186506 - DNA, 22 bp, Homo sapiens
ttttcaaagactggaggctgat

SEQ ID NO: 7186507 - DNA, 22 bp, Homo sapiens
ttttcaaagactggaggctgat

SEQ ID NO: 7186508 - DNA, 16 bp, Homo sapiens
ttttattgtgacagcc

SEQ ID NO: 7186509 - DNA, 16 bp, Homo sapiens
ttttattgtgacagcc

SEQ ID NO: 7186510 - DNA, 22 bp, Homo sapiens
ttttattgtctgtattgcctat

SEQ ID NO: 7186511 - DNA, 16 bp, Homo sapiens
ttttattgtgacagcc

SEQ ID NO: 7186512 - DNA, 16 bp, Homo sapiens
ttttattgtgacagcc

SEQ ID NO: 7186513 - DNA, 16 bp, Homo sapiens
ttttattgtgacagcc

SEQ ID NO: 7186514 - DNA, 16 bp, Homo sapiens
ttttattgtgacagcc

SEQ ID NO: 7186515 - DNA, 16 bp, Homo sapiens
ttttattgtgacagcc

SEQ ID NO: 7186516 - DNA, 20 bp, Homo sapiens
ttttccactcctcaaaacag

SEQ ID NO: 7186517 - DNA, 22 bp, Homo sapiens
ttttcacaagggtccaactagt

SEQ ID NO: 7186518 - DNA, 22 bp, Homo sapiens
ttttcacacaaggtgataagtt

SEQ ID NO: 7186519 - DNA, 22 bp, Homo sapiens
ttttccactttagtgcaataac

SEQ ID NO: 7186520 - DNA, 23 bp, Homo sapiens
ttttccagaatcgactctgtaga

SEQ ID NO: 7186521 - DNA, 22 bp, Homo sapiens
ttttcaagggcagggaaatcat

SEQ ID NO: 7186522 - DNA, 22 bp, Homo sapiens
ttttcaagggcagggaaatcat

SEQ ID NO: 7186523 - DNA, 22 bp, Homo sapiens
ttttcaattttgaggcagtggt

SEQ ID NO: 7186524 - DNA, 22 bp, Homo sapiens
ttttcacaagggtccaactagt

SEQ ID NO: 7186525 - DNA, 22 bp, Homo sapiens
ttttattgtctcccagttctgg

SEQ ID NO: 7186526 - DNA, 22 bp, Homo sapiens
ttttattgtctcccagttctgg

SEQ ID NO: 7186527 - DNA, 22 bp, Homo sapiens
ttttattgtctgtattgcctat

SEQ ID NO: 7186528 - DNA, 22 bp, Homo sapiens
ttttattgtctgtattgcctat

SEQ ID NO: 7186529 - DNA, 22 bp, Homo sapiens
ttttattgtctgtattgcctat

SEQ ID NO: 7186530 - DNA, 22 bp, Homo sapiens
ttttattgtctgtattgcctat

SEQ ID NO: 7186531 - DNA, 22 bp, Homo sapiens
ttttattgtctgtattgcctat

SEQ ID NO: 7186532 - DNA, 22 bp, Homo sapiens
ttttattgtctgtattgcctat

SEQ ID NO: 7186533 - DNA, 22 bp, Homo sapiens
ttttattgtcaatgaagacaga

SEQ ID NO: 7186534 - DNA, 22 bp, Homo sapiens
ttttattgtcaatgaagacaga

SEQ ID NO: 7186535 - DNA, 22 bp, Homo sapiens
ttttattgtcaatgaagacaga

SEQ ID NO: 7186536 - DNA, 22 bp, Homo sapiens
ttttattgtcaatgaagacaga

SEQ ID NO: 7186537 - DNA, 22 bp, Homo sapiens
ttttattgtcaatgaagacaga

SEQ ID NO: 7186538 - DNA, 22 bp, Homo sapiens
ttttattgtcaatgaagacaga

SEQ ID NO: 7186539 - DNA, 22 bp, Homo sapiens
ttttattgtcaatgaagacaga

SEQ ID NO: 7186540 - DNA, 22 bp, Homo sapiens
ttttattgtcaatgaagacaga

SEQ ID NO: 7186541 - DNA, 22 bp, Homo sapiens
ttttattgtctcccagttctgg

SEQ ID NO: 7186542 - DNA, 22 bp, Homo sapiens
ttttattgtctcccagttctgg

SEQ ID NO: 7186543 - DNA, 22 bp, Homo sapiens
ttttattgtctcccagttctgg

SEQ ID NO: 7186544 - DNA, 22 bp, Homo sapiens
ttttattgtctcccagttctgg

SEQ ID NO: 7186545 - DNA, 22 bp, Homo sapiens
ttttattgtctcccagttctgg

SEQ ID NO: 7186546 - DNA, 22 bp, Homo sapiens
tttgaagacagatcaatataag

SEQ ID NO: 7186547 - DNA, 22 bp, Homo sapiens
tttgaagacatattgttacata

SEQ ID NO: 7186548 - DNA, 22 bp, Homo sapiens
tttgaagacatattgttacata

SEQ ID NO: 7186549 - DNA, 22 bp, Homo sapiens
tttgaagacatattgttacata

SEQ ID NO: 7186550 - DNA, 22 bp, Homo sapiens
tttgaagacatttgaatacttt

SEQ ID NO: 7186551 - DNA, 20 bp, Homo sapiens
tttgaactttgtactctgtt

SEQ ID NO: 7186552 - DNA, 22 bp, Homo sapiens
tttgaagaagctgacctatttt

SEQ ID NO: 7186553 - DNA, 22 bp, Homo sapiens
tttgaacttctacctgtcatat

SEQ ID NO: 7186554 - DNA, 22 bp, Homo sapiens
tttgaacttctacctgtcatat

SEQ ID NO: 7186555 - DNA, 22 bp, Homo sapiens
tttgaacttctccattctgatg

SEQ ID NO: 7186556 - DNA, 23 bp, Homo sapiens
tttgaagaagtgaatatcatata

SEQ ID NO: 7186557 - DNA, 22 bp, Homo sapiens
tttgaagactactgggagtgaa

SEQ ID NO: 7186558 - DNA, 22 bp, Homo sapiens
tttgaagactactgggagtgaa

SEQ ID NO: 7186559 - DNA, 22 bp, Homo sapiens
tttgaagactactgggagtgaa

SEQ ID NO: 7186560 - DNA, 22 bp, Homo sapiens
tttgaagactactgggagtgaa

SEQ ID NO: 7186561 - DNA, 22 bp, Homo sapiens
tttgaagaccttatctctaaat

SEQ ID NO: 7186562 - DNA, 22 bp, Homo sapiens
tttgaagaccttatctctaaat

SEQ ID NO: 7186563 - DNA, 22 bp, Homo sapiens
tttgaagaccttatctctaaat

SEQ ID NO: 7186564 - DNA, 22 bp, Homo sapiens
tttgaagactactgggagtgaa

SEQ ID NO: 7186565 - DNA, 22 bp, Homo sapiens
tttgacagcatatcctcatatt

SEQ ID NO: 7186566 - DNA, 23 bp, Homo sapiens
tttgacagcgtggtttctgtggg

SEQ ID NO: 7186567 - DNA, 22 bp, Homo sapiens
tttgacagcagataaaataaaa

SEQ ID NO: 7186568 - DNA, 22 bp, Homo sapiens
tttgacagcataatcctacacc

SEQ ID NO: 7186569 - DNA, 22 bp, Homo sapiens
tttgaacatgctgcatgataat

SEQ ID NO: 7186570 - DNA, 22 bp, Homo sapiens
tttgaacatgctgcatgataat

SEQ ID NO: 7186571 - DNA, 22 bp, Homo sapiens
tttgaacatgctgcatgataat

SEQ ID NO: 7186572 - DNA, 22 bp, Homo sapiens
tttgaacatgctgcatgataat

SEQ ID NO: 7186573 - DNA, 23 bp, Homo sapiens
tttgaacatttctagattacata

SEQ ID NO: 7186574 - DNA, 23 bp, Homo sapiens
tttgaacatttctagattacata

SEQ ID NO: 7186575 - DNA, 22 bp, Homo sapiens
tttgaactacctctccttagca

SEQ ID NO: 7186576 - DNA, 21 bp, Homo sapiens
tttgaactagaggtaaattcc

SEQ ID NO: 7186577 - DNA, 22 bp, Homo sapiens
tttgaactcagcttcagacaac

SEQ ID NO: 7186578 - DNA, 22 bp, Homo sapiens
tttgaactcagcttcagacaac

SEQ ID NO: 7186579 - DNA, 22 bp, Homo sapiens
tttgaactgataatcttctgtt

SEQ ID NO: 7186580 - DNA, 22 bp, Homo sapiens
tttgaactgttctaggatttaa

SEQ ID NO: 7186581 - DNA, 22 bp, Homo sapiens
tttgaacaggagtatctatagt

SEQ ID NO: 7186582 - DNA, 22 bp, Homo sapiens
tttgaacagggaatgttccaca

SEQ ID NO: 7186583 - DNA, 22 bp, Homo sapiens
tttgaacaagagcttcacatta

SEQ ID NO: 7186584 - DNA, 22 bp, Homo sapiens
tttgaacagacactttctacag

SEQ ID NO: 7186585 - DNA, 22 bp, Homo sapiens
tttgaacaggagtatctatagt

SEQ ID NO: 7186586 - DNA, 22 bp, Homo sapiens
tttgaacaggagtatctatagt

SEQ ID NO: 7186587 - DNA, 22 bp, Homo sapiens
tttgacagcttgttacaaagtt

SEQ ID NO: 7186588 - DNA, 22 bp, Homo sapiens
tttgacagcttgttacaaagtt

SEQ ID NO: 7186589 - DNA, 21 bp, Homo sapiens
tttgacagctcagagggcatt

SEQ ID NO: 7186590 - DNA, 22 bp, Homo sapiens
tttgacagcttgcagtgagacc

SEQ ID NO: 7186591 - DNA, 22 bp, Homo sapiens
tttgacagcttgcagtgagacc

SEQ ID NO: 7186592 - DNA, 22 bp, Homo sapiens
tttgacaggactaacatatggc

SEQ ID NO: 7186593 - DNA, 22 bp, Homo sapiens
tttgacaggaattctctctagg

SEQ ID NO: 7186594 - DNA, 22 bp, Homo sapiens
tttgacaggactaacatatggc

SEQ ID NO: 7186595 - DNA, 22 bp, Homo sapiens
tttgacaggactaacatatggc

SEQ ID NO: 7186596 - DNA, 22 bp, Homo sapiens
tttgacaggaggtggctactca

SEQ ID NO: 7186597 - DNA, 22 bp, Homo sapiens
tttgacagggtgatgaggtggt

SEQ ID NO: 7186598 - DNA, 22 bp, Homo sapiens
tttgacagggtgatgaggtggt

SEQ ID NO: 7186599 - DNA, 22 bp, Homo sapiens
tttgacagggtgatgaggtggt

SEQ ID NO: 7186600 - DNA, 22 bp, Homo sapiens
tttgacagtaataaagcacaag

SEQ ID NO: 7186601 - DNA, 22 bp, Homo sapiens
tttgacagtaataaagcacaag

SEQ ID NO: 7186602 - DNA, 22 bp, Homo sapiens
tttgacagtaataaagcacaag

SEQ ID NO: 7186603 - DNA, 22 bp, Homo sapiens
tttgacagtactctgtaggatc

SEQ ID NO: 7186604 - DNA, 22 bp, Homo sapiens
tttgacagtcccctgatgtttg

SEQ ID NO: 7186605 - DNA, 22 bp, Homo sapiens
tttgacagtgctgctaaaatgc

SEQ ID NO: 7186606 - DNA, 22 bp, Homo sapiens
tttgacagtgttggggcaggct

SEQ ID NO: 7186607 - DNA, 22 bp, Homo sapiens
tttgacagtgttggggcaggct

SEQ ID NO: 7186608 - DNA, 22 bp, Homo sapiens
tttgacagtgctgctaaaatgc

SEQ ID NO: 7186609 - DNA, 22 bp, Homo sapiens
tttgacagtgatgatatataca

SEQ ID NO: 7186610 - DNA, 22 bp, Homo sapiens
tttgacagtgctattaagaaac

SEQ ID NO: 7186611 - DNA, 22 bp, Homo sapiens
tttgacagtcccctgatgtttg

SEQ ID NO: 7186612 - DNA, 22 bp, Homo sapiens
tttgacagtgacgcctgtatga

SEQ ID NO: 7186613 - DNA, 22 bp, Homo sapiens
tttgacagtgatgatatataca

SEQ ID NO: 7186614 - DNA, 22 bp, Homo sapiens
tttgacattatcctgttactgg

SEQ ID NO: 7186615 - DNA, 22 bp, Homo sapiens
tttgacattaaggaacatatat

SEQ ID NO: 7186616 - DNA, 22 bp, Homo sapiens
tttgacattaaggaacatatat

SEQ ID NO: 7186617 - DNA, 22 bp, Homo sapiens
tttgacatgtgcttataacttt

SEQ ID NO: 7186618 - DNA, 22 bp, Homo sapiens
tttgagaagctgtcttgggctc

SEQ ID NO: 7186619 - DNA, 22 bp, Homo sapiens
tttgagaagctgtcttgggctc

SEQ ID NO: 7186620 - DNA, 22 bp, Homo sapiens
tttgacattgaaagcagaatcg

SEQ ID NO: 7186621 - DNA, 19 bp, Homo sapiens
tttgagaagttattatcta

SEQ ID NO: 7186622 - DNA, 22 bp, Homo sapiens
tttgagaagtaattcaagacat

SEQ ID NO: 7186623 - DNA, 22 bp, Homo sapiens
tttgagaagtaattcaagacat

SEQ ID NO: 7186624 - DNA, 22 bp, Homo sapiens
tttgagaagtaattcaagacat

SEQ ID NO: 7186625 - DNA, 19 bp, Homo sapiens
tttgagaagttattatcta

SEQ ID NO: 7186626 - DNA, 22 bp, Homo sapiens
tttgagaaggtgacaaattcta

SEQ ID NO: 7186627 - DNA, 22 bp, Homo sapiens
tttgagaagcatggctgtattc

SEQ ID NO: 7186628 - DNA, 22 bp, Homo sapiens
tttgagaaggtgacaaattcta

SEQ ID NO: 7186629 - DNA, 22 bp, Homo sapiens
tttctaggtttacaatactgca

SEQ ID NO: 7186630 - DNA, 22 bp, Homo sapiens
tttctagtaaaagctaattacc

SEQ ID NO: 7186631 - DNA, 22 bp, Homo sapiens
tttctaggtgttcacagagcat

SEQ ID NO: 7186632 - DNA, 22 bp, Homo sapiens
tttctagtcagccatatctagt

SEQ ID NO: 7186633 - DNA, 22 bp, Homo sapiens
tttctataactggactggattg

SEQ ID NO: 7186634 - DNA, 22 bp, Homo sapiens
tttctataactggactggattg

SEQ ID NO: 7186635 - DNA, 22 bp, Homo sapiens
tttctataaaaagtgctaggat

SEQ ID NO: 7186636 - DNA, 22 bp, Homo sapiens
tttctatagctttcttgggagt

SEQ ID NO: 7186637 - DNA, 22 bp, Homo sapiens
tttctatatcttacctattgta

SEQ ID NO: 7186638 - DNA, 22 bp, Homo sapiens
tttctatatgaggagctaaagt

SEQ ID NO: 7186639 - DNA, 22 bp, Homo sapiens
tttctatatgaggagctaaagt

SEQ ID NO: 7186640 - DNA, 22 bp, Homo sapiens
tttctagtggttaagatttaca

SEQ ID NO: 7186641 - DNA, 22 bp, Homo sapiens
tttctagtcttccctacctccc

SEQ ID NO: 7186642 - DNA, 17 bp, Homo sapiens
tttctagattatcctct

SEQ ID NO: 7186643 - DNA, 17 bp, Homo sapiens
tttctagattatcctct

SEQ ID NO: 7186644 - DNA, 22 bp, Homo sapiens
tttctagacatttctatgtaca

SEQ ID NO: 7186645 - DNA, 22 bp, Homo sapiens
tttctagagataactcaaccat

SEQ ID NO: 7186646 - DNA, 22 bp, Homo sapiens
tttctagagtgggcatgtctta

SEQ ID NO: 7186647 - DNA, 22 bp, Homo sapiens
tttctagatattccttgaagtg

SEQ ID NO: 7186648 - DNA, 22 bp, Homo sapiens
tttctagatattcgcagataga

SEQ ID NO: 7186649 - DNA, 22 bp, Homo sapiens
tttgaaatgtatcagtataggt

SEQ ID NO: 7186650 - DNA, 22 bp, Homo sapiens
tttgaaatctaatcaaggaaca

SEQ ID NO: 7186651 - DNA, 22 bp, Homo sapiens
tttgaaatctaatcaaggaaca

SEQ ID NO: 7186652 - DNA, 22 bp, Homo sapiens
tttgaaattggctcattggttt

SEQ ID NO: 7186653 - DNA, 22 bp, Homo sapiens
tttgaaatatgaggcattatga

SEQ ID NO: 7186654 - DNA, 22 bp, Homo sapiens
tttgaaagttcttctgacacta

SEQ ID NO: 7186655 - DNA, 22 bp, Homo sapiens
tttgaaatatgaggcattatga

SEQ ID NO: 7186656 - DNA, 22 bp, Homo sapiens
tttgaaatatgtgatgagagag

SEQ ID NO: 7186657 - DNA, 22 bp, Homo sapiens
tttgaaatatgtgtcttttgaa

SEQ ID NO: 7186658 - DNA, 22 bp, Homo sapiens
tttctattgatctaataaacat

SEQ ID NO: 7186659 - DNA, 22 bp, Homo sapiens
tttctattgatctaataaacat

SEQ ID NO: 7186660 - DNA, 22 bp, Homo sapiens
tttctattgatctaataaacat

SEQ ID NO: 7186661 - DNA, 22 bp, Homo sapiens
tttctatatgaggagctaaagt

SEQ ID NO: 7186662 - DNA, 22 bp, Homo sapiens
tttctatctagggttagagtga

SEQ ID NO: 7186663 - DNA, 22 bp, Homo sapiens
tttctattctggatctgtggca

SEQ ID NO: 7186664 - DNA, 22 bp, Homo sapiens
tttctattggcgtcactgttgt

SEQ ID NO: 7186665 - DNA, 21 bp, Homo sapiens
tttgaaagtgggtgattcttt

SEQ ID NO: 7186666 - DNA, 21 bp, Homo sapiens
tttgaaagtgggtgattcttt

SEQ ID NO: 7186667 - DNA, 21 bp, Homo sapiens
tttgaaagtgggtgattcttt

SEQ ID NO: 7186668 - DNA, 21 bp, Homo sapiens
tttgcttcaattccagaagct

SEQ ID NO: 7186669 - DNA, 22 bp, Homo sapiens
tttgcttaaagttctttctggt

SEQ ID NO: 7186670 - DNA, 22 bp, Homo sapiens
tttgctgtgaatccattactgt

SEQ ID NO: 7186671 - DNA, 22 bp, Homo sapiens
tttgctgtgggatatccatgtg

SEQ ID NO: 7186672 - DNA, 22 bp, Homo sapiens
tttgcttaaaagcggagcaaga

SEQ ID NO: 7186673 - DNA, 22 bp, Homo sapiens
tttgctgaatagattgtaaact

SEQ ID NO: 7186674 - DNA, 22 bp, Homo sapiens
tttgctgaccccattctgagtc

SEQ ID NO: 7186675 - DNA, 22 bp, Homo sapiens
tttgctgagttgaagtttgagg

SEQ ID NO: 7186676 - DNA, 22 bp, Homo sapiens
tttgctgagttgaagtttgagg

SEQ ID NO: 7186677 - DNA, 22 bp, Homo sapiens
tttgctgagttttctcctaaga

SEQ ID NO: 7186678 - DNA, 22 bp, Homo sapiens
tttgctgatattttgctgatac

SEQ ID NO: 7186679 - DNA, 22 bp, Homo sapiens
tttgctgggctctgtgccagac

SEQ ID NO: 7186680 - DNA, 19 bp, Homo sapiens
tttgctggttcaggaaaga

SEQ ID NO: 7186681 - DNA, 22 bp, Homo sapiens
tttgcattgtaatatttagttc

SEQ ID NO: 7186682 - DNA, 22 bp, Homo sapiens
tttgcattgcctctgacttatg

SEQ ID NO: 7186683 - DNA, 22 bp, Homo sapiens
tttgcattgcattaagtattct

SEQ ID NO: 7186684 - DNA, 22 bp, Homo sapiens
tttgcatttgcaaataatgaaa

SEQ ID NO: 7186685 - DNA, 22 bp, Homo sapiens
tttgcatttgttcaagtattga

SEQ ID NO: 7186686 - DNA, 22 bp, Homo sapiens
tttgcataggatggacatttta

SEQ ID NO: 7186687 - DNA, 22 bp, Homo sapiens
tttgcagtttgttcagctcttt

SEQ ID NO: 7186688 - DNA, 22 bp, Homo sapiens
tttgcagtttcattgctgaaat

SEQ ID NO: 7186689 - DNA, 22 bp, Homo sapiens
tttgcagtgttcatcagtattt

SEQ ID NO: 7186690 - DNA, 22 bp, Homo sapiens
tttgcagttcatctgagaaaaa

SEQ ID NO: 7186691 - DNA, 22 bp, Homo sapiens
tttgcagttcatctgagaaaaa

SEQ ID NO: 7186692 - DNA, 22 bp, Homo sapiens
tttgcagttcatgttggaaaat

SEQ ID NO: 7186693 - DNA, 22 bp, Homo sapiens
tttgcagttccatccaggcaga

SEQ ID NO: 7186694 - DNA, 18 bp, Homo sapiens
tttgcatggtaacattga

SEQ ID NO: 7186695 - DNA, 22 bp, Homo sapiens
tttgcattatctcacttatata

SEQ ID NO: 7186696 - DNA, 22 bp, Homo sapiens
tttgagatagtctagagtaact

SEQ ID NO: 7186697 - DNA, 23 bp, Homo sapiens
tttgagcaaatcatacaaaggga

SEQ ID NO: 7186698 - DNA, 22 bp, Homo sapiens
tttgagcaactctgagtcacag

SEQ ID NO: 7186699 - DNA, 22 bp, Homo sapiens
tttgagcaagttccattaagct

SEQ ID NO: 7186700 - DNA, 22 bp, Homo sapiens
tttgagcagaagggtgacatgc

SEQ ID NO: 7186701 - DNA, 22 bp, Homo sapiens
tttgagcaccctatgtgtttac

SEQ ID NO: 7186702 - DNA, 22 bp, Homo sapiens
tttgagcagagaaaggacatga

SEQ ID NO: 7186703 - DNA, 22 bp, Homo sapiens
tttgagcagcagatgcacttag

SEQ ID NO: 7186704 - DNA, 22 bp, Homo sapiens
tttgagctatgggcttggattt

SEQ ID NO: 7186705 - DNA, 22 bp, Homo sapiens
tttgagctatgggcttggattt

SEQ ID NO: 7186706 - DNA, 22 bp, Homo sapiens
tttgagcttgtagcattgctat

SEQ ID NO: 7186707 - DNA, 22 bp, Homo sapiens
tttgagcttgtagcattgctat

SEQ ID NO: 7186708 - DNA, 19 bp, Homo sapiens
tttgcagtggttcctttgt

SEQ ID NO: 7186709 - DNA, 22 bp, Homo sapiens
tttgcagtgtcagcttctgtgt

SEQ ID NO: 7186710 - DNA, 18 bp, Homo sapiens
tttgagaatgcatgactg

SEQ ID NO: 7186711 - DNA, 18 bp, Homo sapiens
tttgagaatgcatgactg

SEQ ID NO: 7186712 - DNA, 18 bp, Homo sapiens
tttgagaatgcatgactg

SEQ ID NO: 7186713 - DNA, 22 bp, Homo sapiens
tttgagaatggtaagtggatcg

SEQ ID NO: 7186714 - DNA, 22 bp, Homo sapiens
tttgagaatggtaagtggatcg

SEQ ID NO: 7186715 - DNA, 21 bp, Homo sapiens
tttgagaattggtcagagtgc

SEQ ID NO: 7186716 - DNA, 21 bp, Homo sapiens
tttgagaattggtcagagtgc

SEQ ID NO: 7186717 - DNA, 21 bp, Homo sapiens
tttgagaattggtcagagtgc

SEQ ID NO: 7186718 - DNA, 20 bp, Homo sapiens
tttgagaccagtctgcccaa

SEQ ID NO: 7186719 - DNA, 20 bp, Homo sapiens
tttgagaccagtctgcccaa

SEQ ID NO: 7186720 - DNA, 22 bp, Homo sapiens
tttggggctcagcaggctgttt

SEQ ID NO: 7186721 - DNA, 22 bp, Homo sapiens
tttgggtagataacaaagatct

SEQ ID NO: 7186722 - DNA, 22 bp, Homo sapiens
tttggggctcagcaggctgttt

SEQ ID NO: 7186723 - DNA, 22 bp, Homo sapiens
tttggggctcagcaggctgttt

SEQ ID NO: 7186724 - DNA, 22 bp, Homo sapiens
tttggggccagccccatgtctg

SEQ ID NO: 7186725 - DNA, 22 bp, Homo sapiens
tttggggatgacaggttaggaa

SEQ ID NO: 7186726 - DNA, 22 bp, Homo sapiens
tttggggatgtctgagttgttg

SEQ ID NO: 7186727 - DNA, 22 bp, Homo sapiens
tttgggctggtttgccatgccc

SEQ ID NO: 7186728 - DNA, 22 bp, Homo sapiens
tttgggctgtacaatttctgta

SEQ ID NO: 7186729 - DNA, 22 bp, Homo sapiens
tttgggctgtacaatttctgta

SEQ ID NO: 7186730 - DNA, 22 bp, Homo sapiens
tttgggctgtacaatttctgta

SEQ ID NO: 7186731 - DNA, 21 bp, Homo sapiens
tttgggcttttactggacgtg

SEQ ID NO: 7186732 - DNA, 22 bp, Homo sapiens
tttgggctgagatgtgggccga

SEQ ID NO: 7186733 - DNA, 18 bp, Homo sapiens
tttgggctgatgttgggc

SEQ ID NO: 7186734 - DNA, 18 bp, Homo sapiens
tttgggctgatgttgggc

SEQ ID NO: 7186735 - DNA, 22 bp, Homo sapiens
tttgggctgactgccaagggcc

SEQ ID NO: 7186736 - DNA, 22 bp, Homo sapiens
tttgggctggaattttagtacc

SEQ ID NO: 7186737 - DNA, 22 bp, Homo sapiens
tttggggagacatggccagctg

SEQ ID NO: 7186738 - DNA, 22 bp, Homo sapiens
tttggggaggttatcggtgtgc

SEQ ID NO: 7186739 - DNA, 22 bp, Homo sapiens
tttgggaaacttaggggtcaga

SEQ ID NO: 7186740 - DNA, 22 bp, Homo sapiens
tttgggcaggcttttccctaga

SEQ ID NO: 7186741 - DNA, 22 bp, Homo sapiens
tttgggcagtagatgtatcact

SEQ ID NO: 7186742 - DNA, 22 bp, Homo sapiens
tttgggcagtcctggaatttgt

SEQ ID NO: 7186743 - DNA, 22 bp, Homo sapiens
tttgggcagtgggcttagcggc

SEQ ID NO: 7186744 - DNA, 22 bp, Homo sapiens
tttgggcatatagctgttccct

SEQ ID NO: 7186745 - DNA, 22 bp, Homo sapiens
tttgggcatgttgtggccagct

SEQ ID NO: 7186746 - DNA, 22 bp, Homo sapiens
tttgggcatgttgtggccagct

SEQ ID NO: 7186747 - DNA, 22 bp, Homo sapiens
tttgggcattagaatattcttt

SEQ ID NO: 7186748 - DNA, 22 bp, Homo sapiens
tttgggcattagtaagttaagc

SEQ ID NO: 7186749 - DNA, 22 bp, Homo sapiens
tttgggctcactatgctgaaga

SEQ ID NO: 7186750 - DNA, 22 bp, Homo sapiens
tttgggctcaatatttgggctc

SEQ ID NO: 7186751 - DNA, 22 bp, Homo sapiens
tttgggctcaatatttgggctc

SEQ ID NO: 7186752 - DNA, 22 bp, Homo sapiens
tttgggctcccacaggcttgtg

SEQ ID NO: 7186753 - DNA, 22 bp, Homo sapiens
tttgggctcccacaggcttgtg

SEQ ID NO: 7186754 - DNA, 22 bp, Homo sapiens
tttgggctcttgctgacctggg

SEQ ID NO: 7186755 - DNA, 22 bp, Homo sapiens
tttgggctcttgctgacctggg

SEQ ID NO: 7186756 - DNA, 22 bp, Homo sapiens
tttgtcctataatcctcttaca

SEQ ID NO: 7186757 - DNA, 20 bp, Homo sapiens
tttgtccagcgtctactctg

SEQ ID NO: 7186758 - DNA, 20 bp, Homo sapiens
tttgtccagcgtctactctg

SEQ ID NO: 7186759 - DNA, 22 bp, Homo sapiens
tttgtcatgtccttaactgtct

SEQ ID NO: 7186760 - DNA, 22 bp, Homo sapiens
tttgtcattctgtgtatttaaa

SEQ ID NO: 7186761 - DNA, 22 bp, Homo sapiens
tttgtcatttccctgattaaag

SEQ ID NO: 7186762 - DNA, 22 bp, Homo sapiens
tttgtcatttccctgattaaag

SEQ ID NO: 7186763 - DNA, 22 bp, Homo sapiens
tttgtcatgtccttaactgtct

SEQ ID NO: 7186764 - DNA, 22 bp, Homo sapiens
tttgtcatgctttccttatgga

SEQ ID NO: 7186765 - DNA, 22 bp, Homo sapiens
tttgtcatcccttttgaaactg

SEQ ID NO: 7186766 - DNA, 22 bp, Homo sapiens
tttgtcatcccttttgaaactg

SEQ ID NO: 7186767 - DNA, 22 bp, Homo sapiens
tttgtcatcagttattaatatg

SEQ ID NO: 7186768 - DNA, 22 bp, Homo sapiens
tttgtcatcagttattaatatg

SEQ ID NO: 7186769 - DNA, 22 bp, Homo sapiens
tttgtcatcagttattaatatg

SEQ ID NO: 7186770 - DNA, 22 bp, Homo sapiens
tttgtcatatcacacaattttg

SEQ ID NO: 7186771 - DNA, 21 bp, Homo sapiens
tttggcattatgtcaccagag

SEQ ID NO: 7186772 - DNA, 22 bp, Homo sapiens
tttggccatatctatactcagc

SEQ ID NO: 7186773 - DNA, 22 bp, Homo sapiens
tttggctaactgcaaaaagtac

SEQ ID NO: 7186774 - DNA, 22 bp, Homo sapiens
tttggctaaggaaaaggagcta

SEQ ID NO: 7186775 - DNA, 22 bp, Homo sapiens
tttggctaagttgtaatgtaaa

SEQ ID NO: 7186776 - DNA, 22 bp, Homo sapiens
tttggctagagaaattactata

SEQ ID NO: 7186777 - DNA, 22 bp, Homo sapiens
tttggctcgatggactttgaat

SEQ ID NO: 7186778 - DNA, 22 bp, Homo sapiens
tttggctcgatggactttgaat

SEQ ID NO: 7186779 - DNA, 22 bp, Homo sapiens
tttggctctagtaaatataacc

SEQ ID NO: 7186780 - DNA, 22 bp, Homo sapiens
tttggctctcacttgcactcag

SEQ ID NO: 7186781 - DNA, 22 bp, Homo sapiens
tttggctctgcgtcttcaccca

SEQ ID NO: 7186782 - DNA, 22 bp, Homo sapiens
tttggctctgtgtctccaccca

SEQ ID NO: 7186783 - DNA, 22 bp, Homo sapiens
tttggctctgtgtcttcaccca

SEQ ID NO: 7186784 - DNA, 22 bp, Homo sapiens
tttggctgaagaccagattaaa

SEQ ID NO: 7186785 - DNA, 22 bp, Homo sapiens
tttggctggatgatagaactaa

SEQ ID NO: 7186786 - DNA, 18 bp, Homo sapiens
tttggctgttcaagagca

SEQ ID NO: 7186787 - DNA, 22 bp, Homo sapiens
tttggctgtcatttgaaaatgt

SEQ ID NO: 7186788 - DNA, 20 bp, Homo sapiens
tttggcttcaagtgcattgc

SEQ ID NO: 7186789 - DNA, 22 bp, Homo sapiens
tttggctttagtgccttctgat

SEQ ID NO: 7186790 - DNA, 22 bp, Homo sapiens
tttgggaaacttaggggtcaga

SEQ ID NO: 7186791 - DNA, 21 bp, Homo sapiens
ttttttcttgcgtgaggcctg

SEQ ID NO: 7186792 - DNA, 21 bp, Homo sapiens
ttttttcttgcgtgaggcctg

SEQ ID NO: 7186793 - DNA, 21 bp, Homo sapiens
ttttttcttgcgtgaggcctg

SEQ ID NO: 7186794 - DNA, 21 bp, Homo sapiens
ttttttcttgcgtgaggcctg

SEQ ID NO: 7186795 - DNA, 22 bp, Homo sapiens
ttttttggtgctcctaggaagg

SEQ ID NO: 7186796 - DNA, 22 bp, Homo sapiens
ttttttgtagcaagcgcagata

SEQ ID NO: 7186797 - DNA, 22 bp, Homo sapiens
ttttttccttcatgacttaaga

SEQ ID NO: 7186798 - DNA, 21 bp, Homo sapiens
ttttttcttgcgtgaggcctg

SEQ ID NO: 7186799 - DNA, 22 bp, Homo sapiens
ttttttccaggaagccactgga

SEQ ID NO: 7186800 - DNA, 22 bp, Homo sapiens
gggtgggaaggctaagggattg

SEQ ID NO: 7186801 - DNA, 22 bp, Homo sapiens
gggtgggaaggctaagggattg

SEQ ID NO: 7186802 - DNA, 22 bp, Homo sapiens
gggtgggaaggctaagggattg

SEQ ID NO: 7186803 - DNA, 22 bp, Homo sapiens
gggtgggactctttggcctgag

SEQ ID NO: 7186804 - DNA, 22 bp, Homo sapiens
gggtgggactctttggcctgag

SEQ ID NO: 7186805 - DNA, 22 bp, Homo sapiens
gggtgggactctttggcctgag

SEQ ID NO: 7186806 - DNA, 22 bp, Homo sapiens
gggtgggactctttggcctgag

SEQ ID NO: 7186807 - DNA, 22 bp, Homo sapiens
gggtgggagaaatgagtatcta

SEQ ID NO: 7186808 - DNA, 22 bp, Homo sapiens
gggtgggactgaagtctgaggg

SEQ ID NO: 7186809 - DNA, 22 bp, Homo sapiens
gggtgggactgaagtctgaggg

SEQ ID NO: 7186810 - DNA, 22 bp, Homo sapiens
gggtgggactgaagtctgaggg

SEQ ID NO: 7186811 - DNA, 22 bp, Homo sapiens
cagagtcagagctccatggagt

SEQ ID NO: 7186812 - DNA, 20 bp, Homo sapiens
cagagtaattattacccttt

SEQ ID NO: 7186813 - DNA, 22 bp, Homo sapiens
cagagtatatatctcattttta

SEQ ID NO: 7186814 - DNA, 22 bp, Homo sapiens
cagagtatccctttagaattaa

SEQ ID NO: 7186815 - DNA, 22 bp, Homo sapiens
cagagtatctaactgatgggta

SEQ ID NO: 7186816 - DNA, 22 bp, Homo sapiens
cagagtatttctctttggggag

SEQ ID NO: 7186817 - DNA, 22 bp, Homo sapiens
gggtgggatctgtggagcctca

SEQ ID NO: 7186818 - DNA, 22 bp, Homo sapiens
ggtgggacaggtaggagtggct

SEQ ID NO: 7186819 - DNA, 22 bp, Homo sapiens
ggtgggacaggtaggagtggct

SEQ ID NO: 7186820 - DNA, 22 bp, Homo sapiens
ggtgggacaggtaggagtggct

SEQ ID NO: 7186821 - DNA, 21 bp, Homo sapiens
gggtgggaggacacagcaggc

SEQ ID NO: 7186822 - DNA, 22 bp, Homo sapiens
gggtgggagtctggccctcaaa

SEQ ID NO: 7186823 - DNA, 22 bp, Homo sapiens
gggtgggagtctggccctcaaa

SEQ ID NO: 7186824 - DNA, 22 bp, Homo sapiens
ggtggggctaggacctcaggat

SEQ ID NO: 7186825 - DNA, 22 bp, Homo sapiens
ggtggggctaggacctcaggat

SEQ ID NO: 7186826 - DNA, 22 bp, Homo sapiens
ggtggggctaggacctcaggat

SEQ ID NO: 7186827 - DNA, 22 bp, Homo sapiens
ggtgggagagctctgtctccag

SEQ ID NO: 7186828 - DNA, 22 bp, Homo sapiens
ggtgggagagctctgtctccag

SEQ ID NO: 7186829 - DNA, 22 bp, Homo sapiens
ggtggggctaggacctcaggat

SEQ ID NO: 7186830 - DNA, 20 bp, Homo sapiens
gggtgggagagtctgagggt

SEQ ID NO: 7186831 - DNA, 20 bp, Homo sapiens
gggtgggagagtctgagggt

SEQ ID NO: 7186832 - DNA, 20 bp, Homo sapiens
gggtgggagagtctgagggt

SEQ ID NO: 7186833 - DNA, 21 bp, Homo sapiens
gggtgggaggacacagcaggc

SEQ ID NO: 7186834 - DNA, 21 bp, Homo sapiens
gggtgggaggacacagcaggc

SEQ ID NO: 7186835 - DNA, 21 bp, Homo sapiens
gggtgggaggacacagcaggc

SEQ ID NO: 7186836 - DNA, 20 bp, Homo sapiens
gggtgggagagtctgagggt

SEQ ID NO: 7186837 - DNA, 20 bp, Homo sapiens
gggtgggagagtctgagggt

SEQ ID NO: 7186838 - DNA, 21 bp, Homo sapiens
gggtgggaggacacagcaggc

SEQ ID NO: 7186839 - DNA, 22 bp, Homo sapiens
ggtgggtcttgcggggcagctt

SEQ ID NO: 7186840 - DNA, 22 bp, Homo sapiens
ggtgggtcttgtggggcagctt

SEQ ID NO: 7186841 - DNA, 22 bp, Homo sapiens
ggtgggtgaaatctaggtgtgt

SEQ ID NO: 7186842 - DNA, 22 bp, Homo sapiens
ggtgggtattgaatacaggtgt

SEQ ID NO: 7186843 - DNA, 22 bp, Homo sapiens
ggtgggtcttgcggggcagctt

SEQ ID NO: 7186844 - DNA, 22 bp, Homo sapiens
ggtgggtattgaatacaggtgt

SEQ ID NO: 7186845 - DNA, 22 bp, Homo sapiens
ggtgggtatagttagggcctct

SEQ ID NO: 7186846 - DNA, 22 bp, Homo sapiens
ggtgggtatagttagggcctct

SEQ ID NO: 7186847 - DNA, 22 bp, Homo sapiens
ggtgggtatagttagggcctct

SEQ ID NO: 7186848 - DNA, 22 bp, Homo sapiens
ggtgggtcttgtggggcagctt

SEQ ID NO: 7186849 - DNA, 22 bp, Homo sapiens
ggtgggtgaaatctaggtgtgt

SEQ ID NO: 7186850 - DNA, 22 bp, Homo sapiens
cagcaaggccattggatgcagt

SEQ ID NO: 7186851 - DNA, 22 bp, Homo sapiens
cagcaaggccattggatgcagt

SEQ ID NO: 7186852 - DNA, 22 bp, Homo sapiens
cagcaaggccattggatgcagt

SEQ ID NO: 7186853 - DNA, 22 bp, Homo sapiens
cagcaagggataaacaaggacg

SEQ ID NO: 7186854 - DNA, 22 bp, Homo sapiens
cagcaagggataaacaaggacg

SEQ ID NO: 7186855 - DNA, 22 bp, Homo sapiens
cagcaagggataaacaaggacg

SEQ ID NO: 7186856 - DNA, 22 bp, Homo sapiens
cagcaagggataaagagttact

SEQ ID NO: 7186857 - DNA, 22 bp, Homo sapiens
cagcaagggttatatcaaagat

SEQ ID NO: 7186858 - DNA, 22 bp, Homo sapiens
cagcaagggttatatcaaagat

SEQ ID NO: 7186859 - DNA, 22 bp, Homo sapiens
cagcaagggttatatcaaagat

SEQ ID NO: 7186860 - DNA, 22 bp, Homo sapiens
ggtggggttttaggctgctgca

SEQ ID NO: 7186861 - DNA, 22 bp, Homo sapiens
ggtggggttttaggctgctgca

SEQ ID NO: 7186862 - DNA, 22 bp, Homo sapiens
ggtggggttttaggctgctgca

SEQ ID NO: 7186863 - DNA, 22 bp, Homo sapiens
ggtgggtaaaactgctggcact

SEQ ID NO: 7186864 - DNA, 22 bp, Homo sapiens
ggtgggtaaaactgctggcact

SEQ ID NO: 7186865 - DNA, 22 bp, Homo sapiens
ggtggggtcacgacagagggaa

SEQ ID NO: 7186866 - DNA, 22 bp, Homo sapiens
ggtggggtcacgacagagggaa

SEQ ID NO: 7186867 - DNA, 21 bp, Homo sapiens
ggtggggtacctaaggtagct

SEQ ID NO: 7186868 - DNA, 22 bp, Homo sapiens
ggtggggtcacgacagagggaa

SEQ ID NO: 7186869 - DNA, 22 bp, Homo sapiens
ggtggggtcacgacagagggaa

SEQ ID NO: 7186870 - DNA, 22 bp, Homo sapiens
ggtggggctcagcaatctgtgt

SEQ ID NO: 7186871 - DNA, 22 bp, Homo sapiens
ggtggggctcagcaatctgtgt

SEQ ID NO: 7186872 - DNA, 22 bp, Homo sapiens
ggtggggctcagcaatctgtgt

SEQ ID NO: 7186873 - DNA, 22 bp, Homo sapiens
ggtggggctgcaagcagttcgg

SEQ ID NO: 7186874 - DNA, 22 bp, Homo sapiens
ggtggggctgcaagcagttcgg

SEQ ID NO: 7186875 - DNA, 22 bp, Homo sapiens
ggtggggctgcaagcagttcgg

SEQ ID NO: 7186876 - DNA, 22 bp, Homo sapiens
ggtgggggagacttggtcaaga

SEQ ID NO: 7186877 - DNA, 22 bp, Homo sapiens
ggtgggggagacttggtcaaga

SEQ ID NO: 7186878 - DNA, 22 bp, Homo sapiens
ggtgggggagacttggtcaaga

SEQ ID NO: 7186879 - DNA, 22 bp, Homo sapiens
ggtgggggagacttggtcaaga

SEQ ID NO: 7186880 - DNA, 22 bp, Homo sapiens
ggtgggggagacttggtcaaga

SEQ ID NO: 7186881 - DNA, 22 bp, Homo sapiens
ggtgggggagacttggtcaaga

SEQ ID NO: 7186882 - DNA, 22 bp, Homo sapiens
ggtgggggagacttggtcaaga

SEQ ID NO: 7186883 - DNA, 22 bp, Homo sapiens
ggttccccaggcggcccttgga

SEQ ID NO: 7186884 - DNA, 22 bp, Homo sapiens
ggttccccaggcggcccttgga

SEQ ID NO: 7186885 - DNA, 23 bp, Homo sapiens
ggttcctgagcagggatctggaa

SEQ ID NO: 7186886 - DNA, 22 bp, Homo sapiens
ggttcctgtacttagctatgta

SEQ ID NO: 7186887 - DNA, 22 bp, Homo sapiens
ggttcctgtgcccatgtcatgg

SEQ ID NO: 7186888 - DNA, 22 bp, Homo sapiens
ggttcctgtgcctctagctggc

SEQ ID NO: 7186889 - DNA, 23 bp, Homo sapiens
ggttctgccgcttactgctgtgc

SEQ ID NO: 7186890 - DNA, 22 bp, Homo sapiens
cagcaataactcaaagccattt

SEQ ID NO: 7186891 - DNA, 22 bp, Homo sapiens
cagcaataaggtaagcttctcc

SEQ ID NO: 7186892 - DNA, 22 bp, Homo sapiens
cagcaaggtctgtcaatagtgg

SEQ ID NO: 7186893 - DNA, 22 bp, Homo sapiens
cagcaagtcagtgagtagaaga

SEQ ID NO: 7186894 - DNA, 22 bp, Homo sapiens
cagcaagtcagtgagtagaaga

SEQ ID NO: 7186895 - DNA, 23 bp, Homo sapiens
cagcaagtgaattccaagagaga

SEQ ID NO: 7186896 - DNA, 23 bp, Homo sapiens
cagcaagtgaattccaagagaga

SEQ ID NO: 7186897 - DNA, 23 bp, Homo sapiens
cagcaagtgaattccaagagaga

SEQ ID NO: 7186898 - DNA, 22 bp, Homo sapiens
cagcaataactcaaagccattt

SEQ ID NO: 7186899 - DNA, 22 bp, Homo sapiens
ggttccagaagggggcgaggtg

SEQ ID NO: 7186900 - DNA, 22 bp, Homo sapiens
ggtgtgcctggggcttagctgc

SEQ ID NO: 7186901 - DNA, 22 bp, Homo sapiens
ggtgtgccacttcactgagcag

SEQ ID NO: 7186902 - DNA, 22 bp, Homo sapiens
cagcacaattttcaggagtcca

SEQ ID NO: 7186903 - DNA, 22 bp, Homo sapiens
ggtgtgccacttcactgagcag

SEQ ID NO: 7186904 - DNA, 22 bp, Homo sapiens
cagcaatagtgtgtttgtttca

SEQ ID NO: 7186905 - DNA, 22 bp, Homo sapiens
cagcaatatacacagtctatgg

SEQ ID NO: 7186906 - DNA, 22 bp, Homo sapiens
cagcaatatacacagtctatgg

SEQ ID NO: 7186907 - DNA, 22 bp, Homo sapiens
cagcaatggcaggcggagagtg

SEQ ID NO: 7186908 - DNA, 22 bp, Homo sapiens
ggttgctgggggtggcagagct

SEQ ID NO: 7186909 - DNA, 22 bp, Homo sapiens
ggttggacactaggtaggagcg

SEQ ID NO: 7186910 - DNA, 22 bp, Homo sapiens
ggttgctgggggtggcagagct

SEQ ID NO: 7186911 - DNA, 22 bp, Homo sapiens
ggttgctgggggtggcagagct

SEQ ID NO: 7186912 - DNA, 22 bp, Homo sapiens
ggttggacactaggtaggagcg

SEQ ID NO: 7186913 - DNA, 22 bp, Homo sapiens
ggttgctctttggaccctgctg

SEQ ID NO: 7186914 - DNA, 22 bp, Homo sapiens
ggttgctctttggaccctgctg

SEQ ID NO: 7186915 - DNA, 23 bp, Homo sapiens
ggttctttaccttgaatgttttc

SEQ ID NO: 7186916 - DNA, 22 bp, Homo sapiens
ggttctttggcagtctgattga

SEQ ID NO: 7186917 - DNA, 22 bp, Homo sapiens
ggttctttgtatatatcacttt

SEQ ID NO: 7186918 - DNA, 22 bp, Homo sapiens
ggttgaatatctttatgttggt

SEQ ID NO: 7186919 - DNA, 22 bp, Homo sapiens
ggttgaatatctttatgttggt

SEQ ID NO: 7186920 - DNA, 22 bp, Homo sapiens
ggttgaatcattctttgcaccg

SEQ ID NO: 7186921 - DNA, 19 bp, Homo sapiens
ggttggagaagagcggccc

SEQ ID NO: 7186922 - DNA, 19 bp, Homo sapiens
ggttggagaagagcggccc

SEQ ID NO: 7186923 - DNA, 22 bp, Homo sapiens
gtaaaatagaataacgtggcta

SEQ ID NO: 7186924 - DNA, 20 bp, Homo sapiens
gtaaaatatggtctttgggt

SEQ ID NO: 7186925 - DNA, 20 bp, Homo sapiens
gtaaaatatggtctttgggt

SEQ ID NO: 7186926 - DNA, 20 bp, Homo sapiens
gtaaaatatggtctttgggt

SEQ ID NO: 7186927 - DNA, 20 bp, Homo sapiens
gtaaaatatggtctttgggt

SEQ ID NO: 7186928 - DNA, 22 bp, Homo sapiens
gtaaaatcatttagttacttaa

SEQ ID NO: 7186929 - DNA, 22 bp, Homo sapiens
gtaaaattgcaattacttttgc

SEQ ID NO: 7186930 - DNA, 22 bp, Homo sapiens
gtaaaattctagcatctgaaag

SEQ ID NO: 7186931 - DNA, 22 bp, Homo sapiens
gtaaaatctttattgctggtga

SEQ ID NO: 7186932 - DNA, 22 bp, Homo sapiens
gtaaaatctttcctatttgcct

SEQ ID NO: 7186933 - DNA, 22 bp, Homo sapiens
gtaaacaggaatgtggtcatgg

SEQ ID NO: 7186934 - DNA, 22 bp, Homo sapiens
gtaaacaatagcattgcctgat

SEQ ID NO: 7186935 - DNA, 22 bp, Homo sapiens
gtaaacacctgttaaattcaga

SEQ ID NO: 7186936 - DNA, 22 bp, Homo sapiens
gtaaacaacacaaatcatttga

SEQ ID NO: 7186937 - DNA, 22 bp, Homo sapiens
gtaaacaacacaaatcatttga

SEQ ID NO: 7186938 - DNA, 22 bp, Homo sapiens
cagcagagtttggcttctaatg

SEQ ID NO: 7186939 - DNA, 22 bp, Homo sapiens
cagcagagtatggcactcaact

SEQ ID NO: 7186940 - DNA, 22 bp, Homo sapiens
cagcagagtatggcactcaact

SEQ ID NO: 7186941 - DNA, 22 bp, Homo sapiens
cagcagagtatggcactcaact

SEQ ID NO: 7186942 - DNA, 22 bp, Homo sapiens
cagcagagtatggcactcaact

SEQ ID NO: 7186943 - DNA, 22 bp, Homo sapiens
cagcagagtatggcactcaact

SEQ ID NO: 7186944 - DNA, 22 bp, Homo sapiens
cagcagagtaattctcacctct

SEQ ID NO: 7186945 - DNA, 22 bp, Homo sapiens
cagcagagtaattctcacctct

SEQ ID NO: 7186946 - DNA, 22 bp, Homo sapiens
cagcagagtaattctcacctct

SEQ ID NO: 7186947 - DNA, 21 bp, Homo sapiens
cagcagagtaatgcattcgta

SEQ ID NO: 7186948 - DNA, 22 bp, Homo sapiens
cagcagagtaattctcacctct

SEQ ID NO: 7186949 - DNA, 21 bp, Homo sapiens
cagcagagtaatgcattcgta

SEQ ID NO: 7186950 - DNA, 22 bp, Homo sapiens
cagcagagctgtgtgggaaggg

SEQ ID NO: 7186951 - DNA, 22 bp, Homo sapiens
cagcagagctgtgtgggaaggg

SEQ ID NO: 7186952 - DNA, 22 bp, Homo sapiens
cagcagagcttatgttgggtca

SEQ ID NO: 7186953 - DNA, 21 bp, Homo sapiens
cagcagagtaatgcattcgta

SEQ ID NO: 7186954 - DNA, 22 bp, Homo sapiens
cagcagcaacaacggaagcctt

SEQ ID NO: 7186955 - DNA, 22 bp, Homo sapiens
cagcagcaacaacggaagcctt

SEQ ID NO: 7186956 - DNA, 22 bp, Homo sapiens
cagcagcaacaacggaagcctt

SEQ ID NO: 7186957 - DNA, 22 bp, Homo sapiens
cagcagcaaatctagaagagga

SEQ ID NO: 7186958 - DNA, 22 bp, Homo sapiens
cagcagcaaatctagaagagga

SEQ ID NO: 7186959 - DNA, 22 bp, Homo sapiens
cagcagagtttggcttctaatg

SEQ ID NO: 7186960 - DNA, 22 bp, Homo sapiens
cagcagatcaatgtagaatatt

SEQ ID NO: 7186961 - DNA, 22 bp, Homo sapiens
cagcagatcaatgtagaatatt

SEQ ID NO: 7186962 - DNA, 22 bp, Homo sapiens
cagcagcaaatctagaagagga

SEQ ID NO: 7186963 - DNA, 22 bp, Homo sapiens
cagcagcaaatctagaagagga

SEQ ID NO: 7186964 - DNA, 22 bp, Homo sapiens
cagcagcaaatctagaagagga

SEQ ID NO: 7186965 - DNA, 22 bp, Homo sapiens
cagcagcaaatctagaagagga

SEQ ID NO: 7186966 - DNA, 22 bp, Homo sapiens
cagcagcaaatctagaagagga

SEQ ID NO: 7186967 - DNA, 22 bp, Homo sapiens
cagcagcaaatctagaagagga

SEQ ID NO: 7186968 - DNA, 22 bp, Homo sapiens
cagcagcaacaacggaagcctt

SEQ ID NO: 7186969 - DNA, 22 bp, Homo sapiens
cagcagcaacaacggaagcctt

SEQ ID NO: 7186970 - DNA, 22 bp, Homo sapiens
cagcagcaacaacggaagcctt

SEQ ID NO: 7186971 - DNA, 22 bp, Homo sapiens
cagcagcaacaacggaagcctt

SEQ ID NO: 7186972 - DNA, 22 bp, Homo sapiens
cagcagcaacaatagcggtcac

SEQ ID NO: 7186973 - DNA, 22 bp, Homo sapiens
cagcagcaacaatagcggtcac

SEQ ID NO: 7186974 - DNA, 22 bp, Homo sapiens
cagcagcaacaatagcggtcac

SEQ ID NO: 7186975 - DNA, 22 bp, Homo sapiens
cagcagcaacaatagcggtcac

SEQ ID NO: 7186976 - DNA, 22 bp, Homo sapiens
cagcagcaacaatagcggtcac

SEQ ID NO: 7186977 - DNA, 22 bp, Homo sapiens
cagcagcaaggtgagggtggag

SEQ ID NO: 7186978 - DNA, 22 bp, Homo sapiens
cagcagcaaggtgagggtggag

SEQ ID NO: 7186979 - DNA, 22 bp, Homo sapiens
cagcagcaaggtgagggtggag

SEQ ID NO: 7186980 - DNA, 22 bp, Homo sapiens
gtatcatatgcatcaggcttgc

SEQ ID NO: 7186981 - DNA, 22 bp, Homo sapiens
gtatcatatgcatcaggcttgc

SEQ ID NO: 7186982 - DNA, 22 bp, Homo sapiens
gtatccatgggggattggttcc

SEQ ID NO: 7186983 - DNA, 22 bp, Homo sapiens
gtatctatgatcctttatatct

SEQ ID NO: 7186984 - DNA, 22 bp, Homo sapiens
gtatctgtatgtgttttttcct

SEQ ID NO: 7186985 - DNA, 22 bp, Homo sapiens
gtatctgtggattttggtatcc

SEQ ID NO: 7186986 - DNA, 22 bp, Homo sapiens
gtatattttgatcaccctctat

SEQ ID NO: 7186987 - DNA, 22 bp, Homo sapiens
gtatattttgatcaccctctat

SEQ ID NO: 7186988 - DNA, 21 bp, Homo sapiens
gtatcacatttgcatgcttat

SEQ ID NO: 7186989 - DNA, 22 bp, Homo sapiens
gtatcacttttgagagtgagaa

SEQ ID NO: 7186990 - DNA, 19 bp, Homo sapiens
gtatatttatatggctgta

SEQ ID NO: 7186991 - DNA, 19 bp, Homo sapiens
gtatatttatatggctgta

SEQ ID NO: 7186992 - DNA, 22 bp, Homo sapiens
gtatatgtatgcgtatacacac

SEQ ID NO: 7186993 - DNA, 22 bp, Homo sapiens
cagcagcaaggtgagggtggag

SEQ ID NO: 7186994 - DNA, 22 bp, Homo sapiens
cagcagcacctattatagtgtt

SEQ ID NO: 7186995 - DNA, 22 bp, Homo sapiens
cagcagcactctgcgggtcccc

SEQ ID NO: 7186996 - DNA, 22 bp, Homo sapiens
cagcagcactctgcgggtcccc

SEQ ID NO: 7186997 - DNA, 22 bp, Homo sapiens
cagcagcactctgcgggtcccc

SEQ ID NO: 7186998 - DNA, 22 bp, Homo sapiens
cagcagcagacatttgatcttc

SEQ ID NO: 7186999 - DNA, 22 bp, Homo sapiens
cagcagcagacatttgatcttc

SEQ ID NO: 7187000 - DNA, 22 bp, Homo sapiens
cagcagcagacatttgatcttc

SEQ ID NO: 7187001 - DNA, 22 bp, Homo sapiens
cagcagcagagatactggtttc

SEQ ID NO: 7187002 - DNA, 22 bp, Homo sapiens
cagcagcagagatactggtttc

SEQ ID NO: 7187003 - DNA, 22 bp, Homo sapiens
cagcagcagagatactggtttc

SEQ ID NO: 7187004 - DNA, 22 bp, Homo sapiens
cagcagcagagatactggtttc

SEQ ID NO: 7187005 - DNA, 22 bp, Homo sapiens
cagcagcagattcagcgtctgg

SEQ ID NO: 7187006 - DNA, 22 bp, Homo sapiens
cagcagcagattcagcgtctgg

SEQ ID NO: 7187007 - DNA, 22 bp, Homo sapiens
cagcagcagattcagcgtctgg

SEQ ID NO: 7187008 - DNA, 22 bp, Homo sapiens
cagcagcagattcagcgtctgg

SEQ ID NO: 7187009 - DNA, 22 bp, Homo sapiens
gtagggagcccagagcccagtg

SEQ ID NO: 7187010 - DNA, 22 bp, Homo sapiens
gtagggatggaagccatgaaat

SEQ ID NO: 7187011 - DNA, 22 bp, Homo sapiens
gtagggatggaagccatgaaat

SEQ ID NO: 7187012 - DNA, 22 bp, Homo sapiens
cagcagcctggcccctcctcgg

SEQ ID NO: 7187013 - DNA, 22 bp, Homo sapiens
cagcagctaaggcatgttcctg

SEQ ID NO: 7187014 - DNA, 22 bp, Homo sapiens
cagcagctaaggcatgttcctg

SEQ ID NO: 7187015 - DNA, 22 bp, Homo sapiens
cagcagcctgccttgggagctt

SEQ ID NO: 7187016 - DNA, 22 bp, Homo sapiens
cagcagcctggagggggccacg

SEQ ID NO: 7187017 - DNA, 22 bp, Homo sapiens
cagcagctacctgctcttgtgg

SEQ ID NO: 7187018 - DNA, 22 bp, Homo sapiens
cagcagctacctgctcttgtgg

SEQ ID NO: 7187019 - DNA, 22 bp, Homo sapiens
cagcagctacctgctcttgtgg

SEQ ID NO: 7187020 - DNA, 22 bp, Homo sapiens
cagcagctacttggagcagcag

SEQ ID NO: 7187021 - DNA, 22 bp, Homo sapiens
cagcagctacttggagcagcag

SEQ ID NO: 7187022 - DNA, 22 bp, Homo sapiens
cagcagctacttggagcagcag

SEQ ID NO: 7187023 - DNA, 22 bp, Homo sapiens
cagcagctacttggagcagcag

SEQ ID NO: 7187024 - DNA, 22 bp, Homo sapiens
cagcaggacatggaggagtaaa

SEQ ID NO: 7187025 - DNA, 22 bp, Homo sapiens
cagcaggaccattgaggcatca

SEQ ID NO: 7187026 - DNA, 22 bp, Homo sapiens
cagcaggaccattgaggcatca

SEQ ID NO: 7187027 - DNA, 22 bp, Homo sapiens
gtatcttttggtggaaaaataa

SEQ ID NO: 7187028 - DNA, 22 bp, Homo sapiens
gtatgaaaattgtaaagttctt

SEQ ID NO: 7187029 - DNA, 22 bp, Homo sapiens
gtatgaaagcatcattcctgct

SEQ ID NO: 7187030 - DNA, 22 bp, Homo sapiens
gtatgaaagcatcattcctgct

SEQ ID NO: 7187031 - DNA, 22 bp, Homo sapiens
gtatgaagtaagatattgttca

SEQ ID NO: 7187032 - DNA, 22 bp, Homo sapiens
gtatgaagttggactgtataaa

SEQ ID NO: 7187033 - DNA, 22 bp, Homo sapiens
gtatgcaattcttaacatacac

SEQ ID NO: 7187034 - DNA, 22 bp, Homo sapiens
gtatggaagtataagttttgaa

SEQ ID NO: 7187035 - DNA, 22 bp, Homo sapiens
cagcagcctcaagtttattttc

SEQ ID NO: 7187036 - DNA, 22 bp, Homo sapiens
cagcagcctccactcgccccac

SEQ ID NO: 7187037 - DNA, 22 bp, Homo sapiens
cagcagcctcttgtgcctgtgg

SEQ ID NO: 7187038 - DNA, 22 bp, Homo sapiens
cagcagcctcttgtgcctgtgg

SEQ ID NO: 7187039 - DNA, 22 bp, Homo sapiens
cagcagcctcttgtgcctgtgg

SEQ ID NO: 7187040 - DNA, 22 bp, Homo sapiens
cagcagcctgccttgggagctt

SEQ ID NO: 7187041 - DNA, 22 bp, Homo sapiens
cagcagcctgccttgggagctt

SEQ ID NO: 7187042 - DNA, 22 bp, Homo sapiens
cagcagcctgccttgggagctt

SEQ ID NO: 7187043 - DNA, 22 bp, Homo sapiens
cagcagcctgccttgggagctt

SEQ ID NO: 7187044 - DNA, 22 bp, Homo sapiens
gtatttcttggaaatcctttta

SEQ ID NO: 7187045 - DNA, 22 bp, Homo sapiens
gtatttgagccatgccttgagg

SEQ ID NO: 7187046 - DNA, 22 bp, Homo sapiens
gtatttctagtttcttccacag

SEQ ID NO: 7187047 - DNA, 22 bp, Homo sapiens
gtatttctggtaactgctgcta

SEQ ID NO: 7187048 - DNA, 22 bp, Homo sapiens
gtatttctggttaaatgtgcta

SEQ ID NO: 7187049 - DNA, 22 bp, Homo sapiens
gtatttctggttaaatgtgcta

SEQ ID NO: 7187050 - DNA, 22 bp, Homo sapiens
gtatttctagaaccaaaagcca

SEQ ID NO: 7187051 - DNA, 22 bp, Homo sapiens
gtatttctagaaaatgcagatt
